United States Patent 11,332,783 (SAMPLE ANALYSIS, PRESENCE DETERMINATION OF A TARGET SEQUENCE) - sequence listing, part 17

SEQ ID NO: 341440 - DNA, 75 bp, Artificial Sequence
  Synthetic
gaaacaaactttaactggggactcagagcactatgtatactgagagataacatgctattaggaacacaagaatta

SEQ ID NO: 341441 - DNA, 75 bp, Artificial Sequence
  Synthetic
cctaaatactttagaccagaactaaaagactataatttaatcatgaaatatgcctttaaattccagtggggagga

SEQ ID NO: 341442 - DNA, 75 bp, Artificial Sequence
  Synthetic
ccaaaccccccgcgtcggatgggggggctgcgcccccccaaaccccccttgcccggggctgtgccccggaccccc

SEQ ID NO: 341443 - DNA, 75 bp, Artificial Sequence
  Synthetic
taatgacagggctcaaggaagtgctgcaaaattacagcaaaaaccacaacactaacacaataaaccacaagatat

SEQ ID NO: 341444 - DNA, 75 bp, Artificial Sequence
  Synthetic
gcaaaattacagcaaaaaccacaacactaacacaataaaccacaagatattacaggaaactgcaataaatgaaga

SEQ ID NO: 341445 - DNA, 75 bp, Artificial Sequence
  Synthetic
actaacacaataaaccacaagatattacaggaaactgcaataaatgaagaaataaatttcacataaccacaacat

SEQ ID NO: 341446 - DNA, 75 bp, Artificial Sequence
  Synthetic
caaaaaaagaggaagtaaaggccattggctaaatcagaagtcctcattagcatagaaaaccaaccaatcagatat

SEQ ID NO: 341447 - DNA, 75 bp, Artificial Sequence
  Synthetic
aagtgcgcagacgaatggctgagtttatgccgctggtggtagacacgagcagagccgagtgtctaaccgcctggg

SEQ ID NO: 341448 - DNA, 75 bp, Artificial Sequence
  Synthetic
ctgcgactgtaaagaacccaaaaaacatcttgaaaaatgcctttcagacgctatagaagacgccggaggaaaccc

SEQ ID NO: 341449 - DNA, 75 bp, Artificial Sequence
  Synthetic
ctcatatttctgggcggtggaatagactggactgtatggactttacaaaacttataccatgaaaaacttaactgg

SEQ ID NO: 341450 - DNA, 75 bp, Artificial Sequence
  Synthetic
atggcatggaatttgctagatttagatacgctaaatttaaattttttaggcatgaatttagatcgtacgtagtaa

SEQ ID NO: 341451 - DNA, 75 bp, Artificial Sequence
  Synthetic
atacgctaaatttaaattttttaggcatgaatttagatcgtacgtagtaacatgggatcaggacataccctgtaa

SEQ ID NO: 341452 - DNA, 75 bp, Artificial Sequence
  Synthetic
ccctttgtgatgcttctaaaaaaacagcataaagtcattctaagcaaacaagaatgtaatcctagaaaaaaagac

SEQ ID NO: 341453 - DNA, 75 bp, Artificial Sequence
  Synthetic
agcataaagtcattctaagcaaacaagaatgtaatcctagaaaaaaagacaaacctgtgactttaaaaataaaac

SEQ ID NO: 341454 - DNA, 75 bp, Artificial Sequence
  Synthetic
gagactatcaagagaactagcaaaaataccacttgtaagactaggaatatctctaatagactttaaagaaccctg

SEQ ID NO: 341455 - DNA, 75 bp, Artificial Sequence
  Synthetic
ataccacttgtaagactaggaatatctctaatagactttaaagaaccctgggtagaaggatttggaaatgctttt

SEQ ID NO: 341456 - DNA, 75 bp, Artificial Sequence
  Synthetic
acgcaaatccaggcaaaacatcagaatggtcgcaatgtaaatacttttggatatatgacacaggcattaacaacc

SEQ ID NO: 341457 - DNA, 75 bp, Artificial Sequence
  Synthetic
atggtcgcaatgtaaatacttttggatatatgacacaggcattaacaaccatgtatacgttgtaatgctaaattc

SEQ ID NO: 341458 - DNA, 75 bp, Artificial Sequence
  Synthetic
ttagcaactaaaaacaattcaattgctcacatagaacaaataggagaaggatatccatactggctattttttttt

SEQ ID NO: 341459 - DNA, 75 bp, Artificial Sequence
  Synthetic
ctcacatagaacaaataggagaaggatatccatactggctatttttttttggaagatcagaaagagatttaaaag

SEQ ID NO: 341460 - DNA, 75 bp, Artificial Sequence
  Synthetic
aagaaatgaattcaattcaaaccccttaagtaaaaaacttaaaatagcaataataggatgggtatctagcaataa

SEQ ID NO: 341461 - DNA, 75 bp, Artificial Sequence
  Synthetic
ttaagtaaaaaacttaaaatagcaataataggatgggtatctagcaataaaacatcaaaagacagcacacaagca

SEQ ID NO: 341462 - DNA, 75 bp, Artificial Sequence
  Synthetic
acagaatatcaccagtactacaacattcaggacactcaggaggagcagcagcaatagataatttatatttaaatg

SEQ ID NO: 341463 - DNA, 75 bp, Artificial Sequence
  Synthetic
ttcaggacactcaggaggagcagcagcaatagataatttatatttaaatggatggccaggaaaccaaaactatcc

SEQ ID NO: 341464 - DNA, 75 bp, Artificial Sequence
  Synthetic
tttgactggagtaaaagaggactgtgcatactcagaaataatatgaaaataggacaacaaacactagacgatgaa

SEQ ID NO: 341465 - DNA, 75 bp, Artificial Sequence
  Synthetic
gcatactcagaaataatatgaaaataggacaacaaacactagacgatgaaacaaccatgtttgctctctttggcc

SEQ ID NO: 341466 - DNA, 75 bp, Artificial Sequence
  Synthetic
aggactcgaaacagcaccacaactaaaaatggaactaaaagactataatattttaatgagatataactttcgctt

SEQ ID NO: 341467 - DNA, 75 bp, Artificial Sequence
  Synthetic
accttcaaaacaagcatcggagaccccagcaccattccctgcccctacggccccggagatcctccccaacttgcc

SEQ ID NO: 341468 - DNA, 75 bp, Artificial Sequence
  Synthetic
tgactatgatggcattgttagaaaagacactctcaaaaaattgcttgaaatccccacagactcggaggaagagaa

SEQ ID NO: 341469 - DNA, 75 bp, Artificial Sequence
  Synthetic
aaagcggagagagcgatatcagttcttcgagcgactcatcgaaggaagaaagcgaagaagagaagagatacagaa

SEQ ID NO: 341470 - DNA, 75 bp, Artificial Sequence
  Synthetic
gacgacacaagcccaccaagcgacgactcctccagcacgtccagcgactggtaaagagattcaggaccctataga

SEQ ID NO: 341471 - DNA, 75 bp, Artificial Sequence
  Synthetic
aatgctaaaaaatccctcaataaaatttacttctctgactaatagcgacctcctgtgtccaatctattattccta

SEQ ID NO: 341472 - DNA, 75 bp, Artificial Sequence
  Synthetic
cctacctaagtcacaaaatggcgggcgcggctgggacacaaaatggcggcgtagtgggggggggaacccccccac

SEQ ID NO: 341473 - DNA, 75 bp, Artificial Sequence
  Synthetic
aagactgaaaaccgttaaattcaaatttgaaaatggcgggcaaaatggcggacagggggcggggattatgcaaat

SEQ ID NO: 341474 - DNA, 75 bp, Artificial Sequence
  Synthetic
gggcaggagcagctgagcggagggcctacatgaaggagaaagactactgggaagaagcctggctgaccagctgta

SEQ ID NO: 341475 - DNA, 75 bp, Artificial Sequence
  Synthetic
ctaccgcattagcgcgtggaaccctaaggttctaagaaactgccgcatcacaggatggtggccagtaatacagtg

SEQ ID NO: 341476 - DNA, 75 bp, Artificial Sequence
  Synthetic
tacaagccgatggacttaagagtcgaggcaaaccggatattcgataaacagggcagtaagatagagacagaacag

SEQ ID NO: 341477 - DNA, 75 bp, Artificial Sequence
  Synthetic
gaggatggtcaagcggagtaatcagcttagagggacttttcaatgaaaacagactgtggagaaacatatggtcta

SEQ ID NO: 341478 - DNA, 75 bp, Artificial Sequence
  Synthetic
cttagagggacttttcaatgaaaacagactgtggagaaacatatggtctaaaagcaatgacgggatggacttggt

SEQ ID NO: 341479 - DNA, 75 bp, Artificial Sequence
  Synthetic
ctatatccaacagagaatcagggctacttgttctggtatgacacagaatttgacgaacagcagagaagaatgtta

SEQ ID NO: 341480 - DNA, 75 bp, Artificial Sequence
  Synthetic
acttgttctggtatgacacagaatttgacgaacagcagagaagaatgttagacgaatatacacaacctagtgtaa

SEQ ID NO: 341481 - DNA, 75 bp, Artificial Sequence
  Synthetic
aatagtatgtaaacaaaagatgccaattagacggagagtaaagagcattttcataccgccaccggcacagttaac

SEQ ID NO: 341482 - DNA, 75 bp, Artificial Sequence
  Synthetic
aacacagtggaagtttcagcaggaactgtgtcaatttccattatttaactgggcctgtatctgtatagacatgga

SEQ ID NO: 341483 - DNA, 75 bp, Artificial Sequence
  Synthetic
gggcctgtatctgtatagacatggacacgccgttcgactacaacggcgcatggcgaaatgcctggtggctaatga

SEQ ID NO: 341484 - DNA, 75 bp, Artificial Sequence
  Synthetic
cacgccgttcgactacaacggcgcatggcgaaatgcctggtggctaatgagaaggcttcaaaacggaaacatgga

SEQ ID NO: 341485 - DNA, 75 bp, Artificial Sequence
  Synthetic
ccgatgacaggagacacagaactgccaccagcagacgacttcaaggcaggaggggtgaacaaaaacttcaaaccg

SEQ ID NO: 341486 - DNA, 75 bp, Artificial Sequence
  Synthetic
aaacaagagagtagtgaaatgggccacagtacacaatgggccaatagacagatggagaaaaaaacagacaggaac

SEQ ID NO: 341487 - DNA, 75 bp, Artificial Sequence
  Synthetic
acagtacacaatgggccaatagacagatggagaaaaaaacagacaggaacgttaaaactatctgcactgagaaga

SEQ ID NO: 341488 - DNA, 75 bp, Artificial Sequence
  Synthetic
gtgagacatactataagtggacagcatcagaatttacaggagcatttcagcaggactggtggccagttagcggaa

SEQ ID NO: 341489 - DNA, 75 bp, Artificial Sequence
  Synthetic
aatggagccagaattcgaaaacccgacagtagaggtgtggtcatggaaagcaactataccgacagcaggaacact

SEQ ID NO: 341490 - DNA, 75 bp, Artificial Sequence
  Synthetic
acagtagaggtgtggtcatggaaagcaactataccgacagcaggaacactgaaagactatttcgggctcagttca

SEQ ID NO: 341491 - DNA, 75 bp, Artificial Sequence
  Synthetic
ttggcaggctgcaattacccagaagcagccacaatgttgactttggacataaagctagatttggcccattttgtg

SEQ ID NO: 341492 - DNA, 75 bp, Artificial Sequence
  Synthetic
agactcagcccccaacccactaaatatctgggtgaaatacacattctattttcagttcggcggcatgtaccagcc

SEQ ID NO: 341493 - DNA, 75 bp, Artificial Sequence
  Synthetic
cctcaccaataaacgcaaaaagcgcttgcaattctaattcgctgtccgtgtattcattgggggggtccggggggg

SEQ ID NO: 341494 - DNA, 75 bp, Artificial Sequence
  Synthetic
ctaccccctctttaactgggcctgtatctgcattgacatggaaaagcccttcgattacacaggggcatggaaaat

SEQ ID NO: 341495 - DNA, 75 bp, Artificial Sequence
  Synthetic
cacttacctactggggtattacaacttcaggtgggagagcatggcaggacacagacttcggaaaaattagactac

SEQ ID NO: 341496 - DNA, 75 bp, Artificial Sequence
  Synthetic
agtggccgtggctcgaccctcacacaacactgcaggtagggggcgcaattgggatcgtttcaaaactatggccga

SEQ ID NO: 341497 - DNA, 75 bp, Artificial Sequence
  Synthetic
aaatgccttacagacgctatcgcagacgccgaaggagaccgaggaggagatggaggacacaccgatggagacgct

SEQ ID NO: 341498 - DNA, 75 bp, Artificial Sequence
  Synthetic
tggccgttgagctacggacactggtaccgtacctgtctcccctttaggcggttaaatggactagtattcccggga

SEQ ID NO: 341499 - DNA, 75 bp, Artificial Sequence
  Synthetic
ctttacaaaacttttatcatgaaaagctaaactggagaaatatatggacagctagtaatgtaggcatggaatacg

SEQ ID NO: 341500 - DNA, 75 bp, Artificial Sequence
  Synthetic
gctaaactggagaaatatatggacagctagtaatgtaggcatggaatacgctagatttttaaagggaaaattcta

SEQ ID NO: 341501 - DNA, 75 bp, Artificial Sequence
  Synthetic
ttaaaaaaacagcacaaactggtactatcacagcaaaactgtaatcctaacagaaaacagaaacctgtgactata

SEQ ID NO: 341502 - DNA, 75 bp, Artificial Sequence
  Synthetic
catcacaatggagactaagcagagaactagcaaaaataccattagtaagactgggaataagttttatagacttaa

SEQ ID NO: 341503 - DNA, 75 bp, Artificial Sequence
  Synthetic
aaatgctttttactctgtattaggatacgaagcaaccaaaacacagggacattggtcaaactgggcacaaatgaa

SEQ ID NO: 341504 - DNA, 75 bp, Artificial Sequence
  Synthetic
gtaggaaatgcagtatatgtagtattattaaagcaagacgtgcaagacaacccaggagatatggcacaaaaatgg

SEQ ID NO: 341505 - DNA, 75 bp, Artificial Sequence
  Synthetic
tattaaagcaagacgtgcaagacaacccaggagatatggcacaaaaatggccaggacaagcaggacaacatccag

SEQ ID NO: 341506 - DNA, 75 bp, Artificial Sequence
  Synthetic
cccaggagatatggcacaaaaatggccaggacaagcaggacaacatccagacgctatagatcatatagaattgat

SEQ ID NO: 341507 - DNA, 75 bp, Artificial Sequence
  Synthetic
tacttttatggaaaaagtgaaagagacataaaagcagaagcacacacaacagaaatagccagagaatttgcaaac

SEQ ID NO: 341508 - DNA, 75 bp, Artificial Sequence
  Synthetic
taggggtagtaggatgggcaagctcaaattatactgcatcaaacagcacacaaggagctacaactgctatacaag

SEQ ID NO: 341509 - DNA, 75 bp, Artificial Sequence
  Synthetic
aaattatactgcatcaaacagcacacaaggagctacaactgctatacaaggaggatacttagcctgggcaggagg

SEQ ID NO: 341510 - DNA, 75 bp, Artificial Sequence
  Synthetic
actaggagatcaagacttagacgatgaaacaactatgctctcactatttggaccctttgtagaaaaagctaacac

SEQ ID NO: 341511 - DNA, 75 bp, Artificial Sequence
  Synthetic
tactttagacctgaactaaaagactataacctaatcatgaaatatgcctttaaactccagtggggaggacacggc

SEQ ID NO: 341512 - DNA, 75 bp, Artificial Sequence
  Synthetic
tttcgaacccggggaccgcttccacagcgggatacaagacccctccaaggtacaaaacacagtcctcaacccctg

SEQ ID NO: 341513 - DNA, 75 bp, Artificial Sequence
  Synthetic
gaagacagcacaagccaagcaagcgacgactcctcaagcacctccagcgggtggtaaagagaatgaagacactgt

SEQ ID NO: 341514 - DNA, 75 bp, Artificial Sequence
  Synthetic
tactaacacaataaaccacaaactattacaggaaactgcaataaatttagaaataagttacacataaccaccaaa

SEQ ID NO: 341515 - DNA, 75 bp, Artificial Sequence
  Synthetic
ttacaggaaactgcaataaatttagaaataagttacacataaccaccaaaccacaggaaactcagcaaaaaagag

SEQ ID NO: 341516 - DNA, 75 bp, Artificial Sequence
  Synthetic
ccgtacctgtctcccctttagaagaaaaaatggactagtgtttacgggaggaggatgtgactggactcaatggag

SEQ ID NO: 341517 - DNA, 75 bp, Artificial Sequence
  Synthetic
ctaaactggaggaatatatggacagctagtaatgtgagcatggagttcgctaggttcttaagaggaaaattttac

SEQ ID NO: 341518 - DNA, 75 bp, Artificial Sequence
  Synthetic
ctagtaatgtgagcatggagttcgctaggttcttaagaggaaaattttacttttttagacatccgtggagaaact

SEQ ID NO: 341519 - DNA, 75 bp, Artificial Sequence
  Synthetic
tccctgtaaacctctaccctatcagaacttgcatccactcttaatgctactaaaaaaacaacataagctagtact

SEQ ID NO: 341520 - DNA, 75 bp, Artificial Sequence
  Synthetic
agaaaacaaaaacctgtaactttaaaatttaaaccaccaccaaaactaacatcacaatggaggttaagcagagaa

SEQ ID NO: 341521 - DNA, 75 bp, Artificial Sequence
  Synthetic
atcacaatggaggttaagcagagaacttgcaaaaatgccacttattagactaggagtaagcttcatagacttaac

SEQ ID NO: 341522 - DNA, 75 bp, Artificial Sequence
  Synthetic
aacgcattctactcaatattaggatatgaagccacaaaagatcaaggacactggtctaattgggcccaaatgaaa

SEQ ID NO: 341523 - DNA, 75 bp, Artificial Sequence
  Synthetic
taggtaatgcagtatatgtcatattattaaaacaaaatgtagaggacaacccaggagacatggcaaatacattta

SEQ ID NO: 341524 - DNA, 75 bp, Artificial Sequence
  Synthetic
agtcaggggtggccatattggttatatttctatggaaaaagcgaacaggacgtaaaaaaagaagcacacacaaca

SEQ ID NO: 341525 - DNA, 75 bp, Artificial Sequence
  Synthetic
atccacattcaaaaaaactaaaaataggggtggtaggatgggcatgctcaaactataccgcaacaggcagtgtac

SEQ ID NO: 341526 - DNA, 75 bp, Artificial Sequence
  Synthetic
aggggtggtaggatgggcatgctcaaactataccgcaacaggcagtgtacaaaatgatagtggaaatatagcagc

SEQ ID NO: 341527 - DNA, 75 bp, Artificial Sequence
  Synthetic
gctgggggacaaggaaaatataatttaggagcaggagccatagataatttacaccaaaaaggatggccaaataat

SEQ ID NO: 341528 - DNA, 75 bp, Artificial Sequence
  Synthetic
atgaaacaaactttaactggggactcagagcactatgtatactcagagataacatgcacctaggaactcaagaat

SEQ ID NO: 341529 - DNA, 75 bp, Artificial Sequence
  Synthetic
cctcttcggacccttcgtagaaaaagcaaatacagcactagcaacaacagaccctaaatactttagaccagaact

SEQ ID NO: 341530 - DNA, 75 bp, Artificial Sequence
  Synthetic
tgtgtccaatctatttttcctacaccccttcaaaatggcgggcgggacacaaaatggcggagggactaagggggg

SEQ ID NO: 341531 - DNA, 75 bp, Artificial Sequence
  Synthetic
agctgccgcaccccccatgcgggggctccgccccctgcacccccgggagggggggaaaccccccctcaacccccc

SEQ ID NO: 341532 - DNA, 75 bp, Artificial Sequence
  Synthetic
aggttgtgactggactcagtggagtttacaaaacctttatcatgaaaaactaaactggagaaatatatggacagc

SEQ ID NO: 341533 - DNA, 75 bp, Artificial Sequence
  Synthetic
taaactggagaaatatatggacagctagtaacgtgggcatggagttcgctagattcttaagaggaaaattctact

SEQ ID NO: 341534 - DNA, 75 bp, Artificial Sequence
  Synthetic
gaaagcaaaaaccagtcaccttaaaattcagaccaccacctaaattaacttcgcaatggagactaagcagagaat

SEQ ID NO: 341535 - DNA, 75 bp, Artificial Sequence
  Synthetic
aggaataagctttatagacctctcagaaccatgggtagaaggttggggaaatgcattttactctgtattaggata

SEQ ID NO: 341536 - DNA, 75 bp, Artificial Sequence
  Synthetic
tggtcaaattgggcacaaatgaaatattattggatgtatgatactggagtaggtaatgcagtatatgtagtacta

SEQ ID NO: 341537 - DNA, 75 bp, Artificial Sequence
  Synthetic
ttaaaagataacgtagacgataatccaggagatatggctaaaaaatggccaggaacatcaggacaacacccagat

SEQ ID NO: 341538 - DNA, 75 bp, Artificial Sequence
  Synthetic
tcctaaatcaataaaactaaaaataggagttgtaggatgggctagctctaattacacagcatcaaacagtagtca

SEQ ID NO: 341539 - DNA, 75 bp, Artificial Sequence
  Synthetic
agagcactatgcctattaagggacaacatgaaactaggtacacaagacttagatgatgaatgcacaatgttaacc

SEQ ID NO: 341540 - DNA, 75 bp, Artificial Sequence
  Synthetic
aagctgccgcaccccccctgcgggggctccgccccctgcacccccgggagggggggaaaccccccctcaaccccc

SEQ ID NO: 341541 - DNA, 75 bp, Artificial Sequence
  Synthetic
tacacttccgggttcaagaggctcaatttggctcgctgcgctcgcaccacgtttgctgccaggcggacctgattg

SEQ ID NO: 341542 - DNA, 75 bp, Artificial Sequence
  Synthetic
taatttatgcaaagtaggaggagctcaattttaatttatgcaaagtaggaggagtcaaatctgattggtcggcag

SEQ ID NO: 341543 - DNA, 75 bp, Artificial Sequence
  Synthetic
ctgatccggagtcaaggggcctatcgggcaggagcagctgagcggagggcccatgttcctgtactgggaagaagc

SEQ ID NO: 341544 - DNA, 75 bp, Artificial Sequence
  Synthetic
cacaaccttgactgccgctgcggagactggtacggacacctccaaagactatgcgctttagaccaattagacgcc

SEQ ID NO: 341545 - DNA, 75 bp, Artificial Sequence
  Synthetic
actggtacggacacctccaaagactatgcgctttagaccaattagacgccgtcgccgccgccgctatagaaagag

SEQ ID NO: 341546 - DNA, 75 bp, Artificial Sequence
  Synthetic
taccggagacatcgcggatggagaccctggcgccgttggcgggtaaggagatggcggcgttccgtctaccgtaga

SEQ ID NO: 341547 - DNA, 75 bp, Artificial Sequence
  Synthetic
cctggcgccgttggcgggtaaggagatggcggcgttccgtctaccgtagaggtggacgtagagcgcgcccctacc

SEQ ID NO: 341548 - DNA, 75 bp, Artificial Sequence
  Synthetic
tatgagacgagtagtaattcagggttggtggccactacttcagtgcctacctggacaggaacacctacgatacag

SEQ ID NO: 341549 - DNA, 75 bp, Artificial Sequence
  Synthetic
tggtggccactacttcagtgcctacctggacaggaacacctacgatacagaccactgaactgggacgttgagaga

SEQ ID NO: 341550 - DNA, 75 bp, Artificial Sequence
  Synthetic
aaccagacacgatgggctacttagtacaatacggtggtggatggggcagcggacagataactctagaggacttat

SEQ ID NO: 341551 - DNA, 75 bp, Artificial Sequence
  Synthetic
acaatacggtggtggatggggcagcggacagataactctagaggacttattcaatgaacaccaaaaatggagaaa

SEQ ID NO: 341552 - DNA, 75 bp, Artificial Sequence
  Synthetic
atggacctagtaagatactttggctgcaaaatatacctatatccactgcagtcggatgattactggttttggtgg

SEQ ID NO: 341553 - DNA, 75 bp, Artificial Sequence
  Synthetic
gcaaaatatacctatatccactgcagtcggatgattactggttttggtgggacacagactttaagcaaaactaca

SEQ ID NO: 341554 - DNA, 75 bp, Artificial Sequence
  Synthetic
accgtcagtaatgctaatggcaaaaagaacaaaaattgtagtggctagagacagagcccaacatagacgaagagt

SEQ ID NO: 341555 - DNA, 75 bp, Artificial Sequence
  Synthetic
agaacaaaaattgtagtggctagagacagagcccaacatagacgaagagttaaaaaaatatacattccaccacca

SEQ ID NO: 341556 - DNA, 75 bp, Artificial Sequence
  Synthetic
tccaaacagatttctgcaaacagccactttttacatgggctgctggcttaatagaactgcaacgaccctttgact

SEQ ID NO: 341557 - DNA, 75 bp, Artificial Sequence
  Synthetic
gtggttggaacctagaaacgaggcaggggaaatggactatataacactctggggtcgagtaccaccacagggaga

SEQ ID NO: 341558 - DNA, 75 bp, Artificial Sequence
  Synthetic
ttcaaaattgggaatataaacaaaaactacaacattcagcctggaaaggaaaaaaacctgtacccaataatggca

SEQ ID NO: 341559 - DNA, 75 bp, Artificial Sequence
  Synthetic
actacaacattcagcctggaaaggaaaaaaacctgtacccaataatggcatatattagaaaagaaaacggacaac

SEQ ID NO: 341560 - DNA, 75 bp, Artificial Sequence
  Synthetic
taacaaaacaattgacaggtggagaaaagcgcaggctagcactctcaatatatctaatctaagaggactatgcct

SEQ ID NO: 341561 - DNA, 75 bp, Artificial Sequence
  Synthetic
acatacaagtggaaacagggagaattcaataaggcctacttcaaccggtggacctataagacctactttgtaacc

SEQ ID NO: 341562 - DNA, 75 bp, Artificial Sequence
  Synthetic
tcaataaggcctacttcaaccggtggacctataagacctactttgtaaccatagacgggagagtaggcactgaaa

SEQ ID NO: 341563 - DNA, 75 bp, Artificial Sequence
  Synthetic
gacctataagacctactttgtaaccatagacgggagagtaggcactgaaaacccgacagtgcaaatatggaactt

SEQ ID NO: 341564 - DNA, 75 bp, Artificial Sequence
  Synthetic
aaccacatactcacttttgccttcggaattagcaaacaaaacacaaacttgaaggacagtgactttggaaaacta

SEQ ID NO: 341565 - DNA, 75 bp, Artificial Sequence
  Synthetic
gaattagcaaacaaaacacaaacttgaaggacagtgactttggaaaactaggactacctaagaccccccatgact

SEQ ID NO: 341566 - DNA, 75 bp, Artificial Sequence
  Synthetic
tggaccatttgttgtcaaaaatgaacccgtagaatttcagttaagaccaccacaagcaattaatgtttgggtgcg

SEQ ID NO: 341567 - DNA, 75 bp, Artificial Sequence
  Synthetic
ggagaataccaacctcccacaggaatccgcgatccctgccttgataacccagcctatcctgtgccccaatcaaca

SEQ ID NO: 341568 - DNA, 75 bp, Artificial Sequence
  Synthetic
gagccggtggtctcaccgcagaggtcggtccttccggtctcaccgcacgtactattagagccctatgtgcaagtc

SEQ ID NO: 341569 - DNA, 75 bp, Artificial Sequence
  Synthetic
cggtccttccggtctcaccgcacgtactattagagccctatgtgcaagtccacccaaaaccaaaacatcgcagtg

SEQ ID NO: 341570 - DNA, 75 bp, Artificial Sequence
  Synthetic
gagaaaacgcaaagaaagaaaacccaggaaacctcgagtgagagctccattacgagtgccgaaagcagttctgaa

SEQ ID NO: 341571 - DNA, 75 bp, Artificial Sequence
  Synthetic
aggaaacctcgagtgagagctccattacgagtgccgaaagcagttctgaaggggatggatcaactgatgaggaag

SEQ ID NO: 341572 - DNA, 75 bp, Artificial Sequence
  Synthetic
acgaaagcgacagctcaagttattttaccagcgactcactgacagatacctggagcacaagcgacgacgattttc

SEQ ID NO: 341573 - DNA, 75 bp, Artificial Sequence
  Synthetic
taccagcgactcactgacagatacctggagcacaagcgacgacgattttcagagtgatggggggtacagacccat

SEQ ID NO: 341574 - DNA, 75 bp, Artificial Sequence
  Synthetic
tggagcacaagcgacgacgattttcagagtgatggggggtacagacccataaacaaaaaaataaagaaaccgctg

SEQ ID NO: 341575 - DNA, 75 bp, Artificial Sequence
  Synthetic
tcatgacagggttcaccggaagggctgcaaaattacacctaaaaccacagacctaacacaataaaccacaaacta

SEQ ID NO: 341576 - DNA, 75 bp, Artificial Sequence
  Synthetic
tgcaaaattacacctaaaaccacagacctaacacaataaaccacaaactattacatgaaactgtaataaatttag

SEQ ID NO: 341577 - DNA, 75 bp, Artificial Sequence
  Synthetic
ccacaggaaactctgcaaaaaagaggaaataaatttcattggctgggccataagtcctcattagaataataaatg

SEQ ID NO: 341578 - DNA, 75 bp, Artificial Sequence
  Synthetic
taagtcctcattagaataataaatggaccaatcagaataacttcctcttttggagtatataagtaagtgcgcaaa

SEQ ID NO: 341579 - DNA, 75 bp, Artificial Sequence
  Synthetic
gaaagatggctgacggtagcgtactgcgcccacggattattctgcggctgtaaaaacccgaaaaaacatctagaa

SEQ ID NO: 341580 - DNA, 75 bp, Artificial Sequence
  Synthetic
aaatgccttacagacgctatcgcagacgccgaaggagaccgacaagaagatggaggcaccggaggtggagacgct

SEQ ID NO: 341581 - DNA, 75 bp, Artificial Sequence
  Synthetic
tggaggcaccggaggtggagacgctactttcgatatcggtatcgacgcgctcctcgccgccgccgcacaaaggta

SEQ ID NO: 341582 - DNA, 75 bp, Artificial Sequence
  Synthetic
ggaggctgtgactggagtcagtggagtttacaaaatctttaccatgaaaaacttaactggagaaatatttggaca

SEQ ID NO: 341583 - DNA, 75 bp, Artificial Sequence
  Synthetic
cttttttagacatccatggagaaattatataataacatgggatcaggacataccgtgcaggccgctaccttatca

SEQ ID NO: 341584 - DNA, 75 bp, Artificial Sequence
  Synthetic
ctaaaaaaacaacacaaaattgtactttcacagcagaactgtaacccaaacagaaaacagaaacctgtgactcta

SEQ ID NO: 341585 - DNA, 75 bp, Artificial Sequence
  Synthetic
tttcacagcagaactgtaacccaaacagaaaacagaaacctgtgactctaaaattcaagcctccaccaaaactga

SEQ ID NO: 341586 - DNA, 75 bp, Artificial Sequence
  Synthetic
actagcaaaaatgccactcattagactgggagtaagctttatagacttaacagagccatgggtagaaggttgggg

SEQ ID NO: 341587 - DNA, 75 bp, Artificial Sequence
  Synthetic
cagagccatgggtagaaggttggggaaacgcattctactcgatattaggatatgaagctacatatcaacagggac

SEQ ID NO: 341588 - DNA, 75 bp, Artificial Sequence
  Synthetic
gtaggtaatgcagtctatgtcatattattaaaacaagacgtaggagacaacccaggagacatggcaaataaattt

SEQ ID NO: 341589 - DNA, 75 bp, Artificial Sequence
  Synthetic
atgccatagacagaatagaattaataagtcagggatggccatattggttatatttctatggaaaaagcgaacagg

SEQ ID NO: 341590 - DNA, 75 bp, Artificial Sequence
  Synthetic
acgtaaaaaaggaggcacatacaacagaaatagctagagaatatgcacaaaatccacattcaaaaaaactaaaaa

SEQ ID NO: 341591 - DNA, 75 bp, Artificial Sequence
  Synthetic
aaattttacaacaacaggcagctcacaatcaccaagtaatcctgtagcaatacaaggaggatacgtagcatacgc

SEQ ID NO: 341592 - DNA, 75 bp, Artificial Sequence
  Synthetic
taacacaaacagagatcaaacaaactttgactggggactaagagctttatgtatactcagagataacatgcactt

SEQ ID NO: 341593 - DNA, 75 bp, Artificial Sequence
  Synthetic
taacgacagggttcaccggaagggctgcaaaattacagctaaaaccacaaaactaacacaataaaccacaaacta

SEQ ID NO: 341594 - DNA, 75 bp, Artificial Sequence
  Synthetic
aaataaattttattggctgggcctgaagtcctcattaaaataaaaaaaggaccaatcaaaaatacttcctctttt

SEQ ID NO: 341595 - DNA, 75 bp, Artificial Sequence
  Synthetic
aagtcctcattaaaataaaaaaaggaccaatcaaaaatacttcctcttttaaactatataaataagtgcgcaaac

SEQ ID NO: 341596 - DNA, 75 bp, Artificial Sequence
  Synthetic
cgtacctgtctcccctttagaagaaaaaatggactaatatttacgggaggaggttgtgactggactcagtggagc

SEQ ID NO: 341597 - DNA, 75 bp, Artificial Sequence
  Synthetic
tttttagacatccttggagaaactatatagtgacttgggatcaggacattccttgtaaacctttaccttatcaaa

SEQ ID NO: 341598 - DNA, 75 bp, Artificial Sequence
  Synthetic
tcacaatggagactaagtagagaattagcaaaaatgccactcattagactaggagttagttttatagacttaaca

SEQ ID NO: 341599 - DNA, 75 bp, Artificial Sequence
  Synthetic
atgcattttactcagtactaggatatgaagccataaaagaccaaggacactggtcaaactgggcacaaataaaat

SEQ ID NO: 341600 - DNA, 75 bp, Artificial Sequence
  Synthetic
tgaagccataaaagaccaaggacactggtcaaactgggcacaaataaaatattactggatatatgatacaggagt

SEQ ID NO: 341601 - DNA, 75 bp, Artificial Sequence
  Synthetic
attactggatatatgatacaggagtaggaaatgctgtatatgtagttatgctaaaacaagacgtagacgacaacc

SEQ ID NO: 341602 - DNA, 75 bp, Artificial Sequence
  Synthetic
aacaactcagggacaacatcccaatgctatagatcacatagaattaataaatgaaggatggccctactggttata

SEQ ID NO: 341603 - DNA, 75 bp, Artificial Sequence
  Synthetic
gctatagatcacatagaattaataaatgaaggatggccctactggttatacttttttggtaaaagtgaacaagac

SEQ ID NO: 341604 - DNA, 75 bp, Artificial Sequence
  Synthetic
atgaaggatggccctactggttatacttttttggtaaaagtgaacaagacataaaaaaagaagcacatagcgaag

SEQ ID NO: 341605 - DNA, 75 bp, Artificial Sequence
  Synthetic
tccaaaatcaaaaaaactaaaaataggaatagtaggatgggcatcctctaacttcacaacaccaggcagtgcaca

SEQ ID NO: 341606 - DNA, 75 bp, Artificial Sequence
  Synthetic
atacaaggaggatacgtagcatgggcaggaggacaaggaaaactaaatctaggagcaggatcaataggaaatttg

SEQ ID NO: 341607 - DNA, 75 bp, Artificial Sequence
  Synthetic
taccaacaaggatggccatctaatcaaaactggccaaatacaaacagagacgaaacaaactttgattggggactc

SEQ ID NO: 341608 - DNA, 75 bp, Artificial Sequence
  Synthetic
cgaaacaaactttgattggggactcagatcactttgtatactaagagataacatgcaattaggaagtcaagaatt

SEQ ID NO: 341609 - DNA, 75 bp, Artificial Sequence
  Synthetic
acactgtgatagataaatatagaaacctagcagacccctcactcaatgtcacaggacacatggaaaaattcatgc

SEQ ID NO: 341610 - DNA, 75 bp, Artificial Sequence
  Synthetic
caaaatggcggcgtagcggggggggaacccccccgcaccccccatgcgggggctccgccccctgcacccccggga

SEQ ID NO: 341611 - DNA, 75 bp, Artificial Sequence
  Synthetic
tacatttccgggttcaggaggctcaatttggctcgcttcgctcgcaccgcgtttgctgccaggcggacctgattg

SEQ ID NO: 341612 - DNA, 75 bp, Artificial Sequence
  Synthetic
atttggctcgcttcgctcgcaccgcgtttgctgccaggcggacctgattgaagaccgaaaaccgttaaattcaaa

SEQ ID NO: 341613 - DNA, 75 bp, Artificial Sequence
  Synthetic
aatttatgcaaagtaggaggagctcgattttaatttatgcaaagtaggaggagtcaaatctgattggtcgggaac

SEQ ID NO: 341614 - DNA, 75 bp, Artificial Sequence
  Synthetic
gattttaatttatgcaaagtaggaggagtcaaatctgattggtcgggaactcaagtcctcatttgcatagggtgt

SEQ ID NO: 341615 - DNA, 75 bp, Artificial Sequence
  Synthetic
gttccgaatggctgagtttatgccgccagcggtagacagaactgtctagcgactgggcgggtgccggaggatccc

SEQ ID NO: 341616 - DNA, 75 bp, Artificial Sequence
  Synthetic
gactgggcgggtgccggaggatccctgatccggagtcaaggggcctatcgggcaggagcagctgagcggagggcc

SEQ ID NO: 341617 - DNA, 75 bp, Artificial Sequence
  Synthetic
ggcaggagcagctgagcggagggcctatgccggaacactgggaggaagcctggttggaagctaccaagggctggc

SEQ ID NO: 341618 - DNA, 75 bp, Artificial Sequence
  Synthetic
aggcggcgttccgtctaccgtagaggtggtcgtagagcgcgcccctaccgcattagtgcgttcaaccctaaaata

SEQ ID NO: 341619 - DNA, 75 bp, Artificial Sequence
  Synthetic
ggtggcctattctgcaatgcttgaagggtcaggagtcgcttagatacaggccattacagtgggatgtagaaaaac

SEQ ID NO: 341620 - DNA, 75 bp, Artificial Sequence
  Synthetic
cgacaactacggctacctagcacagtacggtggagggtggggaagtggagaggtgacactagaaaatctatacca

SEQ ID NO: 341621 - DNA, 75 bp, Artificial Sequence
  Synthetic
tacggtggagggtggggaagtggagaggtgacactagaaaatctataccaggaacacttactgtggagaaactcc

SEQ ID NO: 341622 - DNA, 75 bp, Artificial Sequence
  Synthetic
acttagtaagatactttggatgcatagtatacctatacccattacaggacgcagattactggttctggtgggaca

SEQ ID NO: 341623 - DNA, 75 bp, Artificial Sequence
  Synthetic
agtatacctatacccattacaggacgcagattactggttctggtgggacactgacttcaaagaactatacgcaga

SEQ ID NO: 341624 - DNA, 75 bp, Artificial Sequence
  Synthetic
tcagtaatgatgatggctaagaggacaaaaattgtgatagctagaagtagggcacctcacagaagaaaagtgaga

SEQ ID NO: 341625 - DNA, 75 bp, Artificial Sequence
  Synthetic
ggcacctcacagaagaaaagtgagaaaaattttcattccgccaccaagtagagacacaacgcagtggcaatttca

SEQ ID NO: 341626 - DNA, 75 bp, Artificial Sequence
  Synthetic
ttcacttgggcggcaggactaatagacatgcaaaaaccttttgacgctaatggtgccttccgaaacgcttggtgg

SEQ ID NO: 341627 - DNA, 75 bp, Artificial Sequence
  Synthetic
aaatgaagtacattgagctgtggggaagagtgccaccacagggagatagtgagctgccgccacaaactgaattta

SEQ ID NO: 341628 - DNA, 75 bp, Artificial Sequence
  Synthetic
aagagtgccaccacagggagatagtgagctgccgccacaaactgaatttaaaactggcaacgacaataaaaacta

SEQ ID NO: 341629 - DNA, 75 bp, Artificial Sequence
  Synthetic
aaaatttatccaattttcatatacgtagaccagaaagaccaacagccgagaaaaaaatactgtgtatgctacaat

SEQ ID NO: 341630 - DNA, 75 bp, Artificial Sequence
  Synthetic
tagaccagaaagaccaacagccgagaaaaaaatactgtgtatgctacaataaaactttaaatagatggagaaaca

SEQ ID NO: 341631 - DNA, 75 bp, Artificial Sequence
  Synthetic
aaatctaaggggattagtactgcgacagctcatgaaccaggaaatgacatacatctggaaagagggagaattctc

SEQ ID NO: 341632 - DNA, 75 bp, Artificial Sequence
  Synthetic
cagctcatgaaccaggaaatgacatacatctggaaagagggagaattctctaaagagtttatgccacggtggaag

SEQ ID NO: 341633 - DNA, 75 bp, Artificial Sequence
  Synthetic
caagaaaggcagataatgagaatcctatagtgtccgcgtgggcattcgagggaaaatggacaactactgggacag

SEQ ID NO: 341634 - DNA, 75 bp, Artificial Sequence
  Synthetic
tatagtgtccgcgtgggcattcgagggaaaatggacaactactgggacagtactagcggacgtttttaagataaa

SEQ ID NO: 341635 - DNA, 75 bp, Artificial Sequence
  Synthetic
gacagcttcggaaaattgacacttccaaagtcaccacatgacatagacttcgggcaccacagccgattcggacct

SEQ ID NO: 341636 - DNA, 75 bp, Artificial Sequence
  Synthetic
caaagtcaccacatgacatagacttcgggcaccacagccgattcggacctttttgtgtgaaaagtgaaccattag

SEQ ID NO: 341637 - DNA, 75 bp, Artificial Sequence
  Synthetic
tatcaacttgtggttccagtataaatttctctttcagtttggcggtgaataccagccaccaacaggtatccgcaa

SEQ ID NO: 341638 - DNA, 75 bp, Artificial Sequence
  Synthetic
tccctgcgctgatacaccagcctatcctgtgccacagtcaggaagtgttacgcaccccaaattcgccggcaaagg

SEQ ID NO: 341639 - DNA, 75 bp, Artificial Sequence
  Synthetic
tcttctgaaggagatggatcgtctgatgatgaagagacaatcagacgcagaaggcggcaatggaagcgactcaga

SEQ ID NO: 341640 - DNA, 75 bp, Artificial Sequence
  Synthetic
gacgcatgggacacaagcgacagcgacttcattgacacccccataagagagagatgcctcaataaaaagcaaaag

SEQ ID NO: 341641 - DNA, 75 bp, Artificial Sequence
  Synthetic
gaacctgcctcatagaaggcttctggccgttgagccacggacactggttccgtacctgtccccctatgagaaggc

SEQ ID NO: 341642 - DNA, 75 bp, Artificial Sequence
  Synthetic
aggatgtgactggactcaatggagtttacaaaatttataccatgaaaaattaaactggagaaatatatggacagc

SEQ ID NO: 341643 - DNA, 75 bp, Artificial Sequence
  Synthetic
acttacaacctctattaatgctcctcaaaaaacagcataaattagtcctctctcaaaaagattgcaacccgaaca

SEQ ID NO: 341644 - DNA, 75 bp, Artificial Sequence
  Synthetic
attcaggcctccaccaaaattaacatcacagtggagactaagcagagaactatcaaaaatacccttaataagact

SEQ ID NO: 341645 - DNA, 75 bp, Artificial Sequence
  Synthetic
gggaataagtctcatagacctgtcagaaccatggttagaaggctggggaaatgctttttacagtgtactaggata

SEQ ID NO: 341646 - DNA, 75 bp, Artificial Sequence
  Synthetic
atgctttttacagtgtactaggatatgaagctagtaaacacagtggcagatggtccaactggacacaaatgaaat

SEQ ID NO: 341647 - DNA, 75 bp, Artificial Sequence
  Synthetic
tgaagctagtaaacacagtggcagatggtccaactggacacaaatgaaatatttttggatctatgacacaggggt

SEQ ID NO: 341648 - DNA, 75 bp, Artificial Sequence
  Synthetic
ctaaaaaaagacgtaagtgacaatccaggagacatggctactcaatttgtaacaggatcaggacaacacccagac

SEQ ID NO: 341649 - DNA, 75 bp, Artificial Sequence
  Synthetic
aacaggatcaggacaacacccagacgctatagatcatatagaaatggttaatgaaggatggccttactggctatt

SEQ ID NO: 341650 - DNA, 75 bp, Artificial Sequence
  Synthetic
ataaaaaaactagcacatgaccaagacatagtcagagaatatgccagagaccctaaatcaaaaaaattaaaaata

SEQ ID NO: 341651 - DNA, 75 bp, Artificial Sequence
  Synthetic
acatagtcagagaatatgccagagaccctaaatcaaaaaaattaaaaataggagtcataggatgggccagcagta

SEQ ID NO: 341652 - DNA, 75 bp, Artificial Sequence
  Synthetic
ccctaaatcaaaaaaattaaaaataggagtcataggatgggccagcagtaactacacaacagcaggcagcaatca

SEQ ID NO: 341653 - DNA, 75 bp, Artificial Sequence
  Synthetic
gcaatacaaggtggatatgtagcttatgcaggatccagaataccaggcgcaggatctatcacaaatttgtttcaa

SEQ ID NO: 341654 - DNA, 75 bp, Artificial Sequence
  Synthetic
ggccacccacaaaccaagaccaaaccaattttaattggggactcagaggactttgtgtattaagagataatatga

SEQ ID NO: 341655 - DNA, 75 bp, Artificial Sequence
  Synthetic
ggaccttttgttgaaaaagcaaacacagcctttgctacaaatgaccctaaatacttcagaccagaactaaaagac

SEQ ID NO: 341656 - DNA, 75 bp, Artificial Sequence
  Synthetic
taatgacagggttcaccggaaaggctgcaaaaattacagctaaaaccacaatcataacacaataaaccacaaaaa

SEQ ID NO: 341657 - DNA, 75 bp, Artificial Sequence
  Synthetic
gaaataaattacacataaccacctaaccacaggaaactctgcaaaaaaggggaaataaatctcattggctgggcc

SEQ ID NO: 341658 - DNA, 75 bp, Artificial Sequence
  Synthetic
tcctcgccgccgccgcccaaaggtaaggagacggaggaggaaagctccggtcatacaatggaaccctcctagccg

SEQ ID NO: 341659 - DNA, 75 bp, Artificial Sequence
  Synthetic
tccgtacctgtctcccctttaggcggctaaacggactagtgttcccgggaggaggttgtgactggactcagtgga

SEQ ID NO: 341660 - DNA, 75 bp, Artificial Sequence
  Synthetic
gctagtaacgtgggaatggagttcgctagattcttaagaggaaaattctacttttttagacacccttggagaaac

SEQ ID NO: 341661 - DNA, 75 bp, Artificial Sequence
  Synthetic
taccttgtaaaccactaccatatcaaaacttacatccactcctaatgctactaaaaaaacagcataaactcgtac

SEQ ID NO: 341662 - DNA, 75 bp, Artificial Sequence
  Synthetic
cagaaaacaaaaacctgtaactttaaaatttaaaccaccaccaaaattaacttcacaatggagactaagcagaga

SEQ ID NO: 341663 - DNA, 75 bp, Artificial Sequence
  Synthetic
gtaggaaatgcagtatatgtcatattattaaaacaagcggtaggagacaacccaggagacatggcaaatacattt

SEQ ID NO: 341664 - DNA, 75 bp, Artificial Sequence
  Synthetic
aatccacattcaaaaaaactaaaaataggagtggtaggttgggcctcttcaaattttacaacaacaggcagctca

SEQ ID NO: 341665 - DNA, 75 bp, Artificial Sequence
  Synthetic
gcaatagataatttacacttaaaaggatggccaaacaaccaaaactggcctaacacaaacagagatcaaacaaac

SEQ ID NO: 341666 - DNA, 75 bp, Artificial Sequence
  Synthetic
gcctcctgtgtccaatctatttttcctacaccccttcaaaatggcgggagggacacaaaatggcggagggactaa

SEQ ID NO: 341667 - DNA, 75 bp, Artificial Sequence
  Synthetic
tgctaattcacaaaatggcggcgcggctgggacacaaaatggcggcgtagggggggggaacccccggccccccat

SEQ ID NO: 341668 - DNA, 75 bp, Artificial Sequence
  Synthetic
gcgggggctccgcctgcacccccgggagggggaaacccccccctcaaccccccgcggggggcaagcccccctgca

SEQ ID NO: 341669 - DNA, 75 bp, Artificial Sequence
  Synthetic
tgcaaaattacagctaaaaccacaacactaacacaataaaccacaaaatattacaggaaactgcaataaatttag

SEQ ID NO: 341670 - DNA, 75 bp, Artificial Sequence
  Synthetic
ccacaggaaactctgcaaaaaaagaggaaataaatttcattggctgggcctgaagtcctcattagaataagaaaa

SEQ ID NO: 341671 - DNA, 75 bp, Artificial Sequence
  Synthetic
ttccttgtaaaccgctaccatatcagaacttacatccactattaatgttactaaaaaaacaacacaaaatagtac

SEQ ID NO: 341672 - DNA, 75 bp, Artificial Sequence
  Synthetic
cagaaaacaaaaacctgtaactttaaaattcagaccaccacctaaactcacatcacaatggagactaagcagaga

SEQ ID NO: 341673 - DNA, 75 bp, Artificial Sequence
  Synthetic
gtaggaaatgctgtatatgtagttatgctaaaacaagatatagacgacaacccaggaaaaatggcaagtgagttt

SEQ ID NO: 341674 - DNA, 75 bp, Artificial Sequence
  Synthetic
aatccaaaatcaaaaaaactaaaaataggcatagtaggatgggcatcctctaactacacaacaccaggcagttca

SEQ ID NO: 341675 - DNA, 75 bp, Artificial Sequence
  Synthetic
taacatgcaattaggaagtcaagaattagatgatgaatgtaccatgctctcactctttggaccttttgtagaaaa

SEQ ID NO: 341676 - DNA, 75 bp, Artificial Sequence
  Synthetic
taaaagactataatttaatcatgaaatatgcctttaaattccagtggggaggacatggcacagaaagatttaaaa

SEQ ID NO: 341677 - DNA, 75 bp, Artificial Sequence
  Synthetic
atatgcctttaaattccagtggggaggacatggcacagaaagatttaaaacaaccatcggagaccccagcaccat

SEQ ID NO: 341678 - DNA, 75 bp, Artificial Sequence
  Synthetic
gacagaggaggaggagaaggcgtacccactccttggacaaaaaacagagaaagagccattatcagactccgacga

SEQ ID NO: 341679 - DNA, 75 bp, Artificial Sequence
  Synthetic
ggaggctgtgactggactcagtggagtttacagaacctatatcatgaaaaactaaactggagaaatatatggaca

SEQ ID NO: 341680 - DNA, 75 bp, Artificial Sequence
  Synthetic
ttccttgtaaaccgctaccatatcaaaacttacacccactattaatgctactaaaaaaacagcacaaacttgtac

SEQ ID NO: 341681 - DNA, 75 bp, Artificial Sequence
  Synthetic
cagaaaacagaaaccagttactttaaaattcagaccgccacctaaactcacatctcagtggagactaagcagaga

SEQ ID NO: 341682 - DNA, 75 bp, Artificial Sequence
  Synthetic
aaattcagaccgccacctaaactcacatctcagtggagactaagcagagaactagcaaaaatgcccttaattaga

SEQ ID NO: 341683 - DNA, 75 bp, Artificial Sequence
  Synthetic
cagagccatgggtagaaggctggggaaatgcattttattctttattaggatacgaagcaacaaaacaacaaggac

SEQ ID NO: 341684 - DNA, 75 bp, Artificial Sequence
  Synthetic
aaatgcattttattctttattaggatacgaagcaacaaaacaacaaggacatatttcaaactgggcacaaatgaa

SEQ ID NO: 341685 - DNA, 75 bp, Artificial Sequence
  Synthetic
gtaggaaatgctgtgtatgttatactattaaaaaaagaaactacatctaatccaggacaaatggtacaaaatttt

SEQ ID NO: 341686 - DNA, 75 bp, Artificial Sequence
  Synthetic
tattaaaaaaagaaactacatctaatccaggacaaatggtacaaaattttcctagcagtggaggacaacacccag

SEQ ID NO: 341687 - DNA, 75 bp, Artificial Sequence
  Synthetic
caatgaaggatggccatactggttatatttttatggcaaaagcgaacaagacataaaacgagaggcacatactac

SEQ ID NO: 341688 - DNA, 75 bp, Artificial Sequence
  Synthetic
tatttttatggcaaaagcgaacaagacataaaacgagaggcacatactacagaaatagcaagagaattcgcacaa

SEQ ID NO: 341689 - DNA, 75 bp, Artificial Sequence
  Synthetic
taggagtagtagggtgggcttcttcaaattttacagccacaggcagtgtacaaaactcaggaggaacaacatcag

SEQ ID NO: 341690 - DNA, 75 bp, Artificial Sequence
  Synthetic
aaattttacagccacaggcagtgtacaaaactcaggaggaacaacatcagccatacaaggaggatacgtggcctg

SEQ ID NO: 341691 - DNA, 75 bp, Artificial Sequence
  Synthetic
ttaggtgcgggatccatagacaatttacacttaaaaggctggccaaataatcaaaactggccgaatacaaacaga

SEQ ID NO: 341692 - DNA, 75 bp, Artificial Sequence
  Synthetic
tacacttaaaaggctggccaaataatcaaaactggccgaatacaaacagagatgaaacaaattttgactggggac

SEQ ID NO: 341693 - DNA, 75 bp, Artificial Sequence
  Synthetic
taacatgacattaggcactcaagaaatagacgatgaaacaacaatgttaagcctatttggaccctttatagaaaa

SEQ ID NO: 341694 - DNA, 75 bp, Artificial Sequence
  Synthetic
gcctatttggaccctttatagaaaaagcaaatacagcattagcaacaacagaccctaaatactttagaccagaac

SEQ ID NO: 341695 - DNA, 75 bp, Artificial Sequence
  Synthetic
tgtcattaggggggtgcaggggggcttgccccccgcaccccccgcggggggcaagcccccctgcaccccggtgca

SEQ ID NO: 341696 - DNA, 75 bp, Artificial Sequence
  Synthetic
cagtaaagtgaatataagtaagtgcagttccgaatggctgagtttatgccgccagcggtagacagaactgtctag

SEQ ID NO: 341697 - DNA, 75 bp, Artificial Sequence
  Synthetic
gggcaggagcagctgagcggagggcctatgccggagtactgggaggaagcctggctctccagtgctacgtggatc

SEQ ID NO: 341698 - DNA, 75 bp, Artificial Sequence
  Synthetic
cacgagagtcactgcaagtgcggtaactggagaaaccacctctggacactatgcgctttagacgacgcagatttg

SEQ ID NO: 341699 - DNA, 75 bp, Artificial Sequence
  Synthetic
cctggagacgttggcgggtaaggagatggcggcgttccgtcttccgtagaggaggacgtagagcgcgcccctacc

SEQ ID NO: 341700 - DNA, 75 bp, Artificial Sequence
  Synthetic
agtgaggagagttgtcattaaggggtggtggccacttattcagtgcatgcagggtatggaatacctcagatacag

SEQ ID NO: 341701 - DNA, 75 bp, Artificial Sequence
  Synthetic
tggatatacaaaaaacaaaacagcagaatattctcggaggacatgggttacctaatgcagtacggtggaggatgg

SEQ ID NO: 341702 - DNA, 75 bp, Artificial Sequence
  Synthetic
gaatattctcggaggacatgggttacctaatgcagtacggtggaggatgggcatcaggaacaatttccttaaagg

SEQ ID NO: 341703 - DNA, 75 bp, Artificial Sequence
  Synthetic
gcgcaatgtgtggtcgagatcgaatgacggaatggacctagctagatactttgggtgttcaataacactctaccc

SEQ ID NO: 341704 - DNA, 75 bp, Artificial Sequence
  Synthetic
gacggaatggacctagctagatactttgggtgttcaataacactctacccagaggaaaaccaggattacctattc

SEQ ID NO: 341705 - DNA, 75 bp, Artificial Sequence
  Synthetic
cacagctactaaacctacaagaatacacacaaccaagtgtaatgctgcaggcaaaaaactcaaggctaatagtag

SEQ ID NO: 341706 - DNA, 75 bp, Artificial Sequence
  Synthetic
cacacaaccaagtgtaatgctgcaggcaaaaaactcaaggctaatagtagcgaaaagtagaatgccaattagacg

SEQ ID NO: 341707 - DNA, 75 bp, Artificial Sequence
  Synthetic
ccgccgtcacaaatgacaacacagtggcaattccaaaaagacttagcagattacccacttttcaactgggcatgt

SEQ ID NO: 341708 - DNA, 75 bp, Artificial Sequence
  Synthetic
ggcaattccaaaaagacttagcagattacccacttttcaactgggcatgtatctgcatagacatggaaaagccct

SEQ ID NO: 341709 - DNA, 75 bp, Artificial Sequence
  Synthetic
tgcctggtggctaatgcaaagacaggcatcaggtgacatggaatacatagaaaaatggggaagaattccaccaac

SEQ ID NO: 341710 - DNA, 75 bp, Artificial Sequence
  Synthetic
gcatcaggtgacatggaatacatagaaaaatggggaagaattccaccaacaggagactggaaacttccagcctcc

SEQ ID NO: 341711 - DNA, 75 bp, Artificial Sequence
  Synthetic
atccaaactggaaacccgcagatgagccagacatatatccaatagtagcctattggacaagtgacggaaacacaa

SEQ ID NO: 341712 - DNA, 75 bp, Artificial Sequence
  Synthetic
gccagacatatatccaatagtagcctattggacaagtgacggaaacacaaagacatgcaattggtgcacaattca

SEQ ID NO: 341713 - DNA, 75 bp, Artificial Sequence
  Synthetic
aaaaaagaggcatctgcagtacaggtcagggacctgagaggactgtgcctaagagtatgttcagaacaggaaaca

SEQ ID NO: 341714 - DNA, 75 bp, Artificial Sequence
  Synthetic
tcccaggaaacttcaaacaacagtggtggccacaggggggaacggaccatggactgtgcattatagacgcaacag

SEQ ID NO: 341715 - DNA, 75 bp, Artificial Sequence
  Synthetic
gtggccacaggggggaacggaccatggactgtgcattatagacgcaacaggaacaaaagcattagataatccaga

SEQ ID NO: 341716 - DNA, 75 bp, Artificial Sequence
  Synthetic
ggactgtgcattatagacgcaacaggaacaaaagcattagataatccagacgtatatgtgattaaatggggggca

SEQ ID NO: 341717 - DNA, 75 bp, Artificial Sequence
  Synthetic
cattgacatactggggaataaacacatctggaaatagaaactggcaggacgcagacttcggaaaaatacagttgc

SEQ ID NO: 341718 - DNA, 75 bp, Artificial Sequence
  Synthetic
atctggaaatagaaactggcaggacgcagacttcggaaaaatacagttgccgaaggccccgcacgacgtcgactt

SEQ ID NO: 341719 - DNA, 75 bp, Artificial Sequence
  Synthetic
ttttgcgtgaaaaacccaccatgtgagttcagacaggacccaccaaaccccataaatatttgggtaaaatataaa

SEQ ID NO: 341720 - DNA, 75 bp, Artificial Sequence
  Synthetic
tttttctttcagttcggcggcatgtaccaacctccctgcgggatccaagatccaggaacttctaacccgacctat

SEQ ID NO: 341721 - DNA, 75 bp, Artificial Sequence
  Synthetic
gctcagggtatcaccgctgcctctctcagggccatcagtgcagctccacccagaacctacagtcaaagtgcattt

SEQ ID NO: 341722 - DNA, 75 bp, Artificial Sequence
  Synthetic
cgactcagaatatttctccagcgactcgctgaccgatccctggaccacaagcgacgaagattttcagagtgaccc

SEQ ID NO: 341723 - DNA, 75 bp, Artificial Sequence
  Synthetic
ctggttggaagctaccaagggctggcacgatctcgactgccgctgcggtaactggcaggaccacctatggctcct

SEQ ID NO: 341724 - DNA, 75 bp, Artificial Sequence
  Synthetic
cacgatctcgactgccgctgcggtaactggcaggaccacctatggctcctactcgccgatggagacgccgctttg

SEQ ID NO: 341725 - DNA, 75 bp, Artificial Sequence
  Synthetic
actggcaggaccacctatggctcctactcgccgatggagacgccgctttggccgccgccgtagacgctatagaaa

SEQ ID NO: 341726 - DNA, 75 bp, Artificial Sequence
  Synthetic
aaggcggcgttccgtctaccgtagaggtggacgtagagcgcgcccctaccgactgtttaatccaaaagtaatgcg

SEQ ID NO: 341727 - DNA, 75 bp, Artificial Sequence
  Synthetic
cctattttacaatgcttaaaaggacaggaggcactaagatatagacctctacagtgggacacagagagacagtgg

SEQ ID NO: 341728 - DNA, 75 bp, Artificial Sequence
  Synthetic
aggaggcactaagatatagacctctacagtgggacacagagagacagtggagagtgagatcagacttcgaagacc

SEQ ID NO: 341729 - DNA, 75 bp, Artificial Sequence
  Synthetic
gggaggttggggaagtggtgatgtgacacttgaaggtctctaccaagagcacttattgtggagaaactcttggtc

SEQ ID NO: 341730 - DNA, 75 bp, Artificial Sequence
  Synthetic
acacttgaaggtctctaccaagagcacttattgtggagaaactcttggtctaaaggaaacgatggaatggaccta

SEQ ID NO: 341731 - DNA, 75 bp, Artificial Sequence
  Synthetic
acctatatccactaaaggaccaggactattggttctggtgggacacggacttcaaagaattatatgcagaaaaca

SEQ ID NO: 341732 - DNA, 75 bp, Artificial Sequence
  Synthetic
ctattggttctggtgggacacggacttcaaagaattatatgcagaaaacataaaggaatacagccaaccatcagt

SEQ ID NO: 341733 - DNA, 75 bp, Artificial Sequence
  Synthetic
atagtaatagccagagaaagggcaccacatagaagaaaagtaagaaaaatatttattccgccaccttcgagagac

SEQ ID NO: 341734 - DNA, 75 bp, Artificial Sequence
  Synthetic
cacatagaagaaaagtaagaaaaatatttattccgccaccttcgagagacacaacacagtggcagtttcagacag

SEQ ID NO: 341735 - DNA, 75 bp, Artificial Sequence
  Synthetic
gtgggcagctggtctaatagacatgcaaaaaccgttcgatgctaatggagcctttagaaatgcttggtggctgga

SEQ ID NO: 341736 - DNA, 75 bp, Artificial Sequence
  Synthetic
caaaaaccgttcgatgctaatggagcctttagaaatgcttggtggctggaacagagaaatgatcagggagaaatg

SEQ ID NO: 341737 - DNA, 75 bp, Artificial Sequence
  Synthetic
tacccccacaaggagattcagagctgcccaaaaaaaaagaattctccacaggaacagataacccaaactacaatg

SEQ ID NO: 341738 - DNA, 75 bp, Artificial Sequence
  Synthetic
gcccaaaaaaaaagaattctccacaggaacagataacccaaactacaatgttcaggacaatgaggagaaaaacat

SEQ ID NO: 341739 - DNA, 75 bp, Artificial Sequence
  Synthetic
caaaaagatcaaaaaccaagaaaaaagtactgcgtatgttataataagaccctcaacagatggagactaggacag

SEQ ID NO: 341740 - DNA, 75 bp, Artificial Sequence
  Synthetic
agtactgcgtatgttataataagaccctcaacagatggagactaggacaggcaagtactctaaagataggaaacc

SEQ ID NO: 341741 - DNA, 75 bp, Artificial Sequence
  Synthetic
gatgaatcaagaaatgacgtatatatggaaagaaggagaatacagtgccccctttgtacaaaggtggaaaggcag

SEQ ID NO: 341742 - DNA, 75 bp, Artificial Sequence
  Synthetic
tggaaagaaggagaatacagtgccccctttgtacaaaggtggaaaggcagcagattcgctgtgatagacgcaaga

SEQ ID NO: 341743 - DNA, 75 bp, Artificial Sequence
  Synthetic
tatcaacatggccaattgagggaacgtggaacacacaggacacagtactgaaggatgtattcggtattaacttgc

SEQ ID NO: 341744 - DNA, 75 bp, Artificial Sequence
  Synthetic
gtggaacacacaggacacagtactgaaggatgtattcggtattaacttgcaaaatcaacaatttagggcggcgga

SEQ ID NO: 341745 - DNA, 75 bp, Artificial Sequence
  Synthetic
tcaccgcatgacttagacttcggtcaccacagcagatttgggccattttgtgtgaaaaatgaaccactggagttt

SEQ ID NO: 341746 - DNA, 75 bp, Artificial Sequence
  Synthetic
accacagcagatttgggccattttgtgtgaaaaatgaaccactggagtttcaggtataccctccagaaccaacta

SEQ ID NO: 341747 - DNA, 75 bp, Artificial Sequence
  Synthetic
tatcactgctgcctcttccagagccctcagtgcagatacacccacagaggcagcgcaaagtgcacttctccgagg

SEQ ID NO: 341748 - DNA, 75 bp, Artificial Sequence
  Synthetic
atggaccacaagcgacagcgacttcattgacacccccataagagaaagatgcctcaataaaaaacaaaagaaacg

SEQ ID NO: 341749 - DNA, 75 bp, Artificial Sequence
  Synthetic
attgacacccccataagagaaagatgcctcaataaaaaacaaaagaaacgctaaacagtgtccgattactaatgg

SEQ ID NO: 341750 - DNA, 75 bp, Artificial Sequence
  Synthetic
agatgatgaatgcacaatgttaaccctatttggaccctttgtagaaaaagcaaacacagcactagcaacacaaga

SEQ ID NO: 341751 - DNA, 75 bp, Artificial Sequence
  Synthetic
agccgccgcaccccccctgcgggggctccgccccctgcacccccgggagggggggaaaccccccctcaacccccc

SEQ ID NO: 341752 - DNA, 75 bp, Artificial Sequence
  Synthetic
ttatgacagggttcaccggaagggctgcaaaattacagctaaaaccacaagtctaacacaataaaccacaagcta

SEQ ID NO: 341753 - DNA, 75 bp, Artificial Sequence
  Synthetic
tgcaaaattacagctaaaaccacaagtctaacacaataaaccacaagctattacaggaaactgcaataaatttag

SEQ ID NO: 341754 - DNA, 75 bp, Artificial Sequence
  Synthetic
gaggctgtgactggagccagtggagtttacaaaatctttatcatgaaaaacttaactggagaaatatatggacag

SEQ ID NO: 341755 - DNA, 75 bp, Artificial Sequence
  Synthetic
tagattcttaaaaggaaaattttacttttttagacatccatggagaaattatataataacatgggatcaagacat

SEQ ID NO: 341756 - DNA, 75 bp, Artificial Sequence
  Synthetic
aacttacacccactgctaatgctactaaaaaaacagcacaaaattgtactctcacaacaaaactgtaacccaaac

SEQ ID NO: 341757 - DNA, 75 bp, Artificial Sequence
  Synthetic
taaaaaaacagcacaaaattgtactctcacaacaaaactgtaacccaaacagaaaacaaaaacctgtaactttaa

SEQ ID NO: 341758 - DNA, 75 bp, Artificial Sequence
  Synthetic
tattactggttatatgacacgggagtaggtaatgcagtctatgtcatattattaaaacaagatgtaggagacaac

SEQ ID NO: 341759 - DNA, 75 bp, Artificial Sequence
  Synthetic
caatagacaatttacacttaaaaggatggccaaacaaccaaaactggcctaacacaaacagagatcaaacaaact

SEQ ID NO: 341760 - DNA, 75 bp, Artificial Sequence
  Synthetic
gacacaaaatggcggagggactaaggggggggcaagccccccccaccccccatgcgggggctccgccccctgcac

SEQ ID NO: 341761 - DNA, 75 bp, Artificial Sequence
  Synthetic
taatgacagggttcaccggaaaggctgcaaaattacagctaaaaccacaatcataacacaataaaccacaaacta

SEQ ID NO: 341762 - DNA, 75 bp, Artificial Sequence
  Synthetic
gaagtcctcattagaataagaaaagaaccaatcagaaacacttcctcttttagagtatataagtaagtgcgcaga

SEQ ID NO: 341763 - DNA, 75 bp, Artificial Sequence
  Synthetic
aaccaatcagaaacacttcctcttttagagtatataagtaagtgcgcagacgaatggctgagtttatgccgctgg

SEQ ID NO: 341764 - DNA, 75 bp, Artificial Sequence
  Synthetic
ctgaaaaaagacgtgagtgacaatccaggagacatggctacacagtttgtaacaggctcaggacaacacccagac

SEQ ID NO: 341765 - DNA, 75 bp, Artificial Sequence
  Synthetic
aacaggctcaggacaacacccagacgcaatagatcatatagaaatggtaaacgaaggatggccttactggctatt

SEQ ID NO: 341766 - DNA, 75 bp, Artificial Sequence
  Synthetic
ccctaaatcaaaaaaattaaaaataggagtcataggatgggccagcagtaactacacaacagcagggagcaacca

SEQ ID NO: 341767 - DNA, 75 bp, Artificial Sequence
  Synthetic
ggccacccacaaaccaagaccaaaccaattttaactggggactcagaggactttgtgtattaagagataacatga

SEQ ID NO: 341768 - DNA, 75 bp, Artificial Sequence
  Synthetic
tgaatgcacaatgctctccttatttggaccatttgttgaaaaagcaaacacagcttttgctacaaacgacccaaa

SEQ ID NO: 341769 - DNA, 75 bp, Artificial Sequence
  Synthetic
tacaacgtagtaatgaaatatgcttttaaatttcagtggggaggacatggcaccgaaagatttaaaacaaccatc

SEQ ID NO: 341770 - DNA, 75 bp, Artificial Sequence
  Synthetic
ccacaggaaactctgcaaaaaagaggaaataaattttattggctgtgccttaagtcctcattagaataagaaaag

SEQ ID NO: 341771 - DNA, 75 bp, Artificial Sequence
  Synthetic
ctaaactggagaaatatatggacagctagtaacgtgggaatggaattcgctagatttttaagaggaaaattctac

SEQ ID NO: 341772 - DNA, 75 bp, Artificial Sequence
  Synthetic
taggaaatgctgtatatgtagttatgctaaaacaagatgtagacgacaacccaggaagaatggcatcaacattta

SEQ ID NO: 341773 - DNA, 75 bp, Artificial Sequence
  Synthetic
aatgaaggatggccctactggttatactttttcggtaaaagtgaacaagacataaaaaaagaagcacatagccaa

SEQ ID NO: 341774 - DNA, 75 bp, Artificial Sequence
  Synthetic
atccaaaatcaaaaaaactaaaaataggaatagtaggatgggcatcttcaaattttacaacaacagggagctcac

SEQ ID NO: 341775 - DNA, 75 bp, Artificial Sequence
  Synthetic
aattttacaacaacagggagctcacaatcaccatcaaatcctgtagcaatacaaggaggatacgtagcatacgca

SEQ ID NO: 341776 - DNA, 75 bp, Artificial Sequence
  Synthetic
aacacaaacagagaccaaacaaactttgactggggactaagagcattatgtatactcagagataacatgaactta

SEQ ID NO: 341777 - DNA, 75 bp, Artificial Sequence
  Synthetic
catggaaaaattcatgcagttacatattcaaaacgtacaagaaataagagctaaaaatgctaaaaaatccctcaa

SEQ ID NO: 341778 - DNA, 75 bp, Artificial Sequence
  Synthetic
tctaaacacccttcaaaatggcgggagggacacaaaatggcggagggactaaggggggggcaagccccccccacc

SEQ ID NO: 341779 - DNA, 75 bp, Artificial Sequence
  Synthetic
ccccatgcggggctccgcctgcacccccatcccaagtcacaaaatggcggcgtggctgggacacaaaatggcggc

SEQ ID NO: 341780 - DNA, 75 bp, Artificial Sequence
  Synthetic
ccttgcggggctccgcctgcacccccgggagggggaaaccccccctcaaccccccgcggggggcaagcccccctg

SEQ ID NO: 341781 - DNA, 75 bp, Artificial Sequence
  Synthetic
ggagtcaaatctgattggtcgggaggtcaagtcctcatttgcatagggtgtaaccaatcagaattaaggccttcc

SEQ ID NO: 341782 - DNA, 75 bp, Artificial Sequence
  Synthetic
ctatgccggaacactgggaggaagcctggttggaagctaccaagggctggcacgatctagactgccgctgcggta

SEQ ID NO: 341783 - DNA, 75 bp, Artificial Sequence
  Synthetic
tggtggccgataatacagtgcctcaaaggacaggaatcgttgagatatagaccactgcaatgggatactgaaaag

SEQ ID NO: 341784 - DNA, 75 bp, Artificial Sequence
  Synthetic
aaggacaggaatcgttgagatatagaccactgcaatgggatactgaaaagcagtggagagtgagaaatgactttg

SEQ ID NO: 341785 - DNA, 75 bp, Artificial Sequence
  Synthetic
gtacggaggaggatgggggagtggggaggtcacactggaaaatctttaccaggaacaccttctatggcgaaactc

SEQ ID NO: 341786 - DNA, 75 bp, Artificial Sequence
  Synthetic
gaggtcacactggaaaatctttaccaggaacaccttctatggcgaaactcctggtcaaaaggaaatgatggaatg

SEQ ID NO: 341787 - DNA, 75 bp, Artificial Sequence
  Synthetic
tagtatatctataccctctgaaagacgcagactactggttttggtgggacacagatttcaaagaactatacgctg

SEQ ID NO: 341788 - DNA, 75 bp, Artificial Sequence
  Synthetic
cgcagactactggttttggtgggacacagatttcaaagaactatacgctgaaatgataaaagaatactcgcagcc

SEQ ID NO: 341789 - DNA, 75 bp, Artificial Sequence
  Synthetic
acaaaaataataatagccagagaaagagcaccccacagaaggaaagtaagaaaaatcttcattcctccaccaagt

SEQ ID NO: 341790 - DNA, 75 bp, Artificial Sequence
  Synthetic
gagcaccccacagaaggaaagtaagaaaaatcttcattcctccaccaagtagagacacaactcagtggcaattcc

SEQ ID NO: 341791 - DNA, 75 bp, Artificial Sequence
  Synthetic
attcacatgggcggcaggactaatagagatgcaaaaaccctttgatgcgaatggagcctttaggaacgcatggtg

SEQ ID NO: 341792 - DNA, 75 bp, Artificial Sequence
  Synthetic
gagatgcaaaaaccctttgatgcgaatggagcctttaggaacgcatggtggctggaacagagaacagaccaggga

SEQ ID NO: 341793 - DNA, 75 bp, Artificial Sequence
  Synthetic
ggagagtaccaccacagggagacagtgaattacctaaaaggtcagattttgctaaaagcggtgacaacccaaact

SEQ ID NO: 341794 - DNA, 75 bp, Artificial Sequence
  Synthetic
tgaattacctaaaaggtcagattttgctaaaagcggtgacaacccaaactatgacatacaagacggaaacgagaa

SEQ ID NO: 341795 - DNA, 75 bp, Artificial Sequence
  Synthetic
gtagatcagaaggaccaacaaccacgaaaaaaatactgtgtttgctacaataaaaccttgaacaggtggcggaga

SEQ ID NO: 341796 - DNA, 75 bp, Artificial Sequence
  Synthetic
gaaaaaaatactgtgtttgctacaataaaaccttgaacaggtggcggagaacacagggcagtactctgaatatag

SEQ ID NO: 341797 - DNA, 75 bp, Artificial Sequence
  Synthetic
acagcttatgaaccaggaaatgacctacacttggaaaggacaggaatactcaggtgtgtttctgcaaagatggag

SEQ ID NO: 341798 - DNA, 75 bp, Artificial Sequence
  Synthetic
tacacttggaaaggacaggaatactcaggtgtgtttctgcaaagatggagaggtagtagaatagtagtgatagac

SEQ ID NO: 341799 - DNA, 75 bp, Artificial Sequence
  Synthetic
cgaaggtactatcatggccagtggagggaaactggaacacgaaaggcacagtactttgggacgtttttaagatac

SEQ ID NO: 341800 - DNA, 75 bp, Artificial Sequence
  Synthetic
ggatgatttccacaaactagggctaccaaaatctccacatgacatagactttgggcaccacagtcgcttcggtcc

SEQ ID NO: 341801 - DNA, 75 bp, Artificial Sequence
  Synthetic
ccaaaatctccacatgacatagactttgggcaccacagtcgcttcggtcctttctgcgtaaaatcggaaccactg

SEQ ID NO: 341802 - DNA, 75 bp, Artificial Sequence
  Synthetic
aaagatgcctcaataaaaagcttaaaaagtacaaatgtctcctcattgggggggtccgggggggcttgcccccgt

SEQ ID NO: 341803 - DNA, 75 bp, Artificial Sequence
  Synthetic
attgggatcgttagaaaactatggccgagcatggggggggctccgccccccccaaccccccggtggggggccaag

SEQ ID NO: 341804 - DNA, 75 bp, Artificial Sequence
  Synthetic
taatgccagggtccaccggaagggctgcaaaattacagctaaaaccacaaatctaacacaataaaccacaaacta

SEQ ID NO: 341805 - DNA, 75 bp, Artificial Sequence
  Synthetic
tgcaaaattacagctaaaaccacaaatctaacacaataaaccacaaactattacaggaaactgcaataaatttag

SEQ ID NO: 341806 - DNA, 75 bp, Artificial Sequence
  Synthetic
gaaccgggccccccccctccatggaagaaagatggctgacggtagcgtactgcgcgcacggattattctgcagct

SEQ ID NO: 341807 - DNA, 75 bp, Artificial Sequence
  Synthetic
gctagatttttaagagcgaaattttacttcttcagacatccctggagaagctacattataacttgggaccaggac

SEQ ID NO: 341808 - DNA, 75 bp, Artificial Sequence
  Synthetic
acttcttcagacatccctggagaagctacattataacttgggaccaggacattccttgcagaccattaccttatc

SEQ ID NO: 341809 - DNA, 75 bp, Artificial Sequence
  Synthetic
attccttgcagaccattaccttatcaaaacttacatcctctacttatgctattaaaaaaacaacataaattagtg

SEQ ID NO: 341810 - DNA, 75 bp, Artificial Sequence
  Synthetic
acagaagacaaaaaccagttactttaaaaataagacctcctccaaaactaacaactcaatggagactaagtagag

SEQ ID NO: 341811 - DNA, 75 bp, Artificial Sequence
  Synthetic
actcggtgtaagcctaatagacttatcagagccatggctagaaggttggggaaatgcattttatagtgttttagg

SEQ ID NO: 341812 - DNA, 75 bp, Artificial Sequence
  Synthetic
agagtagctgaatggtgtcaaatgaaatacttttggatatatgacacaggagtaggcaatgcagtatatgttata

SEQ ID NO: 341813 - DNA, 75 bp, Artificial Sequence
  Synthetic
aatacttttggatatatgacacaggagtaggcaatgcagtatatgttatactcctaaaaaaagacatagacgata

SEQ ID NO: 341814 - DNA, 75 bp, Artificial Sequence
  Synthetic
tgtgaagacagcttcacaacacccagatgcaatacaacatatagaaatgataaatgaaggatggccttattggct

SEQ ID NO: 341815 - DNA, 75 bp, Artificial Sequence
  Synthetic
gatgcaatacaacatatagaaatgataaatgaaggatggccttattggctatacttctatggacaatcagaacaa

SEQ ID NO: 341816 - DNA, 75 bp, Artificial Sequence
  Synthetic
gagagatcgtagcagaatatgcaagagacccaaaatctaaaaaactaaaaattggagtaacagggtgggcaagca

SEQ ID NO: 341817 - DNA, 75 bp, Artificial Sequence
  Synthetic
agacccaaaatctaaaaaactaaaaattggagtaacagggtgggcaagcagtaactatacaacaccaggtagctc

SEQ ID NO: 341818 - DNA, 75 bp, Artificial Sequence
  Synthetic
gaagcaataaaaggaggatacgtagcatatccgggagcaaagatacccggagcaggccttataagtaatttattc

SEQ ID NO: 341819 - DNA, 75 bp, Artificial Sequence
  Synthetic
actggcctccaacaaacccagatcaaacaaattttgactggggaaaaagaggactctgtatactaagagataata

SEQ ID NO: 341820 - DNA, 75 bp, Artificial Sequence
  Synthetic
cgatgaatgcacaatgctttcactttttggaccttttgtagaaaaagcaaacacagcctttgctacaaatgaccc

SEQ ID NO: 341821 - DNA, 75 bp, Artificial Sequence
  Synthetic
cctttaaatttcagtggggaggccacggaaccgaaagattcaaaacaaccatcggagatcccagcaccataccat

SEQ ID NO: 341822 - DNA, 75 bp, Artificial Sequence
  Synthetic
ccttggacaaaaaacagagaaagagccattatcagactccgacgaagagagcgttatctcaagcacgagcagtgg

SEQ ID NO: 341823 - DNA, 75 bp, Artificial Sequence
  Synthetic
aatagcggcctcctgtgtccaatctatttttcctacaccccttcaaaatggcgggagggacacaaaatggcggag

SEQ ID NO: 341824 - DNA, 75 bp, Artificial Sequence
  Synthetic
ccccccttgcccggggctgtgccccggaccccctacacttccgggttcaggaggctcaatttggctagcttcgct

SEQ ID NO: 341825 - DNA, 75 bp, Artificial Sequence
  Synthetic
gaggctcaatttggctagcttcgctcgcaccacgtttgctgccaggcggacctgattgaagactgaaaaccgtta

SEQ ID NO: 341826 - DNA, 75 bp, Artificial Sequence
  Synthetic
cgcaccacgtttgctgccaggcggacctgattgaagactgaaaaccgttaaattcaaatttgaaaatggcgggca

SEQ ID NO: 341827 - DNA, 75 bp, Artificial Sequence
  Synthetic
atgcaaattaatttatgcaaagtaggaggagctcgattttaatttatgcaaagtaggaggagtcaattctgattg

SEQ ID NO: 341828 - DNA, 75 bp, Artificial Sequence
  Synthetic
tttatgccgccagcggtagacagaactgtctagcgactgggcgggtgccggaggatccctgatccggagtcaagg

SEQ ID NO: 341829 - DNA, 75 bp, Artificial Sequence
  Synthetic
atacagtgtatggacgggatggagtggataaaatacaagcctatggacttaagagtcgaggcaaactggatattc

SEQ ID NO: 341830 - DNA, 75 bp, Artificial Sequence
  Synthetic
gaattagactatatccaacagagaatcaggactacttgttctggtatgacacagaatttgacgaacagcaaagga

SEQ ID NO: 341831 - DNA, 75 bp, Artificial Sequence
  Synthetic
tcaggactacttgttctggtatgacacagaatttgacgaacagcaaaggagaatgctagatgaatacacacaacc

SEQ ID NO: 341832 - DNA, 75 bp, Artificial Sequence
  Synthetic
gttctattttcagttcggcggcatgtaccagcctcccaccggaatccaagatccctgcacttctaacccgaccta

SEQ ID NO: 341833 - DNA, 75 bp, Artificial Sequence
  Synthetic
atccctgcacttctaacccgacctatcctgtcagaatggtcggagcagttacacaccccaaatacgccgggcaag

SEQ ID NO: 341834 - DNA, 75 bp, Artificial Sequence
  Synthetic
aagagtagtcaaatgggccacagtacacaatggtcctatagacagatggagaaaaaaacagacaggaactttaaa

SEQ ID NO: 341835 - DNA, 75 bp, Artificial Sequence
  Synthetic
ggctgcaactacctagaagcagccacaatgtcgactttggacataaagctagatttgggccattttgcgttaaaa

SEQ ID NO: 341836 - DNA, 75 bp, Artificial Sequence
  Synthetic
tcggagcagttacacaccccaaatacgccgggcaaggcggaatcacgacccaaattggagatcaaggtatcaccg

SEQ ID NO: 341837 - DNA, 75 bp, Artificial Sequence
  Synthetic
ggctcgaccctcacacaacactgcagatagggggcgcaattgggatcgttagaaaactatggccgagcatggggg

SEQ ID NO: 341838 - DNA, 75 bp, Artificial Sequence
  Synthetic
gattttaatttatgcaaagtaggaggagtcaaatctgattggtcgggagctcaagtcctcatttgcatagggtgt

SEQ ID NO: 341839 - DNA, 75 bp, Artificial Sequence
  Synthetic
cttgttctggtatgacacagaatttgacgaacagcaaaggagaatgctagatgaatatacacaacctagtgtaat

SEQ ID NO: 341840 - DNA, 75 bp, Artificial Sequence
  Synthetic
ccgaaagctcttctgagggagatggatcgtctgatgaccaagcagagagacgcgctgccagaaagcgagtcatca

SEQ ID NO: 341841 - DNA, 75 bp, Artificial Sequence
  Synthetic
ctcaccaataaacgcaaaaaacgcttgcaattctaactctgtctctgtgacttcattgggggggtccgggggggc

SEQ ID NO: 341842 - DNA, 75 bp, Artificial Sequence
  Synthetic
ggggcgcaattgggatcgttagaaaactatgcgccgagacatggggggggctccgcacaacccccccccggtggg

SEQ ID NO: 341843 - DNA, 75 bp, Artificial Sequence
  Synthetic
acaaaaatagtcatcgcaagaagtagagccccacatagaaggaaggtgcgcagaattttcataccgcctccaagt

SEQ ID NO: 341844 - DNA, 75 bp, Artificial Sequence
  Synthetic
gttagaacaaagaaacgaggcaggagaaatgaaatacatagagctatggggaagagtgccaccccaaggtgacac

SEQ ID NO: 341845 - DNA, 75 bp, Artificial Sequence
  Synthetic
acagtacttaaagaggttttcaatataaacctgattaatgagcagatgagacaggcagactttggaaaactaaac

SEQ ID NO: 341846 - DNA, 75 bp, Artificial Sequence
  Synthetic
ttaccgaaatccccgcacgacattgactttggacaccacagtagatttggacctttctgtgtaaaaaacgaacca

SEQ ID NO: 341847 - DNA, 75 bp, Artificial Sequence
  Synthetic
gaccgacgaatggaccacaagcgacagcgacttcattgacacccccattagacagagatgcctcaataaaaagca

SEQ ID NO: 341848 - DNA, 75 bp, Artificial Sequence
  Synthetic
cggctttgcttcgacagtggccgtggctcgaccctcacacaacactgcaggtagggggcgcaattgggatcgtta

SEQ ID NO: 341849 - DNA, 75 bp, Artificial Sequence
  Synthetic
taatgacagggctcacggaagtgctgcaaaattacagctaaaaccacaacactaacacaataaaccacaagaaat

SEQ ID NO: 341850 - DNA, 75 bp, Artificial Sequence
  Synthetic
gcaaaattacagctaaaaccacaacactaacacaataaaccacaagaaatttcaggaagctgtaataaattaaga

SEQ ID NO: 341851 - DNA, 75 bp, Artificial Sequence
  Synthetic
tacaataaaaccacaggaaactctgcaaaaaagaggaagaaaatttcattggctaaatcagaagtcctcattagc

SEQ ID NO: 341852 - DNA, 75 bp, Artificial Sequence
  Synthetic
tatcgcagacgccggaggagacccacacggagatggaggcgaaggagatggaggcgctactttcgatattggcat

SEQ ID NO: 341853 - DNA, 75 bp, Artificial Sequence
  Synthetic
ctacggacactggctccgtacctgtctccctatgagaaaagaaaacggactcatttttctgggcggaggaataga

SEQ ID NO: 341854 - DNA, 75 bp, Artificial Sequence
  Synthetic
ctccctatgagaaaagaaaacggactcatttttctgggcggaggaatagactggactgtatggagtttacagaac

SEQ ID NO: 341855 - DNA, 75 bp, Artificial Sequence
  Synthetic
gaaatatatggacagcttctaatgatggcatggaatttgcgcgcttcaaatatgctaaatttaaattctttagac

SEQ ID NO: 341856 - DNA, 75 bp, Artificial Sequence
  Synthetic
tggcatggaatttgcgcgcttcaaatatgctaaatttaaattctttagacatgaatttagatcgtacatagtaac

SEQ ID NO: 341857 - DNA, 75 bp, Artificial Sequence
  Synthetic
ccgctaccatatactaacctacatccatttgtaatgttactaaaaaaacagcacaaagtaattttaagcaaaaag

SEQ ID NO: 341858 - DNA, 75 bp, Artificial Sequence
  Synthetic
gaatgtaatcctagaaaaaaagacaaacctgtagttttaaaaataaaacctccgcctaaactaacttcacaatgg

SEQ ID NO: 341859 - DNA, 75 bp, Artificial Sequence
  Synthetic
tagtacacaaacaaataacaataaaagaaatagaacatgtagcagaagggtggccctattggctatatttcttcg

SEQ ID NO: 341860 - DNA, 75 bp, Artificial Sequence
  Synthetic
atggcctaactcacaaaactacccaccattaaatcaagacaaaaataattttaattggggactaagagctctatg

SEQ ID NO: 341861 - DNA, 75 bp, Artificial Sequence
  Synthetic
aataaagcagccttagatgatgagacaacaatgtttgcacctttcggacccctagtagaaaaagcaaactgggag

SEQ ID NO: 341862 - DNA, 75 bp, Artificial Sequence
  Synthetic
caacaatgtttgcacctttcggacccctagtagaaaaagcaaactgggagggagtagaaactctaccacaattta

SEQ ID NO: 341863 - DNA, 75 bp, Artificial Sequence
  Synthetic
ctcctcaagcacgtccacagactggtaaagagattcaagaccctatagacaaatataaaaacttagcagacccct

SEQ ID NO: 341864 - DNA, 75 bp, Artificial Sequence
  Synthetic
taaagagattcaagaccctatagacaaatataaaaacttagcagacccctcacttaatgtcacaggacatatgga

SEQ ID NO: 341865 - DNA, 75 bp, Artificial Sequence
  Synthetic
cctgtgtccaatctctataaaaacaccccttcaaaatggcggcgggtaacaaaatggcggagggactaagggggg

SEQ ID NO: 341866 - DNA, 75 bp, Artificial Sequence
  Synthetic
ctggccgttgagctacggacactggttccgtacctgtctccctatgagaaggctaaacggacttatattcacggg

SEQ ID NO: 341867 - DNA, 75 bp, Artificial Sequence
  Synthetic
agtttacaaaacttgttccatgaaaaacttaactggaggaatatatggacagcttctaacgtaggcatggaattt

SEQ ID NO: 341868 - DNA, 75 bp, Artificial Sequence
  Synthetic
aacttaactggaggaatatatggacagcttctaacgtaggcatggaatttgctagatttttaagaggaaaattct

SEQ ID NO: 341869 - DNA, 75 bp, Artificial Sequence
  Synthetic
ctacatagtaacatgggatcaggacattccttgtaaacctctcccatatcaaaacttgcaacctctattaatgct

SEQ ID NO: 341870 - DNA, 75 bp, Artificial Sequence
  Synthetic
attccttgtaaacctctcccatatcaaaacttgcaacctctattaatgctactcaaaaaacagcataaattagta

SEQ ID NO: 341871 - DNA, 75 bp, Artificial Sequence
  Synthetic
gcagaaaacagaaaccggtcacattaaaattcagacctccaccaaaattaacatcacaatggagactaagtagag

SEQ ID NO: 341872 - DNA, 75 bp, Artificial Sequence
  Synthetic
aaaattcagacctccaccaaaattaacatcacaatggagactaagtagagaactctctaaaatacctctgattag

SEQ ID NO: 341873 - DNA, 75 bp, Artificial Sequence
  Synthetic
tcagaaccatggctagaagggtggggaaatgcattttacagtgtcctcggatatgaagcttctaaacactccggg

SEQ ID NO: 341874 - DNA, 75 bp, Artificial Sequence
  Synthetic
gaaatgcattttacagtgtcctcggatatgaagcttctaaacactccgggagatggtcaaactggacacaaatga

SEQ ID NO: 341875 - DNA, 75 bp, Artificial Sequence
  Synthetic
cgtaggaaatgcagtctacgttattttactaaaaaaagatgtagatgacaatcccggagatatggctacaaaatt

SEQ ID NO: 341876 - DNA, 75 bp, Artificial Sequence
  Synthetic
atcccggagatatggctacaaaatttgtaacaggacaagggcaacacccagacgctatagatcatatagaaatgg

SEQ ID NO: 341877 - DNA, 75 bp, Artificial Sequence
  Synthetic
atttttttatggacaatcagaacaagacattaaaaaactagcacacgaccaagacatagctagagaatatgccag

SEQ ID NO: 341878 - DNA, 75 bp, Artificial Sequence
  Synthetic
ataggagtcatagggtgggcgagtagcaactatacaacagcaggcagtaatcaaaacaccacagcacaaacacca

SEQ ID NO: 341879 - DNA, 75 bp, Artificial Sequence
  Synthetic
cctatgcaggttcaagaataccaggcgcaggatcaatcaccaatttatttcaaatgggatggccaggagatcaaa

SEQ ID NO: 341880 - DNA, 75 bp, Artificial Sequence
  Synthetic
actggccccccacaaaccaagaacaaaccaattttaactggggactcagaggactctgcgtactcagagataata

SEQ ID NO: 341881 - DNA, 75 bp, Artificial Sequence
  Synthetic
cgatgaatgtacaatgctctcactttttgggccttttgttgaaaaagcaaacacagcctttgctacaaatgaccc

SEQ ID NO: 341882 - DNA, 75 bp, Artificial Sequence
  Synthetic
tcatgacagggttcaccggaaggtctgcaaaattacagctgaaaccacaaagctaacacaataaaccacaaacta

SEQ ID NO: 341883 - DNA, 75 bp, Artificial Sequence
  Synthetic
tgcaaaattacagctgaaaccacaaagctaacacaataaaccacaaactattacaggaaactgcaataaatttag

SEQ ID NO: 341884 - DNA, 75 bp, Artificial Sequence
  Synthetic
ccaaactggagaaatatatgggcagctagtaacgtgggcatggaattcgctagattcttaagaggaaaattctac

SEQ ID NO: 341885 - DNA, 75 bp, Artificial Sequence
  Synthetic
ctagtaacgtgggcatggaattcgctagattcttaagaggaaaattctacttttttagacatccatggagaaact

SEQ ID NO: 341886 - DNA, 75 bp, Artificial Sequence
  Synthetic
accttgtaaaccgctaccatatcaaaacctacatccactattaatgttactaaaaaaacagcacaaattagtact

SEQ ID NO: 341887 - DNA, 75 bp, Artificial Sequence
  Synthetic
aacctacatccactattaatgttactaaaaaaacagcacaaattagtactctcacagcagaactgtaaccctagc

SEQ ID NO: 341888 - DNA, 75 bp, Artificial Sequence
  Synthetic
agaaccatgggtagaaggttggggaaatgctttctactcggtattaggatatgaagccacaaaaacatcaggaag

SEQ ID NO: 341889 - DNA, 75 bp, Artificial Sequence
  Synthetic
aatgaaggatggccatactggttatacttctatggcaaaagtgaaagagacatcaaagcagaagcacacacaaca

SEQ ID NO: 341890 - DNA, 75 bp, Artificial Sequence
  Synthetic
atccaaaatcaaaaaaactaaaaataggagttgtaggatgggctagctctaactacacagcaacaaacagttctc

SEQ ID NO: 341891 - DNA, 75 bp, Artificial Sequence
  Synthetic
taggtgcaggatctatagataatctacatacaaaaggatggccacaagatcaaaactggccaaatacaaacagag

SEQ ID NO: 341892 - DNA, 75 bp, Artificial Sequence
  Synthetic
caaaactggccaaatacaaacagagaacaaacaaattttgattggtctctaagagcactatgcctattaagagat

SEQ ID NO: 341893 - DNA, 75 bp, Artificial Sequence
  Synthetic
taatgacagggctcaggaagtgctgcaaagattacagctaaaaccacaaacacttacacataaccacaaaatatt

SEQ ID NO: 341894 - DNA, 75 bp, Artificial Sequence
  Synthetic
caaagattacagctaaaaccacaaacacttacacataaccacaaaatatttcaggaaactgcaataattttcaac

SEQ ID NO: 341895 - DNA, 75 bp, Artificial Sequence
  Synthetic
acaacattgaccacaggaaactctgcaaaaaagaggaagtaaataccattggctaaatcagaagtcctcattagc

SEQ ID NO: 341896 - DNA, 75 bp, Artificial Sequence
  Synthetic
aatgcactggcgaatggctgagtttatgccgctggatggtagacacgctagtgtctagcagcctgggcgggtgcc

SEQ ID NO: 341897 - DNA, 75 bp, Artificial Sequence
  Synthetic
atgccgctggatggtagacacgctagtgtctagcagcctgggcgggtgccggagctgagacgccagtcacagcgg

SEQ ID NO: 341898 - DNA, 75 bp, Artificial Sequence
  Synthetic
gcaatcctgcggagtgggcctgaatgggggatgtacaaccagacctccactacaggcctcggactcctggtagga

SEQ ID NO: 341899 - DNA, 75 bp, Artificial Sequence
  Synthetic
gggggatgtacaaccagacctccactacaggcctcggactcctggtaggattacccgttggctggatatttgccg

SEQ ID NO: 341900 - DNA, 75 bp, Artificial Sequence
  Synthetic
tgtaagaactggaagggccatctacagctatgcctccgttccgaagacgtcgctggagatggaggagatacccac

SEQ ID NO: 341901 - DNA, 75 bp, Artificial Sequence
  Synthetic
taggcggtatagaagatcttatcgccgcggcagaaaggtaaggagacggagacgatttaaaaggaggagaaggac

SEQ ID NO: 341902 - DNA, 75 bp, Artificial Sequence
  Synthetic
cgcggcagaaaggtaaggagacggagacgatttaaaaggaggagaaggactgctagaatcatccagtggcatcca

SEQ ID NO: 341903 - DNA, 75 bp, Artificial Sequence
  Synthetic
aaggcatctggccgctcctatatggacactggatgagaaatgctctccctatgagaaaacataatggacttttat

SEQ ID NO: 341904 - DNA, 75 bp, Artificial Sequence
  Synthetic
acactggatgagaaatgctctccctatgagaaaacataatggacttttatggctgggaggaggcatagatgtgac

SEQ ID NO: 341905 - DNA, 75 bp, Artificial Sequence
  Synthetic
atggagcacaataatctaagaaatacatggagcagttctaatgaagggatggaattcggccgctttctcaaagcc

SEQ ID NO: 341906 - DNA, 75 bp, Artificial Sequence
  Synthetic
catggagcagttctaatgaagggatggaattcggccgctttctcaaagccactctgtactttcagagacatccca

SEQ ID NO: 341907 - DNA, 75 bp, Artificial Sequence
  Synthetic
ccaagacattacttgtgctttaaaaagagaagagatgcagccttttatctctctgctcaaaaaaaaccataaact

SEQ ID NO: 341908 - DNA, 75 bp, Artificial Sequence
  Synthetic
agagaagagatgcagccttttatctctctgctcaaaaaaaaccataaactcattctaagcagagaccactgcaat

SEQ ID NO: 341909 - DNA, 75 bp, Artificial Sequence
  Synthetic
aactaaaatttaaacctccacccagaatgacttctaaatggtttttacaaagagaactagcacaaatgccacttt

SEQ ID NO: 341910 - DNA, 75 bp, Artificial Sequence
  Synthetic
cttaacaagttactgggtggaaggccgcggaaatgctttttacagcaccttaggatacccaccaaactttagata

SEQ ID NO: 341911 - DNA, 75 bp, Artificial Sequence
  Synthetic
cgcggaaatgctttttacagcaccttaggatacccaccaaactttagatataataatcagaatgcaaacagaagt

SEQ ID NO: 341912 - DNA, 75 bp, Artificial Sequence
  Synthetic
taggatacccaccaaactttagatataataatcagaatgcaaacagaagtgaccactttagatgccgctactttt

SEQ ID NO: 341913 - DNA, 75 bp, Artificial Sequence
  Synthetic
tgcagtttatgttgccagaacagaaaatagacaaaaactacccacagatggaacaggtaacttctggctatcatc

SEQ ID NO: 341914 - DNA, 75 bp, Artificial Sequence
  Synthetic
aatagacaaaaactacccacagatggaacaggtaacttctggctatcatcacaaaatgatgactggcacttgctc

SEQ ID NO: 341915 - DNA, 75 bp, Artificial Sequence
  Synthetic
ttttcttcggaaaaagtgaacatgatctaaaaaaacaagcttttggacaagatgtagatgaaaacccagacatct

SEQ ID NO: 341916 - DNA, 75 bp, Artificial Sequence
  Synthetic
tctaaaaaaacaagcttttggacaagatgtagatgaaaacccagacatctatgtactatgcattatctggtgggc

SEQ ID NO: 341917 - DNA, 75 bp, Artificial Sequence
  Synthetic
cctgcattaaatcaactaacacaatacatgcaatatgattatgtgaggcctaggcctgtagaatacggaggaatc

SEQ ID NO: 341918 - DNA, 75 bp, Artificial Sequence
  Synthetic
acatgcaatatgattatgtgaggcctaggcctgtagaatacggaggaatctcacaaaatttatttaaagacagac

SEQ ID NO: 341919 - DNA, 75 bp, Artificial Sequence
  Synthetic
tccacttcaaaaccaaggttcagaatatcaatggagtgcaagagtactctgctgcatgagagacaattttaaact

SEQ ID NO: 341920 - DNA, 75 bp, Artificial Sequence
  Synthetic
agcagtatgctagccctcttcggtcctatgatgttaaaaagaaacatacaactctcagacaacacaggcaataac

SEQ ID NO: 341921 - DNA, 75 bp, Artificial Sequence
  Synthetic
atggaaacctgctcctaatgtataaatttaaatttcagtggggaggccacggagaggagcgatttgaaacagcca

SEQ ID NO: 341922 - DNA, 75 bp, Artificial Sequence
  Synthetic
ttggagaccccaaaaccattccctgcccagacatttttaacccaggcaccggcaccttccgaacctgggtcagaa

SEQ ID NO: 341923 - DNA, 75 bp, Artificial Sequence
  Synthetic
cctgcaaccctgggaatatgactatgatgggcttgttcgaacagatactctccgacgaatgctacaatactccac

SEQ ID NO: 341924 - DNA, 75 bp, Artificial Sequence
  Synthetic
gatgggcttgttcgaacagatactctccgacgaatgctacaatactccacggaggaggacgaaacacgggagaaa

SEQ ID NO: 341925 - DNA, 75 bp, Artificial Sequence
  Synthetic
gagggaaagggcccttctccgataccagcgatggcagcgataccagcagttccgaaagtttcgattactgcgagg

SEQ ID NO: 341926 - DNA, 75 bp, Artificial Sequence
  Synthetic
tcaagcagcttttcagatttctgaagcgcatcaaaacatgcagataataccctatctctggtccccaaacagggt

SEQ ID NO: 341927 - DNA, 75 bp, Artificial Sequence
  Synthetic
cactttaatcactttctgcccctacacatcaataacataaaccagatacatatccgatcccaaataaaaagacaa

SEQ ID NO: 341928 - DNA, 75 bp, Artificial Sequence
  Synthetic
tcggagtctatttttttcttctacgtggacttcaaaatggcggcggatcacaaaatggcggcgtatggggggggg

SEQ ID NO: 341929 - DNA, 75 bp, Artificial Sequence
  Synthetic
tggacttcaaaatggcggcggatcacaaaatggcggcgtatggggggggggggacccccccaacccccccctttg

SEQ ID NO: 341930 - DNA, 75 bp, Artificial Sequence
  Synthetic
ctttggcggggctggcccccctgcacccccctgggtaaatcaaaaaatgggcgcccggccaggaaccaaaatggc

SEQ ID NO: 341931 - DNA, 75 bp, Artificial Sequence
  Synthetic
cccccctgggtaaatcaaaaaatgggcgcccggccaggaaccaaaatggcggcgtagcgggggggggaccccccc

SEQ ID NO: 341932 - DNA, 75 bp, Artificial Sequence
  Synthetic
cttcccctttttaggtatataagtaagtgcactggcgaatggctgagtttatgccgctggatggtagacacgcta

SEQ ID NO: 341933 - DNA, 75 bp, Artificial Sequence
  Synthetic
tggacttcaaaatggcggcggatcacaaaatggcggcgtatggggggggggggacccccccccacccccccctat

SEQ ID NO: 341934 - DNA, 75 bp, Artificial Sequence
  Synthetic
ccctatgcgggggctgcgccccctgcacccccctggctaagtcacaaaatggcggcgcggcagggataccaaatg

SEQ ID NO: 341935 - DNA, 75 bp, Artificial Sequence
  Synthetic
ccgcaccccccttgtgggggggggaccccccacaccccccggagggggggaaaccccccctcaaccccccgcggg

SEQ ID NO: 341936 - DNA, 75 bp, Artificial Sequence
  Synthetic
accccccacaccccccggagggggggaaaccccccctcaaccccccgcggggggctacgcccccctgcacccccc

SEQ ID NO: 341937 - DNA, 75 bp, Artificial Sequence
  Synthetic
ggagtcagttctgattggtcaggagttcaagtcctcatttgcatagggtgtaaccaatcaagattaaggcgttcc

SEQ ID NO: 341938 - DNA, 75 bp, Artificial Sequence
  Synthetic
cctatgccggaacactgggaggaggcctggttagggagctaccaagggctggcacgacgttgactgctgctgcgg

SEQ ID NO: 341939 - DNA, 75 bp, Artificial Sequence
  Synthetic
cctggttagggagctaccaagggctggcacgacgttgactgctgctgcggtaattggcaggaccacctatggctg

SEQ ID NO: 341940 - DNA, 75 bp, Artificial Sequence
  Synthetic
gcgctttggccgccgccagcttagacgccactatagcggcaagagacgctatggatggagaagacgctactaccg

SEQ ID NO: 341941 - DNA, 75 bp, Artificial Sequence
  Synthetic
cgccactatagcggcaagagacgctatggatggagaagacgctactaccgctacagaccgcgcatctactatcgg

SEQ ID NO: 341942 - DNA, 75 bp, Artificial Sequence
  Synthetic
cggagactatggctggtaaggagaaggcggcgttccgtctaccgacgaggtggacgtagagcgcgcccctaccgc

SEQ ID NO: 341943 - DNA, 75 bp, Artificial Sequence
  Synthetic
ggcggcgttccgtctaccgacgaggtggacgtagagcgcgcccctaccgcattagtggctttaaccctaaagtaa

SEQ ID NO: 341944 - DNA, 75 bp, Artificial Sequence
  Synthetic
gcggccaatactactgtgtcttaaagggcaggtatcactgagatataggccgctgcagtgggacactgaaaaaca

SEQ ID NO: 341945 - DNA, 75 bp, Artificial Sequence
  Synthetic
gggcaggtatcactgagatataggccgctgcagtgggacactgaaaaacagtggagagtaaaagcagattacgag

SEQ ID NO: 341946 - DNA, 75 bp, Artificial Sequence
  Synthetic
atggaggaggatgggggagtggagaggtcacactggaaggattataccaagagcacttactgtggagaaactcct

SEQ ID NO: 341947 - DNA, 75 bp, Artificial Sequence
  Synthetic
ggtcacactggaaggattataccaagagcacttactgtggagaaactcctggtcaaaaggaaatgatggcatgga

SEQ ID NO: 341948 - DNA, 75 bp, Artificial Sequence
  Synthetic
gtgtacctgtacccattacaggaccaagattactggttctggtgggacacagactttaaggaactatacgcagag

SEQ ID NO: 341949 - DNA, 75 bp, Artificial Sequence
  Synthetic
aagattactggttctggtgggacacagactttaaggaactatacgcagagagcatcaaagaatactcacaaccaa

SEQ ID NO: 341950 - DNA, 75 bp, Artificial Sequence
  Synthetic
taaattagtaatagcaagagacagagcaccacacagacgaaaagtgagaaagatttttataccgccaccaagtag

SEQ ID NO: 341951 - DNA, 75 bp, Artificial Sequence
  Synthetic
gcaccacacagacgaaaagtgagaaagatttttataccgccaccaagtagagacacaacgcagtggcaatttcaa

SEQ ID NO: 341952 - DNA, 75 bp, Artificial Sequence
  Synthetic
tcacctgggcggcgggactaattgacatgcaaaagccattcgatgcaaacggcgcgtttagaaacgcgtggtggc

SEQ ID NO: 341953 - DNA, 75 bp, Artificial Sequence
  Synthetic
catgcaaaagccattcgatgcaaacggcgcgtttagaaacgcgtggtggcttgaaacaagaaacgaccagggaga

SEQ ID NO: 341954 - DNA, 75 bp, Artificial Sequence
  Synthetic
agagtgccaccacagggtgacactgaactaccaaaacagagtgattttaaaaagggagacaacaacccaaactat

SEQ ID NO: 341955 - DNA, 75 bp, Artificial Sequence
  Synthetic
aactaccaaaacagagtgattttaaaaagggagacaacaacccaaactataacatacaggaaggtcacgaaaaaa

SEQ ID NO: 341956 - DNA, 75 bp, Artificial Sequence
  Synthetic
ggaccaaaaagaccagaaaacaagaaaaaagtactgtgtatgctacaataaaaccttaaacagatggagaaaggc

SEQ ID NO: 341957 - DNA, 75 bp, Artificial Sequence
  Synthetic
aaaaagtactgtgtatgctacaataaaaccttaaacagatggagaaaggcacaagcgagtacactagctatagga

SEQ ID NO: 341958 - DNA, 75 bp, Artificial Sequence
  Synthetic
aactgatgaatcaagagatgacatactactggaaatccggagaattctcctccccattcatgcagagatggaagg

SEQ ID NO: 341959 - DNA, 75 bp, Artificial Sequence
  Synthetic
ctactggaaatccggagaattctcctccccattcatgcagagatggaagggaactagactaataaccatagacgc

SEQ ID NO: 341960 - DNA, 75 bp, Artificial Sequence
  Synthetic
aaagtaagttcgtgggaatggggacaaaattggaacacaaacggcacagtgcttaaggaagtattcaatataaac

SEQ ID NO: 341961 - DNA, 75 bp, Artificial Sequence
  Synthetic
acgactttgcaaaactgacactgccaaagtcaccacatgatatagactttggacatcacagcagatttggaccat

SEQ ID NO: 341962 - DNA, 75 bp, Artificial Sequence
  Synthetic
aaagtcaccacatgatatagactttggacatcacagcagatttggaccattctgcgtaaaaaacgaaccactaga

SEQ ID NO: 341963 - DNA, 75 bp, Artificial Sequence
  Synthetic
gaggggacgcggaaaagaaaggagaggaaaccgaggaaaccgcgtcatcgaccagtatcacgagtgccgaaagct

SEQ ID NO: 341964 - DNA, 75 bp, Artificial Sequence
  Synthetic
ggaaaccgaggaaaccgcgtcatcgaccagtatcacgagtgccgaaagctctactgaaggtgatggatcgtctga

SEQ ID NO: 341965 - DNA, 75 bp, Artificial Sequence
  Synthetic
ccccgttagctgggttaccgcactaactccctgccaagtgaaactcgggacgagtgagtacgggacatcccgtgt

SEQ ID NO: 341966 - DNA, 75 bp, Artificial Sequence
  Synthetic
cctacacctctccatgggaggatgccgcccccaaaccccccgcgtcggatgggggggctgcgcccccccaaaccc

SEQ ID NO: 341967 - DNA, 75 bp, Artificial Sequence
  Synthetic
cctgtgaatctcgttcacgattgagtgcgggattacccgtgttgtggctaagtaactacacggctttgttgcgac

SEQ ID NO: 341968 - DNA, 75 bp, Artificial Sequence
  Synthetic
tgcgggattacccgtgttgtggctaagtaactacacggctttgttgcgacaatggccgaggctctattcttacac

SEQ ID NO: 341969 - DNA, 75 bp, Artificial Sequence
  Synthetic
taatgacagggctcaggaagtactgcaaatattacagcaaaaaccacaaacacttacacataaccacaaaatatt

SEQ ID NO: 341970 - DNA, 75 bp, Artificial Sequence
  Synthetic
caaatattacagcaaaaaccacaaacacttacacataaccacaaaatatttcaggaaactgcaataattttcaac

SEQ ID NO: 341971 - DNA, 75 bp, Artificial Sequence
  Synthetic
tcaacacaaaccacaggaaactctgcaaaaaagaagaagtaaattctattggctaaatcagaagtcctcattagc

SEQ ID NO: 341972 - DNA, 75 bp, Artificial Sequence
  Synthetic
taggcggtatagaagatcttatcgccgcggcagaaaggtaaggagacggcgccgttatagaaggagaaaaaggac

SEQ ID NO: 341973 - DNA, 75 bp, Artificial Sequence
  Synthetic
cgcggcagaaaggtaaggagacggcgccgttatagaaggagaaaaaggactgctagaatcatccagtggcatcca

SEQ ID NO: 341974 - DNA, 75 bp, Artificial Sequence
  Synthetic
atggagcataataatctaagaaatacatggagcagttcaaatgaggggatggaattcggccgctttctcagagcc

SEQ ID NO: 341975 - DNA, 75 bp, Artificial Sequence
  Synthetic
catggagcagttcaaatgaggggatggaattcggccgctttctcagagccactctgtactttcagagacatccca

SEQ ID NO: 341976 - DNA, 75 bp, Artificial Sequence
  Synthetic
ccaagacattacttgtgctttaaaaagagaagaaatgcagcctttcatctctctgctaaaaaagaaccataaact

SEQ ID NO: 341977 - DNA, 75 bp, Artificial Sequence
  Synthetic
agagaagaaatgcagcctttcatctctctgctaaaaaagaaccataaactcatactaagcagagaccactgtaat

SEQ ID NO: 341978 - DNA, 75 bp, Artificial Sequence
  Synthetic
ttttctttggaaaaagtgaacatgatctaaaaaaacaagcatttggacaagatgtagatgaaaacccagacatct

SEQ ID NO: 341979 - DNA, 75 bp, Artificial Sequence
  Synthetic
tctaaaaaaacaagcatttggacaagatgtagatgaaaacccagacatctatgtcctatgcataatctggtgggc

SEQ ID NO: 341980 - DNA, 75 bp, Artificial Sequence
  Synthetic
ccagctttacaacaattacaacagtaccaacaatatgattatgtgaggcctaggcctgtggaatacggaggagta

SEQ ID NO: 341981 - DNA, 75 bp, Artificial Sequence
  Synthetic
accaacaatatgattatgtgaggcctaggcctgtggaatacggaggagtatcacaaaatttatttaaagacagac

SEQ ID NO: 341982 - DNA, 75 bp, Artificial Sequence
  Synthetic
tccactccaaaaccatggttctgaatatcaatggagtgcccgagtactatgctgcatgagagacaattttaaact

SEQ ID NO: 341983 - DNA, 75 bp, Artificial Sequence
  Synthetic
agcagtatgctagcactatttggacctatgatgttaaaaagaaacatacaactcacagataacacaggcacaaca

SEQ ID NO: 341984 - DNA, 75 bp, Artificial Sequence
  Synthetic
ggcgagacaagagcaccagctcagactcctcaacaagagacgaaagctcaagcagcttttcagatttctgaagcg

SEQ ID NO: 341985 - DNA, 75 bp, Artificial Sequence
  Synthetic
agcagcttttcagatttctgaagcgaatcaaaacatgcagatagtaccctatctctggtccccaaacagggtaaa

SEQ ID NO: 341986 - DNA, 75 bp, Artificial Sequence
  Synthetic
tcaataacataaaccagatacatatccgatcccaaataaaaagacaactttggttccaataaaaacggcggctcg

SEQ ID NO: 341987 - DNA, 75 bp, Artificial Sequence
  Synthetic
acttcaaaatggcggcgggtcacaatatggcggcgtatggggggggggggaccccccccaccccccccatgcggg

SEQ ID NO: 341988 - DNA, 75 bp, Artificial Sequence
  Synthetic
gcggggcctgccccccttgcccccccttaattaagtaaaaaaatggcgccccgccgggaacacaaaatggcgccg

SEQ ID NO: 341989 - DNA, 75 bp, Artificial Sequence
  Synthetic
cttaattaagtaaaaaaatggcgccccgccgggaacacaaaatggcgccgtaggggggggggggaaacccccccc

SEQ ID NO: 341990 - DNA, 75 bp, Artificial Sequence
  Synthetic
accccccacacccccccggagggggggaaaccccccctcaaccccccgcggggggctccgcccccctgcaccccc

SEQ ID NO: 341991 - DNA, 75 bp, Artificial Sequence
  Synthetic
ccacaggaaactgtgcaaaaaagaggaaataaattctattggctgggcctgaagtcctcattagaataataaaag

SEQ ID NO: 341992 - DNA, 75 bp, Artificial Sequence
  Synthetic
tacaaaacttataccatgaaaaactgaactggaggaatatatggacagcctcaaacgtgggcatggaatttgcta

SEQ ID NO: 341993 - DNA, 75 bp, Artificial Sequence
  Synthetic
gaactggaggaatatatggacagcctcaaacgtgggcatggaatttgctagatttctaagagcaaaattttactt

SEQ ID NO: 341994 - DNA, 75 bp, Artificial Sequence
  Synthetic
atcattacttgggaccaagatattccttgtaaacctctaccatatcaaaacttacatcctctccttatgctatta

SEQ ID NO: 341995 - DNA, 75 bp, Artificial Sequence
  Synthetic
cttgtaaacctctaccatatcaaaacttacatcctctccttatgctattaaaaaaacaacataaactagtactct

SEQ ID NO: 341996 - DNA, 75 bp, Artificial Sequence
  Synthetic
aagacaaaaacctgtaactttaaaaataagacctccaccaaaactaacatcacagtggagattaagcagagaact

SEQ ID NO: 341997 - DNA, 75 bp, Artificial Sequence
  Synthetic
ataagacctccaccaaaactaacatcacagtggagattaagcagagaactagcaaaaatgccactcgtaagactg

SEQ ID NO: 341998 - DNA, 75 bp, Artificial Sequence
  Synthetic
aaccatggttagaaggctggggcaatgctttttacagcgtactaggatatgaagccagtaaacactcaggcagat

SEQ ID NO: 341999 - DNA, 75 bp, Artificial Sequence
  Synthetic
tgctttttacagcgtactaggatatgaagccagtaaacactcaggcagatggtcaaactggacacaaataaaata

SEQ ID NO: 342000 - DNA, 75 bp, Artificial Sequence
  Synthetic
ggaaatgctgtctatgtcattctattaaaacaagaagtaagtgacaatccaggtgatatggcgactaaatttgta

SEQ ID NO: 342001 - DNA, 75 bp, Artificial Sequence
  Synthetic
taaaacaagaagtaagtgacaatccaggtgatatggcgactaaatttgtaacaggaacaggacagcatccagatg

SEQ ID NO: 342002 - DNA, 75 bp, Artificial Sequence
  Synthetic
ttttacggacaatcagaacaggacataaaaaaattagcacacgaccaagaaatagcaagagaatatgctaataat

SEQ ID NO: 342003 - DNA, 75 bp, Artificial Sequence
  Synthetic
gagtaataggatgggcaagcagtaactatacaacagcagggagtaatcaaaataatgtttctcaaacaccagaag

SEQ ID NO: 342004 - DNA, 75 bp, Artificial Sequence
  Synthetic
ctatacaacagcagggagtaatcaaaataatgtttctcaaacaccagaagccatacaaggaggatacgtagcata

SEQ ID NO: 342005 - DNA, 75 bp, Artificial Sequence
  Synthetic
ggatcaataacaaacttatttcacgatgcatggccaggagaccaaaactggccacctataaatagagaccaaaca

SEQ ID NO: 342006 - DNA, 75 bp, Artificial Sequence
  Synthetic
atgcatggccaggagaccaaaactggccacctataaatagagaccaaacaaattttaactggggattaagaggac

SEQ ID NO: 342007 - DNA, 75 bp, Artificial Sequence
  Synthetic
gaccttttgtggaaaaagcaaacacagcatttgctacaaatgaccctaaatatttcagacctgaactcaaagact

SEQ ID NO: 342008 - DNA, 75 bp, Artificial Sequence
  Synthetic
agaagtcctcattagaataagaaaagaaccaatcagaatcacttcctcttttaaagtatataagtaagtgcacag

SEQ ID NO: 342009 - DNA, 75 bp, Artificial Sequence
  Synthetic
tgcaaaattacagctaaaaccacaacactaacacaataaaccacaagaaattacaggaaactgcaataaattagg

SEQ ID NO: 342010 - DNA, 75 bp, Artificial Sequence
  Synthetic
ttacaataaaaccacaggaaactctgcaaaaaagaggaaataaaaaccattggctaaatgtgaagtcctcattag

SEQ ID NO: 342011 - DNA, 75 bp, Artificial Sequence
  Synthetic
tatcacaaggtaaggagacggagggtaagaaaagctccggtcattcaatggttcccaccatcaataagaaactgt

SEQ ID NO: 342012 - DNA, 75 bp, Artificial Sequence
  Synthetic
agaaatatatggacagcttctaatgatggcatggaatttgctcgctttaaatatgctaaatttaaattttttaga

SEQ ID NO: 342013 - DNA, 75 bp, Artificial Sequence
  Synthetic
atggcatggaatttgctcgctttaaatatgctaaatttaaattttttagacatgaatttagatcatacgtagtaa

SEQ ID NO: 342014 - DNA, 75 bp, Artificial Sequence
  Synthetic
accgctaccatatactaacctacatccatttgtaatgttattaaaaaagcaacacaaagtaattctaagcaaaag

SEQ ID NO: 342015 - DNA, 75 bp, Artificial Sequence
  Synthetic
ccatttgtaatgttattaaaaaagcaacacaaagtaattctaagcaaaagagaatgtaaccccagaaaaaaagac

SEQ ID NO: 342016 - DNA, 75 bp, Artificial Sequence
  Synthetic
ctccgcctaaactaacatcacaatggagactagcaagagaactaacaaaaatgccactagtaagactaggaatta

SEQ ID NO: 342017 - DNA, 75 bp, Artificial Sequence
  Synthetic
gagactagcaagagaactaacaaaaatgccactagtaagactaggaattagcctgatagactttaaagaaccatg

SEQ ID NO: 342018 - DNA, 75 bp, Artificial Sequence
  Synthetic
tacagcacactaggttatgaagcaaataaagacagcctacaaacatctcaatggtgtcaaataaaatatttctgg

SEQ ID NO: 342019 - DNA, 75 bp, Artificial Sequence
  Synthetic
ataaagacagcctacaaacatctcaatggtgtcaaataaaatatttctggatatatgacaccggagtaaataacc

SEQ ID NO: 342020 - DNA, 75 bp, Artificial Sequence
  Synthetic
agatgctggagacaacccaggagacctagtacaacaaggaaattctataacagaagtagaacaaataggagaagg

SEQ ID NO: 342021 - DNA, 75 bp, Artificial Sequence
  Synthetic
ctagtacaacaaggaaattctataacagaagtagaacaaataggagaaggatggccttactggttatatttcttt

SEQ ID NO: 342022 - DNA, 75 bp, Artificial Sequence
  Synthetic
cgttagcaacaacaaacacaaatatcagaaacgagttcaatcaaaatccagaaagtaaaaaattaaaagtagcgg

SEQ ID NO: 342023 - DNA, 75 bp, Artificial Sequence
  Synthetic
cagaaacgagttcaatcaaaatccagaaagtaaaaaattaaaagtagcggtaataggatgggcttcaagtaataa

SEQ ID NO: 342024 - DNA, 75 bp, Artificial Sequence
  Synthetic
gcaaacacacctattaaaggaacatactttataagtccacatttattacactcaggacacacagcaggagctaca

SEQ ID NO: 342025 - DNA, 75 bp, Artificial Sequence
  Synthetic
actttataagtccacatttattacactcaggacacacagcaggagctacacaaataaataacttatatgaagtag

SEQ ID NO: 342026 - DNA, 75 bp, Artificial Sequence
  Synthetic
accactaaaccaagataaaaataattttgactggggaaagagagcactgtgcatactaagaaacaacataagctt

SEQ ID NO: 342027 - DNA, 75 bp, Artificial Sequence
  Synthetic
tttgactggggaaagagagcactgtgcatactaagaaacaacataagcttaaataaggcagcattagatgatgag

SEQ ID NO: 342028 - DNA, 75 bp, Artificial Sequence
  Synthetic
ccttagtagaaaaggcaaactgggaaggaatagaaacagcaccacaatttaaagaagaactaaaagactataact

SEQ ID NO: 342029 - DNA, 75 bp, Artificial Sequence
  Synthetic
aggaatagaaacagcaccacaatttaaagaagaactaaaagactataacttactgatgagatacatgtttaaatt

SEQ ID NO: 342030 - DNA, 75 bp, Artificial Sequence
  Synthetic
caattcaaaaccagcatcggagaccctagcaccataccctgcccctacgcccccggagatccaccccaatttgcc

SEQ ID NO: 342031 - DNA, 75 bp, Artificial Sequence
  Synthetic
aaggggtcctcaatccgtgggattatgactatgatggaattgttagaaaggacactctcaaaaaactccttgaga

SEQ ID NO: 342032 - DNA, 75 bp, Artificial Sequence
  Synthetic
tgactatgatggaattgttagaaaggacactctcaaaaaactccttgagatcccaacagactcggaaacggagaa

SEQ ID NO: 342033 - DNA, 75 bp, Artificial Sequence
  Synthetic
taatttatgcaaagtaggaggagttgcattttaatttatgcaaagtaggaggagtcaaacctgattggacgggaa

SEQ ID NO: 342034 - DNA, 75 bp, Artificial Sequence
  Synthetic
ggagtcaaacctgattggacgggaaatcaagccctcatttgcatagggtgtaaccaatcagaactaaggcgttcc

SEQ ID NO: 342035 - DNA, 75 bp, Artificial Sequence
  Synthetic
aaggcggcgttccgtctaccgtagaggtggacgtagagcgcgcccctaccgaataagtgcttttaacccgaaagt

SEQ ID NO: 342036 - DNA, 75 bp, Artificial Sequence
  Synthetic
tggtggccaatacttcagtgcctaaaaggacaggaatcacttagatacaggccactacagtgggatgtggaaaaa

SEQ ID NO: 342037 - DNA, 75 bp, Artificial Sequence
  Synthetic
aaggacaggaatcacttagatacaggccactacagtgggatgtggaaaaacaatggagagtaaaaacagactttg

SEQ ID NO: 342038 - DNA, 75 bp, Artificial Sequence
  Synthetic
atacggaggaggttgggggagtggagaggtgacattagaggggctttatcaggaacatttgctatggagaaactc

SEQ ID NO: 342039 - DNA, 75 bp, Artificial Sequence
  Synthetic
gaggtgacattagaggggctttatcaggaacatttgctatggagaaactcatggtcaaaaggaaacgatggaatg

SEQ ID NO: 342040 - DNA, 75 bp, Artificial Sequence
  Synthetic
tagtatacctatacccactaaaagaccgggattactggttttggtgggacacagacttcaaagaactatacgcag

SEQ ID NO: 342041 - DNA, 75 bp, Artificial Sequence
  Synthetic
ccgggattactggttttggtgggacacagacttcaaagaactatacgcagagaacatcaaagagtactcacagcc

SEQ ID NO: 342042 - DNA, 75 bp, Artificial Sequence
  Synthetic
acaaaaatagtgatagctagagacagagcacctcatagaaggaaagtgagaaaaatcttcataccaccaccaagt

SEQ ID NO: 342043 - DNA, 75 bp, Artificial Sequence
  Synthetic
gagcacctcatagaaggaaagtgagaaaaatcttcataccaccaccaagtagagacactacacagtggcagtttc

SEQ ID NO: 342044 - DNA, 75 bp, Artificial Sequence
  Synthetic
attcacatgggcagcaggtctgatagagatgcaaagacctttcgatgccaatggagcgtttagaaacgcgtggtg

SEQ ID NO: 342045 - DNA, 75 bp, Artificial Sequence
  Synthetic
gagatgcaaagacctttcgatgccaatggagcgtttagaaacgcgtggtggttagaaactagaaatgaacaggga

SEQ ID NO: 342046 - DNA, 75 bp, Artificial Sequence
  Synthetic
gaagagtacccccacaaggagacacagagatgccaaaaaagagtgaattcatgaaaggagacaacaaccccaact

SEQ ID NO: 342047 - DNA, 75 bp, Artificial Sequence
  Synthetic
agagatgccaaaaaagagtgaattcatgaaaggagacaacaaccccaactacaatgtgcaggaagggtacgaaaa

SEQ ID NO: 342048 - DNA, 75 bp, Artificial Sequence
  Synthetic
gtcgataaaaaagaccaaaaaccaagaaaaaaatactgcgtatgttacaacaaaacgctaaacagatggcgtaaa

SEQ ID NO: 342049 - DNA, 75 bp, Artificial Sequence
  Synthetic
gaaaaaaatactgcgtatgttacaacaaaacgctaaacagatggcgtaaatcacaggccagtacaatgaatatag

SEQ ID NO: 342050 - DNA, 75 bp, Artificial Sequence
  Synthetic
acagctcatgaaccaggaaatgacatactactggaaaagcggagaatactcctcaccatttatgcagaggtggtc

SEQ ID NO: 342051 - DNA, 75 bp, Artificial Sequence
  Synthetic
tactactggaaaagcggagaatactcctcaccatttatgcagaggtggtcaggttcaagattgatagtaatagac

SEQ ID NO: 342052 - DNA, 75 bp, Artificial Sequence
  Synthetic
caacagtgcaggcatgggaatttggacaaaactggaacacaaaaggcacagtactggagcaagtgttccaaataa

SEQ ID NO: 342053 - DNA, 75 bp, Artificial Sequence
  Synthetic
acaaaactggaacacaaaaggcacagtactggagcaagtgttccaaataagtttggataatagaccgctgagaca

SEQ ID NO: 342054 - DNA, 75 bp, Artificial Sequence
  Synthetic
ccaaaatcaccacacgacatagactttgggcatcacagtagatttggcccattctgcgtaaaaaatgaaccctta

SEQ ID NO: 342055 - DNA, 75 bp, Artificial Sequence
  Synthetic
caactaacctgtggtttcagtacaaattcttctttcagtttggaggtgaataccagccaccaacaggtatcaggg

SEQ ID NO: 342056 - DNA, 75 bp, Artificial Sequence
  Synthetic
cggaggcaacgcaaagtgcacttctccgaggggactcggaaaagaaaggagaggaaaccgaggaaaccacgtcat

SEQ ID NO: 342057 - DNA, 75 bp, Artificial Sequence
  Synthetic
gaaacgctacacagtgtccgctgatttctgggggggtccgggggggcttgcccccccgtaagatgggttaccgca

SEQ ID NO: 342058 - DNA, 75 bp, Artificial Sequence
  Synthetic
tattattggatgtatgatacaggagtaggtaatgcagtatatgtagtactattaaaagataacgtagacgataat

SEQ ID NO: 342059 - DNA, 75 bp, Artificial Sequence
  Synthetic
caggcggtaatccagcggaaccgggccccccctccatggaagaaagatggctgacggtagcgtactgcgcccacg

SEQ ID NO: 342060 - DNA, 75 bp, Artificial Sequence
  Synthetic
gattattctgcggctgtaaagacccgaaaaaacatcttgaaaaatgccttacagacgctatcgcagacgccgaag

SEQ ID NO: 342061 - DNA, 75 bp, Artificial Sequence
  Synthetic
gagaaatatatggacagctagtaacgtgggaatggagttcgctagatttttaagaggaaaattctacttttttag

SEQ ID NO: 342062 - DNA, 75 bp, Artificial Sequence
  Synthetic
acttgggatcaggacattccttgtaaaccgctaccatatcaaaacttacacccactattaatgctactaaaaaaa

SEQ ID NO: 342063 - DNA, 75 bp, Artificial Sequence
  Synthetic
ggagactaagcagagaattagcaaaaatgcctttaattagattaggagtcagcttcatagacttaacagaacctt

SEQ ID NO: 342064 - DNA, 75 bp, Artificial Sequence
  Synthetic
aggagactggcaactaccgtcatccagtgtgatgacacaaaacggagacaacccgaactggaagcctagagacac

SEQ ID NO: 342065 - DNA, 75 bp, Artificial Sequence
  Synthetic
gcactatgcgtgatagacgcaacaggaacaaaggcattagacaatccagacgtatatgtactgacatggaatgag

SEQ ID NO: 342066 - DNA, 75 bp, Artificial Sequence
  Synthetic
ctttgactggggactaagagctttatgtatactcagagataacatgcacttaggaagccaggaattagacgacga

SEQ ID NO: 342067 - DNA, 75 bp, Artificial Sequence
  Synthetic
ccacaggaaactctgcaaaaaagaggaaataaattctattggctgggccataagtcctcattagaatacaaaaag

SEQ ID NO: 342068 - DNA, 75 bp, Artificial Sequence
  Synthetic
acttcaaacctgaactaaaggactataatataatcatgaaatatgtctttaaatttcagtggggaggacacggca

SEQ ID NO: 342069 - DNA, 75 bp, Artificial Sequence
  Synthetic
tgcgggggctccgcctcctgcacccccgtgcgggggggcaaccccccctcaaccccccgcggggggcaagccccc

SEQ ID NO: 342070 - DNA, 75 bp, Artificial Sequence
  Synthetic
ccccgcaccccccatgcgggggctccgcctcctgcacccccgtgcgggggggcaaccccccctcaaccccccgcg

SEQ ID NO: 342071 - DNA, 75 bp, Artificial Sequence
  Synthetic
tacattaaaaccacaggaaactctgcaaaaataaggaagtaaataccattggctaaacctgaagtcctcattagc

SEQ ID NO: 342072 - DNA, 75 bp, Artificial Sequence
  Synthetic
caccctcctagccggagaacgtgcactataactgggttctggccgttgagctacggacactggttccgtacctgt

SEQ ID NO: 342073 - DNA, 75 bp, Artificial Sequence
  Synthetic
ctataactgggttctggccgttgagctacggacactggttccgtacctgtctccccttccgacgaatgaacgggc

SEQ ID NO: 342074 - DNA, 75 bp, Artificial Sequence
  Synthetic
acgaatggagatcatatgtaataacttgggatcaagatataccttgtaaaccattaccatatactaatctacatc

SEQ ID NO: 342075 - DNA, 75 bp, Artificial Sequence
  Synthetic
ttgggatcaagatataccttgtaaaccattaccatatactaatctacatcctttattaatgttattaaaaagaca

SEQ ID NO: 342076 - DNA, 75 bp, Artificial Sequence
  Synthetic
gactgtaaccctagcaaaaaggcaagaccagtaacattaagaataagacctcctccaaaactaacaagtcaatgg

SEQ ID NO: 342077 - DNA, 75 bp, Artificial Sequence
  Synthetic
gaccagtaacattaagaataagacctcctccaaaactaacaagtcaatggagactagccagagaattatcaaaaa

SEQ ID NO: 342078 - DNA, 75 bp, Artificial Sequence
  Synthetic
cttcatagacttgtcagaaccatggttagaaggatggggaaatgcattttatagcttactaggctatgaggcacc

SEQ ID NO: 342079 - DNA, 75 bp, Artificial Sequence
  Synthetic
ttagaaggatggggaaatgcattttatagcttactaggctatgaggcaccataccaacaaggtagaaatacatac

SEQ ID NO: 342080 - DNA, 75 bp, Artificial Sequence
  Synthetic
tatatgacacaggagtaaataatgctgtatatatactactactaaaagatgacataggagacaatccaggagata

SEQ ID NO: 342081 - DNA, 75 bp, Artificial Sequence
  Synthetic
tgtatatatactactactaaaagatgacataggagacaatccaggagatatggcaaaaaattactatgatggagg

SEQ ID NO: 342082 - DNA, 75 bp, Artificial Sequence
  Synthetic
gaaaaagcgtcagaaaattggccatactggctttatttctttggaagatcagaattagatataaaaaacttagca

SEQ ID NO: 342083 - DNA, 75 bp, Artificial Sequence
  Synthetic
actggctttatttctttggaagatcagaattagatataaaaaacttagcaacaaacacacaaataagaaatgaac

SEQ ID NO: 342084 - DNA, 75 bp, Artificial Sequence
  Synthetic
aataaaaatagctgtaataggatgggcaccaagcaatataacagacaaagatagctcacaaaacccaggatcagg

SEQ ID NO: 342085 - DNA, 75 bp, Artificial Sequence
  Synthetic
acatactaccacactggaggagtaataggagcaggggcaatagataatttattcaaaaaaggatggccagcaacc

SEQ ID NO: 342086 - DNA, 75 bp, Artificial Sequence
  Synthetic
tctatttgggccttttgtaggcaaagcaaacacagcactaataacatcagtaccaaaagactatagacctgaact

SEQ ID NO: 342087 - DNA, 75 bp, Artificial Sequence
  Synthetic
tagcagacccctcactcaatgtcacaggacacttagaaaacttcatgagactacacatacaaaacatcacagaaa

SEQ ID NO: 342088 - DNA, 75 bp, Artificial Sequence
  Synthetic
tcatgacagggttcaccggaagggctgcaaaattacagctaaaaccacaattctaacacaataaaccacaaacta

SEQ ID NO: 342089 - DNA, 75 bp, Artificial Sequence
  Synthetic
aacttacacccattattaatgctattaaaaaaacaacacaaattagtactctcacaacaaaactgtaaccctaac

SEQ ID NO: 342090 - DNA, 75 bp, Artificial Sequence
  Synthetic
aatgcattttattcaatattaggatacgaagcagaaaaaactcaaggacgtgtttctaattgggcacaaattaaa

SEQ ID NO: 342091 - DNA, 75 bp, Artificial Sequence
  Synthetic
taggaaacgccgtatatgttataatgttaaaaaaggaaacacaatcaaatccaggacaaatggtaaaaaactttc

SEQ ID NO: 342092 - DNA, 75 bp, Artificial Sequence
  Synthetic
ccaggacaaatggtaaaaaactttccagcagaacatggaagacatccagacgctatagaccatatagaattaata

SEQ ID NO: 342093 - DNA, 75 bp, Artificial Sequence
  Synthetic
acccaaactccttgaagctaaaaataggaatagtaggatgggcatcttcaaactttacaacaccaggtagtgttc

SEQ ID NO: 342094 - DNA, 75 bp, Artificial Sequence
  Synthetic
gcaggaggagcaggaaaatataatttaggagctggatccatagataatttacaccaaaaaggctggcctaataat

SEQ ID NO: 342095 - DNA, 75 bp, Artificial Sequence
  Synthetic
gcagagacgaagacaccacaagccaagcaagcgacgactcctcaagcacctccagcgggtggtaaagaggatgaa

SEQ ID NO: 342096 - DNA, 75 bp, Artificial Sequence
  Synthetic
ccccccaccccccatgcgcttgcccccccgcggggggttgagggggggttcccccccctcccgagggaacagggg

SEQ ID NO: 342097 - DNA, 75 bp, Artificial Sequence
  Synthetic
ctacatgaaggagaaagactactgggaagaggcctggctgaccagctgtacatccatacacgaccatcactgcaa

SEQ ID NO: 342098 - DNA, 75 bp, Artificial Sequence
  Synthetic
tacaagccaatggacttaagagtcgaggcaaactggatattcaataaagacggcagtaagatagagacagaacag

SEQ ID NO: 342099 - DNA, 75 bp, Artificial Sequence
  Synthetic
gagggtggtcaagtggagtaatcagcttagaaggacttttcaatgaaaacagactgtggagaaatatatggtcaa

SEQ ID NO: 342100 - DNA, 75 bp, Artificial Sequence
  Synthetic
cttagaaggacttttcaatgaaaacagactgtggagaaatatatggtcaaagagcaatgacgggatggacttagt

SEQ ID NO: 342101 - DNA, 75 bp, Artificial Sequence
  Synthetic
ctatatccgacagagaatcaggactacttgttctggtatgacacagaatttgacgaacagcaaaggaaaatgcta

SEQ ID NO: 342102 - DNA, 75 bp, Artificial Sequence
  Synthetic
acagtacacaatggtcctatagacagatggagaaaaaaacagacaggaactttaaagctctctgcactgagaggg

SEQ ID NO: 342103 - DNA, 75 bp, Artificial Sequence
  Synthetic
gtgagacttactataagtggacagcatcagaatttacaggggcatttcagcaggactggtggccagttagcggaa

SEQ ID NO: 342104 - DNA, 75 bp, Artificial Sequence
  Synthetic
atcagaatttacaggggcatttcagcaggactggtggccagttagcggaacagaatacccgctatgcactattaa

SEQ ID NO: 342105 - DNA, 75 bp, Artificial Sequence
  Synthetic
acagtggaggtatggtcctggagagcaacaataccacaaacagggactcttaaagactacttcggactgggtaca

SEQ ID NO: 342106 - DNA, 75 bp, Artificial Sequence
  Synthetic
agaaactatagccagagcatggggggggctccgccccaacaacccccccggtgggggccaaggacccccctacac

SEQ ID NO: 342107 - DNA, 75 bp, Artificial Sequence
  Synthetic
caaaaataaggaagtaaataccattggctaaatctgaagtcctcattagcataataaaagaaccaatcagaaaca

SEQ ID NO: 342108 - DNA, 75 bp, Artificial Sequence
  Synthetic
agcgtactgcgcgcacggattattctgcaactgtaaagatccaaaaaaacatcttgaaaaatgcctttcagacgc

SEQ ID NO: 342109 - DNA, 75 bp, Artificial Sequence
  Synthetic
ctatacacagtggagtttacaaaacttttatcatgaaaaattaaactggagaaatatatggacatcctctaatgt

SEQ ID NO: 342110 - DNA, 75 bp, Artificial Sequence
  Synthetic
ttttatcatgaaaaattaaactggagaaatatatggacatcctctaatgtaggaatggaatatgctagatttata

SEQ ID NO: 342111 - DNA, 75 bp, Artificial Sequence
  Synthetic
atgaatggagatcatatgtaataacttgggatcaggatataccttgtaaaccattaccatatactaacctacatc

SEQ ID NO: 342112 - DNA, 75 bp, Artificial Sequence
  Synthetic
ttgggatcaggatataccttgtaaaccattaccatatactaacctacatcctttattgatgttattaaaaagaca

SEQ ID NO: 342113 - DNA, 75 bp, Artificial Sequence
  Synthetic
gactgtaaccctagcaaaaaggcaagaccagtaactttaagaataaaacctccaccaaaactaaccagtcaatgg

SEQ ID NO: 342114 - DNA, 75 bp, Artificial Sequence
  Synthetic
gaccagtaactttaagaataaaacctccaccaaaactaaccagtcaatggagactagccagagaattatcaaaaa

SEQ ID NO: 342115 - DNA, 75 bp, Artificial Sequence
  Synthetic
cttcatagacttgtcagaaccctggttagaaggctggggaaatgcattttatggcttattaggatatgaagcacc

SEQ ID NO: 342116 - DNA, 75 bp, Artificial Sequence
  Synthetic
ttagaaggctggggaaatgcattttatggcttattaggatatgaagcaccatatcaacaaggaagacaatgtcac

SEQ ID NO: 342117 - DNA, 75 bp, Artificial Sequence
  Synthetic
tatatgacacaggggtaaacaatgcagtatatataattttacttaaacaagacataggagataacccaggagcat

SEQ ID NO: 342118 - DNA, 75 bp, Artificial Sequence
  Synthetic
agtatatataattttacttaaacaagacataggagataacccaggagcattagcaaaaaactattatgatgcaca

SEQ ID NO: 342119 - DNA, 75 bp, Artificial Sequence
  Synthetic
gaaaaagtatcagaaaactggccatactggctatacttttttggacgctcagaattagacattaaaaacttagca

SEQ ID NO: 342120 - DNA, 75 bp, Artificial Sequence
  Synthetic
actggctatacttttttggacgctcagaattagacattaaaaacttagcaacaagtacaaaaataagaaacgaac

SEQ ID NO: 342121 - DNA, 75 bp, Artificial Sequence
  Synthetic
agtaaaaataggagtaataggatgggcatcaagtaatttaacagacaaagacagtgaacaaagccaaggtcaacc

SEQ ID NO: 342122 - DNA, 75 bp, Artificial Sequence
  Synthetic
gcatcaagtaatttaacagacaaagacagtgaacaaagccaaggtcaaccacaacaaatacaaggaaactacatt

SEQ ID NO: 342123 - DNA, 75 bp, Artificial Sequence
  Synthetic
gagcaggagctatagataatttattcctaaagggttggaaacaagaacaaaactatccaccaataaaccatgatg

SEQ ID NO: 342124 - DNA, 75 bp, Artificial Sequence
  Synthetic
cctaaagggttggaaacaagaacaaaactatccaccaataaaccatgatggaactaattttgattggggcaccag

SEQ ID NO: 342125 - DNA, 75 bp, Artificial Sequence
  Synthetic
atgaaactaggcccacaaccaatagacgatgcgacaacaatgttatctttatttggacctttcgtagacaaagca

SEQ ID NO: 342126 - DNA, 75 bp, Artificial Sequence
  Synthetic
acgatgcgacaacaatgttatctttatttggacctttcgtagacaaagcaaacacagcactaataacatctgtac

SEQ ID NO: 342127 - DNA, 75 bp, Artificial Sequence
  Synthetic
aaaattcagacctccaccaaaattaacatcacaatggagactaagtagagaactctctaaaatacccttaattag

SEQ ID NO: 342128 - DNA, 75 bp, Artificial Sequence
  Synthetic
tcagaaccatggatagaaggctggggaaatgctttttacagtgtcctcggatatgaggcctctaaacactcaggg

SEQ ID NO: 342129 - DNA, 75 bp, Artificial Sequence
  Synthetic
gaaatgctttttacagtgtcctcggatatgaggcctctaaacactcagggagatggtcaaactggacacaaatga

SEQ ID NO: 342130 - DNA, 75 bp, Artificial Sequence
  Synthetic
cgttggaaatgcagtctatgttattttactaaaacaagaggtaactgataatccaggagacatggctacaaaatt

SEQ ID NO: 342131 - DNA, 75 bp, Artificial Sequence
  Synthetic
atccaggagacatggctacaaaatttgtaacaggtactgggcaacatccagacgctatagatcatatagaaatgg

SEQ ID NO: 342132 - DNA, 75 bp, Artificial Sequence
  Synthetic
ataggagtcataggatgggcgagcagtaactatacaacagcaggcagtaatcaaaaccaaacagctcaaacacca

SEQ ID NO: 342133 - DNA, 75 bp, Artificial Sequence
  Synthetic
actggccccccacaaaccaagaccaaacaaattttaactgggcactcagaggactctgcatactcagagataata

SEQ ID NO: 342134 - DNA, 75 bp, Artificial Sequence
  Synthetic
agcagacccctcactcaatgtcacaggacacatggaaaaattcatgcaactgcacatacaaaacatacaagaaat

SEQ ID NO: 342135 - DNA, 75 bp, Artificial Sequence
  Synthetic
cccttccggtgaaccctgtcatgaggggggtgcaggggggcttgccccccgcggggggttgagggggggtttccc

SEQ ID NO: 342136 - DNA, 75 bp, Artificial Sequence
  Synthetic
gcaagacaggcagatacacaaaacccgaaagtgctatcatggccagtagaaggaaactggaccacgagtaacaca

SEQ ID NO: 342137 - DNA, 75 bp, Artificial Sequence
  Synthetic
cacacaacactgcacatagggggcgtaattgggatcgttagaaaactatggccgagcatgggggggggctccgcc

SEQ ID NO: 342138 - DNA, 75 bp, Artificial Sequence
  Synthetic
tggggggctgccgccccccaaaccccctgcgtcggatggggggggctgcgccccccccaaaccccccttgcccgg

SEQ ID NO: 342139 - DNA, 75 bp, Artificial Sequence
  Synthetic
taatgacagggttcaccggaaaggctgcaaaattacagctaaaaccacaacactaacacaataaaccacaaaata

SEQ ID NO: 342140 - DNA, 75 bp, Artificial Sequence
  Synthetic
aaaaaccgcaccccccttgcgggggctccgccccctgcacccccgggagggggggaaaccccccctcaacccccc

SEQ ID NO: 342141 - DNA, 75 bp, Artificial Sequence
  Synthetic
gtttacaaaacttataccatgaaaaacttaactggagaaatatatggacagcttctaatgttggcatggaatttg

SEQ ID NO: 342142 - DNA, 75 bp, Artificial Sequence
  Synthetic
cttcttcagacacccctggagaagctatattattacttgggaccaagacattccttgcaaacctttaccatacca

SEQ ID NO: 342143 - DNA, 75 bp, Artificial Sequence
  Synthetic
tatattattacttgggaccaagacattccttgcaaacctttaccataccaaaacttacatccactacttatgcta

SEQ ID NO: 342144 - DNA, 75 bp, Artificial Sequence
  Synthetic
tatctcaaaaagactgtaatccaaacagaagacaaaaaccagtaactttaaaaataagacctccaccaaaattaa

SEQ ID NO: 342145 - DNA, 75 bp, Artificial Sequence
  Synthetic
cagaagacaaaaaccagtaactttaaaaataagacctccaccaaaattaacatcacagtggagattaagcagaga

SEQ ID NO: 342146 - DNA, 75 bp, Artificial Sequence
  Synthetic
ctaggagtcagtctaatagacctctcagaaccatggttagaaggctggggaaatgctttttacagcgtactggga

SEQ ID NO: 342147 - DNA, 75 bp, Artificial Sequence
  Synthetic
cagaaccatggttagaaggctggggaaatgctttttacagcgtactgggatatgaagctagtaaacactcaggga

SEQ ID NO: 342148 - DNA, 75 bp, Artificial Sequence
  Synthetic
atacttctggatatatgacacaggagtaggaaatgcagtttatgtcattttattaaaacaagaggtggatgataa

SEQ ID NO: 342149 - DNA, 75 bp, Artificial Sequence
  Synthetic
gtaggaaatgcagtttatgtcattttattaaaacaagaggtggatgataatccaggggcaatggcaacaaaattt

SEQ ID NO: 342150 - DNA, 75 bp, Artificial Sequence
  Synthetic
atgccatagacaggatcgaacaaataaatgaaggatggccttactggcttttcttttacggacagtcagaacaag

SEQ ID NO: 342151 - DNA, 75 bp, Artificial Sequence
  Synthetic
aaatgaaggatggccttactggcttttcttttacggacagtcagaacaagacataaaaaaattagcacacgatca

SEQ ID NO: 342152 - DNA, 75 bp, Artificial Sequence
  Synthetic
aatccaaaatctaaaaaattaaaaataggagtgataggatgggctagcagtaactttacaacagcaggcagctca

SEQ ID NO: 342153 - DNA, 75 bp, Artificial Sequence
  Synthetic
taggagtgataggatgggctagcagtaactttacaacagcaggcagctcacaaaatcaaacaccacaaacaccag

SEQ ID NO: 342154 - DNA, 75 bp, Artificial Sequence
  Synthetic
atatgcaggctcaaaaatacaaggagcaggagcaattacaaacttatacacagatgcatggccgggagaccaaaa

SEQ ID NO: 342155 - DNA, 75 bp, Artificial Sequence
  Synthetic
ttggccacctctaaatagagaacaaacaaactttaactggggcttaagaggactctgtataatgagagataatat

SEQ ID NO: 342156 - DNA, 75 bp, Artificial Sequence
  Synthetic
aacacttcggagttcaggaggctcaatttggctcgcttcgctcgcaccacgtttgcagccaggcggacctaattg

SEQ ID NO: 342157 - DNA, 75 bp, Artificial Sequence
  Synthetic
ggcggggggtggagtttatgcaaattaatttatgcaaagtaggaggagctctgttttaatttatgcaaagtagga

SEQ ID NO: 342158 - DNA, 75 bp, Artificial Sequence
  Synthetic
ctcaagtcctcatttgcatagggtgtaaccaatcaaattcaaggcgttcccagtaaaggaaatataagtaagtgc

SEQ ID NO: 342159 - DNA, 75 bp, Artificial Sequence
  Synthetic
aagacgctatggctggaggaggcgctactaccgctaccgaccgcgttactatagacgacgatggctggtaaggag

SEQ ID NO: 342160 - DNA, 75 bp, Artificial Sequence
  Synthetic
tactaccgctaccgaccgcgttactatagacgacgatggctggtaaggagaaggcggcgttccgtctaccgaaga

SEQ ID NO: 342161 - DNA, 75 bp, Artificial Sequence
  Synthetic
gaattagtgcttttaacccgaaagtaatgcgaagggtagtaattagagggtggtggccaatacttcaatgtctga

SEQ ID NO: 342162 - DNA, 75 bp, Artificial Sequence
  Synthetic
aatgcgaagggtagtaattagagggtggtggccaatacttcaatgtctgaaaggacaggaatccctcagatatag

SEQ ID NO: 342163 - DNA, 75 bp, Artificial Sequence
  Synthetic
cagtggagagtaaagagcgattttgaggacagctacggatacttagtacaatatggtggtggttggggaagtgga

SEQ ID NO: 342164 - DNA, 75 bp, Artificial Sequence
  Synthetic
aggacagctacggatacttagtacaatatggtggtggttggggaagtggagaagtaacactagagggactatatc

SEQ ID NO: 342165 - DNA, 75 bp, Artificial Sequence
  Synthetic
gtggtcaaaaggaaatgatggaatggaccttgtgagatactttggctgcttagtatatctatacccacttaaaga

SEQ ID NO: 342166 - DNA, 75 bp, Artificial Sequence
  Synthetic
gaccttgtgagatactttggctgcttagtatatctatacccacttaaagatcaggactactggttttggtgggat

SEQ ID NO: 342167 - DNA, 75 bp, Artificial Sequence
  Synthetic
aaaacattaaagagtactctcagccctcagttatgatgatggcgaaaagaacaaaaatagtcatagccagggaca

SEQ ID NO: 342168 - DNA, 75 bp, Artificial Sequence
  Synthetic
ctcagttatgatgatggcgaaaagaacaaaaatagtcatagccagggacagagcaccacatagaaggaaagtgag

SEQ ID NO: 342169 - DNA, 75 bp, Artificial Sequence
  Synthetic
agagacacaacacagtggcaatttcaaactgatttctgtaatagacccttattcacatgggcagcaggactgatt

SEQ ID NO: 342170 - DNA, 75 bp, Artificial Sequence
  Synthetic
aaactgatttctgtaatagacccttattcacatgggcagcaggactgattgagatgcaaaggccttttgacgcaa

SEQ ID NO: 342171 - DNA, 75 bp, Artificial Sequence
  Synthetic
gttagagacaagaaatgaggcgggagagatgaaatacgtagaactatggggtagagtaccaccacaaggagacac

SEQ ID NO: 342172 - DNA, 75 bp, Artificial Sequence
  Synthetic
gagatgaaatacgtagaactatggggtagagtaccaccacaaggagacacagaaatgccaaagaagagtgaattt

SEQ ID NO: 342173 - DNA, 75 bp, Artificial Sequence
  Synthetic
ataatgtacaggacgggtacgaaaagaatatatacccgattatagtgtatgtagacaaaaaagaccagaaaccaa

SEQ ID NO: 342174 - DNA, 75 bp, Artificial Sequence
  Synthetic
gaatatatacccgattatagtgtatgtagacaaaaaagaccagaaaccaagaaaaaagtactgcgtatgctataa

SEQ ID NO: 342175 - DNA, 75 bp, Artificial Sequence
  Synthetic
tcacaggctagcacaatgaacattggtgacctgcaaggtctagtgctaagacaactgatgaaccaggaaatgaca

SEQ ID NO: 342176 - DNA, 75 bp, Artificial Sequence
  Synthetic
gtgacctgcaaggtctagtgctaagacaactgatgaaccaggaaatgacatactactggaaagcaggagaatatt

SEQ ID NO: 342177 - DNA, 75 bp, Artificial Sequence
  Synthetic
aggagcaagattaatagtaatagacgcaagaacagcagacacaacaaatccaacagtgcaggcttgggaatttgg

SEQ ID NO: 342178 - DNA, 75 bp, Artificial Sequence
  Synthetic
gcaagaacagcagacacaacaaatccaacagtgcaggcttgggaatttggacaaaactggaacacaaaaaacact

SEQ ID NO: 342179 - DNA, 75 bp, Artificial Sequence
  Synthetic
gtctagaaaacaaaccactgagacaggacgacttcgcaaaactaacactaccaaaatcaccacacgacatagact

SEQ ID NO: 342180 - DNA, 75 bp, Artificial Sequence
  Synthetic
ggacgacttcgcaaaactaacactaccaaaatcaccacacgacatagacttcggacaccacagtagatttggacc

SEQ ID NO: 342181 - DNA, 75 bp, Artificial Sequence
  Synthetic
gaattccaagtatacccccctacccctactaacttgtggtttcagtacaaattcttctttcagtttggcggtgaa

SEQ ID NO: 342182 - DNA, 75 bp, Artificial Sequence
  Synthetic
attcttctttcagtttggcggtgaataccaaccaccaacaggtatcagggatccctgctctgataacccagccta

SEQ ID NO: 342183 - DNA, 75 bp, Artificial Sequence
  Synthetic
acacaccccaaattcgccggaaaaggaggaatgctcacggaaacagaccgttggggtatcactgctgcctcgtcc

SEQ ID NO: 342184 - DNA, 75 bp, Artificial Sequence
  Synthetic
tcatgacagggttcaccggaagggctgcaaaattacagctaaaaccacaagtctaacacaacaaaccacaaagta

SEQ ID NO: 342185 - DNA, 75 bp, Artificial Sequence
  Synthetic
agatttttgagaggaaaattttacttcttcagacacccctggagaagctatatagtaacatgggaccaagacata

SEQ ID NO: 342186 - DNA, 75 bp, Artificial Sequence
  Synthetic
acttacaacctctattaatgctcctcaaaaaacaacataaattagtcctctctcaaaaagattgcaacccgaata

SEQ ID NO: 342187 - DNA, 75 bp, Artificial Sequence
  Synthetic
ctaaaaaaagaagtgagtgacaatccaggagacatggctactcaatttgtaacaggaccaggacaacacccagac

SEQ ID NO: 342188 - DNA, 75 bp, Artificial Sequence
  Synthetic
aacaggaccaggacaacacccagacgctatagaacatatagaaatggttaatgaaggatggccttactggctatt

SEQ ID NO: 342189 - DNA, 75 bp, Artificial Sequence
  Synthetic
ttaaatttcagtggggaggacatggcaccgaaagatttaaaacaaccatcggagaccccagcaccataccctgtc

SEQ ID NO: 342190 - DNA, 75 bp, Artificial Sequence
  Synthetic
ccacggggtacaagaccccgccaaggtacaaaacacagtactcaacccatgggactatgactgtgacgggattgt

SEQ ID NO: 342191 - DNA, 75 bp, Artificial Sequence
  Synthetic
gtacaaaacacagtactcaacccatgggactatgactgtgacgggattgttagaacagatactctcaaaaaactt

SEQ ID NO: 342192 - DNA, 75 bp, Artificial Sequence
  Synthetic
agaaggagaaagcgttcccactccttggacaaaaaacagagaaagagctattatcagactcagacgaagagagcg

SEQ ID NO: 342193 - DNA, 75 bp, Artificial Sequence
  Synthetic
tggacaaaaaacagagaaagagctattatcagactcagacgaagagagcgttatctcaagcacgagcagtggatc

SEQ ID NO: 342194 - DNA, 75 bp, Artificial Sequence
  Synthetic
agcggcctcctgtgtccaatctatttttcctaaaccctttcaaaatggcgggcggaacacaaaatggcggaggga

SEQ ID NO: 342195 - DNA, 75 bp, Artificial Sequence
  Synthetic
tacaataaaaccacaggaaactctgcaaaaaaagaggaagaaaatttcattggctaaatcagaagtcctcattag

SEQ ID NO: 342196 - DNA, 75 bp, Artificial Sequence
  Synthetic
atatgcaaaatttaagttttttagacatgaattcagatcttatatagtaacatgggatcaggacataccatgtaa

SEQ ID NO: 342197 - DNA, 75 bp, Artificial Sequence
  Synthetic
gcggctgggacacaaaatggcggcgtagtgggggggggacccccccacacccccctgcagggggggggacccccc

SEQ ID NO: 342198 - DNA, 75 bp, Artificial Sequence
  Synthetic
gaaagcaaaatccagtaacattaaaattcaaaccgccaccgaaattaacttcacaatggaaactaagcagggaat

SEQ ID NO: 342199 - DNA, 75 bp, Artificial Sequence
  Synthetic
atgctttttactctgtattaggatatgaagccacaaaaacatctggaaggtggtcaaattgggcacagatgaaat

SEQ ID NO: 342200 - DNA, 75 bp, Artificial Sequence
  Synthetic
tgtgtccaatctatttttcttacaccccttcaaaatggcgggagggacacaaaatggcggagggactaagggggg

SEQ ID NO: 342201 - DNA, 75 bp, Artificial Sequence
  Synthetic
atcataacacaataaaccacaaaatattacaggaaactgcaataaatttagaaataaattacacataaccaccta

SEQ ID NO: 342202 - DNA, 75 bp, Artificial Sequence
  Synthetic
ggaaccctcctagccggaggacctgcctcatagaggggttctggccgttgagctacggacactggttccgtacct

SEQ ID NO: 342203 - DNA, 75 bp, Artificial Sequence
  Synthetic
taagaggaaaattctacttttttagacatccttggagaaactatatagtgacttgggatcaggacattccttgta

SEQ ID NO: 342204 - DNA, 75 bp, Artificial Sequence
  Synthetic
ccaccaccaaaactaacttcacaatggagactaagtagagaattagcaaaaatgccactcattagactaggagtt

SEQ ID NO: 342205 - DNA, 75 bp, Artificial Sequence
  Synthetic
ggctagaaggttgggggaatgcattttactcagtactaggatatgaagccataaaagaccaaggacactggtcaa

SEQ ID NO: 342206 - DNA, 75 bp, Artificial Sequence
  Synthetic
gatatatgatacaggagtaggaaatgctgtatatgtagttatgctaaaaaaagacgtagacgacaacccaggaaa

SEQ ID NO: 342207 - DNA, 75 bp, Artificial Sequence
  Synthetic
atcacatagaattaataaatgaaggatggccctactggttatacttttttggtaaaagtgaacaagacataaaaa

SEQ ID NO: 342208 - DNA, 75 bp, Artificial Sequence
  Synthetic
aagagaatatgctagagatccaaaatcaaaaaaactaaaaataggaatagtaggatgggcatcctctaacttcac

SEQ ID NO: 342209 - DNA, 75 bp, Artificial Sequence
  Synthetic
ggatcaataggaaatttgtaccaacaaggatggccatctaatcaaaactggccaaatacaaacagagacgaaaca

SEQ ID NO: 342210 - DNA, 75 bp, Artificial Sequence
  Synthetic
gagaccccagcaccataccctgccccttcgaacccggggaccgcttccacagcgggatacaagacccctccaagg

SEQ ID NO: 342211 - DNA, 75 bp, Artificial Sequence
  Synthetic
ccgcaccccccatgcgggggctccgccccctgcacccccgggagggggggaaaccccccctcaaccccccgcggg

SEQ ID NO: 342212 - DNA, 75 bp, Artificial Sequence
  Synthetic
tggacactatgcgctttagacgacgcagatttggccgccgccgcagatattatagaaagagaagaggcggatgga

SEQ ID NO: 342213 - DNA, 75 bp, Artificial Sequence
  Synthetic
acttgttctggtatgacacagagtttgacgaacagcaaaggaaaatgctagatgaatacacacagcctagtgtta

SEQ ID NO: 342214 - DNA, 75 bp, Artificial Sequence
  Synthetic
aatagtctgtaaacagaagatgccaattagacgccgagttaaaagtatctttataccgccaccagcacagttaac

SEQ ID NO: 342215 - DNA, 75 bp, Artificial Sequence
  Synthetic
attagacgccgagttaaaagtatctttataccgccaccagcacagttaacaactcagtggaaatttcagcaagaa

SEQ ID NO: 342216 - DNA, 75 bp, Artificial Sequence
  Synthetic
gggcctgtatctgtatagacacggacacgccgttcgactacaacggcgcatggagaaacgcctggtggttaatga

SEQ ID NO: 342217 - DNA, 75 bp, Artificial Sequence
  Synthetic
tggagaaacgcctggtggttaatgagaaggctacaaaacggaaacatggagtacatagaaagatgggggagaatt

SEQ ID NO: 342218 - DNA, 75 bp, Artificial Sequence
  Synthetic
aggggtgaacaaaaacttcaaaccgacaggtattcaaagaatataccccatagtagcagtgtgcctagcagaggg

SEQ ID NO: 342219 - DNA, 75 bp, Artificial Sequence
  Synthetic
acagtacacaatggaccaatagacagatggagaaaaaaacagacaggaactttaaaactatcggcactgagaggc

SEQ ID NO: 342220 - DNA, 75 bp, Artificial Sequence
  Synthetic
gatggagaaaaaaacagacaggaactttaaaactatcggcactgagaggcctagtactaagagtatgctcagaaa

SEQ ID NO: 342221 - DNA, 75 bp, Artificial Sequence
  Synthetic
atcagaatttacaggggcatttcaacaggactggtggccagttagcggaacagaatatccgctatgtaccattaa

SEQ ID NO: 342222 - DNA, 75 bp, Artificial Sequence
  Synthetic
caggactggtggccagttagcggaacagaatatccgctatgtaccattaaaatggacccagaatacgaaaacccc

SEQ ID NO: 342223 - DNA, 75 bp, Artificial Sequence
  Synthetic
caaccataccaacatcagggactctgaaagacaacttcggactcagttcagggcaacagtggaaggacagtaact

SEQ ID NO: 342224 - DNA, 75 bp, Artificial Sequence
  Synthetic
cagccacaatgttgactttgggcataaagctagatttggcccattttgtgcgaaaaaacctccagtggaattcag

SEQ ID NO: 342225 - DNA, 75 bp, Artificial Sequence
  Synthetic
taatgacagggttcaccggaagggctgcaaaattacagctaaaaccacaatactaacacaataaaccacaaacta

SEQ ID NO: 342226 - DNA, 75 bp, Artificial Sequence
  Synthetic
ccacaggaaactctgcaaaaaagaggaaataaattctattggctgggccagaagtcctcattagaataagtaaag

SEQ ID NO: 342227 - DNA, 75 bp, Artificial Sequence
  Synthetic
aggacctgcctcatagagggtttctggccgttgagctacggacactggttccgtacctgtctcccctttagaaga

SEQ ID NO: 342228 - DNA, 75 bp, Artificial Sequence
  Synthetic
tttacagaacttataccatgaaaaacttaactggagaaatatatggacagctagtaatgtgggcatggaattcgc

SEQ ID NO: 342229 - DNA, 75 bp, Artificial Sequence
  Synthetic
ttttttagacatccgtggagaaactacatagtgacttgggatcaggacattccttgtaaaccgctaccatatcag

SEQ ID NO: 342230 - DNA, 75 bp, Artificial Sequence
  Synthetic
tccttgtaaaccgctaccatatcagaacttacacccactacttatgttactaaaaaaacaacacaaactagtact

SEQ ID NO: 342231 - DNA, 75 bp, Artificial Sequence
  Synthetic
aattcagaccaccacctaaactcacatcgcaatggagactaagcagagaattagcaaaaatgcccttaataagac

SEQ ID NO: 342232 - DNA, 75 bp, Artificial Sequence
  Synthetic
agaaccatggctagaaggctggggaaatgcattctactctattttaggatacgaagcaacaaaactacaggggca

SEQ ID NO: 342233 - DNA, 75 bp, Artificial Sequence
  Synthetic
aatgcattctactctattttaggatacgaagcaacaaaactacaggggcatatttcaaattgggcacaaataaaa

SEQ ID NO: 342234 - DNA, 75 bp, Artificial Sequence
  Synthetic
taggaaacgcagtatacgtagtaatgttaaaacaagagacacaatcaaatccaggacaaatggtaaaaaactttc

SEQ ID NO: 342235 - DNA, 75 bp, Artificial Sequence
  Synthetic
gttaaaacaagagacacaatcaaatccaggacaaatggtaaaaaactttccaaccactcaaggcagacatccaga

SEQ ID NO: 342236 - DNA, 75 bp, Artificial Sequence
  Synthetic
aatgaaggatggccatactggctatacttctatggtaaaagcgaacaagacattaaaaaagaggcacatagcaca

SEQ ID NO: 342237 - DNA, 75 bp, Artificial Sequence
  Synthetic
acttctatggtaaaagcgaacaagacattaaaaaagaggcacatagcacagaaatagcaagagaatatgcacaaa

SEQ ID NO: 342238 - DNA, 75 bp, Artificial Sequence
  Synthetic
aggaatagtaggatgggcatcatcaaactatacagcaacaggcagtgtacaaaatgatagtggacctatagcagc

SEQ ID NO: 342239 - DNA, 75 bp, Artificial Sequence
  Synthetic
aactatacagcaacaggcagtgtacaaaatgatagtggacctatagcagctatacaaggaggatacgtagcatgg

SEQ ID NO: 342240 - DNA, 75 bp, Artificial Sequence
  Synthetic
taggagctggagccatagataacttacaccaaaaaggctggccaaataatcaaaactggccaaacacaaacgcag

SEQ ID NO: 342241 - DNA, 75 bp, Artificial Sequence
  Synthetic
atgaaacaaactttaactggggactcagagcactttgtatacttagagataacatgactttgggaactcaagaat

SEQ ID NO: 342242 - DNA, 75 bp, Artificial Sequence
  Synthetic
acctagcagacccctcactcaatgtcacaggacacatggaaaattttatgcgcttacacgttcaaaacatacacg

SEQ ID NO: 342243 - DNA, 75 bp, Artificial Sequence
  Synthetic
cacaaaatggcggcgcggctgggacacaaaatggcggcgtagcggggggggggacccccccgcaccccccctgcg

SEQ ID NO: 342244 - DNA, 75 bp, Artificial Sequence
  Synthetic
aaattcagaccaccacctaaactaacctcacaatggagactaagcagagaattagcaaaaatgcctttaattaga

SEQ ID NO: 342245 - DNA, 75 bp, Artificial Sequence
  Synthetic
gaccctaaatactttagaccagaactaaaagactataatttaatcatgaaatatgcctttaaattccagtgggga

SEQ ID NO: 342246 - DNA, 75 bp, Artificial Sequence
  Synthetic
tcacaggacacatggaaaaattcatgcaactacacatacaaaacgtacaagaaataagagctaaaaatgctaaaa

SEQ ID NO: 342247 - DNA, 75 bp, Artificial Sequence
  Synthetic
tcatgacagggttcaccggaagggctgcaaaattacagctaaaaccacaagactaacacaacaaaccacaaacta

SEQ ID NO: 342248 - DNA, 75 bp, Artificial Sequence
  Synthetic
aaaaatggactaatatttacgggaggaggttgtgactggactcagtggagtttacaaaaccttttccatgaaaaa

SEQ ID NO: 342249 - DNA, 75 bp, Artificial Sequence
  Synthetic
ctagtaacgtgggaatggaatttgccagatttttaagagaaaaattctacttttttagacatccttggagaaact

SEQ ID NO: 342250 - DNA, 75 bp, Artificial Sequence
  Synthetic
aacttacacccattattaatgctactaaaaaaacaacacaaaatagtactcccacaacaaaactgtaaccctaac

SEQ ID NO: 342251 - DNA, 75 bp, Artificial Sequence
  Synthetic
tttgaaaatggcgcccaaacatggcggcggggggcggagtttatgcaaattaatttatgcaaagtaggaggagct

SEQ ID NO: 342252 - DNA, 75 bp, Artificial Sequence
  Synthetic
tggtggccaatattacagtgtctaaaaggacaggaatcactaagatatagaccactgcagtgggacactgaaaaa

SEQ ID NO: 342253 - DNA, 75 bp, Artificial Sequence
  Synthetic
aaggacaggaatcactaagatatagaccactgcagtgggacactgaaaaacagtggagagtaaagaaagactatg

SEQ ID NO: 342254 - DNA, 75 bp, Artificial Sequence
  Synthetic
gtacggaggaggttgggggagtggtgaagtgacattggagggattatatcaggaacacttactctggagaaactc

SEQ ID NO: 342255 - DNA, 75 bp, Artificial Sequence
  Synthetic
gaagtgacattggagggattatatcaggaacacttactctggagaaactcttggtcaaagggaaatgatggcatg

SEQ ID NO: 342256 - DNA, 75 bp, Artificial Sequence
  Synthetic
tagtatacctgtacccactgcaggaccaagactactggttttggtgggatacagactttaaagaactatacgcag

SEQ ID NO: 342257 - DNA, 75 bp, Artificial Sequence
  Synthetic
ccaagactactggttttggtgggatacagactttaaagaactatacgcagagagcatcaaagaatactcccagcc

SEQ ID NO: 342258 - DNA, 75 bp, Artificial Sequence
  Synthetic
actagactagtaatagctagagacagagcaccacacagaagaagagtaagaaaaattttcatacccccgccaagc

SEQ ID NO: 342259 - DNA, 75 bp, Artificial Sequence
  Synthetic
gagcaccacacagaagaagagtaagaaaaattttcatacccccgccaagcagagacaccacacaatggcaatttc

SEQ ID NO: 342260 - DNA, 75 bp, Artificial Sequence
  Synthetic
attcacatgggcggcaggattaatagacatgcagaaaccatttgatgcaaacggagcgtttagaaacgcctggtg

SEQ ID NO: 342261 - DNA, 75 bp, Artificial Sequence
  Synthetic
gacatgcagaaaccatttgatgcaaacggagcgtttagaaacgcctggtggctagaaacaaggaatgaccaggga

SEQ ID NO: 342262 - DNA, 75 bp, Artificial Sequence
  Synthetic
gaagggtgccaccacagggtgacacagaactgccaaaacagagtgagtttaagaagggagataataaccctaact

SEQ ID NO: 342263 - DNA, 75 bp, Artificial Sequence
  Synthetic
agaactgccaaaacagagtgagtttaagaagggagataataaccctaactataacataacggaaggacatgaaaa

SEQ ID NO: 342264 - DNA, 75 bp, Artificial Sequence
  Synthetic
gttgaccagaaagaccagaaaacaagaaaaaaatactgtgtatgctacaacaaaactttaaatagatggagaaaa

SEQ ID NO: 342265 - DNA, 75 bp, Artificial Sequence
  Synthetic
gaaaaaaatactgtgtatgctacaacaaaactttaaatagatggagaaaagcccaggcgagtacattagcaatag

SEQ ID NO: 342266 - DNA, 75 bp, Artificial Sequence
  Synthetic
tcagcttatgaatcaggagatgacatactactggaaatcgggagagttttcctcaccattcctgcaaagatggaa

SEQ ID NO: 342267 - DNA, 75 bp, Artificial Sequence
  Synthetic
tactactggaaatcgggagagttttcctcaccattcctgcaaagatggaaaggaactaggctaataaccatagac

SEQ ID NO: 342268 - DNA, 75 bp, Artificial Sequence
  Synthetic
caaaagtaagttcgtgggaatgggggcaaaactggaacacaagcggaacagtgctacaggaggtattcaacattt

SEQ ID NO: 342269 - DNA, 75 bp, Artificial Sequence
  Synthetic
ggatgactttgcaaaattgacactgccaaagtcaccacatgacatagactttggacatcacagcagatttggacc

SEQ ID NO: 342270 - DNA, 75 bp, Artificial Sequence
  Synthetic
ccaaagtcaccacatgacatagactttggacatcacagcagatttggaccattctgtgttaaaaacgaaccacta

SEQ ID NO: 342271 - DNA, 75 bp, Artificial Sequence
  Synthetic
cgacgaatggaccacaagcgacagcgacttcattgatacccccataagagaaagatgcctcaataaaaaacaaaa

SEQ ID NO: 342272 - DNA, 75 bp, Artificial Sequence
  Synthetic
cacgagactcactgcaagtgcggtaactggagaaaccacctctggacactatgcgctttagacgacgcagatttg

SEQ ID NO: 342273 - DNA, 75 bp, Artificial Sequence
  Synthetic
aggtggtggatacacgacggaaattggccatcaaggtatcaccgctgcctctctccgagccatcagtgcagctcc

SEQ ID NO: 342274 - DNA, 75 bp, Artificial Sequence
  Synthetic
gctgctgccccccaaaccccccgcgtcggatggggggggctgcgcccccccccaaaccccccttgcccggggctg

SEQ ID NO: 342275 - DNA, 75 bp, Artificial Sequence
  Synthetic
caattttaatttatgcaaagtaggaggagtcaaatctgattggtcgggagctcaagtcctcatttgcatagggtg

SEQ ID NO: 342276 - DNA, 75 bp, Artificial Sequence
  Synthetic
ggagtcaaatctgattggtcgggagctcaagtcctcatttgcatagggtgtaacctatcacatttaaggcgttcc

SEQ ID NO: 342277 - DNA, 75 bp, Artificial Sequence
  Synthetic
gtggttagaacctagaaacgaggcaggtgaaatggactatataacactctggggtcgagtaccaccacagggaga

SEQ ID NO: 342278 - DNA, 75 bp, Artificial Sequence
  Synthetic
tggagcacaagcgacgacgattttcagagtgatggggggtacagacctataaacaaaaaaataaagaaaccgctt

SEQ ID NO: 342279 - DNA, 75 bp, Artificial Sequence
  Synthetic
tgggggggtccgggggggcttgcccccccgttagctgggttaccgcactaactccctgccaagtgaaactcgggg

SEQ ID NO: 342280 - DNA, 75 bp, Artificial Sequence
  Synthetic
ttttttagacatccgtggagaaactatataataacttgggatcaagatataccctgtaaaccgctaccgtatcaa

SEQ ID NO: 342281 - DNA, 75 bp, Artificial Sequence
  Synthetic
gatcaatagacaatttacaccttagagcatggcctcaggaccaaaactggccaaacacaaacagagaccaaacta

SEQ ID NO: 342282 - DNA, 75 bp, Artificial Sequence
  Synthetic
atgtatcctaagagacaatatgaaactaggagatcaagacttagacgatgaaacaactatgctctcactatttgg

SEQ ID NO: 342283 - DNA, 75 bp, Artificial Sequence
  Synthetic
taatctaatcatgaaatatgcctttaaattccagtggggaggacacggcacagaaagatttaaaaccaacatcgg

SEQ ID NO: 342284 - DNA, 75 bp, Artificial Sequence
  Synthetic
agctaaacaaccaaccattgagacaagatgacttccacaaacttggactaccaaaatcgccacatgacattgact

SEQ ID NO: 342285 - DNA, 75 bp, Artificial Sequence
  Synthetic
gaaataaatttcacataaccaccaaaccacaggaaactctgcaaaaaagaggaaataaattctattggctgggcc

SEQ ID NO: 342286 - DNA, 75 bp, Artificial Sequence
  Synthetic
accccccatgcgggggctccgcccctgcacccccttgctaagtcacaaaatggcggcgcggcaaggacacaaaat

SEQ ID NO: 342287 - DNA, 75 bp, Artificial Sequence
  Synthetic
ccgccccctgcacccccgggagggggggaaaccccccctcaacccccgcggggggcaagcccccctgcacccccc

SEQ ID NO: 342288 - DNA, 75 bp, Artificial Sequence
  Synthetic
aataaaccacaaagtattacaggaaactgcaataaatttagaaataaattacacataaccaccaaaccacaggaa

SEQ ID NO: 342289 - DNA, 75 bp, Artificial Sequence
  Synthetic
actgcaataaatttagaaataaattacacataaccaccaaaccacaggaaactgtgcaaaaaagaggaaataaat

SEQ ID NO: 342290 - DNA, 75 bp, Artificial Sequence
  Synthetic
ctgggcgggtgccggagctcctgagagcggagtcaaggggcctatcgggcaggcggtaatccagcggaaccgggc

SEQ ID NO: 342291 - DNA, 75 bp, Artificial Sequence
  Synthetic
cggattattctgcggctgtaaaaacccgaaaaaacatctagaaaaatgccttacagacgctatcgcagacgccgg

SEQ ID NO: 342292 - DNA, 75 bp, Artificial Sequence
  Synthetic
tgcctcatagagggcttctggccgttgagctacggacactggttccgtacctgtctccctatgagaaggctaaac

SEQ ID NO: 342293 - DNA, 75 bp, Artificial Sequence
  Synthetic
gtgactggactcaatggagtttacaaaatttataccacgaaaaacttaactggaggaatatatggacagcttcta

SEQ ID NO: 342294 - DNA, 75 bp, Artificial Sequence
  Synthetic
taacttgggaccaggacattccttgcagaccattaccttatcaaaacttacatcctctacttatgctattaaaaa

SEQ ID NO: 342295 - DNA, 75 bp, Artificial Sequence
  Synthetic
cagaccattaccttatcaaaacttacatcctctacttatgctattaaaaaaacaacacaaattagtattatctca

SEQ ID NO: 342296 - DNA, 75 bp, Artificial Sequence
  Synthetic
taagcctaatagacttatcagaaccgtggctagaaggatggggaaatgcattttatagtgttttaggatatgaag

SEQ ID NO: 342297 - DNA, 75 bp, Artificial Sequence
  Synthetic
tggatatatgacacaggagtaggaaatgcagtatatgttatacttctaaaaaaagaaatagacgataatccagga

SEQ ID NO: 342298 - DNA, 75 bp, Artificial Sequence
  Synthetic
cagcgtcgcaacatccagacgcaatacatcatatagaaatgataaatgaaggatggccatactggctatactttt

SEQ ID NO: 342299 - DNA, 75 bp, Artificial Sequence
  Synthetic
acatcatatagaaatgataaatgaaggatggccatactggctatacttttatggacaatcagaacaagacatcaa

SEQ ID NO: 342300 - DNA, 75 bp, Artificial Sequence
  Synthetic
gtagcagaatattcaagaaacccaaaatctaaaaaactaaaaataggagtaacaggatgggcaagtagtaacttt

SEQ ID NO: 342301 - DNA, 75 bp, Artificial Sequence
  Synthetic
aatctaaaaaactaaaaataggagtaacaggatgggcaagtagtaactttacaacagcaggtagcgtacaaaata

SEQ ID NO: 342302 - DNA, 75 bp, Artificial Sequence
  Synthetic
aaaaggaggatatgtagcatatccaggagctaaaatacccggagcaggatcaataagtaatttattcacagacgg

SEQ ID NO: 342303 - DNA, 75 bp, Artificial Sequence
  Synthetic
ccaacaaaccctgatcaaacaaattttgactggggaaaaagaggactatgtatactaagagataatatgagactg

SEQ ID NO: 342304 - DNA, 75 bp, Artificial Sequence
  Synthetic
ttttgtagaaaaagcaaacacagcatttgctacaaatgaccctaaatacttcagaccagaactaaaagactataa

SEQ ID NO: 342305 - DNA, 75 bp, Artificial Sequence
  Synthetic
cctcctgtgtccaatctatttttcctacaccccttcaaaatggcgggcgggacacaaaatggcggagggactaag

SEQ ID NO: 342306 - DNA, 75 bp, Artificial Sequence
  Synthetic
taatgacagggctcaccggaaaggctgcaaaattacagctaaaaccacaacgctaacacaataaaccacaagaaa

SEQ ID NO: 342307 - DNA, 75 bp, Artificial Sequence
  Synthetic
tttcaataaaaccacaggaaactctgcaaaaaagaggaaataaataccattggctaattctgaagccctcattag

SEQ ID NO: 342308 - DNA, 75 bp, Artificial Sequence
  Synthetic
ctcatatttctgggcggtggaatagactggactgtttggactttacaaaatttatacaatgaaaaacttaactgg

SEQ ID NO: 342309 - DNA, 75 bp, Artificial Sequence
  Synthetic
atggaatggaatttgctagatttagatatgcaaagtttaaattttttagacatgaattcagatcctacgtagtaa

SEQ ID NO: 342310 - DNA, 75 bp, Artificial Sequence
  Synthetic
atatgcaaagtttaaattttttagacatgaattcagatcctacgtagtaacatgggatcaagacataccttgtaa

SEQ ID NO: 342311 - DNA, 75 bp, Artificial Sequence
  Synthetic
cccatggtcatgctactaaaaaaacaacataaagtagtactaagcaaacaagaatgtaaccctagaaaaaaagat

SEQ ID NO: 342312 - DNA, 75 bp, Artificial Sequence
  Synthetic
aacataaagtagtactaagcaaacaagaatgtaaccctagaaaaaaagataggcctgtaactttaaaaataagac

SEQ ID NO: 342313 - DNA, 75 bp, Artificial Sequence
  Synthetic
gagactctctagagaactagctaaaatacccctactaagattaggattctctttaatagacttcaaagaaccatg

SEQ ID NO: 342314 - DNA, 75 bp, Artificial Sequence
  Synthetic
atacccctactaagattaggattctctttaatagacttcaaagaaccatggctagaaggatatggaaatgctttt

SEQ ID NO: 342315 - DNA, 75 bp, Artificial Sequence
  Synthetic
acatgtcaagccaaaaaactagtgaatggtgccaatgtaaatatttttggatttatgactcaggagtaggtaacc

SEQ ID NO: 342316 - DNA, 75 bp, Artificial Sequence
  Synthetic
atggtgccaatgtaaatatttttggatttatgactcaggagtaggtaaccatgtctatgtagtgatgctacaaaa

SEQ ID NO: 342317 - DNA, 75 bp, Artificial Sequence
  Synthetic
ttagcagcacaatcaaatactatagatcatatagaacaaataggagaaggatacccttactggctattctttttt

SEQ ID NO: 342318 - DNA, 75 bp, Artificial Sequence
  Synthetic
atcatatagaacaaataggagaaggatacccttactggctattcttttttggaagatcagaaagagacttaaaag

SEQ ID NO: 342319 - DNA, 75 bp, Artificial Sequence
  Synthetic
tagaaatgaattcaatgcaaatccaaacagcaaaaaacttaaaataggaatcataggatgggtatctagcaataa

SEQ ID NO: 342320 - DNA, 75 bp, Artificial Sequence
  Synthetic
aacagcaaaaaacttaaaataggaatcataggatgggtatctagcaataacacagctgcagatagtagtcaagga

SEQ ID NO: 342321 - DNA, 75 bp, Artificial Sequence
  Synthetic
acagaatatcacatgttttacagacctcaggacacacaggaggagcagcagcaattgataacttatgggaaaatg

SEQ ID NO: 342322 - DNA, 75 bp, Artificial Sequence
  Synthetic
ctcaggacacacaggaggagcagcagcaattgataacttatgggaaaatgggtggcctaactcacaaaactaccc

SEQ ID NO: 342323 - DNA, 75 bp, Artificial Sequence
  Synthetic
ttagattttagcaaaagaggactatgtatacttagaaacaacatgaaactaggacaacaacccttagatgatgag

SEQ ID NO: 342324 - DNA, 75 bp, Artificial Sequence
  Synthetic
gtatacttagaaacaacatgaaactaggacaacaacccttagatgatgagaccacaatgttctcactctttggac

SEQ ID NO: 342325 - DNA, 75 bp, Artificial Sequence
  Synthetic
aggcgctgaatctacaatacaactaaaacctgaactaaaggactataatattttaatgagatataactttcgttt

SEQ ID NO: 342326 - DNA, 75 bp, Artificial Sequence
  Synthetic
aaaccctgatggaacgaaaaaaatacaaatcccgcgtacagcgaaaaccccccccccacccccgattggtccaaa

SEQ ID NO: 342327 - DNA, 75 bp, Artificial Sequence
  Synthetic
cggggggtgaaaggtcacgggggcgtaaaaaaactaaacagcctcgaagggtgaaactcgaccacctcgacgtaa

SEQ ID NO: 342328 - DNA, 75 bp, Artificial Sequence
  Synthetic
tacaaaacctcatttgcatacacacaaaaaggggaagtgaacctgattggacgaaaccagaagacctcatttgca

SEQ ID NO: 342329 - DNA, 75 bp, Artificial Sequence
  Synthetic
gtaaggggggggcgggtgaccgccccccccttagaccccccccggggggggcagagcccccccctgcaccccccc

SEQ ID NO: 342330 - DNA, 75 bp, Artificial Sequence
  Synthetic
taccacgcaaatgaactgacgcaaaaccgccgaaattcggcggaaggaggaaacttctcccattggacagaacca

SEQ ID NO: 342331 - DNA, 75 bp, Artificial Sequence
  Synthetic
gaagacctcatttgcattgacgtgtcacttcctcattggacgaaaactatataaagaaccggggtgacgaatggc

SEQ ID NO: 342332 - DNA, 75 bp, Artificial Sequence
  Synthetic
tgagtttactccgccgggtgtaggagacgcgaccggagggagaggcatccgcagcccgtgggcgggacccgcaga

SEQ ID NO: 342333 - DNA, 75 bp, Artificial Sequence
  Synthetic
gcattccgaaggtatgcggcgcgtgtaggggcaattcgggcacgggctcccgggcggaccgggcaaggttctctg

SEQ ID NO: 342334 - DNA, 75 bp, Artificial Sequence
  Synthetic
gggtgcccgcggcgaagccgcccgtactaaggcgataatgaaactaaccttagctacctgctgccgcaacagaac

SEQ ID NO: 342335 - DNA, 75 bp, Artificial Sequence
  Synthetic
cggggccgaccctggcgagatactacaaactacagacggcgccgatgcagcggcggacccaggagctgatatgga

SEQ ID NO: 342336 - DNA, 75 bp, Artificial Sequence
  Synthetic
aggagctagttgacaacagccacaagctattctgtaactgcatggacccgcagaaccactaccgcctcatctgcc

SEQ ID NO: 342337 - DNA, 75 bp, Artificial Sequence
  Synthetic
agaacctgaaccgggaaccgggagagccatggcgtacggccggaggtattggagaaggaggcgctggaggagacg

SEQ ID NO: 342338 - DNA, 75 bp, Artificial Sequence
  Synthetic
gggcggccgctggtggcgaaggagacgtccatggaagacccgctggcgcagaagacggagaagatggcgccgacg

SEQ ID NO: 342339 - DNA, 75 bp, Artificial Sequence
  Synthetic
ccgctatggccgccgcgctcgccgctttcgaagacgccaccgggtaggtcgctggagaaaactatttaggcgggt

SEQ ID NO: 342340 - DNA, 75 bp, Artificial Sequence
  Synthetic
gaagagcagggtagtcagacaatgggaccccaatgtaaccagacgatgcatgataaacgggtacgaccacgcact

SEQ ID NO: 342341 - DNA, 75 bp, Artificial Sequence
  Synthetic
gttctggggacaacaggcacaacacagaatactatatgacaacctaccctggcctataaaaaaagaagggacaca

SEQ ID NO: 342342 - DNA, 75 bp, Artificial Sequence
  Synthetic
agagggaggcagtatgaacatgatgcaactcacgttacaattcctgtacaaggacaacctagcagggagaaacag

SEQ ID NO: 342343 - DNA, 75 bp, Artificial Sequence
  Synthetic
gtggacgagaagtaactgggacatggacctagcaaaataccacgaaaccaccttactgttccccagacacagaaa

SEQ ID NO: 342344 - DNA, 75 bp, Artificial Sequence
  Synthetic
ctacagctacgtagtgttcatcaccagagggccaaacgacatcctagacgaacacacatacccagggctgcaccc

SEQ ID NO: 342345 - DNA, 75 bp, Artificial Sequence
  Synthetic
agaaaagatgctaggcaggagaaaaaagatagtagtatggagcaaagacctgagaccacatgggaaaaactacat

SEQ ID NO: 342346 - DNA, 75 bp, Artificial Sequence
  Synthetic
aagggtcagggtaccaccaccacaagtattcaaaaaccaatggtacttccagagagacatctgccaaatgcccat

SEQ ID NO: 342347 - DNA, 75 bp, Artificial Sequence
  Synthetic
cctgacactaggtttcgccgcctttgacccagtaaacgtcacattagcgggaaacatggccaacagctccataat

SEQ ID NO: 342348 - DNA, 75 bp, Artificial Sequence
  Synthetic
cctctggggaatcccatactggagcagacccatgccatacaacacctggtatgactactggaccaagtgcgcagg

SEQ ID NO: 342349 - DNA, 75 bp, Artificial Sequence
  Synthetic
accacaaaacataccctggtcagacagacaaaccaacatagcagcgggaataactcaaaaatccgcacaaacatg

SEQ ID NO: 342350 - DNA, 75 bp, Artificial Sequence
  Synthetic
cctaaaactgaaaaacaaacacttcggactaacaaacacagccatagtcagtgactacgacaaagacaacataga

SEQ ID NO: 342351 - DNA, 75 bp, Artificial Sequence
  Synthetic
caaaaacacaaaacaaataaaaacaatagtaatgagcctaaacagatggtacccaaaatggccaatgaaatggaa

SEQ ID NO: 342352 - DNA, 75 bp, Artificial Sequence
  Synthetic
agacgcaggagacataaacacacagacaccattcccatacagatactcatggagagaagaccaagggtggggaaa

SEQ ID NO: 342353 - DNA, 75 bp, Artificial Sequence
  Synthetic
caaagtcagactatggaccagagagtgcagaacagacataccagaagaaacactaggaatagaaaacatgccact

SEQ ID NO: 342354 - DNA, 75 bp, Artificial Sequence
  Synthetic
gtacgtactgatgaatggctacatagactacgtcacaaaccacagcacacacagcccactaaactgggtagtctc

SEQ ID NO: 342355 - DNA, 75 bp, Artificial Sequence
  Synthetic
agtcttctgcccttacacagacccgccaatgaccaacgtaatcccagtagggaaagactggttcatacaaaacgt

SEQ ID NO: 342356 - DNA, 75 bp, Artificial Sequence
  Synthetic
agaaccgggagaaaacaaatacccctcagataatgcagacaacacatttgcaccaggagaaaaaacaaaaattaa

SEQ ID NO: 342357 - DNA, 75 bp, Artificial Sequence
  Synthetic
gaactacgacagcagcaaagacgaattcacaggaaacgtaataagagccccagacgtatacgactccctaccagc

SEQ ID NO: 342358 - DNA, 75 bp, Artificial Sequence
  Synthetic
acaacaagcactgtacatagccagtcccttcagcctaaaatgggcacaaaccacaggctccattgtcttctttta

SEQ ID NO: 342359 - DNA, 75 bp, Artificial Sequence
  Synthetic
ccagagcaaatggacctggggcggggacttccccagacagagaccaatcattgatccgtgcaacagaccgaagtg

SEQ ID NO: 342360 - DNA, 75 bp, Artificial Sequence
  Synthetic
gggagggctacccgttaccggttatgacgagacaggactattactgcaaaatccggaaaaagcggaggccagggc

SEQ ID NO: 342361 - DNA, 75 bp, Artificial Sequence
  Synthetic
gaggggacacctcggcgacctcagacggggggacctcaccaaaacggcccttaagagactcatggaacttacttc

SEQ ID NO: 342362 - DNA, 75 bp, Artificial Sequence
  Synthetic
cacagaggagggcagcccacaaaaaaagaagagaagagacaaggaggtcagaactaccgccgacctactacggcc

SEQ ID NO: 342363 - DNA, 75 bp, Artificial Sequence
  Synthetic
cgaagacgtctactgctggatgtcgccgaccccagagacgcccccgaaagctggaaagacgccagagtccagctt

SEQ ID NO: 342364 - DNA, 75 bp, Artificial Sequence
  Synthetic
tgcggaaacctacgacaaccacaccaaactcgcgaaaagggtcaagaaagagatccacaaccagaacagaagaca

SEQ ID NO: 342365 - DNA, 75 bp, Artificial Sequence
  Synthetic
cagactcctcctggcccacctacgaagagagcgagaccgactcctgggtcaccacctcctccgatagcgacgagt

SEQ ID NO: 342366 - DNA, 75 bp, Artificial Sequence
  Synthetic
accccccaaaaaccagaagagcgcacaaaactgcccctcgccttcgcctataaagacctctgggaagccatgacc

SEQ ID NO: 342367 - DNA, 75 bp, Artificial Sequence
  Synthetic
caaaaagactggggagaagaaaaccaaggcatgctaaccggagccacgtggttagacgagtgccaatcagcgtac

SEQ ID NO: 342368 - DNA, 75 bp, Artificial Sequence
  Synthetic
ctgtggggcaggaaacccagacacagctgggcggatcccccggaaagcctagacaactggtcatttaaaacacac

SEQ ID NO: 342369 - DNA, 75 bp, Artificial Sequence
  Synthetic
ccctttcacccatggagaataaacttcaccctgaccccgcccccggaaaccccctaaataaaaaatgctcgaggt

SEQ ID NO: 342370 - DNA, 75 bp, Artificial Sequence
  Synthetic
ggtcgataaagggagcccggagtccgtttatataagttcacgccgagaacacaaaatggcgaagacacaagatgg

SEQ ID NO: 342371 - DNA, 75 bp, Artificial Sequence
  Synthetic
actcattctcgcgagagaatgagtcactatgacatcaaaaggggtggagacaacacactataaattcaagtacca

SEQ ID NO: 342372 - DNA, 75 bp, Artificial Sequence
  Synthetic
tggggaatggctgagtttttgccgctccagggccaagaaaacgcagcttctggtaagcaagtgtcttggagcctg

SEQ ID NO: 342373 - DNA, 75 bp, Artificial Sequence
  Synthetic
ggcgggtgcaggaggccaaaggccggatcaaggggcttatcgggcagagcgaccctggagcggaaaagggctcaa

SEQ ID NO: 342374 - DNA, 75 bp, Artificial Sequence
  Synthetic
tggaggatattaggacgctatggaaagtaacatttgacctgttatatgataacaactactttccttcaacaggta

SEQ ID NO: 342375 - DNA, 75 bp, Artificial Sequence
  Synthetic
tgtacccatgttttgatgaaaaagaaatatgtctttgtctcgcatggacattgttgctgattggattctcaactc

SEQ ID NO: 342376 - DNA, 75 bp, Artificial Sequence
  Synthetic
tcctgatcttgaccatacagttaattataagcgtaaggaggctgaatggaagcgtaaatgctctgatctccataa

SEQ ID NO: 342377 - DNA, 75 bp, Artificial Sequence
  Synthetic
agaattctgctggtgtggtgactggacaaaccatatcaccaaaaaatgccatttcggaggaggttcaggcgccgg

SEQ ID NO: 342378 - DNA, 75 bp, Artificial Sequence
  Synthetic
agatggaggagacccttcaggaggtaccactatcggaggaatcgccactggtgggggcgcagacgcagaaaatgg

SEQ ID NO: 342379 - DNA, 75 bp, Artificial Sequence
  Synthetic
cgtcaccgacgaagaatgcctgcggtaagataccatccttctagaagacataaatatatagtaataagaggcata

SEQ ID NO: 342380 - DNA, 75 bp, Artificial Sequence
  Synthetic
gaacctttaggaaacctatgtacagatcatacaccatcctggctaagagctactcctggtagatcctttgaatct

SEQ ID NO: 342381 - DNA, 75 bp, Artificial Sequence
  Synthetic
gctggacaaactcttggagaatgggaggggacttggggggctcatcatcacagttttgctggactattattaaga

SEQ ID NO: 342382 - DNA, 75 bp, Artificial Sequence
  Synthetic
gcacaatgtagatttgctacttttagtggagactggaaaagctatgactatattgaatataaaggaggcaccttt

SEQ ID NO: 342383 - DNA, 75 bp, Artificial Sequence
  Synthetic
tacatacctccacaatgtacaacattcctttttggtattgatcctcaatttactaaaatatctaaagagggagaa

SEQ ID NO: 342384 - DNA, 75 bp, Artificial Sequence
  Synthetic
aaagaacagccaaatgaggaaacctggctacatccaggctggcttttacatcaaagaggcactcacataatctat

SEQ ID NO: 342385 - DNA, 75 bp, Artificial Sequence
  Synthetic
tcaaaagacataaaaccttggagaaggtggtataaacttagagtaaaacctggacctacttgggaaggaccatat

SEQ ID NO: 342386 - DNA, 75 bp, Artificial Sequence
  Synthetic
tcacttccaaatgcatttaactttataatgtcccaatggtggtggtcttggcttgattttcaacatgcctttgag

SEQ ID NO: 342387 - DNA, 75 bp, Artificial Sequence
  Synthetic
gacaatacaagaagtcaaatctgtcatgcagatcctcaaaacttttctctgttttgtggacaaaaaccatggtgg

SEQ ID NO: 342388 - DNA, 75 bp, Artificial Sequence
  Synthetic
tttgacagtacatacaaaaatacaattgaaataccaaaaagacttgtaaataaagcctgtaatgcctgggttaat

SEQ ID NO: 342389 - DNA, 75 bp, Artificial Sequence
  Synthetic
agacaagaatatatgattaaaattggacaaaaagtaactgataaaatgcttcatcctgaagacgacattctatgt

SEQ ID NO: 342390 - DNA, 75 bp, Artificial Sequence
  Synthetic
gggaatcaatctcaacaaagtcaaaaaaaatattttcaacaacaaaatcctggttggggaccttttttacctctt

SEQ ID NO: 342391 - DNA, 75 bp, Artificial Sequence
  Synthetic
ctatataatggagacaattgctcactctggttcaaataccgttatgtctttaaggtctctggagactgtgaatac

SEQ ID NO: 342392 - DNA, 75 bp, Artificial Sequence
  Synthetic
agaaaaactccaagtacagacctcacacaaatggtcccaacagcaccaggaccatggaacgcagagggagatcgc

SEQ ID NO: 342393 - DNA, 75 bp, Artificial Sequence
  Synthetic
ccacaaatacaatctcgttccatactcaaaaaatcaagaaaaagaccacttgacacagcagacatcctcctcgga

SEQ ID NO: 342394 - DNA, 75 bp, Artificial Sequence
  Synthetic
gacacagatgacgggatcctcacggagacaggccttgagagaattagtggacctagtccaaaagacctcctatgc

SEQ ID NO: 342395 - DNA, 75 bp, Artificial Sequence
  Synthetic
ggaatggaaaacactccaccaaaacgagttcgattccgacagtcagatgtcctacgaaagcacaagcaccgaatc

SEQ ID NO: 342396 - DNA, 75 bp, Artificial Sequence
  Synthetic
ctcaatctcattgatcagttatccagatgaagggggggagacccccccttacaccccccccgtagaggagggtgc

SEQ ID NO: 342397 - DNA, 75 bp, Artificial Sequence
  Synthetic
cttcacttccccttttttgccagttgattgcagcacccaaatttaaataaaaggaagttgtggtttaaaaatgga

SEQ ID NO: 342398 - DNA, 75 bp, Artificial Sequence
  Synthetic
gtctgtggttttgtggtcggctagggaaatcctgggcggagccaaggcggggctacccttcagggttacttctct

SEQ ID NO: 342399 - DNA, 75 bp, Artificial Sequence
  Synthetic
gccaaggcggggctacccttcagggttacttctctttttgtgtctggggcacgcccctcctgaggggggggcccc

SEQ ID NO: 342400 - DNA, 75 bp, Artificial Sequence
  Synthetic
accagagggaaaatgtagaagggcattaaccggtcgaaataatcacccctctcgtaggcccgaaagtggcaactt

SEQ ID NO: 342401 - DNA, 75 bp, Artificial Sequence
  Synthetic
tcgtggccgaaggcgatctaagaccttcaacaaacttgccacttcacttaattaggataagtggattgctgcaaa

SEQ ID NO: 342402 - DNA, 75 bp, Artificial Sequence
  Synthetic
gtcacgggctcaaacagacctcattatcactctattcttaacatacttttcattcgtgctactaaatcacagacg

SEQ ID NO: 342403 - DNA, 75 bp, Artificial Sequence
  Synthetic
tcaagatgtcttcagtctttaaagcatatgagctgttcaatttggaacaagaacagcaagaaagagggaatgatc

SEQ ID NO: 342404 - DNA, 75 bp, Artificial Sequence
  Synthetic
tagtgctgccacctgaaaccctcagatcaaatatcagggtttttgtactaaacacacaggaccctgagataagat

SEQ ID NO: 342405 - DNA, 75 bp, Artificial Sequence
  Synthetic
ttaggatgatgtgcttttgtattagattagttgcaagtaattctgctagatcagctcatcgaactggtgccctgc

SEQ ID NO: 342406 - DNA, 75 bp, Artificial Sequence
  Synthetic
tcactctgcttagcctccctactgctgccatgcaaaatcatattagaattgcagacagatcacctgatgcagaaa

SEQ ID NO: 342407 - DNA, 75 bp, Artificial Sequence
  Synthetic
ttgaaagaatagaaattgaaggatttgaacaaggcagttacaagctcatcccgaatgccagaaccccaatgtctc

SEQ ID NO: 342408 - DNA, 75 bp, Artificial Sequence
  Synthetic
ctgcagaaatcactgcacttgatgccatggctactgatcttccagattcaataatgtatgatactccattcatga

SEQ ID NO: 342409 - DNA, 75 bp, Artificial Sequence
  Synthetic
atatgtatactgaagcagaaggatgtgatgaaattgaggagtttctggaagcagtctacagtgtattgattcagg

SEQ ID NO: 342410 - DNA, 75 bp, Artificial Sequence
  Synthetic
tctggataactgtctgcaaatgcatgactgcatatgatcaaccaacaggatctgatgagaagagaatggcaaagt

SEQ ID NO: 342411 - DNA, 75 bp, Artificial Sequence
  Synthetic
atcaacagcaagggagattagatcctaaatatactcttcagcaggaagttaggcgactaatccagaaatgcattc

SEQ ID NO: 342412 - DNA, 75 bp, Artificial Sequence
  Synthetic
gaggctctctaccagtgagacaattcctagcgtttgaattacagactgcaagaaagcaaggcacaataacaagca

SEQ ID NO: 342413 - DNA, 75 bp, Artificial Sequence
  Synthetic
aatattattcaatggttggtgatatcagcaagtatattgagaatgcagggatgagtgcctttttcatgactgcca

SEQ ID NO: 342414 - DNA, 75 bp, Artificial Sequence
  Synthetic
ggtatgctctaggaactagatgggctccattggcactagctgcattcacaggtgatctgctcaagatgaaatctt

SEQ ID NO: 342415 - DNA, 75 bp, Artificial Sequence
  Synthetic
taatgctcttgtacagaaagcttggagagaaggcacgctttatggcattgctagaaatgcctgacatgatggaat

SEQ ID NO: 342416 - DNA, 75 bp, Artificial Sequence
  Synthetic
ttgcgcctgcaaattacaatttgctttatagttatgcaatgggtatcggaagtgtgatggacgcccagatgagaa

SEQ ID NO: 342417 - DNA, 75 bp, Artificial Sequence
  Synthetic
actacaactttgctagacccttcttgaatacagcttacttccaactaggagtggagacagccaataagcagcagg

SEQ ID NO: 342418 - DNA, 75 bp, Artificial Sequence
  Synthetic
gtgcagtggataagaacatggcagctgaattggggctgagtgaagatgataagcgggttatggctcagactgtat

SEQ ID NO: 342419 - DNA, 75 bp, Artificial Sequence
  Synthetic
ccagattaacaggtaacaaagctggctctgacaaccaagacctaatggatatgctaagtcgaagatcacgatcag

SEQ ID NO: 342420 - DNA, 75 bp, Artificial Sequence
  Synthetic
gccagactcgtgcactcaggatgagtgcgcaaggaaaccaggctgtggatggagatgaagaagatgatgaggaag

SEQ ID NO: 342421 - DNA, 75 bp, Artificial Sequence
  Synthetic
aagaagaagaggaggaggcacgggatctgacagaagaagaacagaaagaaagtgaggcatggcttaagaagtgga

SEQ ID NO: 342422 - DNA, 75 bp, Artificial Sequence
  Synthetic
aggagatagaagcacagagacatgcagccattgaggcaatgaagaagcacaaagctgccaggactcaaccctcac

SEQ ID NO: 342423 - DNA, 75 bp, Artificial Sequence
  Synthetic
aaatgccgtctgaagtccaggtccacaatgagaaccaagatgttaggggagatcttgactcttaagtaagaggct

SEQ ID NO: 342424 - DNA, 75 bp, Artificial Sequence
  Synthetic
gaaacaaatagaaatccaccacaaccacaatcgacccatgccatcacagccacagtccatcagcatctccagatc

SEQ ID NO: 342425 - DNA, 75 bp, Artificial Sequence
  Synthetic
aaactgccacccagtatttcatatgatatttaataaaaaataggaattattgagtaatatacaaaagtgcaagat

SEQ ID NO: 342426 - DNA, 75 bp, Artificial Sequence
  Synthetic
aggcccgaactgtggtcctgtgaaggacagaaccgtctcgggtcccgctccaggccacctccttaacggaagtgt

SEQ ID NO: 342427 - DNA, 75 bp, Artificial Sequence
  Synthetic
tacgagcagcacacagcccacagcctgccgttatggagatcagtccttcagatgaggaaattaatatctggatgg

SEQ ID NO: 342428 - DNA, 75 bp, Artificial Sequence
  Synthetic
acaaggctttggacactgtggatcatttcacatcaatccctgtcaatccacagagttccttgggaaaaaacacca

SEQ ID NO: 342429 - DNA, 75 bp, Artificial Sequence
  Synthetic
tcaaggcagggaacaccaaatcaatcattaaatcagctgaacgcaaggctcgcgcagtccccgatcatgccaatg

SEQ ID NO: 342430 - DNA, 75 bp, Artificial Sequence
  Synthetic
cagcccccaatgccacagttgaaccggccactgatcgcccatatcaaacagtgcagccagtaaccaagcccaaac

SEQ ID NO: 342431 - DNA, 75 bp, Artificial Sequence
  Synthetic
agccaagaaaggcaagagctctgccatgtcccagctcagcacctccagttcctcctcgagtcagcgaaccccaag

SEQ ID NO: 342432 - DNA, 75 bp, Artificial Sequence
  Synthetic
aagagccatatgaagaacttggagcccctgctcaagaagatactcctctccttaaacaagctgttccccaatctc

SEQ ID NO: 342433 - DNA, 75 bp, Artificial Sequence
  Synthetic
catcctcagggaaattgaaatccagccaacttccgcccctagacaattcaaatgacagcagcaatccgtcactgt

SEQ ID NO: 342434 - DNA, 75 bp, Artificial Sequence
  Synthetic
ctgaccaaaacatctttaagaggggcatatccaagagtgccggacggaatgaacaaaaaattacacgtcacagga

SEQ ID NO: 342435 - DNA, 75 bp, Artificial Sequence
  Synthetic
gagagttcaactttgtctggagtgggagccgtccagtcctcattgagtggtgcaacccaatctgcacccccatca

SEQ ID NO: 342436 - DNA, 75 bp, Artificial Sequence
  Synthetic
ctcccaatccaagacgacaatcctgtcggtgcgggagatgcccaagtgtttgcaaactctgtgaaggagattacc

SEQ ID NO: 342437 - DNA, 75 bp, Artificial Sequence
  Synthetic
acaatcttgcaaggtatggaagcgaggatgagtcagattgaatggaaagtagacaagcttctggcccagcaaagt

SEQ ID NO: 342438 - DNA, 75 bp, Artificial Sequence
  Synthetic
accatcacacaaattagaaacgagcaggttgctcttaaggctcaaatggctacaatagagggattattggctact

SEQ ID NO: 342439 - DNA, 75 bp, Artificial Sequence
  Synthetic
gttaaaattatggatccaggagctgtatcaagcaccaccgccaatcaggcaaaaaagtactttacagaatcttgt

SEQ ID NO: 342440 - DNA, 75 bp, Artificial Sequence
  Synthetic
gtagttgtaagtgggccacccacaggagatctggagctcaccaaggcaaaagagctgtttattggagacttagga

SEQ ID NO: 342441 - DNA, 75 bp, Artificial Sequence
  Synthetic
acaccgacacccaatccgccgccacagccacaaccggcccaaagtgattcacgagagctcgctggttacaaaatg

SEQ ID NO: 342442 - DNA, 75 bp, Artificial Sequence
  Synthetic
acactgaatatgcttgccaaagattgcattcccaactctcagcaaagacaacccttccttaagaagattgaaact

SEQ ID NO: 342443 - DNA, 75 bp, Artificial Sequence
  Synthetic
ataaagtctgaacaagattttaagaagcttaagagagagataattcgagctgctgtctaacaccaacacacacag

SEQ ID NO: 342444 - DNA, 75 bp, Artificial Sequence
  Synthetic
ccaatggataactggctctgcagtgcttatcctgatatctctcacactgggcacccaggcagccgccattccctc

SEQ ID NO: 342445 - DNA, 75 bp, Artificial Sequence
  Synthetic
acaacgctttgcatgcttcgcctcacttttgcaatgagactatgctttaagaaaaaacagaacaattccgttcat

SEQ ID NO: 342446 - DNA, 75 bp, Artificial Sequence
  Synthetic
aatagtaaccacaaactgcaccgatatagaaaaaacaggcccgaatgggtatgccactccatcgggcagcaacaa

SEQ ID NO: 342447 - DNA, 75 bp, Artificial Sequence
  Synthetic
tggcctccctcatcggagcatcaattcccatcccagtcaatcctgacagcggtaagagcaatctcaaaccatttc

SEQ ID NO: 342448 - DNA, 75 bp, Artificial Sequence
  Synthetic
ccatcatcaaggcacctgcagatcaatctggccatactgggaaaattgtacgacagatcaggatcaaaaatctca

SEQ ID NO: 342449 - DNA, 75 bp, Artificial Sequence
  Synthetic
ctccaaagggctccacagagatcccgatcacattcatgaacacatacggattcattaaaccaatttggactcatg

SEQ ID NO: 342450 - DNA, 75 bp, Artificial Sequence
  Synthetic
gtgaatttttctctgaatttcatcgcaataacagcacaccatcactgactgcatgcatgctgccttttggaacgg

SEQ ID NO: 342451 - DNA, 75 bp, Artificial Sequence
  Synthetic
gaccctttgttgacaacccttcaaaacttctgggcgatctggagaaaatacaaatcaatgtgaagaagagtgcta

SEQ ID NO: 342452 - DNA, 75 bp, Artificial Sequence
  Synthetic
gcttaagagaggaggtaatctttgatatcaagaccattccctttgcattcactaagtttcaaattggaagagaga

SEQ ID NO: 342453 - DNA, 75 bp, Artificial Sequence
  Synthetic
gaatcatatgtgtatcctctgataggtatgtcaaatgtccagggaaattaacatcaggagtagaatattcttact

SEQ ID NO: 342454 - DNA, 75 bp, Artificial Sequence
  Synthetic
gtattgcattcatttctcttacattttgccctgagagttacaaattcagggttgccaggccacttcagcagctga

SEQ ID NO: 342455 - DNA, 75 bp, Artificial Sequence
  Synthetic
ggacaagttacatgagagccatacagctggagatcataatgaagattgattgtgccccagactcacccattaaga

SEQ ID NO: 342456 - DNA, 75 bp, Artificial Sequence
  Synthetic
gaaatttgatctatgataaagagaatgacatttacattgcatcagtttggctgcatttgtgtaacatcctaaaag

SEQ ID NO: 342457 - DNA, 75 bp, Artificial Sequence
  Synthetic
ggaagaaccatttcaaaacttatgatgacacctattttgcaaataaatgtcgaaagatgcagcttgtctgtggaa

SEQ ID NO: 342458 - DNA, 75 bp, Artificial Sequence
  Synthetic
tagcagatatgtggggccccacgatcatagtccatagcaaaggaaggataccaaagagtgcagcaccctacttca

SEQ ID NO: 342459 - DNA, 75 bp, Artificial Sequence
  Synthetic
attccaaaggatgggcatgtcaccctctatcagagattgcaccaagtatcacaaaaatactgtggtcggttggtg

SEQ ID NO: 342460 - DNA, 75 bp, Artificial Sequence
  Synthetic
ctaccattcttcaggtgaatgctgtgttgcaaccatcagacatcagcagtgctgcaggaacttctgatctaattt

SEQ ID NO: 342461 - DNA, 75 bp, Artificial Sequence
  Synthetic
acccaaaagtgaaaatcaatccggacttggcagaagaaagaggaatcaaatggaatccactccgcaaagcagtgc

SEQ ID NO: 342462 - DNA, 75 bp, Artificial Sequence
  Synthetic
attcgacatgaacatcacaacaccgggagttgcagaaaggatagcacaccacaaatttcagtctacaatctgtat

SEQ ID NO: 342463 - DNA, 75 bp, Artificial Sequence
  Synthetic
gtcaatcaattgcctataatacaaaattatcgcttatgcatcatgaccacatatcacaattgatataatcacatc

SEQ ID NO: 342464 - DNA, 75 bp, Artificial Sequence
  Synthetic
cgcttacagtttatgcaatttcaaagtttaataaaaaattcccttacatcctcaagaccgatgacacacagcatt

SEQ ID NO: 342465 - DNA, 75 bp, Artificial Sequence
  Synthetic
acatccacaaagactacacaaccaaaaccaccccacaacccaagcaaggagcagccacagccgcactgcaaagac

SEQ ID NO: 342466 - DNA, 75 bp, Artificial Sequence
  Synthetic
caacaacaggcccgaacacaacaacctccagtcagggccagaaccaaactccatccacacagaccacaccacacc

SEQ ID NO: 342467 - DNA, 75 bp, Artificial Sequence
  Synthetic
acacacaaccatggtcaccatcatcaagcctttaattctccttgtcaccgtaatcttacaaatttctggtcacat

SEQ ID NO: 342468 - DNA, 75 bp, Artificial Sequence
  Synthetic
tgacacgactgctctaaccagcataggtgccgtaattgcatcgtctaaagagatcatgtattatgcacaaagcac

SEQ ID NO: 342469 - DNA, 75 bp, Artificial Sequence
  Synthetic
accaaactatatagtcatcaaactaattccaaatctccctaatatccctagccaatgtaatttttcaagtatagc

SEQ ID NO: 342470 - DNA, 75 bp, Artificial Sequence
  Synthetic
ttattacaataaaactttattggaccttttcactccaatctccgataacattaatatgttacatcagagattatc

SEQ ID NO: 342471 - DNA, 75 bp, Artificial Sequence
  Synthetic
taacactggtaggaatcgtagatttgctggtgtggccattggattagctgcacttggcgtcgccactgctgctca

SEQ ID NO: 342472 - DNA, 75 bp, Artificial Sequence
  Synthetic
agtaaccgcggcttttgcattagtagaagctaagtctaacacagccaaaattgcacaaatagggcaggcaatcca

SEQ ID NO: 342473 - DNA, 75 bp, Artificial Sequence
  Synthetic
gaacacaaatgctgccatcaactcactcaatgctggcatagggggtgcagtcacagcaattcaggcaatacagac

SEQ ID NO: 342474 - DNA, 75 bp, Artificial Sequence
  Synthetic
tcagattaatggcataattactgaccaaatcaacgcagccacatgtactgcactagatgcacagataggaacttt

SEQ ID NO: 342475 - DNA, 75 bp, Artificial Sequence
  Synthetic
actcaacatgtacttacttcaattaactacaacttttcagccccaaatccaaaaccctgcattgcaacctttatc

SEQ ID NO: 342476 - DNA, 75 bp, Artificial Sequence
  Synthetic
aatccaggcactacatagaatcatgcaaggtacatctattgtcttaagcaacttaactgattcctcaaagtatgg

SEQ ID NO: 342477 - DNA, 75 bp, Artificial Sequence
  Synthetic
tttgaatgatgcactatcggctggattaatcacgggacaaattgtttcagtagatttaaggttaatgcaaataac

SEQ ID NO: 342478 - DNA, 75 bp, Artificial Sequence
  Synthetic
tattgcagcaaatgtaccaactttatcaagactggagaatgctattgctcatgacattatgaggattacaactaa

SEQ ID NO: 342479 - DNA, 75 bp, Artificial Sequence
  Synthetic
tgtgaacaatactgaggtgatagtacaattgccagagactattatggaacatgcaggcagattatatcagttcaa

SEQ ID NO: 342480 - DNA, 75 bp, Artificial Sequence
  Synthetic
caaggaccactgtctttcaagtacccaacgcttcttttgcccttatagtgatgctaagctactcacaagtaagat

SEQ ID NO: 342481 - DNA, 75 bp, Artificial Sequence
  Synthetic
cagctcttgtctgtctggtatcaggggtgattgcatattttctcctgttgttggtaattttgctacccgtttcat

SEQ ID NO: 342482 - DNA, 75 bp, Artificial Sequence
  Synthetic
ttctgttaaaggtgtaattatcgcaaattgtaagtttatcagatgtacatgcctgcaacctgaggggattatcag

SEQ ID NO: 342483 - DNA, 75 bp, Artificial Sequence
  Synthetic
ccaactggatgatcacacgcttacagtcatagacttaaaattatgcaacaaacttgacctagggctaatccaatt

SEQ ID NO: 342484 - DNA, 75 bp, Artificial Sequence
  Synthetic
tgacctacaagtacttagcaatatatcttatgagatgacactcaatacttctcaaaatcagttaattcttactga

SEQ ID NO: 342485 - DNA, 75 bp, Artificial Sequence
  Synthetic
cccattagatctgtctagtgaactgcagacaatgaatcagtcaattaataatgctgctaattttatcgagaagag

SEQ ID NO: 342486 - DNA, 75 bp, Artificial Sequence
  Synthetic
taactcattacttaattcgtcaacttatgagttcaataggagtgttgctcttttagtagcacttatcttactttc

SEQ ID NO: 342487 - DNA, 75 bp, Artificial Sequence
  Synthetic
attaacaatactctatgttatagtcctcacttgtgtggttaaattgttagttcatgaagttagtaagaataggag

SEQ ID NO: 342488 - DNA, 75 bp, Artificial Sequence
  Synthetic
acacattcaagacttagagtcacatcataagtagctatgcttcacaaataaatatgatattgatgcactttactg

SEQ ID NO: 342489 - DNA, 75 bp, Artificial Sequence
  Synthetic
attagataaagtacttatcagagttgtatatgtaggtagattactcgatttgatagtcctccttatttattcaaa

SEQ ID NO: 342490 - DNA, 75 bp, Artificial Sequence
  Synthetic
acacactatattgtacccaactaaccacataatcacaaagagcatgttaggcccgaataggtgccaaactccaag

SEQ ID NO: 342491 - DNA, 75 bp, Artificial Sequence
  Synthetic
cctccagatttatccagaacacttgtcacctcaccctgcaaccgctcaactaccacaccaactccaacctcccag

SEQ ID NO: 342492 - DNA, 75 bp, Artificial Sequence
  Synthetic
actctgcctctaatcatggattccagaagtgactccttcactgacatacccttagataacagaattgaaagaaca

SEQ ID NO: 342493 - DNA, 75 bp, Artificial Sequence
  Synthetic
gtcacatctaagaaaacgtggaggtcaatattcagagtcaccgccattatattactaattatctgtgtggtagta

SEQ ID NO: 342494 - DNA, 75 bp, Artificial Sequence
  Synthetic
tcatctatcagtcttaatcagcataatgatgcaccattaaatggtgcaggtaatcaggctacttctgggtttatg

SEQ ID NO: 342495 - DNA, 75 bp, Artificial Sequence
  Synthetic
gatgcaattaaaagtctcgagaaattgatgtcacaaactattaatgaactaaaccaagtagtgatgacaacatcc

SEQ ID NO: 342496 - DNA, 75 bp, Artificial Sequence
  Synthetic
gtccaactccctaacaggattactaagtttgggcaggatatccttgaccaggttactcagatggtacgacaatgc

SEQ ID NO: 342497 - DNA, 75 bp, Artificial Sequence
  Synthetic
aatgcagtgtgtaggggcccaggtgtaggcccctcaattcagaattatgtaattcagggtcatgctccaacagtg

SEQ ID NO: 342498 - DNA, 75 bp, Artificial Sequence
  Synthetic
tcctttgatcctatctctgctgaatatcaaaagtttgtattcggcatcactgagaagactcttatcacagcatac

SEQ ID NO: 342499 - DNA, 75 bp, Artificial Sequence
  Synthetic
cacaacccatgggaatgcctcagatttccttctcaacatctatttgacacaacctggtgtgtctcgtatcaaatc

SEQ ID NO: 342500 - DNA, 75 bp, Artificial Sequence
  Synthetic
ctcacccaaaactgttctgatcatggacctaggatcacagtgatccagctgggagaaatcatgattgctaataat

SEQ ID NO: 342501 - DNA, 75 bp, Artificial Sequence
  Synthetic
ttgtctacagttttccgtgatccagtcataaagtacattaggcaccacatttggcttaggagttgttccgtagtt

SEQ ID NO: 342502 - DNA, 75 bp, Artificial Sequence
  Synthetic
gcgtattactcacagtgtacaatattctgtacttccacaaataaatcagaacccagtgattacgccgatacggga

SEQ ID NO: 342503 - DNA, 75 bp, Artificial Sequence
  Synthetic
tacgagcaattattcctagccactctccaatctgatggaacatttacagagcactctatgcatggggtcaatatt

SEQ ID NO: 342504 - DNA, 75 bp, Artificial Sequence
  Synthetic
gttcaccagtggaatgccatatatggaggagtgggtaatggtgttattattggtagaaatatgctgattccacta

SEQ ID NO: 342505 - DNA, 75 bp, Artificial Sequence
  Synthetic
tatggtggaattaattattacgatcacaatactactattgttcagacagtggatttaagaccatatccgatccct

SEQ ID NO: 342506 - DNA, 75 bp, Artificial Sequence
  Synthetic
gatagttgttcccagacagacaattaccagactaattatttaccctctatgtttacaaattcttactatggaact

SEQ ID NO: 342507 - DNA, 75 bp, Artificial Sequence
  Synthetic
aacctagtagtgagtggatatctgtcttgtaggctcatggctggtactccaacatcttgtagcataagggtgatc

SEQ ID NO: 342508 - DNA, 75 bp, Artificial Sequence
  Synthetic
cctattgagaatatgacaatgggatctgaaggacaattttacttaattaataatcagctttactactataaaaga

SEQ ID NO: 342509 - DNA, 75 bp, Artificial Sequence
  Synthetic
agttcaaattggattcgtgatactcaagtctacctattatcatacagtgacaaagggaatataattgaaataaca

SEQ ID NO: 342510 - DNA, 75 bp, Artificial Sequence
  Synthetic
agtgctgagagatatatattcaaatctgtaacaagtcctgatgaaggagattgtgtaactaatcatggttgccct

SEQ ID NO: 342511 - DNA, 75 bp, Artificial Sequence
  Synthetic
tctaattgcataggaggtctattccaagctccctggatccttaatgacttcaaactatgcggatctaacattaca

SEQ ID NO: 342512 - DNA, 75 bp, Artificial Sequence
  Synthetic
tgtccaaaaattgtgactgtttgggctgatcaacccgacaaacgatcaaacccgatgctatcaatagctgagact

SEQ ID NO: 342513 - DNA, 75 bp, Artificial Sequence
  Synthetic
gacaaattactattacataagtcatacattaattatcatactgctgttgggtactctactgtgttatgttttgat

SEQ ID NO: 342514 - DNA, 75 bp, Artificial Sequence
  Synthetic
tcgccaaagctaaaccttaaaacatgtgttgtgttacaagagttaatgtccgatgataaattactaattaggatt

SEQ ID NO: 342515 - DNA, 75 bp, Artificial Sequence
  Synthetic
agttacagtattgttagcataatggttgaatgatattctgacactgctttcttgatttgtgcagcccacacttta

SEQ ID NO: 342516 - DNA, 75 bp, Artificial Sequence
  Synthetic
tttgaccataatactaggtatatgcacgtgagcagcctgtttgataatccccagatgcatgctattcaagtatca

SEQ ID NO: 342517 - DNA, 75 bp, Artificial Sequence
  Synthetic
tatattttcccggagtgtttaaatcactgtagcatagatagtctaattcttattatgtgggtaatatagatagat

SEQ ID NO: 342518 - DNA, 75 bp, Artificial Sequence
  Synthetic
ctgaattttaataaaaaaatgataattgatatagatatggaaccaacttacaatagccagcttataattaaataa

SEQ ID NO: 342519 - DNA, 75 bp, Artificial Sequence
  Synthetic
caaacatcatattaattcaattcgagtgtacaaccacccatcaatcaaacccactacaatgccatcatgggccag

SEQ ID NO: 342520 - DNA, 75 bp, Artificial Sequence
  Synthetic
aatggctgctccttcgcagatcattctgcccgaagtccaccttgactcaccaatagtcaaaaacaaattgatcta

SEQ ID NO: 342521 - DNA, 75 bp, Artificial Sequence
  Synthetic
aatggctgctccttcgcagatcattctgcccgaagtccaccttgactcacctatagtcaaaaacaaattgatcta

SEQ ID NO: 342522 - DNA, 75 bp, Artificial Sequence
  Synthetic
aatggctgctccttcgcagatcattctgcccgaagtccaccttgactcacccatagtcaaaaacaaattgatcta

SEQ ID NO: 342523 - DNA, 75 bp, Artificial Sequence
  Synthetic
aatggctgctccttcgcagatcattctgcccgaagtccaccttgactcaccgatagtcaaaaacaaattgatcta

SEQ ID NO: 342524 - DNA, 75 bp, Artificial Sequence
  Synthetic
ctttgtcaaattagctggcctcccgcttccggatgaagatttggaagatgatccattccctgccgttgattgggc

SEQ ID NO: 342525 - DNA, 75 bp, Artificial Sequence
  Synthetic
aagaattcgtcgagaggagaataggcttagtgatcgcctaaatcaggttaaatcaagattgtatagtgagatcat

SEQ ID NO: 342526 - DNA, 75 bp, Artificial Sequence
  Synthetic
agactctttcccaaaatcagaattctcattatttgtatctaagttgaatgtcttgctgtggccaaaggtcctgcc

SEQ ID NO: 342527 - DNA, 75 bp, Artificial Sequence
  Synthetic
tattgtaactacttggaccatccctgaacttactgaaagattctcagatgtctatactatcatacaaagatcatg

SEQ ID NO: 342528 - DNA, 75 bp, Artificial Sequence
  Synthetic
tgatatcatatcttcaggagcttcaaatctactaagagatattagttatcaactctcaaaatctactgaactctt

SEQ ID NO: 342529 - DNA, 75 bp, Artificial Sequence
  Synthetic
cactaggaattctttgcattgctcaatacatgatcagcatactagaccctctgacctaagtcagcttgctctgct

SEQ ID NO: 342530 - DNA, 75 bp, Artificial Sequence
  Synthetic
agaatctaactcagactacatgcatcaattcaatgtgtggtttattataagacttaagatgcggcaacaaatact

SEQ ID NO: 342531 - DNA, 75 bp, Artificial Sequence
  Synthetic
agcaaatcaagattcatcccaacacctccaactagtagagctagggaaaaaagatcacaaaatatatatcacccc

SEQ ID NO: 342532 - DNA, 75 bp, Artificial Sequence
  Synthetic
cgaaattgtgtgcatttggatccgagagaagaaaattataacctattttacatttgagatggtcctgatggtttg

SEQ ID NO: 342533 - DNA, 75 bp, Artificial Sequence
  Synthetic
tgatatgattgaaggtagacgaaatgtccttgccttgacaaaatatagttgttatcttgcaccactcttgccaag

SEQ ID NO: 342534 - DNA, 75 bp, Artificial Sequence
  Synthetic
gctcaaacgaatttttagcattgtggatgagttatgtgaacatctgggaaacagtgtatactcagtagtagcatc

SEQ ID NO: 342535 - DNA, 75 bp, Artificial Sequence
  Synthetic
attagagagtcttgtttatgcggaattgcaacttgcagaccctgtcccagaattacgaggtgaattccatgcatt

SEQ ID NO: 342536 - DNA, 75 bp, Artificial Sequence
  Synthetic
tataagtcaagagctaattaatgcaattacttctaaaggaatcatatcagaccaagaggcaaatattatatgcac

SEQ ID NO: 342537 - DNA, 75 bp, Artificial Sequence
  Synthetic
taggctcttggaatgttatcataatttaccacctgatctggttgcagagctcctttgcactatgcgcttatgggg

SEQ ID NO: 342538 - DNA, 75 bp, Artificial Sequence
  Synthetic
tcatccaatgcttaatgcagaaactgccgccaaaaaggttagggcttcaatgtgtgctcccaaaatgttagattt

SEQ ID NO: 342539 - DNA, 75 bp, Artificial Sequence
  Synthetic
gactataattttgaaggttaaagcatttttccatggtatcattgtaaatggatacagaagaaaacacaatggaat

SEQ ID NO: 342540 - DNA, 75 bp, Artificial Sequence
  Synthetic
ctggccaaaagttatccttcccccttttgcatcaccaagcctaacagaattctttcatgataactcagagctacc

SEQ ID NO: 342541 - DNA, 75 bp, Artificial Sequence
  Synthetic
ttaccattacatactagcacattggaaagaaattgcttttttacaatttgacaaaagctttgatgctgacccagg

SEQ ID NO: 342542 - DNA, 75 bp, Artificial Sequence
  Synthetic
tgaagacctcagtatttttatgaaggataaagcaatcagtaccccaaagaagaactggatgagtgtgtttaggaa

SEQ ID NO: 342543 - DNA, 75 bp, Artificial Sequence
  Synthetic
aagcttgataaaaccaacatgtgacaaactcaaagtcccttatccagagcctttcaaccggagactgcttatcaa

SEQ ID NO: 342544 - DNA, 75 bp, Artificial Sequence
  Synthetic
tttccttcaggataacaactttgatcctactgaagaattaaaatatgtaacaacaggtgagtatttggatgacaa

SEQ ID NO: 342545 - DNA, 75 bp, Artificial Sequence
  Synthetic
tgaattctgtgcctcatactctatgaaggagaaagagattaaggaagatggaagaatctttgcaaaactaacaaa

SEQ ID NO: 342546 - DNA, 75 bp, Artificial Sequence
  Synthetic
gaggatgagatcttgccaggttatatgtgaatcattgttagcaagtcatgcagggaagttgttcaaggagaacgg

SEQ ID NO: 342547 - DNA, 75 bp, Artificial Sequence
  Synthetic
agtgaccctagatcagctgagtctcacaaaatcgcttcttacaatgtcccaaattggtctaatatccaaaagtag

SEQ ID NO: 342548 - DNA, 75 bp, Artificial Sequence
  Synthetic
taggagagcagccagagacaacattgacattattcaccatgttgctgacattagaaaaggtaatcaatatgctaa

SEQ ID NO: 342549 - DNA, 75 bp, Artificial Sequence
  Synthetic
agtaaatgttaagccaagcacacatgcaataccaaagccagatgagattagcgaaattgccgcctgctttcttac

SEQ ID NO: 342550 - DNA, 75 bp, Artificial Sequence
  Synthetic
tactgatttgaagaaatactgcctccaatggcggtatcaaagtatcatcccatttgcaacttcacttaatcaatt

SEQ ID NO: 342551 - DNA, 75 bp, Artificial Sequence
  Synthetic
atatggatataaccatctctttgagtggattcacttgagactaatgaggtcaacgttgtatgtcggtgatccatt

SEQ ID NO: 342552 - DNA, 75 bp, Artificial Sequence
  Synthetic
cagtcctccccgtgacttggataccccagacttggataatgtgcaaaataaggggatcttcattgtctctgctag

SEQ ID NO: 342553 - DNA, 75 bp, Artificial Sequence
  Synthetic
aggaggtattgaaggattgtgtcaaaaaatgtggacaatgatttcaattgctgtgataattctatcagcgactga

SEQ ID NO: 342554 - DNA, 75 bp, Artificial Sequence
  Synthetic
atccaatacaagagtaatgtgcatggtacagggggataaccaagcaatagccatcacatcaaaggtcccaagaac

SEQ ID NO: 342555 - DNA, 75 bp, Artificial Sequence
  Synthetic
attgagctatgaacacaagaaacaaattgcattcaatcatagcaaactcttcattgaaagactgaggatcaataa

SEQ ID NO: 342556 - DNA, 75 bp, Artificial Sequence
  Synthetic
tcatggaataggccaccacttgaaagaccaagaaactattgttagttcggaacttttcatttacagtaaaagagt

SEQ ID NO: 342557 - DNA, 75 bp, Artificial Sequence
  Synthetic
cctgtataaggggagaattcttaatcaagctttaaagaatgctagcaaactgtgtttaattgctgatgtgctaag

SEQ ID NO: 342558 - DNA, 75 bp, Artificial Sequence
  Synthetic
tgagtgtacccaaacttcagcatctaaccttacaaccaccataatgagactcacagagaatgggattgagaaaga

SEQ ID NO: 342559 - DNA, 75 bp, Artificial Sequence
  Synthetic
catctgttattactggagtgtatattatacaattaggcaactagttcatgatctcatgttccctctaacccaatt

SEQ ID NO: 342560 - DNA, 75 bp, Artificial Sequence
  Synthetic
atttgaagaggatgttgtgaccacttatctcaacaatccaggcctgattgcaaaacttgccatcttaccatcaca

SEQ ID NO: 342561 - DNA, 75 bp, Artificial Sequence
  Synthetic
gctcggaggccttaactattatgcaatcagtaggttgttctgcagaaatattggagatccattgacatcatccat

SEQ ID NO: 342562 - DNA, 75 bp, Artificial Sequence
  Synthetic
ttcagatgtaaaacgctttatgagggctggcatcttgcccagatggatattaaagaacatcttgagtagaccatc

SEQ ID NO: 342563 - DNA, 75 bp, Artificial Sequence
  Synthetic
tggggatggatcatgggtgactcttgctgccgatccatactcaattaatatcccttacctctatcctcccaccac

SEQ ID NO: 342564 - DNA, 75 bp, Artificial Sequence
  Synthetic
tatgctcaagaaacacactcagagagttctgatggagagtagtacaaatcccatgctaagaggggtattttatga

SEQ ID NO: 342565 - DNA, 75 bp, Artificial Sequence
  Synthetic
tggggcacttcaagaagaatcagaattggccaaattcctcttggaccgtccggttgtgatgccacgggttgcaca

SEQ ID NO: 342566 - DNA, 75 bp, Artificial Sequence
  Synthetic
catcatcattgaacaatcttcatgtggaaggagaaaacaaattcaaggttatctggatacaactagaactatcat

SEQ ID NO: 342567 - DNA, 75 bp, Artificial Sequence
  Synthetic
tcgatatgcactgaaactggcacctcttagctataagaagaccactaaggtacttgattataatctgttatacct

SEQ ID NO: 342568 - DNA, 75 bp, Artificial Sequence
  Synthetic
atcttataatttggaattgataaaacactctactaagtcttcagcccatccattggcaagtcaggatctgtcaga

SEQ ID NO: 342569 - DNA, 75 bp, Artificial Sequence
  Synthetic
tgtatgcagtattgacatctcacaattgttgaggaagctttcttggacaaatttattaaatggaagagggctaca

SEQ ID NO: 342570 - DNA, 75 bp, Artificial Sequence
  Synthetic
gggtttggaaacacctgaccctattgaactcctgaatggattcctgattacaggcacaacatcgtgcattgcatg

SEQ ID NO: 342571 - DNA, 75 bp, Artificial Sequence
  Synthetic
tatggagggtgattccaagttcacctggttatttctacctgctggcattgatctacaggcaccccctgatgagaa

SEQ ID NO: 342572 - DNA, 75 bp, Artificial Sequence
  Synthetic
tcctcccattagagtaccatatgttgggtctagaactgatgagaggagagtggcatcaatggggtatgttaaagg

SEQ ID NO: 342573 - DNA, 75 bp, Artificial Sequence
  Synthetic
tgccagccaggctctcaagtcttcattgaggttgacaggtgtttatatatgggcatatggtgagactgattataa

SEQ ID NO: 342574 - DNA, 75 bp, Artificial Sequence
  Synthetic
ttgggatcaagctctaatgctagctaacacaagagcagcaataaataaagaacagctccaggcactcactcccct

SEQ ID NO: 342575 - DNA, 75 bp, Artificial Sequence
  Synthetic
tccaacatcgtcaaatcttgttcatagactggatgatggacttacacagttgaaatttactcctgccagctccta

SEQ ID NO: 342576 - DNA, 75 bp, Artificial Sequence
  Synthetic
tgctttttcaagctatgtccacatttccaatgattctcaaaatttagaattgctggaaaggcagttagactcaaa

SEQ ID NO: 342577 - DNA, 75 bp, Artificial Sequence
  Synthetic
cttgatttatcagcaggtcatgttacttggtcttggaattattgagacatggcttcagttcccaaatgaacaaaa

SEQ ID NO: 342578 - DNA, 75 bp, Artificial Sequence
  Synthetic
ccaaagtgacctttcagtacacctgcacacaggctcatcttgttgcatcagacaggttgactcatgcattatcaa

SEQ ID NO: 342579 - DNA, 75 bp, Artificial Sequence
  Synthetic
tgaaagctcatctaatgttcccattttaaatgttccatatcagaatcattttgtatttgatccaagtccacttag

SEQ ID NO: 342580 - DNA, 75 bp, Artificial Sequence
  Synthetic
tgatgagcaggctattcaagttaaaaatctgacattccagaccaatataagtgcattggacatgattccacttaa

SEQ ID NO: 342581 - DNA, 75 bp, Artificial Sequence
  Synthetic
cgataaattccctgttcttgctcatttaattggtatccaaattgcacatagcttgacaggtttagatgaatcaac

SEQ ID NO: 342582 - DNA, 75 bp, Artificial Sequence
  Synthetic
atccttaattaatgatgctgtggttgaaacagattatgcctgcaattggataagtgaatgcttgaatacacagct

SEQ ID NO: 342583 - DNA, 75 bp, Artificial Sequence
  Synthetic
tgataaggttttttattatgcagcttggcacttacttcttgatctagcttatcaactctattatttacgtgtctt

SEQ ID NO: 342584 - DNA, 75 bp, Artificial Sequence
  Synthetic
gggtcaacatgctatattagattattataccactattctttacagaattcctggcttagcacttacaggtatttc

SEQ ID NO: 342585 - DNA, 75 bp, Artificial Sequence
  Synthetic
atcaactattagccaccctaaactcttaagaaggatgattaatcttggtattatcattccgcgaaatgcacccta

SEQ ID NO: 342586 - DNA, 75 bp, Artificial Sequence
  Synthetic
cttagcaacattggactatcagaagatgtcaactgatgctttaatttggggagcaaaacatgttctctcagatct

SEQ ID NO: 342587 - DNA, 75 bp, Artificial Sequence
  Synthetic
catgcatggtatagatatagaaatcatagtaccatcagaggactccacagaaatttcagatagagttctcaacct

SEQ ID NO: 342588 - DNA, 75 bp, Artificial Sequence
  Synthetic
ggtagcaagaaaactgtctctatgtgcattgatctttaattctgactctgttcttccgcatgtgagagggttagc

SEQ ID NO: 342589 - DNA, 75 bp, Artificial Sequence
  Synthetic
acccgatgaaaaatgcagggctcttacagatgcaatcttgcatatgttcaacaattcattgggccaatcagatag

SEQ ID NO: 342590 - DNA, 75 bp, Artificial Sequence
  Synthetic
aattgaatcattgcaggctatgatagtcatgccaaaaatctccgcatatcctaacaacttatactatctaacacg

SEQ ID NO: 342591 - DNA, 75 bp, Artificial Sequence
  Synthetic
gaagctgttaaactggattagagactcagacgaagcacaattattgcttgctactttctatgatagcttcggctt

SEQ ID NO: 342592 - DNA, 75 bp, Artificial Sequence
  Synthetic
ctttgagactcagcattcactttcaatgacaccttcaattctaaaagaagaagatgcagattcaaccttaactga

SEQ ID NO: 342593 - DNA, 75 bp, Artificial Sequence
  Synthetic
ttatgactctgtcattacaatacagagccaaggtgatgatctgcaagctatatctttccctgccacttcagttta

SEQ ID NO: 342594 - DNA, 75 bp, Artificial Sequence
  Synthetic
tgacccagttcctcctaacgtagcagtgagtcctcctgtacatcacattttacgcccaattggattatcatcaac

SEQ ID NO: 342595 - DNA, 75 bp, Artificial Sequence
  Synthetic
ttcttggtataaaggattgagtgtattgagagtgctacatacttatcaattaccaaagggaaatcatctttatct

SEQ ID NO: 342596 - DNA, 75 bp, Artificial Sequence
  Synthetic
ggcagaaggtagtggagctatcatgacactgatggaggctaattatcctgctgatgtcatattctataacagtta

SEQ ID NO: 342597 - DNA, 75 bp, Artificial Sequence
  Synthetic
cttttccagcggacaatgtccccctcagagaaattttcagccattacccactcaatttatagagagtgtagtata

SEQ ID NO: 342598 - DNA, 75 bp, Artificial Sequence
  Synthetic
caaaaatctccaattaggcataccatctgacaatggaaatgtacaggaatttaagccactctggagtggtaatag

SEQ ID NO: 342599 - DNA, 75 bp, Artificial Sequence
  Synthetic
tgtacaaacggatctgagtacaaaggaatgtgttgactatatcatatctcaagtcaatgcacatacattatctct

SEQ ID NO: 342600 - DNA, 75 bp, Artificial Sequence
  Synthetic
cattactttggatattgaggaaccaactccagagggtgtccatgatgtatcacctgccctaataaactcattcct

SEQ ID NO: 342601 - DNA, 75 bp, Artificial Sequence
  Synthetic
aattgcacattttgctctcaaggcacagggtattatgattattaagacccacttatcaccttttcatagattctc

SEQ ID NO: 342602 - DNA, 75 bp, Artificial Sequence
  Synthetic
aagaatcattacccttgcatcaaaggaattcggatcaattactgccgtgcggtcatcatactcggatccaaattc

SEQ ID NO: 342603 - DNA, 75 bp, Artificial Sequence
  Synthetic
tgatgaactgtatctcatacttcaaagggtggcgatcactaacccaagagatttcacactagcgctggaatcaat

SEQ ID NO: 342604 - DNA, 75 bp, Artificial Sequence
  Synthetic
gaatcaactacatgaagcaggattcactttagtgagtgaggacaaattgactgaacttattgacgggttaaggga

SEQ ID NO: 342605 - DNA, 75 bp, Artificial Sequence
  Synthetic
gaaccaacagcaaatctacaatgaaatagaatatcaaaataagatggcctcatgtacctctaacctgactgacca

SEQ ID NO: 342606 - DNA, 75 bp, Artificial Sequence
  Synthetic
catcacactatcacaactggggagttgtatacaaaccaacaagatcttggagaaagcaccagctcattcaatgac

SEQ ID NO: 342607 - DNA, 75 bp, Artificial Sequence
  Synthetic
tgaattgttggaacgcatctgtactgcagtcaccactttcttgaaggagatgattgctttgacagaggcagctgt

SEQ ID NO: 342608 - DNA, 75 bp, Artificial Sequence
  Synthetic
gattgataaatctgccttaatatacaactcttacaatctccagttaccaggcaaaatcaatacttctgcaaaact

SEQ ID NO: 342609 - DNA, 75 bp, Artificial Sequence
  Synthetic
ggttgcaacacaaatattagaactttatatccggaattgggacttaatatccattgatctcagactgaaactaat

SEQ ID NO: 342610 - DNA, 75 bp, Artificial Sequence
  Synthetic
tcaaatgattgaattgggatatttttcagttggagaaatcctgagcacaaatgactttataaaatacacgaatgt

SEQ ID NO: 342611 - DNA, 75 bp, Artificial Sequence
  Synthetic
tccaaattatttacggaaggtattaggaatgactacaattgatcaggaattacatttgagactcaaggtatacct

SEQ ID NO: 342612 - DNA, 75 bp, Artificial Sequence
  Synthetic
ttcaagagctcaacagaagagagtatggaaatcagttggaagcgtgatcttgactggaacactggatgggagtca

SEQ ID NO: 342613 - DNA, 75 bp, Artificial Sequence
  Synthetic
attgccagaatttgacactcaatcagacaagtttgaggatgaagagcgcgatctcgccggcgatctcattgactg

SEQ ID NO: 342614 - DNA, 75 bp, Artificial Sequence
  Synthetic
tctcattgactgagtagagagacaaaacataaattacattaagaaaaaacaatgcttatttattttccctctggt

SEQ ID NO: 342615 - DNA, 75 bp, Artificial Sequence
  Synthetic
accagagggaaaatatacagaggaatttaccggacgagatcaataatgctgatgtgggcccgaaagtggcatccg

SEQ ID NO: 342616 - DNA, 75 bp, Artificial Sequence
  Synthetic
tcggggtcgaagtcgatcccagggttctgctttcgggtcttgattagagttatcttctcactagtaggagtatcc

SEQ ID NO: 342617 - DNA, 75 bp, Artificial Sequence
  Synthetic
agactcttttcaagatgtcgtcagttttccaagcttttgagcagttcactcttgaacaggatcagcaggtgggag

SEQ ID NO: 342618 - DNA, 75 bp, Artificial Sequence
  Synthetic
gaggtaatttagaagtgccacctgaaactctccagactactatcaaggttttcatccttaatacccaaaaccccc

SEQ ID NO: 342619 - DNA, 75 bp, Artificial Sequence
  Synthetic
agatacgctatcagatgctttgcttttgcttacgaattatcgctagtaattctgcgagaaccgctcaaaaacatg

SEQ ID NO: 342620 - DNA, 75 bp, Artificial Sequence
  Synthetic
gagctctcttgactattttgagccttccaactgcaatgatgcaaaatcatatcagaattgccgacagatccccgg

SEQ ID NO: 342621 - DNA, 75 bp, Artificial Sequence
  Synthetic
actctgtgattgagagaattgaaattgaagggtttgagccaggcacatacaggctgcgtgccaatgcaagaacac

SEQ ID NO: 342622 - DNA, 75 bp, Artificial Sequence
  Synthetic
caatgacagcgggtgaggttattgccctggagaacatggctgaagatctgccggatacactcgctaatcagacac

SEQ ID NO: 342623 - DNA, 75 bp, Artificial Sequence
  Synthetic
ctttccttaatcccaatactgaggacgaaatttgtgatgaaatggagaaatttttggatgcagtgtacagtgtct

SEQ ID NO: 342624 - DNA, 75 bp, Artificial Sequence
  Synthetic
tgattcaggtttgggtaatggtctgtaaagcaatgactgcatttgatcagccgacggggtcggatacaaggaggc

SEQ ID NO: 342625 - DNA, 75 bp, Artificial Sequence
  Synthetic
tggcgaaatatcagcaacaggggagaatggaccaaaagtacctactacagaatgaagttcgacgattgatacaat

SEQ ID NO: 342626 - DNA, 75 bp, Artificial Sequence
  Synthetic
tgggcattagagaaagcttaacaataaggcaatttctggtatttgaaatgcaaactgcaagacgtcagggtccaa

SEQ ID NO: 342627 - DNA, 75 bp, Artificial Sequence
  Synthetic
tcaccagcaaatactatgcaatgattggagacattgctagatatattgagaatgcggggatggggccattcttta

SEQ ID NO: 342628 - DNA, 75 bp, Artificial Sequence
  Synthetic
tgacaatcaaatttgctcttggcactcggtggcccccattggctcttgcggccttctcaggagaactagtaaaga

SEQ ID NO: 342629 - DNA, 75 bp, Artificial Sequence
  Synthetic
ttaagggattgatgcaactttatcgaaggcttggagacagagccaagtatatggctctccttgaaatgtctgaaa

SEQ ID NO: 342630 - DNA, 75 bp, Artificial Sequence
  Synthetic
taatggatttcgccccagcaaattatcagctcctgtttagctatgctatgggaattggccgggtacaagatcctc

SEQ ID NO: 342631 - DNA, 75 bp, Artificial Sequence
  Synthetic
ttatggatttcgccccagcaaattatcagctcctgtttagctatgctatgggaattggccgggtacaagatcctc

SEQ ID NO: 342632 - DNA, 75 bp, Artificial Sequence
  Synthetic
tcatggatttcgccccagcaaattatcagctcctgtttagctatgctatgggaattggccgggtacaagatcctc

SEQ ID NO: 342633 - DNA, 75 bp, Artificial Sequence
  Synthetic
tgatggatttcgccccagcaaattatcagctcctgtttagctatgctatgggaattggccgggtacaagatcctc

SEQ ID NO: 342634 - DNA, 75 bp, Artificial Sequence
  Synthetic
agctgcaggggtacaattttgcacggccattcctcaatgctgcattcttccagcttggaatggaaacagcaaatc

SEQ ID NO: 342635 - DNA, 75 bp, Artificial Sequence
  Synthetic
gccaacagggatcagttgaccgagagatggcagaggaactgggactcactgacgccgataaacgggaaatggctg

SEQ ID NO: 342636 - DNA, 75 bp, Artificial Sequence
  Synthetic
cccaactgacacgactcacaactggcagaggtggagatgaccaacagggtatcgtcaatgtgtttgggaggcgtg

SEQ ID NO: 342637 - DNA, 75 bp, Artificial Sequence
  Synthetic
cacagagacaacaggttattcagaatcaggaccagtttagagtagtggaggaagaggagagtgaggaggaagagg

SEQ ID NO: 342638 - DNA, 75 bp, Artificial Sequence
  Synthetic
aagagattgaagaacaacctgttagaggagcggctcccgcaccaattcggcgcccgaatgatgaagaggctgctt

SEQ ID NO: 342639 - DNA, 75 bp, Artificial Sequence
  Synthetic
ggcaggcaaggctaaatgaattagaaggaatgcagaggagaccacaccctcccagacatgtccagttgcacccac

SEQ ID NO: 342640 - DNA, 75 bp, Artificial Sequence
  Synthetic
tgcagcccgttccggtaggactggctgctgcacagattcacagagagcctcctgctcaggaactggttgctgatt

SEQ ID NO: 342641 - DNA, 75 bp, Artificial Sequence
  Synthetic
tggttgaatgaattcgcagctccagcattgcaggcttaaatgatagtagactgcgttagtgctgctttttgcata

SEQ ID NO: 342642 - DNA, 75 bp, Artificial Sequence
  Synthetic
gagtttttaagaaaaaacaagggtgggcccgaagagtggtacctctcgggtcctcccctcttcgggctctccttg

SEQ ID NO: 342643 - DNA, 75 bp, Artificial Sequence
  Synthetic
atcttcgaaggaatcatacaccctgtcactcaaagcatagactaaagatccatagagccaacatggatcccagcc

SEQ ID NO: 342644 - DNA, 75 bp, Artificial Sequence
  Synthetic
catcagacgaagaaatatccgcctggattgacaaaggcatggacactgtccagcacttcatatctcaacccgtaa

SEQ ID NO: 342645 - DNA, 75 bp, Artificial Sequence
  Synthetic
accctcaaagctctcttggcaagaacaccatcaaatcaggcaatacaaaaattctcataaaatctgcagaaaaga

SEQ ID NO: 342646 - DNA, 75 bp, Artificial Sequence
  Synthetic
agtccaaggcaaccaaagacaacgtcacccaagaaagcgctcccacaccgcccccaagagactaccaatcagaga

SEQ ID NO: 342647 - DNA, 75 bp, Artificial Sequence
  Synthetic
agaaggaagtggttcggccaaaaattcggaaaactcagggtgagcggcctaggcccctccctcctatacctcaac

SEQ ID NO: 342648 - DNA, 75 bp, Artificial Sequence
  Synthetic
aggaggaatcaatttatgaagaagtgtctagggaagttgtagaagaggatcagccattactccaacaacaacaag

SEQ ID NO: 342649 - DNA, 75 bp, Artificial Sequence
  Synthetic
cccatgttctcaagggaaagcagaagattctgagcacctctccagtgaatcaagaacctgatcttccaactggcc

SEQ ID NO: 342650 - DNA, 75 bp, Artificial Sequence
  Synthetic
ctggtgggcaaggttttaagagggggtctcggtctcatatctcaacaacaggactcgtccacttacgaccaaggc

SEQ ID NO: 342651 - DNA, 75 bp, Artificial Sequence
  Synthetic
atagacgagagtttgacatcagatggtatggcaacaaaccttgtgttagagagtggtgcaaccctggctgttccc

SEQ ID NO: 342652 - DNA, 75 bp, Artificial Sequence
  Synthetic
ctatcagaccaactccaatgcgatatacctgcacttgtggagaatgccctgcagtctgctccatgtgtgaaggag

SEQ ID NO: 342653 - DNA, 75 bp, Artificial Sequence
  Synthetic
atcctcagatacttgagagtgctggagaaccgatttaatcaaatggaatccaagattgacaaaatcataagccac

SEQ ID NO: 342654 - DNA, 75 bp, Artificial Sequence
  Synthetic
cagaatatattgacccaaattcggaatgaacaattaggactcaaagcaagcatggcgatgcttgaggggatgatt

SEQ ID NO: 342655 - DNA, 75 bp, Artificial Sequence
  Synthetic
acatcaataaagataatggatccaggtgttggcccaggagcgactgctgctcaagccaaaaaattgttcaaagaa

SEQ ID NO: 342656 - DNA, 75 bp, Artificial Sequence
  Synthetic
gttcctgttgtcataagcgggaacagcgtgggagcaactgagttgacagaagcagcagagctcgagattcaggat

SEQ ID NO: 342657 - DNA, 75 bp, Artificial Sequence
  Synthetic
cttggacgccctgtgatacctcaacagactccgaaaaagagagctgttgttggtgatagtgatctggcaagttac

SEQ ID NO: 342658 - DNA, 75 bp, Artificial Sequence
  Synthetic
aaactcaccctcaagaatctggccaaagattgcatcccaaatgcacatatccaggctgaatttgacaagaagatc

SEQ ID NO: 342659 - DNA, 75 bp, Artificial Sequence
  Synthetic
tcatctatccgatctgagaatgatttcaagaagatcaagagagagatcctcagggcagcaacttaggaacccagc

SEQ ID NO: 342660 - DNA, 75 bp, Artificial Sequence
  Synthetic
tgctaagaggaagctagcctctgtttggaattacccgctttgcttacactgtcattagtactagcttataatgtc

SEQ ID NO: 342661 - DNA, 75 bp, Artificial Sequence
  Synthetic
cgcatgctaatccctctaatcatgcttgcattaaagtaggtattataatagattagtttaagaaaaaatcaaaat

SEQ ID NO: 342662 - DNA, 75 bp, Artificial Sequence
  Synthetic
gggtccgaacccataggacttcgaccccggccaagatggctcatcggcaagctactgtgtcgatcaaggtcaatc

SEQ ID NO: 342663 - DNA, 75 bp, Artificial Sequence
  Synthetic
atgaaagtgagaaaaatcatcttcgtccgttccccatcgttcaactcccaccttcacctggggggtcaaggggtc

SEQ ID NO: 342664 - DNA, 75 bp, Artificial Sequence
  Synthetic
ggttaactcggcagatccgaatcaaagatttaacaccagccggatcgactgagccgtcactgaccttcataaaca

SEQ ID NO: 342665 - DNA, 75 bp, Artificial Sequence
  Synthetic
cttatgggttcgccaaaccgcttcgcactagaactgagttcttttctgagctacacaaacctgattccttaccca

SEQ ID NO: 342666 - DNA, 75 bp, Artificial Sequence
  Synthetic
gtgtcactgcctgtacattaccctttggtgcaggcccgaacatcgagcatccaatgagattgttggatgaaattg

SEQ ID NO: 342667 - DNA, 75 bp, Artificial Sequence
  Synthetic
aaaaagtacacattgtcatgaggaaaagtgcaagtgctagagaggagattgtttttaatgtatgccgccttcccc

SEQ ID NO: 342668 - DNA, 75 bp, Artificial Sequence
  Synthetic
ctatattaagcaaacatcacattgcaactcaaaaattagtatgtatctcatctgagaaatatctcaaagctccag

SEQ ID NO: 342669 - DNA, 75 bp, Artificial Sequence
  Synthetic
ggaagatgatctcagggatggattataattatcatattgcattcatttccgtggtctactgtcctgccagtctga

SEQ ID NO: 342670 - DNA, 75 bp, Artificial Sequence
  Synthetic
agttccgtgtaatgcgcccattgcagcttttaagatctagtacgatgaggagcatacagctagaagtgatcttgg

SEQ ID NO: 342671 - DNA, 75 bp, Artificial Sequence
  Synthetic
tcattgaatgctcagacaattcccctgcaactcgcaacctcatctttgatgatgaaagtaagacatggagagcat

SEQ ID NO: 342672 - DNA, 75 bp, Artificial Sequence
  Synthetic
cagtgtggttccatttgtgcaacattctcaagagtaataagagtgctgagaaatatgatgaccattattttaatg

SEQ ID NO: 342673 - DNA, 75 bp, Artificial Sequence
  Synthetic
agaagtgcaagaagatggatcttgaagttggaatcgcagatatgtgggggcccacatttctggtgaaagcacacg

SEQ ID NO: 342674 - DNA, 75 bp, Artificial Sequence
  Synthetic
ggaagataccgaagactgcacaggtatactttagccctaaaggttggtcttgtcacccattagtagatgctgccc

SEQ ID NO: 342675 - DNA, 75 bp, Artificial Sequence
  Synthetic
ctgctttgagcaaaatattatggtccactggtgcacggattgtaaatgttaatgcaatcttacagccatcagatc

SEQ ID NO: 342676 - DNA, 75 bp, Artificial Sequence
  Synthetic
ttgggcaattagtccaagtctctgatgtgatctatccaaaagtcaagatcaacaagaaactgatgaataccgctc

SEQ ID NO: 342677 - DNA, 75 bp, Artificial Sequence
  Synthetic
catctcgttggaatccagttaagaaggcagtcctggcataatgttgatgatgattaaccgctatggccttactct

SEQ ID NO: 342678 - DNA, 75 bp, Artificial Sequence
  Synthetic
ttcctcagacagacttagatagggaggaaatacttattgcttatcatgatgaacattttgttttttagaaaagct

SEQ ID NO: 342679 - DNA, 75 bp, Artificial Sequence
  Synthetic
tcaatggcactgggagcccaattgcaaggcagaacgaccgctaagtacaacaagaacacaagttcataatctctt

SEQ ID NO: 342680 - DNA, 75 bp, Artificial Sequence
  Synthetic
gctactgtcgcatgcttctttcattgtcttatttcatgccctatcattttctgctcatgcacgtatagtttaaga

SEQ ID NO: 342681 - DNA, 75 bp, Artificial Sequence
  Synthetic
aaaaactaatattattaccttcggaaacggattacacccatatcgtatagagtccaggaacattgggcccgaacc

SEQ ID NO: 342682 - DNA, 75 bp, Artificial Sequence
  Synthetic
cagaagcccaaccgccctgcccgaatccgaactgtacagcgagtgctcacctcacaatggctccatgcgtattat

SEQ ID NO: 342683 - DNA, 75 bp, Artificial Sequence
  Synthetic
tcctatcatccctcttgttgatttcaaccatcagtccttctcatgggatcaatcaacctgcactgagacggattg

SEQ ID NO: 342684 - DNA, 75 bp, Artificial Sequence
  Synthetic
gtgcaatagtatcgtccgttaagcaacttaaattttattcaaagacaaaaccgaattatataattgttaagctac

SEQ ID NO: 342685 - DNA, 75 bp, Artificial Sequence
  Synthetic
tgcctacaattaacctgtcaaaaagtaattgtaatctcactagtatcaacagatataaagaatctgtgatagaaa

SEQ ID NO: 342686 - DNA, 75 bp, Artificial Sequence
  Synthetic
ttatcaaaccactggctgacaatattgacaacttgaatcagaaattacttccaaaaaatagaaggaaaaggatgg

SEQ ID NO: 342687 - DNA, 75 bp, Artificial Sequence
  Synthetic
caggtgtagctattggtcttgctgccttaggtgtggctgcggctgcacaagcaacggcagcagttgcacttgttg

SEQ ID NO: 342688 - DNA, 75 bp, Artificial Sequence
  Synthetic
aagctaggaagaatactcaaatgatacagtctttggctgattcgattcaagatactaatgcggcagtgcaagctg

SEQ ID NO: 342689 - DNA, 75 bp, Artificial Sequence
  Synthetic
tcaacattgggttacaaaatagtgccgttgcaatccaggccatccaaaatcaaatcaataatgtaattaatccgg

SEQ ID NO: 342690 - DNA, 75 bp, Artificial Sequence
  Synthetic
ctctagatcgtcttaactgtgaggtccttgatgctcagatcgcaagcatacttaacctctacttgatcaaatcag

SEQ ID NO: 342691 - DNA, 75 bp, Artificial Sequence
  Synthetic
tgactattttccagaaccagttgactaatcctgctttacagcaattatcaattcaaatgttgtctatagttatgc

SEQ ID NO: 342692 - DNA, 75 bp, Artificial Sequence
  Synthetic
aagatacagcaaaaattcttggcaatttcaccatcggagacaagtttgaccaacatgatcttttaggttctggat

SEQ ID NO: 342693 - DNA, 75 bp, Artificial Sequence
  Synthetic
taattacaggacaagtagtaggagttaatcttactaatcttcaattaataatcgcagcttttatcccatcaatag

SEQ ID NO: 342694 - DNA, 75 bp, Artificial Sequence
  Synthetic
caccactaccacaggcatacattattgatttaatatctataactattagtgtaaatgacactgaagcagtaattc

SEQ ID NO: 342695 - DNA, 75 bp, Artificial Sequence
  Synthetic
aaatacctgaaagaattatggagcatgggtcgagtatttatcaatttggtgggaagcaatgtgtatacggtcaat

SEQ ID NO: 342696 - DNA, 75 bp, Artificial Sequence
  Synthetic
tttctgcttattgcccgtttagtgatgcagttctgatgactcaagatcttcaactatgcatgaaaggcaacatag

SEQ ID NO: 342697 - DNA, 75 bp, Artificial Sequence
  Synthetic
agcattgcatttttagttctgttttaggctctttcccgaatcgttttgcatcagttgatggagtattctatgcta

SEQ ID NO: 342698 - DNA, 75 bp, Artificial Sequence
  Synthetic
attgtaagtatatgtcatgcgcatgctcagatcctttgcaggttatccatcaggatgatagtgtgaatttaatgg

SEQ ID NO: 342699 - DNA, 75 bp, Artificial Sequence
  Synthetic
taattgactcttccgtgtgcagatctctcacacttggtcatgtgacattcccaattatagcattttcgaatgtga

SEQ ID NO: 342700 - DNA, 75 bp, Artificial Sequence
  Synthetic
gttatcaaatgaagactaatatatctatagaacaaatgattgttacaagtcctttagatctatccacggagttaa

SEQ ID NO: 342701 - DNA, 75 bp, Artificial Sequence
  Synthetic
aacaaataaacaattcagttaacattgcaaatacttttctagattcaagcaatagggcattgaaaactagtattt

SEQ ID NO: 342702 - DNA, 75 bp, Artificial Sequence
  Synthetic
ttgggacaagttcgcaaataatactgattgtgttactcatattcacatgcttattgattttatatgtaatattcc

SEQ ID NO: 342703 - DNA, 75 bp, Artificial Sequence
  Synthetic
ttacatatataatcaaaatattgatcaaagaagtcaagagactaagagatggtaacagcaggactggcagtaagt

SEQ ID NO: 342704 - DNA, 75 bp, Artificial Sequence
  Synthetic
tatcatttattaatccggatgtgtaaacgcctagtgattgtatgctaaatttagtaaacaggccgtttaattgat

SEQ ID NO: 342705 - DNA, 75 bp, Artificial Sequence
  Synthetic
ctctgacaattacgattctattagtattttagttttaataaaaaacctagtggactggaagcctgggcccgaccc

SEQ ID NO: 342706 - DNA, 75 bp, Artificial Sequence
  Synthetic
catcaagtccagaagccccccacaacaccagttcgactcaaccatgccaccggtaccaactgtctcacaatcaat

SEQ ID NO: 342707 - DNA, 75 bp, Artificial Sequence
  Synthetic
tgatgagggaagtttcactgacatcccactgtcacccgatgacatcaaacatccattgtctaaaaagacgtgccg

SEQ ID NO: 342708 - DNA, 75 bp, Artificial Sequence
  Synthetic
gaaattgtttcgaattgtcactctgattggagtagggttaataagtattttaacaattatctcacttgcacaaca

SEQ ID NO: 342709 - DNA, 75 bp, Artificial Sequence
  Synthetic
aaccggaattctcagaaaggttgacagttcagatttccaaagttatgtacaggagtctttcaagcaggtattaaa

SEQ ID NO: 342710 - DNA, 75 bp, Artificial Sequence
  Synthetic
tctaatgaagcaattcagcagcaacttaaattctcttattgaaattacatctgttacattaccgtttcgtattga

SEQ ID NO: 342711 - DNA, 75 bp, Artificial Sequence
  Synthetic
tcaattcggaacagatattaaaactcaggttgcacaacttgtgcggcaatgtaatgcagtctgccgtggtcctat

SEQ ID NO: 342712 - DNA, 75 bp, Artificial Sequence
  Synthetic
aaagggcccgacaacccaaaatattgtatacccagcattgtatgagacaagcctcaataaaacattagagactaa

SEQ ID NO: 342713 - DNA, 75 bp, Artificial Sequence
  Synthetic
gaatgtcagaatacaagaggtcagacaggaggtagacccagtgccaggtccgggtttatctaatgggtgtactcg

SEQ ID NO: 342714 - DNA, 75 bp, Artificial Sequence
  Synthetic
taacccttcatttagtgtgtaccatggagtatggtgttatacgcatgctacttccattggtaattgtaatggctc

SEQ ID NO: 342715 - DNA, 75 bp, Artificial Sequence
  Synthetic
attggggacttctcagctattcaggattgggaatgttctagaaggtgatggtggagcaccttaccataaatctct

SEQ ID NO: 342716 - DNA, 75 bp, Artificial Sequence
  Synthetic
agcaacacacttattaacaactagaaatgtgtcacgacagtgctccgcaactgcctcttattatggttgttattt

SEQ ID NO: 342717 - DNA, 75 bp, Artificial Sequence
  Synthetic
catctgtagtgagcccgtcctgaccgaaagagatgattatgagacaccagggatcgaacctattacaatattcag

SEQ ID NO: 342718 - DNA, 75 bp, Artificial Sequence
  Synthetic
gcttgatcctgacggaaattgggttgtgttccctaatataaatagattcactgagtactcacttaaggcacttta

SEQ ID NO: 342719 - DNA, 75 bp, Artificial Sequence
  Synthetic
ccctggtataggtagtggggtattatttcaagggaagctaattttccctatgtatggtggcattgataaagaacg

SEQ ID NO: 342720 - DNA, 75 bp, Artificial Sequence
  Synthetic
gctgagtgcattaggccttgggaatataggattgatagaacggcgtatggcagatacctgtaatcatacagaaaa

SEQ ID NO: 342721 - DNA, 75 bp, Artificial Sequence
  Synthetic
agaactgggtagatcattcccgggtgctttctcaagcccatattatcatgatgcagttatgcttaatttcttatt

SEQ ID NO: 342722 - DNA, 75 bp, Artificial Sequence
  Synthetic
gatatgtgagatgattgagaatcttccaggggattgtgacctgcagatattgaacccaacaaatatgtctatggg

SEQ ID NO: 342723 - DNA, 75 bp, Artificial Sequence
  Synthetic
atcagaatcccagttgtccgttttagacaatgaactattcctgtatcagagaagtgcttcatggtggccatatac

SEQ ID NO: 342724 - DNA, 75 bp, Artificial Sequence
  Synthetic
tttaatttatagattgaacatgaggtacacagggaagtacttaaaaccaaaatctattatcccaatggtcattaa

SEQ ID NO: 342725 - DNA, 75 bp, Artificial Sequence
  Synthetic
gtcaaacacacgacctggttatgagggatgcaatcatgaacgagtctgcccgaaagtatgtgtcacaggtgtttt

SEQ ID NO: 342726 - DNA, 75 bp, Artificial Sequence
  Synthetic
ccaggcaccctggattttgtcaattggaagagatcacaaggaaagagtatctaatgtaacttatatggttgcttg

SEQ ID NO: 342727 - DNA, 75 bp, Artificial Sequence
  Synthetic
gagtatggataaatctgacaggacatatcctgcagtatctgtgtgcggctctgatacatgtaaattgactgttcc

SEQ ID NO: 342728 - DNA, 75 bp, Artificial Sequence
  Synthetic
attaggggactcaaaagtacattcagcttactcagtaacaagatgttacctatcaagggatcacatgtcagcata

SEQ ID NO: 342729 - DNA, 75 bp, Artificial Sequence
  Synthetic
ctgccttgttatatttgaacttgatgctagaccatgggctgagatgcgcatacaatctttcttatacaaactaat

SEQ ID NO: 342730 - DNA, 75 bp, Artificial Sequence
  Synthetic
actcacttaggattttccagggtctatcaaattatctctctaattatctataacatattacgttaattgtcatct

SEQ ID NO: 342731 - DNA, 75 bp, Artificial Sequence
  Synthetic
ctgtgattactaatgtctgagattataatagatattatattgaatataaatgaataacatctttaagaaaaaact

SEQ ID NO: 342732 - DNA, 75 bp, Artificial Sequence
  Synthetic
gaattgggccagaatggctgcccctcagcagatcattctgcccgaggtccatctggactctcccattgttcagaa

SEQ ID NO: 342733 - DNA, 75 bp, Artificial Sequence
  Synthetic
caaattactgtactttgtgagactaggtggccttccattgcctgaccttttctttgaagacgatttcttccccga

SEQ ID NO: 342734 - DNA, 75 bp, Artificial Sequence
  Synthetic
tgttgattgggatcgtgttcgaagggaagagaatagactttcatccagactagaaactattagaagtagaattct

SEQ ID NO: 342735 - DNA, 75 bp, Artificial Sequence
  Synthetic
tgcaaaaactcaaactggctctggcttaaatcctatcaataaaactgctcctctcatccttctctggcctagctg

SEQ ID NO: 342736 - DNA, 75 bp, Artificial Sequence
  Synthetic
tttaactcgattacatcaattcacattccctgaagctttatcaagatttcatgatgctaacaaaatcatgcaggc

SEQ ID NO: 342737 - DNA, 75 bp, Artificial Sequence
  Synthetic
agcttgtaattatctctctgctgggctgactactgtcctcacatcagtcagtgaaaagctaactaataaaaccaa

SEQ ID NO: 342738 - DNA, 75 bp, Artificial Sequence
  Synthetic
tttgtttacacacaatgaatctcagtgtttgcatgtccgatctcatgatcgccctcaagaccttaaacaaatatg

SEQ ID NO: 342739 - DNA, 75 bp, Artificial Sequence
  Synthetic
tgaacagatgacaaatgcgcagtggaaaagtcaatttgacttatggttcctagtcagacaccaaatgaggacatt

SEQ ID NO: 342740 - DNA, 75 bp, Artificial Sequence
  Synthetic
gatcaataagaataacaaccaatcaactgacaaattagtgatagaaatggacaggagagtacaatcaataattat

SEQ ID NO: 342741 - DNA, 75 bp, Artificial Sequence
  Synthetic
cacgccagaattagtggctctttgggacagagaagataactttttgacttacctgacattcgagatggttctcat

SEQ ID NO: 342742 - DNA, 75 bp, Artificial Sequence
  Synthetic
ggtatgtgacctgtacgaaggccggctaaacattttgggagtagcaaaaatgagctgttatctttcacccctgac

SEQ ID NO: 342743 - DNA, 75 bp, Artificial Sequence
  Synthetic
ttctcgccttaacaagctttttgaaattgttgatgagctttgcacactgttaggtaatcaggtctatgccattgt

SEQ ID NO: 342744 - DNA, 75 bp, Artificial Sequence
  Synthetic
agcgtcacttgaaagccttgtgtatgcccgactgcagctattagatcctgtagaagaagtttgcggtgattttta

SEQ ID NO: 342745 - DNA, 75 bp, Artificial Sequence
  Synthetic
ttcattcatctgcaaagaactgattgatggcctcactgcaaatgatgtcattagcattccagaagctgagcttat

SEQ ID NO: 342746 - DNA, 75 bp, Artificial Sequence
  Synthetic
tgctgacaaactgctagactgctataataatttgactcctgatcttattgctgagcttttatgcgttatgagaat

SEQ ID NO: 342747 - DNA, 75 bp, Artificial Sequence
  Synthetic
gtggggacatccgatgctcacatcagaaaaagcagcagccaaagtcagggaatctatgtgcgctccaaaagtgat

SEQ ID NO: 342748 - DNA, 75 bp, Artificial Sequence
  Synthetic
tgattttgaaacaacactcaagacacttgcattctttaatgaaatcataattaatggataccgtcgaaaacataa

SEQ ID NO: 342749 - DNA, 75 bp, Artificial Sequence
  Synthetic
cggaatttggcccaaatgcaaattaccaccatatgcatcattgagtcttcaggaacttaagcatgacaattctga

SEQ ID NO: 342750 - DNA, 75 bp, Artificial Sequence
  Synthetic
aatttcacaccaatacactctaacacattggaaggaaatcgcgtttatagaatttgagaaaagttttgatgcaga

SEQ ID NO: 342751 - DNA, 75 bp, Artificial Sequence
  Synthetic
tccaggttcagatttgagtattttcatgaaagacaaagctataagtgctcccaaaaaagattggttgagtgtatt

SEQ ID NO: 342752 - DNA, 75 bp, Artificial Sequence
  Synthetic
taggaagagcttaattaaaccgctctgtgaaagacttcatcaacccatgccttcatcttacaacaggaggttact

SEQ ID NO: 342753 - DNA, 75 bp, Artificial Sequence
  Synthetic
gttgaactttcttgatgatgatcagtttgatccagttaaggaattggaatatgtgacctcaggagcatatcttga

SEQ ID NO: 342754 - DNA, 75 bp, Artificial Sequence
  Synthetic
tgatgaggatttctgtgcatcttactccctcaaagaaaaggagatcaaagaaaccgggagaatttttgctaaact

SEQ ID NO: 342755 - DNA, 75 bp, Artificial Sequence
  Synthetic
tactaagaagatgagatcctgtcaagtaatttgtgagtccctgcttgccaatcatgcaggaaaattgttcaaaga

SEQ ID NO: 342756 - DNA, 75 bp, Artificial Sequence
  Synthetic
gaatggagtagttgtcgatcacttaaatttaaccaaatcattattaacaatgtctcagattggactgatatctac

SEQ ID NO: 342757 - DNA, 75 bp, Artificial Sequence
  Synthetic
taaatccaggcgtgctgcaagagaaaatatcactgtagtctcacatcttaaatcaagaaacaataatccgacaca

SEQ ID NO: 342758 - DNA, 75 bp, Artificial Sequence
  Synthetic
gagtatacagaaacaggctgatcaacccacaattgatgaaactacagaaattgcagccttcttcctcacaaccga

SEQ ID NO: 342759 - DNA, 75 bp, Artificial Sequence
  Synthetic
cctaaaaaaatactgtctcaattggagataccaatcaattatcctgtttgcaacatcattgaataaattgtatgg

SEQ ID NO: 342760 - DNA, 75 bp, Artificial Sequence
  Synthetic
ctacccacacctatttgagtggatccatctgaggcttatgaggagtactctgtatgtgggtgatcctttcaatcc

SEQ ID NO: 342761 - DNA, 75 bp, Artificial Sequence
  Synthetic
tcccagattcctaaacacactggatttggacgaagtgcaaaatgatggaatattcatagtatcaccaagaggtgg

SEQ ID NO: 342762 - DNA, 75 bp, Artificial Sequence
  Synthetic
gatagaaggtctatgccagaaaatgtggacaatgatttcaattgcagttattacactctctgcaaccgaatctag

SEQ ID NO: 342763 - DNA, 75 bp, Artificial Sequence
  Synthetic
cactagagttatgagtatggtgcagggtgacaatcaagcaatcgcaatgacaactaaagtaccaagatcacttaa

SEQ ID NO: 342764 - DNA, 75 bp, Artificial Sequence
  Synthetic
ccacagacagaaaaaggagatagcttacaataacagcaaattgtttgttgagaggcttcgatacaataacagggg

SEQ ID NO: 342765 - DNA, 75 bp, Artificial Sequence
  Synthetic
cctgggtcaccatctaaaagaacaagaaaccatcatgagttcagatttctttgtatacagtaagaggattgtttt

SEQ ID NO: 342766 - DNA, 75 bp, Artificial Sequence
  Synthetic
ccggggaagaattttaaaccaagcattaaagaatgtgagcaaacttaatttgatagctgatgtgcttagtgaatg

SEQ ID NO: 342767 - DNA, 75 bp, Artificial Sequence
  Synthetic
cacacaaacatcttgttccaatttgactaccaccattatgagattgactgaaaatggagtagagaaagatatctg

SEQ ID NO: 342768 - DNA, 75 bp, Artificial Sequence
  Synthetic
ctataatctgagcttctttttctcgatcaagcaactagtctatgatcttttgtttccaattacgacaatctttga

SEQ ID NO: 342769 - DNA, 75 bp, Artificial Sequence
  Synthetic
ggatgaggttactgccttatatcttaatcatcccatcttgatttctaggttatgtcttttaccatctcaattagg

SEQ ID NO: 342770 - DNA, 75 bp, Artificial Sequence
  Synthetic
aggccttaatttttattcaattagtagattgttcaacagaaacataggggatcccctcacatcagcaattgcaga

SEQ ID NO: 342771 - DNA, 75 bp, Artificial Sequence
  Synthetic
ccttaaacgtttcctggctgctgatctattgccaaagtggactattgcaaatttgttagggagaaatccgggaaa

SEQ ID NO: 342772 - DNA, 75 bp, Artificial Sequence
  Synthetic
agggacatggagtactctcgctgctgatccgtactcgctcaatatagactatctttaccctccaacaacatatct

SEQ ID NO: 342773 - DNA, 75 bp, Artificial Sequence
  Synthetic
caaaaaacatacccagagagtcttgatggaaggaagtgtgaatcccatgctccaggggatatttacagacaatgc

SEQ ID NO: 342774 - DNA, 75 bp, Artificial Sequence
  Synthetic
aatagaggaagaaaatgcaattgcgaagttcttattagacagacctattgttatgccaagagtagcacatattgt

SEQ ID NO: 342775 - DNA, 75 bp, Artificial Sequence
  Synthetic
tttagagcagacatcatgtggaagaagaaaacaaatacaaggattccttgacacaactcggaccataattcggca

SEQ ID NO: 342776 - DNA, 75 bp, Artificial Sequence
  Synthetic
tgctcttgcaaagcaaccaccaagttacaaaaagttggagaaaattatcgactataatcggttatatctggcata

SEQ ID NO: 342777 - DNA, 75 bp, Artificial Sequence
  Synthetic
caatcttgaactgatatccaagcctaatgacaaaaaggcggaaagaaaagctagagaggacctggtcaatgtttg

SEQ ID NO: 342778 - DNA, 75 bp, Artificial Sequence
  Synthetic
cagcatagatttggctaagttactaagacggatgtcctggtcgcaattgctttctggaaggcctattgatggtct

SEQ ID NO: 342779 - DNA, 75 bp, Artificial Sequence
  Synthetic
tgaaacccctgacccaactgagttgattcaaggatacattatcaatggaaatgataactgtttggcatgcttaca

SEQ ID NO: 342780 - DNA, 75 bp, Artificial Sequence
  Synthetic
aggagataggaaatttacatggttttatattccaggaaacataacccttgatgctcctcctgaagacaatccacc

SEQ ID NO: 342781 - DNA, 75 bp, Artificial Sequence
  Synthetic
cataagagttccttacatagggtcgagaactgatgaaagaagggtagcatcattaggatatgttaagggagctac

SEQ ID NO: 342782 - DNA, 75 bp, Artificial Sequence
  Synthetic
acaggctttgaaatctgcattaaggttggcaggagtctatatttgggcatttggcgacacagatgacaattggaa

SEQ ID NO: 342783 - DNA, 75 bp, Artificial Sequence
  Synthetic
tgatgcgctcaatcttgctagcacccgggtaaacataaccttagaacaactgaggactctgacaccaatgccaac

SEQ ID NO: 342784 - DNA, 75 bp, Artificial Sequence
  Synthetic
cagtaccaacttaacccacaggcttgatgatggattaacacagatgaagtttacaccagccagttcttatgcaat

SEQ ID NO: 342785 - DNA, 75 bp, Artificial Sequence
  Synthetic
ttcaagctatgttcatatctcaaatgataatcagaaccttgaaattatggataagcaattggattgcaatcttat

SEQ ID NO: 342786 - DNA, 75 bp, Artificial Sequence
  Synthetic
ctaccaacaaattatgctgttaggattgggaattatagaaacttggttgcaattgcctcagtaccagaatataga

SEQ ID NO: 342787 - DNA, 75 bp, Artificial Sequence
  Synthetic
tgatttttctgtccatctacatactgaggggtcttgctgcataagagctgtagacatgtgtgttatcaatgagac

SEQ ID NO: 342788 - DNA, 75 bp, Artificial Sequence
  Synthetic
ttctgatgaagtgcctccaatgagtgtcccttatggtaataaatttgtttatgatgattcaccattggatcatga

SEQ ID NO: 342789 - DNA, 75 bp, Artificial Sequence
  Synthetic
tcaacaggttaaaattgagaacttaagctttcaggctaatatcactggcttagatataataccaactgaagaaaa

SEQ ID NO: 342790 - DNA, 75 bp, Artificial Sequence
  Synthetic
gatccctctccttgcacattttgtaggactgcaatttgctcatagccttactggtttagatgaggctacttcctt

SEQ ID NO: 342791 - DNA, 75 bp, Artificial Sequence
  Synthetic
ggttaacgatgcagttatagagactgattatgctaacaattggatcagtgaatgtctcaatacatacatggataa

SEQ ID NO: 342792 - DNA, 75 bp, Artificial Sequence
  Synthetic
ggtgttctattatactgcatggaacatgctgcttgatttgtcataccaaatgtattaccttagggttactggaat

SEQ ID NO: 342793 - DNA, 75 bp, Artificial Sequence
  Synthetic
aactgcaattttggactatatgacattgattcttgatagaataccgggtcttgcactaactgggattgcctcaac

SEQ ID NO: 342794 - DNA, 75 bp, Artificial Sequence
  Synthetic
aatcagtcaccccaaaatattaaggaggttaatcaacctcggaattgtaattcctagtaattctccatatttagc

SEQ ID NO: 342795 - DNA, 75 bp, Artificial Sequence
  Synthetic
aacacttgattatcataaaatgtccactttatctatcatgtggggagttcagagtgttctcagtgacatcagctc

SEQ ID NO: 342796 - DNA, 75 bp, Artificial Sequence
  Synthetic
agggttagatattgaacttatcattccctctgaagatagtacagagttatctgacagagttttgaatcttgttgc

SEQ ID NO: 342797 - DNA, 75 bp, Artificial Sequence
  Synthetic
aagaaagctgtctttaatctcacttgtgattggacacgggagtgctctgtcgtatgttagaggactgacccctga

SEQ ID NO: 342798 - DNA, 75 bp, Artificial Sequence
  Synthetic
tgtcaagtgcaaaacattgacagagaaattaattgttatcattgaaacaacaatcaccgatcctgagcaaagagg

SEQ ID NO: 342799 - DNA, 75 bp, Artificial Sequence
  Synthetic
caaactctcaacattagttactgaaccaaaaatatcagcatttccaagtaatttgtattatcttatgcgaaagtt

SEQ ID NO: 342800 - DNA, 75 bp, Artificial Sequence
  Synthetic
actcaattggattagggattcagataaagctcagcaattaattgcaatgttttatgatagttttggatatatgga

SEQ ID NO: 342801 - DNA, 75 bp, Artificial Sequence
  Synthetic
atttcaaacctcagatatctctcccattaatcatagcatcgatacatgtacatccaattcgttaacaattcacga

SEQ ID NO: 342802 - DNA, 75 bp, Artificial Sequence
  Synthetic
taaagtgagtaacatactggattatgatactgttgcagaaaagtatgcctacccaaaatgtgatccatcactaca

SEQ ID NO: 342803 - DNA, 75 bp, Artificial Sequence
  Synthetic
gtaccacatgaaacctgttgcagatcctcctgtacatcatatattaagacccataggattgtcttcaacttcttg

SEQ ID NO: 342804 - DNA, 75 bp, Artificial Sequence
  Synthetic
gtataaaggcttgtccattctgaatgttctatcttgctctaaagttcctacagggaatcatctctatcttgctga

SEQ ID NO: 342805 - DNA, 75 bp, Artificial Sequence
  Synthetic
ggggagtggcgccctgatgactctcatagaatcttatatacctgcacagaagatatattacaacagcctgttttc

SEQ ID NO: 342806 - DNA, 75 bp, Artificial Sequence
  Synthetic
aagcggtcagtgccctccacaacggaatttccagccaatgccaactcagtttacagaaagcatggtgtacatgaa

SEQ ID NO: 342807 - DNA, 75 bp, Artificial Sequence
  Synthetic
catccaaaatggctatgggaatagtgatttgattgatcaagaatttattgctttgtggagtggagtggagagaca

SEQ ID NO: 342808 - DNA, 75 bp, Artificial Sequence
  Synthetic
gacagacttaagcaagaaagattgtattgaattcatactccagcagattccatcacaatcattgtcattaatatc

SEQ ID NO: 342809 - DNA, 75 bp, Artificial Sequence
  Synthetic
ctcagatattgaagagggaataggtagtaatcttactcaactgtcaaaggctacaataaattctgtcttactatc

SEQ ID NO: 342810 - DNA, 75 bp, Artificial Sequence
  Synthetic
atatgtacttttgaaagatggcgggttattaataatgaagattaatttgactcctttttgcaaattctcacaatt

SEQ ID NO: 342811 - DNA, 75 bp, Artificial Sequence
  Synthetic
gataacactcttaagctcaaaatttaagaacataaaagctgtaaggtcatcatactctgacccaagtacagacga

SEQ ID NO: 342812 - DNA, 75 bp, Artificial Sequence
  Synthetic
attatatctggttgcaacagcatcaggagattcctcagttggggatttcaatgcagcaagatacaattcggatat

SEQ ID NO: 342813 - DNA, 75 bp, Artificial Sequence
  Synthetic
tcttgatagtgagtcatttacactagtttcacctcaattgctcctagatctacatcatgggattactgagaatca

SEQ ID NO: 342814 - DNA, 75 bp, Artificial Sequence
  Synthetic
gaaaacagtatatgatataatagaaatgcaaatttcaactggtcagtgttttgagaatattgaagatcatgagac

SEQ ID NO: 342815 - DNA, 75 bp, Artificial Sequence
  Synthetic
tttaatcaaactaggtagtagcactcaaagaaatagactaatgacatccccagccgctgagtcaagatcagaatt

SEQ ID NO: 342816 - DNA, 75 bp, Artificial Sequence
  Synthetic
gctagaacggatatctgatattatcactctctacctgaaggagacaataaatataattgagtcatcacagctaga

SEQ ID NO: 342817 - DNA, 75 bp, Artificial Sequence
  Synthetic
taggaatcgattgttatacaactcatacaatgtctctagttatgggaaaattaggacttctgccaaattgagtgc

SEQ ID NO: 342818 - DNA, 75 bp, Artificial Sequence
  Synthetic
aaagttggtacttgacatcttcataagaaattggattaatttgggagtacctctgagaaaaagaattgcaggtat

SEQ ID NO: 342819 - DNA, 75 bp, Artificial Sequence
  Synthetic
gatagaaaaggggtatttttgtgttggtgaaaccatttcatgtaaggattatttgtcattctgtaaagcaagaaa

SEQ ID NO: 342820 - DNA, 75 bp, Artificial Sequence
  Synthetic
atacttgttaaagactattgggatcgatcagctagcagtagaattggaacaaaatctttcttgtgaatttcaaag

SEQ ID NO: 342821 - DNA, 75 bp, Artificial Sequence
  Synthetic
atccgagcaaaagaaactctggaagaacataggatgcattgcattcattgaatccattgaacccggtgatttcaa

SEQ ID NO: 342822 - DNA, 75 bp, Artificial Sequence
  Synthetic
ttcaccagagcagattttccaggatgatgaaattgaggagcgcgacatcggaggcgaattgctgtaaccagggaa

SEQ ID NO: 342823 - DNA, 75 bp, Artificial Sequence
  Synthetic
attgctgtaaccagggaaaccataaagttttaactgcagttttaagaaaaaacccatttagattttccccttggt

SEQ ID NO: 342824 - DNA, 75 bp, Artificial Sequence
  Synthetic
accagagggaaaattaagaagggtctttccagtcagatgagattcctgattcagtgggcccggaagtggcatagt

SEQ ID NO: 342825 - DNA, 75 bp, Artificial Sequence
  Synthetic
tcggggtcgattacgactctgaatggtctcttccggagctttaattggataattcggtatcgttgaggtacaacc

SEQ ID NO: 342826 - DNA, 75 bp, Artificial Sequence
  Synthetic
aaattatagcaatcatggcatcactcttcagagccttggaacaatttactctggaacaagatcaaggcggtcgcg

SEQ ID NO: 342827 - DNA, 75 bp, Artificial Sequence
  Synthetic
gtaatgtgggtgaccagccgccagagactctccaggcaactatcaaagtctttgtaattaatacacctgatcccc

SEQ ID NO: 342828 - DNA, 75 bp, Artificial Sequence
  Synthetic
gcttaagatataggatgatgtgcttttgcttgcgcctaatagttagtaactctgcaaggactgggcagagacatg

SEQ ID NO: 342829 - DNA, 75 bp, Artificial Sequence
  Synthetic
gagctctcatgacactgctcagcttgccaactgcagtgatgcaaaatcattttcgcactgcagagcgatctcctg

SEQ ID NO: 342830 - DNA, 75 bp, Artificial Sequence
  Synthetic
actgccaaattgaacggattgaagttgatggatttgaaccggggacttacagaatcagaacaaatgcaagaaccc

SEQ ID NO: 342831 - DNA, 75 bp, Artificial Sequence
  Synthetic
ccctgacccatggagaggtggtcgcccttgaggagatggcagatgacatcccagaagctctagcaaaccacacac

SEQ ID NO: 342832 - DNA, 75 bp, Artificial Sequence
  Synthetic
cctttgtggatgcgcagactgaactcgaagaatgtgatgagatggaaaaattccttgaggcgatctacagcaccc

SEQ ID NO: 342833 - DNA, 75 bp, Artificial Sequence
  Synthetic
tcatccaagtgtggataatggttacaaagagcatgaccgcatttgaccaaccaacagggtcagatgagcgtaggg

SEQ ID NO: 342834 - DNA, 75 bp, Artificial Sequence
  Synthetic
ttgcaaaataccagcaacaaggcaggcttaaccctcattaccttctgcaaggagaggtgcgtaggcggatccaac

SEQ ID NO: 342835 - DNA, 75 bp, Artificial Sequence
  Synthetic
tatgcataaggcagagcctccccattaggcaattccttgtgaatgaattgcaaacagcaagcaaccaaggtccaa

SEQ ID NO: 342836 - DNA, 75 bp, Artificial Sequence
  Synthetic
ttacagggaaatattatgcaatggtggcggacatcgggaagtatattatgaatgctggaatggggggattcttca

SEQ ID NO: 342837 - DNA, 75 bp, Artificial Sequence
  Synthetic
tgaccatcagatttgctcttggacaaaaatggccgccacttgcactagctgcattctcgggagagatagttaaga

SEQ ID NO: 342838 - DNA, 75 bp, Artificial Sequence
  Synthetic
tgaagagcctaatgcttcaatatagaagattaggagacagggcaaaatttatggcactgttggaaatgtcagaga

SEQ ID NO: 342839 - DNA, 75 bp, Artificial Sequence
  Synthetic
tgatggattttgcaccatccaacttcccactattgtatagttatgcaatgggtatagggagtgtccaagatcccc

SEQ ID NO: 342840 - DNA, 75 bp, Artificial Sequence
  Synthetic
aaatgaggggctacacattcggaagaccctacctcaatgcagcattttaccagctgggtgtcgaaactgcaaacc

SEQ ID NO: 342841 - DNA, 75 bp, Artificial Sequence
  Synthetic
aacagcaaggatctgtagacaaagacatggctgctgaacttgggctaaccgaggcagataagagggcaatggcag

SEQ ID NO: 342842 - DNA, 75 bp, Artificial Sequence
  Synthetic
caactgtcactcgactcacgacaggcagaggagggctgcagggcaacatgggtatcaatgccatggcaagaagag

SEQ ID NO: 342843 - DNA, 75 bp, Artificial Sequence
  Synthetic
ggcagcaactcccgcagcctcaagacaatgtagtagaagaagatgaggaagaggatgaggaagaggaagaacccc

SEQ ID NO: 342844 - DNA, 75 bp, Artificial Sequence
  Synthetic
agaatcaagagagggaggtagatccagaactagaaaggagagtggcactcaggatcgcacaggatcaagagaggt

SEQ ID NO: 342845 - DNA, 75 bp, Artificial Sequence
  Synthetic
gggccaggaggttggctgaaatagaagcagaacgagttgccagacaagcagccagccatccacctcaacatgatg

SEQ ID NO: 342846 - DNA, 75 bp, Artificial Sequence
  Synthetic
caacaagagatcaaatacctgatcaacaagaatatgatagcaacctaattgagtagcaaggcttacaaacaacga

SEQ ID NO: 342847 - DNA, 75 bp, Artificial Sequence
  Synthetic
gcgggcttgcgcaaactgcatcgcaatatattatgtaggagctttatgtctttaagaaaaaactatagtaggccc

SEQ ID NO: 342848 - DNA, 75 bp, Artificial Sequence
  Synthetic
gaaggttggcatcttccgggctctcgctgacttcggctccgaagtctcttctgccactcaacttaggactgattt

SEQ ID NO: 342849 - DNA, 75 bp, Artificial Sequence
  Synthetic
tgaaattgttaccacaacttcccaatatggaacccactccgtcagacgcggaaatctccgcatggatagagaaag

SEQ ID NO: 342850 - DNA, 75 bp, Artificial Sequence
  Synthetic
gactagctactgccaagcattttgctccaaatcccgtatcatcacaaagcagcttagggaaatcaacaatcaaga

SEQ ID NO: 342851 - DNA, 75 bp, Artificial Sequence
  Synthetic
aggggaataccaaagtcctcgtctcatcagcagaacaaattgccagctcccaacccgcagccagtcacaccgtca

SEQ ID NO: 342852 - DNA, 75 bp, Artificial Sequence
  Synthetic
aggttcaagctcaagtccacccgcaacagcccaccgcttcccaaccatgcactggagcaagaccaaaaacaaaga

SEQ ID NO: 342853 - DNA, 75 bp, Artificial Sequence
  Synthetic
gaactgcaacacctgccccgaccccgtctgtccagcaggcagtcaaaatagagcctgtatatgaggatattgtat

SEQ ID NO: 342854 - DNA, 75 bp, Artificial Sequence
  Synthetic
caaatcccactcatcaagctgagaatgcaccattgattgcaactcaatcatctgcaaagcagtcactgctgtgta

SEQ ID NO: 342855 - DNA, 75 bp, Artificial Sequence
  Synthetic
ctgagcctcttcccagccaaccttcttccgctactcgctgtggagagcaaagctttaagagggggcgattttctt

SEQ ID NO: 342856 - DNA, 75 bp, Artificial Sequence
  Synthetic
cctgttccaccgggaagagatccaacagtcacccaggacacagacgagaatttgatcttgtttggggctcaggaa

SEQ ID NO: 342857 - DNA, 75 bp, Artificial Sequence
  Synthetic
aatttgaggtcagagaatggtgcaacccaacctgctccccaatcactccaatccccagaagatatcagtgccgtt

SEQ ID NO: 342858 - DNA, 75 bp, Artificial Sequence
  Synthetic
gtggggaatgccctagaatctgcaaacagtgtgagggagattatcaggtacttgaaagtcatggaggccaaaatg

SEQ ID NO: 342859 - DNA, 75 bp, Artificial Sequence
  Synthetic
acacaaattgaatggaaagtggataaagtactggctcagaatagtcttatccagcaagtcaggaatgaacagctg

SEQ ID NO: 342860 - DNA, 75 bp, Artificial Sequence
  Synthetic
gtgctcaaagctagcatggcaacaattgaaggattaatgacaacaataaaaattatggatcctggggtagggccg

SEQ ID NO: 342861 - DNA, 75 bp, Artificial Sequence
  Synthetic
ggcgcaacagccgcacaagccaaaagattgttcaaggaagctccggtagtagtcagtggccccatagtaggtgac

SEQ ID NO: 342862 - DNA, 75 bp, Artificial Sequence
  Synthetic
aatgatctcatctttgaggacaaaattgaaatcagtagtcttgggaaaccacaaaaggttgctcctcaaccaaag

SEQ ID NO: 342863 - DNA, 75 bp, Artificial Sequence
  Synthetic
aagcggcttgtcactagtgaggctgacatagctggttataaactcactctcacaaaattactaaaagagtgcatt

SEQ ID NO: 342864 - DNA, 75 bp, Artificial Sequence
  Synthetic
cccaacgccaatcagcacaaaaaatttgaagatctgatagctagtgtaaagaatgaaagtgatttcaaagcagca

SEQ ID NO: 342865 - DNA, 75 bp, Artificial Sequence
  Synthetic
aagagggaaatcgtgagagctgcaatctagagatcagtcaacaccaacttacaatcttacctattaactttagct

SEQ ID NO: 342866 - DNA, 75 bp, Artificial Sequence
  Synthetic
tgtgccttaaacctataatctgcttctgcatagcatctaatctctcaaaacaaaaagcattcctacttcgaaact

SEQ ID NO: 342867 - DNA, 75 bp, Artificial Sequence
  Synthetic
cacctgccaacacagaaaaaaatcatagcctgaaggcctttaagaaaaaactaggctggggtcgaacccatagac

SEQ ID NO: 342868 - DNA, 75 bp, Artificial Sequence
  Synthetic
ccctaacgtccccaacaatggctgggagacaggctacaattcctgttccaatcaattttgagagcccaaagaact

SEQ ID NO: 342869 - DNA, 75 bp, Artificial Sequence
  Synthetic
atctcaatgcattcccaatcgtccaagctgacccgtctgtatctggagaagccgggaagctgctcaaacaaatca

SEQ ID NO: 342870 - DNA, 75 bp, Artificial Sequence
  Synthetic
gattcaaagatctaacccttaggggatccaccgaagcccctatctcatttgttaactcatatggattcataaagc

SEQ ID NO: 342871 - DNA, 75 bp, Artificial Sequence
  Synthetic
cattgcgcactagggaggagttcttttctgaaatgcacaaaccatcccaagccccctgtcttacagcttgctgcc

SEQ ID NO: 342872 - DNA, 75 bp, Artificial Sequence
  Synthetic
tcccttttggagctggtccggccatagaacacccagataagataatggatgacctagacaaagtgtttatagtgg

SEQ ID NO: 342873 - DNA, 75 bp, Artificial Sequence
  Synthetic
ttagaaagagtgcaagtactattgaggagtgtgtgttcgatatccggaaactgccatccagcctatcccgccacc

SEQ ID NO: 342874 - DNA, 75 bp, Artificial Sequence
  Synthetic
agcttgcaggcaaccgtgttctttgtgttgcatcggataaatacatcaaggctccgtgtaagctgacttcaggta

SEQ ID NO: 342875 - DNA, 75 bp, Artificial Sequence
  Synthetic
tggattatacatacaacattgtctttctctctataactcactgcccgccaagtcaaaaattccgtgttcctatgc

SEQ ID NO: 342876 - DNA, 75 bp, Artificial Sequence
  Synthetic
ctatacagagccttagagctaaggtgatgaggagtgtccacctagaaattatgattaaagttgactgtgacaaaa

SEQ ID NO: 342877 - DNA, 75 bp, Artificial Sequence
  Synthetic
actcaccgatcaccaagaatctgatctatgacccaagtaatgacatctggatggcatctatttggtttcatctgt

SEQ ID NO: 342878 - DNA, 75 bp, Artificial Sequence
  Synthetic
gcaatttctacaagggttcaaagccgttcaaggaatatgatgatcagcactttgcctcaaaatgcagagccatgg

SEQ ID NO: 342879 - DNA, 75 bp, Artificial Sequence
  Synthetic
gtctagaagtaggcttagtagatttttggggtccaacatttttggtcaaagcacatggtaagattcctcacgcag

SEQ ID NO: 342880 - DNA, 75 bp, Artificial Sequence
  Synthetic
caagacctttctttggtaagcacggatgggtctgccatccaatgatggactgtgctcctgcaatcagtaagtcac

SEQ ID NO: 342881 - DNA, 75 bp, Artificial Sequence
  Synthetic
tttgggcattgagtatatctatcctacaagtcaacgctgttttgcaagcctcagacttaaatcagatgattagaa

SEQ ID NO: 342882 - DNA, 75 bp, Artificial Sequence
  Synthetic
tgaccgacgttgtgttcccaaaggtgaagattaacccagatattgctggagtacagaagactcgctggaacccgg

SEQ ID NO: 342883 - DNA, 75 bp, Artificial Sequence
  Synthetic
taaagaaattagtcaccattgattagccacaaatctgcgcatcctgtatggcactggaacgccgtccccacatca

SEQ ID NO: 342884 - DNA, 75 bp, Artificial Sequence
  Synthetic
gtcaaccccagaaatcaaagacatacacatttccctcccaaaacaaactgtagttaataatcaaccccatcccat

SEQ ID NO: 342885 - DNA, 75 bp, Artificial Sequence
  Synthetic
ctgaatgatcattctccttaatcacgcatataccttcagtttaagaaaaaactgcaaagagtctaagacttggag

SEQ ID NO: 342886 - DNA, 75 bp, Artificial Sequence
  Synthetic
gaaatgaaagacgggggcgaacccatacacgatagaccccacagccaaagaactgtccattatagttaaatgaac

SEQ ID NO: 342887 - DNA, 75 bp, Artificial Sequence
  Synthetic
aatgctctggttaactatcttaattgccttagttgggaatcatgagtctacttgcatgaatataaattttctaca

SEQ ID NO: 342888 - DNA, 75 bp, Artificial Sequence
  Synthetic
atctttagggcaaataaattcccaaaagagatttctgaatttctatacccaacaaccaccaagttatatggtaat

SEQ ID NO: 342889 - DNA, 75 bp, Artificial Sequence
  Synthetic
caggttggttccaactctacaactttctgctaacaactgtactcttggtagcatagtacgttatcgtaatgctat

SEQ ID NO: 342890 - DNA, 75 bp, Artificial Sequence
  Synthetic
taaggagctaatacaacccatggatgaaaatctcagatggttatcatcaaatcttattccacaaaggcgcgggaa

SEQ ID NO: 342891 - DNA, 75 bp, Artificial Sequence
  Synthetic
aagatttgctggagtggctgtaggtttagctgctttaggtgttgcagttgctgctcaagcaactgcggcagtagc

SEQ ID NO: 342892 - DNA, 75 bp, Artificial Sequence
  Synthetic
attggtggaagctagagcaaatgcagaaaaaatagcatccatgtctcagtcaatacaagaaactaacaaagcagt

SEQ ID NO: 342893 - DNA, 75 bp, Artificial Sequence
  Synthetic
aacatctcttagtcaggcagtatctgcaagtggcattgctatacaagccattcaaaacgagatcaataatgtgat

SEQ ID NO: 342894 - DNA, 75 bp, Artificial Sequence
  Synthetic
tcatccaatactaaaccaagtccaatgtgatgtattagatgcccgggtaggcaacatacttaatctatatttaat

SEQ ID NO: 342895 - DNA, 75 bp, Artificial Sequence
  Synthetic
aaaagtcacaacaatatttcaaaatcagttaacaaaccctgctctacagcgattatcaactcaagctctgagcat

SEQ ID NO: 342896 - DNA, 75 bp, Artificial Sequence
  Synthetic
gcttatgcagtctacttcatcttatctgcgtaatctttcatcctcagaaagtgcaattaatgcagatttaagtat

SEQ ID NO: 342897 - DNA, 75 bp, Artificial Sequence
  Synthetic
gaccaacttaatcgaagcccaaatagtaggtatcaatatgacaaatcttcaattagtccttgctgtcttcatacc

SEQ ID NO: 342898 - DNA, 75 bp, Artificial Sequence
  Synthetic
ttctattgcgagattgaatggcgcgttgctctatgactttattagtattacaatcagctcaaatcaaaccgaggt

SEQ ID NO: 342899 - DNA, 75 bp, Artificial Sequence
  Synthetic
tatgctacaaattcctcatagggttttagagatagggaatagtctttatacatttgaaggtacacagtgtgagat

SEQ ID NO: 342900 - DNA, 75 bp, Artificial Sequence
  Synthetic
gactaagctaaatgcttattgcttgtacagcgatgccattccagtaactgaatctcttagagactgtatgaacgg

SEQ ID NO: 342901 - DNA, 75 bp, Artificial Sequence
  Synthetic
gttgtttagtcaatgtggatttgtaaggataattggttctttcgctaatagatttgcgagtgtgaacggggtaat

SEQ ID NO: 342902 - DNA, 75 bp, Artificial Sequence
  Synthetic
atatgcaaattgcaaacaccttacttgttcttgcctacagcctgatgaaattatcactcaagacactaatgtccc

SEQ ID NO: 342903 - DNA, 75 bp, Artificial Sequence
  Synthetic
attaactataatagatacaaagagatgtacaaaaataagtttagggcatctgacatttaccataagagagtacgc

SEQ ID NO: 342904 - DNA, 75 bp, Artificial Sequence
  Synthetic
aaatgtaacttactcactcaggactgaaatagcaaattctcaaatcactgtagtgagccctttggatttatcttc

SEQ ID NO: 342905 - DNA, 75 bp, Artificial Sequence
  Synthetic
acaattgaccacaataaacaattcacttgctgatgcaacaaatcatattatgaatagtgatcgtattttggatag

SEQ ID NO: 342906 - DNA, 75 bp, Artificial Sequence
  Synthetic
gctcaactctggtctgtatagcaaatgggttataatatttcttatatgtgcatcaattgtatcactaataggact

SEQ ID NO: 342907 - DNA, 75 bp, Artificial Sequence
  Synthetic
agtatttctgggcttcctaattagagggcttattttggaattaagatcaaaacacagatctaatcttaataaggc

SEQ ID NO: 342908 - DNA, 75 bp, Artificial Sequence
  Synthetic
tagcacttactctattgattcttcaatagggttgacataaattctcatcagtgtcattttaatgtctcattaact

SEQ ID NO: 342909 - DNA, 75 bp, Artificial Sequence
  Synthetic
gtgattagtatatagctctatgtaataggttagatatgatttttaataaaaaacttgacattggaagccctaccc

SEQ ID NO: 342910 - DNA, 75 bp, Artificial Sequence
  Synthetic
gggcccgacccagtcagccctccagccccgcagctccacacacggacccacgacgacatccaatcatgcacaaca

SEQ ID NO: 342911 - DNA, 75 bp, Artificial Sequence
  Synthetic
ggacacaatctgtcagcagtatagacacctcatctgatgtctatctccctcggagaaagaaggccgtcacaaaat

SEQ ID NO: 342912 - DNA, 75 bp, Artificial Sequence
  Synthetic
tcacatttaagaaaatcttccgagttctaatcttaacactcttactatcaattattataatcatagcagtaatct

SEQ ID NO: 342913 - DNA, 75 bp, Artificial Sequence
  Synthetic
tcccaaaaattgaccacatcagagaaacatgcgataacagtcaaatactggaaacaattaccaatcaaaactcgg

SEQ ID NO: 342914 - DNA, 75 bp, Artificial Sequence
  Synthetic
aaatcaagaacctgattaactctgctatcactaaccttaatgtattattaacatcgactacagttgatttaccaa

SEQ ID NO: 342915 - DNA, 75 bp, Artificial Sequence
  Synthetic
ttaagcttaataattttggaaagagtattgtggaccaggtaacaatgatggtcagacaatgtaatgctgtctgtc

SEQ ID NO: 342916 - DNA, 75 bp, Artificial Sequence
  Synthetic
ggggccctggagatcgtccgactcaaaatattgaattattcaaaggtttataccacacctccccaccctcaaata

SEQ ID NO: 342917 - DNA, 75 bp, Artificial Sequence
  Synthetic
cttccaccaaattgagcatgattactgaagcatcaaatccagatgatatagttccccggcccgggaaactgcttg

SEQ ID NO: 342918 - DNA, 75 bp, Artificial Sequence
  Synthetic
gctgcaccaggtttccatcttttagtgtccattatgggttatggtgttatggtcacatggcttctacagggaatt

SEQ ID NO: 342919 - DNA, 75 bp, Artificial Sequence
  Synthetic
gcagcgggtcatctccatcagtgcagatcatcagaataggttcaattgggaccaataaggacggcacgcccaaat

SEQ ID NO: 342920 - DNA, 75 bp, Artificial Sequence
  Synthetic
atgtaatcatagccagtgcatcactcccagagacaactagactgtatcattgctctgtcacaatgacatctattg

SEQ ID NO: 342921 - DNA, 75 bp, Artificial Sequence
  Synthetic
gatgctatattttatgcactactccctcagtctccgagacagatgactatagtactatgggtatagagaaaatga

SEQ ID NO: 342922 - DNA, 75 bp, Artificial Sequence
  Synthetic
gcatatccttcttatcattggatggatacttaacacagttgggtcagccaactggattggacaatcaaaatttgt

SEQ ID NO: 342923 - DNA, 75 bp, Artificial Sequence
  Synthetic
atgctttatatcccggtcctgggtcaggtgtgatctttagggattttttgatattcccgatgatgggcggaattc

SEQ ID NO: 342924 - DNA, 75 bp, Artificial Sequence
  Synthetic
ggttaatggatgcacagaagatgctcaatagaaatatcacctatagaggctttcccccaagtgagacctgcactg

SEQ ID NO: 342925 - DNA, 75 bp, Artificial Sequence
  Synthetic
aaagtgaacttaagcttaaacaggaagtagcaaatatgttaacaagtccttattatggtgaagtgttagtgctca

SEQ ID NO: 342926 - DNA, 75 bp, Artificial Sequence
  Synthetic
acttcctctatgtatgctctctcttagataatatccctggagattgttctgtccaattgattccgccggataaca

SEQ ID NO: 342927 - DNA, 75 bp, Artificial Sequence
  Synthetic
tgacacttggagcagaatcaaggctgtacgtattaaatggatcactaattatgtacaaaagagggtcatcatggt

SEQ ID NO: 342928 - DNA, 75 bp, Artificial Sequence
  Synthetic
ggccgtatacagagctatatcagataaattatagggtaaacaatcgtgcattcagggtgagggaatccgtgagga

SEQ ID NO: 342929 - DNA, 75 bp, Artificial Sequence
  Synthetic
ttaatacaacatccacaagcagaccaggagtacaagggtgcaatcttgaaaaagtttgcccaaaagtttgtgtat

SEQ ID NO: 342930 - DNA, 75 bp, Artificial Sequence
  Synthetic
caggcatctatcagagccccggcatcatatcagcaccggtgaatccaacaagacaggaagaagggctcctttatt

SEQ ID NO: 342931 - DNA, 75 bp, Artificial Sequence
  Synthetic
tccttgtctggacttcctccatgagttcgaggacaggaccactgagctcattatgtgatcattctacctgtagaa

SEQ ID NO: 342932 - DNA, 75 bp, Artificial Sequence
  Synthetic
tcacatatcccattggagatgatacaattttcataggatatacggattccagttgtttcatgtctagtatcaagg

SEQ ID NO: 342933 - DNA, 75 bp, Artificial Sequence
  Synthetic
aaggaatttattgtattgccttcttggaactagataaccaaccttactccatgatggctattaggtctttatcat

SEQ ID NO: 342934 - DNA, 75 bp, Artificial Sequence
  Synthetic
atattatcaattagtagaattggccatcagactgttaccccttatcttacaaattctctgcttggattgagcttg

SEQ ID NO: 342935 - DNA, 75 bp, Artificial Sequence
  Synthetic
attactttaagaaaaacaatgggccagaatggctgccacatcgcagatcattctccccgaggtccatttggattc

SEQ ID NO: 342936 - DNA, 75 bp, Artificial Sequence
  Synthetic
tccaatagtagaaaataagcttttgtatctcctccagctaggtgagttgccaatctttgattcttactatgaaca

SEQ ID NO: 342937 - DNA, 75 bp, Artificial Sequence
  Synthetic
tgacttcttccctgaagttgactggccgagagtccgaagagaggaaaacaagctattttctagactcaacgaggt

SEQ ID NO: 342938 - DNA, 75 bp, Artificial Sequence
  Synthetic
cagagatagactcttgagcaaaactctttccgctactactcgcaagctacaccactcgctactgccaactccaat

SEQ ID NO: 342939 - DNA, 75 bp, Artificial Sequence
  Synthetic
cccatggcccagatgcatgcccgaattacacagtgttaccatcaagcactctttgcaacgattcacggatgctga

SEQ ID NO: 342940 - DNA, 75 bp, Artificial Sequence
  Synthetic
gcttaccatcacacatgccgccgaaagtatcagtcaaggtttgtctagtgtgattaatgaactagcagataaatt

SEQ ID NO: 342941 - DNA, 75 bp, Artificial Sequence
  Synthetic
aacaggtaaatcagatctattctcaaggaatattcaatcatgtatggaccattcaagccacacccgcccaaatgg

SEQ ID NO: 342942 - DNA, 75 bp, Artificial Sequence
  Synthetic
actgattgacattgcccaaattgctcaaagtaccgactggaaggacaactttaatcagtggttcctgattcgcca

SEQ ID NO: 342943 - DNA, 75 bp, Artificial Sequence
  Synthetic
cttaatgagacaattgatcatggacaacaatacagggaagatttccattccaccaattgagattgatgatagaca

SEQ ID NO: 342944 - DNA, 75 bp, Artificial Sequence
  Synthetic
gatgtctgtaattatcactccagagctagtcacaatctggatagggaaaactaatcatgtattctacttcacatt

SEQ ID NO: 342945 - DNA, 75 bp, Artificial Sequence
  Synthetic
tgagatgacattgatggtctgtgacatgtatgagggcaggatgaatgcaattatgcttaccaccatgagttgtta

SEQ ID NO: 342946 - DNA, 75 bp, Artificial Sequence
  Synthetic
cttgtcacctttaagaaacaggcttcaaagattatactatctagttgatagcctgtgtgaaatcataggaaataa

SEQ ID NO: 342947 - DNA, 75 bp, Artificial Sequence
  Synthetic
tgtgtattctattgtggcatcaatggaaagcttggtatatgggaagatacaacttgcagacccagtacctgatgt

SEQ ID NO: 342948 - DNA, 75 bp, Artificial Sequence
  Synthetic
tgctggtgagttctactccttcattatcactgagatgttatcagcattaattgaaaccaagatgtttacaataca

SEQ ID NO: 342949 - DNA, 75 bp, Artificial Sequence
  Synthetic
agaggcaacaactgtcgtagagagaatatctgaatgctatgacaatctctcacctgacttaattgcagagctttt

SEQ ID NO: 342950 - DNA, 75 bp, Artificial Sequence
  Synthetic
atgccttatgcgtatgtggggacatccttccttgagtgcagagaaagctgcagataaagtgaggaaatcaatgtg

SEQ ID NO: 342951 - DNA, 75 bp, Artificial Sequence
  Synthetic
tgcggcaaaagtaattgatcttgagaccaacttaaagacacttgcattcttccatggtatccttattaatgggta

SEQ ID NO: 342952 - DNA, 75 bp, Artificial Sequence
  Synthetic
tcgccggaagcataatggaatttggccaaaatgtacccttccacccaatgcaagcctgagtcttgccgaattgaa

SEQ ID NO: 342953 - DNA, 75 bp, Artificial Sequence
  Synthetic
acatgacaattcagaattacctcaccattatatattgcaacattggaaagaggtagcattcatccagttcgaaaa

SEQ ID NO: 342954 - DNA, 75 bp, Artificial Sequence
  Synthetic
gagttttgatgcagatcctggagaggagctcagcatattcatgaaggacaaagccatcagtgcccccaaaaaaga

SEQ ID NO: 342955 - DNA, 75 bp, Artificial Sequence
  Synthetic
ctggatgagtgtctttaggagaagcttgataaagccaatctgcgaaaagctaggtgccccgcttccaaatgcttt

SEQ ID NO: 342956 - DNA, 75 bp, Artificial Sequence
  Synthetic
taatagaagactactgctgaacttcctttctgacagtaactttgacccagacaaggaacttgaatacgtaacaac

SEQ ID NO: 342957 - DNA, 75 bp, Artificial Sequence
  Synthetic
tgggagatacttagatgatgattcattttgtgcatcttactcattaaaggagaaggaaataaaagagacaggaag

SEQ ID NO: 342958 - DNA, 75 bp, Artificial Sequence
  Synthetic
gatttttgcaaaacttactaaaaatatgagatcttgtcaggtgatgagtgagtcactattagctaatcatgctgg

SEQ ID NO: 342959 - DNA, 75 bp, Artificial Sequence
  Synthetic
gaaattattcaaagagaatggtgtggtcttagacaatcttaatttgactaaatctctcctgaccatgtctcagat

SEQ ID NO: 342960 - DNA, 75 bp, Artificial Sequence
  Synthetic
tggcctgatatcaaaacagtcacggagaaatgttcgggaaaatgtaacagtgatgaccaaggtgcataagagaag

SEQ ID NO: 342961 - DNA, 75 bp, Artificial Sequence
  Synthetic
caacttagcaaacacaaaaattcagtctagtcatggaccatcatcccctacaactgatgaacaattagaaattgc

SEQ ID NO: 342962 - DNA, 75 bp, Artificial Sequence
  Synthetic
tgccttctttttgacaactgatttagaaaagtactgtctaaattggaggtatcaaagtattgcaatgtttgccaa

SEQ ID NO: 342963 - DNA, 75 bp, Artificial Sequence
  Synthetic
ttctatgaaccaactgtatggatatccccatctttttgagtggatacacccacgcctgatgagatctacactgta

SEQ ID NO: 342964 - DNA, 75 bp, Artificial Sequence
  Synthetic
tgtgggtgatccatataacccacccagaaacatccacagcacagatctagatgagatgaagaacgagggaatttt

SEQ ID NO: 342965 - DNA, 75 bp, Artificial Sequence
  Synthetic
catcgtatccccgagaggcgggatagaagggctatgtcaaaaactgtggacaatgatatcaatatcaatcataat

SEQ ID NO: 342966 - DNA, 75 bp, Artificial Sequence
  Synthetic
cctctcagcagctgaatctggtacacgagtgatgagtatggtgcaaggtgacaaccagacaattgccataacaac

SEQ ID NO: 342967 - DNA, 75 bp, Artificial Sequence
  Synthetic
aaaagttccaagaagtatccctcataaggacaaaaaaaggatagcttatgaaaatagcaaagcattcattgagag

SEQ ID NO: 342968 - DNA, 75 bp, Artificial Sequence
  Synthetic
actaagagtaaacaatcaccatatgggccaccatctaaagagtcaagaaactatattgagttccaatttctttgt

SEQ ID NO: 342969 - DNA, 75 bp, Artificial Sequence
  Synthetic
ttatagcaagaggatatttatcaatggaaggattctaaaccaatccctaaagaacatgagcaaagcaaacctcat

SEQ ID NO: 342970 - DNA, 75 bp, Artificial Sequence
  Synthetic
atcagatgtattaggtgagtgcactcaatcatcttgctccaatctaactacaacaattatgaggttgaccgaaaa

SEQ ID NO: 342971 - DNA, 75 bp, Artificial Sequence
  Synthetic
tggggttgagaaagatatctgttactggctaagtttctacctttcaatcaaacaattgacctttgatctactgtt

SEQ ID NO: 342972 - DNA, 75 bp, Artificial Sequence
  Synthetic
ccccttgacatctcaatttgaggacccggtcacagcagcttacctcaatcatccacacttaattgggagaatctg

SEQ ID NO: 342973 - DNA, 75 bp, Artificial Sequence
  Synthetic
tgcaatcccttctcaattgggaggtcttaattactatgctatgagccgtctcttttgtagaaacattggagaccc

SEQ ID NO: 342974 - DNA, 75 bp, Artificial Sequence
  Synthetic
tctaacatctgcaacatctgacctcaagcgcctcataacacacaaagtgatcccagagtggtatctaagcaatct

SEQ ID NO: 342975 - DNA, 75 bp, Artificial Sequence
  Synthetic
tataaatcgacatcccggagaaggcggctggaacactcttgcatctgacccttatgcactgaatattgattacat

SEQ ID NO: 342976 - DNA, 75 bp, Artificial Sequence
  Synthetic
ctaccctcctacttcattcctaaaaagacatactcaaaaagtgcttatggagaacagcatcaaccccatgttatc

SEQ ID NO: 342977 - DNA, 75 bp, Artificial Sequence
  Synthetic
gggtgtcttttcagagaactccagtgatgaagaagctgcgttagcaaggttcttgcttgatcggccgcttgttat

SEQ ID NO: 342978 - DNA, 75 bp, Artificial Sequence
  Synthetic
gccaagagttgcacacattgtgattgaacagacatcttgcggcagaaggagacagatccaaggctatcttgacac

SEQ ID NO: 342979 - DNA, 75 bp, Artificial Sequence
  Synthetic
aactagaactatgatgaagcatgctctaaataagcaacctcctggctaccaaaaagtggagagaataattgaata

SEQ ID NO: 342980 - DNA, 75 bp, Artificial Sequence
  Synthetic
caatcgcctatacctaaattacaatttggaaattattaagaaaccaatcaagaagaaaacaaaaataataatcaa

SEQ ID NO: 342981 - DNA, 75 bp, Artificial Sequence
  Synthetic
ggcatctatgcttgacctgtgcagtattgacatttcaaagctattgcggagattgtcatggtctccacttctagg

SEQ ID NO: 342982 - DNA, 75 bp, Artificial Sequence
  Synthetic
tggtcgaccgcttgaaggattggaaacaccagacccgatcgagttaatctttggatcgttggtagatggttgcaa

SEQ ID NO: 342983 - DNA, 75 bp, Artificial Sequence
  Synthetic
tatctgtcactattgtttggcaggtgataaaaagtttacctggttctttataccttcgggcatccttcttgactc

SEQ ID NO: 342984 - DNA, 75 bp, Artificial Sequence
  Synthetic
tccaccagaagacaacccgccaatgagagtgccttatgtcgggtcgcgcactgatgagcgtagagttgcttcaat

SEQ ID NO: 342985 - DNA, 75 bp, Artificial Sequence
  Synthetic
tggttatgtgaaaggagcatctgtctctctaaagtctgccctacgctgtgcgggcatatacatctgggcattcgg

SEQ ID NO: 342986 - DNA, 75 bp, Artificial Sequence
  Synthetic
tgacacagaaacgaattgggaggatgcactagagttagccaacaccagagtgaatattaacatggatcaattaag

SEQ ID NO: 342987 - DNA, 75 bp, Artificial Sequence
  Synthetic
aactctcactccaatgccaaccagtgcaaacttaactcatcggcttgatgatgggctatctcaaatgaaattcac

SEQ ID NO: 342988 - DNA, 75 bp, Artificial Sequence
  Synthetic
acctgccagttcctatgccttttcttgttatgttcatatatcaaatgataatcagaacttagaacaactagacaa

SEQ ID NO: 342989 - DNA, 75 bp, Artificial Sequence
  Synthetic
gctgttagactcaaatttgatatatcaacaggttatgatattaggacttggattaattgaaacttggctggctgc

SEQ ID NO: 342990 - DNA, 75 bp, Artificial Sequence
  Synthetic
gccaaatacagaaaatgaagaagatatatctgtacatctgcacacaggatcctcatgttgcataagacctgtaga

SEQ ID NO: 342991 - DNA, 75 bp, Artificial Sequence
  Synthetic
catgtgtgtactcaatgaaactgaagctgaagtccctcatctactcgtgccgcgagcaaacaaatttgtatttga

SEQ ID NO: 342992 - DNA, 75 bp, Artificial Sequence
  Synthetic
tgacaatccgttggataatgagcaaattgagattatagacaatgttatgatacaatctagactgagtggagttga

SEQ ID NO: 342993 - DNA, 75 bp, Artificial Sequence
  Synthetic
ttgcttgaccattcaagagaagatacctcttctcgcacatctgattgccttacagtttgcccacagcttaattgg

SEQ ID NO: 342994 - DNA, 75 bp, Artificial Sequence
  Synthetic
cctggatgaatctacctcgttagtgaatgatgcagttgtggatgcggattatgctgcaaattggattagtgaatg

SEQ ID NO: 342995 - DNA, 75 bp, Artificial Sequence
  Synthetic
tttgaatacttatttggatagggtattttattacacagcatggaacatcctacttgacctctcttaccagatgta

SEQ ID NO: 342996 - DNA, 75 bp, Artificial Sequence
  Synthetic
ttacatgaggattacctctgttaattcggtgctagattacctaggtattgtcctcgcaagaatcccaggacttgc

SEQ ID NO: 342997 - DNA, 75 bp, Artificial Sequence
  Synthetic
tttaagtggaattgcctcaacaattaaccatcctaaaatcctaagaagaatgataaatcttggaatcttggtccc

SEQ ID NO: 342998 - DNA, 75 bp, Artificial Sequence
  Synthetic
atctaactctccttacctggcaacactcaattatcacaaattgacaactgatgcaattatgtggggtgcacatca

SEQ ID NO: 342999 - DNA, 75 bp, Artificial Sequence
  Synthetic
agtgctagctgatctacaatcaggaagggacattgaaatcataataccttctgaagatagcactgaactgagtga

SEQ ID NO: 343000 - DNA, 75 bp, Artificial Sequence
  Synthetic
cagaactctgaatttgatagctagaaaattaactcttatggcccttgtagttgcacctgattcagcacttcctta

SEQ ID NO: 343001 - DNA, 75 bp, Artificial Sequence
  Synthetic
tgtcaggggtcttccaccagatcagaaatgcaaggtcttaacagattatcttgtacagcttgtgttaaccatgac

SEQ ID NO: 343002 - DNA, 75 bp, Artificial Sequence
  Synthetic
ctcagatccagaaatcataaatagctggagatcagttatccaaatgccaaagttatcagcatttccccataatct

SEQ ID NO: 343003 - DNA, 75 bp, Artificial Sequence
  Synthetic
attctacctaactaggaaaatgttaaatgctgtcagggactcgtctgaaggacaagccttactggagcagttcta

SEQ ID NO: 343004 - DNA, 75 bp, Artificial Sequence
  Synthetic
tgggagcttcggattcttagaatctgatctaaatgtccaattaatggatcttgcttctggttctcagggtgattc

SEQ ID NO: 343005 - DNA, 75 bp, Artificial Sequence
  Synthetic
taaaagtctaacagtatttgatgtagttcaagaattgttcaactcggcacataatgtagaacgattgtgctttcc

SEQ ID NO: 343006 - DNA, 75 bp, Artificial Sequence
  Synthetic
tacaggagacatccaattagacctagagccgataggtcatgtcacaccgccaactcatcatgtcctaaggccaat

SEQ ID NO: 343007 - DNA, 75 bp, Artificial Sequence
  Synthetic
tggcctctcatcaacatcatggtacaagggcatcacactgatcaattatcttaaaggtcttaaactgcccatagg

SEQ ID NO: 343008 - DNA, 75 bp, Artificial Sequence
  Synthetic
tgatcatctttatttagctgagggaagtggggcaataatgaccataattgaagcatacttccctggagagcacat

SEQ ID NO: 343009 - DNA, 75 bp, Artificial Sequence
  Synthetic
attttacaatagttttttcacaagtgggcaatgccctccacagagaaatttccagccaatgcctacacagtttac

SEQ ID NO: 343010 - DNA, 75 bp, Artificial Sequence
  Synthetic
tgagagcatagtgtaccagcatttgcaaaatgacataccctgtgatatgggatttgtacaagacttcatcccatt

SEQ ID NO: 343011 - DNA, 75 bp, Artificial Sequence
  Synthetic
gtggagtggaaacagtaaacaaactgatttgagtcgtaaggagtgtgtcaattttatcctagatagaataccttc

SEQ ID NO: 343012 - DNA, 75 bp, Artificial Sequence
  Synthetic
ttctacagtctcaatactctcctgtgatttagaagagggctttataagtaatccaaacgagttatcttcagccct

SEQ ID NO: 343013 - DNA, 75 bp, Artificial Sequence
  Synthetic
acttcatgtactgttattatcattcattcttgtcaaagagtcaggtgtgacaatacttaaaactgacttaatgcc

SEQ ID NO: 343014 - DNA, 75 bp, Artificial Sequence
  Synthetic
gttctcaaaattgtcaaaacttgttacaatactaagtcacagatacaccaagattgatgctgtcagatcagccta

SEQ ID NO: 343015 - DNA, 75 bp, Artificial Sequence
  Synthetic
ctctgatccttctcatcatgaaatcttcttagtgtgtattgctggtcccgggatgggtattggggaattcaatat

SEQ ID NO: 343016 - DNA, 75 bp, Artificial Sequence
  Synthetic
ggctctgcacaaagcaaatactgatgcacagcaaggtttctcaatcatcaatccgcttcgtcatcatgaacttct

SEQ ID NO: 343017 - DNA, 75 bp, Artificial Sequence
  Synthetic
tcatatgactgcagattcgtctaataacgtgatggacataatagatatgcaaatcaaattggctcaggcgtccga

SEQ ID NO: 343018 - DNA, 75 bp, Artificial Sequence
  Synthetic
gaatgaagatgatcatatcctgctgtctagactgggttgcagatcccagacagataagctactgtcaattaaagc

SEQ ID NO: 343019 - DNA, 75 bp, Artificial Sequence
  Synthetic
atcaaagagtatggacgagttccttcatagagtggcatcacttatcactgtgtatctaaaagaatccatcaacat

SEQ ID NO: 343020 - DNA, 75 bp, Artificial Sequence
  Synthetic
cattgagtcttacaatgaagatcggactagactaatctttatggcctataatgtatcagcttatgggaaaattaa

SEQ ID NO: 343021 - DNA, 75 bp, Artificial Sequence
  Synthetic
aacctcagccaaaatatgtgcaaagacaattcttgacataactatccgaaattggacactcctcggattccctct

SEQ ID NO: 343022 - DNA, 75 bp, Artificial Sequence
  Synthetic
cagaaagctggttgctgccagtctaaggctaggagaattttcagcaggccttgtaattaatgcaaaagattttct

SEQ ID NO: 343023 - DNA, 75 bp, Artificial Sequence
  Synthetic
tcaaagatctaatgctaggaaatatattaagacttcagtaggattagaacaattggatattgagctatcccaaaa

SEQ ID NO: 343024 - DNA, 75 bp, Artificial Sequence
  Synthetic
tttgaggctattgcttagcagagctgaacagaagactgtctggaaacagattggagccatcaatctggttagttc

SEQ ID NO: 343025 - DNA, 75 bp, Artificial Sequence
  Synthetic
tctcgagaatgattcagatactctctggggtgatgcatacctagaggacgaaccagagcaacctgaattcgatat

SEQ ID NO: 343026 - DNA, 75 bp, Artificial Sequence
  Synthetic
cgctggcgaagaaatttagaaaagatgcaaggtaaaatgcaagctaatgcagtttaagaaaaaattattgatttt

SEQ ID NO: 343027 - DNA, 75 bp, Artificial Sequence
  Synthetic
agaaatttagaaaagatgcaaggtaaaatgcaagctaatgcagtttaagaaaaaattattgattttccccttggt

SEQ ID NO: 343028 - DNA, 75 bp, Artificial Sequence
  Synthetic
gtagactccttgaaaagctactgctaaaaccgctggtatgagccaactcaaagaaatacaggaggagatcacccg

SEQ ID NO: 343029 - DNA, 75 bp, Artificial Sequence
  Synthetic
aaaaccgctggtatgagccaactcaaagaaatacaggaggagatcacccgccatgaacagcagattgtcatcgcc

SEQ ID NO: 343030 - DNA, 75 bp, Artificial Sequence
  Synthetic
cggcaaaaactcaaagatgcagaaaagacagtggaagccgacccagatgatgttaacaaaagcacactacagagt

SEQ ID NO: 343031 - DNA, 75 bp, Artificial Sequence
  Synthetic
tgttaacaaaagcacactacagagtagacgggcagctgtgtcagcattggaggacaaactggcagacttcaagag

SEQ ID NO: 343032 - DNA, 75 bp, Artificial Sequence
  Synthetic
gcagcttgcagatttggtatcaagtcaaaaaatgggtgaaaagcctgttgacccgactgggcttgagccggatga

SEQ ID NO: 343033 - DNA, 75 bp, Artificial Sequence
  Synthetic
tcatctcaaggagaggtcaagtcttagatatggaaatgtccttgatgtgaatgctatagatattgatgaaccaag

SEQ ID NO: 343034 - DNA, 75 bp, Artificial Sequence
  Synthetic
tggacaaacagcagactggttttctattggccaatacatcacaggattcgcacttgctataatcttgaaggcatt

SEQ ID NO: 343035 - DNA, 75 bp, Artificial Sequence
  Synthetic
gtacatgctgtcaaccagagggagacaaacaatcaaggaaaataaggggacaagaattcggtttaaggatgacag

SEQ ID NO: 343036 - DNA, 75 bp, Artificial Sequence
  Synthetic
ctcttatgaagaaattaatggcattagacgaccaaagcatctgtatgtgtctatgcctacagcccaatctaccat

SEQ ID NO: 343037 - DNA, 75 bp, Artificial Sequence
  Synthetic
gaaagcggatgagttgacaccaggtagattcaggacaattgtctgtggactcttccctgctcagattatgcacag

SEQ ID NO: 343038 - DNA, 75 bp, Artificial Sequence
  Synthetic
aaacatcataagtcctgtcatgggtgtaattggcttttctttttttgtcaaggactggcctgaaaagattgagga

SEQ ID NO: 343039 - DNA, 75 bp, Artificial Sequence
  Synthetic
gtttcttatcaagccctgcccattcctaaagaaaagtggccctagtaaggaggaagattttcttgtgagtaatga

SEQ ID NO: 343040 - DNA, 75 bp, Artificial Sequence
  Synthetic
tgcatatcttctagggcgtgaaaaagcattgagggaatcacaccttgctgagattgatgatttgattgaccttgc

SEQ ID NO: 343041 - DNA, 75 bp, Artificial Sequence
  Synthetic
agcctcaggagacccaacaccaccagattctataaaatcaccacaagcaccatgggtattcgcctgtgcaccaga

SEQ ID NO: 343042 - DNA, 75 bp, Artificial Sequence
  Synthetic
taggtgccctcctacatgcatttatatagcagggatggcagagttaggggctttcttctccattctgcaggacat

SEQ ID NO: 343043 - DNA, 75 bp, Artificial Sequence
  Synthetic
gaggaatacgattatggcatctaagactgtgggtacttcagaagagaagttaaagaagaagtcctcgttctatca

SEQ ID NO: 343044 - DNA, 75 bp, Artificial Sequence
  Synthetic
gtcttatctgaggcgcacccaatctatgggaatacaactggatcaaaggattatcctgctatttatgacagagtg

SEQ ID NO: 343045 - DNA, 75 bp, Artificial Sequence
  Synthetic
cattgaccaaaaagttaaagagatttcaaaccaggaaccattgaaaatctgaactagagttcctgcatacacaca

SEQ ID NO: 343046 - DNA, 75 bp, Artificial Sequence
  Synthetic
cacacctccaatgatatgaatttgaagggttgggcacaaatttcactgatgcatgattacaattcacacacacac

SEQ ID NO: 343047 - DNA, 75 bp, Artificial Sequence
  Synthetic
aagttgattattgcactacagcttggtcattgaccactcaggtaatctgctgctctgtatgtttatcgttagtct

SEQ ID NO: 343048 - DNA, 75 bp, Artificial Sequence
  Synthetic
gttaagttttaaatttaagtcattgtttgatgtaaaaatttatttttgtattatgtcattagtgtaagttcatta

SEQ ID NO: 343049 - DNA, 75 bp, Artificial Sequence
  Synthetic
ttgggcccgataatgtgaaactgagctatcatctctattttcttttttcatctctgttcaaacatctctacctcc

SEQ ID NO: 343050 - DNA, 75 bp, Artificial Sequence
  Synthetic
ctatcatctctattttcttttttcatctctgttcaaacatctctacctccgtacacttatatatatgcacgtagc

SEQ ID NO: 343051 - DNA, 75 bp, Artificial Sequence
  Synthetic
catatatataagtgtacgattctactacctcagacaattgttttcttgattgcttttcaaggagtctactactaa

SEQ ID NO: 343052 - DNA, 75 bp, Artificial Sequence
  Synthetic
tagtagtagactccttgaaaagctactactgaagccgctggtatgagccaactcaaagaaatacaggaggaaatc

SEQ ID NO: 343053 - DNA, 75 bp, Artificial Sequence
  Synthetic
ggagaagacagtggaagccgacccggatgatgttaacaagaatacactccagagcagacgggcagctgtgtcagc

SEQ ID NO: 343054 - DNA, 75 bp, Artificial Sequence
  Synthetic
actggaagacaaattggcagaattcaagagacaacttgccgatttggtatcaagtcagaagatgggtgaaaagcc

SEQ ID NO: 343055 - DNA, 75 bp, Artificial Sequence
  Synthetic
aagagacaacttgccgatttggtatcaagtcagaagatgggtgaaaagcctgtggacccaactgggcttgaaccg

SEQ ID NO: 343056 - DNA, 75 bp, Artificial Sequence
  Synthetic
gtttgcacttgcaattgttctaaaggctttatatatgctgtcaacccgtggaaggcagaccatcaaggaaaataa

SEQ ID NO: 343057 - DNA, 75 bp, Artificial Sequence
  Synthetic
agggacacggatcagattcaaagatgatagttcctttgaagagattaacgggataaggcgacccaagcatttata

SEQ ID NO: 343058 - DNA, 75 bp, Artificial Sequence
  Synthetic
tgtctcaatgccaactgcacagtctactattaaagctgatgagttaacaccaggcagattcaggactatcgtgtg

SEQ ID NO: 343059 - DNA, 75 bp, Artificial Sequence
  Synthetic
actattaaagctgatgagttaacaccaggcagattcaggactatcgtgtgtgggctgttccctgctcaaataatg

SEQ ID NO: 343060 - DNA, 75 bp, Artificial Sequence
  Synthetic
cacagaaacattataagtcctgtgatgggagtgattgggttctcattttttgtgaaagactggccagagaagatt

SEQ ID NO: 343061 - DNA, 75 bp, Artificial Sequence
  Synthetic
gaggaatttctcattaagccctgtcctttcctaaaaaaccaaggttctcccggcaaagaagaagaatttcttgtg

SEQ ID NO: 343062 - DNA, 75 bp, Artificial Sequence
  Synthetic
agcaatgatgcttacctaattgggagagaaaaggcacttcgagaatcacacctggctgagattgatgacttgatt

SEQ ID NO: 343063 - DNA, 75 bp, Artificial Sequence
  Synthetic
gagaaaaggcacttcgagaatcacacctggctgagattgatgacttgattgaccttgcagcctcaggagatccta

SEQ ID NO: 343064 - DNA, 75 bp, Artificial Sequence
  Synthetic
gaccttgcagcctcaggagatcctacaccaccagattccatcaagtctccacaagcaccgtgggtatttgcatgt

SEQ ID NO: 343065 - DNA, 75 bp, Artificial Sequence
  Synthetic
gcacctgataggtgccctcctacatgcatttacattgctgggatggcagagcttggtgcatttttctctatactt

SEQ ID NO: 343066 - DNA, 75 bp, Artificial Sequence
  Synthetic
caagatatgagaaacacaattatggcatctaaaactgtgggaacggcagaagagaagctaaaaaagaaatcatca

SEQ ID NO: 343067 - DNA, 75 bp, Artificial Sequence
  Synthetic
agagaagctaaaaaagaaatcatcattttatcaatcttatcttcgtcgcactcaatccatgggaatacaactgga

SEQ ID NO: 343068 - DNA, 75 bp, Artificial Sequence
  Synthetic
caaagtctcattgaccaaaaggtcaaggagatttctaaccaggaaccattaaaaatttaatcaacagttcctgca

SEQ ID NO: 343069 - DNA, 75 bp, Artificial Sequence
  Synthetic
tacacacatgcacattcaatgatatgaatttgatgggttgggcacaaattcacaaatgcatgatttaaattcaca

SEQ ID NO: 343070 - DNA, 75 bp, Artificial Sequence
  Synthetic
gaatttgatgggttgggcacaaattcacaaatgcatgatttaaattcacacatacactgattgggtcgggcgggt

SEQ ID NO: 343071 - DNA, 75 bp, Artificial Sequence
  Synthetic
aatcaaatacacaatagctggggtaggtaagtttactaatcgtaaggtagctactaagttgattattgcactaca

SEQ ID NO: 343072 - DNA, 75 bp, Artificial Sequence
  Synthetic
tctgctgctctgtatgtttaatgttagtttgttaagtttagaagttaagtctttgtttattgttaagttttattt

SEQ ID NO: 343073 - DNA, 75 bp, Artificial Sequence
  Synthetic
agtgtaagaatttatttttatattatgttgttagtgtgatcttatattgggcccgtcaatgtgaaactgagctat

SEQ ID NO: 343074 - DNA, 75 bp, Artificial Sequence
  Synthetic
gcccgtcaatgtgaaactgagctatcatctctatttccttctttcatctctaattaaacatttctacctccgtac

SEQ ID NO: 343075 - DNA, 75 bp, Artificial Sequence
  Synthetic
acttatatatatgcacgtagcatatatataagtgtacgattctactacctcagacagttgttttcttgattgctt

SEQ ID NO: 343076 - DNA, 75 bp, Artificial Sequence
  Synthetic
gcatatatataagtgtacgattctactacctcagacagttgttttcttgattgcttttcaaggagtctactacta

SEQ ID NO: 343077 - DNA, 75 bp, Artificial Sequence
  Synthetic
tagtagtagactccgagatagagaagtctactaaaaatggagaaatacacagagatccacaatagaatgagagaa

SEQ ID NO: 343078 - DNA, 75 bp, Artificial Sequence
  Synthetic
tgtgtgccaggggaggtatctgcagtagagtgcctggatctattagatcggttttacgctgtgagacatgatgtt

SEQ ID NO: 343079 - DNA, 75 bp, Artificial Sequence
  Synthetic
gtggatcagatgataaagcatgattggtctgacaacaaagacaaagaacagcctataggccatgtcttgctgatg

SEQ ID NO: 343080 - DNA, 75 bp, Artificial Sequence
  Synthetic
gcaggagtaccgaatgaagtcatacaaggtatggaaaagaagatcatacctggaagtcctagtgggcagattctg

SEQ ID NO: 343081 - DNA, 75 bp, Artificial Sequence
  Synthetic
agatcattttttaagatgacaccagataactacaagattacagggagtttaattgagtttattgaggtgacagtt

SEQ ID NO: 343082 - DNA, 75 bp, Artificial Sequence
  Synthetic
acagctgatgtggcaagaggaacacgtgagaaaatcttgaagtatcaagcaggtctagagtacatagaacagttg

SEQ ID NO: 343083 - DNA, 75 bp, Artificial Sequence
  Synthetic
ctgcatcaggagtcagaaagaggcaatctgccaggtggttatagaataaagtttgatgtagtggcagtgaggact

SEQ ID NO: 343084 - DNA, 75 bp, Artificial Sequence
  Synthetic
gatggctcaaatatatcaacacaatggccaagtcaacgaaatgagggtgtcgttcaaacaatgaggttaattcag

SEQ ID NO: 343085 - DNA, 75 bp, Artificial Sequence
  Synthetic
gcagatatcaattacgtgagagaacatttaataaaaaatgatgagagatcagcactagaagccatgttcaattta

SEQ ID NO: 343086 - DNA, 75 bp, Artificial Sequence
  Synthetic
aaattccatgtcagtggacctaaagccaggacctttgacattcctgattatcggccccaacaactgtgtaaccca

SEQ ID NO: 343087 - DNA, 75 bp, Artificial Sequence
  Synthetic
aacatagataatctcttgaactactgtaaaaattggttgacacgagagcatgaatttgcctttgatgaggttaaa

SEQ ID NO: 343088 - DNA, 75 bp, Artificial Sequence
  Synthetic
gggcaaagagttttcaacatatttgaagcagaagaaattaagcataaagaaagatacaatccatcacgtaaacca

SEQ ID NO: 343089 - DNA, 75 bp, Artificial Sequence
  Synthetic
aggaattttttattgatacaaggaaccgttcaaggtccatacttgccctcaactatagcatccgaccagtacgat

SEQ ID NO: 343090 - DNA, 75 bp, Artificial Sequence
  Synthetic
acaaaagttggctgtctggagatattaaaaaaccatcctgaaactccgatacaaatattagctagagatatggca

SEQ ID NO: 343091 - DNA, 75 bp, Artificial Sequence
  Synthetic
ttgaaatatataatgttggataaagatgaccttataaactactataaccctagagcatatttcaagcaaactgct

SEQ ID NO: 343092 - DNA, 75 bp, Artificial Sequence
  Synthetic
aatataaaggaacctggcacttttaagctgaatttatcatcaatggatcctaaggccaaggcactgttagatgtt

SEQ ID NO: 343093 - DNA, 75 bp, Artificial Sequence
  Synthetic
atctcaaagaactcaaaaaaaggtgtgtttggtgaggtaattgatagtatagagataagtagtttaatacagcaa

SEQ ID NO: 343094 - DNA, 75 bp, Artificial Sequence
  Synthetic
aatgagtgttctaaagtcatagaaaagatcctatctgatttggagatcaatgttggtgaaacaagccaaggccta

SEQ ID NO: 343095 - DNA, 75 bp, Artificial Sequence
  Synthetic
gataatcccaagaggacaacaggtgttgatgatatcttaaagaagttttatgacaatgagttggtcaagtatatg

SEQ ID NO: 343096 - DNA, 75 bp, Artificial Sequence
  Synthetic
ttacatatagtaagaaagacaacagcatggcatatggggcatttgttaagagatataacagaatgtctaattgca

SEQ ID NO: 343097 - DNA, 75 bp, Artificial Sequence
  Synthetic
catgctggcttgaaaagatcaaagtactggtcaatacatgggttctctcatggtggaatattattgatgatcttg

SEQ ID NO: 343098 - DNA, 75 bp, Artificial Sequence
  Synthetic
ccatcaaaatcactagaagttgcaggttcttatattcggttttttactgtttttaaggatggattaggtttaatt

SEQ ID NO: 343099 - DNA, 75 bp, Artificial Sequence
  Synthetic
gactatgaaaacttagattcaactgtggtaattgatggtgtaagttggtgtttcagcaaggttatgagtttagac

SEQ ID NO: 343100 - DNA, 75 bp, Artificial Sequence
  Synthetic
ctaaatcgactattggctctgaatatatcttttgagaagacactattagcaacagctacatggtttcaatactat

SEQ ID NO: 343101 - DNA, 75 bp, Artificial Sequence
  Synthetic
acagaggaccaaggtcactttcccttacaacatgcattgaggtctgtttttgcattccactttttactgactgtg

SEQ ID NO: 343102 - DNA, 75 bp, Artificial Sequence
  Synthetic
acacaaaagatgaaattatgtgctatctttgataatttaagatatctaatccctgcagtgacctcgctttattca

SEQ ID NO: 343103 - DNA, 75 bp, Artificial Sequence
  Synthetic
ggatataaaccgttgattgtaaagttttttgaaaggccatttaagagtgcacttgatgtatacctgtatactatt

SEQ ID NO: 343104 - DNA, 75 bp, Artificial Sequence
  Synthetic
ataaaaacactacttgtaagccttgcacaaaataataaaatccgcttctattcaaaagttcggctattggggctt

SEQ ID NO: 343105 - DNA, 75 bp, Artificial Sequence
  Synthetic
acagtagaccaatcaaccattggtgcaagtggagtttacccttctttaatgtcaagagtggtttataaacattat

SEQ ID NO: 343106 - DNA, 75 bp, Artificial Sequence
  Synthetic
aaaagtttaatctcagaagcgactacctgttttttcttatttgagaagggtcttcatggcaatcttactgaggaa

SEQ ID NO: 343107 - DNA, 75 bp, Artificial Sequence
  Synthetic
gcaaaaatacatttagagacagtcgaatgggctaggaaatttagtgacaaagagaaggcttatggtgcatatatt

SEQ ID NO: 343108 - DNA, 75 bp, Artificial Sequence
  Synthetic
atggaggaaggttacacaataaaggatgtagtagatggcaatattccagtagaacaacaattattttgtcaagaa

SEQ ID NO: 343109 - DNA, 75 bp, Artificial Sequence
  Synthetic
gtagtagagttatctgcaatggaattaaatacatatttggaagccaagtcacaagtgatggcagctaacataatg

SEQ ID NO: 343110 - DNA, 75 bp, Artificial Sequence
  Synthetic
aacaaacactgggatcgtccatatttcagccaaacaaggaatattagcttaaaaggtatgtcaggcgcattacaa

SEQ ID NO: 343111 - DNA, 75 bp, Artificial Sequence
  Synthetic
gaagatggtcatttatcagctagtgttacattaattgaagcaatacgttttttgaatcaatctcaacaaaacccc

SEQ ID NO: 343112 - DNA, 75 bp, Artificial Sequence
  Synthetic
tcagtgttggagatgtatgaacaaactaagaggcagaaggctatggcacggattgttagaaaataccagagaaca

SEQ ID NO: 343113 - DNA, 75 bp, Artificial Sequence
  Synthetic
gaagctgatcgtggattttttataactactttaccaaccagagtgagattagagataatagaggattattttgat

SEQ ID NO: 343114 - DNA, 75 bp, Artificial Sequence
  Synthetic
gcaatagctaaagtagtccctgaagagtatatatcatatggaggagagcggaagatattaaatattcaacaggca

SEQ ID NO: 343115 - DNA, 75 bp, Artificial Sequence
  Synthetic
cttgaaaaggcattaagatgggcttcaggtgaaagtgagattcaaattagtatgggacaggtcattaaactaaaa

SEQ ID NO: 343116 - DNA, 75 bp, Artificial Sequence
  Synthetic
cggaagttaatgtatgttagtgcagatgcaacaaaatggtccccaggagataactctgcgaaattccgaagattc

SEQ ID NO: 343117 - DNA, 75 bp, Artificial Sequence
  Synthetic
acccaggcattacacgatggtctacgagatgataaattaaagaggtgtgtagtggatgccttacggaatatatat

SEQ ID NO: 343118 - DNA, 75 bp, Artificial Sequence
  Synthetic
gaaactgattttttcatgtctaggaagttacatcgatatatcgatggtatggatgatttatctgaatttgtagaa

SEQ ID NO: 343119 - DNA, 75 bp, Artificial Sequence
  Synthetic
gattttttatcattctttccaaataaagtatctgctgctatcaaaggaaattggctgcaaggaaatctaaacaag

SEQ ID NO: 343120 - DNA, 75 bp, Artificial Sequence
  Synthetic
tgctcatcattatttggtgcagcagtttccctgctatttagaaaaatctggagccttctttacccagaactggac

SEQ ID NO: 343121 - DNA, 75 bp, Artificial Sequence
  Synthetic
tgcttctttgagtttgcacaccattctgacgatgcattgtttatctatggttatcttgaacctactgatgatgga

SEQ ID NO: 343122 - DNA, 75 bp, Artificial Sequence
  Synthetic
actgaatggtttagatttgtaacacaacagatacaagctgggaatctccattggtatgcagtcaatcaagagatg

SEQ ID NO: 343123 - DNA, 75 bp, Artificial Sequence
  Synthetic
tggaagagtatgtttaaccttcatgaacatattttattgatgggttccatcaaaatatcgcctaaaaagactaca

SEQ ID NO: 343124 - DNA, 75 bp, Artificial Sequence
  Synthetic
gtatccccaactaatgcagaattcctatcaacattttttgaaggatgtgcagtttcgatcccttttataaaaata

SEQ ID NO: 343125 - DNA, 75 bp, Artificial Sequence
  Synthetic
ctattgggctctctgtctgatttaccagggttaggttattttgatgatttggctgctgcacagagtagatgtgtt

SEQ ID NO: 343126 - DNA, 75 bp, Artificial Sequence
  Synthetic
aaagcgcttgatatgggggcctgtcctcaattagcacagctagggattgttttgtgcacaagcaaagttgaacga

SEQ ID NO: 343127 - DNA, 75 bp, Artificial Sequence
  Synthetic
ttgtatggcacagctacagggatggtaaataatccaacttcctttttaaaagtagaaagatcatcaatacctatc

SEQ ID NO: 343128 - DNA, 75 bp, Artificial Sequence
  Synthetic
ccattaggtggtgatggctcgatgtctatcatggaacttgctacagcagggataggcatggctgacaagaatgtc

SEQ ID NO: 343129 - DNA, 75 bp, Artificial Sequence
  Synthetic
ttaaagaatgcatatatttcgtttaaacatactaaaagagatagtgatcgttatatattgggtttatttaaattc

SEQ ID NO: 343130 - DNA, 75 bp, Artificial Sequence
  Synthetic
cttatgagtctaagtgatgatgtattccaacacgatcgattaggtgaattcagctttgtgggcaaagttcagtgg

SEQ ID NO: 343131 - DNA, 75 bp, Artificial Sequence
  Synthetic
aaagtctttactcctaaatcagagtttgaattctttgatcaatattcgtcgaagtacttgcagttatggactgaa

SEQ ID NO: 343132 - DNA, 75 bp, Artificial Sequence
  Synthetic
caacatcctgtctatgactatatcattccgcgtgggagggataatctattagtctatttggttagaaagttaaat

SEQ ID NO: 343133 - DNA, 75 bp, Artificial Sequence
  Synthetic
gacccaagtatagtgacagctatgactatgcaatcaccacttcaactaagattcaggatgcaagctaagcagcat

SEQ ID NO: 343134 - DNA, 75 bp, Artificial Sequence
  Synthetic
atgaaagtatgtaggttaaacggtgagtgggtaacttttagggaggtacttgcagctgctgattcatttgcacag

SEQ ID NO: 343135 - DNA, 75 bp, Artificial Sequence
  Synthetic
agtttcaaaccatcacaaagtgatatggaattgtttcaaactctagttaattgtactttttcaaaggaatatgca

SEQ ID NO: 343136 - DNA, 75 bp, Artificial Sequence
  Synthetic
tggagggatttcttgaatgaggtgaagtgtgaagtgttaacaacaagacaagtgcatagaccaaaagttgctaga

SEQ ID NO: 343137 - DNA, 75 bp, Artificial Sequence
  Synthetic
acctttacagttaaagaaagagatcaagcaattcaaaattcaataacagctgtaattggatataaatacgctaat

SEQ ID NO: 343138 - DNA, 75 bp, Artificial Sequence
  Synthetic
aaagctgatgaaataagtgatgtgttggacagtgcagtacatccagattccctttcaacagacttacaggtaatg

SEQ ID NO: 343139 - DNA, 75 bp, Artificial Sequence
  Synthetic
agggagggtgtctatagagaactgggtctggatataaactatcctaatgttcttaaacgtgtagctccacttttg

SEQ ID NO: 343140 - DNA, 75 bp, Artificial Sequence
  Synthetic
tataaatcaggaaagtcaagagtggtaatagtacagggaaatatagagggtactgcagagtcaatttgcagttat

SEQ ID NO: 343141 - DNA, 75 bp, Artificial Sequence
  Synthetic
tggttgaaaactatgtctttagttaagaccatcaaagttagacccaaaaaagaagtgttgaaggctgtgtcgttg

SEQ ID NO: 343142 - DNA, 75 bp, Artificial Sequence
  Synthetic
tttagtaaaaaggaaaagattggggatttaactcaccttgcagctacaagattatgtattgatgtttggaggtgg

SEQ ID NO: 343143 - DNA, 75 bp, Artificial Sequence
  Synthetic
tgtaaagctaatgaacaagatcctaaggcatggttaagtgctctttactttgaaggtaggactttgatgcaatgg

SEQ ID NO: 343144 - DNA, 75 bp, Artificial Sequence
  Synthetic
gtagatgtgttccttgataaaggtgtagttccagttgacccagaaatccaatgtatgggtttaatgatttatgat

SEQ ID NO: 343145 - DNA, 75 bp, Artificial Sequence
  Synthetic
ctgactggacaaaaaaatctattgcaaatgcaagctaacagaagggcttattctggtaagcagtatgatgcctat

SEQ ID NO: 343146 - DNA, 75 bp, Artificial Sequence
  Synthetic
tgtgttcagacatataatgaggaaactaaattgtatgagggggatttaagggtaacatttaacttcggaattgat

SEQ ID NO: 343147 - DNA, 75 bp, Artificial Sequence
  Synthetic
tgtgctcgattggagattttttgggacaagcaggattacttgctagagacatcaataacccaaaggcatgttttg

SEQ ID NO: 343148 - DNA, 75 bp, Artificial Sequence
  Synthetic
aaaatcctgatggaggaagtgacaaaagaattattaagatgtgggatgagatttaagactgaacaagtaaattct

SEQ ID NO: 343149 - DNA, 75 bp, Artificial Sequence
  Synthetic
tctagaagtgttgttctttttaagacagatgcaggctttgaatggggtaagcccaatatcccttgtattgtgttt

SEQ ID NO: 343150 - DNA, 75 bp, Artificial Sequence
  Synthetic
aggaattgtgcattacgtactgggcttagagttcgtcatcctattaataaatcatttactattactatacaagca

SEQ ID NO: 343151 - DNA, 75 bp, Artificial Sequence
  Synthetic
ggtggttttcgggcaatggcacaacttgacgaggagaatcccaggttcttattggcacatgcttatcacaattta

SEQ ID NO: 343152 - DNA, 75 bp, Artificial Sequence
  Synthetic
aaagatatcaggtatcaagcattacaagccataggaaacatctggtttaaaacacaacagcataaattgtttata

SEQ ID NO: 343153 - DNA, 75 bp, Artificial Sequence
  Synthetic
aatcctatcatttctgctggacttctagagaattttatgaaagggctgcctgctgccattccacctgcagcctat

SEQ ID NO: 343154 - DNA, 75 bp, Artificial Sequence
  Synthetic
tcactaattatgaacaaagctaaaatatcagtagatttatttatgtttaatgaattgcttgcattaataaaccca

SEQ ID NO: 343155 - DNA, 75 bp, Artificial Sequence
  Synthetic
aaaaatgttttaaacttagatgggatcgaggaaacaagtgaaggatacagtactgtctcaactatttcaagcaca

SEQ ID NO: 343156 - DNA, 75 bp, Artificial Sequence
  Synthetic
caatggtctgaagaggtaagtttggttatggatgatagtgatgatgaagaccaacctgattacacaattgaccta

SEQ ID NO: 343157 - DNA, 75 bp, Artificial Sequence
  Synthetic
gatgatattgatttcgaaacaattgatctgaaagaagatattgagcattttctacaagatgaatctgcatatact

SEQ ID NO: 343158 - DNA, 75 bp, Artificial Sequence
  Synthetic
ggtgatttgttgatacagactgatgacactgagataaaaaagttaagaggaatgacaagaatattagagcctata

SEQ ID NO: 343159 - DNA, 75 bp, Artificial Sequence
  Synthetic
aaattgataaaaagttgggtttcaaagggtctttcaattgaaaaagtttacagccctgttggtattattttgatg

SEQ ID NO: 343160 - DNA, 75 bp, Artificial Sequence
  Synthetic
gctagatatatgtctaagcactatgattttaataaagctccactatcactattaaatccttatgacctaacagaa

SEQ ID NO: 343161 - DNA, 75 bp, Artificial Sequence
  Synthetic
tttgagagtattgttaagggctggggtgagtgtgtaaatgataggtttattgagtatgatcatgaggcagaaaga

SEQ ID NO: 343162 - DNA, 75 bp, Artificial Sequence
  Synthetic
aaagtcaaggaagaaaaaatacaaccagaagatgtcctcccggattcccttttctccttcagacatgctgatatt

SEQ ID NO: 343163 - DNA, 75 bp, Artificial Sequence
  Synthetic
cttcttaggaggttgttcccaaaggattcagctgcttcattttattaataatgagtactatttgttgctcttttc

SEQ ID NO: 343164 - DNA, 75 bp, Artificial Sequence
  Synthetic
tcccaaaggattcagctgcttcattttattaataatgagtactatttgttgctcttttctcggagcatactacta

SEQ ID NO: 343165 - DNA, 75 bp, Artificial Sequence
  Synthetic
tagtagtagactccttgaaaagctactactgaaaccgctggtatgagccaactcaaagaaatacaggaggagatc

SEQ ID NO: 343166 - DNA, 75 bp, Artificial Sequence
  Synthetic
actcaaagaaatacaggaggagatcacccgccatgaacagcaaattgtcattgctcggcaaaaactcaaagatgc

SEQ ID NO: 343167 - DNA, 75 bp, Artificial Sequence
  Synthetic
acccgccatgaacagcaaattgtcattgctcggcaaaaactcaaagatgcagaaaagacagtggaagccgacccg

SEQ ID NO: 343168 - DNA, 75 bp, Artificial Sequence
  Synthetic
aagagacaacttgccgatttggtatcaagtcagaaaatgggtgagaagcctgtggacccgactggcattgaaccg

SEQ ID NO: 343169 - DNA, 75 bp, Artificial Sequence
  Synthetic
gctttatacatgctgtcaacccgtggaagacaaaccattaaggagaataaaggcacacggatcagatttaaagat

SEQ ID NO: 343170 - DNA, 75 bp, Artificial Sequence
  Synthetic
aggcacacggatcagatttaaagatgatagttcctttgaagagatcaacgggataaggcgacctaagcatttata

SEQ ID NO: 343171 - DNA, 75 bp, Artificial Sequence
  Synthetic
gatagttcctttgaagagatcaacgggataaggcgacctaagcatttatatgtttcaatgccaactgcacagtct

SEQ ID NO: 343172 - DNA, 75 bp, Artificial Sequence
  Synthetic
actatgaaagctgatgagttaacacctggcagattcaggactattgtgtgtgggctatttcctgctcaaataatg

SEQ ID NO: 343173 - DNA, 75 bp, Artificial Sequence
  Synthetic
cacagaaacattataagtcctgttatgggagtgattgggttctcattctttgtgaaagattggccagaaaagatt

SEQ ID NO: 343174 - DNA, 75 bp, Artificial Sequence
  Synthetic
gaggaatttctcatcaagccatgccctttcctaaaaaagcaaggttctcctggcaaagaagaggaatttcttgtg

SEQ ID NO: 343175 - DNA, 75 bp, Artificial Sequence
  Synthetic
tggcaaagaagaggaatttcttgtgagcaatgatgcttatctgattgggagagaaaaggcacttcgagaatcaca

SEQ ID NO: 343176 - DNA, 75 bp, Artificial Sequence
  Synthetic
agcaatgatgcttatctgattgggagagaaaaggcacttcgagaatcacacccggctgagattgatgacttgatt

SEQ ID NO: 343177 - DNA, 75 bp, Artificial Sequence
  Synthetic
gaccttgcagcctcaggagatccaacaccaccagattccatcaagtctccgcaggcaccttgggtatttgcatgt

SEQ ID NO: 343178 - DNA, 75 bp, Artificial Sequence
  Synthetic
gcacctgataggtgccctcctacatgcatttacattgctgggatggcagagcttggtgcattcttttctatactt

SEQ ID NO: 343179 - DNA, 75 bp, Artificial Sequence
  Synthetic
caggatatgagaaacacaattatggcatccaagactgtaggaacagcagaagagaagctgaaaaagaaatcatca

SEQ ID NO: 343180 - DNA, 75 bp, Artificial Sequence
  Synthetic
ttttatcaatcttatctgcggcgtactcaatccatggggatacaactggaccagagaattattttgctgttcatg

SEQ ID NO: 343181 - DNA, 75 bp, Artificial Sequence
  Synthetic
ggaccctgaacttagaacacttgcacaaagtctcattgaccaaaaggtcaaggagatttctaaccaggaaccact

SEQ ID NO: 343182 - DNA, 75 bp, Artificial Sequence
  Synthetic
caaagtctcattgaccaaaaggtcaaggagatttctaaccaggaaccactgaaaatctaatcaacagttcctgca

SEQ ID NO: 343183 - DNA, 75 bp, Artificial Sequence
  Synthetic
tacacacatgcacatccaatgatatgaattcgatgggttgggcacaaattcacaaatgcatgatttaaattcaca

SEQ ID NO: 343184 - DNA, 75 bp, Artificial Sequence
  Synthetic
cacaaatgcatgatttaaattcacacatacactgattgggtcgggtgggtcaaatcaaatacataatagctgggg

SEQ ID NO: 343185 - DNA, 75 bp, Artificial Sequence
  Synthetic
taggtaagtttactaatcgtaaggtagctactaagttgattattgcactacagcttgtcaatgaccactcaggta

SEQ ID NO: 343186 - DNA, 75 bp, Artificial Sequence
  Synthetic
ttctgctgctctgtatgtttaatgttagtttgttaagtttagaagttaagtctttgtttattgttaagttttatt

SEQ ID NO: 343187 - DNA, 75 bp, Artificial Sequence
  Synthetic
tctttgtttattgttaagttttatttggtgtatgaatttatttttatattatgttgttagtgcaattttatattg

SEQ ID NO: 343188 - DNA, 75 bp, Artificial Sequence
  Synthetic
gatgatcaccttaaggagaggtcaagtctcagatatgggaatgtccttgatgtgaatgctattgatattgatgag

SEQ ID NO: 343189 - DNA, 75 bp, Artificial Sequence
  Synthetic
ccaagtggacaaacagctgattggtttgcaattggtcagtacatcatagggtttgcacttgcaattgttctaaag

SEQ ID NO: 343190 - DNA, 75 bp, Artificial Sequence
  Synthetic
tgtctcaatgccgactgcacagtctactatgaaagctgatgagttaacacctggcagattcaggactattgtgtg

SEQ ID NO: 343191 - DNA, 75 bp, Artificial Sequence
  Synthetic
caggatatgagaaacacaattatggcatctaagactgtgggaacagcagaagaaaagcttgaaaagaaatcatca

SEQ ID NO: 343192 - DNA, 75 bp, Artificial Sequence
  Synthetic
ccagagaattattttgctgttcatgatggagtggggttctgatattgtcaaccactttcatctgggtgatgatat

SEQ ID NO: 343193 - DNA, 75 bp, Artificial Sequence
  Synthetic
aaaaatctaatcaacagttcctgcatacacacatgcacatccaacgatatgaattcgatgggttgggcgcaaatt

SEQ ID NO: 343194 - DNA, 75 bp, Artificial Sequence
  Synthetic
agctactaagttgattattgcactacagcttggtcaatgaccactcaggtattctgctgctctgtatgtttaatg

SEQ ID NO: 343195 - DNA, 75 bp, Artificial Sequence
  Synthetic
gtctttgtttattgttaagttttatttggtgtatgaatttattttttatattatgttgttagtgtaattttatat

SEQ ID NO: 343196 - DNA, 75 bp, Artificial Sequence
  Synthetic
tgggcccgtcaatgtgaaactgagctatcatctctatttcctcctttcatctctgattaaacatctctacctccg

SEQ ID NO: 343197 - DNA, 75 bp, Artificial Sequence
  Synthetic
acccgccatgaacagcagatcgtcattgctcggcaaaaactcaaggatgcagagaagacagtggaggccgacccg

SEQ ID NO: 343198 - DNA, 75 bp, Artificial Sequence
  Synthetic
ttgctcggcaaaaactcaaggatgcagagaagacagtggaggccgacccggatgatgttaataaaagtacactac

SEQ ID NO: 343199 - DNA, 75 bp, Artificial Sequence
  Synthetic
agagcagacgggcagctgtgtcagcattggaggacaagttggcagacttcaagaggcagcttgcagatttggtat

SEQ ID NO: 343200 - DNA, 75 bp, Artificial Sequence
  Synthetic
caagtcaaaaaatgggtgaaaagcctgttgacccgactgggcttgagccggatgaccatctcaaggagagatcta

SEQ ID NO: 343201 - DNA, 75 bp, Artificial Sequence
  Synthetic
gcctcagatatggaaatgtccttgatgtgaatgccattgatattgatgagccaagtggtcaaacagcagactggt

SEQ ID NO: 343202 - DNA, 75 bp, Artificial Sequence
  Synthetic
tctccattggacaatacattatagggtttgcactagcaatagtcctaaaggcattatacatgttatcaacaagag

SEQ ID NO: 343203 - DNA, 75 bp, Artificial Sequence
  Synthetic
gtttgcactagcaatagtcctaaaggcattatacatgttatcaacaagaggaaggcagacaattaaggaaaacaa

SEQ ID NO: 343204 - DNA, 75 bp, Artificial Sequence
  Synthetic
gcattatacatgttatcaacaagaggaaggcagacaattaaggaaaacaaggggactagaatcaggttcaaagat

SEQ ID NO: 343205 - DNA, 75 bp, Artificial Sequence
  Synthetic
gacagttcctttgaggagatcaatggcatacggcgtcctaagcacctctatgtgtcaatgcctactgcacagtcc

SEQ ID NO: 343206 - DNA, 75 bp, Artificial Sequence
  Synthetic
actatgaaagctgatgagttaacaccaggtaggtttagaacaattgtttgtggacttttcccggctcaaatcatg

SEQ ID NO: 343207 - DNA, 75 bp, Artificial Sequence
  Synthetic
cacagaaatatcataagtccagtcatgggtgttattgggttttcattctttgtgaaagactggcctgagaagatc

SEQ ID NO: 343208 - DNA, 75 bp, Artificial Sequence
  Synthetic
tgggtgttattgggttttcattctttgtgaaagactggcctgagaagatcgaagaatttttaattaagccttgtc

SEQ ID NO: 343209 - DNA, 75 bp, Artificial Sequence
  Synthetic
cttttttaaagaaacaaggtgcacctgggaaagaggaagactttcttgtcagcaatgatgcttatctccttgggc

SEQ ID NO: 343210 - DNA, 75 bp, Artificial Sequence
  Synthetic
gggaaaaagcattgagggaatcacacctggctgagattgatgacttgattgatcttgcagcatcaggggatccaa

SEQ ID NO: 343211 - DNA, 75 bp, Artificial Sequence
  Synthetic
gatcttgcagcatcaggggatccaacaccgccggactctataaaatcaccacaagccccgtgggtgtttgcctgt

SEQ ID NO: 343212 - DNA, 75 bp, Artificial Sequence
  Synthetic
gcacctgatagatgccctcctacatgcatttacattgctgggatggcagagttaggtgccttcttctcaatccta

SEQ ID NO: 343213 - DNA, 75 bp, Artificial Sequence
  Synthetic
caggatatgaggaacacaatcatggcatccaagacagttggcactgctgaggagaagctgaagaaaaaatcttct

SEQ ID NO: 343214 - DNA, 75 bp, Artificial Sequence
  Synthetic
catccaagacagttggcactgctgaggagaagctgaagaaaaaatcttctttttatcaatcatacttgagacgca

SEQ ID NO: 343215 - DNA, 75 bp, Artificial Sequence
  Synthetic
ctcagtcaatgggaatacaactggatcagaggattattctgctgttcatgacggaatggggttcagatattgtca

SEQ ID NO: 343216 - DNA, 75 bp, Artificial Sequence
  Synthetic
acggaatggggttcagatattgtcaaccatttccatcttggagatgatatggacccagagctccggacacttgca

SEQ ID NO: 343217 - DNA, 75 bp, Artificial Sequence
  Synthetic
caaagtctcattgatcaaaaggtcaaggagatatctaaccaggaaccattgaaaatctaggcagctgttcctgca

SEQ ID NO: 343218 - DNA, 75 bp, Artificial Sequence
  Synthetic
tacacacacacacatccaatgatatgaatttgaagggttgggcacaaatttcacattgatgcatgattaaattca

SEQ ID NO: 343219 - DNA, 75 bp, Artificial Sequence
  Synthetic
tcacattgatgcatgattaaattcacacatacactgattgggttgggtgggtcaaatcaaatacatataagctgg

SEQ ID NO: 343220 - DNA, 75 bp, Artificial Sequence
  Synthetic
tacagcttggtcattgaccactcaggtaatctgctgctctgtatgtttattgttagtttgttaagttttaaaggt

SEQ ID NO: 343221 - DNA, 75 bp, Artificial Sequence
  Synthetic
aagtcattgcttggtgtataaatttatttttgtattatgttgttagtgtaagttcaatattgggccccgttaatg

SEQ ID NO: 343222 - DNA, 75 bp, Artificial Sequence
  Synthetic
tgaaactgagctatcatctcttcctttctttttcatctctgatttaacatttctacctccgtacacttatatata

SEQ ID NO: 343223 - DNA, 75 bp, Artificial Sequence
  Synthetic
ttctacctccgtacacttatatatatgcacgtagcatatatataagtgtacgattctactacctcagacagttgc

SEQ ID NO: 343224 - DNA, 75 bp, Artificial Sequence
  Synthetic
gcatatatataagtgtacgattctactacctcagacagttgctttcttgattgcttttcaaggagtctactacta

SEQ ID NO: 343225 - DNA, 75 bp, Artificial Sequence
  Synthetic
ttagtagtagactccttgaaaagctaatactaaaaccgctggtatgagccaactcaaagaaatacaggaggagat

SEQ ID NO: 343226 - DNA, 75 bp, Artificial Sequence
  Synthetic
aactcaaagaaatacaggaggagatcacccgccatgaacagcagattgttatcgcccggcaaaaacttaaagatg

SEQ ID NO: 343227 - DNA, 75 bp, Artificial Sequence
  Synthetic
cagaaaaaacagtggaggccgacccagatgatgttaacaaaagtacactacagagcagacaggcggctgtgtcag

SEQ ID NO: 343228 - DNA, 75 bp, Artificial Sequence
  Synthetic
cattggaagacaaattggcagacttcaagaggaagcttgcagatctggtatcaagtcaaaaaatgggtgaaaagc

SEQ ID NO: 343229 - DNA, 75 bp, Artificial Sequence
  Synthetic
ctgttgacccgactgggcttgagccagatgaccatctcaaggagagatcaagcctcagatatggaaatgtccttg

SEQ ID NO: 343230 - DNA, 75 bp, Artificial Sequence
  Synthetic
atgtgaatgctattgacattgatgaaccaagtggacaaacagctgattggttttctattggccagtatgttatgg

SEQ ID NO: 343231 - DNA, 75 bp, Artificial Sequence
  Synthetic
gttttgcacttgcaatcatcttgaaagcattgtatatgttgtcaactaggggaaggcaaacaattaaagagaata

SEQ ID NO: 343232 - DNA, 75 bp, Artificial Sequence
  Synthetic
aaggaacaagaatccgatttaaagatgacagttcttatgaggaaatcaatggcattagacgacccaagcaccttt

SEQ ID NO: 343233 - DNA, 75 bp, Artificial Sequence
  Synthetic
atgtatccatgccgacagcacagtctaccatgaaagcagatgagttaacaccgggtaggtttagaacaatcgttt

SEQ ID NO: 343234 - DNA, 75 bp, Artificial Sequence
  Synthetic
gtggacttttccctgcacaaattatgcacagaaatataataagtcctgtgatgggtgttattggtttttcttttt

SEQ ID NO: 343235 - DNA, 75 bp, Artificial Sequence
  Synthetic
tcgtaaaggattggccagaaaagattgaggagttcttgataaaaccatgtccctttctaaaaaaaagtggcccta

SEQ ID NO: 343236 - DNA, 75 bp, Artificial Sequence
  Synthetic
gtaaggaggaggactttcttgtgagtaatgatgcttacttattagggcgtgaaaaggcattgagggattcacacc

SEQ ID NO: 343237 - DNA, 75 bp, Artificial Sequence
  Synthetic
ttgctgagattgatgacttgattgaccttgcagaatcaggggacccaacaccgccagattctataaagtcaccac

SEQ ID NO: 343238 - DNA, 75 bp, Artificial Sequence
  Synthetic
aggcaccatgggtgtttgcttgtgcacctgacagatgccctccaacatgcatttacatagcagggatggcagagc

SEQ ID NO: 343239 - DNA, 75 bp, Artificial Sequence
  Synthetic
taggagctttcttttccattctccaagacatgaggaacacaatcatggcatctaaaactgtgggcactgccgaag

SEQ ID NO: 343240 - DNA, 75 bp, Artificial Sequence
  Synthetic
aaaaactaaaaaagaaatcttcattctatcagtcttatctgaggcgcactcaatccatggggatacaactggatc

SEQ ID NO: 343241 - DNA, 75 bp, Artificial Sequence
  Synthetic
aaaggattatattgctgttcatgacagaatggggatctgatattgtcaatcattttcaccttggtgatgatatgg

SEQ ID NO: 343242 - DNA, 75 bp, Artificial Sequence
  Synthetic
atcctgaactcaggacacttgcacaaagtctcattgaccagaaggtcaaggagatttcgaaccaggagccattaa

SEQ ID NO: 343243 - DNA, 75 bp, Artificial Sequence
  Synthetic
aaatctaaattttaagttcctgcatacacacacgcacatccaatgatatgaatttgaagggttgggcactaaatt

SEQ ID NO: 343244 - DNA, 75 bp, Artificial Sequence
  Synthetic
aatttgaagggttgggcactaaattcacacaaatgcataattacaattcacatatacactgattgggttgggtgg

SEQ ID NO: 343245 - DNA, 75 bp, Artificial Sequence
  Synthetic
tacagcttggtcattgaccactcaggtaatctgctgctctgtatgtttattgttagtttgttaagtttgaaattt

SEQ ID NO: 343246 - DNA, 75 bp, Artificial Sequence
  Synthetic
aagtcattgtttggtgtataaatttatttttgtattatgttgttagtgtaagttcaatattgggcccgtcaatgt

SEQ ID NO: 343247 - DNA, 75 bp, Artificial Sequence
  Synthetic
gaaactgagctatcatctctatttctttttctcatctctgatttaacatttctacctccgtacacttatatatat

SEQ ID NO: 343248 - DNA, 75 bp, Artificial Sequence
  Synthetic
gcacgtagcatatatataagtgtacgattctactacctcaaatagctgctttcttgattgcttttcaaggagtct

SEQ ID NO: 343249 - DNA, 75 bp, Artificial Sequence
  Synthetic
gcatatatataagtgtacgattctactacctcaaatagctgctttcttgattgcttttcaaggagtctactacta

SEQ ID NO: 343250 - DNA, 75 bp, Artificial Sequence
  Synthetic
tgtggacccgactggccttgaaccggatgatcaccttaaggagaggtcaagtctcagatatggaaatgtccttga

SEQ ID NO: 343251 - DNA, 75 bp, Artificial Sequence
  Synthetic
gtctcagatatggaaatgtccttgatgtgaatgctattgatattgatgagccaagtggacagacagctgactggt

SEQ ID NO: 343252 - DNA, 75 bp, Artificial Sequence
  Synthetic
ttgcaattggtcagtacatcatagggtttgcacttgcaattgtcctaaaagcgttatatatgctgtcaacccgtg

SEQ ID NO: 343253 - DNA, 75 bp, Artificial Sequence
  Synthetic
gaaggcaaaccatcaaggagaataaaggcacacgaatcagattcaaagatgatagttctttcgaagagattaatg

SEQ ID NO: 343254 - DNA, 75 bp, Artificial Sequence
  Synthetic
ggataaggagacccaagcatttatatgtctcaatgccgactgcacagtctactatgaaagcagatgagttaacac

SEQ ID NO: 343255 - DNA, 75 bp, Artificial Sequence
  Synthetic
ctggcaggttcaggactattgtttgtgggctattccctgctcaaataatgcacagaaacatcataagtcctgtga

SEQ ID NO: 343256 - DNA, 75 bp, Artificial Sequence
  Synthetic
tgggagtaattgggttctcattttttgtgaaagactggccagaaaagattgaggaatttctcatcaagccttgtc

SEQ ID NO: 343257 - DNA, 75 bp, Artificial Sequence
  Synthetic
ctttcctaaaaaaacaaggttctcctggcaaagaagaggaatttcttgtgagcaatgatgcatacctaattggga

SEQ ID NO: 343258 - DNA, 75 bp, Artificial Sequence
  Synthetic
gaccttgcagcctcaggagatcctacaccaccagattccatcaagtctccgcaagcaccatgggtatttgcatgt

SEQ ID NO: 343259 - DNA, 75 bp, Artificial Sequence
  Synthetic
caggatatgagaaacacaatcatggcatctaaaactgtgggaacagcagaagagaagttaaaaaagaaatcatca

SEQ ID NO: 343260 - DNA, 75 bp, Artificial Sequence
  Synthetic
caaagtctcattgaccaaaaggttaaggagatttctaaccaggaaccattaaaaatctaatcaacagttcctgca

SEQ ID NO: 343261 - DNA, 75 bp, Artificial Sequence
  Synthetic
catacgctgattgggttgggtgggtaaatcaaatacacaatagctggggtaggtaagtttactaatgctaaggta

SEQ ID NO: 343262 - DNA, 75 bp, Artificial Sequence
  Synthetic
agtgtaagaatttatttttatattatgttgttagtgtaattttgtattgggcccgttaatgtgaaactgagctat

SEQ ID NO: 343263 - DNA, 75 bp, Artificial Sequence
  Synthetic
gcccgttaatgtgaaactgagctatcatctctatttcctcctttcatctctaattaaacacctctacctccgtac

SEQ ID NO: 343264 - DNA, 75 bp, Artificial Sequence
  Synthetic
tagtagtagactccttgaaaagctactactaaaaccgctggtatgagccaactcaaagaaatacaagaggagatc

SEQ ID NO: 343265 - DNA, 75 bp, Artificial Sequence
  Synthetic
acccgccatgaacagcaaattgtcattgcccggcaaaaacttaaagatgcagaaaagacggtggaagccgacccg

SEQ ID NO: 343266 - DNA, 75 bp, Artificial Sequence
  Synthetic
gatgatgttaacaagagcacactacagagtagacgggcagctgtgtcagcattggaggacaagctggcagacttc

SEQ ID NO: 343267 - DNA, 75 bp, Artificial Sequence
  Synthetic
tgttgacccgactgggcttgagccggatgatcacctcaaggagagatcaagccttcgatatggaaatgtccttga

SEQ ID NO: 343268 - DNA, 75 bp, Artificial Sequence
  Synthetic
tgtgaatgctattgacatcgatgagccaagtggacagacagcagattggttttctatcggccagtacattacagg

SEQ ID NO: 343269 - DNA, 75 bp, Artificial Sequence
  Synthetic
ctttgcacttgcaataatcttgaaggcattgtatatgctgtcgactagagggaggcaaacaatcaaggaaaataa

SEQ ID NO: 343270 - DNA, 75 bp, Artificial Sequence
  Synthetic
gggaacaagaatccggttcaaggatgacagctcatatgaagagatcaatggcattagacgcccgaaacatctata

SEQ ID NO: 343271 - DNA, 75 bp, Artificial Sequence
  Synthetic
tgtgtctatgccaacagcccagtctactatgaaagccgatgaattgacaccaggtaggtttagaacaattgtttg

SEQ ID NO: 343272 - DNA, 75 bp, Artificial Sequence
  Synthetic
tggactctttcctgctcaaattatgcacagaaacatcataagtcctgtcatgggtgtgattggattttctttttt

SEQ ID NO: 343273 - DNA, 75 bp, Artificial Sequence
  Synthetic
aaaaggcactaagggaatcacaccttgctgagatagatgacttgattgaccttgcagcttcagaagacccgacac

SEQ ID NO: 343274 - DNA, 75 bp, Artificial Sequence
  Synthetic
tctatatagcagggatggcagagttaggagcatttttttccattcttcaggacatgaggaacacgattatggcat

SEQ ID NO: 343275 - DNA, 75 bp, Artificial Sequence
  Synthetic
gacatgaggaacacgattatggcatccaaaactgtgggcacagcagaagagaagttaaagaaaaaatcctcattc

SEQ ID NO: 343276 - DNA, 75 bp, Artificial Sequence
  Synthetic
gaagttaaagaaaaaatcctcattctatcagtcatatctgagacgcactcaatctatgggaatacaactggatca

SEQ ID NO: 343277 - DNA, 75 bp, Artificial Sequence
  Synthetic
aatctatgggaatacaactggatcagagaatcatcttgctatttatgacagagtggggttctgatattgtcaacc

SEQ ID NO: 343278 - DNA, 75 bp, Artificial Sequence
  Synthetic
gagtggggttctgatattgtcaaccatttccatctgggcgatgatatgagccctgagctcagaacacttgcacaa

SEQ ID NO: 343279 - DNA, 75 bp, Artificial Sequence
  Synthetic
agtctcattgaccagaaggttaaagagatttcaaaccaggaaccattaaaaatctaaattgttgttcctgcatac

SEQ ID NO: 343280 - DNA, 75 bp, Artificial Sequence
  Synthetic
acacatgcacatccaatgatatgaatttgaagggtcgggcacaaaattcacaccaatgcatgattacaattcaca

SEQ ID NO: 343281 - DNA, 75 bp, Artificial Sequence
  Synthetic
aatctgctgctctgtatgtttattgttagtttgttaagttttaaattgtaagtccttgtttggtgtaaaaattta

SEQ ID NO: 343282 - DNA, 75 bp, Artificial Sequence
  Synthetic
ttagtttgttaagttttaaattgtaagtccttgtttggtgtaaaaatttatttttgtattatgttactagtgtaa

SEQ ID NO: 343283 - DNA, 75 bp, Artificial Sequence
  Synthetic
gttcattattgggcccaattatgtgaaactgagctatcatctctgtctcttttcttcatctctatttaaacattt

SEQ ID NO: 343284 - DNA, 75 bp, Artificial Sequence
  Synthetic
tttcttcatctctatttaaacatttctacctccgtacacttatatatatgcacgtagcatatatataagtgtacg

SEQ ID NO: 343285 - DNA, 75 bp, Artificial Sequence
  Synthetic
gcatatatataagtgtacgattccactacctcagacagttgttttcttgattgcttttcaaggagtctactacta

SEQ ID NO: 343286 - DNA, 75 bp, Artificial Sequence
  Synthetic
ttgcaattggtcagtatatcatagggtttgcacttgcaattgttctaaaggctttatatatattgtcaacccgtg

SEQ ID NO: 343287 - DNA, 75 bp, Artificial Sequence
  Synthetic
gtttgcacttgcaattgttctaaaggctttatatatattgtcaacccgtgggaggcagaccatcaaggaaaataa

SEQ ID NO: 343288 - DNA, 75 bp, Artificial Sequence
  Synthetic
actatgaaagctgatgagttaacacctggcagattcaggactatcgtgtgtggcctgttccctgctcaaataatg

SEQ ID NO: 343289 - DNA, 75 bp, Artificial Sequence
  Synthetic
gaggcatttctcattaagccctgtcctttcctaaaaaaacaaggtgctcctgggaaagaagaagaatttcttgtg

SEQ ID NO: 343290 - DNA, 75 bp, Artificial Sequence
  Synthetic
ggaccctgaactcagaacacttgcacaaagtctcattgaccaaaaggttaaggagatttctaaccaggaaccatt

SEQ ID NO: 343291 - DNA, 75 bp, Artificial Sequence
  Synthetic
attggaggacaagctggcagacttcaagaggcagcttgcagatctggtgtcaagtcaaaaaatgggtgaaaagcc

SEQ ID NO: 343292 - DNA, 75 bp, Artificial Sequence
  Synthetic
cgttaaagattggcctgaaaagattgaggagttccttattaaaccctgcccattcctgaagaaaagtggtcctag

SEQ ID NO: 343293 - DNA, 75 bp, Artificial Sequence
  Synthetic
cattcctgaagaaaagtggtcctagtaaggaagaggattttcttgtgagtaatgatgcttaccttttaggacgtg

SEQ ID NO: 343294 - DNA, 75 bp, Artificial Sequence
  Synthetic
taaggaagaggattttcttgtgagtaatgatgcttaccttttaggacgtgaaaaggcattaagggagtcacacct

SEQ ID NO: 343295 - DNA, 75 bp, Artificial Sequence
  Synthetic
caccagactctataaagtcaccacaagcaccatgggtgtttgcttgtcgaccagacaggtgccctcccacatgca

SEQ ID NO: 343296 - DNA, 75 bp, Artificial Sequence
  Synthetic
tctatatagcagggatggcagagttgggagcatttttttccattctgcaggacatgaggaacacgattatggcat

SEQ ID NO: 343297 - DNA, 75 bp, Artificial Sequence
  Synthetic
gggagcatttttttccattctgcaggacatgaggaacacgattatggcatctaaaactgtgggcacagcagagga

SEQ ID NO: 343298 - DNA, 75 bp, Artificial Sequence
  Synthetic
gagtggggttctgatattgtcaaccacttccatctgggtgatgatatgagccctgagctcagaacacttgcacaa

SEQ ID NO: 343299 - DNA, 75 bp, Artificial Sequence
  Synthetic
agtctcattgatcagaaggtcaaagagatttcaaaccaggaaccgctaaaaatctaatttgtagttcctgcatac

SEQ ID NO: 343300 - DNA, 75 bp, Artificial Sequence
  Synthetic
acacacgcacatccaatgatatgaatttgaagggttgggcacaaaattcacaccaatgcatgattacaattcaca

SEQ ID NO: 343301 - DNA, 75 bp, Artificial Sequence
  Synthetic
catacactgattgggttgggtgggtcaaatcaaacacatataagctggggtaggtaagtttactaatcgtaaggt

SEQ ID NO: 343302 - DNA, 75 bp, Artificial Sequence
  Synthetic
taggtaagtttactaatcgtaaggtagctactaagttgattattgcactacagcttggtcattgaccactcaggt

SEQ ID NO: 343303 - DNA, 75 bp, Artificial Sequence
  Synthetic
agctactaagttgattattgcactacagcttggtcattgaccactcaggtaatctgctgctctgtatgtttattg

SEQ ID NO: 343304 - DNA, 75 bp, Artificial Sequence
  Synthetic
tttttgtattatgtcactagtgtaagttcattattgggcccaataatgtgaaactgagctatcatctctgtcttt

SEQ ID NO: 343305 - DNA, 75 bp, Artificial Sequence
  Synthetic
gttcattattgggcccaataatgtgaaactgagctatcatctctgtctttttttcttcatctctacttaaacatt

SEQ ID NO: 343306 - DNA, 75 bp, Artificial Sequence
  Synthetic
tgctgagatagatgacttgattgaccttgcagcttcaggagacccaacaccaccagactctataaagtcaccaca

SEQ ID NO: 343307 - DNA, 75 bp, Artificial Sequence
  Synthetic
ccaaaactgtgggcacagcagaggaaaaattgaagaaaaaatcctcattctatcagtcatatctgagacgcactc

SEQ ID NO: 343308 - DNA, 75 bp, Artificial Sequence
  Synthetic
tatcagtcatatctgagacgcactcaatctatgggaatacaactggatcaaagaattatcttgctatttatgaca

SEQ ID NO: 343309 - DNA, 75 bp, Artificial Sequence
  Synthetic
gcatatatataagtgtacgattccactacctcagacagttgttttcttgattgcttttcaaggagcatactacta

SEQ ID NO: 343310 - DNA, 75 bp, Artificial Sequence
  Synthetic
tagtagtagactccgcaagaagaagcaaacacagagaaaactggaataaagaagtatgttttgtctgtgtttgag

SEQ ID NO: 343311 - DNA, 75 bp, Artificial Sequence
  Synthetic
caaacacagagaaaactggaataaagaagtatgttttgtctgtgtttgagtcttctcggtctactactatgttgg

SEQ ID NO: 343312 - DNA, 75 bp, Artificial Sequence
  Synthetic
ccagcagctacaagaaaccttttagaactgaaggttgaatgtccacacacaattgggttaggacaaggtattgtg

SEQ ID NO: 343313 - DNA, 75 bp, Artificial Sequence
  Synthetic
aattgggttaggacaaggtattgtgattggtagtgcagaattgccacctgtgcctttagcgaaggtagagtcact

SEQ ID NO: 343314 - DNA, 75 bp, Artificial Sequence
  Synthetic
tgcctttagcgaaggtagagtcactgaagctggaaagttcttgtaactttgacttgcatacaagcacagctgcac

SEQ ID NO: 343315 - DNA, 75 bp, Artificial Sequence
  Synthetic
aacaggcttttactaaatggtcatgggagaagaaggctgatactgctgagaatgcaaaagcagcatcaacaacat

SEQ ID NO: 343316 - DNA, 75 bp, Artificial Sequence
  Synthetic
ggagaagaaggctgatactgctgagaatgcaaaagcagcatcaacaacatttcaatctagcagtaaggaagtgca

SEQ ID NO: 343317 - DNA, 75 bp, Artificial Sequence
  Synthetic
attaagaggtctttgtgtcataccaacccttgtccttgagactgcttctcggacaaggaaaactgtcacatgttt

SEQ ID NO: 343318 - DNA, 75 bp, Artificial Sequence
  Synthetic
tgacctttcatgtaatcagactgtatgtcaacccacagtgtatttaatggcaccaatccagacctgtgttaccac

SEQ ID NO: 343319 - DNA, 75 bp, Artificial Sequence
  Synthetic
aaaaagctgcttgttaggtttaggggatcagaggattcaagtagtttatgaaaagacatattgtgtgtcaggaca

SEQ ID NO: 343320 - DNA, 75 bp, Artificial Sequence
  Synthetic
attaattgaagggaattgctttaacccgctgcacactattgctatatctcaaccaactcatacctatgatattat

SEQ ID NO: 343321 - DNA, 75 bp, Artificial Sequence
  Synthetic
gacactagctgtgcattgcttttttatttcaaaaaaaggtggtacagatgacacgttaaagattgaaaagcagtt

SEQ ID NO: 343322 - DNA, 75 bp, Artificial Sequence
  Synthetic
tgaaaccctagttgagaaaacaggttgtacagagaatgcacttaaaggttattatgcatgtattttaggcacaag

SEQ ID NO: 343323 - DNA, 75 bp, Artificial Sequence
  Synthetic
tgtacagagaatgcacttaaaggttattatgcatgtattttaggcacaagttctgaagtggtatatgttcctgca

SEQ ID NO: 343324 - DNA, 75 bp, Artificial Sequence
  Synthetic
atggatgattataggtcatcagagatattgtctaggatgaccacagcaccccatggagaagaccatgacatagac

SEQ ID NO: 343325 - DNA, 75 bp, Artificial Sequence
  Synthetic
cctaatgccattagctcactgaggattgtaggacaacttactggtaaggcaccttctactgagtcttcagacact

SEQ ID NO: 343326 - DNA, 75 bp, Artificial Sequence
  Synthetic
gtacaagggatagcatttgcaggaacaccactatatacttctacttcaatacttgtgcgaaaagaggacccaatt

SEQ ID NO: 343327 - DNA, 75 bp, Artificial Sequence
  Synthetic
taagaagaccctcccacttacatggacaggctttataactctaccaggagagattgagaaaacaactcagtgcac

SEQ ID NO: 343328 - DNA, 75 bp, Artificial Sequence
  Synthetic
agtcttctgtacattatctggcccgggggcagactgtgaagcctattcagatacaggtatcttcaacataagttc

SEQ ID NO: 343329 - DNA, 75 bp, Artificial Sequence
  Synthetic
acctacgtgcttagttaatagagtacagaggtttaggggggcagagcagcaggtaaagtttgtttgtcaaagggt

SEQ ID NO: 343330 - DNA, 75 bp, Artificial Sequence
  Synthetic
tgatttagacattactgtatattgtaatggtgtaaaaaaagtgatattaacaaaaaccttagtaataggacaatg

SEQ ID NO: 343331 - DNA, 75 bp, Artificial Sequence
  Synthetic
tatatacacatttactagtatattttcattgatgccaggtgttgcacattctcttgcagttgaattatgtgttcc

SEQ ID NO: 343332 - DNA, 75 bp, Artificial Sequence
  Synthetic
tgggctgcatggatgggcaactatctctttattgattacattttgctttggctggctagctattcctctattatc

SEQ ID NO: 343333 - DNA, 75 bp, Artificial Sequence
  Synthetic
tatgattattataaggtttctattaattttcacttacttatgctcaaaatatagtactgattctaaatttaaact

SEQ ID NO: 343334 - DNA, 75 bp, Artificial Sequence
  Synthetic
tataattgaaaaggtgaaacaggaataccagaaaacaatgggttctatggtttgtgaagtttgtcaacaaggatg

SEQ ID NO: 343335 - DNA, 75 bp, Artificial Sequence
  Synthetic
taccagaaaacaatgggttctatggtttgtgaagtttgtcaacaaggatgtgagactgcaaaggagctagaatct

SEQ ID NO: 343336 - DNA, 75 bp, Artificial Sequence
  Synthetic
cacaaaaaaagctgtccacatggacagtgtccatactgtctcaacccaactgaagctactgagtctgccctacag

SEQ ID NO: 343337 - DNA, 75 bp, Artificial Sequence
  Synthetic
gctcattttaaagtctgtaagttgacaactaggtttcaagagaatttaaagaaatcattaagtacatatgagcct

SEQ ID NO: 343338 - DNA, 75 bp, Artificial Sequence
  Synthetic
aaacgtggcctctatcgaacactctccatgtttagatacaaaagcaaatgctatgtgggtttggtttggtgtatt

SEQ ID NO: 343339 - DNA, 75 bp, Artificial Sequence
  Synthetic
ttgttaactatggagttgatagtgtgggcagctagtgctgagacaataaatcttgaacctggatggacagacaca

SEQ ID NO: 343340 - DNA, 75 bp, Artificial Sequence
  Synthetic
gcccatggctcagggataatcccacttaagactgatttagaattggatttttccctaccatcttctgcaacatac

SEQ ID NO: 343341 - DNA, 75 bp, Artificial Sequence
  Synthetic
ttccctaccatcttctgcaacatacacatatagaagagaactacaaaatcctgcaaatgaacaagaaaagatacc

SEQ ID NO: 343342 - DNA, 75 bp, Artificial Sequence
  Synthetic
attccattttcaaatggagagacaagttatacatgctgaaatacagcatttaggtcactggatggatggcacttt

SEQ ID NO: 343343 - DNA, 75 bp, Artificial Sequence
  Synthetic
gttatacatgctgaaatacagcatttaggtcactggatggatggcacttttaatttgaaaactgcgtttcattgc

SEQ ID NO: 343344 - DNA, 75 bp, Artificial Sequence
  Synthetic
tatggctcttgtataaaatatgcttatccttggcagacagcaaagtgttttcttgagaaggattttgaatttgaa

SEQ ID NO: 343345 - DNA, 75 bp, Artificial Sequence
  Synthetic
actggatggggctgtaatcctcctgactgcccaggggtaggtacagggtgtacagcctgtggtgtttatctagat

SEQ ID NO: 343346 - DNA, 75 bp, Artificial Sequence
  Synthetic
aaattacgatctgttggcaaagtttataaaatcctgtcccttaaatatactagaaaagtttgtatccagttaggt

SEQ ID NO: 343347 - DNA, 75 bp, Artificial Sequence
  Synthetic
actgagcaaacatgtaagacaattgattctaatgattgtttggtaacaacttctgtgaaggtctgtatgattgga

SEQ ID NO: 343348 - DNA, 75 bp, Artificial Sequence
  Synthetic
acacattattattcttagggccgctagaagagggtggaatgatttttaaacaatggtgtacaacaacatgccaat

SEQ ID NO: 343349 - DNA, 75 bp, Artificial Sequence
  Synthetic
ttggagacccaggtgatatcatgagcacacccttagggatgaaatgcccagaacatgcaggttcctttagaaaaa

SEQ ID NO: 343350 - DNA, 75 bp, Artificial Sequence
  Synthetic
agtgttcttttgccacattgccatcatgtcagtatgatggaaacactgtatctggatatcagagaatgattgcca

SEQ ID NO: 343351 - DNA, 75 bp, Artificial Sequence
  Synthetic
caaaagattcattccagtcattcaatattacagaaccccatattacaacaaattcactagaatgggttgacccag

SEQ ID NO: 343352 - DNA, 75 bp, Artificial Sequence
  Synthetic
atagttctctaaaggaccatgtcaatctgatagtaaaccgggatctatctttccaagatttagctgaaaatccat

SEQ ID NO: 343353 - DNA, 75 bp, Artificial Sequence
  Synthetic
gtggggtttaatttagtctgctctgtcagccttacagaatgtgcatcgtttctcacatcaatcaaagcatgtgat

SEQ ID NO: 343354 - DNA, 75 bp, Artificial Sequence
  Synthetic
tctgccatgtgttatggttcaagcacagctaatctagtaaggggccaaaacacagtacatgttgtaggcaaaggt

SEQ ID NO: 343355 - DNA, 75 bp, Artificial Sequence
  Synthetic
ggccattctggatccaaattcatgtgctgccatgataaaaaatgttcagctacagggcttgttgcagcagcacca

SEQ ID NO: 343356 - DNA, 75 bp, Artificial Sequence
  Synthetic
caccttgatagagtcacaggatacaatcaaattgacacaaataaggtttttgatgatggtgcaccacaatgtggt

SEQ ID NO: 343357 - DNA, 75 bp, Artificial Sequence
  Synthetic
gttcattgttggttcaagaagtcaggtgaatggttgctaggtattttaagtggtaactggatggttgttgctgtt

SEQ ID NO: 343358 - DNA, 75 bp, Artificial Sequence
  Synthetic
cttattgcactgtttatattttcactattattattcagcctttgctgcccacgtcgtcagaattataagaaaaat

SEQ ID NO: 343359 - DNA, 75 bp, Artificial Sequence
  Synthetic
aaataagcatgagtccaatataactttttattattccttaatgcatatgtacttataccttatatcttatattac

SEQ ID NO: 343360 - DNA, 75 bp, Artificial Sequence
  Synthetic
taatctcctatattaacagtatgtgtttatatcaaactgaactgtatagccctcatactacttccaaaaaaaact

SEQ ID NO: 343361 - DNA, 75 bp, Artificial Sequence
  Synthetic
aaaactaccactttactactactctacctcatatcgatcattcctggacttttgttcctgcggagcatactacta

SEQ ID NO: 343362 - DNA, 75 bp, Artificial Sequence
  Synthetic
tagtagtagactccttgaaaagctactactaaaaccgctggtatgagccaactcaaagaaatacaggaggagatc

SEQ ID NO: 343363 - DNA, 75 bp, Artificial Sequence
  Synthetic
taaggaagaagattttcttgtgagtaatgatgcttaccttttaggacgtgaaaaggcattgagggaatcacacct

SEQ ID NO: 343364 - DNA, 75 bp, Artificial Sequence
  Synthetic
gagtggggttctgatattgtcaaccatttccatctgggtgatgatatggaccctgagctcagaacacttgcacaa

SEQ ID NO: 343365 - DNA, 75 bp, Artificial Sequence
  Synthetic
ctacctccgtacacttatatatatgcacgtagcatatatataagtgtacgattctactacctcaaacagttgttt

SEQ ID NO: 343366 - DNA, 75 bp, Artificial Sequence
  Synthetic
ggggacaagaatccggttcaaggatgacagctcatatgaagaaatcaatggcattagacgcccgaaacatctgta

SEQ ID NO: 343367 - DNA, 75 bp, Artificial Sequence
  Synthetic
acccgccatgaacagcagattgtcattgctcggcaaaaactcaaagatgcagagaagacagtggaggccgaccca

SEQ ID NO: 343368 - DNA, 75 bp, Artificial Sequence
  Synthetic
gatgatgttaacaagaatacactccagagcagacgggcagctgtgtcagcattggaggacaaattggcagaattc

SEQ ID NO: 343369 - DNA, 75 bp, Artificial Sequence
  Synthetic
aagagacagcttgccgatctggtatcaagtcagaaaatgggtgagaagcctgttgatccgactgggcttgagcca

SEQ ID NO: 343370 - DNA, 75 bp, Artificial Sequence
  Synthetic
gatgatcacctcaaggagagatccagtctcagatatggaaatgtccttgatgtaaatgctattgatattgatgag

SEQ ID NO: 343371 - DNA, 75 bp, Artificial Sequence
  Synthetic
ccaagtggacaaacagcagattggttttctattgggcagtatgttatgggctttgctttggcaattgtcttgaaa

SEQ ID NO: 343372 - DNA, 75 bp, Artificial Sequence
  Synthetic
gcattatacatgctatctacccgtggaaggcaaacaatcaaagaaaataaggggacacgaatcagattcaaagat

SEQ ID NO: 343373 - DNA, 75 bp, Artificial Sequence
  Synthetic
gacagttcatttgaggagatcaatgggataaggcggccaaaacacctgtatgtctcaatgcctactgcacagtct

SEQ ID NO: 343374 - DNA, 75 bp, Artificial Sequence
  Synthetic
accatgaaagcagatgaactaacacccggtcgtttccggactattgtctgtggcttgtttcctgctcaaatcatg

SEQ ID NO: 343375 - DNA, 75 bp, Artificial Sequence
  Synthetic
catagaaacataataagtcctgttatgggtgtgatcggattttcattctttgtcaaggactggccagaaaagatt

SEQ ID NO: 343376 - DNA, 75 bp, Artificial Sequence
  Synthetic
gaggaattcctgatcaaaccatgtccatttttaaagaaacaaggcagctcaggcaaggaggaggaatttcttgtg

SEQ ID NO: 343377 - DNA, 75 bp, Artificial Sequence
  Synthetic
agtaatgatgcatacttaattggtagggaaaaaacattgcaagagtcacacttgactgagattgatgatttgatt

SEQ ID NO: 343378 - DNA, 75 bp, Artificial Sequence
  Synthetic
gatctagcagactcaggagatcctacaccaccagactctataaaatctccacaagcaccatgggtttttgcctgt

SEQ ID NO: 343379 - DNA, 75 bp, Artificial Sequence
  Synthetic
gcgcctgatcgatgccctcccacttgtatttatatagctgggatggctgaacttggtgctttcttttcaatactc

SEQ ID NO: 343380 - DNA, 75 bp, Artificial Sequence
  Synthetic
caggatatgaggaatacaatcatggcttctaagactgtgggaacagcagaggagaaattgaaaaagaaatcatct

SEQ ID NO: 343381 - DNA, 75 bp, Artificial Sequence
  Synthetic
ttctatcagtcctacctaaggcgcactcaatcaatgggaatccaactggaccaaaggattatcttgctgttcatg

SEQ ID NO: 343382 - DNA, 75 bp, Artificial Sequence
  Synthetic
atggagtggggttctgatattgtcaaccatttccatttgggcgatgatatggaccctgaactaagaacacttgct

SEQ ID NO: 343383 - DNA, 75 bp, Artificial Sequence
  Synthetic
cagagtctcattgatcaaaaggtcaaggagatttcaaaccaggaaccactgaaaatctgaaagaacagttcctgc

SEQ ID NO: 343384 - DNA, 75 bp, Artificial Sequence
  Synthetic
atacacgcacacacatccaatgatatgatttgatgggttgggcacaaattcacatagatgcatgaaaaaatcaca

SEQ ID NO: 343385 - DNA, 75 bp, Artificial Sequence
  Synthetic
cacatagatgcatgaaaaaatcacatatacactgattgggttgggtgggtcaaatcaaacatacaatagctgggg

SEQ ID NO: 343386 - DNA, 75 bp, Artificial Sequence
  Synthetic
tagtttgttaagttttaaaagttaagtctttgtttagtgtaagaatttatttttatattatgttgtcaatgtaag

SEQ ID NO: 343387 - DNA, 75 bp, Artificial Sequence
  Synthetic
aactatagtgggccctgtaatgtgaaactgagctatcacctccatttctttctttcatctccaatcaaacatttc

SEQ ID NO: 343388 - DNA, 75 bp, Artificial Sequence
  Synthetic
gaagaagcaaacacagagaaaactggaataaagaagtatgttttgtctgtgtttgagtcttctcggtctactact

SEQ ID NO: 343389 - DNA, 75 bp, Artificial Sequence
  Synthetic
agtcactgaagttggaaagctcttgtaactttgacttgcatacaagcacggctgcacaacaggcttttacaaaat

SEQ ID NO: 343390 - DNA, 75 bp, Artificial Sequence
  Synthetic
ggtcatgggagaagaaggctgatactgctgagaatgcaaaagcagcatcaacaacatttcaatctagtagtaagg

SEQ ID NO: 343391 - DNA, 75 bp, Artificial Sequence
  Synthetic
tgctgagaatgcaaaagcagcatcaacaacatttcaatctagtagtaaggaggtgcagttaagaggtctttgtgt

SEQ ID NO: 343392 - DNA, 75 bp, Artificial Sequence
  Synthetic
aaaggttattatgcatgtattttaggcacaagttctgaagtggtgtatgaacctgcaatggatgattataggtca

SEQ ID NO: 343393 - DNA, 75 bp, Artificial Sequence
  Synthetic
cttcaatacttgtgcgaaaagaggacccaatttatttatggtcacctggtatcattcctgaaggcaatcattcac

SEQ ID NO: 343394 - DNA, 75 bp, Artificial Sequence
  Synthetic
aatgtgataagaagaccctcccacttacatggacaggctttataactctaccaggagagattgagaaaacaactc

SEQ ID NO: 343395 - DNA, 75 bp, Artificial Sequence
  Synthetic
gtgttcctgggttgcatggatgggcaactatatctttattgattacattttgttttggctggcttgctattcccc

SEQ ID NO: 343396 - DNA, 75 bp, Artificial Sequence
  Synthetic
aactatatctttattgattacattttgttttggctggcttgctattcccctattatctatgattattataaggtt

SEQ ID NO: 343397 - DNA, 75 bp, Artificial Sequence
  Synthetic
tctatggtttgtgaagtttgtcaacaagaatgcgagactgcaaaggagctagaatcgcacaaaaaaagctgtcca

SEQ ID NO: 343398 - DNA, 75 bp, Artificial Sequence
  Synthetic
aacatacacatataggagagaactacaaaatcctgcaaatgaacaagaaaagataccattccatttccaaatgga

SEQ ID NO: 343399 - DNA, 75 bp, Artificial Sequence
  Synthetic
aagacaagttatacatgctgaaatacagcatttaggtcactggatggatggcacttttaatttaaagactgcgtt

SEQ ID NO: 343400 - DNA, 75 bp, Artificial Sequence
  Synthetic
cagcatttaggtcactggatggatggcacttttaatttaaagactgcgtttcattgctatggctcttgtataaaa

SEQ ID NO: 343401 - DNA, 75 bp, Artificial Sequence
  Synthetic
taacaacttctgtgaaggtctgtatgattggaacaatatcaaagtttcaacctggagacacattattattcttag

SEQ ID NO: 343402 - DNA, 75 bp, Artificial Sequence
  Synthetic
tgccaatttggagacccaggtgatatcatgagcacacccttagggatgaagtgcccagaacatgcaggttccttt

SEQ ID NO: 343403 - DNA, 75 bp, Artificial Sequence
  Synthetic
tcatgagcacacccttagggatgaagtgcccagaacatgcaggttcctttagaaagaagtgttcttttgccacat

SEQ ID NO: 343404 - DNA, 75 bp, Artificial Sequence
  Synthetic
aatccatgtcaggttgatttaagtgtatcatcaattgatggtgcatggggctcaggtgtggggtttaatttagtc

SEQ ID NO: 343405 - DNA, 75 bp, Artificial Sequence
  Synthetic
tgttctgtcagccttacagaatgtgcatcatttctcacgtcaatcaaagcatgtgattctgccatgtgttatggt

SEQ ID NO: 343406 - DNA, 75 bp, Artificial Sequence
  Synthetic
ttttcactattattattcagcctttgctgcccacgtcgtcagaattataagaaaaataagtaagcatgagtccat

SEQ ID NO: 343407 - DNA, 75 bp, Artificial Sequence
  Synthetic
tataactttttattattccttaatgcatatgtacttatacgtatatcttatattactaatctcctatattaacag

SEQ ID NO: 343408 - DNA, 75 bp, Artificial Sequence
  Synthetic
tatgtgtttatatcaagctgaactatatagcccttatactacttccaaaaaaaactaccattttactactactct

SEQ ID NO: 343409 - DNA, 75 bp, Artificial Sequence
  Synthetic
gaactatatagcccttatactacttccaaaaaaaactaccattttactactactctaccccataccgattatgcc

SEQ ID NO: 343410 - DNA, 75 bp, Artificial Sequence
  Synthetic
acccgccatgagcagcagattgtcattgcccggcaaaagctcaaggatgcagagaagacggtggaggccgacccg

SEQ ID NO: 343411 - DNA, 75 bp, Artificial Sequence
  Synthetic
ttgcccggcaaaagctcaaggatgcagagaagacggtggaggccgacccggatgatgttaacaagagtacattac

SEQ ID NO: 343412 - DNA, 75 bp, Artificial Sequence
  Synthetic
caagtcaaaagatgggtgaaaagcctgttgacccgactgggcttgaaccggacgaccacctcaaggagagatcta

SEQ ID NO: 343413 - DNA, 75 bp, Artificial Sequence
  Synthetic
tttctattggacagtacattatagggtttgcactagcaattgtcttgaaagcattgtatatgttgtcaacaagag

SEQ ID NO: 343414 - DNA, 75 bp, Artificial Sequence
  Synthetic
gtaggcagacaattaaagaaaacaaagggacgagaattaggtttaaagatgatagctcctttgaagagatcaatg

SEQ ID NO: 343415 - DNA, 75 bp, Artificial Sequence
  Synthetic
gcatacggcgtcctaagcatctttatgtgtcaatgcccactgcacaatccaccatgaaagctgacgagttaacac

SEQ ID NO: 343416 - DNA, 75 bp, Artificial Sequence
  Synthetic
ctggtaggttcagaacaattgtctgtggactttttccagctcagatcatgcataggaacatcataagtcctgtca

SEQ ID NO: 343417 - DNA, 75 bp, Artificial Sequence
  Synthetic
tgggtgtcattggattttcattttttgttaaagattggcctgagaagattgaggaattcttaattaaaccctgcc

SEQ ID NO: 343418 - DNA, 75 bp, Artificial Sequence
  Synthetic
ctttcttaaaaaagcaaggtgcacctgggaaagaagaggacttcctcgtaagcaatgatgcttatctgctcgggc

SEQ ID NO: 343419 - DNA, 75 bp, Artificial Sequence
  Synthetic
gagagaaagcactacgggaatcacacttggctgagattgatgacttgattgaccttgcagcttcaggggatccaa

SEQ ID NO: 343420 - DNA, 75 bp, Artificial Sequence
  Synthetic
caccaccagactctataaagtcaccacaagccccatgggtgtttgcttgtgcacctgataggtgtcctccaacat

SEQ ID NO: 343421 - DNA, 75 bp, Artificial Sequence
  Synthetic
gtatttatgttgctgggatggcagagctaggagcctttttctcaatccttcaggatatgaggaatacaatcatgg

SEQ ID NO: 343422 - DNA, 75 bp, Artificial Sequence
  Synthetic
catctaaaacagtgggcactgctgaggagaagttaaagaagaaatcctccttttatcagtcatacttgagacgca

SEQ ID NO: 343423 - DNA, 75 bp, Artificial Sequence
  Synthetic
ctcagtcaatgggaatacaactggatcagaggattattctgttgtttatgacagaatggggttcagatattgtca

SEQ ID NO: 343424 - DNA, 75 bp, Artificial Sequence
  Synthetic
accatttccaccttggtgatgatatggacccagaactccggacacttgcacaaagtctcattgaccaaaaggtca

SEQ ID NO: 343425 - DNA, 75 bp, Artificial Sequence
  Synthetic
caaagtctcattgaccaaaaggtcaaagagatatctaaccaggaaccattaaaaatctaggcagctgttcctgca

SEQ ID NO: 343426 - DNA, 75 bp, Artificial Sequence
  Synthetic
cacatacactgattgggttgggtgggtcgaatcaaacacatataagctgggttaggtaagtttactaatcgtaag

SEQ ID NO: 343427 - DNA, 75 bp, Artificial Sequence
  Synthetic
tacagcttggtcattgaccacttaggtaatctgctgctctgtatgtttattgttagtttgttaagttttaagttt

SEQ ID NO: 343428 - DNA, 75 bp, Artificial Sequence
  Synthetic
aagtcattgttcggtgtataaatttatttttatatattatgttgttagtgtaagtccattattgggcccattaat

SEQ ID NO: 343429 - DNA, 75 bp, Artificial Sequence
  Synthetic
gtgaaactgagctattatctttttttcttcttttcatctctgattcaacatttctacctccgtacacttatatat

SEQ ID NO: 343430 - DNA, 75 bp, Artificial Sequence
  Synthetic
atgagcaccctcaaagaaatacaggaagagatcacccgccatgagcagcagattgtcattgctcggcaaaaactt

SEQ ID NO: 343431 - DNA, 75 bp, Artificial Sequence
  Synthetic
aaagatgcggagaagacggtggaggccgacccggatgatgttaacaaaaatacactccagagcagacgggcagct

SEQ ID NO: 343432 - DNA, 75 bp, Artificial Sequence
  Synthetic
gtgtcaacattggaggacaaattggcagaattcaaaagacaacttgccgatctggtgtcaagtcaaaagatgggt

SEQ ID NO: 343433 - DNA, 75 bp, Artificial Sequence
  Synthetic
gagaaacctgttgatccgactgggctggagccagacgaccaccttaaggaaagatctagcctcagatatggaaat

SEQ ID NO: 343434 - DNA, 75 bp, Artificial Sequence
  Synthetic
gtccttgatgtgaatgctactgacattgatgagccaagtgggcagacagcagactggttttctatcggtcagtac

SEQ ID NO: 343435 - DNA, 75 bp, Artificial Sequence
  Synthetic
ataatgggatttgcacttgcaatcgtgcttaaggcgttgtacatgttgtcgacacgcgggagacaaaccatcaag

SEQ ID NO: 343436 - DNA, 75 bp, Artificial Sequence
  Synthetic
gaaaataaagggacaagaattaagtttaaagatgacagttcaattgaggagattaacgggataagacgtccaaaa

SEQ ID NO: 343437 - DNA, 75 bp, Artificial Sequence
  Synthetic
cacctgtatgtctcaatgccaactgcacagtccacaatgaaagcagatgagttaacaccaggaagatttaggaca

SEQ ID NO: 343438 - DNA, 75 bp, Artificial Sequence
  Synthetic
attgtctgtggcctcttccctgcccaaataatgcatagaaacatcatcagtccagtaatgggtgtaataggattc

SEQ ID NO: 343439 - DNA, 75 bp, Artificial Sequence
  Synthetic
tctttctttgtcaaagattggccagataagattgaggagttccttattaaaccatgtcccttcttgaaaaaacaa

SEQ ID NO: 343440 - DNA, 75 bp, Artificial Sequence
  Synthetic
ggttccaccaaagaagaagaatttcttgtgagcaatgatgcatacatgctcgggagggaaaaagcattacgggaa

SEQ ID NO: 343441 - DNA, 75 bp, Artificial Sequence
  Synthetic
tcacacctggctgaaattgatgagttgattgatcttgcagactcaggggacccaacaccgcctgactccatcaag

SEQ ID NO: 343442 - DNA, 75 bp, Artificial Sequence
  Synthetic
tccccacaggcaccatgggtatttgcatgtgcaccagatagatgcccccctacatgtatttatattgctgggatg

SEQ ID NO: 343443 - DNA, 75 bp, Artificial Sequence
  Synthetic
gctgaacttggggcattcttttctatactccaggacatgagaaatacaatcatggcatctaagactgttggaaca

SEQ ID NO: 343444 - DNA, 75 bp, Artificial Sequence
  Synthetic
gcagaggaaaagttaaagaaaaaatcatcattttatcagtcttatttgcggcgcactcaatcaatgggaatacaa

SEQ ID NO: 343445 - DNA, 75 bp, Artificial Sequence
  Synthetic
gcgcactcaatcaatgggaatacaactggaccaaaggattatcctgctttttatgatggagtggggttctgatat

SEQ ID NO: 343446 - DNA, 75 bp, Artificial Sequence
  Synthetic
tgtcaaccatttccatctgggtgatgatatggaccctgaactcagaacacttgcacaaagtctcattgaccagaa

SEQ ID NO: 343447 - DNA, 75 bp, Artificial Sequence
  Synthetic
ggtcaaggagatttcaaaccaggagccattgaaaatctaaacactagttcctgcatacatgcacacacagtcaat

SEQ ID NO: 343448 - DNA, 75 bp, Artificial Sequence
  Synthetic
gatatgaatttgatgggttgggcacaaatttacattaaatcattattcaaattaaacatacactgattgggttgg

SEQ ID NO: 343449 - DNA, 75 bp, Artificial Sequence
  Synthetic
gtgggtttaatcaagtacatataagctggggtaggtaagtttactaattgtaaggtagctactaaattgattatt

SEQ ID NO: 343450 - DNA, 75 bp, Artificial Sequence
  Synthetic
gcactaaagcttggtcattgaccactcaggtaatctgctgctttttttatgtttattgttgttgttaagtctctg

SEQ ID NO: 343451 - DNA, 75 bp, Artificial Sequence
  Synthetic
tttagaatagggttttgtctggtgtaaattttatttttttattgttttatcaatgtgaatttatattgggcccgt

SEQ ID NO: 343452 - DNA, 75 bp, Artificial Sequence
  Synthetic
taatgtgaaactgagctatcattgtttccttttctttttcatctctatttacacacctctacctccgtacactta

SEQ ID NO: 343453 - DNA, 75 bp, Artificial Sequence
  Synthetic
gtctcagatatggaaatgtcctggatgtgaatgccattgatattgatgagccaagtggtcaaacagcggactggt

SEQ ID NO: 343454 - DNA, 75 bp, Artificial Sequence
  Synthetic
gcattatacatgttatcaacaagaggaaggcagacaattaaggaaaacaaggggactaggatccggttcaaagat

SEQ ID NO: 343455 - DNA, 75 bp, Artificial Sequence
  Synthetic
actatgaaagctgatgagttaacaccaggtaggtttagaacaattgtctgtggacttttcccggctcaaattatg

SEQ ID NO: 343456 - DNA, 75 bp, Artificial Sequence
  Synthetic
tgggtgttattgggttttcattctttgtgaaagactggcctgagaagatcgaagaatttttaattaaaccctgtc

SEQ ID NO: 343457 - DNA, 75 bp, Artificial Sequence
  Synthetic
gatcttgcagcatcaggggatccaacaccaccggactctataaaatcaccacaggccccatgggtgtttgcctgt

SEQ ID NO: 343458 - DNA, 75 bp, Artificial Sequence
  Synthetic
caggatatgagggacacaatcatggcatctaagacagtgggcactgctgaggagaagttgaagaaaaaatcttcc

SEQ ID NO: 343459 - DNA, 75 bp, Artificial Sequence
  Synthetic
catctaagacagtgggcactgctgaggagaagttgaagaaaaaatcttccttttatcaatcatacttgaggcgta

SEQ ID NO: 343460 - DNA, 75 bp, Artificial Sequence
  Synthetic
acggaatggggttcagatattgtcaatcattttcatcttggagatgatatggacccagaactccggacacttgca

SEQ ID NO: 343461 - DNA, 75 bp, Artificial Sequence
  Synthetic
tacacgcacacacatccaatgatatgaatttgaagggttgggcacaaaattcacattgatgcataattaaattca

SEQ ID NO: 343462 - DNA, 75 bp, Artificial Sequence
  Synthetic
tacagcttggtcattgaccactcaggtaatctgctgctctgtatgtttattgttagcttgttaagtttaaaagtt

SEQ ID NO: 343463 - DNA, 75 bp, Artificial Sequence
  Synthetic
aagtcattgtttggtgtataaatttatttttgtattatgttgttagtgtaagtacaatattgggcccgttaatgt

SEQ ID NO: 343464 - DNA, 75 bp, Artificial Sequence
  Synthetic
accagaaaagggtggtcacggggtcgtaagtttcaaagaaaattatttatggcttaggaacaaagtttcctatcg

SEQ ID NO: 343465 - DNA, 75 bp, Artificial Sequence
  Synthetic
tcaaaaatcctatgggagggattgaggggtatagtcaaaaattatggactatagcaactattccctacttatatc

SEQ ID NO: 343466 - DNA, 75 bp, Artificial Sequence
  Synthetic
tgggatctggttccggttaactctacaaaccagataacatggcagatttgttcagcaaggtaaatgactttcaaa

SEQ ID NO: 343467 - DNA, 75 bp, Artificial Sequence
  Synthetic
tatctgcatatgaagttggtgtcaggatcgcatcagtcgttcaaggtgacaatgaggtaggtgcaataacaaaac

SEQ ID NO: 343468 - DNA, 75 bp, Artificial Sequence
  Synthetic
aatatagaaccaatctaggacgtcaaggagggttgactgtcaaattagtgggtgtgagaagcacagttgtggttc

SEQ ID NO: 343469 - DNA, 75 bp, Artificial Sequence
  Synthetic
gagtgaaatctagcctaccctactcagtaaagaagaggatgagtacgcaaatggcacttgaattttttgatagac

SEQ ID NO: 343470 - DNA, 75 bp, Artificial Sequence
  Synthetic
tcgttccatcgaccaaagatcataggctgagatggaagttaatcaggttattaaccctcgcagtctacaatgact

SEQ ID NO: 343471 - DNA, 75 bp, Artificial Sequence
  Synthetic
tcagatggaacttttctatggtaggacacaacttaaaagctagcgaaactataattagctctcactttttcgtct

SEQ ID NO: 343472 - DNA, 75 bp, Artificial Sequence
  Synthetic
cccttccagattcgatttctattggagccttactttctttgcttgcaatttcctttgaacagcctgcagctgtga

SEQ ID NO: 343473 - DNA, 75 bp, Artificial Sequence
  Synthetic
attctaaaaggatttactacgatggtgtttgtatgacacaaggtctgaaggccgttgcgagatgtgttttctggt

SEQ ID NO: 343474 - DNA, 75 bp, Artificial Sequence
  Synthetic
ttcgggggcttctaagcgacccagatcttgaggtgcagatgatagaggtaagcttggatgatcagggtgagataa

SEQ ID NO: 343475 - DNA, 75 bp, Artificial Sequence
  Synthetic
cagaaactattgttgatgaaaccagatcagcatgtagcaacatttctacatctttagctaaggcaattgaaaatg

SEQ ID NO: 343476 - DNA, 75 bp, Artificial Sequence
  Synthetic
gatttgctgccagaggagacatactaaccagatataaagatgcttactttgaaaagatccgtgacttccctaatc

SEQ ID NO: 343477 - DNA, 75 bp, Artificial Sequence
  Synthetic
gtgttgatagagagttgatgtataagatgaatattctcaaaactattcagcaattaataatatcacttggcttct

SEQ ID NO: 343478 - DNA, 75 bp, Artificial Sequence
  Synthetic
ctgatgatgacttagctatatttgaagatccggaactaggtgattactctgacatcactcaagatgaatatcaag

SEQ ID NO: 343479 - DNA, 75 bp, Artificial Sequence
  Synthetic
caattaatgactctttaactcctgatgtcactgaccctatattaaagagtccaaattggattatcgtagctgcat

SEQ ID NO: 343480 - DNA, 75 bp, Artificial Sequence
  Synthetic
ctatgatcacgactataactattcaactctggatcttgctaactaaggccgtgactgcacctgacacagctcatg

SEQ ID NO: 343481 - DNA, 75 bp, Artificial Sequence
  Synthetic
tggttccctcatctcttggaggtttcaattatcttaacatggcccggctattggttagaaacataggtgatccag

SEQ ID NO: 343482 - DNA, 75 bp, Artificial Sequence
  Synthetic
atagtgagcaaagaagatttattaagtatcttcagcaaagaaaagcttatgctgcattcaagtttactactatat

SEQ ID NO: 343483 - DNA, 75 bp, Artificial Sequence
  Synthetic
tgactgcatcgttggctgatgtcaaacgaatgatagatggcaaacttctccctgagagcatactaatgaaaatta

SEQ ID NO: 343484 - DNA, 75 bp, Artificial Sequence
  Synthetic
ttacagagagagtgcggagaaaaattgcacagagcttgtccataaggaaattcatggtaagtatcatgttagaag

SEQ ID NO: 343485 - DNA, 75 bp, Artificial Sequence
  Synthetic
tgactcaagaatccgggacttctgattatatcgactgggttagtgacccgtattacacaaatataccacacagtc

SEQ ID NO: 343486 - DNA, 75 bp, Artificial Sequence
  Synthetic
taaggaaatctgggtcggctaaaggaagaatctctgaatgcattgctgatgtatcggcttacattgaagaagcag

SEQ ID NO: 343487 - DNA, 75 bp, Artificial Sequence
  Synthetic
agagcataaccaaaatcataaaaaatataacagccaggttcattttgcaaagtagccccaacccgatgctagagg

SEQ ID NO: 343488 - DNA, 75 bp, Artificial Sequence
  Synthetic
gcttgagtgggtttatcctaacactcaaatatggcattggaacaagatttccagtgctggctcttaatgcattcc

SEQ ID NO: 343489 - DNA, 75 bp, Artificial Sequence
  Synthetic
gcttgtttcatataaactctgataaagaagaccgggaactggctcgcttcctccttgacaggaaagtaatcctac

SEQ ID NO: 343490 - DNA, 75 bp, Artificial Sequence
  Synthetic
aaagtgatctcagtgtgataaggaatctgattgacctgtacaaaagcatgggaacaatagcaccattcatggtgc

SEQ ID NO: 343491 - DNA, 75 bp, Artificial Sequence
  Synthetic
ctagggcagcaagtgaaatagtagataactcgatcactggagcaagagagagtctagcagggttgcttgatacta

SEQ ID NO: 343492 - DNA, 75 bp, Artificial Sequence
  Synthetic
ttattgaagatgcaacccaagtcaagtttgccccaggtaattactcgttactctggagctttgcaatgggcgttg

SEQ ID NO: 343493 - DNA, 75 bp, Artificial Sequence
  Synthetic
caaaagggctgataagaacaggattaaagagagggggattaaggcctaacttactcaataaaatatccaattatg

SEQ ID NO: 343494 - DNA, 75 bp, Artificial Sequence
  Synthetic
gaactgctttggatcatgcaatgaataatctcaacataaatcgagattatttggaaccaagctacttcagacttg

SEQ ID NO: 343495 - DNA, 75 bp, Artificial Sequence
  Synthetic
attataatcagtttcgtcagttcaataggctaatgcaaaacgataaatacaactcattaattgaaactggttctt

SEQ ID NO: 343496 - DNA, 75 bp, Artificial Sequence
  Synthetic
gtcaagaggtggtgagattgtcagaaagcacagtagacaggtcaatggctcaagaattaggtattgatcccacat

SEQ ID NO: 343497 - DNA, 75 bp, Artificial Sequence
  Synthetic
gttctgtagagttggcgagagcatttaggcaacacatgtggatcaatctttctaaaggtagggttatttacggac

SEQ ID NO: 343498 - DNA, 75 bp, Artificial Sequence
  Synthetic
ctgaggatctaatcatgagagcagtccaagctgcaggagtgggatcaagagatccggatgcagcacgtagaacag

SEQ ID NO: 343499 - DNA, 75 bp, Artificial Sequence
  Synthetic
tcgaaactcctgatgtaattgaatcgtcatctggctattttttggaaggttatgaagactgtccacattgctcaa

SEQ ID NO: 343500 - DNA, 75 bp, Artificial Sequence
  Synthetic
ggagattccaagttgctgacattcaaatagatgaaggacctgttgatcttgcaacagaagcagaggatcaaacaa

SEQ ID NO: 343501 - DNA, 75 bp, Artificial Sequence
  Synthetic
atggaaaccagtattatagctggttttttgtccctaacagttgtgaactagataatgttggaaattcaaacagct

SEQ ID NO: 343502 - DNA, 75 bp, Artificial Sequence
  Synthetic
caaaggacaatgaacagcgcattaaagtcccagaccccaggggatccattggacaaagcaacgctcagtttcaac

SEQ ID NO: 343503 - DNA, 75 bp, Artificial Sequence
  Synthetic
ctctcagagtaccttacgtagggtcaacaacagaagaacgcagtgagattaaactcggaaatatccgatctccta

SEQ ID NO: 343504 - DNA, 75 bp, Artificial Sequence
  Synthetic
caccaaaaccacaattacgtggaagagtaatgccccctgaaaggaagcccacagatcagcagaaaaatcttcagg

SEQ ID NO: 343505 - DNA, 75 bp, Artificial Sequence
  Synthetic
gcagggctctaaaagctgccattaggatagcaacagtttacacctgggcttatggtgatactgaaaaggaatgga

SEQ ID NO: 343506 - DNA, 75 bp, Artificial Sequence
  Synthetic
atcaacgtcccagaccatctgccacaccgaggagactgacaaaggacgctgaagacaacattgaccagctgtttg

SEQ ID NO: 343507 - DNA, 75 bp, Artificial Sequence
  Synthetic
atgaagctttatacctagcaaatcagcgttgtaaaatcactcttgctgaacttaagactgttacacctatatcca

SEQ ID NO: 343508 - DNA, 75 bp, Artificial Sequence
  Synthetic
cacagtatgattcaggtgttgcagctcccgaagatgtaaccctggtaacatccgacagcacatctcctgctcgga

SEQ ID NO: 343509 - DNA, 75 bp, Artificial Sequence
  Synthetic
catctactaacatcgctcacaggctaagagacaaaagcacccagatgaaatatgcagcagcttcaaattcaagag

SEQ ID NO: 343510 - DNA, 75 bp, Artificial Sequence
  Synthetic
gttcaggaacaggaagtgacatggatctcatcaatcaatcaccttgagtaatgcaaggtggatctccaactatca

SEQ ID NO: 343511 - DNA, 75 bp, Artificial Sequence
  Synthetic
tgtcacgctatgtgactatcagcaatgacaatctcaattttgagtttgacggtgttaaaatggacacgaattttg

SEQ ID NO: 343512 - DNA, 75 bp, Artificial Sequence
  Synthetic
atttcttattatatatcaattaatgactatcttaactttatagagctttcatactatcgcaattatatatcatga

SEQ ID NO: 343513 - DNA, 75 bp, Artificial Sequence
  Synthetic
tctatcaacagttcatgctaactgggttggcaatcctagaggacaagtttagatactatagcaccacaggctgct

SEQ ID NO: 343514 - DNA, 75 bp, Artificial Sequence
  Synthetic
atcatttataaaggatgtgcatgaataaaccaattaaagaaaacttaggatccaagtatcctaggctttggcacc

SEQ ID NO: 343515 - DNA, 75 bp, Artificial Sequence
  Synthetic
acaacacaatttaccatcttcatgttactgatagttgctgcgttgtaccaatggaggactattcatatatcccat

SEQ ID NO: 343516 - DNA, 75 bp, Artificial Sequence
  Synthetic
tgccctagccaactcccaaccacacttgcaacacaggccgcaacgagaccacacatcccctgagacaccacaccc

SEQ ID NO: 343517 - DNA, 75 bp, Artificial Sequence
  Synthetic
catggatgaatccacccccttatcaatcaattaaatccaataaactcatctatgatcctgagccgattcaaggaa

SEQ ID NO: 343518 - DNA, 75 bp, Artificial Sequence
  Synthetic
aagggtccatcaaccataactagcccaaaacacttccgcacagagctcaacctccccaaccaaagtccccaccac

SEQ ID NO: 343519 - DNA, 75 bp, Artificial Sequence
  Synthetic
aggatttaatcaagacctacaaacagtacattaacagtctagatgtagatttttgtacttggtcactagcagact

SEQ ID NO: 343520 - DNA, 75 bp, Artificial Sequence
  Synthetic
tgatcgaacattggtactctccatctacccaacaaatgaataacaccgagatcattgagaatgcctctaaagttt

SEQ ID NO: 343521 - DNA, 75 bp, Artificial Sequence
  Synthetic
tggatgatggtctagccggttctctagctcatagcattattgaaattatagacaaaagcttaaaagaccacctag

SEQ ID NO: 343522 - DNA, 75 bp, Artificial Sequence
  Synthetic
tggaagcgattgatgccgccaaagaagaagagctcagaaaccttaactctcttgtccaaccaagagcccctctca

SEQ ID NO: 343523 - DNA, 75 bp, Artificial Sequence
  Synthetic
gagatttccaggttattgcatctgatgatgatataaatagctttataactgagttcctacttgttgatccaaaat

SEQ ID NO: 343524 - DNA, 75 bp, Artificial Sequence
  Synthetic
atgcaggatccacccctggtgagatcatcaacgagatcaagcatctatccacccgtgatcaagaagggggaacat

SEQ ID NO: 343525 - DNA, 75 bp, Artificial Sequence
  Synthetic
tattcatgcttcatctaggtcagactgttgccatccattgggcattcgacattcattatagaagagccagtggaa

SEQ ID NO: 343526 - DNA, 75 bp, Artificial Sequence
  Synthetic
cgagcaaagacgaagaggaatcaggagctggcagaacagttgctgaaggagctgccacacgagaccacaagtata

SEQ ID NO: 343527 - DNA, 75 bp, Artificial Sequence
  Synthetic
aatatgaaatgactgagcttctcataagcatgctatatcgaagttctaggagcgcatttaagatattggccaatg

SEQ ID NO: 343528 - DNA, 75 bp, Artificial Sequence
  Synthetic
gcaaatctcgtccaaagaaacaaccgagatctggattacaatctggagcagctggtaagaaccctactccagatg

SEQ ID NO: 343529 - DNA, 75 bp, Artificial Sequence
  Synthetic
ctttcactcatccaaaagtatacaagagattctgggattgcgggttcatcgaaccagtttatggtcccatgctaa

SEQ ID NO: 343530 - DNA, 75 bp, Artificial Sequence
  Synthetic
gagaaggaggggacacatgtaacagagagcttgatcaacactctgatggagacggacactctaacaccgaaggag

SEQ ID NO: 343531 - DNA, 75 bp, Artificial Sequence
  Synthetic
ttcagcaggattatgttcgttgctgccttgacctaattataacggcctttgaaatgtatacagaacaatggttga

SEQ ID NO: 343532 - DNA, 75 bp, Artificial Sequence
  Synthetic
caagctctgatctggccagcatacaaccttgtcagacagatgatgcaccatgcagctctacatcatatttagatg

SEQ ID NO: 343533 - DNA, 75 bp, Artificial Sequence
  Synthetic
atggcgaaggggttgaacctgactacatattgtgtgaaccagatgaagacatcttacctacaagattagctaccg

SEQ ID NO: 343534 - DNA, 75 bp, Artificial Sequence
  Synthetic
aagaagatgaaccagctgtaaggccaaaaacccagtgcaagcaatctgggttaattgagtcgaaggaagatgaag

SEQ ID NO: 343535 - DNA, 75 bp, Artificial Sequence
  Synthetic
ttcaagctcgacacctatcttacctttgtgacttatattgtccaccaggtaagatgccttcgattagaggcttgg

SEQ ID NO: 343536 - DNA, 75 bp, Artificial Sequence
  Synthetic
atggaatgctttctgaactccatgaacagcacaaaggccgttctaagcgactatcggcattgggaagggtgaatt

SEQ ID NO: 343537 - DNA, 75 bp, Artificial Sequence
  Synthetic
acgtttatcagaaagctcaagttctcagcaatcacttacagaccatggccatggaatacgactcaactctttctt

SEQ ID NO: 343538 - DNA, 75 bp, Artificial Sequence
  Synthetic
cctcaccaattccatctccaagacctgacgaattgcttaaaaaaggcatcggagagagtatagtatggtctggtc

SEQ ID NO: 343539 - DNA, 75 bp, Artificial Sequence
  Synthetic
ggaatttagatcaaatcaaagtaatcacatatccttctacattgacctacttgaggcgaggatgtattaaacaaa

SEQ ID NO: 343540 - DNA, 75 bp, Artificial Sequence
  Synthetic
gaatgacggagtctttattgagtcatggtgtaatccaatgtgtgccaggatcagaccgttaccaatccgggaaat

SEQ ID NO: 343541 - DNA, 75 bp, Artificial Sequence
  Synthetic
taagaattcgacgacctttaagcctactgccttactctaatcctcttgacgggattcaacagctgaaaagcccaa

SEQ ID NO: 343542 - DNA, 75 bp, Artificial Sequence
  Synthetic
ctgtgtctgtggccgatgcccacttaaatgctcgaagtgcctgctggacccagaataaggagccgcaatgccaca

SEQ ID NO: 343543 - DNA, 75 bp, Artificial Sequence
  Synthetic
ctatactgagtcacactgatgctgaagggtctaaccctgatttctgccaagcagttaaaaactactatccatgtt

SEQ ID NO: 343544 - DNA, 75 bp, Artificial Sequence
  Synthetic
tcacaaattcaccatcagacaccagtactgataacgcatcccgatccgaacttcgcacaattgaggaagaagact

SEQ ID NO: 343545 - DNA, 75 bp, Artificial Sequence
  Synthetic
caatatcctgtgacaaagttcttccgattcttgggacaattgggaatgattcaaaatatagctgttatggtgtta

SEQ ID NO: 343546 - DNA, 75 bp, Artificial Sequence
  Synthetic
accttcaagatgatgattttgaacaatctattgaagacagggattttgacccaggagattgggacccatctgata

SEQ ID NO: 343547 - DNA, 75 bp, Artificial Sequence
  Synthetic
cacggtgggaaagccataaatacagaagagttggaattaactctaccagttgttataaagcatggtcccttagta

SEQ ID NO: 343548 - DNA, 75 bp, Artificial Sequence
  Synthetic
aacacaacgataatggcttgctcttgcaaatattaaagaatcaagaagagatcctaaacaggttgaaaacaattg

SEQ ID NO: 343549 - DNA, 75 bp, Artificial Sequence
  Synthetic
aatacctatctactcgaatgaattccactggccctcgtgtctttttgggagaaggttctggagctatgttggcaa

SEQ ID NO: 343550 - DNA, 75 bp, Artificial Sequence
  Synthetic
ggtcaattcaagaaagtctagatagcatcaaaagaatccagtctaaacaaggcctcgcactctcaactctagaag

SEQ ID NO: 343551 - DNA, 75 bp, Artificial Sequence
  Synthetic
cgtattatgcctgcttaggccctgctatgacatactataactcaggagtaacaaaagatgacgtgttaggtcaac

SEQ ID NO: 343552 - DNA, 75 bp, Artificial Sequence
  Synthetic
gactgctgtccagtgtcatgattgctattccagggtctggaaatcctggaagcagtgttgaaattaatcctgatt

SEQ ID NO: 343553 - DNA, 75 bp, Artificial Sequence
  Synthetic
gcgaattaaacatttaccctgcagaagttgaattaatcaacaatcttactgatgtcagggtagggttaaagaatg

SEQ ID NO: 343554 - DNA, 75 bp, Artificial Sequence
  Synthetic
tgaaacctatgttgggtagaaacaaaaacagggcattgaaggaagtgtctgatgagttgacgcctccaaaccaat

SEQ ID NO: 343555 - DNA, 75 bp, Artificial Sequence
  Synthetic
atcttaaaatattatttaatggccgaccagaaagcacatggttggggaatcctgaatgttattgctatatcctca

SEQ ID NO: 343556 - DNA, 75 bp, Artificial Sequence
  Synthetic
ttctccaaaaacaagggatgactattcagcaggctgttaaaccaaaagaaacaatgttcccaccagccattaaaa

SEQ ID NO: 343557 - DNA, 75 bp, Artificial Sequence
  Synthetic
gtactgtatcacatgagtctgtgagtctaatccactgtgatttagagtcaaactttgagaaagacacagaaactg

SEQ ID NO: 343558 - DNA, 75 bp, Artificial Sequence
  Synthetic
caggggaaagtagtgcaaaagggtttcatccaaaggagaatctcgtgagccggactgtgatcaatagcataatta

SEQ ID NO: 343559 - DNA, 75 bp, Artificial Sequence
  Synthetic
ttattgaagaacagtgccatattttgtcacttggtttgactctactttcaaaagatggcattttagttaccaagt

SEQ ID NO: 343560 - DNA, 75 bp, Artificial Sequence
  Synthetic
ctgctcgcgttaacaatccagaacttgcggcgaagttaaaactggcagtggcaaaagcccagacaaaagaagagc

SEQ ID NO: 343561 - DNA, 75 bp, Artificial Sequence
  Synthetic
tatgtccagatgcttctggatatattgttccattgctcagatcttatcaaaatttcttttcaactgttgagatcg

SEQ ID NO: 343562 - DNA, 75 bp, Artificial Sequence
  Synthetic
tagagagaatacacaagtccattatcaagaatcttaaaaattgagttgctaaaatcaactacagttcaaggataa

SEQ ID NO: 343563 - DNA, 75 bp, Artificial Sequence
  Synthetic
ttcttcctcaattcagtaatccggaatccacagaattttacttggttgcttaccagattaagagaaatctcattg

SEQ ID NO: 343564 - DNA, 75 bp, Artificial Sequence
  Synthetic
ttacatctgggtagtcttaaaccacctcatatgaaagtcccagtcaaagcttaccttcattacagtttcacttgc

SEQ ID NO: 343565 - DNA, 75 bp, Artificial Sequence
  Synthetic
tagaaccttggttaatgtcatctaaatataaaaatttgagtcctgttgaatctacgagattaattaatttaatat

SEQ ID NO: 343566 - DNA, 75 bp, Artificial Sequence
  Synthetic
tctttcactatcccagtaccctaaacctgtaaaatcaacttcaataatcctttgaccgaagttaggacaattgct

SEQ ID NO: 343567 - DNA, 75 bp, Artificial Sequence
  Synthetic
tggatcagaagtatcacatgtggaataccttgacatcttcagggaataaggcagataactctttcgaaactgatc

SEQ ID NO: 343568 - DNA, 75 bp, Artificial Sequence
  Synthetic
caaccgtagatttcttctcaatatagctactgacaccatgtgacaggcttgatttgataacacatctgttaccac

SEQ ID NO: 343569 - DNA, 75 bp, Artificial Sequence
  Synthetic
ctgatatgtttaaactaagtagagtagaacaagaactcttgtcatttggctttaagcttaatggaccgtatgtgt

SEQ ID NO: 343570 - DNA, 75 bp, Artificial Sequence
  Synthetic
cctgcagcaacttcaacccttgcaattacatataagctcaacaaaatctgctcggttcaaatcactcgcttctct

SEQ ID NO: 343571 - DNA, 75 bp, Artificial Sequence
  Synthetic
gcaaatacctgctgcaccatgatcctgcaggaggcaaagaagctctagtagggtctatacttgtgctatacaagg

SEQ ID NO: 343572 - DNA, 75 bp, Artificial Sequence
  Synthetic
ccaaattacaaaaaacttaggaccaaagtgtcctatattcaatctacgatgtatccatctgctccaagaattgat

SEQ ID NO: 343573 - DNA, 75 bp, Artificial Sequence
  Synthetic
agttactccagatgtacgattcagaacacgagacctctagcatgtttaatccatatcctgtcagggatggttcta

SEQ ID NO: 343574 - DNA, 75 bp, Artificial Sequence
  Synthetic
gaagccccagtggttgactgtgaatatgagttcataccaaccacatggcttgaaaaagggtacctgagtgcaatg

SEQ ID NO: 343575 - DNA, 75 bp, Artificial Sequence
  Synthetic
aaacaagagaagtggtttactcaattatgaggaagtactacgggctgttgatattataccctgagcaaagtcaat

SEQ ID NO: 343576 - DNA, 75 bp, Artificial Sequence
  Synthetic
aaagttgaaagtgatcataatggtaagataattccttctgtaagagtagtaaatccgggttggggtgagaggaaa

SEQ ID NO: 343577 - DNA, 75 bp, Artificial Sequence
  Synthetic
caaaagctcatccatatgttgttaaggctctgaggtcacaaactatgtttcttgacttgctttcaagacacctta

SEQ ID NO: 343578 - DNA, 75 bp, Artificial Sequence
  Synthetic
acatcaggttatatgtacttgattatgcatggcatcgtagaagatgttcccaaagatggagatactgaacagcga

SEQ ID NO: 343579 - DNA, 75 bp, Artificial Sequence
  Synthetic
ttgcattaatgccttctcatatccggaattatcttagtaaacttagaattaaaaggtactggactatggcaataa

SEQ ID NO: 343580 - DNA, 75 bp, Artificial Sequence
  Synthetic
tacagtgggaaaacatatgcagcattccccctgggtgtcggaaagagcaacgctacaccagatgatttgttaact

SEQ ID NO: 343581 - DNA, 75 bp, Artificial Sequence
  Synthetic
ttacaaaagaaatcaaactatggtggaaattacttgggtattcctatttactgagataattcaatatgcctgatt

SEQ ID NO: 343582 - DNA, 75 bp, Artificial Sequence
  Synthetic
tcaatgaataaactccaaattactgtaagaaggacagcaggtgcaggtgaaagaatagtatttgggaataatgcc

SEQ ID NO: 343583 - DNA, 75 bp, Artificial Sequence
  Synthetic
aggtcagtcaaattaatcaataataatgtgatacatataactaagttaaaagcattagaaaaaacttaaacaaaa

SEQ ID NO: 343584 - DNA, 75 bp, Artificial Sequence
  Synthetic
ccgcttggggcactgtttccttggaggagagtcctagactttggtgctgttttcactgcctataaggtttgtttg

SEQ ID NO: 343585 - DNA, 75 bp, Artificial Sequence
  Synthetic
aatctctcaatcttattccaattacaagtcaaagctgttgtttaaaagaaagtagacagtgatacggtgaaccag

SEQ ID NO: 343586 - DNA, 75 bp, Artificial Sequence
  Synthetic
tcagtcgaatcaattagcctgtttacacctcagaggtttcgaccattatttcttactgtgacattgcttacagat

SEQ ID NO: 343587 - DNA, 75 bp, Artificial Sequence
  Synthetic
tagccaaaacaaaatttaatattatcagattaaacagcaggtaccttagttcgatatccactatcaataaatatc

SEQ ID NO: 343588 - DNA, 75 bp, Artificial Sequence
  Synthetic
aatggactttataaagcacctagcttgtttgcggatttcagagcctcaaaagctgtctcatttaatttattagca

SEQ ID NO: 343589 - DNA, 75 bp, Artificial Sequence
  Synthetic
gagtgaccattaatcagtcaaattcacaaaacattattaacccacttgcaatcaaacagcaataggttcaatata

SEQ ID NO: 343590 - DNA, 75 bp, Artificial Sequence
  Synthetic
cgtttgacagtgaacaataaatctggaaaggattatctagcaactgcacctgctagtgacactaagcaggtggta

SEQ ID NO: 343591 - DNA, 75 bp, Artificial Sequence
  Synthetic
tcagcactgacaaagggtatcttttaccaatcaactgtatctagccgaacaaatacaagagggcaatttccatgg

SEQ ID NO: 343592 - DNA, 75 bp, Artificial Sequence
  Synthetic
tccttcatggtacacatagggaattttgtcagaaagggtggagatgtttactcaaactcttactgcaagaagaaa

SEQ ID NO: 343593 - DNA, 75 bp, Artificial Sequence
  Synthetic
tatgatgatagtattattattacacattttaaaactaagtgaggattcctggatcattaaggtagatcttttggt

SEQ ID NO: 343594 - DNA, 75 bp, Artificial Sequence
  Synthetic
attgaccgtatggacttacaatttgcattgggtgctgtaggaggattgagttttcatatcaagatcaatgggaag

SEQ ID NO: 343595 - DNA, 75 bp, Artificial Sequence
  Synthetic
tgatgttagataatttgaagcttttatattaaacatgcgatctaatcaaccctaggcaaacacactaagtttaag

SEQ ID NO: 343596 - DNA, 75 bp, Artificial Sequence
  Synthetic
atgagtaagacattgatgactcagctaggcttccataggaatttatgctattcaataatggatataaatcctgac

SEQ ID NO: 343597 - DNA, 75 bp, Artificial Sequence
  Synthetic
actaaaactgaagagatcgcaggctttaatgttgtgatccggtaccggtactgaatccagtggaaacaaccttga

SEQ ID NO: 343598 - DNA, 75 bp, Artificial Sequence
  Synthetic
ctcaataaaaagatttggaattcatcttgcagaatcacatcagtagctgccatcctacagccttctgtgagtaag

SEQ ID NO: 343599 - DNA, 75 bp, Artificial Sequence
  Synthetic
atccagtggaaacaaccttgatcaatcaaccaagcaacttgctatattaacattccatagctcaccttttctggt

SEQ ID NO: 343600 - DNA, 75 bp, Artificial Sequence
  Synthetic
gatttcaaaatttaccatgatgtattcatagataacactggtaaaatcatgggttgatcattaagaatccagagt

SEQ ID NO: 343601 - DNA, 75 bp, Artificial Sequence
  Synthetic
gggataatattattatacgctaatataaaacactaatctgcaagttagacattcccaaagaatacaaacatagcc

SEQ ID NO: 343602 - DNA, 75 bp, Artificial Sequence
  Synthetic
taaatttatctaacctaagtagatcttcgaattcagaacataaataccatgaaattaatctactggaagtttgat

SEQ ID NO: 343603 - DNA, 75 bp, Artificial Sequence
  Synthetic
cacacttcaaatcagttaattaatcacaatgtaactagtcaataagttttaacctctaaatttgctcctcaatct

SEQ ID NO: 343604 - DNA, 75 bp, Artificial Sequence
  Synthetic
ctatcattgattttctagtatctaatagttttatgtactagactgagaactgacataaaaattgaacaatctgtt

SEQ ID NO: 343605 - DNA, 75 bp, Artificial Sequence
  Synthetic
gcactcctcgaatcaacaccaactcactatagcatccaactctaagtgtagactaattgatacttgcaattcaaa

SEQ ID NO: 343606 - DNA, 75 bp, Artificial Sequence
  Synthetic
ataaatctgaataacactaccatgaagtctattgtaaggcactttacgataaccattgcacttttagccctaata

SEQ ID NO: 343607 - DNA, 75 bp, Artificial Sequence
  Synthetic
cccatataactactaaaacctattacaaaaaacttaggggcaaagtgattgaccccattgacaatgccacacttt

SEQ ID NO: 343608 - DNA, 75 bp, Artificial Sequence
  Synthetic
aagaaagagcccaactcaaactaagtagactcctcaaatcaggattgcaatcccatacctatctcaatattcgag

SEQ ID NO: 343609 - DNA, 75 bp, Artificial Sequence
  Synthetic
attagtagccaacatgatgaccttgatgtagactcagaactgtgtcttggtgtagaacctaattactacttcctt

SEQ ID NO: 343610 - DNA, 75 bp, Artificial Sequence
  Synthetic
ctttgggtcattattactttccaactagtagtcattgggatccttgtctggaactcaatttaccaaggatggcat

SEQ ID NO: 343611 - DNA, 75 bp, Artificial Sequence
  Synthetic
cactgctaaaaacaatttgctacatctatctcattacctatgccaaacttgaacctacaccaaaatcgcaacttg

SEQ ID NO: 343612 - DNA, 75 bp, Artificial Sequence
  Synthetic
atttagactcccttgccagtataggggtagttgatgcaggaaaatacaattataaactaatgacaactggatctg

SEQ ID NO: 343613 - DNA, 75 bp, Artificial Sequence
  Synthetic
aaaaacttatggtgattaaactagtgcctaatattacatatgcaactaattgcaatctaactgcccatactgcgt

SEQ ID NO: 343614 - DNA, 75 bp, Artificial Sequence
  Synthetic
atactaagatgattgaaaggttactaactccaattaatcaaagcctttatgaaatgagatcagtaattactgagc

SEQ ID NO: 343615 - DNA, 75 bp, Artificial Sequence
  Synthetic
gagatggtgggaccatattttggggcgccataatagcaggtgcagcgttaggtgtagcaacagcggcagcaataa

SEQ ID NO: 343616 - DNA, 75 bp, Artificial Sequence
  Synthetic
cggcaggtgttgctctccatagggctgaacaaaatgcaagaaatattgctgcactcaaggatgcgttacggaaca

SEQ ID NO: 343617 - DNA, 75 bp, Artificial Sequence
  Synthetic
gcaatgaagcgattcaacatctgaaggatgcacaggggcatacagtacttgccattcaggggttgcaagaacaaa

SEQ ID NO: 343618 - DNA, 75 bp, Artificial Sequence
  Synthetic
ttaacaacaacatcattcctaaactgaaagaatctcattgtttaggagtaaataaccagttaggtctgcttctga

SEQ ID NO: 343619 - DNA, 75 bp, Artificial Sequence
  Synthetic
atcaatattattctgaaatattgactgtttttggacccaatcttcaaaacccggtcagcgcatctcttaccattc

SEQ ID NO: 343620 - DNA, 75 bp, Artificial Sequence
  Synthetic
aagccattgcaaaagcctttaatggagattttaattctctaatgaccaacctcaactatgatccaactgatctgc

SEQ ID NO: 343621 - DNA, 75 bp, Artificial Sequence
  Synthetic
tagacatattggaaagtaacagtattaatggacgtataattgacgtgaacctaaatgagaaatatattgctttat

SEQ ID NO: 343622 - DNA, 75 bp, Artificial Sequence
  Synthetic
ctatagaaattcctaatttcatcacccttacagatgccaaaattcaaacgttcaatagaattacttatggctatg

SEQ ID NO: 343623 - DNA, 75 bp, Artificial Sequence
  Synthetic
gcagcaatgaatggctaacattgattcctgacaacatccttgaatacggcaatctaatttctaatgtagatctta

SEQ ID NO: 343624 - DNA, 75 bp, Artificial Sequence
  Synthetic
caagctgtgttaaaacaaagagctcttacatttgcaaccaagatacatcttaccccatcagcagtgaactaacta

SEQ ID NO: 343625 - DNA, 75 bp, Artificial Sequence
  Synthetic
gatgcttgcgtggtgacacttcaagttgtccaagaaccccagtggtcaacagcagagctccaacatttgccttaa

SEQ ID NO: 343626 - DNA, 75 bp, Artificial Sequence
  Synthetic
gtggagggcatatttatgccaactgtgcaaaagctgcatgccgctgcgaaaagcctccaatggccatcgttcaac

SEQ ID NO: 343627 - DNA, 75 bp, Artificial Sequence
  Synthetic
cagcaacatcaaccttgacattcttaacagagaaggagtgtcaagaagttgttatcgatcagatcaacattcaac

SEQ ID NO: 343628 - DNA, 75 bp, Artificial Sequence
  Synthetic
tggctcctaataggctcaataaaactataattactgacggcattgatttaggcccagaagtcatcattaacccaa

SEQ ID NO: 343629 - DNA, 75 bp, Artificial Sequence
  Synthetic
ttgatgtaagtgcagagcttgggaatattgaattggaaatggataaaactcagaaagcactagacaggtcaaaca

SEQ ID NO: 343630 - DNA, 75 bp, Artificial Sequence
  Synthetic
aaatacttgattcaatgataactgaggtaactccagataagttgttaatagcaatgattgttgtttttggtattc

SEQ ID NO: 343631 - DNA, 75 bp, Artificial Sequence
  Synthetic
tacttctttggctctttggtgtgagctattacgcattcaaaatatggagcaaactccatttcctggattcttatg

SEQ ID NO: 343632 - DNA, 75 bp, Artificial Sequence
  Synthetic
tttactccctccgtaatccatcacatcacaggagcaacggtcatcagaatcattcattcagtacagatataagtg

SEQ ID NO: 343633 - DNA, 75 bp, Artificial Sequence
  Synthetic
gataaatacattgagtatctaaattatacaagtattaaaaatactagatttgtgtagttttaaaataaataatgt

SEQ ID NO: 343634 - DNA, 75 bp, Artificial Sequence
  Synthetic
taataaatatgattaggtatttctgaactttagtatacaaattgtgcatttgatatagcatatcgcaagatcagg

SEQ ID NO: 343635 - DNA, 75 bp, Artificial Sequence
  Synthetic
cttagccaaactaactgcaaattgcacagatttagattcatcaacctgaatataactagtcacaaatcagatcaa

SEQ ID NO: 343636 - DNA, 75 bp, Artificial Sequence
  Synthetic
tggtcaaagatcttcggaatccaaactattactccagggataagtaattgtcaatttgcagtcgattttgctaac

SEQ ID NO: 343637 - DNA, 75 bp, Artificial Sequence
  Synthetic
acaattaatctaaacttatataatactagtgttgatcatttaccttgagaagttatcagtaaccaagatattaag

SEQ ID NO: 343638 - DNA, 75 bp, Artificial Sequence
  Synthetic
aaaaacttaggggccaagtaccctagatccttggaaactacaagagctttcacactcaaagcattaatattggca

SEQ ID NO: 343639 - DNA, 75 bp, Artificial Sequence
  Synthetic
aagcaactgtacattctgcatacaccaaccccttttagcaggaaaatctcaagcttaatctcaacccttaacaca

SEQ ID NO: 343640 - DNA, 75 bp, Artificial Sequence
  Synthetic
aactaataacagttattatggattatcattcacacacgactcaaactgggtccaatgaaactctatatcaagacc

SEQ ID NO: 343641 - DNA, 75 bp, Artificial Sequence
  Synthetic
ctttgcagagccagagtgggagtcgcgatacacttgatggaccaccttcaactctccaacattattcaaatcctc

SEQ ID NO: 343642 - DNA, 75 bp, Artificial Sequence
  Synthetic
caccttatagtgaagaggatcaaggtattgatggtcctcaaagatcacaaccattatcaactccacatcagtatg

SEQ ID NO: 343643 - DNA, 75 bp, Artificial Sequence
  Synthetic
accgttactatggagttaacattcagcatacaagggtgtataatcatttagggacaatctataaagggttgaaac

SEQ ID NO: 343644 - DNA, 75 bp, Artificial Sequence
  Synthetic
ttgcttttcaaattctaggatgggtaagcgttatcattacaatgattatcactgtgactactctaaagaaaatga

SEQ ID NO: 343645 - DNA, 75 bp, Artificial Sequence
  Synthetic
gtgatggcaatagccaagacagtgcaatgttaaaatctctggatgagaattttgatgcaattcaagaagtggcta

SEQ ID NO: 343646 - DNA, 75 bp, Artificial Sequence
  Synthetic
atctactagacaatgaagtaagacctaagttaggagtgacaatgacccaaaccactttccaactaccgaaagaac

SEQ ID NO: 343647 - DNA, 75 bp, Artificial Sequence
  Synthetic
tgagcgaaattaaacgttacctactaagattagagagaaattgtccagtttgtggtacggaagcaaccccacaag

SEQ ID NO: 343648 - DNA, 75 bp, Artificial Sequence
  Synthetic
gaagtaaagggaatgcttcaggagatacagctttttgtccgccttgtctgaccagacagtgctcggaggatagta

SEQ ID NO: 343649 - DNA, 75 bp, Artificial Sequence
  Synthetic
cccacgaccaaggccctggagttgaaggaacctctcgaaatcataagggtaagatcaatttccctcatatactgc

SEQ ID NO: 343650 - DNA, 75 bp, Artificial Sequence
  Synthetic
agagtgatgattgtggacgtagcgataaccttattgtctactcaatcaaccttgtccctggtttaagtttcattc

SEQ ID NO: 343651 - DNA, 75 bp, Artificial Sequence
  Synthetic
agcttccgtctggaactaaacattgcataattgatgtatcatatacattcagtgacacactagctggttatctaa

SEQ ID NO: 343652 - DNA, 75 bp, Artificial Sequence
  Synthetic
tcgttggtggtgttgatgggtgtcagctccataacaaagcaataatttatctatcattaggttattataaaacaa

SEQ ID NO: 343653 - DNA, 75 bp, Artificial Sequence
  Synthetic
agatgatatatccgcctgactatattgccattgctacatatacgtatgatctggtcccgaatctacgagactgct

SEQ ID NO: 343654 - DNA, 75 bp, Artificial Sequence
  Synthetic
ccattgcagtcaatcaaacctctctggcagccatatgcacaagtaaaaagacaaaggaaaaccaagatttcagta

SEQ ID NO: 343655 - DNA, 75 bp, Artificial Sequence
  Synthetic
catctggtgttcacccattttatatattcacattaaatacagatggtatctttacagtaactgttatagaacaat

SEQ ID NO: 343656 - DNA, 75 bp, Artificial Sequence
  Synthetic
cacagttaaaactagattatcaatatgcagcactatatccagcaaccggaccagggatttttataggagaccatc

SEQ ID NO: 343657 - DNA, 75 bp, Artificial Sequence
  Synthetic
ttgtttttttgatgtggggaggtcttatgacaaaagcagaaggagatgcttattgtcaggcatctgggtgtaatg

SEQ ID NO: 343658 - DNA, 75 bp, Artificial Sequence
  Synthetic
atgctcaccgaactagttgtaatatagctcaaatgcctagtgcttatggtcacaggcagcttgtcaacggtctgc

SEQ ID NO: 343659 - DNA, 75 bp, Artificial Sequence
  Synthetic
tcatgttgccaattaaagaattaggatctcacttaattcagcctagtctggagaccatatcaccaaaaattaatt

SEQ ID NO: 343660 - DNA, 75 bp, Artificial Sequence
  Synthetic
gggccggaggacatgggagactatattacaactgggaaataaatacaacgtacatatacattgaagggaagacct

SEQ ID NO: 343661 - DNA, 75 bp, Artificial Sequence
  Synthetic
ggagatcaagacctaatttggggataatttcatggagcaaaccactaagcattagatggattgaccacagtgttg

SEQ ID NO: 343662 - DNA, 75 bp, Artificial Sequence
  Synthetic
cacgaagaccaggtgcaagaccctgtgactctgctaatgactgcccagaagattgtttagttggtggatactatg

SEQ ID NO: 343663 - DNA, 75 bp, Artificial Sequence
  Synthetic
acatgtttccaatgtcatcagattacaaaacagcaataaccataataccgactcaccaccaatggccttcaagtc

SEQ ID NO: 343664 - DNA, 75 bp, Artificial Sequence
  Synthetic
ctgcacttaaactgttcaacacaaatcgagaggtcagagtagttatgattttaaggccccctaataacgttaaga

SEQ ID NO: 343665 - DNA, 75 bp, Artificial Sequence
  Synthetic
aaacaactatatcttgtattcggatcatgcaaaccaactggtgtctggggtttataatatttaaagaaggaaaca

SEQ ID NO: 343666 - DNA, 75 bp, Artificial Sequence
  Synthetic
atgcttggggacaaatttattcgtatatctaccaagttgaaagtacatgtcctaatactaagtaatgccttcact

SEQ ID NO: 343667 - DNA, 75 bp, Artificial Sequence
  Synthetic
taagtgtcactggataattcaagtctattatgtgactactaatataaggattggaatcatgatatcgtacagatt

SEQ ID NO: 343668 - DNA, 75 bp, Artificial Sequence
  Synthetic
agattaagtgtaatatcataaagagggtacaaagaattgtaaatataatgtaagtgtccttttataagattgctc

SEQ ID NO: 343669 - DNA, 75 bp, Artificial Sequence
  Synthetic
agagtgactgacaaaaatcttttctataacttatagaatatatcaaactgttaaaaatgtctccctattgtaact

SEQ ID NO: 343670 - DNA, 75 bp, Artificial Sequence
  Synthetic
cttgaattacttatggctattatattacaaaaaacttaggatccaagatccttatattacaatttgctgatatgg

SEQ ID NO: 343671 - DNA, 75 bp, Artificial Sequence
  Synthetic
acaaccagttgggcgacgtaagagatgttctctaccctgaatcacacttagatagcccgcttgtagctgcaaagt

SEQ ID NO: 343672 - DNA, 75 bp, Artificial Sequence
  Synthetic
tggtccaggctatagagtatgcagaattacatcacaatcagaaactaaaagataccaccattatagatgtagcaa

SEQ ID NO: 343673 - DNA, 75 bp, Artificial Sequence
  Synthetic
aaatcaaattagctcgcagtcaaaaatcaccttatttagtcgcacaaagacaattacaggaaacaatctatcaaa

SEQ ID NO: 343674 - DNA, 75 bp, Artificial Sequence
  Synthetic
tggataagaggtttgattcaaggaacccagttccgtacccagaatgcaattatgacttgttcaggatttcagatc

SEQ ID NO: 343675 - DNA, 75 bp, Artificial Sequence
  Synthetic
caactttctcttcaaagttggaaatgcttttagagtactcaggtcggtgctttggaaagatagaacatcttatta

SEQ ID NO: 343676 - DNA, 75 bp, Artificial Sequence
  Synthetic
gtaatacattatcaaaattgcgattgaaatttggagttaatcaaaaatcgagcagcagtttgacaggaccttcgg

SEQ ID NO: 343677 - DNA, 75 bp, Artificial Sequence
  Synthetic
aagcatccaatattcgtttatactcagtgatgaaatcatcaaggtggtacaatagttttttgttttggtttaccc

SEQ ID NO: 343678 - DNA, 75 bp, Artificial Sequence
  Synthetic
ttaaaacagagatgagatatctaataaagaattcaaacaaacagaaattaatccagggtcgaggtcaattggttg

SEQ ID NO: 343679 - DNA, 75 bp, Artificial Sequence
  Synthetic
ttgaaacaaaagatcacaaaattgtaggcaatcggaatttggttgtaatcatggaccaaggttattcacatggca

SEQ ID NO: 343680 - DNA, 75 bp, Artificial Sequence
  Synthetic
aagtctattacctaacttatgaactggtacttatgtattgtgatgtaatagagggccgtctcatggtggaaacca

SEQ ID NO: 343681 - DNA, 75 bp, Artificial Sequence
  Synthetic
ccatgtcacttgacaagcggtacggtcctctttacccaagagctatgagactatgggatttattcgattctttat

SEQ ID NO: 343682 - DNA, 75 bp, Artificial Sequence
  Synthetic
ttgtggatcttggcaacaacacatataatattatatcacaaattgagccgctagctttaagttacctgcaattgc

SEQ ID NO: 343683 - DNA, 75 bp, Artificial Sequence
  Synthetic
gagatgaatcgggaatcctagcaggagcttttttgaaccataccttaacagaaattacagacgaacttaaacaat

SEQ ID NO: 343684 - DNA, 75 bp, Artificial Sequence
  Synthetic
taggatacactaatgaagatgacattagtcagttcctcggtcatatagatgacattttcaatattaatgatgtta

SEQ ID NO: 343685 - DNA, 75 bp, Artificial Sequence
  Synthetic
atttaactgcagagtttttctctttctttcggtcatttggacacccattcctggaggctgagactgctgctgaca

SEQ ID NO: 343686 - DNA, 75 bp, Artificial Sequence
  Synthetic
aggttagagagcatatgagcaaacctaagttagtatcatttgaagtcatgatgaaaggtcatgccattttttgtg

SEQ ID NO: 343687 - DNA, 75 bp, Artificial Sequence
  Synthetic
gaataattattaacggtcatcgtgatagacatggaggagcatggcctccagttactttcccaaatcattgttcga

SEQ ID NO: 343688 - DNA, 75 bp, Artificial Sequence
  Synthetic
gtcacatcttgaatgctcaacgtaacagtgaagcattaacagatcaaatgtgcataacaaactggaagagcttct

SEQ ID NO: 343689 - DNA, 75 bp, Artificial Sequence
  Synthetic
gcgggatgaggtttgggtgttttatgccactgtcacttgatgaggacctatctatgtacatgaaagataaagcct

SEQ ID NO: 343690 - DNA, 75 bp, Artificial Sequence
  Synthetic
tagcagcaatcaagaaagagtgggactctgcataccctcttgattctcttccctatacccctccagttcaaacga

SEQ ID NO: 343691 - DNA, 75 bp, Artificial Sequence
  Synthetic
cctctagaaggttagttgatgttttcttgcaagacagtaaatttgatccttatcaaatactgatgtatgtgatca

SEQ ID NO: 343692 - DNA, 75 bp, Artificial Sequence
  Synthetic
atggtgaatatctgcatgatccagaattcaatatatcttacagcctcaaagaaaaggaaacaaagcaagcaggga

SEQ ID NO: 343693 - DNA, 75 bp, Artificial Sequence
  Synthetic
ggttgtttgctaaaatgacccacaaaatgagagcatgtcaagtcattgcggaatctttgattgctaacggaatag

SEQ ID NO: 343694 - DNA, 75 bp, Artificial Sequence
  Synthetic
gtgattactttaaagataacggcatggcaaagagtgaacatgatttactcaaaacactccataagttgtccattt

SEQ ID NO: 343695 - DNA, 75 bp, Artificial Sequence
  Synthetic
cttctgttccaaaaacaagaagctacaaagaagggtgtcaagatgatcatagtggacatagccctggaaggagaa

SEQ ID NO: 343696 - DNA, 75 bp, Artificial Sequence
  Synthetic
ctggtaattctagttcactaactgatccatatttgaagaaaattgacctaacaagtatgaacacccagtctaaga

SEQ ID NO: 343697 - DNA, 75 bp, Artificial Sequence
  Synthetic
ccctttacagctcattgaaatttagtcataaaactccaacaaccagggtaagcggaagagtaagaaagaaatgca

SEQ ID NO: 343698 - DNA, 75 bp, Artificial Sequence
  Synthetic
cattcagagacatacatcaagcattgaagcctggtttaaaatctgcatgttgtaaagggaatgtaaaggatgtga

SEQ ID NO: 343699 - DNA, 75 bp, Artificial Sequence
  Synthetic
ctagagcatatgaagtgggtcaaccatctgacaacaacttatttgatgatcaagaaactcaatatgaaactgtca

SEQ ID NO: 343700 - DNA, 75 bp, Artificial Sequence
  Synthetic
gttccttcttaacaactgatcttcagaagttctgcctaaactggcgctatgaaacaagtgctatatatgcacaaa

SEQ ID NO: 343701 - DNA, 75 bp, Artificial Sequence
  Synthetic
ggcttgatgagatttacggacttccaaacttctttgaatggctgcataaacgattagaaagatcaacattgtatg

SEQ ID NO: 343702 - DNA, 75 bp, Artificial Sequence
  Synthetic
tgtgtgatccttcatgtcctccaaaattagctaaacatgttgatttggatactatgccaaatgaacatatattca

SEQ ID NO: 343703 - DNA, 75 bp, Artificial Sequence
  Synthetic
agtcgttcgtctgcgtgagctctactacttagtattgtttttggaggatcgtgagattaacacagtgccggcagt

SEQ ID NO: 343704 - DNA, 75 bp, Artificial Sequence
  Synthetic
gtccctgcctgttggaagctaccagcccgtgtcaggccgccaagcgccacttcgccgaggagtgcagcctgtatg

SEQ ID NO: 343705 - DNA, 75 bp, Artificial Sequence
  Synthetic
gtgagattaacacagtgccggcagtttctttgagcgttgattttcaatgtctaagaaaccaggagggcccggaag

SEQ ID NO: 343706 - DNA, 75 bp, Artificial Sequence
  Synthetic
accagcccgtgtcaggccgccaagcgccacttcgccgaggagtgcagcctgtatggccccagacaggactgggtt

SEQ ID NO: 343707 - DNA, 75 bp, Artificial Sequence
  Synthetic
cgcggcataccccgcgtattcccactagtgggagtgaagagggtagtcatgggcttgttggatggaagaggacca

SEQ ID NO: 343708 - DNA, 75 bp, Artificial Sequence
  Synthetic
gggcttgttggatggaagaggaccagtgcgattcgtgctggccttgatgacattcttcaagttcaccgcgcttgc

SEQ ID NO: 343709 - DNA, 75 bp, Artificial Sequence
  Synthetic
cattcttcaagttcaccgcgcttgccccgacgaaggccttgctaggccgttggaagcgcatcaacaagaccacgg

SEQ ID NO: 343710 - DNA, 75 bp, Artificial Sequence
  Synthetic
tggaagcgcatcaacaagaccacggcaatgaaacacctgactagcttcagaaaggaattaggaacaatgatcaac

SEQ ID NO: 343711 - DNA, 75 bp, Artificial Sequence
  Synthetic
aaaggaattaggaacaatgatcaacgtggttaacaatcggggcacaaaaaagaagagaggcaacaatggaccagg

SEQ ID NO: 343712 - DNA, 75 bp, Artificial Sequence
  Synthetic
agaagagaggcaacaatggaccaggattagtgatgatcataacactcatgacggttgtttcaatggtttcctctt

SEQ ID NO: 343713 - DNA, 75 bp, Artificial Sequence
  Synthetic
taaagctttccaacttccaggggaaagtcatgatgaccatcaacgcgactgatatggcagatgtcattgttgttc

SEQ ID NO: 343714 - DNA, 75 bp, Artificial Sequence
  Synthetic
agtcatgatgaccatcaacgcgactgatatggcagatgtcattgttgttcccacgcaacatgggaaaaaccagtg

SEQ ID NO: 343715 - DNA, 75 bp, Artificial Sequence
  Synthetic
gatatggcagatgtcattgttgttcccacgcaacatgggaaaaaccagtgctggattagagccatggatgtcggg

SEQ ID NO: 343716 - DNA, 75 bp, Artificial Sequence
  Synthetic
ctggattagagccatggatgtcgggtacatgtgtgatgataccatcacttatgaatgccccaaactggatgcagg

SEQ ID NO: 343717 - DNA, 75 bp, Artificial Sequence
  Synthetic
aaatgacccagaagacattgactgttggtgtgacaaacaacccatgtacgtccactatggaaggtgcacaagaac

SEQ ID NO: 343718 - DNA, 75 bp, Artificial Sequence
  Synthetic
tccactatggaaggtgcacaagaaccagacactcgaagcggagtcggcggtcgatcgcagtgcagacgcacgggg

SEQ ID NO: 343719 - DNA, 75 bp, Artificial Sequence
  Synthetic
cagacactcgaagcggagtcggcggtcgatcgcagtgcagacgcacggggagagtatgctggctaacaagaagga

SEQ ID NO: 343720 - DNA, 75 bp, Artificial Sequence
  Synthetic
tcgatcgcagtgcagacgcacggggagagtatgctggctaacaagaaggatgcttggctagactcaaccaaggct

SEQ ID NO: 343721 - DNA, 75 bp, Artificial Sequence
  Synthetic
tgcttggctagactcaaccaaggcttcgagatacctgatgaagactgagaattggattatcaggaatcctgggta

SEQ ID NO: 343722 - DNA, 75 bp, Artificial Sequence
  Synthetic
tcgagatacctgatgaagactgagaattggattatcaggaatcctgggtatgcttttgtagctgtcctcttgggc

SEQ ID NO: 343723 - DNA, 75 bp, Artificial Sequence
  Synthetic
attggattatcaggaatcctgggtatgcttttgtagctgtcctcttgggctggatgctgggaagcaacaatggac

SEQ ID NO: 343724 - DNA, 75 bp, Artificial Sequence
  Synthetic
tggatgctgggaagcaacaatggacaaagggtcgttttcgtcgttctcttgctccttgtggcgcctgcttatagc

SEQ ID NO: 343725 - DNA, 75 bp, Artificial Sequence
  Synthetic
ttagactaggagatcttctgctctattccaacatcaaccacaaggcacagagcgccgaaaattgtggctgatggg

SEQ ID NO: 343726 - DNA, 75 bp, Artificial Sequence
  Synthetic
ttcaactgccttggtatgagcaacagagacttccttgagggagtctctggtgctacctgggttgacgtggttttg

SEQ ID NO: 343727 - DNA, 75 bp, Artificial Sequence
  Synthetic
gaaggtgacagctgcataaccatcatggccaaggacaagccgaccattgacattaagatgatggaaactgaagcc

SEQ ID NO: 343728 - DNA, 75 bp, Artificial Sequence
  Synthetic
acgaacctggctgaagtgagaagctactgctatctagccactgtctcagatgtttcaactgtctccaactgtcca

SEQ ID NO: 343729 - DNA, 75 bp, Artificial Sequence
  Synthetic
tgtttcaactgtctccaactgtccaacaactggggaggcccacaatcctaagagagctgaggacacgtacgtgtg

SEQ ID NO: 343730 - DNA, 75 bp, Artificial Sequence
  Synthetic
acaactggggaggcccacaatcctaagagagctgaggacacgtacgtgtgcaaaagtggtgtcactgacaggggc

SEQ ID NO: 343731 - DNA, 75 bp, Artificial Sequence
  Synthetic
caaaagtggtgtcactgacaggggctggggcaatggctgtggactatttggcaaaggaagtatagacacgtgtgc

SEQ ID NO: 343732 - DNA, 75 bp, Artificial Sequence
  Synthetic
tggggcaatggctgtggactatttggcaaaggaagtatagacacgtgtgccaacttcacctgctccctgaaagcg

SEQ ID NO: 343733 - DNA, 75 bp, Artificial Sequence
  Synthetic
caacttcacctgctccctgaaagcgatgggccggatgatccaaccggaaaatgttaagtatgaagtgggaatctt

SEQ ID NO: 343734 - DNA, 75 bp, Artificial Sequence
  Synthetic
gctctattccaacatcaaccacaaggcacagagcgccgaaaattgtggctggtggggaacaagaccccgggatct

SEQ ID NO: 343735 - DNA, 75 bp, Artificial Sequence
  Synthetic
atgttaagtatgaagtgggaatcttcatacatggttctaccagctctgacactcacggcaactattcttcacaac

SEQ ID NO: 343736 - DNA, 75 bp, Artificial Sequence
  Synthetic
actcacggcaactattcttcacaactaggagcatcacaggctgggcggtttaccatcactcccaactccccagcc

SEQ ID NO: 343737 - DNA, 75 bp, Artificial Sequence
  Synthetic
taggagcatcacaggctgggcggtttaccatcactcccaactccccagccatcactgtgaagatgggtgactatg

SEQ ID NO: 343738 - DNA, 75 bp, Artificial Sequence
  Synthetic
taccatcactcccaactccccagccatcactgtgaagatgggtgactatggagaaatatcagttgagtgtgaacc

SEQ ID NO: 343739 - DNA, 75 bp, Artificial Sequence
  Synthetic
atcactgtgaagatgggtgactatggagaaatatcagttgagtgtgaaccaagaaacgggttgaacaccgaggca

SEQ ID NO: 343740 - DNA, 75 bp, Artificial Sequence
  Synthetic
tactacatcatgtcagtgggcaccaaacacttccttgtccatagagaatggtttaatgacttggccctcccatgg

SEQ ID NO: 343741 - DNA, 75 bp, Artificial Sequence
  Synthetic
aacacttccttgtccatagagaatggtttaatgacttggccctcccatggacttcaccagctagctcaaattgga

SEQ ID NO: 343742 - DNA, 75 bp, Artificial Sequence
  Synthetic
gtttaatgacttggccctcccatggacttcaccagctagctcaaattggagaaatagagagatactactagagtt

SEQ ID NO: 343743 - DNA, 75 bp, Artificial Sequence
  Synthetic
acttcaccagctagctcaaattggagaaatagagagatactactagagttcgaagagccccatgccacaaagcaa

SEQ ID NO: 343744 - DNA, 75 bp, Artificial Sequence
  Synthetic
tcgatcgcagtgcagacgcacggggagagtatgctggccaacaagaaggatgcttggctagactcaaccaaggct

SEQ ID NO: 343745 - DNA, 75 bp, Artificial Sequence
  Synthetic
cgaagagccccatgccacaaagcaatcagttgtggcgcttggttcccaggaaggtgctttgcaccaggccttggc

SEQ ID NO: 343746 - DNA, 75 bp, Artificial Sequence
  Synthetic
aaggtgctttgcaccaggccttggcaggagctgttccagtgtctttctcgggcagtgtcaagctcacatctggtc

SEQ ID NO: 343747 - DNA, 75 bp, Artificial Sequence
  Synthetic
aggagctgttccagtgtctttctcgggcagtgtcaagctcacatctggtcatctcaagtgtcgagtcaagatgga

SEQ ID NO: 343748 - DNA, 75 bp, Artificial Sequence
  Synthetic
acttcttgtggcgcctgcttacagcttcaactgccttggtatgagcaacagagacttccttgagggagtctctgg

SEQ ID NO: 343749 - DNA, 75 bp, Artificial Sequence
  Synthetic
gagacttccttgagggagtctctggtgctacctgggtcgacgtggttttggaaggtgacagctgcataaccatca

SEQ ID NO: 343750 - DNA, 75 bp, Artificial Sequence
  Synthetic
aaagttgacactaaaaggcaccacctacggcatgtgcacggaaaagttttcttttgcaaaaaatccggctgacac

SEQ ID NO: 343751 - DNA, 75 bp, Artificial Sequence
  Synthetic
cttttgcaaaaaatccggctgacacgggtcacggcactgtggtccttgaactgcagtacacgggatctgacggac

SEQ ID NO: 343752 - DNA, 75 bp, Artificial Sequence
  Synthetic
cttgcaaaatcccaatttccattgtggcatcactttccgatctcacccccattggtagaatggttacagcaaacc

SEQ ID NO: 343753 - DNA, 75 bp, Artificial Sequence
  Synthetic
atcactgtgaagatgggtgactatggagaaatatcagttgagtgtgagccaagaaacggattgaacactgaggca

SEQ ID NO: 343754 - DNA, 75 bp, Artificial Sequence
  Synthetic
tggttggaagaggggataagcagataaaccatcactggcacaaagcaggaagttccattggaaaagcgttcatca

SEQ ID NO: 343755 - DNA, 75 bp, Artificial Sequence
  Synthetic
ccactatcaaaggggcacagcgtctagctgccctaggcgacacagcgtgggactttgggtcggtcggagggattt

SEQ ID NO: 343756 - DNA, 75 bp, Artificial Sequence
  Synthetic
cttctgctctattccaacatcaaccacaaggcacagagcgccgaaaattgtggctgatggggaactagaccacag

SEQ ID NO: 343757 - DNA, 75 bp, Artificial Sequence
  Synthetic
tcaattctgtaggaaaggcggtacatcaggtctttggaggagccttcagaactctcttcggtggcatgtcctgga

SEQ ID NO: 343758 - DNA, 75 bp, Artificial Sequence
  Synthetic
actctcttcggtggcatgtcctggatcacccagggtctaatgggagctctgcttctatggatgggggtgaatgcg

SEQ ID NO: 343759 - DNA, 75 bp, Artificial Sequence
  Synthetic
aaaccatcactggcacaaagcaggaagctccattggaaaagcgttcatcaccactatcaaaggagcacagcgtct

SEQ ID NO: 343760 - DNA, 75 bp, Artificial Sequence
  Synthetic
agagatcgatccatcgcactggtgatgttagccacgggaggggtgctcctctttctcgccacaaacgtccatgca

SEQ ID NO: 343761 - DNA, 75 bp, Artificial Sequence
  Synthetic
gactcgggatgtgcgatagacgtgggaaggagagagttgcgctgtggacaagggatttttatccacaatgatgtt

SEQ ID NO: 343762 - DNA, 75 bp, Artificial Sequence
  Synthetic
gaaggagagagttgcgctgtggacaagggatttttatccacaatgatgttgaagcgtgggtcgaccggtacaaat

SEQ ID NO: 343763 - DNA, 75 bp, Artificial Sequence
  Synthetic
ttatgcctgaaacaccaaaacagctggcaaaggtcatcgagcaagcccacgcgaaaggaatatgtggattgaggt

SEQ ID NO: 343764 - DNA, 75 bp, Artificial Sequence
  Synthetic
gctctattccaacatcaaccacaaggcacagagcgccgaaaattgtggctgatggggggcaagaccccaggatct

SEQ ID NO: 343765 - DNA, 75 bp, Artificial Sequence
  Synthetic
ccgtctcacgtctggaacacgtgatgtgggagaacatcagagatgaactcaacaccctcctcagagagaatgcag

SEQ ID NO: 343766 - DNA, 75 bp, Artificial Sequence
  Synthetic
tggttgacgggcccgagaccaaagaatgtcccgatgtgaaaagagcttggaacagccttgaaattgaagactttg

SEQ ID NO: 343767 - DNA, 75 bp, Artificial Sequence
  Synthetic
aacaccctcctcagagagaatgcagtagatctaagtgtcgtggttgagaagccaaaaggaatgtacaaatcagca

SEQ ID NO: 343768 - DNA, 75 bp, Artificial Sequence
  Synthetic
ccacagagattggcactcacatctgaagagtttgagattgggtggaaggcttggggaaagagcttggtgttcgca

SEQ ID NO: 343769 - DNA, 75 bp, Artificial Sequence
  Synthetic
ccagaactggccaaccacacttttgtggttgacgggcccgagaccaaagaatgtcccgatgtaaaaagagcttgg

SEQ ID NO: 343770 - DNA, 75 bp, Artificial Sequence
  Synthetic
tggttgacgggcccgagaccaaagaatgtcccgatgtaaaaagagcttggaacagccttgagattgaagactttg

SEQ ID NO: 343771 - DNA, 75 bp, Artificial Sequence
  Synthetic
ccgtcacaatcactgaagcatgtgggaagagaggaccctccataagaactactactagcagtggtagattggtca

SEQ ID NO: 343772 - DNA, 75 bp, Artificial Sequence
  Synthetic
gatttggcatcatgtccaccagggtttggctgaaagtcagagaacacaacactactgactgcgacagctcaataa

SEQ ID NO: 343773 - DNA, 75 bp, Artificial Sequence
  Synthetic
ttgggacggctgttaaaggagacatagctgtgcacagtgacctctcctactggattgaaagccacaagaacacga

SEQ ID NO: 343774 - DNA, 75 bp, Artificial Sequence
  Synthetic
catggaggctcgagagggctgtctttggagagatcaaatcatgcacgtggcctgagacacacactctttggagtg

SEQ ID NO: 343775 - DNA, 75 bp, Artificial Sequence
  Synthetic
tggagagatcaaatcatgcacgtggcctgagacacacactctttggagtgatggcgttgttgaaagtgatctggt

SEQ ID NO: 343776 - DNA, 75 bp, Artificial Sequence
  Synthetic
tctctcccaggaattctcaacgccactgccacagcgtggatgctcctgagggctgccacccagccatccacttct

SEQ ID NO: 343777 - DNA, 75 bp, Artificial Sequence
  Synthetic
atggcgttgttgaaagtgatctggttgtgccagtcaccctcgctggaccaaaaagcaatcacaaccggcgtgaag

SEQ ID NO: 343778 - DNA, 75 bp, Artificial Sequence
  Synthetic
gatgtttgccatcgtgggtggtctagctgagttggatgttgattccatgtccattccttttgtgttggccgggct

SEQ ID NO: 343779 - DNA, 75 bp, Artificial Sequence
  Synthetic
gactttgactattgcccaggtaccaccgtcacaatcactgaagcatgtgggaagagaggaccctccataagaact

SEQ ID NO: 343780 - DNA, 75 bp, Artificial Sequence
  Synthetic
ccgtcacaatcactgaagcatgtgggaagagaggaccctccataagaactactactagcagtggtagactggtca

SEQ ID NO: 343781 - DNA, 75 bp, Artificial Sequence
  Synthetic
cagactggtgctgccggagctgcacccttccccctttgagatacaggacaaaaaatggatgttggtatggaatgg

SEQ ID NO: 343782 - DNA, 75 bp, Artificial Sequence
  Synthetic
ggcaataatacctgctggaataggctattggctcactgtcaagtacgcaaaaagaggaggcgtcttttgggacac

SEQ ID NO: 343783 - DNA, 75 bp, Artificial Sequence
  Synthetic
agataagacccatgaaacatgatgagacgacgctggtaaaatccagcgtcagtgcctatcggagtgacatgattg

SEQ ID NO: 343784 - DNA, 75 bp, Artificial Sequence
  Synthetic
aaagaggaggcgtcttttgggacaccccggctccaaggacctaccccaagggtgacacatcaccgggagtatacc

SEQ ID NO: 343785 - DNA, 75 bp, Artificial Sequence
  Synthetic
atccttttcagttgggccttctggtgatgtttctggccacccaggaggtcctgaggaagaggtggacggccagat

SEQ ID NO: 343786 - DNA, 75 bp, Artificial Sequence
  Synthetic
gtatcatgagccgttacattctggggacctaccaggctggagtgggcgtcatgtatgaaggagttcttcacaccc

SEQ ID NO: 343787 - DNA, 75 bp, Artificial Sequence
  Synthetic
ctgaggaagaggtggacggccagattgactgttccggctattgtgggagctctactcgtgctgattcttggggga

SEQ ID NO: 343788 - DNA, 75 bp, Artificial Sequence
  Synthetic
tctactcgtgctgattcttgggggaatcacttacactgacctgcttaggtatgttcttctggttggggcggcctt

SEQ ID NO: 343789 - DNA, 75 bp, Artificial Sequence
  Synthetic
cgccgaagccaacagcgggggtgacatcgttcatctagctctcatagccgccttcaaaattcaaccaggctttct

SEQ ID NO: 343790 - DNA, 75 bp, Artificial Sequence
  Synthetic
cgtaatgacatttcttaggggaaagtggacgaaccaagagaacatcctgctggctctgggggcagcattctttca

SEQ ID NO: 343791 - DNA, 75 bp, Artificial Sequence
  Synthetic
gtgcaaggcgaaagagaagaagaacccgttcctgaagcgtacaacgcagacatgctaagaaagaagcagctgaca

SEQ ID NO: 343792 - DNA, 75 bp, Artificial Sequence
  Synthetic
tggctctgggggcagcattctttcagatggcggccaccgatttgaacttttctctcccaggaattctcaatgcca

SEQ ID NO: 343793 - DNA, 75 bp, Artificial Sequence
  Synthetic
gatggcggccaccgatttgaacttttctctcccaggaattctcaatgccactgccacagcttggatgctcctgag

SEQ ID NO: 343794 - DNA, 75 bp, Artificial Sequence
  Synthetic
ctgccacagcttggatgctcctgagggctgccacccagccatccacttcagccatcgtcatgcctttgctttgcc

SEQ ID NO: 343795 - DNA, 75 bp, Artificial Sequence
  Synthetic
gccatcgtcatgcctttgctttgcctgctggctcctggcatgagactgctctacctggacacgtatagaatcact

SEQ ID NO: 343796 - DNA, 75 bp, Artificial Sequence
  Synthetic
cctgacagagcctggagtagtgggtttgagtggataacagaatacaccgggaaaacagtctggtttgtcgctagt

SEQ ID NO: 343797 - DNA, 75 bp, Artificial Sequence
  Synthetic
ctcatcatcatcggcatctgcagcctgataggggagcgccgtagggcggccgcaaagaagaaaggggcggtactg

SEQ ID NO: 343798 - DNA, 75 bp, Artificial Sequence
  Synthetic
aacaacagacatctcagagatgggcgcgaactttggggccagcagagtcattgactgccggaaaagcgtgaaacc

SEQ ID NO: 343799 - DNA, 75 bp, Artificial Sequence
  Synthetic
tgataggggagcgccgtagggcggccgcaaagaagaaaggggcggtactgctagggttagcactaacatcaacag

SEQ ID NO: 343800 - DNA, 75 bp, Artificial Sequence
  Synthetic
aacaaaaagcggggatggccggccacagaagttttgacagcagttggattgatgtttgccatcgtgggtggtcta

SEQ ID NO: 343801 - DNA, 75 bp, Artificial Sequence
  Synthetic
gctgagttggatgttgattctatgtccattccttttgtgttagccgggctgatggcagtttcttacaccatctca

SEQ ID NO: 343802 - DNA, 75 bp, Artificial Sequence
  Synthetic
tccacctcccaaatgggcttgttgcacaaatgtatgggccagaaagagacaaagctttcaccatggacggggagt

SEQ ID NO: 343803 - DNA, 75 bp, Artificial Sequence
  Synthetic
ggcaaatcgacagacttgtggcttgagagagcagctgacataacatgggaaactgatgcagccataactggaacc

SEQ ID NO: 343804 - DNA, 75 bp, Artificial Sequence
  Synthetic
agagagcagctgacataacatgggaaactgatgcagccataactggaaccagccaacgcctagatgtaaaattgg

SEQ ID NO: 343805 - DNA, 75 bp, Artificial Sequence
  Synthetic
agccaacgcctagatgtaaaattggatgatgatggtgacttccaccttattaacgaccctggagtgccgtggaag

SEQ ID NO: 343806 - DNA, 75 bp, Artificial Sequence
  Synthetic
acaaagtggcttcaaatggtatacagtataccgacaggaagtggtgttttgatggaccaaggtcgaacatcattc

SEQ ID NO: 343807 - DNA, 75 bp, Artificial Sequence
  Synthetic
taacgaccctggagtgccgtggaagatatgggtcatccgtatgacggcattgggattcgcagcctggacaccatg

SEQ ID NO: 343808 - DNA, 75 bp, Artificial Sequence
  Synthetic
tccttgaagtcctggggagaatgcctgagcacttcgcaggcaaaaccagagaggcctttgataccatgtatctgg

SEQ ID NO: 343809 - DNA, 75 bp, Artificial Sequence
  Synthetic
cccggctccaaggacctaccccaagggtgacacttcaccaggagtataccgtatcatgagccgttacattttggg

SEQ ID NO: 343810 - DNA, 75 bp, Artificial Sequence
  Synthetic
aaagaggaggcgtcttttgggacaccccggctccaaggacctaccccaagggtgacacttcaccaggagtatacc

SEQ ID NO: 343811 - DNA, 75 bp, Artificial Sequence
  Synthetic
tggcgacagctgagaagggaggaaaagcccaccgtatggcccttgaagagttgccggacgctcttgagaccataa

SEQ ID NO: 343812 - DNA, 75 bp, Artificial Sequence
  Synthetic
gacctaccaggctggagtgggcgtcatgtatgaaggagtttttcacaccctgtggcacaccacaagaggggcagc

SEQ ID NO: 343813 - DNA, 75 bp, Artificial Sequence
  Synthetic
atgtatgaaggagtttttcacaccctgtggcacaccacaagaggggcagctatcagaagtggtgaaggaaggctc

SEQ ID NO: 343814 - DNA, 75 bp, Artificial Sequence
  Synthetic
ggtgacacttcaccaggagtataccgtatcatgagccgttacattttggggacctaccaggctggagtgggcgtc

SEQ ID NO: 343815 - DNA, 75 bp, Artificial Sequence
  Synthetic
actccctactggggtagtgtgaaagaagacaggatcacctatggtgggccatggaagtttgacaggaagtggaat

SEQ ID NO: 343816 - DNA, 75 bp, Artificial Sequence
  Synthetic
aagacaggatcacctatggtgggccatggaagtttgacaggaagtggaatggtctcgatgatgttcagctcatca

SEQ ID NO: 343817 - DNA, 75 bp, Artificial Sequence
  Synthetic
ggtctcgatgatgttcagctcatcatagtggctcccggaaaggcagccataaacatccaaaccaaaccaggcatc

SEQ ID NO: 343818 - DNA, 75 bp, Artificial Sequence
  Synthetic
tagtggctcccggaaaggcagccataaacatccaaaccaaaccaggcatcttcaaaacgccacagggggaaatag

SEQ ID NO: 343819 - DNA, 75 bp, Artificial Sequence
  Synthetic
tgtacgggaatggagtcatcttgggcaacggctcgtatgtcagtgccatcgtgcaaggcgaaagagaagaagaac

SEQ ID NO: 343820 - DNA, 75 bp, Artificial Sequence
  Synthetic
ccgttcctgaagcgtacaacgcagatatgttaagaaagaagcagctgacagtgctggacctgcatccaggagcgg

SEQ ID NO: 343821 - DNA, 75 bp, Artificial Sequence
  Synthetic
atcatgaaaaatgctgtggtagatgggctggtagctacggatgttcctgaactggagagaaccacccccctcatg

SEQ ID NO: 343822 - DNA, 75 bp, Artificial Sequence
  Synthetic
gtgctggacctgcatccaggagcgggaaagaccaggaggatactcccccagatcatcaaagatgccatccagcgc

SEQ ID NO: 343823 - DNA, 75 bp, Artificial Sequence
  Synthetic
gaaagaccaggaggatactcccccagatcatcaaagatgccatccagcgccgccttcgtacagctgtgctggctc

SEQ ID NO: 343824 - DNA, 75 bp, Artificial Sequence
  Synthetic
caaaagaaggtaggccagattttactggttggggtcagcgcggcggcattgttagtcaacccgtgtgttacaact

SEQ ID NO: 343825 - DNA, 75 bp, Artificial Sequence
  Synthetic
cgccttcgtacagctgtgctggctccaacccgtgtggtggctgcagaaatggctgaggccctcaagggccttccg

SEQ ID NO: 343826 - DNA, 75 bp, Artificial Sequence
  Synthetic
caacccgtgtggtggctgcagaaatggctgaggccctcaagggccttccggtccgatacctgaccccagcggtca

SEQ ID NO: 343827 - DNA, 75 bp, Artificial Sequence
  Synthetic
ggctgaggccctcaagggccttccggtccgatacctgaccccagcggtcaacagagagcatagtggcacagagat

SEQ ID NO: 343828 - DNA, 75 bp, Artificial Sequence
  Synthetic
agtggatgttatgtgtcatgccactctaacccacagactcatgtcacctctaagagttccaaactacaacctctt

SEQ ID NO: 343829 - DNA, 75 bp, Artificial Sequence
  Synthetic
ctaacccacagactcatgtcacctctaagagttccaaactacaacctctttgtgatggatgaggctcacttcact

SEQ ID NO: 343830 - DNA, 75 bp, Artificial Sequence
  Synthetic
tgtgatggatgaggctcacttcactgacccggcgagcatagcagcacgaggctacattgctacaaaagttgagtt

SEQ ID NO: 343831 - DNA, 75 bp, Artificial Sequence
  Synthetic
gggtgaagcggcagcaatattcatgactgcgactccccctggcactcacgatccgttcccagacaccaatgcacc

SEQ ID NO: 343832 - DNA, 75 bp, Artificial Sequence
  Synthetic
actgcgactccccctggcactcacgatccgttcccagacaccaatgcaccagttacagacatacaagctgaggtg

SEQ ID NO: 343833 - DNA, 75 bp, Artificial Sequence
  Synthetic
atccgttcccagacaccaatgcaccagttacagacatacaagctgaggtgcctgacagagcctggagtagtgggt

SEQ ID NO: 343834 - DNA, 75 bp, Artificial Sequence
  Synthetic
agttacagacatacaagctgaggtgcctgacagagcctggagtagtgggtttgagtggataacagaatacaccgg

SEQ ID NO: 343835 - DNA, 75 bp, Artificial Sequence
  Synthetic
cctgacagagcctggagtagtgggtttgagtggataacagaatacaccgggaaaacagtttggttcgtcgctagt

SEQ ID NO: 343836 - DNA, 75 bp, Artificial Sequence
  Synthetic
ttgagtggataacagaatacaccgggaaaacagtttggttcgtcgctagtgtgaagatgggaaatgagattgcac

SEQ ID NO: 343837 - DNA, 75 bp, Artificial Sequence
  Synthetic
gtgaagatgggaaatgagattgcacagtgtcttcagagagcgggaaagaaggtcatccaactcaaccgcaagtcc

SEQ ID NO: 343838 - DNA, 75 bp, Artificial Sequence
  Synthetic
gcgaactttggggccagcagagtcattgactgtcggaaaagcgtgaaacccaccatcttggaggaaggcgaaggg

SEQ ID NO: 343839 - DNA, 75 bp, Artificial Sequence
  Synthetic
agagccgttgggaagccccagccacatgccaaccaggagaagattaaagccaggattcaaagattgaaagaggag

SEQ ID NO: 343840 - DNA, 75 bp, Artificial Sequence
  Synthetic
caccatcttggaggaaggcgaagggagagtgatcttgagcaacccctcaccaatcaccagtgctagtgctgccca

SEQ ID NO: 343841 - DNA, 75 bp, Artificial Sequence
  Synthetic
gaggagagggagagtaggtagaaatcctagtcagataggtgatgagtaccactatggaggaggcacaagcgaaga

SEQ ID NO: 343842 - DNA, 75 bp, Artificial Sequence
  Synthetic
tttgaagagcagaaccaatggagcagtgctagggaggctgtagaggaccctcggttctgggaaatggtggacgaa

SEQ ID NO: 343843 - DNA, 75 bp, Artificial Sequence
  Synthetic
cctagtcagataggtgatgagtaccactatggaggaggcacaagcgaagatgacacgatcgcagctcattggact

SEQ ID NO: 343844 - DNA, 75 bp, Artificial Sequence
  Synthetic
tgacacgatcgcagctcattggactgaagcaaagatcatgttagataacatccacctcccaaatgggcttgttgc

SEQ ID NO: 343845 - DNA, 75 bp, Artificial Sequence
  Synthetic
acaaatgtatgggccagaaagagacaaagccttcaccatggacggggagtaccgactgagaggagaggagagaaa

SEQ ID NO: 343846 - DNA, 75 bp, Artificial Sequence
  Synthetic
aaagccttcaccatggacggggagtaccgactgagaggagaggagagaaagaccttcctggagttgctgaggact

SEQ ID NO: 343847 - DNA, 75 bp, Artificial Sequence
  Synthetic
gcagacctgccagtgtggcttgcctacaaagtggcttcaaatggtatacagtacaccgacaggaagtggtgcttt

SEQ ID NO: 343848 - DNA, 75 bp, Artificial Sequence
  Synthetic
gatggaccaaggtcaaacatcattctggaagacaacaatgaagtcgaaattgtcacccgcacaggtgaacgcaag

SEQ ID NO: 343849 - DNA, 75 bp, Artificial Sequence
  Synthetic
cagatgtggctcttgctgtacttccacagaagagatctgaggctgatggcaaacgccatctgctcagcagtcccc

SEQ ID NO: 343850 - DNA, 75 bp, Artificial Sequence
  Synthetic
tgtcacccgcacaggtgaacgcaagatgctgaagccacgctggttggatgccagggtctacgctgaccatcagtc

SEQ ID NO: 343851 - DNA, 75 bp, Artificial Sequence
  Synthetic
tggaagacaacaatgaagtcgaaattgtcacccgcacaggtgaacgcaagatgctgaagccacgctggttggatg

SEQ ID NO: 343852 - DNA, 75 bp, Artificial Sequence
  Synthetic
gctcaagtggttcaaggactttgcggctggtaagcgatcagcagtgggattccttgaagtcctggggagaatgcc

SEQ ID NO: 343853 - DNA, 75 bp, Artificial Sequence
  Synthetic
tcacttagaagatatgaagaagttagtgtccaggaggacagggttttgtaaataagtgtttagggttttgtaatt

SEQ ID NO: 343854 - DNA, 75 bp, Artificial Sequence
  Synthetic
tgagcacttcgcaggcaagaccagagaggcttttgataccatgtatctggtggcgacagctgagaagggaggaaa

SEQ ID NO: 343855 - DNA, 75 bp, Artificial Sequence
  Synthetic
taattaaacatgtaatgtaatttagttgtaaatgtttgattgtgtagctttatttagtattattttaggttttat

SEQ ID NO: 343856 - DNA, 75 bp, Artificial Sequence
  Synthetic
agcccaccgcatggcccttgaagagttgccggacgctcttgaaaccataacactcattgtggctttggctgtgat

SEQ ID NO: 343857 - DNA, 75 bp, Artificial Sequence
  Synthetic
ttgtaaatgtttgattgtgtagctttatttagtattattttaggttttatttagttattttatttaattgaattt

SEQ ID NO: 343858 - DNA, 75 bp, Artificial Sequence
  Synthetic
gacagcaggagttttcttgctcctcgttcagaggagaggcataggtaagctggggcttggcggtatggtgctagg

SEQ ID NO: 343859 - DNA, 75 bp, Artificial Sequence
  Synthetic
accggaagttgagtagacggtgctgcctgcgactcaaccccaggcggactgggttaacaaagctgaccgctgatg

SEQ ID NO: 343860 - DNA, 75 bp, Artificial Sequence
  Synthetic
cctagccactttcttcttgtggatggctgacgtctcaggcaccaagatcgcaggaaccttattgctggctctgct

SEQ ID NO: 343861 - DNA, 75 bp, Artificial Sequence
  Synthetic
gctgacgtctcaggcaccaagatcgcaggaaccttattgctggctctgctcatgatgatagtgttgattcctgaa

SEQ ID NO: 343862 - DNA, 75 bp, Artificial Sequence
  Synthetic
catgatgatagtgttgattcctgaacctgagaagcaacgatcccagacggacaaccagctagctgtgtttctgat

SEQ ID NO: 343863 - DNA, 75 bp, Artificial Sequence
  Synthetic
cctgagaagcaacgatcccagacggacaaccagctagctgtgtttctgatctgtgtcttgctggtggtgggagtg

SEQ ID NO: 343864 - DNA, 75 bp, Artificial Sequence
  Synthetic
cctgtatggccccaggaggactgggttaccaaagccgaaaggcccccacggcccaagcgaacagacggtgatgcg

SEQ ID NO: 343865 - DNA, 75 bp, Artificial Sequence
  Synthetic
ctgtgtcttgctggtggtgggagtggtggctgccaatgaatacggaatgttagagagaacaaaaagtgaccttgg

SEQ ID NO: 343866 - DNA, 75 bp, Artificial Sequence
  Synthetic
gtggctgccaatgaatacggaatgttagagagaacaaaaagtgaccttgggaaaatattctccagtacacgtcaa

SEQ ID NO: 343867 - DNA, 75 bp, Artificial Sequence
  Synthetic
ccacaaagtgctctgccgctaccctccatgaacgctttggcattggatttgcgaccagcaacagcgtgggcctta

SEQ ID NO: 343868 - DNA, 75 bp, Artificial Sequence
  Synthetic
gcgaccagcaacagcgtgggccttatacggaggaagcacagtggttctcacgcccttgatcaaacatcttgtaac

SEQ ID NO: 343869 - DNA, 75 bp, Artificial Sequence
  Synthetic
cgcccttgatcaaacatcttgtaacatcagaatacatcacaacatctctggcttcaataagcgctcaggctgggt

SEQ ID NO: 343870 - DNA, 75 bp, Artificial Sequence
  Synthetic
gcttcaataagcgctcaggctgggtctttgttcaacctacctcgtggactccccttcactgagctggacttgaca

SEQ ID NO: 343871 - DNA, 75 bp, Artificial Sequence
  Synthetic
gtggtcttggtctttttgggatgttggggccaagtgtcgttaacaactctgatcactgcggcagctctggctact

SEQ ID NO: 343872 - DNA, 75 bp, Artificial Sequence
  Synthetic
ctccactatggctacatgctgcctggatggcaggctgaagctttgagggcggctcaacggagaacagcggccgga

SEQ ID NO: 343873 - DNA, 75 bp, Artificial Sequence
  Synthetic
gatggcaggctgaagctttgagggcggctcaacggagaacagcggccggaatcatgaaaaatgctgtggtagatg

SEQ ID NO: 343874 - DNA, 75 bp, Artificial Sequence
  Synthetic
ggctcaacggagaacagcggccggaatcatgaaaaatgctgtggtagatggtttggtggctacggatgttcctga

SEQ ID NO: 343875 - DNA, 75 bp, Artificial Sequence
  Synthetic
atcatgaaaaatgctgtggtagatggtttggtggctacggatgttcctgagctggagagaaccacccccctcatg

SEQ ID NO: 343876 - DNA, 75 bp, Artificial Sequence
  Synthetic
gtttggtggctacggatgttcctgagctggagagaaccacccccctcatgcaaagaaaggtaggccagattttac

SEQ ID NO: 343877 - DNA, 75 bp, Artificial Sequence
  Synthetic
caaagaaaggtaggccagattttactgattggagtcagcgcagcggcattgttagtcaacccgtgtgttacaact

SEQ ID NO: 343878 - DNA, 75 bp, Artificial Sequence
  Synthetic
gttcgggaagccggcatcctcatatcagcggcactcctgactctctgggacaacggagccattgcagtatggaat

SEQ ID NO: 343879 - DNA, 75 bp, Artificial Sequence
  Synthetic
cagcggcactcctgactctctgggacaacggagccattgcagtatggaattccaccaccgcgaccggactttgcc

SEQ ID NO: 343880 - DNA, 75 bp, Artificial Sequence
  Synthetic
acgtcatccgtggcaattggttggctggagcctctatagcttggactctgataaagaatgctgacaaaccggcct

SEQ ID NO: 343881 - DNA, 75 bp, Artificial Sequence
  Synthetic
ataaagaatgctgacaaaccggcctgcaaacgaggaagaccaggaggaaggacactgggtgagcaatggaaggag

SEQ ID NO: 343882 - DNA, 75 bp, Artificial Sequence
  Synthetic
gacactgggtgagcaatggaaggagaagctaaacgggctcagcaaggaggacttcctgaagtacaggaaagaggc

SEQ ID NO: 343883 - DNA, 75 bp, Artificial Sequence
  Synthetic
acttcctgaagtacaggaaagaggccatcactgaagtcgaccggtccgcagcccgaaaagctaggagggacggga

SEQ ID NO: 343884 - DNA, 75 bp, Artificial Sequence
  Synthetic
gcccgaaaagctaggagggacgggaacaaaactggaggacacccagtgtccagaggctccgcaaagctgagatgg

SEQ ID NO: 343885 - DNA, 75 bp, Artificial Sequence
  Synthetic
cagaggctccgcaaagctgagatggatggtagaacgccaatttgtcaaaccaattggcaaggtggttgacctagg

SEQ ID NO: 343886 - DNA, 75 bp, Artificial Sequence
  Synthetic
atggtagaacgccaatttgtcaaaccaattggcaaggtggttgacctaggttgtgggcgaggaggatggagttac

SEQ ID NO: 343887 - DNA, 75 bp, Artificial Sequence
  Synthetic
caattggcaaggtggttgacctaggttgtgggcgaggaggatggagttactatgcagccacgctcaaaggcgtcc

SEQ ID NO: 343888 - DNA, 75 bp, Artificial Sequence
  Synthetic
ttgtgggcgaggaggatggagttactatgcagccacgctcaaaggcgtccaagaagtcagaggctatacgaaagg

SEQ ID NO: 343889 - DNA, 75 bp, Artificial Sequence
  Synthetic
tatgcagccacgctcaaaggcgtccaagaagtcagaggctatacgaaaggaggacctggacatgaggaaccgatg

SEQ ID NO: 343890 - DNA, 75 bp, Artificial Sequence
  Synthetic
aagaagtcagaggctatacgaaaggaggacctggacatgaggaaccgatgcttatgcaaagctatggctggaacc

SEQ ID NO: 343891 - DNA, 75 bp, Artificial Sequence
  Synthetic
aggacctggacatgaggaaccgatgcttatgcaaagctatggctggaaccttgtcactatgaagagcggagtgga

SEQ ID NO: 343892 - DNA, 75 bp, Artificial Sequence
  Synthetic
cttatgcaaagctatggctggaaccttgtcactatgaagagcggagtggacgtgtattataaaccatctgagccg

SEQ ID NO: 343893 - DNA, 75 bp, Artificial Sequence
  Synthetic
ttggaaatggtctctgattggctgcagagaggaccaagagagttctgcatcaaggttctctgcccatacatgcca

SEQ ID NO: 343894 - DNA, 75 bp, Artificial Sequence
  Synthetic
caaggttctctgcccatacatgccacgtgtcatggagcgcttggaagttctacaacggaggtatggaggaggatt

SEQ ID NO: 343895 - DNA, 75 bp, Artificial Sequence
  Synthetic
ggttcgagtccctctttccagaaattccaaccatgagatgtactgggtcagtggagctgctggcaacattgtcca

SEQ ID NO: 343896 - DNA, 75 bp, Artificial Sequence
  Synthetic
cgcagtgaacatgacgagtcaagtgctcatagggcgaatggagaagagaacatggcatggaccaaaatacgagga

SEQ ID NO: 343897 - DNA, 75 bp, Artificial Sequence
  Synthetic
catggcatggaccaaaatacgaggaggatgttaaccttggaagtggaacaagagccgttgggaagccccagccac

SEQ ID NO: 343898 - DNA, 75 bp, Artificial Sequence
  Synthetic
ggatgttaaccttggaagtggaacaagagccgttgggaagccccagccacataccaaccaggagaagattaaagc

SEQ ID NO: 343899 - DNA, 75 bp, Artificial Sequence
  Synthetic
caggattcaaagattgaaagaggagtatgcagccacatggcaccatgacaaggaccacccatatcggacctggac

SEQ ID NO: 343900 - DNA, 75 bp, Artificial Sequence
  Synthetic
tatgcagccacatggcaccatgacaaggaccacccatatcggacctggacctaccacggaagttatgaagtgaaa

SEQ ID NO: 343901 - DNA, 75 bp, Artificial Sequence
  Synthetic
aggaccacccatatcggacctggacctaccacggaagttatgaagtgaaaccgaccggttcagcaagctccttgg

SEQ ID NO: 343902 - DNA, 75 bp, Artificial Sequence
  Synthetic
ccgaccggttcagcaagctccttggtcaacggagtcgtccgcctaatgagcaagccctgggatgcaattctcaac

SEQ ID NO: 343903 - DNA, 75 bp, Artificial Sequence
  Synthetic
ccactccgtttgggcagcaaagggttttcaaagaaaaggttgacaccaaggccccggaacccccttctggagtta

SEQ ID NO: 343904 - DNA, 75 bp, Artificial Sequence
  Synthetic
gggaagagtttaagaggaaggtcaacagcaacgctgctttgggagccatgtttgaagagcagaaccaatggagca

SEQ ID NO: 343905 - DNA, 75 bp, Artificial Sequence
  Synthetic
cagcaacgctgctttgggagccatgtttgaagagcagaaccaatggagcagtgccagggaggctgtagaggaccc

SEQ ID NO: 343906 - DNA, 75 bp, Artificial Sequence
  Synthetic
tttgaagagcagaaccaatggagcagtgccagggaggctgtagaggaccctcggttctgggaaatggtggacgaa

SEQ ID NO: 343907 - DNA, 75 bp, Artificial Sequence
  Synthetic
gaaagggagaaccatctgaaaggagagtgccacacatgcatttacaacatgatggggaagcgtgagaagaagctc

SEQ ID NO: 343908 - DNA, 75 bp, Artificial Sequence
  Synthetic
agtgccacacatgcatttacaacatgatggggaagcgtgagaagaagctcggagagtttggcaaagcgaaaggta

SEQ ID NO: 343909 - DNA, 75 bp, Artificial Sequence
  Synthetic
gtcgagccatatggttcatgtggctaggcgccagattcctggagtttgaagccctgggctttctgaatgaggacc

SEQ ID NO: 343910 - DNA, 75 bp, Artificial Sequence
  Synthetic
aggcgccagattcctggagtttgaagccctgggctttctgaatgaggaccattggttaggaagaaagaattctgg

SEQ ID NO: 343911 - DNA, 75 bp, Artificial Sequence
  Synthetic
attggttaggaagaaagaattctggaggaggtgttgaaggacttggtgtccaaaaacttggctacattctgcgtg

SEQ ID NO: 343912 - DNA, 75 bp, Artificial Sequence
  Synthetic
agatgagccaccactcaggtggaaaaatgtacgcggatgacacagccggctgggacacccggataaccagagccg

SEQ ID NO: 343913 - DNA, 75 bp, Artificial Sequence
  Synthetic
aatgtacgcggatgacacagccggctgggacacccggataaccagagccgatcttgacaacgaggccaaagtttt

SEQ ID NO: 343914 - DNA, 75 bp, Artificial Sequence
  Synthetic
tgacctacaaacacaaggtggtgaaagttatgcgacctggcacagatgggaagaccgtcatggatgtgatttccc

SEQ ID NO: 343915 - DNA, 75 bp, Artificial Sequence
  Synthetic
gagaagatcagagaggaagtggacaggttgtgacctatgctctcaacacattcaccaacattgccgtccagctca

SEQ ID NO: 343916 - DNA, 75 bp, Artificial Sequence
  Synthetic
ttagactgatggaagctgaaggagtgattgggcaggaacatctggaaagtcttccccggaaaaccaaatacgctg

SEQ ID NO: 343917 - DNA, 75 bp, Artificial Sequence
  Synthetic
gattgggcaggaacatctggaaagtcttccccggaaaaccaaatacgctgtgagaacctggctctttgagaacgg

SEQ ID NO: 343918 - DNA, 75 bp, Artificial Sequence
  Synthetic
cgattggcagcaagtgcctttctgctcaaaccactttcaggaattgatcatgaagaacggaaggactttggtggc

SEQ ID NO: 343919 - DNA, 75 bp, Artificial Sequence
  Synthetic
gtgagtggagatgattgtgttgtcaagcccctggatgatcggtttgccaatgccctgcactttctcaattcgatg

SEQ ID NO: 343920 - DNA, 75 bp, Artificial Sequence
  Synthetic
tgccctgcactttctcaattcgatgtccaaggtcagaaaagacgtgccagagtggaaaccctcctcgggatggca

SEQ ID NO: 343921 - DNA, 75 bp, Artificial Sequence
  Synthetic
tccaaggtcagaaaagacgtgccagagtggaaaccctcctcgggatggcacgattggcagcaagtgcctttctgc

SEQ ID NO: 343922 - DNA, 75 bp, Artificial Sequence
  Synthetic
agtggaaaccctcctcgggatggcacgattggcagcaagtgcctttctgctcaaaccactttcaggaattgatca

SEQ ID NO: 343923 - DNA, 75 bp, Artificial Sequence
  Synthetic
atgtccaggaggacagggttttgtaaataagtgtttagggttttgcaatttaattaaatatgcaatgtaatttgt

SEQ ID NO: 343924 - DNA, 75 bp, Artificial Sequence
  Synthetic
tgaaggacggaaggactttggtggttccctgccggggtcaggatgaactcattgggagggcgcgagtctcccccg

SEQ ID NO: 343925 - DNA, 75 bp, Artificial Sequence
  Synthetic
tccctgccggggtcaggatgaactcattgggagggcgcgagtctcccccggctctggatggaatgttagggacac

SEQ ID NO: 343926 - DNA, 75 bp, Artificial Sequence
  Synthetic
agtcgttcgtctgcgtgagctctactacttcatattggttttggaggatcgtgagattaacacagtgccggcagt

SEQ ID NO: 343927 - DNA, 75 bp, Artificial Sequence
  Synthetic
aaaccgggccatcaatatgctgaaacgcggcataccccgcgtgttcccactagtgggagtaaagagggtagtcat

SEQ ID NO: 343928 - DNA, 75 bp, Artificial Sequence
  Synthetic
cgcatgcttggccaaggcctacgctcagatgtggctcctgctgtacttccacagaagagatctgaggctgatggc

SEQ ID NO: 343929 - DNA, 75 bp, Artificial Sequence
  Synthetic
gggcttgttggatggaagaggaccagtgcgatttgtgctggccttgatgacattcttcaagttcaccgcgcttgc

SEQ ID NO: 343930 - DNA, 75 bp, Artificial Sequence
  Synthetic
cttcatggtcagtgcatgccacaggtgaatggatgacaactgatgacatgttggaagtgtggaacaaagtgtgga

SEQ ID NO: 343931 - DNA, 75 bp, Artificial Sequence
  Synthetic
caagaccccagttcaaagctggacagacatcccttacaccgggaagcgggaagacatatggtgtggaagcctgat

SEQ ID NO: 343932 - DNA, 75 bp, Artificial Sequence
  Synthetic
tggtgtgacaaacaacccatgtacgtccactacggaaggtgcacaagaaccagacattcgaagcggagccggcgg

SEQ ID NO: 343933 - DNA, 75 bp, Artificial Sequence
  Synthetic
aagacatatggtgtggaagcctgataggcacgcgaacacgggcaacgtgggctgaaaacatctacgcagccatta

SEQ ID NO: 343934 - DNA, 75 bp, Artificial Sequence
  Synthetic
accaggtgagggccattattggccaggaaaaatacagggattacatgctttcacttagaagatatgaagaagtta

SEQ ID NO: 343935 - DNA, 75 bp, Artificial Sequence
  Synthetic
ggaaaaatacagggattacatgctttcacttagaagatatgaagaagttaatgtccaggaggacagggttttgta

SEQ ID NO: 343936 - DNA, 75 bp, Artificial Sequence
  Synthetic
tgcttttgtggctgtcctgttgggctggatgctgggaagcaacaatggacaaagggtcgttttcgtcgtactctt

SEQ ID NO: 343937 - DNA, 75 bp, Artificial Sequence
  Synthetic
aataagtgtttagggttttgcaatttaattaaatatgcaatgtaatttagttgtaaatatttgattgtgtagctt

SEQ ID NO: 343938 - DNA, 75 bp, Artificial Sequence
  Synthetic
tatttagcattgttttaggatagtagaagttaaggttttatttagttattttatttaattgaatttgatagtcag

SEQ ID NO: 343939 - DNA, 75 bp, Artificial Sequence
  Synthetic
gagacttccttgagggagtctctggtgctacctgggtcgacgtggttctggaaggtgacagctgcataaccatca

SEQ ID NO: 343940 - DNA, 75 bp, Artificial Sequence
  Synthetic
ttatttaattgaatttgatagtcaggccagggcaacctgccaccggaagttgagtagacggtgctgcctgcgact

SEQ ID NO: 343941 - DNA, 75 bp, Artificial Sequence
  Synthetic
gaagttaaggttttatttagttattttatttaattgaatttgatagtcaggccagggcaacctgccaccggaagt

SEQ ID NO: 343942 - DNA, 75 bp, Artificial Sequence
  Synthetic
gaaggtgacagctgcataaccatcatggctaaggataagccgaccattgacatcaagatgatggaaactgaagcc

SEQ ID NO: 343943 - DNA, 75 bp, Artificial Sequence
  Synthetic
aagctgaccgctgatgatgggaaagcccctcagaaccgtttcggagagggaccctgcctattggaagcgtccagc

SEQ ID NO: 343944 - DNA, 75 bp, Artificial Sequence
  Synthetic
acaactggggaggcccacaatcctaagagagctgaggacacgtacgtgtgcaagagtggcgttactgacagaggc

SEQ ID NO: 343945 - DNA, 75 bp, Artificial Sequence
  Synthetic
ccccaggaggactgggttaccaaagccgaaaggcccccacggcccaagcgaacagacggtgatgcgaactgttcg

SEQ ID NO: 343946 - DNA, 75 bp, Artificial Sequence
  Synthetic
atgttaagtatgaagtgggaatcttcatacatggttccaccagctctgacactcatggcaactattcttcacaac

SEQ ID NO: 343947 - DNA, 75 bp, Artificial Sequence
  Synthetic
tggaaggactagaggttagaggagaccccgtggaacttaggtgcggcccaagccgtttccgaagctgtaggaacg

SEQ ID NO: 343948 - DNA, 75 bp, Artificial Sequence
  Synthetic
agccgtttccgaagctgtaggaacggtggaaggactagaggttagaggagaccccgcatcatgagcatcaaaaaa

SEQ ID NO: 343949 - DNA, 75 bp, Artificial Sequence
  Synthetic
cagcatattgacacctgggaattagactaggagatcttctgctctattccaacatcaaccacaaggcacagagcg

SEQ ID NO: 343950 - DNA, 75 bp, Artificial Sequence
  Synthetic
ctaagaaaccaggagggcccggaagaaaccgggccatcaatatgctgaaacgcggcataccccgcgtattcccac

SEQ ID NO: 343951 - DNA, 75 bp, Artificial Sequence
  Synthetic
aggagctgttccagtgtctttctcgagcagtgtcaagctcacatctggtcatctcaagtgtcgtgtcaagatgga

SEQ ID NO: 343952 - DNA, 75 bp, Artificial Sequence
  Synthetic
tggaagcgcatcaacaagaccacggcaatgaaacacctgactagcttcaaaaaggaattaggaacaatgatcaac

SEQ ID NO: 343953 - DNA, 75 bp, Artificial Sequence
  Synthetic
gtggttaacaatcggggcacaaaaaagaagagaggcaacaatggaccaggactagtgatgatcataacactcatg

SEQ ID NO: 343954 - DNA, 75 bp, Artificial Sequence
  Synthetic
tacggcatgtgtacggaaaagttttcttttgcaaaaaatccggctgacacgggacacagcactgtggttcttgaa

SEQ ID NO: 343955 - DNA, 75 bp, Artificial Sequence
  Synthetic
actagtgatgatcataacactcatgacggttgtttcaatggtttcctctttaaagctttccaacttccaggggaa

SEQ ID NO: 343956 - DNA, 75 bp, Artificial Sequence
  Synthetic
ctgcagtacacgggatctgatggaccttgcaaaattccaatttccatcgtggcatcactttccgatctcactccc

SEQ ID NO: 343957 - DNA, 75 bp, Artificial Sequence
  Synthetic
cgcgaaagtgctggttgagatggaaccaccattcggagattcatacattgtggttggaagaggagacaagcagat

SEQ ID NO: 343958 - DNA, 75 bp, Artificial Sequence
  Synthetic
agctccattggaaaagcgttcatcaccactatcaaaggagcacagcgtttagctgctttaggcgatccagcgtgg

SEQ ID NO: 343959 - DNA, 75 bp, Artificial Sequence
  Synthetic
tcaattctgtagggaaggcggtacatcaggtctttggaggagccttcaggacactcttcggcggcatgtcttgga

SEQ ID NO: 343960 - DNA, 75 bp, Artificial Sequence
  Synthetic
gagaaatatcagttgagtgtgaaccgagaaacgggttgaacaccgaggcatactacatcatgtcagtgggcacta

SEQ ID NO: 343961 - DNA, 75 bp, Artificial Sequence
  Synthetic
gtttaatgacttggccctcccatggacttcaccagctagctcaaattggagaaacagagagatactactggagtt

SEQ ID NO: 343962 - DNA, 75 bp, Artificial Sequence
  Synthetic
gaagcgtgggtcgaccggtacaaatttatgcctgagacaccaaaacagctggcaaaggttatcgagcaagcccac

SEQ ID NO: 343963 - DNA, 75 bp, Artificial Sequence
  Synthetic
ccaccatttggagattcatacattgtggttggaagaggggataagcagataaaccatcactggcacaaagcagga

SEQ ID NO: 343964 - DNA, 75 bp, Artificial Sequence
  Synthetic
gcgaaaggaatatgtggattgaggtctgtctcacgtctggaacacgtgatgtgggagaacatcagagatgaactc

SEQ ID NO: 343965 - DNA, 75 bp, Artificial Sequence
  Synthetic
gaagcgtgggtcgaccggtacaaattcatgcctggaacaccaaaacagctggcaaaggtcatcgagcaagcccac

SEQ ID NO: 343966 - DNA, 75 bp, Artificial Sequence
  Synthetic
ccgcagagactagcactcacatctgaagagtttgagattgggtggaaggcctggggaaagagcttggtgttcgca

SEQ ID NO: 343967 - DNA, 75 bp, Artificial Sequence
  Synthetic
ccagaactggccaaccacacctttgtggttgatgggcctgagaccaaagaatgccccgacgtaaaaagggcttgg

SEQ ID NO: 343968 - DNA, 75 bp, Artificial Sequence
  Synthetic
accactgactgcgacagctcaataattgggacggccgttaaaggagacatagctgtgcacagtgacctctcctac

SEQ ID NO: 343969 - DNA, 75 bp, Artificial Sequence
  Synthetic
ttgggacggccgttaaaggagacatagctgtgcacagtgacctctcctactggattgaaagccataagaacacga

SEQ ID NO: 343970 - DNA, 75 bp, Artificial Sequence
  Synthetic
atgttcttctggttggggcggccttcgccgaagccaacagcgggggtgacgtcgttcatctagctctcatagccg

SEQ ID NO: 343971 - DNA, 75 bp, Artificial Sequence
  Synthetic
gtgggatgaagaagacatcgttctcgactttgactattgcccaggtaccaccgtcacaatcactgaagcatgtgg

SEQ ID NO: 343972 - DNA, 75 bp, Artificial Sequence
  Synthetic
ctagggttagcactaacatcaacagggcagttctctgcatcagttatggcggctgggctcatggcatgcaatccc

SEQ ID NO: 343973 - DNA, 75 bp, Artificial Sequence
  Synthetic
aaaaatggatgttggtatggaatggagataagacccatgaagcatgatgagacgacgttggtaaagtctagcgtt

SEQ ID NO: 343974 - DNA, 75 bp, Artificial Sequence
  Synthetic
tggacgaaccaagagaacatcctgctggctctgggggcagcattctttcagatggcggccaccgatttggacctc

SEQ ID NO: 343975 - DNA, 75 bp, Artificial Sequence
  Synthetic
tctctcccaggaattctcaatgccactgccacagcttggatgctcctgagggctgccacccagccatccacttct

SEQ ID NO: 343976 - DNA, 75 bp, Artificial Sequence
  Synthetic
atgtatgaaggagttcttcacaccctgtggcacaccacaagaggggcagctatcagaagtggtgaaggaaggctc

SEQ ID NO: 343977 - DNA, 75 bp, Artificial Sequence
  Synthetic
aaacatccaaaccaaaccaggcatcttcaaaacgccacaaggggaaataggagcagtcagcctggactatcctga

SEQ ID NO: 343978 - DNA, 75 bp, Artificial Sequence
  Synthetic
ggcagttctccgcgtcggttatggcagctgggctcatggcatgcaatcccaacaaaaagcgggggtggccggcca

SEQ ID NO: 343979 - DNA, 75 bp, Artificial Sequence
  Synthetic
agctgggctcatggcatgcaatcccaacaaaaagcgggggtggccggccacagaagttttgacggcagttggatt

SEQ ID NO: 343980 - DNA, 75 bp, Artificial Sequence
  Synthetic
gatcatcaaagatgccatccagcgccgcctccgtacagctgtgctggctccaacccgtgtggtggctgcagaaat

SEQ ID NO: 343981 - DNA, 75 bp, Artificial Sequence
  Synthetic
tatgacacggagtatcccaaatgcaagaatggagactgggattttgtgataacaacagacatctcagagatgggc

SEQ ID NO: 343982 - DNA, 75 bp, Artificial Sequence
  Synthetic
caccatcttggaggaaggcgaagggagagtgatcttgagcaacccctcaccaatcactagtgctagtgctgccca

SEQ ID NO: 343983 - DNA, 75 bp, Artificial Sequence
  Synthetic
agagtgatcttgagcaacccctcaccaatcactagtgctagtgctgcccagaggagagggagagtaggtagaaat

SEQ ID NO: 343984 - DNA, 75 bp, Artificial Sequence
  Synthetic
acaaagtggcttcaaatggtatacagtacaccgacaggaagtggtgttttgatggaccaaggtcaaacatcattc

SEQ ID NO: 343985 - DNA, 75 bp, Artificial Sequence
  Synthetic
cactcattgtggctttggccgtgatgacagcaggagttttcttgctcctcgttcagaggagaggcataggtaagc

SEQ ID NO: 343986 - DNA, 75 bp, Artificial Sequence
  Synthetic
gtggctgccaatgaatacggaatgttagagagaacaaaaagtgaccttgggaaaatattctccagcacacgtcaa

SEQ ID NO: 343987 - DNA, 75 bp, Artificial Sequence
  Synthetic
tagagagaacaaaaagtgaccttgggaaaatattctccagcacacgtcaaccacaaagtgctctgccgctaccct

SEQ ID NO: 343988 - DNA, 75 bp, Artificial Sequence
  Synthetic
ggtcttgatgatgttcagctcatcatagtggcacccggaaaggcagccataaacatccaaaccaaaccaggtgtc

SEQ ID NO: 343989 - DNA, 75 bp, Artificial Sequence
  Synthetic
gaaaatattctccagcacacgtcaaccacaaagtgctctgccgctaccctctatgagcgctttggcattggattt

SEQ ID NO: 343990 - DNA, 75 bp, Artificial Sequence
  Synthetic
gtgcaaggggaaagagaagaagaacccgttcccgaagcgtacaacgcagacatgttaagaaagaagcagctgaca

SEQ ID NO: 343991 - DNA, 75 bp, Artificial Sequence
  Synthetic
tagtggcacccggaaaggcagccataaacatccaaaccaaaccaggtgtcttcaaaactccacaaggggaaatag

SEQ ID NO: 343992 - DNA, 75 bp, Artificial Sequence
  Synthetic
tacggagggagcacagtggttctcacgcccttgatcaaacatcttgtaacatcagaatacatcacaacatctctg

SEQ ID NO: 343993 - DNA, 75 bp, Artificial Sequence
  Synthetic
caacccgtgtggtggctgcagaaatggctgaagctctcaagggccttccggtccgatacttgaccccagcggtca

SEQ ID NO: 343994 - DNA, 75 bp, Artificial Sequence
  Synthetic
tgattggagtcagcgcggcggcattgttagtcaacccgtgtgttacaactgttcgggaagccggcatcctcatat

SEQ ID NO: 343995 - DNA, 75 bp, Artificial Sequence
  Synthetic
cagcggcactcctgactctctgggacaacggagccattgcagtatggaattccaccaccgcgaccggactttgtc

SEQ ID NO: 343996 - DNA, 75 bp, Artificial Sequence
  Synthetic
cctgacagagcctggagtagtgggtttgagtggataacagaatacaccgggaaaacagtctggtttgttgctagc

SEQ ID NO: 343997 - DNA, 75 bp, Artificial Sequence
  Synthetic
aagctaaacgggctcagcaaggaggatttcctgaagtacaggaaagaggccatcactgaagtcgaccggtccgca

SEQ ID NO: 343998 - DNA, 75 bp, Artificial Sequence
  Synthetic
agagtgatcttgagcaacccctcaccaatcactagtgctagtgctgcccagaggagaggaagagtaggtagaaat

SEQ ID NO: 343999 - DNA, 75 bp, Artificial Sequence
  Synthetic
acaaatgtatgggccagaaagagacaaagctttcaccatggacggggagtaccgtctgataggacaggagagaaa

SEQ ID NO: 344000 - DNA, 75 bp, Artificial Sequence
  Synthetic
tgcgacacgcttttctgtgacattggagaatcatcttctagtgctgaggtggaagaacaacgcactctgaggatt

SEQ ID NO: 344001 - DNA, 75 bp, Artificial Sequence
  Synthetic
gaccttcctggagttgttgaggactgcagacctgccagtgtggcttgcctacaaagtggcttcaaatggtataca

SEQ ID NO: 344002 - DNA, 75 bp, Artificial Sequence
  Synthetic
ataccaaccaggagaagattaaagccaggattcaaagattgaaagaggagtatgcagccacatggcaccacgaca

SEQ ID NO: 344003 - DNA, 75 bp, Artificial Sequence
  Synthetic
gaggcctttgataccatgtatctggtggcgacagccgagaagggaggaaaagcccaccgcatggcctttgaagag

SEQ ID NO: 344004 - DNA, 75 bp, Artificial Sequence
  Synthetic
ttgccggacgctcttgagactataacactcattgtggctctggccgtgatgacagcaggagttttcttgctcctc

SEQ ID NO: 344005 - DNA, 75 bp, Artificial Sequence
  Synthetic
gtgaccaccatggcgatgactgacaccactccgtttgggcagcagagggttttcaaagaaaaggttgacaccaag

SEQ ID NO: 344006 - DNA, 75 bp, Artificial Sequence
  Synthetic
gagaggtgatggatgagaccaccaattggctgtgggcttttctcgcacgagaaaagaagccaaggttgtgcacca

SEQ ID NO: 344007 - DNA, 75 bp, Artificial Sequence
  Synthetic
gttcagaggagaggtataggtaagctggggcttggtggtatggtgctaggcctagccactttcttcttgtggatg

SEQ ID NO: 344008 - DNA, 75 bp, Artificial Sequence
  Synthetic
ttggctgtgggcttttctcgcacgagaaaagaagccaaggttgtgcaccagggaagagtttaagaggaaggtcaa

SEQ ID NO: 344009 - DNA, 75 bp, Artificial Sequence
  Synthetic
aggaggtgttgaaggacttggtgtccaaaaacttggttacattctgcgtgagatgagccaccattcaggtgggaa

SEQ ID NO: 344010 - DNA, 75 bp, Artificial Sequence
  Synthetic
gaaaatgttctccggcacacgtcaaccacagagtgctctgccgctaccttccatgaacgctttggcattggattt

SEQ ID NO: 344011 - DNA, 75 bp, Artificial Sequence
  Synthetic
ccatgaacgctttggcattggatttgcgaccagcaacagcatgggccctatatggagggagcacagtagttctca

SEQ ID NO: 344012 - DNA, 75 bp, Artificial Sequence
  Synthetic
ggagctgatggaaggtgagcacagacaactagccagagcaatcattgagctgacctacaaacacaaggtggtgaa

SEQ ID NO: 344013 - DNA, 75 bp, Artificial Sequence
  Synthetic
gagaagatcagagaggaagtggacaggttgtgacctatgctctcaacacattcaccaacattgccgtccagctta

SEQ ID NO: 344014 - DNA, 75 bp, Artificial Sequence
  Synthetic
gatcactgcggcagctctggccacccttcactatggctacatgctgcctggatggcaggctgaagctttgagggc

SEQ ID NO: 344015 - DNA, 75 bp, Artificial Sequence
  Synthetic
acagaagagatctgaggctgatggcaaacgccatctgttcagcagtccccagcaattgggttcccactggcagga

SEQ ID NO: 344016 - DNA, 75 bp, Artificial Sequence
  Synthetic
ggctcaacggagaacagcggctggaatcatgaaaaatgctgtggtagacggcttggtggctacggatgttcctga

SEQ ID NO: 344017 - DNA, 75 bp, Artificial Sequence
  Synthetic
agcaattgggttcccactggcaggacttcatggtcagtgcatgccacaggtgaatggatgacaactgatgacatg

SEQ ID NO: 344018 - DNA, 75 bp, Artificial Sequence
  Synthetic
tgaatggatgacaactgatgacatgttggaagtgtggaacaaagtgtggatccaagacaatgaatggatgctgga

SEQ ID NO: 344019 - DNA, 75 bp, Artificial Sequence
  Synthetic
tcacttagaagatatgaagaagttaatgtccaggaggacagggttttgtaaataagtgtttagggttttgtaatt

SEQ ID NO: 344020 - DNA, 75 bp, Artificial Sequence
  Synthetic
gcaaacgaggaagaccaggaggaaggacactgggtgagcagtggaaagaaaagctgaatgggctcagtagggagg

SEQ ID NO: 344021 - DNA, 75 bp, Artificial Sequence
  Synthetic
atgtccaggaggacagggttttgtaaataagtgtttagggttttgtaatttaattaaatatgcaatgtaatttag

SEQ ID NO: 344022 - DNA, 75 bp, Artificial Sequence
  Synthetic
tgagtagacggtgctgcctgcgactcaaccccaggcggactgggttaacaaagctgaccgctgatgatgggaaag

SEQ ID NO: 344023 - DNA, 75 bp, Artificial Sequence
  Synthetic
agccgtttccgaagctgtaggaacggtggaaggactagaggttagaggagaccccgcatcataagcatcaaaaaa

SEQ ID NO: 344024 - DNA, 75 bp, Artificial Sequence
  Synthetic
ttgtcactatgaagagcggagtggacgtgtattataaaccatctgagccgtgcgacacgcttttttgtgacattg

SEQ ID NO: 344025 - DNA, 75 bp, Artificial Sequence
  Synthetic
aaaagcaatcacaaccggcgtgaaggttacaaagtccagagccaggggccgtgggacgaagaagacatcgttctc

SEQ ID NO: 344026 - DNA, 75 bp, Artificial Sequence
  Synthetic
ggatgttaaccttggaagtggaacaagagccgtcgggaagccccagccacatgccaaccaggagaagatcaaagc

SEQ ID NO: 344027 - DNA, 75 bp, Artificial Sequence
  Synthetic
tatgcagccacatggcaccatgacaaggaccacccatatcggacttggacctaccacggaagctatgaagtgaaa

SEQ ID NO: 344028 - DNA, 75 bp, Artificial Sequence
  Synthetic
ccgaccggttcagcaggctccttggtcaacggagtcgttcgcctaatgagcaagccttgggatgcaattcttaac

SEQ ID NO: 344029 - DNA, 75 bp, Artificial Sequence
  Synthetic
tgaatggatgacaactgatgacatgttggaagtgtggaacaaagtgtggatccaagacaacgaatggatgctgga

SEQ ID NO: 344030 - DNA, 75 bp, Artificial Sequence
  Synthetic
gctctattccaacatcaaccacaaggcacagagcgccgaaaattgtggctggtggggaactagaccacaggatct

SEQ ID NO: 344031 - DNA, 75 bp, Artificial Sequence
  Synthetic
aaatgacccagaagacattgactgttggtgtgacaaacaacccatgtatgtccactatggaaggtgcacaagaac

SEQ ID NO: 344032 - DNA, 75 bp, Artificial Sequence
  Synthetic
aggaggtgttgaaggacttggtgtccaaaagcttggttacattctgcgggagatgagccaccactcaggtgggaa

SEQ ID NO: 344033 - DNA, 75 bp, Artificial Sequence
  Synthetic
ggttgtgacctatgctctcaacacattcaccaacattgccgtccagctcatcagactgatggaagctgaaggagt

SEQ ID NO: 344034 - DNA, 75 bp, Artificial Sequence
  Synthetic
tccttgccgaggtcaggatgaactcattgggagggcgcgagtctcccccggctctgggtggaatgttagggacac

SEQ ID NO: 344035 - DNA, 75 bp, Artificial Sequence
  Synthetic
attgggagggcgcgagtctcccccggctctgggtggaatgttagggacactgcatgcttggctaaggcctacgcc

SEQ ID NO: 344036 - DNA, 75 bp, Artificial Sequence
  Synthetic
tggagcctctatagcttggactttgataaagaatgctgacaaaccggcctgcaagcgaggaagaccaggaggaag

SEQ ID NO: 344037 - DNA, 75 bp, Artificial Sequence
  Synthetic
ggaaaagtatagggattacatgctttcacttagaagatatgaagaagttgatgtccaagaggacagggttttgta

SEQ ID NO: 344038 - DNA, 75 bp, Artificial Sequence
  Synthetic
ttgtaaatatttgattgtgtagctttatttagcattgttttaggatagtagaagttaaggttttgtttagttatt

SEQ ID NO: 344039 - DNA, 75 bp, Artificial Sequence
  Synthetic
aataagtgtttagggttttgtaatttattcaaatatgtaatgtaatttagttgtaagtatttgattgtgtagctt

SEQ ID NO: 344040 - DNA, 75 bp, Artificial Sequence
  Synthetic
ttgtaagtatttgattgtgtagctttatttagtatcattttaggataatagaagttgagtttgtatttagttatt

SEQ ID NO: 344041 - DNA, 75 bp, Artificial Sequence
  Synthetic
agatgttggcctgtgtgagctctactacttagtattgtttttggaggatcgtgagattaacacagtgccggcagt

SEQ ID NO: 344042 - DNA, 75 bp, Artificial Sequence
  Synthetic
caaccccaggcggactgggttaacaaagctggccgctgatgataggaaagcccctcagaaccgtttcggagaggg

SEQ ID NO: 344043 - DNA, 75 bp, Artificial Sequence
  Synthetic
tggatgctgggaagcaacaatggacaaagggtcgttttcgtcgttctcttacttcttgtggcgcctgcttatagc

SEQ ID NO: 344044 - DNA, 75 bp, Artificial Sequence
  Synthetic
agccgtttccgaagctgtaggagcggtggaaggactagaggttagaggagaccccgcatcataagcatcaaaaac

SEQ ID NO: 344045 - DNA, 75 bp, Artificial Sequence
  Synthetic
cttatgtggcttcatccgaagccaacgcgaaagtgttggttgagatggaaccaccatttggagattcatacattg

SEQ ID NO: 344046 - DNA, 75 bp, Artificial Sequence
  Synthetic
aagagtttgagattgggtggaaagcttggggaaagagcttggtgttcgcaccagaactggccaaccacacttttg

SEQ ID NO: 344047 - DNA, 75 bp, Artificial Sequence
  Synthetic
gctgagttggatgttgattccatgtccattccttttgtgttagccgggctgatggcagtttcttacaccatttca

SEQ ID NO: 344048 - DNA, 75 bp, Artificial Sequence
  Synthetic
ccatgaacgctttggcattggatttgcgaccagcaacagcgtgggccttatacggagggagcacagtggttctca

SEQ ID NO: 344049 - DNA, 75 bp, Artificial Sequence
  Synthetic
atcagaatacatcacaacatctctggcttcaataagcgctcaggctgggtctttgttcaacctaccccgcggact

SEQ ID NO: 344050 - DNA, 75 bp, Artificial Sequence
  Synthetic
ccccttcacggagctggacttgacagtggtcttggtctttttgggatgttggggccaagtgtcgttaacaactct

SEQ ID NO: 344051 - DNA, 75 bp, Artificial Sequence
  Synthetic
atttcctgaagtacaggaaagaggccatcactgaagtcgaccggtccgcagcccgaaaagctaggagggacggga

SEQ ID NO: 344052 - DNA, 75 bp, Artificial Sequence
  Synthetic
atcttgacaacgaggccaaagttttggagctgatggaaggtgagcacagacaactagctagagcaatcattgagc

SEQ ID NO: 344053 - DNA, 75 bp, Artificial Sequence
  Synthetic
tgagaacctggctctttgagaacggagaagaaagggtgacccgcatggctgtgagtggagatgattgtgttgtca

SEQ ID NO: 344054 - DNA, 75 bp, Artificial Sequence
  Synthetic
gctctattccaacatcaaccacaaggcacagagcgccgaaaattgtggctgatggtgaactagacaccaggatct

SEQ ID NO: 344055 - DNA, 75 bp, Artificial Sequence
  Synthetic
tagactaggagatcttctgctctattccaacatcaaccacaaggcacagagcgccgaaaattgtggttggtgggg

SEQ ID NO: 344056 - DNA, 75 bp, Artificial Sequence
  Synthetic
agagatcgatccatcgcactggtgatgttagccacgggaggggtgctcctttttctcgccacaaacgtccatgca

SEQ ID NO: 344057 - DNA, 75 bp, Artificial Sequence
  Synthetic
gctctattccaacatcaaccacaaggcacagagcgccgaaaattgtggctgatggggaacaagaccacaggatct

SEQ ID NO: 344058 - DNA, 75 bp, Artificial Sequence
  Synthetic
gtttaatgatttggccctcccatggacttcaccagctagctcaaattggagaaatagagagatactactagagtt

SEQ ID NO: 344059 - DNA, 75 bp, Artificial Sequence
  Synthetic
acaaatgtatgggccagaaagagacaaagcctttaccatggacggggagtaccgactgagaggagaggagagaaa

SEQ ID NO: 344060 - DNA, 75 bp, Artificial Sequence
  Synthetic
gctctattccaacatcaaccacaaggcacagagcgccgaaaattgtggctgatggggagctagaccacaggatca

SEQ ID NO: 344061 - DNA, 75 bp, Artificial Sequence
  Synthetic
aaaccgggccatcaatatgctgaaacgcggcataccccgcgtattcccactagtgggagtaaagagggtagttat

SEQ ID NO: 344062 - DNA, 75 bp, Artificial Sequence
  Synthetic
gtgcgatttgtgctggccttgatgacattcttcaagttcaccgcgcttgccccgacaaaagccttgttaggccgt

SEQ ID NO: 344063 - DNA, 75 bp, Artificial Sequence
  Synthetic
ctggatcagagccatggatgtcgggtatatgtgtgatgataccatcacctatgaatgccccaaattggatgcagg

SEQ ID NO: 344064 - DNA, 75 bp, Artificial Sequence
  Synthetic
tggtgtgacaaacaacccatgtatgtccactatggaaggtgcacaagaaccaggcattcgaagcggagccggcgg

SEQ ID NO: 344065 - DNA, 75 bp, Artificial Sequence
  Synthetic
tggttggaagaggggataagcagataaaccatcactggcacaaagcaggaagctccattggaaaagcgttcatca

SEQ ID NO: 344066 - DNA, 75 bp, Artificial Sequence
  Synthetic
tcgagatatctaatgaagactgaaaattggattattaggaatcctgggtatgcttttgtagccgtcctgttgggc

SEQ ID NO: 344067 - DNA, 75 bp, Artificial Sequence
  Synthetic
tggatgctgggaagcaacaatggacaaagggtcgtcttcgtcatactcttacttcttgtggcgccagcttacagc

SEQ ID NO: 344068 - DNA, 75 bp, Artificial Sequence
  Synthetic
tttaactgccttggtatgagcaacagagacttccttgagggagtttctggtgccacctgggtcgacgtggttctg

SEQ ID NO: 344069 - DNA, 75 bp, Artificial Sequence
  Synthetic
tatgacacggagtatcccaaatgcaagaatggagactgggattttgtgataacaacagacatctcagagatgggt

SEQ ID NO: 344070 - DNA, 75 bp, Artificial Sequence
  Synthetic
gaaggtgatagctgcataaccatcatggctaaagacaagccgaccattgacattaagatgatggaaactgaagcc

SEQ ID NO: 344071 - DNA, 75 bp, Artificial Sequence
  Synthetic
acgaatttggctgaagtgagaagctactgctatctagctactgtctcagatgtttcaactgtctccaattgtccg

SEQ ID NO: 344072 - DNA, 75 bp, Artificial Sequence
  Synthetic
actcatggcaactattcttcacaactaggagcatcacaggctgggcggttcaccatcactcccaattccccagcc

SEQ ID NO: 344073 - DNA, 75 bp, Artificial Sequence
  Synthetic
cgaagaaccccatgccacaaagcaatcagtagtggcgcttggttctcaggaaggtgctctgcaccaggccttggc

SEQ ID NO: 344074 - DNA, 75 bp, Artificial Sequence
  Synthetic
ttggaagtgtggaacaaagtgtggatccaagacaatgaatggatgctggacaagaccccagttcaaagctggaca

SEQ ID NO: 344075 - DNA, 75 bp, Artificial Sequence
  Synthetic
cttttgcaaaaaatccggctgacacgggtcacggcactgtggtccttgaactgcagtacacgggatctgatggac

SEQ ID NO: 344076 - DNA, 75 bp, Artificial Sequence
  Synthetic
cgcgaaagtgctggttgagatggaatcacctttcggagattcatacatcgtggttggaagaggggacaagcagat

SEQ ID NO: 344077 - DNA, 75 bp, Artificial Sequence
  Synthetic
agctccattggaaaagcgttcatcaccactatcaaaggagcacagcgtctggcagctctaggtgacacagcgtgg

SEQ ID NO: 344078 - DNA, 75 bp, Artificial Sequence
  Synthetic
gcttctgtggatgggggtgaatgcgagagatagatccatcgcactggtgatgttagccacgggaggtgtgctcct

SEQ ID NO: 344079 - DNA, 75 bp, Artificial Sequence
  Synthetic
agagatagatccatcgcactggtgatgttagccacgggaggtgtgctcctctttctcgccacaaacgtccacgca

SEQ ID NO: 344080 - DNA, 75 bp, Artificial Sequence
  Synthetic
tagacctgagtgtcgtggttgagaagccaaaaggaatgtacagatcagcaccgcagagactagcacttacatctg

SEQ ID NO: 344081 - DNA, 75 bp, Artificial Sequence
  Synthetic
tggttgatgggcccgagaccaaggaatgccccgatgcaaaaagagcttggaacagccttgagattgaagactttg

SEQ ID NO: 344082 - DNA, 75 bp, Artificial Sequence
  Synthetic
gctctattccaacatcaaccacaaggcacagagcgccgaaaattgtggctgatggggaactagaccacaggatct

SEQ ID NO: 344083 - DNA, 75 bp, Artificial Sequence
  Synthetic
gatttggtatcatgtccaccagggtttggctaaaagtcagagaacacaacaccactgactgcgacagctcaataa

SEQ ID NO: 344084 - DNA, 75 bp, Artificial Sequence
  Synthetic
tgtgccagtcacccttgctgggccaaagagcaatcacaaccggcgtgaaggttacaaagtccagagccaagggcc

SEQ ID NO: 344085 - DNA, 75 bp, Artificial Sequence
  Synthetic
attgggagggcgcgagtctcccccggctctggatggaatgttagggacaccgcatgtttggccaaggcctacgct

SEQ ID NO: 344086 - DNA, 75 bp, Artificial Sequence
  Synthetic
ccttccccctttgagatacaggacaaaaaatggatgttggtatggaatggagataagacccatgaagcatgatga

SEQ ID NO: 344087 - DNA, 75 bp, Artificial Sequence
  Synthetic
aaaaatggatgttggtatggaatggagataagacccatgaagcatgatgagacgacgttggtgaagtccagcgtt

SEQ ID NO: 344088 - DNA, 75 bp, Artificial Sequence
  Synthetic
cgcagtgaatatgacgagtcaagtgctcatagggcgaatggagaagagaacatggcatggaccaaaatacgagga

SEQ ID NO: 344089 - DNA, 75 bp, Artificial Sequence
  Synthetic
cgccatgacatttttcaggggaaagtggacgaaccaagagaacatcctgctggctttgggggcagcattctttca

SEQ ID NO: 344090 - DNA, 75 bp, Artificial Sequence
  Synthetic
tggacgaaccaagagaacatcctgctggctttgggggcagcattctttcagatggcggccaccgacttgaacttc

SEQ ID NO: 344091 - DNA, 75 bp, Artificial Sequence
  Synthetic
gctctattccaacatcaaccacaaggcacagagcgccgaaaattgtggctgatggggggctagaccacaggatct

SEQ ID NO: 344092 - DNA, 75 bp, Artificial Sequence
  Synthetic
gccatcgtcatgcctttgctctgcctactggctcctggcatgagactgctctacctggacacgtatagaatcact

SEQ ID NO: 344093 - DNA, 75 bp, Artificial Sequence
  Synthetic
cccgacaaaggccttgctaggccgttggaagcgcatcaacaagaccacggcaatgaaacacctgacaagtttcaa

SEQ ID NO: 344094 - DNA, 75 bp, Artificial Sequence
  Synthetic
ttagggttagcactcacatcaacaggacagttctctgcatcggttatggcggctgggctcatggcatgcaatccc

SEQ ID NO: 344095 - DNA, 75 bp, Artificial Sequence
  Synthetic
actactgatgatcataacactcatgacggccgtttcaatggtttcctctttgaagctttccaactttcaggggaa

SEQ ID NO: 344096 - DNA, 75 bp, Artificial Sequence
  Synthetic
acggccgtttcaatggtttcctctttgaagctttccaactttcaggggaaagtcatgatgaccatcaatgcgact

SEQ ID NO: 344097 - DNA, 75 bp, Artificial Sequence
  Synthetic
atgtatgaaggagttcttcacaccctgtggcacaccacaagaggggcagccatcagaagtggtgaaggaaggctc

SEQ ID NO: 344098 - DNA, 75 bp, Artificial Sequence
  Synthetic
tgcttggctagactcaaccaaggcttcgagatatctgatgaagactgaaaactggattatcaggaatcctgggta

SEQ ID NO: 344099 - DNA, 75 bp, Artificial Sequence
  Synthetic
catcagaagtggtgaaggaaggctcactccctactggggcagtgtgaaagaagacaggattacctatggtgggcc

SEQ ID NO: 344100 - DNA, 75 bp, Artificial Sequence
  Synthetic
tgcttttgtagctgtcctgttgggctggatgctgggaggcaacaatggacaaagggtcgttttcgtcgtactttt

SEQ ID NO: 344101 - DNA, 75 bp, Artificial Sequence
  Synthetic
tggctaaggacaagccgaccattgatattaagatgatggaaactgaggccacgaatctggctgaagtgagaagct

SEQ ID NO: 344102 - DNA, 75 bp, Artificial Sequence
  Synthetic
acgaatctggctgaagtgagaagctactgctatctagccactgtctcagatgtttcaactgtctccaattgtcca

SEQ ID NO: 344103 - DNA, 75 bp, Artificial Sequence
  Synthetic
acgactggggaggcccacaatcctaagagagctgaggacacgtacgtgtgcaagagtggtgtcactgacagaggc

SEQ ID NO: 344104 - DNA, 75 bp, Artificial Sequence
  Synthetic
caacccgtgtggtggctgcggaaatggctgaggctctcaagggccttccggtccgatacttgaccccagcagtca

SEQ ID NO: 344105 - DNA, 75 bp, Artificial Sequence
  Synthetic
caagagtggtgtcactgacagaggctggggcaatggctgtggactatttggcaagggaagtatagacacgtgtgc

SEQ ID NO: 344106 - DNA, 75 bp, Artificial Sequence
  Synthetic
acagagagcatagtggcacagagatagtggatgtcatgtgtcatgccactctaacccacagactcatgtcacctc

SEQ ID NO: 344107 - DNA, 75 bp, Artificial Sequence
  Synthetic
tgtgatggatgaagctcatttcactgacccggcgagcatagcagcacgaggctacattgccacaaaagttgagtt

SEQ ID NO: 344108 - DNA, 75 bp, Artificial Sequence
  Synthetic
catacatggctccactagctctgacactcatggcaactattcttcacaactaggagtatcacaggctgggcggtt

SEQ ID NO: 344109 - DNA, 75 bp, Artificial Sequence
  Synthetic
aagaaatgggttgaacactgaggcatactacatcatgtcagtgggcaccaaacatttccttgtccatagagaatg

SEQ ID NO: 344110 - DNA, 75 bp, Artificial Sequence
  Synthetic
gtttaatgacttggccctcccatggacttcaccagccagctcaaattggagaaatagagaaatactactagagtt

SEQ ID NO: 344111 - DNA, 75 bp, Artificial Sequence
  Synthetic
cgaagaaccccatgccacaaagcaatcagtcgtggcgcttggttctcaggaaggtgctttgcaccaggccttggc

SEQ ID NO: 344112 - DNA, 75 bp, Artificial Sequence
  Synthetic
aaagctttcaccatggacggggagtaccggctgagaggagaggagagaaagaccttcctggaattgttgaggact

SEQ ID NO: 344113 - DNA, 75 bp, Artificial Sequence
  Synthetic
atctcaagtgtcgagtcaagatggaaaaattgacactaaaaggcaccacctatagcatgtgtacggaaaagtttt

SEQ ID NO: 344114 - DNA, 75 bp, Artificial Sequence
  Synthetic
ccagggtctattccgaccatcaatcgctcaagtggttcaaggactttgcggctggtaagcgatcagcagtgggat

SEQ ID NO: 344115 - DNA, 75 bp, Artificial Sequence
  Synthetic
ctgcagtacacgggatctgatggaccttgcaaaattccaatttccatcgtagtatcactttccgatctcactccc

SEQ ID NO: 344116 - DNA, 75 bp, Artificial Sequence
  Synthetic
tgagcacttcgcaggcaaaaccagagaggcttttgacaccatgtacctggtggcgacagctgagaagggaggaaa

SEQ ID NO: 344117 - DNA, 75 bp, Artificial Sequence
  Synthetic
attggtagaatggttacagcaaacccctatgtggcttcatccgaagccaacgcgaaagtgctggttgagatggaa

SEQ ID NO: 344118 - DNA, 75 bp, Artificial Sequence
  Synthetic
gaggcttttgacaccatgtacctggtggcgacagctgagaagggaggaaaagcccaccgtatggctcttgaagag

SEQ ID NO: 344119 - DNA, 75 bp, Artificial Sequence
  Synthetic
ccaccatttggagattcatacattgtggttggaagaggggacaagcagataaaccatcactggcacaaggcagga

SEQ ID NO: 344120 - DNA, 75 bp, Artificial Sequence
  Synthetic
agctccataggaaaagcgttcatcaccaccatcaaaggggcacagcgtctagctgctctaggtgacacagcttgg

SEQ ID NO: 344121 - DNA, 75 bp, Artificial Sequence
  Synthetic
agctgctctaggtgacacagcttgggactttgggtcggtcggagggattttcaattccgtaggaaaggcggtaca

SEQ ID NO: 344122 - DNA, 75 bp, Artificial Sequence
  Synthetic
tagagagaacaaaaagtgaccttgggaaaatgttttccagcacacgtcaaccacagagtgctctgccgctacctt

SEQ ID NO: 344123 - DNA, 75 bp, Artificial Sequence
  Synthetic
tcaggtctttggaggagccttcaggactctcttcggcggcatgtcctggatcacccagggtctaatgggagctct

SEQ ID NO: 344124 - DNA, 75 bp, Artificial Sequence
  Synthetic
gcttctgtggatgggagtgaacgcgagagatcgatctatcgcactggtgatgttagccacgggaggagtgctcct

SEQ ID NO: 344125 - DNA, 75 bp, Artificial Sequence
  Synthetic
atcagaatacatcacaacatctctggcctcaataagcgctcaggctgggtctttgttcaacctacctcgcggact

SEQ ID NO: 344126 - DNA, 75 bp, Artificial Sequence
  Synthetic
tgttagccacgggaggagtgctcctctttctcgccacgaacgtccatgcagactcgggatgcgcgatagacgtgg

SEQ ID NO: 344127 - DNA, 75 bp, Artificial Sequence
  Synthetic
ggaggagagagttgcgctgtggacaagggatcttcatccacaatgatgttgaagcgtgggtcgaccggtacaaat

SEQ ID NO: 344128 - DNA, 75 bp, Artificial Sequence
  Synthetic
gaagcgtgggtcgaccggtacaaattcatgcctgaaacaccaaaacaactggcaaaggtcatcgagcaagcccac

SEQ ID NO: 344129 - DNA, 75 bp, Artificial Sequence
  Synthetic
gtgggagaacatcagagatgaactcaacaccctccttagagagaatgcagtagacctaagtgtcgtggttgagaa

SEQ ID NO: 344130 - DNA, 75 bp, Artificial Sequence
  Synthetic
gccaaaaggaatgtacaaatcagcaccgcagagactggcactcacgtctgaagagtttgagattgggtggaaggc

SEQ ID NO: 344131 - DNA, 75 bp, Artificial Sequence
  Synthetic
ctggggaaagagtttggtgttcgcaccagaactggccaaccacacttttgtggttgatgggcctgagactaaaga

SEQ ID NO: 344132 - DNA, 75 bp, Artificial Sequence
  Synthetic
acgtcatccgtggcaattggttggctggagcctctatagcctggaccctgattaagaacgctgacaaaccggcct

SEQ ID NO: 344133 - DNA, 75 bp, Artificial Sequence
  Synthetic
atgccccgacgtaaaaagagcttggaacagtcttgagattgaagactttggattcggcatcatgtccaccagggt

SEQ ID NO: 344134 - DNA, 75 bp, Artificial Sequence
  Synthetic
gcaaacgaggaagaccaggaggaaggacactgggtgaacagtggaaggagaagctgaatgggctcagcagggagg

SEQ ID NO: 344135 - DNA, 75 bp, Artificial Sequence
  Synthetic
gattcggcatcatgtccaccagggtttggctgaaagtcagagaatacaacactaccgactgcgacagctcaataa

SEQ ID NO: 344136 - DNA, 75 bp, Artificial Sequence
  Synthetic
aagaagtcagaggctacacgaaaggaggacctggacatgaggaaccgatgctaatgcaaagctatggttggaacc

SEQ ID NO: 344137 - DNA, 75 bp, Artificial Sequence
  Synthetic
catggaggctcgagagagctgtctttggagagatcaaatcatgcacgtggcctgagacacacactctttggagtg

SEQ ID NO: 344138 - DNA, 75 bp, Artificial Sequence
  Synthetic
atggtgttgttgagagtgatctggttgtgccagtcaccctcgccgggccaaaaagcaatcacaaccggcgtgaag

SEQ ID NO: 344139 - DNA, 75 bp, Artificial Sequence
  Synthetic
ggaagaacaacgcactctgaggattctggaaatggtctctgattggctgcagagaggaccaaaagagttttgcat

SEQ ID NO: 344140 - DNA, 75 bp, Artificial Sequence
  Synthetic
aaaagcaatcacaaccggcgtgaaggttacaaagtccagagccaagggccgtgggatgaagaagacatcattctc

SEQ ID NO: 344141 - DNA, 75 bp, Artificial Sequence
  Synthetic
gaagagaggaccctccataagaactaccactagcagtggtagattggtcacagactggtgttgtcggagctgcac

SEQ ID NO: 344142 - DNA, 75 bp, Artificial Sequence
  Synthetic
aaaaatggatgttggtatggaatggagataagacccatgaagcatgatgagacgacgctggtaaagtccagcgtt

SEQ ID NO: 344143 - DNA, 75 bp, Artificial Sequence
  Synthetic
ccgaccggttcagcaagctccttggtcaacggagtcgtccgcttaatgagcaagccctgggatgcaattcttaat

SEQ ID NO: 344144 - DNA, 75 bp, Artificial Sequence
  Synthetic
tttttaaaatccaaccaggctttctcacaatgacatttcttaggggaaagtggacgaatcaagagaacatcctgc

SEQ ID NO: 344145 - DNA, 75 bp, Artificial Sequence
  Synthetic
tggctctgggggcagcattctttcagatggcggccactgatttgaacttctctttcccaggaattctcaatgcca

SEQ ID NO: 344146 - DNA, 75 bp, Artificial Sequence
  Synthetic
tctttcccaggaattctcaatgccactgccacggcttggatgctcctgagggctgccacccagccatctacttct

SEQ ID NO: 344147 - DNA, 75 bp, Artificial Sequence
  Synthetic
aatgtacgcagatgacacagccggctgggacacccggataaccagagctgatcttgacaatgaggccaaagtttt

SEQ ID NO: 344148 - DNA, 75 bp, Artificial Sequence
  Synthetic
tattggctcctggcatgagactgctctacctggacacgtatagaatcactctcatcatcatcggcatttgcagcc

SEQ ID NO: 344149 - DNA, 75 bp, Artificial Sequence
  Synthetic
ctagggttagcactaacatcaacagggcagttttctgcgtcggttatggcagctggactcatggcatgcaatccc

SEQ ID NO: 344150 - DNA, 75 bp, Artificial Sequence
  Synthetic
gatggcagtttcttacaccatttcaggcaagtcgacagacttgtggcttgagagagcagctgacataacatggga

SEQ ID NO: 344151 - DNA, 75 bp, Artificial Sequence
  Synthetic
agagagcagctgacataacatgggaaactgatgcagccataaccggaaccagccaacgcttagatgtaaaactgg

SEQ ID NO: 344152 - DNA, 75 bp, Artificial Sequence
  Synthetic
cgattggcagcaagtgcctttctgctcaaaccattttcaggaattgatcatgaaggacggaaggactttggtggt

SEQ ID NO: 344153 - DNA, 75 bp, Artificial Sequence
  Synthetic
taggattcgcagcctggacgccatgggcaataatacctgccggaataggctattggctcactgtcaaatacgcaa

SEQ ID NO: 344154 - DNA, 75 bp, Artificial Sequence
  Synthetic
aaagaggaggtgtcttttgggacaccccggctccaaggacataccccaagggtgacacttcaccaggagtatacc

SEQ ID NO: 344155 - DNA, 75 bp, Artificial Sequence
  Synthetic
ggtgacacttcaccaggagtataccgtatcatgagccgttacattctagggacctaccaggctggggtgggcgtc

SEQ ID NO: 344156 - DNA, 75 bp, Artificial Sequence
  Synthetic
taaccaaatgtgtaatgtaatttagttgtgaatatttgattgtgtagctttatttagtatcattttaggatagta

SEQ ID NO: 344157 - DNA, 75 bp, Artificial Sequence
  Synthetic
actccctactggggcagtgtaaaagaagacaggatcacctatggtggaccatggaagtttgacagaaagtggaat

SEQ ID NO: 344158 - DNA, 75 bp, Artificial Sequence
  Synthetic
atggaagtttgacagaaagtggaatggtctcgatgatgtccagctcatcatagtggcccccggaaaggcagccat

SEQ ID NO: 344159 - DNA, 75 bp, Artificial Sequence
  Synthetic
aaacattcaaaccaaaccaggtgtcttcaaaacgccacaaggggaaataggagcagtcagcttggactatcctga

SEQ ID NO: 344160 - DNA, 75 bp, Artificial Sequence
  Synthetic
cccctcagaaccgtttcggagagggaccctgcttattggaagcgtccagcccgtgtcaggccgcaaagcgccact

SEQ ID NO: 344161 - DNA, 75 bp, Artificial Sequence
  Synthetic
ttcaaaacgccacaaggggaaataggagcagtcagcttggactatcctgaagggacttcaggctccccaatattg

SEQ ID NO: 344162 - DNA, 75 bp, Artificial Sequence
  Synthetic
tgggttatcaaagccgaaaggcccccacggcccaagcgaacagacggtgatgcgaactgttcgtggaaggactag

SEQ ID NO: 344163 - DNA, 75 bp, Artificial Sequence
  Synthetic
gtgcaaggggaaagagaagaagaacccgttcctgaagcgtacaatgcagacatgctaagaaagaagcaactaaca

SEQ ID NO: 344164 - DNA, 75 bp, Artificial Sequence
  Synthetic
gttttggacctgcatccaggagcgggaaagaccaggaggatactcccccagatcatcaaagatgccattcagcgc

SEQ ID NO: 344165 - DNA, 75 bp, Artificial Sequence
  Synthetic
cgcctccgcacggctgtgttggctccgacccgtgtggtggctgcagaaatggctgaggctctcaagggccttccg

SEQ ID NO: 344166 - DNA, 75 bp, Artificial Sequence
  Synthetic
gtccgatacttgaccccagcggtcaatagagagcatagcggcacagagatagtggatgttatgtgtcatgctact

SEQ ID NO: 344167 - DNA, 75 bp, Artificial Sequence
  Synthetic
ctaacctacagactcatgtcacctctaagagttccaaactacaacctctttgtgatggatgaagccgacttcact

SEQ ID NO: 344168 - DNA, 75 bp, Artificial Sequence
  Synthetic
gatccagcgagcatagcagcacgaggctatattgccacaaaagttgagttgggcgaagcggcagcaatattcatg

SEQ ID NO: 344169 - DNA, 75 bp, Artificial Sequence
  Synthetic
actgcaactccccctggtactcacgatccgttcccagacaccaatgcaccagtcacagacatacaagctgaggtg

SEQ ID NO: 344170 - DNA, 75 bp, Artificial Sequence
  Synthetic
cccgacagagcctggagtagtggatttgagtggataacagaatacaccgggaaaaccgtctggtttgttgctagt

SEQ ID NO: 344171 - DNA, 75 bp, Artificial Sequence
  Synthetic
gtgaagatgggaaatgagattgcacagtgtcttcaaagagcgggaaagaaggtcatccaactcaaccgcaagtct

SEQ ID NO: 344172 - DNA, 75 bp, Artificial Sequence
  Synthetic
gcgaactttggggccagcagggtcattgactgccggaaaagcgtaaaacccaccattctggaggaaggcgaaggg

SEQ ID NO: 344173 - DNA, 75 bp, Artificial Sequence
  Synthetic
agagtgatcttgagcaacccctcaccaatcactagtgctagtgccgcccagaggagaggaagagtaggcagaaat

SEQ ID NO: 344174 - DNA, 75 bp, Artificial Sequence
  Synthetic
cctagtcagataggtgatgagtaccactatggaggaagcacaagcgaagatgacacgattgcggctcattggact

SEQ ID NO: 344175 - DNA, 75 bp, Artificial Sequence
  Synthetic
actatggaggaagcacaagcgaagatgacacgattgcggctcattggactgaagcaaagatcatgttagacaaca

SEQ ID NO: 344176 - DNA, 75 bp, Artificial Sequence
  Synthetic
gatggacccaggtcaaacgtcatcctggaagacaacaatgaagtcgaaattgtcacccgcacaggtgagcgcaag

SEQ ID NO: 344177 - DNA, 75 bp, Artificial Sequence
  Synthetic
tggaagacaacaatgaagtcgaaattgtcacccgcacaggtgagcgcaagatgctgaagccacgctggctagatg

SEQ ID NO: 344178 - DNA, 75 bp, Artificial Sequence
  Synthetic
cagacactcgaagcggagtcggcggtcgattgcggtgcagacgcacggggagagtatgctggctaacaagaagga

SEQ ID NO: 344179 - DNA, 75 bp, Artificial Sequence
  Synthetic
tgagcacttcgctggcaaaaccagagaggcttttgacaccatgtatctggtggcgacagccgagaagggaggaaa

SEQ ID NO: 344180 - DNA, 75 bp, Artificial Sequence
  Synthetic
gaggcttttgacaccatgtatctggtggcgacagccgagaagggaggaaaagcccaccgcatggctcttgaagag

SEQ ID NO: 344181 - DNA, 75 bp, Artificial Sequence
  Synthetic
aaagggtcgtttttgtcgttctcttacttcttgtggcgcctgcttacagcttcaactgccttggcatgagcaaca

SEQ ID NO: 344182 - DNA, 75 bp, Artificial Sequence
  Synthetic
gttcagaggagaggcataggtaagttggggcttggtggcatggtgctaggcttagccactttcttcttgtggatg

SEQ ID NO: 344183 - DNA, 75 bp, Artificial Sequence
  Synthetic
gctgacgtctcaggcaccaagatcgcaggaactttattgctggctttactcatgatgatagtgttgatccctgaa

SEQ ID NO: 344184 - DNA, 75 bp, Artificial Sequence
  Synthetic
cctgaaaagcaacgatcccaaacggacaaccagcttgctgtgtttctgatctgtgtcttgctggtagtgggagtg

SEQ ID NO: 344185 - DNA, 75 bp, Artificial Sequence
  Synthetic
gcaaaggaagtatagacacgtgcgccaacttcacctgctccctgaaagcgacgggccggatgattcaaccggaaa

SEQ ID NO: 344186 - DNA, 75 bp, Artificial Sequence
  Synthetic
gtggctgcaaatgaatacggaatgttagagagaacaaaaagtgatcttgggaaaatgttctccagcacacgtcaa

SEQ ID NO: 344187 - DNA, 75 bp, Artificial Sequence
  Synthetic
ccacagagtgctctgccgctacattccatgaacgctttggcattggatttgcgaccagcaacagcgtgggcccta

SEQ ID NO: 344188 - DNA, 75 bp, Artificial Sequence
  Synthetic
atcagaatacatcacaacatctctggcatcaataagcgctcaggctgggtcgttgttcaccctaccccgcggact

SEQ ID NO: 344189 - DNA, 75 bp, Artificial Sequence
  Synthetic
ccccttcacggagctggacttgacagtggtcttggtctttttgggatgctggggccaggtgtcgttaacaactct

SEQ ID NO: 344190 - DNA, 75 bp, Artificial Sequence
  Synthetic
ggggccaggtgtcgttaacaactctgattactgcggcagctctggctaccctccactatggctacatgctgcctg

SEQ ID NO: 344191 - DNA, 75 bp, Artificial Sequence
  Synthetic
ggctcaacggagaacagcggccggaatcatgaaaaatgccgtggtagatggcttggtggctacggatgttcctga

SEQ ID NO: 344192 - DNA, 75 bp, Artificial Sequence
  Synthetic
attggagagaaccaccccccttatgcaaaagaaggtaggccagattttactgattggggtcagcgcggcggcatt

SEQ ID NO: 344193 - DNA, 75 bp, Artificial Sequence
  Synthetic
caaaagaaggtaggccagattttactgattggggtcagcgcggcggcattgttagttaacccgtgtgttacaaca

SEQ ID NO: 344194 - DNA, 75 bp, Artificial Sequence
  Synthetic
gcaaacgaggaagaccaggaggaagaacactaggtgagcagtggaaagagaagctgaatgggctcagcagggagg

SEQ ID NO: 344195 - DNA, 75 bp, Artificial Sequence
  Synthetic
ttgggacggctgttaaaggagacatagctgtgcacagtgacctctcctattgtattgaaagccacaagaacacga

SEQ ID NO: 344196 - DNA, 75 bp, Artificial Sequence
  Synthetic
aattcctgaagtacaggaaagaggccatcactgaagtcgaccggtccgcagcccggaaggccaggagggacggga

SEQ ID NO: 344197 - DNA, 75 bp, Artificial Sequence
  Synthetic
gcccggaaggccaggagggacgggaacaaaactggaggacacccggtgtccagaggctcggcaaagctgagatgg

SEQ ID NO: 344198 - DNA, 75 bp, Artificial Sequence
  Synthetic
tggctctgggggcagcattctttcagatggcggccaccgatttgaacttatcccttccaggaattctcaatgcca

SEQ ID NO: 344199 - DNA, 75 bp, Artificial Sequence
  Synthetic
gggaatcatcttctagtgctgaggtggaagaacaacgcactctgaggattttggacatggtctctgattggctgc

SEQ ID NO: 344200 - DNA, 75 bp, Artificial Sequence
  Synthetic
ggaagaacaacgcactctgaggattttggacatggtctctgattggctgcagagaggaccaagagagttctgtat

SEQ ID NO: 344201 - DNA, 75 bp, Artificial Sequence
  Synthetic
gagcagtcagcctggactatcctgaagggacctcaggctccccaatactggacaagaatggcgacatcgtgggct

SEQ ID NO: 344202 - DNA, 75 bp, Artificial Sequence
  Synthetic
ggttcgagtccctctttccagaaattccaaccatgagatgtactgggtcagtggagctgctggcaacattgttca

SEQ ID NO: 344203 - DNA, 75 bp, Artificial Sequence
  Synthetic
ccgttcctgaagcgtacaacgcagacatgctaagaaagaagcagctgacagtgctggaccttcatccaggggcgg

SEQ ID NO: 344204 - DNA, 75 bp, Artificial Sequence
  Synthetic
ggatgttaaccttggaagtggaacaagagctgtcgggaagccccagccacatgccaatcaggagaagattaaagc

SEQ ID NO: 344205 - DNA, 75 bp, Artificial Sequence
  Synthetic
caggattcaaagattgaaagaggagtatgcagccacatggcaccatgacaaggaccacccatatcggacttggac

SEQ ID NO: 344206 - DNA, 75 bp, Artificial Sequence
  Synthetic
acaaatgtatgggccagaaagagacaaagccttcaccatggacggggagtaccggttgagaggagaagagagaaa

SEQ ID NO: 344207 - DNA, 75 bp, Artificial Sequence
  Synthetic
gtgaccactatggcgatgactgacaccactccattcgggcagcagagggtcttcaaagagaaggttgataccaag

SEQ ID NO: 344208 - DNA, 75 bp, Artificial Sequence
  Synthetic
gaaaagaagccaaggttgtgcaccagggaagagttcaagaggaaggtcaacagcaacgctgctttgggtgccatg

SEQ ID NO: 344209 - DNA, 75 bp, Artificial Sequence
  Synthetic
agtgccacacatgcatttacaacatgatggggaagcgtgagaagaagctcggagagtttggcaaagcgaaaggca

SEQ ID NO: 344210 - DNA, 75 bp, Artificial Sequence
  Synthetic
gtcgagccatatggtttatgtggctaggcgccagattcctggagtttgaagccttgggctttctgaacgaggacc

SEQ ID NO: 344211 - DNA, 75 bp, Artificial Sequence
  Synthetic
agtgccacacatgcatttacaacatgatggggaagcgtgagaagaagctcggagagtttggcaaagcaaagggca

SEQ ID NO: 344212 - DNA, 75 bp, Artificial Sequence
  Synthetic
attggttaggaagaaagaattctggaggaggtgttgaagggcttggtgtccaaaagcttggttacattctgcggg

SEQ ID NO: 344213 - DNA, 75 bp, Artificial Sequence
  Synthetic
aggaggtgttgaagggcttggtgtccaaaagcttggttacattctgcgggaaatgagctaccactcaggtgggaa

SEQ ID NO: 344214 - DNA, 75 bp, Artificial Sequence
  Synthetic
aatgtacgcagatgacacggccggctgggacacccggataaccagagctgatcttgacaacgaggccaaggtttt

SEQ ID NO: 344215 - DNA, 75 bp, Artificial Sequence
  Synthetic
atcttgacaacgaggccaaggttttagagctgatggaaggtgagcacagacaactggccagagcaatcattgagc

SEQ ID NO: 344216 - DNA, 75 bp, Artificial Sequence
  Synthetic
agttatgcgacctggcacagatgggaagaccgtcatggatgtgatctcccgagaagaccagagaggaagtggaca

SEQ ID NO: 344217 - DNA, 75 bp, Artificial Sequence
  Synthetic
gattgggcaggaacatttggaaagtcttccccggaaaactaaatacgctgtaagaacctggctctttgagaacgg

SEQ ID NO: 344218 - DNA, 75 bp, Artificial Sequence
  Synthetic
cttccccggaaaactaaatacgctgtaagaacctggctctttgagaacggagaagaaagagtaacccgtatggct

SEQ ID NO: 344219 - DNA, 75 bp, Artificial Sequence
  Synthetic
tccttgccggggtcaggatgaactcattgggagggcgcgagtctcccccggctctggatggaatgtccgggacac

SEQ ID NO: 344220 - DNA, 75 bp, Artificial Sequence
  Synthetic
tcaaaccactttcaggaattgatcatgaaggacggaaggactttggtggttccctgccgaggccaggatgaactc

SEQ ID NO: 344221 - DNA, 75 bp, Artificial Sequence
  Synthetic
taattaaatatgcaatgtaatttagttgtaaatatttgattgcgtagctctatttagtgttgttttaggatagta

SEQ ID NO: 344222 - DNA, 75 bp, Artificial Sequence
  Synthetic
acagaagagatctgaggctgatggcaaacgccatctgctcagcagtccctagcaattggatccccactggcagga

SEQ ID NO: 344223 - DNA, 75 bp, Artificial Sequence
  Synthetic
ggaaaagtatagggactacatgctctcgcttagaagatatgaagaagttagtgtccaagaggacagggttttgta

SEQ ID NO: 344224 - DNA, 75 bp, Artificial Sequence
  Synthetic
aacaagtgtttagggttttacaacttaatcaaatatgtaatgtaatttagttgtaagtatttgattgtgtagctt

SEQ ID NO: 344225 - DNA, 75 bp, Artificial Sequence
  Synthetic
ttgtaagtatttgattgtgtagctttacttagcatcattttaggataatagaagttaagtttgtatttagttatt

SEQ ID NO: 344226 - DNA, 75 bp, Artificial Sequence
  Synthetic
aagctggccgctgatgataggaaagcccctcagaaccgtctcggagagggaccctgcctattggaagcgttcagc

SEQ ID NO: 344227 - DNA, 75 bp, Artificial Sequence
  Synthetic
ccgtgtcaggccgcaaagcgccacttcgccaaggagtgcagcctgtatggccccaggaggactgggttaccaaag

SEQ ID NO: 344228 - DNA, 75 bp, Artificial Sequence
  Synthetic
ccgaaaggcccccacggcccaagcgaacagacggtgatgcgaactgtttcgtggaaggactagaggttagaggag

SEQ ID NO: 344229 - DNA, 75 bp, Artificial Sequence
  Synthetic
gcaaacgaggaagaccaggaggaaggacactgggtgagcaatggaaggagaagctaaacgggctgggcaaggagg

SEQ ID NO: 344230 - DNA, 75 bp, Artificial Sequence
  Synthetic
gctctattccaacatcaaccacaaggcacagagcgccgaaaattgtggctgatggggaactagaccccaggatca

SEQ ID NO: 344231 - DNA, 75 bp, Artificial Sequence
  Synthetic
gctctattccaacatcaaccacaaggcacagagcgccgaaaattgtggctgatggggagcaagaccacaggatct

SEQ ID NO: 344232 - DNA, 75 bp, Artificial Sequence
  Synthetic
aacagccttgagattgaagactttggatttggcatcatgtccaccagggtttggctgaaagtcagagagcacaac

SEQ ID NO: 344233 - DNA, 75 bp, Artificial Sequence
  Synthetic
gctgagttggatgttgattctatgtccattccttttgtgttagccgggctgatggcagtttcttacaccatttca

SEQ ID NO: 344234 - DNA, 75 bp, Artificial Sequence
  Synthetic
gctctattccaacatcaaccacaaggcacagagcgcccaaaattgtggctggtgggggactagaccacaggatct

SEQ ID NO: 344235 - DNA, 75 bp, Artificial Sequence
  Synthetic
gctctattccaacatcaaccacaaggcacagagcgccgaaaattgtggctggtggggggctagaccacaggatct

SEQ ID NO: 344236 - DNA, 75 bp, Artificial Sequence
  Synthetic
gttcagaggagaggcataggtaagctggggcttggcggtatggtgctaggcctagccaccttctttttgtggatg

SEQ ID NO: 344237 - DNA, 75 bp, Artificial Sequence
  Synthetic
gtttggtggctacggatgttcctgagctggagagaaccacccccctcatgcaaaagaaggtaggccagattttac

SEQ ID NO: 344238 - DNA, 75 bp, Artificial Sequence
  Synthetic
taattaaatatgcaatgtaatttagttgtaaatatttgattgtgtagctttgtttagcattgttttagtatagta

SEQ ID NO: 344239 - DNA, 75 bp, Artificial Sequence
  Synthetic
cctagccactttcttcttgtggatggctgacgtctcaggcaccaagatcgcaggaaccctattgctggctctgct

SEQ ID NO: 344240 - DNA, 75 bp, Artificial Sequence
  Synthetic
taattaaatatgcaatgtaatttagttgtaaatatttgattgtgtagctttatttagcattgttattttatttaa

SEQ ID NO: 344241 - DNA, 75 bp, Artificial Sequence
  Synthetic
acggctgtttcaatggtttcctctttaaagctttccaacttccaggggaaagtcatgatgaccatcaacgcgact

SEQ ID NO: 344242 - DNA, 75 bp, Artificial Sequence
  Synthetic
aacttaggtgcggcccaagccgtttccgaagctgtaggaacggtggaaggactagaggttagaggagaccccgca

SEQ ID NO: 344243 - DNA, 75 bp, Artificial Sequence
  Synthetic
tgcctttgtagctgtcctcttgggctggatgttgggaagcaacaatggacaaagggtcgttttcgtcgttctctt

SEQ ID NO: 344244 - DNA, 75 bp, Artificial Sequence
  Synthetic
aaagggtcgttttcgtcgttctcttgcttcttgtggcgcctgcttacagcttcaactgccttggcatgagcaaca

SEQ ID NO: 344245 - DNA, 75 bp, Artificial Sequence
  Synthetic
caacttcacctgctccctgaaagcggtgggccggatgatccaaccggaaaatgttaagtatgaagtgggaatctt

SEQ ID NO: 344246 - DNA, 75 bp, Artificial Sequence
  Synthetic
aagaaacgggttgaacactgaggcatactacatcatgtcagtgggtaccaaacacttccttgttcatagagaatg

SEQ ID NO: 344247 - DNA, 75 bp, Artificial Sequence
  Synthetic
aggagctgttccagtgtctttcttgggcagtgtcaagctcacatctggtcatctcaagtgccgagtcaagatgga

SEQ ID NO: 344248 - DNA, 75 bp, Artificial Sequence
  Synthetic
cttttgcaaaaaatccggctgacacgggtcacggcactgtggtacttgaactgcagtacacgggatccgatggac

SEQ ID NO: 344249 - DNA, 75 bp, Artificial Sequence
  Synthetic
attggtagaatggttacagcaaacccttatgtggcttcatccgaagccaacgcgaaagtgctggttgagatggaa

SEQ ID NO: 344250 - DNA, 75 bp, Artificial Sequence
  Synthetic
agctccattggaaaagcgttcatcactactatcaaaggagcacagcgtctagctgccctaggtgacacagcgtgg

SEQ ID NO: 344251 - DNA, 75 bp, Artificial Sequence
  Synthetic
gactttgggtcggtcggagggattttcaattctgtagggaaggcggtacatcaggtctttggaggagccttcaga

SEQ ID NO: 344252 - DNA, 75 bp, Artificial Sequence
  Synthetic
agatgttggcctgtgtgagctctactacttagtattgttttggaggatcgttagattaatacagtgttgacagtt

SEQ ID NO: 344253 - DNA, 75 bp, Artificial Sequence
  Synthetic
actctctttggtggcatgtcctggatcacccagggtctaatgggagctttgcttctgtggatgggggtgaatgcg

SEQ ID NO: 344254 - DNA, 75 bp, Artificial Sequence
  Synthetic
tctttgagcgttgattttcaatgtctaagaaaccaggagggcccggtcgaaaccgggccgtcaatatgctaaaac

SEQ ID NO: 344255 - DNA, 75 bp, Artificial Sequence
  Synthetic
gcggcataccccgcgtattcccattagtgggagtgaagagggtagttatgagcttgttggacgggaggggcccag

SEQ ID NO: 344256 - DNA, 75 bp, Artificial Sequence
  Synthetic
gactcgggatgtgcgatagacgtgggaaggagagagttgcgctgtggacaagggatcttcatccacaatgatgtt

SEQ ID NO: 344257 - DNA, 75 bp, Artificial Sequence
  Synthetic
tgcgatttgtgctggctctcctagcgttcttcaagttcacagcgcttgccccgacaaaggctcttctgggccgtt

SEQ ID NO: 344258 - DNA, 75 bp, Artificial Sequence
  Synthetic
gaagcgtgggtcgaccggtacaaatttatgcctgaaacaccaaaacagctggcaaaggtcattgagcaagcccac

SEQ ID NO: 344259 - DNA, 75 bp, Artificial Sequence
  Synthetic
ggaagcgcatcaacaagaccacggccatgaaacacctgaccagctttaagaaagaactaggcaccatgatcaacg

SEQ ID NO: 344260 - DNA, 75 bp, Artificial Sequence
  Synthetic
ccgtttcacgtctggaacacgtgatgtgggagaacatcagagacgaactcaataccctcctcagagagaatgcag

SEQ ID NO: 344261 - DNA, 75 bp, Artificial Sequence
  Synthetic
tggttaacaaccggggcacaaaaaagaagagaagttccaatggaccgagcctggctatgattgtggcactgatga

SEQ ID NO: 344262 - DNA, 75 bp, Artificial Sequence
  Synthetic
aataccctcctcagagagaatgcagtagatctaagtgtcgtggttgagaagccgaaaggaatgtacagatcagca

SEQ ID NO: 344263 - DNA, 75 bp, Artificial Sequence
  Synthetic
cagctgtttccatggttgcctcattgaagctttccaatttccaagggaagatcatgatgaccatcaacgcgaccg

SEQ ID NO: 344264 - DNA, 75 bp, Artificial Sequence
  Synthetic
acctatcggatgtcatcgtcattccaactcagcgagggaacaaccgatgctgggtgagagcaatggatgtgggct

SEQ ID NO: 344265 - DNA, 75 bp, Artificial Sequence
  Synthetic
aagagtttgagattgggtggaaggcttggggaaagagcttggtgttcgcaccagaattggccaaccacactttcg

SEQ ID NO: 344266 - DNA, 75 bp, Artificial Sequence
  Synthetic
acatgtgtgaggacaccatcacttatgaatgccctaagctggacgaaggaaatgatccagaggatattgactgct

SEQ ID NO: 344267 - DNA, 75 bp, Artificial Sequence
  Synthetic
ggtgcgataagcagccaatgtatgtccactatgggagatgcacccgaaccagacattcaaaacggagccgtcgtt

SEQ ID NO: 344268 - DNA, 75 bp, Artificial Sequence
  Synthetic
ccataacggtgcaggcccatggcgagagtatgttggccaacaaaaagaacgcatggctggactcgaccaaggctt

SEQ ID NO: 344269 - DNA, 75 bp, Artificial Sequence
  Synthetic
caaggtacttgatgaaaactgagaattggattatcagaaaccccggatacgccctagtggctgtcttgttaggtt

SEQ ID NO: 344270 - DNA, 75 bp, Artificial Sequence
  Synthetic
aaataagacccatgaagcatgatgagacgacgttggtaaaatccagcgtcagtgcctaccggagtgacatgattg

SEQ ID NO: 344271 - DNA, 75 bp, Artificial Sequence
  Synthetic
ggatgcttgggagcaacaacggtcagcggatcatcttcaccattcttttgctcctagttgcaccagcgtacagtt

SEQ ID NO: 344272 - DNA, 75 bp, Artificial Sequence
  Synthetic
agtgcctaccggagtgacatgattgatccttttcagttgggccttctggtgatgtttctggccacccaggaggtc

SEQ ID NO: 344273 - DNA, 75 bp, Artificial Sequence
  Synthetic
ttaactgtctcgggatgagcaacagagatttcctggagggggtttctggggcaacttgggtggacgtggttctgg

SEQ ID NO: 344274 - DNA, 75 bp, Artificial Sequence
  Synthetic
attacttacactgacctgcttaggtatgttcttctggttggggcggccttcgccgaagccaacagcgggggtgac

SEQ ID NO: 344275 - DNA, 75 bp, Artificial Sequence
  Synthetic
cgccgaagccaacagcgggggtgacgtcgtccatctagctctcatagccgcctttaaaattcaaccaggctttct

SEQ ID NO: 344276 - DNA, 75 bp, Artificial Sequence
  Synthetic
aaggggacagttgcatcactatcatggccaaagacaaaccgaccattgacatcagaatgatggagactgaagcca

SEQ ID NO: 344277 - DNA, 75 bp, Artificial Sequence
  Synthetic
cctttaaaattcaaccaggctttctcgcaatgacatttctgaggggaaagtggacaaaccaagagaacattctgc

SEQ ID NO: 344278 - DNA, 75 bp, Artificial Sequence
  Synthetic
cgaacttggctgaggtcaggagctattgctacttggccactgtgtctgatgtttccaccgtttcgaattgtccca

SEQ ID NO: 344279 - DNA, 75 bp, Artificial Sequence
  Synthetic
caactggggaagctcacaaccctaagagagctgaaggcacctatgtttgcaagagtggcgtcacagacaggggtt

SEQ ID NO: 344280 - DNA, 75 bp, Artificial Sequence
  Synthetic
ggggaaacggatgcggtttgtttggcaaaggaagcatcgacacgtgtgccaactttacctgctccttgaaggctg

SEQ ID NO: 344281 - DNA, 75 bp, Artificial Sequence
  Synthetic
gccatcgtcatgcccttgctttgcctgctagctcctggcatgagactgctctacctggacacgtacagaatcact

SEQ ID NO: 344282 - DNA, 75 bp, Artificial Sequence
  Synthetic
ttggtaggatgattcaaccagaaaatgtgaagcatgaagtgggagtctttatacatggttccaccagctctgact

SEQ ID NO: 344283 - DNA, 75 bp, Artificial Sequence
  Synthetic
ctcatggcaactattcatcccaaagaggagcctcccaggcaggaagattcgtcataactctgaactctccagcta

SEQ ID NO: 344284 - DNA, 75 bp, Artificial Sequence
  Synthetic
tcacggtcaagatgggggactatggggaaatagcagttgaatgcgaacccagaaatggtttgaacacagaatcct

SEQ ID NO: 344285 - DNA, 75 bp, Artificial Sequence
  Synthetic
gctgaattggatgttgattccatgtccattccttttgtattggccgggctgatggcagtttcttacaccatctca

SEQ ID NO: 344286 - DNA, 75 bp, Artificial Sequence
  Synthetic
actacatcatgtcagtgggttccaagcactttctggtgcacagagaatggttcaatgacttggcccttccttgga

SEQ ID NO: 344287 - DNA, 75 bp, Artificial Sequence
  Synthetic
atgatgatggtgacttccaccttattaacgaccctggagtgccgtggaagatatgggtcatccgcatgacggcac

SEQ ID NO: 344288 - DNA, 75 bp, Artificial Sequence
  Synthetic
atatgggtcatccgcatgacggcactgggattcgcagcctggacaccatgggcaataatacctgctggaataggc

SEQ ID NO: 344289 - DNA, 75 bp, Artificial Sequence
  Synthetic
catcaccagctagttccaactggaggaacagagagttgctgcttgagtttgaggagccccatgcaacaaaacaat

SEQ ID NO: 344290 - DNA, 75 bp, Artificial Sequence
  Synthetic
ccgttgtggcacttggctcgcaggaaggagccttgcatcaggctttggcaggcgctgttccagtaacgttttctg

SEQ ID NO: 344291 - DNA, 75 bp, Artificial Sequence
  Synthetic
aaagaggaggcgtcttttgggacaccccggctccaaggacttatcccaagggtgacacttcaccaggagtatacc

SEQ ID NO: 344292 - DNA, 75 bp, Artificial Sequence
  Synthetic
gaagtgtcaaactcacttccggccacttgaaatgccgagtgaagatggaaaagctaacactgaaagggacaacct

SEQ ID NO: 344293 - DNA, 75 bp, Artificial Sequence
  Synthetic
acggcatgtgcacaaagaagttctcatttgcaaaaaatccagctgacactggacacggcacagttgttttggaac

SEQ ID NO: 344294 - DNA, 75 bp, Artificial Sequence
  Synthetic
tccagtacacaggagtggatgggccatgtaagattccaatttctattgtggcatcactttcagacctcactccca

SEQ ID NO: 344295 - DNA, 75 bp, Artificial Sequence
  Synthetic
taggcaggatggtaacggcgaatccttatgtggcatcttcagaggccaattcaaaagtgctggttgagatggaac

SEQ ID NO: 344296 - DNA, 75 bp, Artificial Sequence
  Synthetic
gacaagaatggcgacatcgtgggcttgtacgggaatggagtcatcttgggcaacggctcgtatgtcagtgccatc

SEQ ID NO: 344297 - DNA, 75 bp, Artificial Sequence
  Synthetic
ctccattcggtgactcattcatcgtggttggaagaggtgacaagcagatcaatcaccattggcacaaggcaggta

SEQ ID NO: 344298 - DNA, 75 bp, Artificial Sequence
  Synthetic
gctccataggaaaagccttcgtcacaaccataaagggagcccaaagattagcagcgctgggtgacacggcttggg

SEQ ID NO: 344299 - DNA, 75 bp, Artificial Sequence
  Synthetic
ctgttcctgaagcgtacaacgcagacatgctaagaaagaagcagctgacagtgttggacttgcatccaggagcgg

SEQ ID NO: 344300 - DNA, 75 bp, Artificial Sequence
  Synthetic
actttgggtccgttggaggaatcttcaactctgtggggaaagccgttcaccaagtctttggaggggcgtttagaa

SEQ ID NO: 344301 - DNA, 75 bp, Artificial Sequence
  Synthetic
cgttgtttggaggcatgtcctggataacccaaggactgatgggagtgttgttgctgtggatgggagtgaatgcaa

SEQ ID NO: 344302 - DNA, 75 bp, Artificial Sequence
  Synthetic
gagaccggtccattgctctggtaatgctggctaccggtggagttttgctcttcctagctaccaatgttcatgctg

SEQ ID NO: 344303 - DNA, 75 bp, Artificial Sequence
  Synthetic
tgtgatggatgaggctcacttcactgacccagcgagcatagcagcacgaggctacattgccacaaaagttgagtt

SEQ ID NO: 344304 - DNA, 75 bp, Artificial Sequence
  Synthetic
gacccagcgagcatagcagcacgaggctacattgccacaaaagttgagttgggcgaagcggcagcaatatttatg

SEQ ID NO: 344305 - DNA, 75 bp, Artificial Sequence
  Synthetic
actccggatgtgcaatcgatgttggaaggagagaactgcggtgcggacaaggaatattcattcacaatgatgttg

SEQ ID NO: 344306 - DNA, 75 bp, Artificial Sequence
  Synthetic
aggcctggatcgaccgctacaagttcatgcccggaaccccgaaacaattggccaaagtcatcgaacaggctcatg

SEQ ID NO: 344307 - DNA, 75 bp, Artificial Sequence
  Synthetic
cgaagggaatctgcggacttagatcggtttcacgtctagagcatgtgatgtgggagaacatcagggatgaactca

SEQ ID NO: 344308 - DNA, 75 bp, Artificial Sequence
  Synthetic
gtgaagatgggaaatgagattgcacagtgtcttcagagagcggggaaaaaggtcattcaactcaaccgtaagtcc

SEQ ID NO: 344309 - DNA, 75 bp, Artificial Sequence
  Synthetic
acacccttctcatggaaaacgcagtggaccttagcgttgtggttgaaaagcaaaaagggatgtacaaatctgctc

SEQ ID NO: 344310 - DNA, 75 bp, Artificial Sequence
  Synthetic
cacaaagattggccctcacctcagaagaatttgaaataggctggaaggcttgggggaaaagcttggtttttgctc

SEQ ID NO: 344311 - DNA, 75 bp, Artificial Sequence
  Synthetic
gcgaactttggggctagcagagtcattgactgccggaaaagcgtgaaacccaccattttggaggaaggcgatggg

SEQ ID NO: 344312 - DNA, 75 bp, Artificial Sequence
  Synthetic
ctgagctagctaaccacacgtttgtggttgacggtccagagaccaaagaatgtcctgatggaagaagggcctgga

SEQ ID NO: 344313 - DNA, 75 bp, Artificial Sequence
  Synthetic
gaggagagggagagtaggtagaaatcctagtcagataggtgatgagtaccactacggaggaggcacaaacgaaga

SEQ ID NO: 344314 - DNA, 75 bp, Artificial Sequence
  Synthetic
acagcctcgaaatcgaagactttggattcggcattatgtccaccagggtttggctgcgggtgcgagaacacaaca

SEQ ID NO: 344315 - DNA, 75 bp, Artificial Sequence
  Synthetic
ccactgaatgtgacagctcaataattggaacggcagtgaaaggtgatgtggcagtccacagtgatctctcttact

SEQ ID NO: 344316 - DNA, 75 bp, Artificial Sequence
  Synthetic
accggctgagaggagaggagagaaagaccttcctggagttgttgaggactgcggacctgccagtgtggcttgctt

SEQ ID NO: 344317 - DNA, 75 bp, Artificial Sequence
  Synthetic
ggattgaaagccacaagaacgctacatggaggttagagagagctgtgtttggagagataaaatcatgcacctggc

SEQ ID NO: 344318 - DNA, 75 bp, Artificial Sequence
  Synthetic
tggaagacaacaatgaagtcgaaattgtcacccgcacaggtgaacgcaagatgctgaagccacgctggttagatg

SEQ ID NO: 344319 - DNA, 75 bp, Artificial Sequence
  Synthetic
ctgagacccacaccctctggagtgatggggtcactgagagtgatctcattgtgccaatcacactggctggaccca

SEQ ID NO: 344320 - DNA, 75 bp, Artificial Sequence
  Synthetic
ccagggtctacgctgaccatcaatcgctcaagtggttcaaggactttgcggctggcaagcgatcagcagtgggat

SEQ ID NO: 344321 - DNA, 75 bp, Artificial Sequence
  Synthetic
gaagcaaccacaaccgacgagatggctacaaggtgcaaactcagggaccttgggatgaggaagacatcactcttg

SEQ ID NO: 344322 - DNA, 75 bp, Artificial Sequence
  Synthetic
attttgactactgtcccggcaccacggtcaccatcacggagacttgcgggaaaagaggtccttccatcagaacga

SEQ ID NO: 344323 - DNA, 75 bp, Artificial Sequence
  Synthetic
tggcgacagcggagaagggaggaaaagcccaccgtatggcccttgaagagttgccggacgctcttgagactataa

SEQ ID NO: 344324 - DNA, 75 bp, Artificial Sequence
  Synthetic
cgaccaatagtggtcgcctggtcacagactggtgctgtaggagttgcactcttcctcccctgaggtatagaacga

SEQ ID NO: 344325 - DNA, 75 bp, Artificial Sequence
  Synthetic
agaatggatgttggtatgggatggagattaggcctatgaagcatgatgaaactaccctggtcaagtcaaatgtca

SEQ ID NO: 344326 - DNA, 75 bp, Artificial Sequence
  Synthetic
acgccctgcgaggcgacatgattgacccttttcagctgggccttctggtgatgtttctggccacccaggaggtcc

SEQ ID NO: 344327 - DNA, 75 bp, Artificial Sequence
  Synthetic
gtggctgccaatgaatacggaatgttagagagaacaaaaagtgaccttgggaaaatgttctccagcacacgtcaa

SEQ ID NO: 344328 - DNA, 75 bp, Artificial Sequence
  Synthetic
tgaggaagaggtggacggccagactgactgttccggctattgtgtgggctctgctcgtgctgttacttgggggca

SEQ ID NO: 344329 - DNA, 75 bp, Artificial Sequence
  Synthetic
tagagagaacaaaaagtgaccttgggaaaatgttctccagcacacgtcaaccacagaatgctttgccgctaccct

SEQ ID NO: 344330 - DNA, 75 bp, Artificial Sequence
  Synthetic
ttacttacactgacctgttaaggtatgtccttttggttggggcggcattcgctgaagccaatgatggaggtgacg

SEQ ID NO: 344331 - DNA, 75 bp, Artificial Sequence
  Synthetic
tggtgcatttggcactcatagccgccttcaagatccaaccagggtttttagccatgatttttctcagagggaagt

SEQ ID NO: 344332 - DNA, 75 bp, Artificial Sequence
  Synthetic
ggaccaatcaggaaaacattcttctagctttaggtgcggcattcttccaaatggcagcaacagatttgagctttt

SEQ ID NO: 344333 - DNA, 75 bp, Artificial Sequence
  Synthetic
ctctgccaggaatcgtcaatgcaacagcaaccgcctggatgatactgcgggcagccgcccaaccctcaacatcgg

SEQ ID NO: 344334 - DNA, 75 bp, Artificial Sequence
  Synthetic
caaaagaaggtgggccagattctactgattggggtcagcgcggcggcattgttagtcaacccgtgtgtcacaact

SEQ ID NO: 344335 - DNA, 75 bp, Artificial Sequence
  Synthetic
ccgtggtaatgcccctgctttgtttgttggccccaggcatgaggatgctttacctggacacctacaggattaccc

SEQ ID NO: 344336 - DNA, 75 bp, Artificial Sequence
  Synthetic
ttgtcatcattggaatttgcagcctcatagcagagcgtcgtcggtcagccgccaagaaaaaaggggccattttga

SEQ ID NO: 344337 - DNA, 75 bp, Artificial Sequence
  Synthetic
tgggtttggctctcacgtcaacggggcaattttctgcttcagtgatggccgctggactgatggcatgcaacccaa

SEQ ID NO: 344338 - DNA, 75 bp, Artificial Sequence
  Synthetic
aagctgaacgggctcagcaaggaggatttcctgaagtacaggaaagaggccatcactgaagttgaccgttccgca

SEQ ID NO: 344339 - DNA, 75 bp, Artificial Sequence
  Synthetic
acaaaaaacgagggtggccggcaactgaagtcttgacagcaatcgggctgatgttcgccattgtaggaggccttg

SEQ ID NO: 344340 - DNA, 75 bp, Artificial Sequence
  Synthetic
cagagttggacgtggaatccatgtccatcccctttgttttagctgggctcatggcagtgtcgtataccgtatctg

SEQ ID NO: 344341 - DNA, 75 bp, Artificial Sequence
  Synthetic
gcaagtcaacagacctctggcttgaaagagcagcagacatcacatgggagagtgatgcggcgataactgggacca

SEQ ID NO: 344342 - DNA, 75 bp, Artificial Sequence
  Synthetic
gccagcgcttggatgtcaagcttgatgacgatggtgattttcatttgatcaatgaccctggagtgccatggaaga

SEQ ID NO: 344343 - DNA, 75 bp, Artificial Sequence
  Synthetic
tgcgacacgcttttttgtgacattggagaatcatcctccagtgctgaggtggaagaacaacgcactctgaggatc

SEQ ID NO: 344344 - DNA, 75 bp, Artificial Sequence
  Synthetic
tttgggtcatcagaatgactgcactcgggtttgctgcatggacaccttgggcgataataccggctggaataggct

SEQ ID NO: 344345 - DNA, 75 bp, Artificial Sequence
  Synthetic
actggctcacagtgaagtatgctaagagaggaggagtgttctgggacactccagccccgcggacttatccgaagg

SEQ ID NO: 344346 - DNA, 75 bp, Artificial Sequence
  Synthetic
gtgacacctcccccggagtgtatcgtatcatgacccgtcgcattttgggtgcttaccagataggagttggggtca

SEQ ID NO: 344347 - DNA, 75 bp, Artificial Sequence
  Synthetic
tgtatgaaggggttttacacaccctctggcacactacaagaggagcagcaattagaagcggtgagggaaggctca

SEQ ID NO: 344348 - DNA, 75 bp, Artificial Sequence
  Synthetic
ccccatactggggctgcgtgaaagaagataggatcacctatggtgggccatggaagctagacaggaagtggaatg

SEQ ID NO: 344349 - DNA, 75 bp, Artificial Sequence
  Synthetic
ccactccgtttgggcagcagagggttttcaaagaaaaggttgacaccaaggccccagaacccccttctggagtta

SEQ ID NO: 344350 - DNA, 75 bp, Artificial Sequence
  Synthetic
gccccagaacccccttctggagttagagaggtgatggatgagaccaccaattggctgtgggcttttctcgcacga

SEQ ID NO: 344351 - DNA, 75 bp, Artificial Sequence
  Synthetic
gacttgatgatgtgcagctcattgtggtagctcctgggaaagccgctgttaacatccaaacaaagccgggtatct

SEQ ID NO: 344352 - DNA, 75 bp, Artificial Sequence
  Synthetic
ttaagacaccacagggagagattggagcggttagcctggactatccatcaggaacttcaggctccccaatactgg

SEQ ID NO: 344353 - DNA, 75 bp, Artificial Sequence
  Synthetic
tttgaagagcagaaccaatggagcagtgccagggaggctgtagaggacccccggttctgggaaatggtggacgag

SEQ ID NO: 344354 - DNA, 75 bp, Artificial Sequence
  Synthetic
acaagaatggcgacatcgtgggattgtatggaaatggggttgtcctgggaaatggttcctatgtcagtgctattg

SEQ ID NO: 344355 - DNA, 75 bp, Artificial Sequence
  Synthetic
attggttaggaagaaagaattctggaggaggtgttgaagggcttggtgtccaaaaacttggttacattctgcgtg

SEQ ID NO: 344356 - DNA, 75 bp, Artificial Sequence
  Synthetic
tgcaaggtgagagagaagaagaacccctcccggatgcatacaacgcggacatgctgaggaaaaagcagctgactg

SEQ ID NO: 344357 - DNA, 75 bp, Artificial Sequence
  Synthetic
aggaggtgttgaagggcttggtgtccaaaaacttggttacattctgcgtgagatgagtcaccattcaggtgggaa

SEQ ID NO: 344358 - DNA, 75 bp, Artificial Sequence
  Synthetic
tgctggacttgcatccaggagcagggaagactagaagaattcttcctcagatcatcaaagacgccattcagcgtc

SEQ ID NO: 344359 - DNA, 75 bp, Artificial Sequence
  Synthetic
gcttgcgcactgctgtgctggctccgacccgggtcgtggctgccgagatggctgaggctctcaaaggactcccaa

SEQ ID NO: 344360 - DNA, 75 bp, Artificial Sequence
  Synthetic
ttcggtacctaactccagctgtcaaccgggaacacaatggcacagagatcgtggatgtaatgtgccatgccacat

SEQ ID NO: 344361 - DNA, 75 bp, Artificial Sequence
  Synthetic
ggttgtgacctatgctctcaacacattcaccaacattgccgtccagcttatcagactgatggaagctgaaggagt

SEQ ID NO: 344362 - DNA, 75 bp, Artificial Sequence
  Synthetic
tgacccatcggttgatgtctccactgagggttccaaactacaatctctttgtaatggatgaggcccacttcacgg

SEQ ID NO: 344363 - DNA, 75 bp, Artificial Sequence
  Synthetic
acccagcgagcatagccgcaaggggatatattgccaccaaggttgaattgggtgaggcggctgccatattcatga

SEQ ID NO: 344364 - DNA, 75 bp, Artificial Sequence
  Synthetic
cggctactcccccaggctcatacgatccctttccggacactaacgctcctatcacagacattcaaaccgaagtgc

SEQ ID NO: 344365 - DNA, 75 bp, Artificial Sequence
  Synthetic
cagacagagcttggagcagtgggttcgagtggataacagagtacactggaaagacagtttggtttgttgctagcg

SEQ ID NO: 344366 - DNA, 75 bp, Artificial Sequence
  Synthetic
tgaaaataggcaatgaaattgcgcaatgcctccagagagccgggaagagagtaatccagctcaatcggaagtcgt

SEQ ID NO: 344367 - DNA, 75 bp, Artificial Sequence
  Synthetic
cagatgtggctcttgctgtacttccacagaagagatctgaggctgatggcaaatgccatctgctcagcagtccct

SEQ ID NO: 344368 - DNA, 75 bp, Artificial Sequence
  Synthetic
atgacactgagtacccgaagtgcaaaaatggggactgggactttgtggtgacaacagacatctcagagatgggag

SEQ ID NO: 344369 - DNA, 75 bp, Artificial Sequence
  Synthetic
ccaactttggagctagcagggttatcgattgcaggaagagtgtgaaaccaaccattctggaggaaggagaaggga

SEQ ID NO: 344370 - DNA, 75 bp, Artificial Sequence
  Synthetic
aggcacgcgaacacgggcaacgtgggctgaaaacatctacgcggccataaaccaggtgagggccattattggcca

SEQ ID NO: 344371 - DNA, 75 bp, Artificial Sequence
  Synthetic
gagtgattctgggcaacccttcaccaatcactagtgctagcgctgcacagagaaggggaaggataggaaggaacc

SEQ ID NO: 344372 - DNA, 75 bp, Artificial Sequence
  Synthetic
gctgaaaacatctacgcggccataaaccaggtgagggccattattggccaggaaaagtacagggattacatgctt

SEQ ID NO: 344373 - DNA, 75 bp, Artificial Sequence
  Synthetic
cgagccagattggtgatgagtaccactatggaggcggcactagtgaagatgatgccattgctgcacactggattg

SEQ ID NO: 344374 - DNA, 75 bp, Artificial Sequence
  Synthetic
taatcaaatatgaaatgtaatttagttgtaaatatttgattgtgtagctttatctagcattattttaggatagta

SEQ ID NO: 344375 - DNA, 75 bp, Artificial Sequence
  Synthetic
aggccaaaatcatgcttgacaacattcacttgccaaatgggctagtggcccagctgtacggacctgagagggaca

SEQ ID NO: 344376 - DNA, 75 bp, Artificial Sequence
  Synthetic
aggtcttttctatggatggtgaataccggctgcgtggagaagaaagaaagaactttctagaactgctaagaaccg

SEQ ID NO: 344377 - DNA, 75 bp, Artificial Sequence
  Synthetic
cagacctaccagtgtggctggcgtacaaagtagcttcgagcggaatccagtacaccgataggaaatggtgttttg

SEQ ID NO: 344378 - DNA, 75 bp, Artificial Sequence
  Synthetic
atggaccaaggtcaaacgtcatcttggaagacaacaacgaggttgaaatagtcacccgcactggtgagaggagaa

SEQ ID NO: 344379 - DNA, 75 bp, Artificial Sequence
  Synthetic
tgctgaagccacgttggttggatgctagggtttattcggaccatcagtcactcaaatggttcaaggactttgccg

SEQ ID NO: 344380 - DNA, 75 bp, Artificial Sequence
  Synthetic
caggaaagaggtcagcagtggggtttcttgaggtcttgggaaggatgcccgaacactttgctgggaagaccagag

SEQ ID NO: 344381 - DNA, 75 bp, Artificial Sequence
  Synthetic
aggccttcgacaccatgtatctggtggcaacagctgagaaaggaggaaaggcacatcgcatggcacttgaagaac

SEQ ID NO: 344382 - DNA, 75 bp, Artificial Sequence
  Synthetic
taccggatgctttggaaacaatcactttgattgttgcccttgccgtcatgacagcaggagtgtttctcctccttg

SEQ ID NO: 344383 - DNA, 75 bp, Artificial Sequence
  Synthetic
ttcagagaagaggcattggaaaacttggcttgggtggcatgatactgggcttggcaaccttttttctgtggatgg

SEQ ID NO: 344384 - DNA, 75 bp, Artificial Sequence
  Synthetic
ctgacgtgccaggaacaaagattgctggaacactgctactggctttgttgatgatgatagtgttgattccagagc

SEQ ID NO: 344385 - DNA, 75 bp, Artificial Sequence
  Synthetic
ccgaaaagcagcgttctcagacagacaaccagctggctgtatttttaatctgtgtgctgttagtggtaggggttg

SEQ ID NO: 344386 - DNA, 75 bp, Artificial Sequence
  Synthetic
gctctattccaacatcaaccacaaggcacagagcgccgaaaattgtggctgatggtgaacaagaccacaggatct

SEQ ID NO: 344387 - DNA, 75 bp, Artificial Sequence
  Synthetic
tggctgcaaatgagtatggaatgctggagaggacaaagagtgaccttggaaagatattctctcactcgaagcaac

SEQ ID NO: 344388 - DNA, 75 bp, Artificial Sequence
  Synthetic
aaacgactgctctcccacttccttcaatgagcaatttggcacttgatttgaggccggcgacagcttgggcgttgt

SEQ ID NO: 344389 - DNA, 75 bp, Artificial Sequence
  Synthetic
atggtggaagcactgtggttctcactccattgataaaacatttggtgacatcagagtacatcacaacctccctgg

SEQ ID NO: 344390 - DNA, 75 bp, Artificial Sequence
  Synthetic
catcaattagtgcgcaagctggctccctgttcaacctgccccgtgggcttccgttcacagaactggatctcaccg

SEQ ID NO: 344391 - DNA, 75 bp, Artificial Sequence
  Synthetic
ttattctggtttttttagggtgctggggccaggtttcgctgactaccttgatcacagctacggctctggcgactt

SEQ ID NO: 344392 - DNA, 75 bp, Artificial Sequence
  Synthetic
tgcattacgggtacatgctgccaggatggcaagccgaggccttgcgggccgcacagcggaggacggccgcaggga

SEQ ID NO: 344393 - DNA, 75 bp, Artificial Sequence
  Synthetic
atgttaagtatgaagtgggaatcttcatacatggttccaccagctctgacactcacggcaactattcttcacaac

SEQ ID NO: 344394 - DNA, 75 bp, Artificial Sequence
  Synthetic
tcatgaagaacgcggttgtggatggtttggtggctactgacgttccagagttggagagaacaactccccttatgc

SEQ ID NO: 344395 - DNA, 75 bp, Artificial Sequence
  Synthetic
aaaagaaggttggccagattctgctcattggcgtcagtgcggctgctctcttggtgaacccatgtgtgacaaccg

SEQ ID NO: 344396 - DNA, 75 bp, Artificial Sequence
  Synthetic
tgcgggaagctggtattcttatatcagcagcactcctgacactttgggacaacggagccatagccgtttggaatt

SEQ ID NO: 344397 - DNA, 75 bp, Artificial Sequence
  Synthetic
caaccacagcaacgggactttgccatgtcatccgtgggaattggctagccggagcttccatagcctggaccctga

SEQ ID NO: 344398 - DNA, 75 bp, Artificial Sequence
  Synthetic
taaagaatgcagacaaaccagccaacaagcgtggtcgtcccggaggacgaacattgggagaacaatggaaggaaa

SEQ ID NO: 344399 - DNA, 75 bp, Artificial Sequence
  Synthetic
aattgaatgggcttagcaaagaggattttctaaaatatagaaaggaagccatcaccgaagttgaccggacagaag

SEQ ID NO: 344400 - DNA, 75 bp, Artificial Sequence
  Synthetic
cgaggaaagccagaagagatgggaacaagacaggcgggcacccggtttctagggggtcggcgaaattaagatggt

SEQ ID NO: 344401 - DNA, 75 bp, Artificial Sequence
  Synthetic
tcacccagggtctaatgggagctctgcttttatggatgggggtgaatgcgagagatcgatccatcgcactggtga

SEQ ID NO: 344402 - DNA, 75 bp, Artificial Sequence
  Synthetic
tggttgaacggcagtttgtgaaaccagttggaaaagttgtcgacttaggctgtggccgaggaggatggagctact

SEQ ID NO: 344403 - DNA, 75 bp, Artificial Sequence
  Synthetic
atgccgccacgctaaaaggggtccaagaggtcagagggtacacaaaaggaggtcccgggcatgaagaaccaatgc

SEQ ID NO: 344404 - DNA, 75 bp, Artificial Sequence
  Synthetic
tcatgcagagctatggctggaaccttgtcaccatgaaaagcggagtggatgtgtattacaagccatctgagacat

SEQ ID NO: 344405 - DNA, 75 bp, Artificial Sequence
  Synthetic
gtgacacattgctgtgtgacattggggagtcttcctccagcgctgaggttgaggagcagcgcaccttgagagttc

SEQ ID NO: 344406 - DNA, 75 bp, Artificial Sequence
  Synthetic
tggacatggtgactgattggctgcagagaggcccgcaggaattttgcatcaaagtcctctgcccttacatgccga

SEQ ID NO: 344407 - DNA, 75 bp, Artificial Sequence
  Synthetic
gagtaatggagaggctggaaagcttgcaacggcggtacggcggaggactggtcagagtccctctttctagaaact

SEQ ID NO: 344408 - DNA, 75 bp, Artificial Sequence
  Synthetic
caaaccatgagatgtactgggtcagcggagcagctggaaatatcgttcatgcaatcaacatgactagtcaagtgc

SEQ ID NO: 344409 - DNA, 75 bp, Artificial Sequence
  Synthetic
tcataggacgcatggaaaaaagatcatggcatggcccaaaacatgaagaggatgtgaaccttggaagtggaacga

SEQ ID NO: 344410 - DNA, 75 bp, Artificial Sequence
  Synthetic
gagctgtgggaaagccccaaccgcattcgaaccaggacaagataaaagccaggatccaaaggctgaaagatgagt

SEQ ID NO: 344411 - DNA, 75 bp, Artificial Sequence
  Synthetic
acgctgccacatggcaccatgacaaagaccatccgtaccggacttggacctatcatggcagttatgaagtgaaac

SEQ ID NO: 344412 - DNA, 75 bp, Artificial Sequence
  Synthetic
caacaggatcagccagctctctggtcaatggcgtcgtccggctgatgagcaaaccttgggacaccatcctcaatg

SEQ ID NO: 344413 - DNA, 75 bp, Artificial Sequence
  Synthetic
tgacaaccatggccatgactgacaccaccccgtttgggcaacagcgtgtcttcaaagaaaaggttgacaccaagg

SEQ ID NO: 344414 - DNA, 75 bp, Artificial Sequence
  Synthetic
caccagaaccccccgccggggtgaaagaagtgatggatgaaaccaccaattggctatgggcgtatctggcaagag

SEQ ID NO: 344415 - DNA, 75 bp, Artificial Sequence
  Synthetic
agaaaaaaccacgaatgtgcaccagagaagaattcaagaggaaggtcaacagcaatgcagcactgggagccatgt

SEQ ID NO: 344416 - DNA, 75 bp, Artificial Sequence
  Synthetic
atcagaatacatcacaacatctctggcttcaataagcgctcaggctgggtctttgttcaacctaccccgtggact

SEQ ID NO: 344417 - DNA, 75 bp, Artificial Sequence
  Synthetic
tcgaggaacaaaaccagtggagcagcgcccgtgaagcggttgaggaccctcggttttgggcaatggtggatgagg

SEQ ID NO: 344418 - DNA, 75 bp, Artificial Sequence
  Synthetic
gtggtcctggtctttttgggatgttggggccaagtgtcgttaacaaccctgatcactgcggcagctctggctact

SEQ ID NO: 344419 - DNA, 75 bp, Artificial Sequence
  Synthetic
agagagagaaccatctgaaaggagagtgccacacatgtatctacaacatgatgggcaaacgagagaaaaagctgg

SEQ ID NO: 344420 - DNA, 75 bp, Artificial Sequence
  Synthetic
gcgaatttggcaaggcaaaaggaagcagagctatatggttcatgtggctcggggccaggtttctggagtttgagg

SEQ ID NO: 344421 - DNA, 75 bp, Artificial Sequence
  Synthetic
cattgggttttctcaatgaggaccattggctgggtaggaagaactctggtggaggtgtcgaagggctgggagtgc

SEQ ID NO: 344422 - DNA, 75 bp, Artificial Sequence
  Synthetic
agaaactcggatacattctccgggaaatgagccaccattctgggggaaagatgtacgcggatgacacagccggtt

SEQ ID NO: 344423 - DNA, 75 bp, Artificial Sequence
  Synthetic
gggacactcgaatcaccagggcggaccttgacaatgaagcaaaggttttggagttgatggagggtgagcacagac

SEQ ID NO: 344424 - DNA, 75 bp, Artificial Sequence
  Synthetic
tgctggctagggccatcattgaattgacatacaaacacaaggtggtgaaggtcatgcgaccggggactgatggga

SEQ ID NO: 344425 - DNA, 75 bp, Artificial Sequence
  Synthetic
agacagtcatggatgtgatctcgcgagaagaccagagaggaagcgggcaagtggtgacatacgccctgaacacat

SEQ ID NO: 344426 - DNA, 75 bp, Artificial Sequence
  Synthetic
gactaggagatcttctgctctattccaacatcaaccacaaggcacagagcgccgaaaattgtggctggtggggaa

SEQ ID NO: 344427 - DNA, 75 bp, Artificial Sequence
  Synthetic
tcaccaacatcgctgttcaactcatacgcttgatggaagcagaaggtgtgattggccaagagcatttggatagcc

SEQ ID NO: 344428 - DNA, 75 bp, Artificial Sequence
  Synthetic
tccccaggaagacaaaatacgcagtaagaacgtggttgtttgagaaaggagaagagagggtgacccgtatggcgg

SEQ ID NO: 344429 - DNA, 75 bp, Artificial Sequence
  Synthetic
tgagtggagatgactgcgttgtgaagccactggacgaccgattcgccgacgccctgcacttcctgaactccatgt

SEQ ID NO: 344430 - DNA, 75 bp, Artificial Sequence
  Synthetic
cgaaagtcagaaaggatgtcccagaatggaaaccctcatcaggatggcatgactggcagcaagtgcccttttgtt

SEQ ID NO: 344431 - DNA, 75 bp, Artificial Sequence
  Synthetic
gctctattccaacatcaaccacaaggcacagagcgccgaaaattgtggctgatggggaactagaccccaggatct

SEQ ID NO: 344432 - DNA, 75 bp, Artificial Sequence
  Synthetic
ccaaccactttcaagaactgatcatgaaggacggcagaaccctggtggttccctgccgaggacaggatgaactca

SEQ ID NO: 344433 - DNA, 75 bp, Artificial Sequence
  Synthetic
tagggagggcccgagtttctcctggttcaggatggaatgtcagagacactgcatgcttggccaaggcctacgccc

SEQ ID NO: 344434 - DNA, 75 bp, Artificial Sequence
  Synthetic
aaatgtggctactgctgtacttccaccggagggatctgaggctcatggccaacgccatttgctcagcagtcccaa

SEQ ID NO: 344435 - DNA, 75 bp, Artificial Sequence
  Synthetic
gcaactgggtcccaacagggaggacctcatggtctgtgcatgccactggagagtggatgaccacagaagacatgt

SEQ ID NO: 344436 - DNA, 75 bp, Artificial Sequence
  Synthetic
tggaagtgtggaacagggtctggattcaggataacgaatggatgcaggacaaaacgcccgtccagagctggacgg

SEQ ID NO: 344437 - DNA, 75 bp, Artificial Sequence
  Synthetic
aagttccctataccggaaagagagaagacatttggtgcggcagtttgattggcaccagggcacgtgcaacatggg

SEQ ID NO: 344438 - DNA, 75 bp, Artificial Sequence
  Synthetic
ctgagaacatctatgcagccatcaaccaggttagagcaataattggccaagaaaagtacagagattacatgctct

SEQ ID NO: 344439 - DNA, 75 bp, Artificial Sequence
  Synthetic
cactcaggagatatgaggaaactatagtgcaggaagacagggttttgtaaatatgttatagaggagtagtgtagt

SEQ ID NO: 344440 - DNA, 75 bp, Artificial Sequence
  Synthetic
ttgtatgtttattttattagctaagttagttgtttaagtagaataagttgtaaatagtagatgtaaatagaaaaa

SEQ ID NO: 344441 - DNA, 75 bp, Artificial Sequence
  Synthetic
gtggaaggactagaggttagaggagaccccgcatcatgagcatcaaaaaaacagcatattgacacctgggaatta

SEQ ID NO: 344442 - DNA, 75 bp, Artificial Sequence
  Synthetic
agactaggagatcttctgctctattccaacatcaaccacaaggcacagagcgccgaaaattgtggctgatgggga

SEQ ID NO: 344443 - DNA, 75 bp, Artificial Sequence
  Synthetic
attttatttttagtgtaggaatgtcaggccagattttctgccaccggaagttgagtagacggtgctgcctgcgac

SEQ ID NO: 344444 - DNA, 75 bp, Artificial Sequence
  Synthetic
tcaaccccaggcggactgggttaacaaagttggttgctgatgacaggaaagcccctcaataccgtctcggagagg

SEQ ID NO: 344445 - DNA, 75 bp, Artificial Sequence
  Synthetic
acacaaagaccctccaacattaagaatggattacatcaaaatcaaaaaggaagaccttccgccaggtgtcagtcc

SEQ ID NO: 344446 - DNA, 75 bp, Artificial Sequence
  Synthetic
atggattacatcaaaatcaaaaaggaagaccttccgccaggtgtcagtccagagcctagtctttggcagtcaaag

SEQ ID NO: 344447 - DNA, 75 bp, Artificial Sequence
  Synthetic
aagaccttccgccaggtgtcagtccagagcctagtctttggcagtcaaagactatctggcagatgatggacagtg

SEQ ID NO: 344448 - DNA, 75 bp, Artificial Sequence
  Synthetic
ttgtggtgtgggcttttctgtcatggagaattctctggcttggctaattctggatgaagggatcttcacctactt

SEQ ID NO: 344449 - DNA, 75 bp, Artificial Sequence
  Synthetic
gagaattctctggcttggctaattctggatgaagggatcttcacctacttaaaggatgggctttggtacaagcag

SEQ ID NO: 344450 - DNA, 75 bp, Artificial Sequence
  Synthetic
attgcgttgggtggcccttggagagacccaggcctctcatcctcaacatgtatcgttattacaagcatgggctgg

SEQ ID NO: 344451 - DNA, 75 bp, Artificial Sequence
  Synthetic
acccaggcctctcatcctcaacatgtatcgttattacaagcatgggctggttcctcaggacaaacttgctgccat

SEQ ID NO: 344452 - DNA, 75 bp, Artificial Sequence
  Synthetic
ctgtttggagaccagaatccaaaaaaacggaagaaggaaatgaagaagatctccatgggaactgccatcttcagg

SEQ ID NO: 344453 - DNA, 75 bp, Artificial Sequence
  Synthetic
aacggaagaaggaaatgaagaagatctccatgggaactgccatcttcaggacgtatcaggctctgagaaggcagc

SEQ ID NO: 344454 - DNA, 75 bp, Artificial Sequence
  Synthetic
tagtgtaactggaaaaaatctactaacagacattgtcctagtccatgctctcaacatgcaggacagatttctaaa

SEQ ID NO: 344455 - DNA, 75 bp, Artificial Sequence
  Synthetic
acagacattgtcctagtccatgctctcaacatgcaggacagatttctaaaaaggtccactgtgattctgaagaga

SEQ ID NO: 344456 - DNA, 75 bp, Artificial Sequence
  Synthetic
gtgctgaaggcaaaacaaacaagaaggagaaaaaactgaagaaaggccagctcaaattccccttcgaatctgaca

SEQ ID NO: 344457 - DNA, 75 bp, Artificial Sequence
  Synthetic
ggagaaaaaactgaagaaaggccagctcaaattccccttcgaatctgacaaggagaatctgctcctgcctcctca

SEQ ID NO: 344458 - DNA, 75 bp, Artificial Sequence
  Synthetic
aaggctttcccagaagctcgtgctcaaatgctcagcacctcctggggtcctgactggccagcaatccagtccctg

SEQ ID NO: 344459 - DNA, 75 bp, Artificial Sequence
  Synthetic
aaatgctcagcacctcctggggtcctgactggccagcaatccagtccctgtagtgggccgaagcccttttagtag

SEQ ID NO: 344460 - DNA, 75 bp, Artificial Sequence
  Synthetic
ccgaattaaaggggataaaggggttggggggaggggaaggggagggaaaggggagggaggggacatgagaaggga

SEQ ID NO: 344461 - DNA, 75 bp, Artificial Sequence
  Synthetic
ggggggaggggaaggggagggaaaggggagggaggggacatgagaagggagggaggggggatgcagcctacggga

SEQ ID NO: 344462 - DNA, 75 bp, Artificial Sequence
  Synthetic
ctcaaccaccttggtggcttctcctttggcgttgatcagcccaaaggacttcaggtaggcctttttctggtcagc

SEQ ID NO: 344463 - DNA, 75 bp, Artificial Sequence
  Synthetic
ttggcgttgatcagcccaaaggacttcaggtaggcctttttctggtcagctgagaggaaagagctggccagacct

SEQ ID NO: 344464 - DNA, 75 bp, Artificial Sequence
  Synthetic
acatcacctccctggcgctgagacccctgtgcttcacgttgatggtgcgggagaactctaccaagtagagtttgt

SEQ ID NO: 344465 - DNA, 75 bp, Artificial Sequence
  Synthetic
cctgtgcttcacgttgatggtgcgggagaactctaccaagtagagtttgtgagcgtcaatcagggccctgattgt

SEQ ID NO: 344466 - DNA, 75 bp, Artificial Sequence
  Synthetic
agaccagcaaaggcgttgtgcatcatcacagcggggtatccagggctgagctgagtcatcctggagtgggtgaca

SEQ ID NO: 344467 - DNA, 75 bp, Artificial Sequence
  Synthetic
tcacagcggggtatccagggctgagctgagtcatcctggagtgggtgacagcagtgaaattcactacttggggga

SEQ ID NO: 344468 - DNA, 75 bp, Artificial Sequence
  Synthetic
tgcgatggcaattctggacaaagtgaggtcagatgcctccctcgccttgtcagtgaggtggtacctagtcctcag

SEQ ID NO: 344469 - DNA, 75 bp, Artificial Sequence
  Synthetic
aggtcagatgcctccctcgccttgtcagtgaggtggtacctagtcctcagctttgcgaaggccttcttgccttcc

SEQ ID NO: 344470 - DNA, 75 bp, Artificial Sequence
  Synthetic
tgagcttgttgcccctggtgaggtggagcacgatcatggatcgaatgtctttcaacatttcctcccggtcaatcc

SEQ ID NO: 344471 - DNA, 75 bp, Artificial Sequence
  Synthetic
gagcacgatcatggatcgaatgtctttcaacatttcctcccggtcaatccctgcctttccggcacactccgcaat

SEQ ID NO: 344472 - DNA, 75 bp, Artificial Sequence
  Synthetic
aagccttgatactggaaaagactgacgagctcctggatctcctctggctcccagcctccggcttcgatctcctga

SEQ ID NO: 344473 - DNA, 75 bp, Artificial Sequence
  Synthetic
ccagcctccggcttcgatctcctgagcgaacttaacccagtcagttgccatggttaatcgttcactttgttggag

SEQ ID NO: 344474 - DNA, 75 bp, Artificial Sequence
  Synthetic
acacaaagacctccaactaagctatcgatagatcatggctatgccggagaattgggtgcgctttgcgattgaaat

SEQ ID NO: 344475 - DNA, 75 bp, Artificial Sequence
  Synthetic
cgatagatcatggctatgccggagaattgggtgcgctttgcgattgaaatctcggatgctcagtgggaggaggac

SEQ ID NO: 344476 - DNA, 75 bp, Artificial Sequence
  Synthetic
attgggtgcgctttgcgattgaaatctcggatgctcagtgggaggaggacgagatccgagagttcatcaatctct

SEQ ID NO: 344477 - DNA, 75 bp, Artificial Sequence
  Synthetic
cgtggtgctgagcaggatttttgagttggccaaaaaggctgacctctcccgggaccagatgctgagggacatcag

SEQ ID NO: 344478 - DNA, 75 bp, Artificial Sequence
  Synthetic
ttggccaaaaaggctgacctctcccgggaccagatgctgagggacatcagggctctgatcactctccacctgacc

SEQ ID NO: 344479 - DNA, 75 bp, Artificial Sequence
  Synthetic
agaagaggctgtctgaggagggcaagaaagagtttgccctgctgaaggccagataccagcttgtggacaaggcca

SEQ ID NO: 344480 - DNA, 75 bp, Artificial Sequence
  Synthetic
gaaagagtttgccctgctgaaggccagataccagcttgtggacaaggccaaggaggctgcagatctgacactctc

SEQ ID NO: 344481 - DNA, 75 bp, Artificial Sequence
  Synthetic
ctgacgtgccgcattctgccgcaggtggtggcacacacagccgtgactcgatcacggatggagagtctgagtgca

SEQ ID NO: 344482 - DNA, 75 bp, Artificial Sequence
  Synthetic
atcacggatggagagtctgagtgcagactatccagtgtgcatgatgcacaatgcctttgctggcctgatcgatga

SEQ ID NO: 344483 - DNA, 75 bp, Artificial Sequence
  Synthetic
gccctggtcgatgcccacaggctctacctgctggagttctccaggaccatcaacgtgaagcaccgcggaatggag

SEQ ID NO: 344484 - DNA, 75 bp, Artificial Sequence
  Synthetic
acctgctggagttctccaggaccatcaacgtgaagcaccgcggaatggaggccaaagagatcttggatgccaatg

SEQ ID NO: 344485 - DNA, 75 bp, Artificial Sequence
  Synthetic
aagctcctttctgactcctagtcagaagagagcttacctgctgagcttcaagctggtggacggaaatggcaaggt

SEQ ID NO: 344486 - DNA, 75 bp, Artificial Sequence
  Synthetic
actgtcctcagatctttgatctgaggtgttttggaatttgatttaattcggccaaattaaaactcactaattgga

SEQ ID NO: 344487 - DNA, 75 bp, Artificial Sequence
  Synthetic
gtgttttggaatttgatttaattcggccaaattaaaactcactaattggactctaaaagggcttaggcccaaact

SEQ ID NO: 344488 - DNA, 75 bp, Artificial Sequence
  Synthetic
cttggtgaatgtggtgtccagcagtcgctcccttgcactctcaaaggtgatccagtgctcctcaaggttgactag

SEQ ID NO: 344489 - DNA, 75 bp, Artificial Sequence
  Synthetic
agatctgattcaaacatgaagttcatatgcttcttcttcatcccataacgcttgggtccatagttgcaaggtgct

SEQ ID NO: 344490 - DNA, 75 bp, Artificial Sequence
  Synthetic
tctctgcaatggtcccccttgtgactagtcttttctggagatcaagtatgtggagaaggcacagatccttcacca

SEQ ID NO: 344491 - DNA, 75 bp, Artificial Sequence
  Synthetic
tggagaaggcacagatccttcaccagattctgcccagtgacctgaacctcagtgagcttcattctccttattttt

SEQ ID NO: 344492 - DNA, 75 bp, Artificial Sequence
  Synthetic
gatctcattctgagtgcaaggtcaaacagcatcttcccaagggagaccctggatctcttcttccgtctcagcctg

SEQ ID NO: 344493 - DNA, 75 bp, Artificial Sequence
  Synthetic
tgctcatgatcgttatgaaggacctttgcaaagtataagtcccgatgatgtccattctcaagttcctgaagaaat

SEQ ID NO: 344494 - DNA, 75 bp, Artificial Sequence
  Synthetic
ttgcaaagtataagtcccgatgatgtccattctcaagttcctgaagaaattgaggatgagagctcgattcttctc

SEQ ID NO: 344495 - DNA, 75 bp, Artificial Sequence
  Synthetic
atcatctcttcatcagtcggtctaaggacatctaaaccatcaatcaggatgtcatacaggccctcatccacctca

SEQ ID NO: 344496 - DNA, 75 bp, Artificial Sequence
  Synthetic
caccgttaatggttgtcttcagaggaatggtgctagggaagtagccatcatccatcatctcccaaagcgagtcgt

SEQ ID NO: 344497 - DNA, 75 bp, Artificial Sequence
  Synthetic
aaagtgaagccctgagggagatcctcgttctggatagtgaagtaagacatgcttaatgttggagggtctttgtgt

SEQ ID NO: 344498 - DNA, 75 bp, Artificial Sequence
  Synthetic
acacaaagacgccaagatgcttttagcgatttgctcgaggaccaaccgacaacagggtcttaactgccctccagc

SEQ ID NO: 344499 - DNA, 75 bp, Artificial Sequence
  Synthetic
aacagggtcttaactgccctccagctgtgacctttacctccagccacatgagaccgccaattccatcatttctgc

SEQ ID NO: 344500 - DNA, 75 bp, Artificial Sequence
  Synthetic
tgtgacctttacctccagccacatgagaccgccaattccatcatttctgctctggactgaggggtctgatgttct

SEQ ID NO: 344501 - DNA, 75 bp, Artificial Sequence
  Synthetic
ccagctggatcagttactggatcatccattggtccaaagttcaaaatcaaaacacaggctgcttcatcttttgtg

SEQ ID NO: 344502 - DNA, 75 bp, Artificial Sequence
  Synthetic
ccattggtccaaagttcaaaatcaaaacacaggctgcttcatcttttgtgcatgatttcacctttgcccactggt

SEQ ID NO: 344503 - DNA, 75 bp, Artificial Sequence
  Synthetic
agaccacttcccgctggtcaatgacacttttgaccactggactcctgatttcatctcgcagaggctagatggaag

SEQ ID NO: 344504 - DNA, 75 bp, Artificial Sequence
  Synthetic
tcatctcgcagaggctagatggaagcaaggtggtggttgagtttacaaccaaccgttcagaccaggaacaatctc

SEQ ID NO: 344505 - DNA, 75 bp, Artificial Sequence
  Synthetic
aggaaagtacgaggttgcacttcacaatcgatcgactaccagcagcatactatttggagtggttgtggtcagtga

SEQ ID NO: 344506 - DNA, 75 bp, Artificial Sequence
  Synthetic
aatcgatcgactaccagcagcatactatttggagtggttgtggtcagtgagacaacagtagtcactaacttgaac

SEQ ID NO: 344507 - DNA, 75 bp, Artificial Sequence
  Synthetic
tctgctttaggttcttagttgctagagctgttcacctggaaatgaccaccaagatgatcattccagagtatgatg

SEQ ID NO: 344508 - DNA, 75 bp, Artificial Sequence
  Synthetic
aagatgatcattccagagtatgatgatgaggatgaagacaagaggagccgagaagtgaaggcagccttccactct

SEQ ID NO: 344509 - DNA, 75 bp, Artificial Sequence
  Synthetic
gtacagccagattggaatgtgacagaagccaactttgcccctttctccagaaggatgttctccaactttgcccaa

SEQ ID NO: 344510 - DNA, 75 bp, Artificial Sequence
  Synthetic
aagccaactttgcccctttctccagaaggatgttctccaactttgcccaaatggagccagacaaggagtacctgg

SEQ ID NO: 344511 - DNA, 75 bp, Artificial Sequence
  Synthetic
gcaagcacaagcggatctggatggcaatcattacctcaatgagagtttgactgagcaagccagacttgataggaa

SEQ ID NO: 344512 - DNA, 75 bp, Artificial Sequence
  Synthetic
aatcattacctcaatgagagtttgactgagcaagccagacttgataggaacagagaggagagcttgaatatggtt

SEQ ID NO: 344513 - DNA, 75 bp, Artificial Sequence
  Synthetic
atgcagcccagcggtcagcttggagccacaagtccactgtgccttttccaggagtgatcccgaaggtgagcggag

SEQ ID NO: 344514 - DNA, 75 bp, Artificial Sequence
  Synthetic
ccacaagtccactgtgccttttccaggagtgatcccgaaggtgagcggagacaccacatccctttctagacttgt

SEQ ID NO: 344515 - DNA, 75 bp, Artificial Sequence
  Synthetic
tcagatgcaacaatcagggcttggaggtcagcctatggatcagtgagcaacggaacagttgaaaggtgtgatgag

SEQ ID NO: 344516 - DNA, 75 bp, Artificial Sequence
  Synthetic
ggtcagcctatggatcagtgagcaacggaacagttgaaaggtgtgatgaggacgtggaaagagaaaggagggcag

SEQ ID NO: 344517 - DNA, 75 bp, Artificial Sequence
  Synthetic
gctagaagagtccaaggctctgaggatgaaataccacaggtgcaagatagacaatggaatgatggacaagttgga

SEQ ID NO: 344518 - DNA, 75 bp, Artificial Sequence
  Synthetic
atgaaataccacaggtgcaagatagacaatggaatgatggacaagttggatttagcaatgcaaggggttgaggct

SEQ ID NO: 344519 - DNA, 75 bp, Artificial Sequence
  Synthetic
tcatcaagaagagatcagagtcgaagaagacctttcctctgactgcagacactcgagacatcgacttgttcctcc

SEQ ID NO: 344520 - DNA, 75 bp, Artificial Sequence
  Synthetic
gaagacctttcctctgactgcagacactcgagacatcgacttgttcctccatcatgatgacttgatgttcaacaa

SEQ ID NO: 344521 - DNA, 75 bp, Artificial Sequence
  Synthetic
gccatgattgaggctgtcaaggctggggctgatgcacaatcactgcatgggttggacaagagtgcaaatccatgg

SEQ ID NO: 344522 - DNA, 75 bp, Artificial Sequence
  Synthetic
gggctgatgcacaatcactgcatgggttggacaagagtgcaaatccatggtacgcttcagctctctggttccttg

SEQ ID NO: 344523 - DNA, 75 bp, Artificial Sequence
  Synthetic
catgtgcacctgcatcggagtggagttaagcatcagtctgaaacaacactgtggcaggcaaaagttcatcattaa

SEQ ID NO: 344524 - DNA, 75 bp, Artificial Sequence
  Synthetic
ctcctgatcaagcccacgaattctggaagtcacgtcttctactcgattgcatttccagagtcagccattcttggg

SEQ ID NO: 344525 - DNA, 75 bp, Artificial Sequence
  Synthetic
atttccagagtcagccattcttgggaagttgcacagatcccaatgttttaaaggcttgcagtttgaggatgggtg

SEQ ID NO: 344526 - DNA, 75 bp, Artificial Sequence
  Synthetic
aaaatgtcaaaactgactaacgttgtgaaatgcctgtccactgggttcaacttgttttggttctggagagattac

SEQ ID NO: 344527 - DNA, 75 bp, Artificial Sequence
  Synthetic
cttgttttggttctggagagattactatgaagtacccttctgggctgggaatgaaaaagacttccaaacagggaa

SEQ ID NO: 344528 - DNA, 75 bp, Artificial Sequence
  Synthetic
ttttgcttgctaatgctgctagaggacaaagccaggacagaggaaattgctacgctgtctaggtatgtcatgatg

SEQ ID NO: 344529 - DNA, 75 bp, Artificial Sequence
  Synthetic
gaagggtttgtcagtcccccttgcattccaaagccccagaagatgatcgagaagttgcctaatctggctaggact

SEQ ID NO: 344530 - DNA, 75 bp, Artificial Sequence
  Synthetic
ttccaaagccccagaagatgatcgagaagttgcctaatctggctaggactaagttccaggtgtggctaatatcca

SEQ ID NO: 344531 - DNA, 75 bp, Artificial Sequence
  Synthetic
gtcagattacccgttcaaaatcacagcaggacacaaatcagccaactggacaggcatgttcaactgggtcacagg

SEQ ID NO: 344532 - DNA, 75 bp, Artificial Sequence
  Synthetic
gcaggacacaaatcagccaactggacaggcatgttcaactgggtcacaggagaaccaattgaatcaacgcagaag

SEQ ID NO: 344533 - DNA, 75 bp, Artificial Sequence
  Synthetic
accttaagaacaaagaggagtcccctgagagaaatgcaagcattggaatgtacaagaagatactggagtatgagg

SEQ ID NO: 344534 - DNA, 75 bp, Artificial Sequence
  Synthetic
tacaagaagatactggagtatgaggacaagcaccccggaaggtacacctacctagggcttggggaccctcctagt

SEQ ID NO: 344535 - DNA, 75 bp, Artificial Sequence
  Synthetic
ccattagcttattaaagcatctctgcatccatgctgagcatgatttgaggcggaattggggggaatctttcaaag

SEQ ID NO: 344536 - DNA, 75 bp, Artificial Sequence
  Synthetic
ccatgatttctcgagatattgtggatgccattgccagcttggatctggagagactggcaactctgaaggcttcca

SEQ ID NO: 344537 - DNA, 75 bp, Artificial Sequence
  Synthetic
gaagaggggtgatggaaagatctaccatcggagcaaggttctggaaaaagtcagcaagtatgtcaagaagagtag

SEQ ID NO: 344538 - DNA, 75 bp, Artificial Sequence
  Synthetic
catcggagcaaggttctggaaaaagtcagcaagtatgtcaagaagagtagctcacatgtccaccatatcatggaa

SEQ ID NO: 344539 - DNA, 75 bp, Artificial Sequence
  Synthetic
aaggttgtatgcatgtgtgtctgttcaagaaaccgcagcatggtggtctgagagagatatatgttcttggatttg

SEQ ID NO: 344540 - DNA, 75 bp, Artificial Sequence
  Synthetic
caagaaaccgcagcatggtggtctgagagagatatatgttcttggatttgaagagagagtggtccagctggtgat

SEQ ID NO: 344541 - DNA, 75 bp, Artificial Sequence
  Synthetic
aaacggttcaaatctgaaaccttgaccaacccaaagcaaaaactggccattccagaaacacatggtcttagggct

SEQ ID NO: 344542 - DNA, 75 bp, Artificial Sequence
  Synthetic
gtcaagacatgtggcattcatcatgaaacagtggcgacatcagacgatgctgccaaatggaatcagtgccatcat

SEQ ID NO: 344543 - DNA, 75 bp, Artificial Sequence
  Synthetic
gccatttcacagatcctttgtttcatgggttcatcattagaggatgttccatgttcatgaagaagcgcataatga

SEQ ID NO: 344544 - DNA, 75 bp, Artificial Sequence
  Synthetic
ttgatcagagcctgattgatatcatagactcccacaccacactggagacatctgatgcatacctccaaaagatcc

SEQ ID NO: 344545 - DNA, 75 bp, Artificial Sequence
  Synthetic
tctgatgcatacctccaaaagatccacagagggtaccatgggagtcttgatgaccagcctagatggatctctaga

SEQ ID NO: 344546 - DNA, 75 bp, Artificial Sequence
  Synthetic
acagagggtaccatgggagtcttgatgaccagcctagatggatctctagaggcggggcctttgtgcaaacggaaa

SEQ ID NO: 344547 - DNA, 75 bp, Artificial Sequence
  Synthetic
ttacacctctagtctactccacaccttgctccaggagtggcttagaactttctcacaaagattcatcaggacaag

SEQ ID NO: 344548 - DNA, 75 bp, Artificial Sequence
  Synthetic
ttgctccaggagtggcttagaactttctcacaaagattcatcaggacaagggtttcagtcgaccagcgcccagat

SEQ ID NO: 344549 - DNA, 75 bp, Artificial Sequence
  Synthetic
cagatgattctggcatgatgatctccttcccgtcaacagacaagggagccactgggaagtacagatacttgtctg

SEQ ID NO: 344550 - DNA, 75 bp, Artificial Sequence
  Synthetic
cttcccgtcaacagacaagggagccactgggaagtacagatacttgtctgcccttattttcaagtacaaaaaagt

SEQ ID NO: 344551 - DNA, 75 bp, Artificial Sequence
  Synthetic
tcatctgtaaagtccactaacaacaccctccacctactagaattcaactcagagtttttctttcacatcaaccac

SEQ ID NO: 344552 - DNA, 75 bp, Artificial Sequence
  Synthetic
ccctccacctactagaattcaactcagagtttttctttcacatcaaccacaacaggcctctgctaaggtggatca

SEQ ID NO: 344553 - DNA, 75 bp, Artificial Sequence
  Synthetic
agaatctctggcttcaaggcaagaagagatgtacaacaatctgacgtcagttctcgagggtggtggcagcttttc

SEQ ID NO: 344554 - DNA, 75 bp, Artificial Sequence
  Synthetic
ttctcgagggtggtggcagcttttctctggtatccttttgccagtttggtcagttgctcctacactacactctat

SEQ ID NO: 344555 - DNA, 75 bp, Artificial Sequence
  Synthetic
taggcatgacagtttccccactgttccttgagtacataaagttggtgtcagaaataaaggacccttccctgggct

SEQ ID NO: 344556 - DNA, 75 bp, Artificial Sequence
  Synthetic
gaaataaaggacccttccctgggctacttcctgatggatcacccgttcgggtctggtctatctggattcaagtac

SEQ ID NO: 344557 - DNA, 75 bp, Artificial Sequence
  Synthetic
gtatactaggatccagatatagatccttgctggaggctatacagaattctgacagtgctgctccaaagaaaacct

SEQ ID NO: 344558 - DNA, 75 bp, Artificial Sequence
  Synthetic
cttgctggaggctatacagaattctgacagtgctgctccaaagaaaaccttggatacaacaacttctgggacttt

SEQ ID NO: 344559 - DNA, 75 bp, Artificial Sequence
  Synthetic
ggagatagaaagaaatggcagagactggtggacaggttgaacctcccagaggactggctggatgtgattgacaag

SEQ ID NO: 344560 - DNA, 75 bp, Artificial Sequence
  Synthetic
tggtggacaggttgaacctcccagaggactggctggatgtgattgacaagaatcctgagattgtgtatcgtcgac

SEQ ID NO: 344561 - DNA, 75 bp, Artificial Sequence
  Synthetic
gaggattgcagagaaggtccattctccgggagtctctaactccctgtccaagggcaactgcatcatcagggtcat

SEQ ID NO: 344562 - DNA, 75 bp, Artificial Sequence
  Synthetic
agggcaactgcatcatcagggtcatctcatcatcagtgtacatcctgagcaggagcattctaagtgatggtctgg

SEQ ID NO: 344563 - DNA, 75 bp, Artificial Sequence
  Synthetic
ggtcaaacgccctctgctgtacaaggttatgaatcagcctgaactggacctccattccaggttgactccggcaca

SEQ ID NO: 344564 - DNA, 75 bp, Artificial Sequence
  Synthetic
gttatgaatcagcctgaactggacctccattccaggttgactccggcacagctgtcaacgctgtttcccatgatg

SEQ ID NO: 344565 - DNA, 75 bp, Artificial Sequence
  Synthetic
atcttaggagttatatgaaaattgaaggcgagttcatatcaaagaagaaggtcataactcagactagggtcaaca

SEQ ID NO: 344566 - DNA, 75 bp, Artificial Sequence
  Synthetic
aggcgagttcatatcaaagaagaaggtcataactcagactagggtcaacattcttgagactgagagattccttag

SEQ ID NO: 344567 - DNA, 75 bp, Artificial Sequence
  Synthetic
gataaatggtttggcttcaccagaacaagaatgactccaaggactttcaaagaggagtgggagaatctgacttct

SEQ ID NO: 344568 - DNA, 75 bp, Artificial Sequence
  Synthetic
caagaatgactccaaggactttcaaagaggagtgggagaatctgacttctgtgtttccatggctaacaggaaacc

SEQ ID NO: 344569 - DNA, 75 bp, Artificial Sequence
  Synthetic
tttccagcaccatgtccagctaagaaatttcttcagtagactggacctcaaggggagagacatcagaattatagg

SEQ ID NO: 344570 - DNA, 75 bp, Artificial Sequence
  Synthetic
aggggagagacatcagaattataggtgctcctataaagaagtctagtggtgtgagcaacgtctctacagccatta

SEQ ID NO: 344571 - DNA, 75 bp, Artificial Sequence
  Synthetic
cctgactcacataccagatgaagctgcaatggaaagaattgaagcagcaggcattctgaaacatgctctcttcct

SEQ ID NO: 344572 - DNA, 75 bp, Artificial Sequence
  Synthetic
gcaatggaaagaattgaagcagcaggcattctgaaacatgctctcttcctcacagtgacaggaccttacaccgat

SEQ ID NO: 344573 - DNA, 75 bp, Artificial Sequence
  Synthetic
attttatcactagctcagagcccatcactcttaaacctaaccacggaaaaaccaggaccaacgtgctttccctgt

SEQ ID NO: 344574 - DNA, 75 bp, Artificial Sequence
  Synthetic
ttcaggattacttctccaagagagggccagacatcatcttcaacagaattcagatggctaactgtggagtgatcg

SEQ ID NO: 344575 - DNA, 75 bp, Artificial Sequence
  Synthetic
cagatggctaactgtggagtgatcggaggattcacatctcctcagaagccaaaggaggttgacggcaagattgtc

SEQ ID NO: 344576 - DNA, 75 bp, Artificial Sequence
  Synthetic
gaggattcacatctcctcagaagccaaaggaggttgacggcaagattgtctacactggtgatggtgtgtggcgag

SEQ ID NO: 344577 - DNA, 75 bp, Artificial Sequence
  Synthetic
gctggtcattacctacatgccaaagcagaagtcaaatgagctaaaatccataactgtcaactcagacagatgcat

SEQ ID NO: 344578 - DNA, 75 bp, Artificial Sequence
  Synthetic
ctctgccttgagcagcttctgccagtcgtggtgcaaagaaatgggagtgttcaacaccgaggatttctccaagac

SEQ ID NO: 344579 - DNA, 75 bp, Artificial Sequence
  Synthetic
ttcatgcacaagttcaagatctctggttcaaagcagactctaggtgccccgatcttcatcgtcagtgagaagatc

SEQ ID NO: 344580 - DNA, 75 bp, Artificial Sequence
  Synthetic
gatcttcatcgtcagtgagaagatcttccgacccatctgctgggatccatcgaagctggaatttagagtgcgcgg

SEQ ID NO: 344581 - DNA, 75 bp, Artificial Sequence
  Synthetic
gaacactctaaatctcacttacaaggaagtcaatccgggtgctggccagagaatgttcaacattctcagttacac

SEQ ID NO: 344582 - DNA, 75 bp, Artificial Sequence
  Synthetic
gaagtcaatccgggtgctggccagagaatgttcaacattctcagttacactgtcaaggatacagatgtctctgat

SEQ ID NO: 344583 - DNA, 75 bp, Artificial Sequence
  Synthetic
tgtcgcctagacacaagttccatgggcgggagccgagcacttcttggatctgcatgagagccctgcctatcagca

SEQ ID NO: 344584 - DNA, 75 bp, Artificial Sequence
  Synthetic
gcgggagccgagcacttcttggatctgcatgagagccctgcctatcagcaccattgacaagctgctagagagaat

SEQ ID NO: 344585 - DNA, 75 bp, Artificial Sequence
  Synthetic
tcaatcgacaacgaacgcctggcagagtgtttcaagaatgtgatggagtcaaccttgaggcgtaagggagtgttt

SEQ ID NO: 344586 - DNA, 75 bp, Artificial Sequence
  Synthetic
agtgtttcaagaatgtgatggagtcaaccttgaggcgtaagggagtgtttctatctgaattctcaagggccactc

SEQ ID NO: 344587 - DNA, 75 bp, Artificial Sequence
  Synthetic
agatatgttggatttttttgctgaggctggcctcaatgatgatctcctgctggaagaggagccatggctgagcgg

SEQ ID NO: 344588 - DNA, 75 bp, Artificial Sequence
  Synthetic
gaggcatacctggaagagtacaatcttggtcctttcggtgtgttcagtgtggagcaggagatgaacaccaagtac

SEQ ID NO: 344589 - DNA, 75 bp, Artificial Sequence
  Synthetic
ttggtcctttcggtgtgttcagtgtggagcaggagatgaacaccaagtactaccaccacttgcttttggactccc

SEQ ID NO: 344590 - DNA, 75 bp, Artificial Sequence
  Synthetic
taccaccacttgcttttggactccctggttgaggatgtaatccagaaattgtccctggacgggttgaggaagttg

SEQ ID NO: 344591 - DNA, 75 bp, Artificial Sequence
  Synthetic
aatacaagaaagaggtgattcgactgctcaacatcttgcagagggatgcgagtcagataaagtggaagagcagag

SEQ ID NO: 344592 - DNA, 75 bp, Artificial Sequence
  Synthetic
gctcaacatcttgcagagggatgcgagtcagataaagtggaagagcagagaccttttgtcagagaacatgggtct

SEQ ID NO: 344593 - DNA, 75 bp, Artificial Sequence
  Synthetic
tgagtgacttttctttgggttggatgctggcattgcttttactatctctctctctttgaatgtatcttcctttac

SEQ ID NO: 344594 - DNA, 75 bp, Artificial Sequence
  Synthetic
gatgctggcattgcttttactatctctctctctttgaatgtatcttcctttacttccatcttggcgactttgtgt

SEQ ID NO: 344595 - DNA, 75 bp, Artificial Sequence
  Synthetic
acacaaagaaggctaacatggtaaggacatatctcttgcttttgctcctgtgcgggccggcaacgcctttcttca

SEQ ID NO: 344596 - DNA, 75 bp, Artificial Sequence
  Synthetic
gacatatctcttgcttttgctcctgtgcgggccggcaacgcctttcttcaatcacctgatggatgtcacccgtcg

SEQ ID NO: 344597 - DNA, 75 bp, Artificial Sequence
  Synthetic
tgcgggccggcaacgcctttcttcaatcacctgatggatgtcacccgtcgcatcctggactccagcaacgcaacc

SEQ ID NO: 344598 - DNA, 75 bp, Artificial Sequence
  Synthetic
acagactgtcaaggctggatgctcatgtcatgtcaatgcttggggttggttcacacattgatgaggtcagtgcca

SEQ ID NO: 344599 - DNA, 75 bp, Artificial Sequence
  Synthetic
tgtcatgtcaatgcttggggttggttcacacattgatgaggtcagtgccaatcacagccagcatctccacaactt

SEQ ID NO: 344600 - DNA, 75 bp, Artificial Sequence
  Synthetic
aggaggactctaaccatgatggaccccaaatcaggcaagtttaagcgcctgaaatgtaatgaaaaccagactctg

SEQ ID NO: 344601 - DNA, 75 bp, Artificial Sequence
  Synthetic
ccaaatcaggcaagtttaagcgcctgaaatgtaatgaaaaccagactctgtccaaggattgtgcctcttgcatag

SEQ ID NO: 344602 - DNA, 75 bp, Artificial Sequence
  Synthetic
tgagcatctggtctacgatgacgccatttgtcagtctgattacagcagtcctgaggcaatgccagaccatgagac

SEQ ID NO: 344603 - DNA, 75 bp, Artificial Sequence
  Synthetic
atttgtcagtctgattacagcagtcctgaggcaatgccagaccatgagacacacctttgcaggatcgggccacta

SEQ ID NO: 344604 - DNA, 75 bp, Artificial Sequence
  Synthetic
ccaagagggttcagcatgtttcttggttttggattgatgggaaactgagggtgtatgatgacttctccgtctcct

SEQ ID NO: 344605 - DNA, 75 bp, Artificial Sequence
  Synthetic
gttttggattgatgggaaactgagggtgtatgatgacttctccgtctcctggaccgaggggaagttcctgtccct

SEQ ID NO: 344606 - DNA, 75 bp, Artificial Sequence
  Synthetic
aaggaccacaactgcaacaagactgtctgcctggaggggagatgctctggggaccttcagttttgcacagagttc

SEQ ID NO: 344607 - DNA, 75 bp, Artificial Sequence
  Synthetic
tctgcctggaggggagatgctctggggaccttcagttttgcacagagttcacatgctcatatgcaaaggctgact

SEQ ID NO: 344608 - DNA, 75 bp, Artificial Sequence
  Synthetic
tggggtggcagtggtacacaccaagcacggctccttcatgcctgagtgcatgggtcagtctctttggtctgtacg

SEQ ID NO: 344609 - DNA, 75 bp, Artificial Sequence
  Synthetic
cacggctccttcatgcctgagtgcatgggtcagtctctttggtctgtacgaaaacctttaactaagagatcggta

SEQ ID NO: 344610 - DNA, 75 bp, Artificial Sequence
  Synthetic
gtgaaactgactgcaaggtggaccacattctggtgatagtaaggcacttctacccagaccattaccaagcttgtc

SEQ ID NO: 344611 - DNA, 75 bp, Artificial Sequence
  Synthetic
cattctggtgatagtaaggcacttctacccagaccattaccaagcttgtctgggctccacttgcctcactggtcg

SEQ ID NO: 344612 - DNA, 75 bp, Artificial Sequence
  Synthetic
ccatttaagatggctgaccggctttcagattcacacttcgagatacgtatctgggataaggagagatccaatgaa

SEQ ID NO: 344613 - DNA, 75 bp, Artificial Sequence
  Synthetic
cagattcacacttcgagatacgtatctgggataaggagagatccaatgaatatttcttagaatctaggtgtgagt

SEQ ID NO: 344614 - DNA, 75 bp, Artificial Sequence
  Synthetic
atgctggttttgcagagcaaattgggccaacattcactgcttttctaaggagcaggtcctgattcttgttgcagt

SEQ ID NO: 344615 - DNA, 75 bp, Artificial Sequence
  Synthetic
gccaacattcactgcttttctaaggagcaggtcctgattcttgttgcagtgagctctctgtgcatattagtgctg

SEQ ID NO: 344616 - DNA, 75 bp, Artificial Sequence
  Synthetic
tcattgccaccttcacctggaaaataataaagcccttttggtggatcctttccctattatgcagaacttgctcca

SEQ ID NO: 344617 - DNA, 75 bp, Artificial Sequence
  Synthetic
aataaagcccttttggtggatcctttccctattatgcagaacttgctccaaaagactgaacaaacgggcagagcg

SEQ ID NO: 344618 - DNA, 75 bp, Artificial Sequence
  Synthetic
gaagaaggactgaataatgttgatgaagggcccagagagcagaacaaccctgtaagagcagtggcaagacctaat

SEQ ID NO: 344619 - DNA, 75 bp, Artificial Sequence
  Synthetic
aagggcccagagagcagaacaaccctgtaagagcagtggcaagacctaatgttcgacaaaaaatgttcaacttaa

SEQ ID NO: 344620 - DNA, 75 bp, Artificial Sequence
  Synthetic
catgctgtgtctgacttgtcctgttgagagttgctcagactccatcactgtgacagcttccagtcagagatgctc

SEQ ID NO: 344621 - DNA, 75 bp, Artificial Sequence
  Synthetic
gagagttgctcagactccatcactgtgacagcttccagtcagagatgctccacaaactcagatggagtgaactcc

SEQ ID NO: 344622 - DNA, 75 bp, Artificial Sequence
  Synthetic
ttcaggttagtcccaaggggcaagagagctgtttgatcctaaaggggccaactggaacagcagtggactctatta

SEQ ID NO: 344623 - DNA, 75 bp, Artificial Sequence
  Synthetic
gagctgtttgatcctaaaggggccaactggaacagcagtggactctattaggatcaagaccaccgacattaagct

SEQ ID NO: 344624 - DNA, 75 bp, Artificial Sequence
  Synthetic
tgggttcccagggtgacccataggtgtatagggaccaggcgatgccatctcatgggagcatgcaagggagaggcc

SEQ ID NO: 344625 - DNA, 75 bp, Artificial Sequence
  Synthetic
gtatagggaccaggcgatgccatctcatgggagcatgcaagggagaggcctgctctgagtttaagataaatgatt

SEQ ID NO: 344626 - DNA, 75 bp, Artificial Sequence
  Synthetic
ggagttgatggctcagctaggttggagctactgtgttgagcagtgcggtggtgccctctgtcagtgcttcaacat

SEQ ID NO: 344627 - DNA, 75 bp, Artificial Sequence
  Synthetic
agctactgtgttgagcagtgcggtggtgccctctgtcagtgcttcaacatgaggccctcttgcttctacctgagg

SEQ ID NO: 344628 - DNA, 75 bp, Artificial Sequence
  Synthetic
acgctttcaacatctatgagtgctcagaatggtcataccggataaatgtgcttgtctcgacaaatacaactcact

SEQ ID NO: 344629 - DNA, 75 bp, Artificial Sequence
  Synthetic
agaatggtcataccggataaatgtgcttgtctcgacaaatacaactcactctaatctaactctaaagcttggagt

SEQ ID NO: 344630 - DNA, 75 bp, Artificial Sequence
  Synthetic
attagcttatctagtgtgtcccagcctccagcaatagcatactcagaatgctttggggaagatctgcacggcaca

SEQ ID NO: 344631 - DNA, 75 bp, Artificial Sequence
  Synthetic
ctccagcaatagcatactcagaatgctttggggaagatctgcacggcacaaaattccacacagtctgcaatagaa

SEQ ID NO: 344632 - DNA, 75 bp, Artificial Sequence
  Synthetic
aggggagatacagtgccccaccaaagctgatgccctggcagtctctaagaggtgcattagcagcgactcaataat

SEQ ID NO: 344633 - DNA, 75 bp, Artificial Sequence
  Synthetic
gctgatgccctggcagtctctaagaggtgcattagcagcgactcaataatcttctccaaggtccacaaggattcg

SEQ ID NO: 344634 - DNA, 75 bp, Artificial Sequence
  Synthetic
atcccatgacaatcaggaatcggaacaagttgccatccacagtaggttcagtcactttctggccaactgaaacca

SEQ ID NO: 344635 - DNA, 75 bp, Artificial Sequence
  Synthetic
caagttgccatccacagtaggttcagtcactttctggccaactgaaaccagtgttgaggcagccatccctgactt

SEQ ID NO: 344636 - DNA, 75 bp, Artificial Sequence
  Synthetic
ttagatggttacaccattcagttcagatcagattccaacaagtgcagcccaagattcttgtcattatctggatgt

SEQ ID NO: 344637 - DNA, 75 bp, Artificial Sequence
  Synthetic
gatcagattccaacaagtgcagcccaagattcttgtcattatctggatgttacaactgcgaggctggagccaagc

SEQ ID NO: 344638 - DNA, 75 bp, Artificial Sequence
  Synthetic
tgggacagccttgggcatcctcgaatgcccgagcctaggctacacgacatattatgaggttaagaacatgcttga

SEQ ID NO: 344639 - DNA, 75 bp, Artificial Sequence
  Synthetic
tgcccgagcctaggctacacgacatattatgaggttaagaacatgcttgaaaagtccataagaaccatgcactta

SEQ ID NO: 344640 - DNA, 75 bp, Artificial Sequence
  Synthetic
gctacttccggtgccccaattctgagagtcagctaaccataagaggagaactaatctatctcttcaatgatgaca

SEQ ID NO: 344641 - DNA, 75 bp, Artificial Sequence
  Synthetic
gagtcagctaaccataagaggagaactaatctatctcttcaatgatgacatcaggcaccataatcagaccttgtc

SEQ ID NO: 344642 - DNA, 75 bp, Artificial Sequence
  Synthetic
tctggatgggatccttttggttggttcaaagcctcctggctgagagcgatttgggccattctgggtggaacggtg

SEQ ID NO: 344643 - DNA, 75 bp, Artificial Sequence
  Synthetic
tcaaagcctcctggctgagagcgatttgggccattctgggtggaacggtgtctttgataattggagtggtgatca

SEQ ID NO: 344644 - DNA, 75 bp, Artificial Sequence
  Synthetic
aaaagttaaaaaatcgtgaagctcctcttttccccatccccctcaaccccttcccttctccccccctcatcctct

SEQ ID NO: 344645 - DNA, 75 bp, Artificial Sequence
  Synthetic
gacgccgctggagcattaattactaaatggtgtcattcggggtggtccttggtagtgtccgtgaataccatattt

SEQ ID NO: 344646 - DNA, 75 bp, Artificial Sequence
  Synthetic
aatggtgtcattcggggtggtccttggtagtgtccgtgaataccatatttgttgttccatgtagccggtcttagt

SEQ ID NO: 344647 - DNA, 75 bp, Artificial Sequence
  Synthetic
acacaaagacggcttacataatgaggtgtctcctgcaaatcgtgtgtgctcttgcactggtggtccctggagagc

SEQ ID NO: 344648 - DNA, 75 bp, Artificial Sequence
  Synthetic
gtgtctcctgcaaatcgtgtgtgctcttgcactggtggtccctggagagctgtatttcagccaacttagggatgc

SEQ ID NO: 344649 - DNA, 75 bp, Artificial Sequence
  Synthetic
cttgcactggtggtccctggagagctgtatttcagccaacttagggatgcagcccgcagaatccttgatgggtct

SEQ ID NO: 344650 - DNA, 75 bp, Artificial Sequence
  Synthetic
ccgagtcccactctctcacaaagaactcaaagttcttgatgagtgctctgtccttagtgcaaaatgtggatacca

SEQ ID NO: 344651 - DNA, 75 bp, Artificial Sequence
  Synthetic
ctcaaagttcttgatgagtgctctgtccttagtgcaaaatgtggataccatcaagatggaccacaggaagcatct

SEQ ID NO: 344652 - DNA, 75 bp, Artificial Sequence
  Synthetic
gggaccgggaggacctctctcaccatgctcaatgttctgacaggaaacttcactcagctccaatgtctaaagaat

SEQ ID NO: 344653 - DNA, 75 bp, Artificial Sequence
  Synthetic
tgctcaatgttctgacaggaaacttcactcagctccaatgtctaaagaatcagtctctgagtcctgattgcacca

SEQ ID NO: 344654 - DNA, 75 bp, Artificial Sequence
  Synthetic
cctgtccagtcaccatttggtttatgatgatgccatttgccagtcagaaaacagtcctccagagtcaatgccaga

SEQ ID NO: 344655 - DNA, 75 bp, Artificial Sequence
  Synthetic
gatgatgccatttgccagtcagaaaacagtcctccagagtcaatgccagatcatgacacaagtttgtgcagcatt

SEQ ID NO: 344656 - DNA, 75 bp, Artificial Sequence
  Synthetic
atcatgaggttaaaagagcagaacatgttgcgtggttctgggttgatggaaaaatacggatttatgatgattata

SEQ ID NO: 344657 - DNA, 75 bp, Artificial Sequence
  Synthetic
tgttgcgtggttctgggttgatggaaaaatacggatttatgatgattatagcatttcgtggcaggaaggcaaatt

SEQ ID NO: 344658 - DNA, 75 bp, Artificial Sequence
  Synthetic
aaatcatctggagcagaagcatgtgacaagtcaacttgtttggaaggtcattgcacaggggatatccaattctgc

SEQ ID NO: 344659 - DNA, 75 bp, Artificial Sequence
  Synthetic
acaagtcaacttgtttggaaggtcattgcacaggggatatccaattctgcaccgaattctcctgctcttctgaat

SEQ ID NO: 344660 - DNA, 75 bp, Artificial Sequence
  Synthetic
caaggtgcctggtgtggctgttgcccatgtgaaaggtgggacctttatccctgcctgcttcgggaagtctatgtg

SEQ ID NO: 344661 - DNA, 75 bp, Artificial Sequence
  Synthetic
catgtgaaaggtgggacctttatccctgcctgcttcgggaagtctatgtggctcattgggaagaagagatccaag

SEQ ID NO: 344662 - DNA, 75 bp, Artificial Sequence
  Synthetic
gcatcgactgtgaaacagtgtgtggagattctgaaatccatgtggttgtgcgacactttgaccctgatcattatc

SEQ ID NO: 344663 - DNA, 75 bp, Artificial Sequence
  Synthetic
agattctgaaatccatgtggttgtgcgacactttgaccctgatcattatcaggcctgccttgggtccacttgctt

SEQ ID NO: 344664 - DNA, 75 bp, Artificial Sequence
  Synthetic
ttttcaattcctttcaaaatggctgacagaatggcagattctgccctgcaaatacatgtttgggacaaggcaaag

SEQ ID NO: 344665 - DNA, 75 bp, Artificial Sequence
  Synthetic
acagaatggcagattctgccctgcaaatacatgtttgggacaaggcaaagcacaatgaatacgtgattacttctg

SEQ ID NO: 344666 - DNA, 75 bp, Artificial Sequence
  Synthetic
tgcaataacctgttggttctgcagagcaaactgggcaaatgtccactgtttctcaaaggaacaaactttcattct

SEQ ID NO: 344667 - DNA, 75 bp, Artificial Sequence
  Synthetic
gcaaactgggcaaatgtccactgtttctcaaaggaacaaactttcattctcctaataatcatctctctctgtatc

SEQ ID NO: 344668 - DNA, 75 bp, Artificial Sequence
  Synthetic
caataaaggtaattgcagcttttgtgtggaaaattctgaagccaatgttctggctagtgtcagtgctcagcagag

SEQ ID NO: 344669 - DNA, 75 bp, Artificial Sequence
  Synthetic
gtggaaaattctgaagccaatgttctggctagtgtcagtgctcagcagagctgccactagagttgcccgcttgag

SEQ ID NO: 344670 - DNA, 75 bp, Artificial Sequence
  Synthetic
cattctttggaagaaggtcttgttgaaatccctctggtggaaattcccagagaacctgctcgggctaatcctgct

SEQ ID NO: 344671 - DNA, 75 bp, Artificial Sequence
  Synthetic
aaatccctctggtggaaattcccagagaacctgctcgggctaatcctgctgttgccaacagaatgaggatgtttc

SEQ ID NO: 344672 - DNA, 75 bp, Artificial Sequence
  Synthetic
tctagttctcattgtggtccctcaaggggtggagctgtgctctgattctctatctgttacagcatcatcaagcag

SEQ ID NO: 344673 - DNA, 75 bp, Artificial Sequence
  Synthetic
ggggtggagctgtgctctgattctctatctgttacagcatcatcaagcagatgcgtgacagatagatttggccac

SEQ ID NO: 344674 - DNA, 75 bp, Artificial Sequence
  Synthetic
ctctcctacaagttagcccaaagggtcaagaaagctgcataattctaaagaacccaaataatcaagcaatagaga

SEQ ID NO: 344675 - DNA, 75 bp, Artificial Sequence
  Synthetic
tcaagaaagctgcataattctaaagaacccaaataatcaagcaatagagactattagaatacagactgaggacat

SEQ ID NO: 344676 - DNA, 75 bp, Artificial Sequence
  Synthetic
ctgtattgggtaccaagagcaacccaccgatgtgtgggaacaagaaggtgtcatctgatgggtgattgccaagga

SEQ ID NO: 344677 - DNA, 75 bp, Artificial Sequence
  Synthetic
accgatgtgtgggaacaagaaggtgtcatctgatgggtgattgccaaggagaaaagtgctcagagttcaagattg

SEQ ID NO: 344678 - DNA, 75 bp, Artificial Sequence
  Synthetic
tgaagaggaattgatgtccaagttgggatggagttactgcattgagcaatgtggaggtgctctatgccagtgctt

SEQ ID NO: 344679 - DNA, 75 bp, Artificial Sequence
  Synthetic
ggatggagttactgcattgagcaatgtggaggtgctctatgccagtgcttcaacatgaatccatcatgtttctat

SEQ ID NO: 344680 - DNA, 75 bp, Artificial Sequence
  Synthetic
ctcaggacgcctacaacatgtttgaatgctcagagtggtcttataagattaatgtccttgtccacactaattcaa

SEQ ID NO: 344681 - DNA, 75 bp, Artificial Sequence
  Synthetic
atgctcagagtggtcttataagattaatgtccttgtccacactaattcaaccacaaccaaagttgccctaaaact

SEQ ID NO: 344682 - DNA, 75 bp, Artificial Sequence
  Synthetic
ggagtgattagtctttcaaccgtttctcagcctcctgcagtagcatacacagagtgctttggagaagacttgcat

SEQ ID NO: 344683 - DNA, 75 bp, Artificial Sequence
  Synthetic
ctcagcctcctgcagtagcatacacagagtgctttggagaagacttgcatggttcaaaattccatgcagtctgca

SEQ ID NO: 344684 - DNA, 75 bp, Artificial Sequence
  Synthetic
gaggttaggagagatccagtgcccaactaaagctgatgctttatctctctcaaaaaggtgcataagcacagactc

SEQ ID NO: 344685 - DNA, 75 bp, Artificial Sequence
  Synthetic
actaaagctgatgctttatctctctcaaaaaggtgcataagcacagactccattgtcttctccaaagtccacaaa

SEQ ID NO: 344686 - DNA, 75 bp, Artificial Sequence
  Synthetic
tcattgacccttcattgatactgtcaaaaaacaagctgccttcaacagtgggatctgtcacattctggccttctg

SEQ ID NO: 344687 - DNA, 75 bp, Artificial Sequence
  Synthetic
aaaaaacaagctgccttcaacagtgggatctgtcacattctggccttctgagtccagtgttgtggcctctgtccc

SEQ ID NO: 344688 - DNA, 75 bp, Artificial Sequence
  Synthetic
atcagattggatggttacacaattgaatacagatctgataacaataagtgtaatgccaggttcttaaaactaaat

SEQ ID NO: 344689 - DNA, 75 bp, Artificial Sequence
  Synthetic
aatacagatctgataacaataagtgtaatgccaggttcttaaaactaaatggctgttataactgtgaaccgggtg

SEQ ID NO: 344690 - DNA, 75 bp, Artificial Sequence
  Synthetic
agactttggaactgcaatgggcattttagaatgtccggaagcaggatacaccacatattatcaggttacgcccag

SEQ ID NO: 344691 - DNA, 75 bp, Artificial Sequence
  Synthetic
ttagaatgtccggaagcaggatacaccacatattatcaggttacgcccagcctagtgaaggatgtgaggaccatt

SEQ ID NO: 344692 - DNA, 75 bp, Artificial Sequence
  Synthetic
tggcttgtgtattcaagtgccccaattctcagcaagacatccagataaaaggggaactcgtctacttgttcaatg

SEQ ID NO: 344693 - DNA, 75 bp, Artificial Sequence
  Synthetic
ttctcagcaagacatccagataaaaggggaactcgtctacttgttcaatgatgacgtccgccacagcaaccagac

SEQ ID NO: 344694 - DNA, 75 bp, Artificial Sequence
  Synthetic
actggaacaagctgggatcccttcgggtggctgagattttcatggatgcgtttgatttggtctctgtttggcagc

SEQ ID NO: 344695 - DNA, 75 bp, Artificial Sequence
  Synthetic
ggtggctgagattttcatggatgcgtttgatttggtctctgtttggcagcacaatagccatcataataggaatca

SEQ ID NO: 344696 - DNA, 75 bp, Artificial Sequence
  Synthetic
gtgcataaaatccaaaaaacaataatgtcattacctacacctccccttccaacccttatcgccatcttccccttc

SEQ ID NO: 344697 - DNA, 75 bp, Artificial Sequence
  Synthetic
tgtcattacctacacctccccttccaacccttatcgccatcttccccttcctttcccccctggcttaggccaggc

SEQ ID NO: 344698 - DNA, 75 bp, Artificial Sequence
  Synthetic
gtcagagcataggcgttgatctcctgcctagtctatttttgattggataagcatgtggttctagtggcattcgca

SEQ ID NO: 344699 - DNA, 75 bp, Artificial Sequence
  Synthetic
gcatgtggttctagtggcattcgcattgccagtggatcccgtgtttcatcatagtatttgcttgttatgtagccg

SEQ ID NO: 344700 - DNA, 75 bp, Artificial Sequence
  Synthetic
acacaaagacgccaagatgcttttagcgatatgctcgagaacaaatcctcagcggggactaaactgtccacctgc

SEQ ID NO: 344701 - DNA, 75 bp, Artificial Sequence
  Synthetic
agaccacccatcccatccttcttgctgtggacagagggatcggatgttctgatggactttgacctggacaccatc

SEQ ID NO: 344702 - DNA, 75 bp, Artificial Sequence
  Synthetic
tgtggacagagggatcggatgttctgatggactttgacctggacaccatccctccaggatcagtcactggatctt

SEQ ID NO: 344703 - DNA, 75 bp, Artificial Sequence
  Synthetic
gactcaggctgcttcatcatttgtccatgatttcacctttgcacattggtgtgatgcatcagacatgccgctaaa

SEQ ID NO: 344704 - DNA, 75 bp, Artificial Sequence
  Synthetic
ggatcattttcctctagtgaatgacacatttgatcactggactcctgatttcatttctcagaggctcgatggaag

SEQ ID NO: 344705 - DNA, 75 bp, Artificial Sequence
  Synthetic
tcatttctcagaggctcgatggaagcaaggttgttgttgagttcacaacgaatcgatcagatcaggaacagtctc

SEQ ID NO: 344706 - DNA, 75 bp, Artificial Sequence
  Synthetic
tcttcggagtggtggttgtgagtgaaactactgttgtgacaaacctcaacctaaatcagcaagaggtggatgagc

SEQ ID NO: 344707 - DNA, 75 bp, Artificial Sequence
  Synthetic
ctaaatcagcaagaggtggatgagctatgctttaggttcctggtttccagggcagtccacttggaaatgacgacg

SEQ ID NO: 344708 - DNA, 75 bp, Artificial Sequence
  Synthetic
ggcagcccaggatgatcttgacaagaaccactacctctctgagagcctcactgagcaagagaggctagacaggaa

SEQ ID NO: 344709 - DNA, 75 bp, Artificial Sequence
  Synthetic
aaccactacctctctgagagcctcactgagcaagagaggctagacaggaacagggacgaaagtctcaagatggtg

SEQ ID NO: 344710 - DNA, 75 bp, Artificial Sequence
  Synthetic
aaggtgctgaaaggtctgcctggagccacaaatccacggtcccttttcccggagtaattcctaaggtctctggag

SEQ ID NO: 344711 - DNA, 75 bp, Artificial Sequence
  Synthetic
ggagtaattcctaaggtctctggagacaccacttccctttcgaggctaacggaactgcctgttatcactggaggg

SEQ ID NO: 344712 - DNA, 75 bp, Artificial Sequence
  Synthetic
ggacagcctatggatcagttagcaatggcacagtggagagatgtgatgaggacgtggagagagagaggagagctg

SEQ ID NO: 344713 - DNA, 75 bp, Artificial Sequence
  Synthetic
gattgaagaatccaaggccctcaggatgaagtatcaccgctgcaagattgataatggcatgatggacaaactgga

SEQ ID NO: 344714 - DNA, 75 bp, Artificial Sequence
  Synthetic
atgaagtatcaccgctgcaagattgataatggcatgatggacaaactggatctagcgctccaaggagtggaagct

SEQ ID NO: 344715 - DNA, 75 bp, Artificial Sequence
  Synthetic
tcatcaagaagagagaggagtctaagaagactttccctctgacaactgataccagagacattgacatgttcttgc

SEQ ID NO: 344716 - DNA, 75 bp, Artificial Sequence
  Synthetic
agaattgtcacagacccccccagctccaatgatcgaagctgtgaaggcaggagcagaagctcaatccctgcatgg

SEQ ID NO: 344717 - DNA, 75 bp, Artificial Sequence
  Synthetic
tatcaatctgctctaactttcctcagcttgcctattgggctatggctctttatgtgcacttgcattggagtggag

SEQ ID NO: 344718 - DNA, 75 bp, Artificial Sequence
  Synthetic
gaagctgagattcttcgacatcttccttctgattaagcccaccaactctgggagccatgtcttttattccatagc

SEQ ID NO: 344719 - DNA, 75 bp, Artificial Sequence
  Synthetic
ggagccatgtcttttattccatagcttttccagagtctgccatcactggaaagctacaccgatctcagtgcttca

SEQ ID NO: 344720 - DNA, 75 bp, Artificial Sequence
  Synthetic
aaggccttcagtttgaggatgggtggttttggactgaattcaactcttttaagatgtccaagctgacaaatgtgg

SEQ ID NO: 344721 - DNA, 75 bp, Artificial Sequence
  Synthetic
tctcttttggttctggcgtgacttttatgaagtgccattctgggctggcagtgagaaggattatctagctggaaa

SEQ ID NO: 344722 - DNA, 75 bp, Artificial Sequence
  Synthetic
acaaggctcgcacagaagagattgcaacactgtcacgttacattatgatggagggttttgtcagtccaccttgca

SEQ ID NO: 344723 - DNA, 75 bp, Artificial Sequence
  Synthetic
aagttccaggtttggctcatctcaagaatgctacaaaccatcatcagaatctcggactacccctttaaaataaca

SEQ ID NO: 344724 - DNA, 75 bp, Artificial Sequence
  Synthetic
ctggcatgttcaactgggtcacaggagagcctgttgactcgacccaaaagctcatttctttgttctaccttggtt

SEQ ID NO: 344725 - DNA, 75 bp, Artificial Sequence
  Synthetic
agagagaaacgcaagtgttggcatgtacaagaaaatcttagagtatgaggacaagcatcctggccgatacacgta

SEQ ID NO: 344726 - DNA, 75 bp, Artificial Sequence
  Synthetic
tacaagaaaatcttagagtatgaggacaagcatcctggccgatacacgtacttgggtcttggagatcctcctgct

SEQ ID NO: 344727 - DNA, 75 bp, Artificial Sequence
  Synthetic
cattcatgcagaacacaatctgagacagaattggggagagtccttcaaagctatgatctctcgagacattgttga

SEQ ID NO: 344728 - DNA, 75 bp, Artificial Sequence
  Synthetic
gagtgtctgaagaaggtggaaagtcaaggatgcatgcacatttgtttgttcaagaagcctcaacatggaggtctc

SEQ ID NO: 344729 - DNA, 75 bp, Artificial Sequence
  Synthetic
aggagagagtggtccagttagtgattgagactattgccagacaaatttgcaagagattcaagtcagaaacactca

SEQ ID NO: 344730 - DNA, 75 bp, Artificial Sequence
  Synthetic
aagagattcaagtcagaaacactcactaaccccaaacagaagttggcaatacctgagacacacggactgcgagct

SEQ ID NO: 344731 - DNA, 75 bp, Artificial Sequence
  Synthetic
acctgagacacacggactgcgagctgtaaaaacctgcggaatacaccatgagacagtggccacatcagatgatgc

SEQ ID NO: 344732 - DNA, 75 bp, Artificial Sequence
  Synthetic
tgggttcatcatcagaggatgctctatgttcatgaaaaagcgcataatgattgatcaaagcttgatcaacatcat

SEQ ID NO: 344733 - DNA, 75 bp, Artificial Sequence
  Synthetic
atgttcatgaaaaagcgcataatgattgatcaaagcttgatcaacatcattgatgcgcacaccacccttgaaact

SEQ ID NO: 344734 - DNA, 75 bp, Artificial Sequence
  Synthetic
accgaggttatcatggaagtttagaggatcaaccaaaatggatgcaacgaggtggagcctttgttcagactgaga

SEQ ID NO: 344735 - DNA, 75 bp, Artificial Sequence
  Synthetic
ggtggagcctttgttcagactgagactggcatgatgcaggggatcctgcattacacctctagcctattgcacaca

SEQ ID NO: 344736 - DNA, 75 bp, Artificial Sequence
  Synthetic
tctcacagagattcatcagatcaaaggtgtcagtggatcaacgaccagatgtgctagtggatgttttgcagagct

SEQ ID NO: 344737 - DNA, 75 bp, Artificial Sequence
  Synthetic
tttcccatcaaccgacaagaactcaacaggaaagtacagatacctatctgctctggtcttcaagttcaagaaggt

SEQ ID NO: 344738 - DNA, 75 bp, Artificial Sequence
  Synthetic
tcttccatcaaatcaacgaacaacactttgcaccttcttgaattcaactcagaattcttcttccacataaaccac

SEQ ID NO: 344739 - DNA, 75 bp, Artificial Sequence
  Synthetic
gagatgtataacaacctgacatctgttcttgagggtggaggcagcttctcacttgtgtctttctgtcagtatggc

SEQ ID NO: 344740 - DNA, 75 bp, Artificial Sequence
  Synthetic
ttcttgagggtggaggcagcttctcacttgtgtctttctgtcagtatggccagcttctgctccactacactttgc

SEQ ID NO: 344741 - DNA, 75 bp, Artificial Sequence
  Synthetic
tctagagtacataaaacttgtttcagagattaaggatccatccctgggattcttcctcatggatcatccttttgg

SEQ ID NO: 344742 - DNA, 75 bp, Artificial Sequence
  Synthetic
gagattaaggatccatccctgggattcttcctcatggatcatccttttgggagtggactatctggcttcaagtac

SEQ ID NO: 344743 - DNA, 75 bp, Artificial Sequence
  Synthetic
tcttctggaggccatccaaaactctgacagtgctgctccaaagaaaactctggatacaacaacctctggaacatt

SEQ ID NO: 344744 - DNA, 75 bp, Artificial Sequence
  Synthetic
ggcgacaggaagaaatggcaaagactggttgacaggctgaatctgcctgaggattggctggaaatcattgatcaa

SEQ ID NO: 344745 - DNA, 75 bp, Artificial Sequence
  Synthetic
ggattggctggaaatcattgatcaaaatccagaaattgtttacagacggcctagagatgggactgaagtgagttt

SEQ ID NO: 344746 - DNA, 75 bp, Artificial Sequence
  Synthetic
atcatcctcagtttacatcctgagcagaaacattctgagtgatggattggcatggctgtatgatgaagaagatga

SEQ ID NO: 344747 - DNA, 75 bp, Artificial Sequence
  Synthetic
gtgatgaaccaaccagacttggatgcacactcgaggctcaccccagcacaactgtccactctttttcccatgatg

SEQ ID NO: 344748 - DNA, 75 bp, Artificial Sequence
  Synthetic
acctaaggagctacatgaaaattgatggtgaattcatttcaaagaagaaagtgatcactcagactagaataaaca

SEQ ID NO: 344749 - DNA, 75 bp, Artificial Sequence
  Synthetic
tggtgaattcatttcaaagaagaaagtgatcactcagactagaataaacatcctggaaactgagaggtttttgag

SEQ ID NO: 344750 - DNA, 75 bp, Artificial Sequence
  Synthetic
gtgatcactcagactagaataaacatcctggaaactgagaggtttttgagagcacgtccagaggacctcatagca

SEQ ID NO: 344751 - DNA, 75 bp, Artificial Sequence
  Synthetic
ggaggagtgggatcatctgacagcagttttcccttggctgaagaacaaccctgctgagacactggaacaatcccc

SEQ ID NO: 344752 - DNA, 75 bp, Artificial Sequence
  Synthetic
aacttcttcagcagattggatttgaaaggtagggacatcaggatcattggtgctccaatcaaaaaatccagtgga

SEQ ID NO: 344753 - DNA, 75 bp, Artificial Sequence
  Synthetic
gctgactcatattccagatgaggcagcattggagagaattgaagcagctggcattttgaaacatgcactattcct

SEQ ID NO: 344754 - DNA, 75 bp, Artificial Sequence
  Synthetic
gcattttgaaacatgcactattcctgaccgtgactgggccatacacagatgacacaaggctggagatgtgcaagg

SEQ ID NO: 344755 - DNA, 75 bp, Artificial Sequence
  Synthetic
tctcttgaaacccaaccatgggaaaacaagaagcaatgtgttgtcacttttccaagacttcttttccatgagagg

SEQ ID NO: 344756 - DNA, 75 bp, Artificial Sequence
  Synthetic
acaagaagcaatgtgttgtcacttttccaagacttcttttccatgagagggccagacatcattttcaacagaatt

SEQ ID NO: 344757 - DNA, 75 bp, Artificial Sequence
  Synthetic
tgccaccctaagcagtttctgccattcctggtgcaaagagatgggggtgttcaacacagaagacttttcaaagtc

SEQ ID NO: 344758 - DNA, 75 bp, Artificial Sequence
  Synthetic
gctctcgacagacactgggtgctccgattttcatcgttggagaaagaatattcagaccaatctgctgggatccct

SEQ ID NO: 344759 - DNA, 75 bp, Artificial Sequence
  Synthetic
caaagttggagttcagagtaagagggaacaccttaaacttaacctacagagaatctattcccaaggcagggcaaa

SEQ ID NO: 344760 - DNA, 75 bp, Artificial Sequence
  Synthetic
tgtgaaagacacagatgtctctgatgaaaatgcattcaagttgatgtcactctctccaagacacaagttccatgg

SEQ ID NO: 344761 - DNA, 75 bp, Artificial Sequence
  Synthetic
cagagaacccagcacttcatggatttgtatgagagcattgcctatcaacaccattgacaggctattggacagaat

SEQ ID NO: 344762 - DNA, 75 bp, Artificial Sequence
  Synthetic
tccattgacaatgacaggctggctgaatgcttcaagaatgttctggagtctgctctcaggaggaaaggtgtgttt

SEQ ID NO: 344763 - DNA, 75 bp, Artificial Sequence
  Synthetic
tcgaggaagaaccttggctaggtgggctggacactttctccctcgatgatgaagattatcttgaggaatacaact

SEQ ID NO: 344764 - DNA, 75 bp, Artificial Sequence
  Synthetic
taggaccctttggcatgttcagcgttgagcaagaaatgaacacaaagtactaccatcatctcctgcttgactccc

SEQ ID NO: 344765 - DNA, 75 bp, Artificial Sequence
  Synthetic
agtacaagaaggaagtgtctcgcttgttttccatcttgcagcgagatgctagccgaatagtttggaagagcagag

SEQ ID NO: 344766 - DNA, 75 bp, Artificial Sequence
  Synthetic
gttttccatcttgcagcgagatgctagccgaatagtttggaagagcagagacctcctgtcagagaacatgggtct

SEQ ID NO: 344767 - DNA, 75 bp, Artificial Sequence
  Synthetic
taaagatatataagtgggttccgcatcaaagtcaagctagttctatctatctctaattctttttcttcttttact

SEQ ID NO: 344768 - DNA, 75 bp, Artificial Sequence
  Synthetic
acacaaagacgccaagatgttattagcgatttgctcaagagtaccacaacagcctggactacaatgccctccagc

SEQ ID NO: 344769 - DNA, 75 bp, Artificial Sequence
  Synthetic
gcgatttgctcaagagtaccacaacagcctggactacaatgccctccagcagaaaccttccagtccagccacatg

SEQ ID NO: 344770 - DNA, 75 bp, Artificial Sequence
  Synthetic
agcctggactacaatgccctccagcagaaaccttccagtccagccacatgaggcctccaataccacggtttcttt

SEQ ID NO: 344771 - DNA, 75 bp, Artificial Sequence
  Synthetic
tataaactttgatcttgaatctcttcctcctggctctgtcactggatcttccattggacccaggtttaatcttaa

SEQ ID NO: 344772 - DNA, 75 bp, Artificial Sequence
  Synthetic
cctcctggctctgtcactggatcttccattggacccaggtttaatcttaaggcccaaacagcctcttccttcgta

SEQ ID NO: 344773 - DNA, 75 bp, Artificial Sequence
  Synthetic
gtgatgctgcagatatgcccctgagagatcattttcctttagtgaatgatacatatgaccattggacacctgatt

SEQ ID NO: 344774 - DNA, 75 bp, Artificial Sequence
  Synthetic
agatcattttcctttagtgaatgatacatatgaccattggacacctgatttcatttcaaagaggctggatgggaa

SEQ ID NO: 344775 - DNA, 75 bp, Artificial Sequence
  Synthetic
aaccggtccaatcaggagaattctctcttgggagcattcaacactaaagtggggaagtatgagttagcactgcat

SEQ ID NO: 344776 - DNA, 75 bp, Artificial Sequence
  Synthetic
tcttgggagcattcaacactaaagtggggaagtatgagttagcactgcataatagagcatctggcctaagcatct

SEQ ID NO: 344777 - DNA, 75 bp, Artificial Sequence
  Synthetic
gactcttgtggttacaaatttgcctttaagtcaacaagaagttgatgagctttgttttagatttttggtagctag

SEQ ID NO: 344778 - DNA, 75 bp, Artificial Sequence
  Synthetic
ttaagtcaacaagaagttgatgagctttgttttagatttttggtagctagagcagtccatctagaaatgacaagc

SEQ ID NO: 344779 - DNA, 75 bp, Artificial Sequence
  Synthetic
atgtggatgaagataagaaaagtagagaagtgaaagctgcctttcactcaatcaggccagattgggaatgcactc

SEQ ID NO: 344780 - DNA, 75 bp, Artificial Sequence
  Synthetic
agaagtgaaagctgcctttcactcaatcaggccagattgggaatgcactcaagagaagttctttcctttctctga

SEQ ID NO: 344781 - DNA, 75 bp, Artificial Sequence
  Synthetic
ttagatccagactctgagtatttggctaaagtggttttcaagtcactatctgatgctcagctggaaatggattct

SEQ ID NO: 344782 - DNA, 75 bp, Artificial Sequence
  Synthetic
ctaaagtggttttcaagtcactatctgatgctcagctggaaatggattctgatcattttttaaaggaacctttga

SEQ ID NO: 344783 - DNA, 75 bp, Artificial Sequence
  Synthetic
taaggaagattgtaggcgaataattcgatcttacgaagatgactttaactcaagagcaacaagaagtccctggag

SEQ ID NO: 344784 - DNA, 75 bp, Artificial Sequence
  Synthetic
cgatcttacgaagatgactttaactcaagagcaacaagaagtccctggagtcataaatccactatacctttccct

SEQ ID NO: 344785 - DNA, 75 bp, Artificial Sequence
  Synthetic
ataccactgccatatcacatttaagaaatttgccagtaatcacaggtggttctgatgcaaccattagagcctggc

SEQ ID NO: 344786 - DNA, 75 bp, Artificial Sequence
  Synthetic
aaatttgccagtaatcacaggtggttctgatgcaaccattagagcctggcggtcagcttatagctcagtggtgtg

SEQ ID NO: 344787 - DNA, 75 bp, Artificial Sequence
  Synthetic
gatgttgaaagagaaaggagagctgcattgtgctcactcactttggaggaactagaagagagcaagagcatgaga

SEQ ID NO: 344788 - DNA, 75 bp, Artificial Sequence
  Synthetic
cattgtgctcactcactttggaggaactagaagagagcaagagcatgagagtgaagtaccatcggtgcaagattg

SEQ ID NO: 344789 - DNA, 75 bp, Artificial Sequence
  Synthetic
acttgccctacaaggagtggaggccaaagaattcaggggtcatccggaaatagttaaaaagagatcagaatcaaa

SEQ ID NO: 344790 - DNA, 75 bp, Artificial Sequence
  Synthetic
aaagaattcaggggtcatccggaaatagttaaaaagagatcagaatcaaagaaaacttttccattgtccactgac

SEQ ID NO: 344791 - DNA, 75 bp, Artificial Sequence
  Synthetic
aaaaagatgagtctttgtttgattcggccatgagtcaaacccctcctgctgccattatagaagcagtcaaagcag

SEQ ID NO: 344792 - DNA, 75 bp, Artificial Sequence
  Synthetic
ggccatgagtcaaacccctcctgctgccattatagaagcagtcaaagcaggtgctgatgctcaatccttgcacgg

SEQ ID NO: 344793 - DNA, 75 bp, Artificial Sequence
  Synthetic
tacacctctgtgcttcagttcttgagcttgccaatcggattatggttatttatgtcaacttgtattggggtggaa

SEQ ID NO: 344794 - DNA, 75 bp, Artificial Sequence
  Synthetic
gcttgccaatcggattatggttatttatgtcaacttgtattggggtggaactcagcataagtttaaagcagcact

SEQ ID NO: 344795 - DNA, 75 bp, Artificial Sequence
  Synthetic
gaaactccggttttttgatatctttctacttatcaagcccactaattctggtagtcatgtctttttttcaatagc

SEQ ID NO: 344796 - DNA, 75 bp, Artificial Sequence
  Synthetic
ctacttatcaagcccactaattctggtagtcatgtctttttttcaatagccttccctgagtctgccattttgggg

SEQ ID NO: 344797 - DNA, 75 bp, Artificial Sequence
  Synthetic
agggcttgaattttgaagatggttggttttggacagaattttcatcatttaaaatgtccaagctgaccaatgttg

SEQ ID NO: 344798 - DNA, 75 bp, Artificial Sequence
  Synthetic
gttttggacagaattttcatcatttaaaatgtccaagctgaccaatgttgttaagtctctttcaactggaatgaa

SEQ ID NO: 344799 - DNA, 75 bp, Artificial Sequence
  Synthetic
tatgaggtgccattctggattgggagtgctgcagatcataaactaggaatatcaaaggccaacaagatgtttaaa

SEQ ID NO: 344800 - DNA, 75 bp, Artificial Sequence
  Synthetic
gtgctgcagatcataaactaggaatatcaaaggccaacaagatgtttaaattctgcttgctaatgcaccttgaag

SEQ ID NO: 344801 - DNA, 75 bp, Artificial Sequence
  Synthetic
aacactctctagatatgtactgatggaaggatttgttagccctccttgcatccctaaacctcataaaatggtgga

SEQ ID NO: 344802 - DNA, 75 bp, Artificial Sequence
  Synthetic
gaaggatttgttagccctccttgcatccctaaacctcataaaatggtggaaaaacttcctgaactggctagaact

SEQ ID NO: 344803 - DNA, 75 bp, Artificial Sequence
  Synthetic
gaatgttgcaaacaatggttcgtgtgtcagatagtccatttaagatctctgctggccatagatctgcaagttgga

SEQ ID NO: 344804 - DNA, 75 bp, Artificial Sequence
  Synthetic
gtcagatagtccatttaagatctctgctggccatagatctgcaagttggactggcatattcaattggataacagg

SEQ ID NO: 344805 - DNA, 75 bp, Artificial Sequence
  Synthetic
ttgatttcattattctatttaggctacctgaagaataaagaagaatctccagagcgtaatgctagcattggaatg

SEQ ID NO: 344806 - DNA, 75 bp, Artificial Sequence
  Synthetic
acctgaagaataaagaagaatctccagagcgtaatgctagcattggaatgtacaaaaagattcttgaatatgagg

SEQ ID NO: 344807 - DNA, 75 bp, Artificial Sequence
  Synthetic
cttaggaatgcatgaccctcctccagaagacactagatttcatgaatactcaattagtttcctgaagtatttatg

SEQ ID NO: 344808 - DNA, 75 bp, Artificial Sequence
  Synthetic
gaagacactagatttcatgaatactcaattagtttcctgaagtatttatgcaaccatgcagagaatgaattaaga

SEQ ID NO: 344809 - DNA, 75 bp, Artificial Sequence
  Synthetic
ctatgatcaccagagatattgttgattctattgccagcttggatctagaaaggttggctacacttaaggcctcta

SEQ ID NO: 344810 - DNA, 75 bp, Artificial Sequence
  Synthetic
ttctattgccagcttggatctagaaaggttggctacacttaaggcctctagcaattttaatgaagattggtatca

SEQ ID NO: 344811 - DNA, 75 bp, Artificial Sequence
  Synthetic
catagaagcaaagttatagaaaaggtgagtaagtatgttcgaagaaacaactctcatgtgcatcatatcatggaa

SEQ ID NO: 344812 - DNA, 75 bp, Artificial Sequence
  Synthetic
tgagtaagtatgttcgaagaaacaactctcatgtgcatcatatcatggaagagtgtttaaagaaagtggaggctc

SEQ ID NO: 344813 - DNA, 75 bp, Artificial Sequence
  Synthetic
caagaagccccagcatggaggtctcagagagatttatgtattaggatttgaagagcgtgttgtccagctagtctt

SEQ ID NO: 344814 - DNA, 75 bp, Artificial Sequence
  Synthetic
agagagatttatgtattaggatttgaagagcgtgttgtccagctagtcttggaaaccatagccaggcaaatttgt

SEQ ID NO: 344815 - DNA, 75 bp, Artificial Sequence
  Synthetic
ctaatccaaaacaaaagctgaccatccctgaaactcatggcctgagggctgtcaagacttgtggcattcatcatg

SEQ ID NO: 344816 - DNA, 75 bp, Artificial Sequence
  Synthetic
ccctgaaactcatggcctgagggctgtcaagacttgtggcattcatcatgaaacagtagcaacatctgatgacgc

SEQ ID NO: 344817 - DNA, 75 bp, Artificial Sequence
  Synthetic
gtgacaaagtttgctctcatgctttgtcattttacagatcctttgtttcatggctttatcataagagggtgctca

SEQ ID NO: 344818 - DNA, 75 bp, Artificial Sequence
  Synthetic
gtcattttacagatcctttgtttcatggctttatcataagagggtgctcaatgttcatgaaaaagagaatcatga

SEQ ID NO: 344819 - DNA, 75 bp, Artificial Sequence
  Synthetic
tgattctcatgttgatcttcaaaccaatgatgagtatttgaaaaaaatacataggggttatcatggtagcatttc

SEQ ID NO: 344820 - DNA, 75 bp, Artificial Sequence
  Synthetic
aatgatgagtatttgaaaaaaatacataggggttatcatggtagcatttctgatcaaccaaagtggatggttaga

SEQ ID NO: 344821 - DNA, 75 bp, Artificial Sequence
  Synthetic
ctggtatgatgcaaggaatactccattacacttctagccttctgcacacaatctttcaggaatggatgaggactt

SEQ ID NO: 344822 - DNA, 75 bp, Artificial Sequence
  Synthetic
ttacacttctagccttctgcacacaatctttcaggaatggatgaggacttttactcagaagtatatttgctccag

SEQ ID NO: 344823 - DNA, 75 bp, Artificial Sequence
  Synthetic
gttttagtggatgttcttcagagctctgatgattcagggatgatgatctcatttcccactcaagaaaagaataga

SEQ ID NO: 344824 - DNA, 75 bp, Artificial Sequence
  Synthetic
ctgatgattcagggatgatgatctcatttcccactcaagaaaagaatagaactgcaaagtatagatatctttcag

SEQ ID NO: 344825 - DNA, 75 bp, Artificial Sequence
  Synthetic
cattggcaagtatcttggtatctacgcatctataaaatctacaaacaacactcttcatctgatagagtttaattc

SEQ ID NO: 344826 - DNA, 75 bp, Artificial Sequence
  Synthetic
gcatctataaaatctacaaacaacactcttcatctgatagagtttaattctgaattcttctttcatattaatcat

SEQ ID NO: 344827 - DNA, 75 bp, Artificial Sequence
  Synthetic
ctgcttgtgacactatctctgaacaagagtctctagcttcccgccaagaggaaatgtataacaatttaacctctg

SEQ ID NO: 344828 - DNA, 75 bp, Artificial Sequence
  Synthetic
agagtctctagcttcccgccaagaggaaatgtataacaatttaacctctgtgttagaaggtggtgctagcttttc

SEQ ID NO: 344829 - DNA, 75 bp, Artificial Sequence
  Synthetic
caactgttattacattacacattgttgggaatgacagtttctcctttatttctagaatatatcaagttagtttct

SEQ ID NO: 344830 - DNA, 75 bp, Artificial Sequence
  Synthetic
tgggaatgacagtttctcctttatttctagaatatatcaagttagtttctgagataaaagatccatctttaggct

SEQ ID NO: 344831 - DNA, 75 bp, Artificial Sequence
  Synthetic
atctggactttcaggctttaagtataacgtatggattgcagtacaaaacagtgccctaggagctcgatatagatc

SEQ ID NO: 344832 - DNA, 75 bp, Artificial Sequence
  Synthetic
aacgtatggattgcagtacaaaacagtgccctaggagctcgatatagatcactattggaagcaattgcatctgca

SEQ ID NO: 344833 - DNA, 75 bp, Artificial Sequence
  Synthetic
tagataccacaacttctggcacctttgtgcagtcaacaataataagatttggagacagaaaaaaatggcaaagat

SEQ ID NO: 344834 - DNA, 75 bp, Artificial Sequence
  Synthetic
tgtgcagtcaacaataataagatttggagacagaaaaaaatggcaaagattggttgacaggttaaatctccccaa

SEQ ID NO: 344835 - DNA, 75 bp, Artificial Sequence
  Synthetic
aatccagaagttgtctataggaggcctagagatgggtgtgaagtggctcttaggattgcagagaagatccattca

SEQ ID NO: 344836 - DNA, 75 bp, Artificial Sequence
  Synthetic
ctagagatgggtgtgaagtggctcttaggattgcagagaagatccattcaccaggagtgtcaaattctttatcta

SEQ ID NO: 344837 - DNA, 75 bp, Artificial Sequence
  Synthetic
ttcctcatctgtatacatattgagcagaaacattctcagtgatgggcttgcttggctttatgatgaagaagaagg

SEQ ID NO: 344838 - DNA, 75 bp, Artificial Sequence
  Synthetic
agaaacattctcagtgatgggcttgcttggctttatgatgaagaagaaggacggaaaagaccactactattcaag

SEQ ID NO: 344839 - DNA, 75 bp, Artificial Sequence
  Synthetic
cacattccagactcactcctgctcagatatcaatgatgtttcccatgtctgcagagtaccaaaaactgcaggtgc

SEQ ID NO: 344840 - DNA, 75 bp, Artificial Sequence
  Synthetic
gatatcaatgatgtttcccatgtctgcagagtaccaaaaactgcaggtgcatttccagagttactcagtaattga

SEQ ID NO: 344841 - DNA, 75 bp, Artificial Sequence
  Synthetic
gtcattactcagactaggataaacatacttgaatctgagcggtttttacgagctagaccagaggatttagttgct

SEQ ID NO: 344842 - DNA, 75 bp, Artificial Sequence
  Synthetic
tacttgaatctgagcggtttttacgagctagaccagaggatttagttgctgacatgtggtttggattcaccagaa

SEQ ID NO: 344843 - DNA, 75 bp, Artificial Sequence
  Synthetic
ggaggagtggaaccacttaactgctgtattcccatggttaaaccaggatccttcagtctcattgagagattctcc

SEQ ID NO: 344844 - DNA, 75 bp, Artificial Sequence
  Synthetic
gtattcccatggttaaaccaggatccttcagtctcattgagagattctccttttcaacatcatgtacaattgagg

SEQ ID NO: 344845 - DNA, 75 bp, Artificial Sequence
  Synthetic
agggccgtgacatcagaatcattggtgcaccgatcaagaagtcaagtggtgttagcaatgtttctactgctgtcc

SEQ ID NO: 344846 - DNA, 75 bp, Artificial Sequence
  Synthetic
tgcaccgatcaagaagtcaagtggtgttagcaatgtttctactgctgtccgagacaattttttccctcgatttat

SEQ ID NO: 344847 - DNA, 75 bp, Artificial Sequence
  Synthetic
gccatggagagattggaggctgctggaatgctaaaacatgcattattcttaacagtcacaggaccttacactaat

SEQ ID NO: 344848 - DNA, 75 bp, Artificial Sequence
  Synthetic
gaatgctaaaacatgcattattcttaacagtcacaggaccttacactaatgatacaaaactggacatgtgtatag

SEQ ID NO: 344849 - DNA, 75 bp, Artificial Sequence
  Synthetic
agccctcagacctaatcacggaaagacaagaagtaatgttctttctcttttccaggatttcttttctccacacgg

SEQ ID NO: 344850 - DNA, 75 bp, Artificial Sequence
  Synthetic
acaagaagtaatgttctttctcttttccaggatttcttttctccacacggaaaagatattattttcaatcgaatt

SEQ ID NO: 344851 - DNA, 75 bp, Artificial Sequence
  Synthetic
gaggcttcacatctcctcaaactcttaaagaagttgatgggaagttaacttacacaggtgatggagtgtggagag

SEQ ID NO: 344852 - DNA, 75 bp, Artificial Sequence
  Synthetic
taaagaagttgatgggaagttaacttacacaggtgatggagtgtggagaggtgttgtggatggattccaggtgca

SEQ ID NO: 344853 - DNA, 75 bp, Artificial Sequence
  Synthetic
caaaaggtaaatcagctaaagtcaattagtgttaactctgataaatcaatatctactttagctggtttttgtcat

SEQ ID NO: 344854 - DNA, 75 bp, Artificial Sequence
  Synthetic
ttagtgttaactctgataaatcaatatctactttagctggtttttgtcattcatggtgcaaagagatgggtgtgt

SEQ ID NO: 344855 - DNA, 75 bp, Artificial Sequence
  Synthetic
tcataggatctctaaagcttcatttttcatgtataactttaaaatctctagtgctaagcagtctttaggagctcc

SEQ ID NO: 344856 - DNA, 75 bp, Artificial Sequence
  Synthetic
ttcatgtataactttaaaatctctagtgctaagcagtctttaggagctcccatttctatagtgagtgatagaatc

SEQ ID NO: 344857 - DNA, 75 bp, Artificial Sequence
  Synthetic
atcagctgacattccggttgaggggaaacactctaaatttatcatataatgactctcctcaaggagttagaacaa

SEQ ID NO: 344858 - DNA, 75 bp, Artificial Sequence
  Synthetic
aaacactctaaatttatcatataatgactctcctcaaggagttagaacaaggctcttcaacatcttgagttatac

SEQ ID NO: 344859 - DNA, 75 bp, Artificial Sequence
  Synthetic
gagtgtgcttttaagctcatgacagtatcccaaaaacacaagttccatggcagagaacctagcacctcttggata

SEQ ID NO: 344860 - DNA, 75 bp, Artificial Sequence
  Synthetic
tatcccaaaaacacaagttccatggcagagaacctagcacctcttggatatgcatgagagctttacctattaaca

SEQ ID NO: 344861 - DNA, 75 bp, Artificial Sequence
  Synthetic
tgaatcaaggtccagaataagtggctccattgatacagcaggccttgctgactgcttcaaaaatgtgatggaatc

SEQ ID NO: 344862 - DNA, 75 bp, Artificial Sequence
  Synthetic
tccattgatacagcaggccttgctgactgcttcaaaaatgtgatggaatcagctctgagaaagaagggagttttt

SEQ ID NO: 344863 - DNA, 75 bp, Artificial Sequence
  Synthetic
aaaagatgatgaccactcttagtgctgacatgctagacttctttgcagatatgggattggttgatgattttgaca

SEQ ID NO: 344864 - DNA, 75 bp, Artificial Sequence
  Synthetic
tgacatgctagacttctttgcagatatgggattggttgatgattttgacatggagactgaaccctggttagaagg

SEQ ID NO: 344865 - DNA, 75 bp, Artificial Sequence
  Synthetic
gaggattatcttgaggagtacaacctaggtccttttggaactttttcaacagagcaggaaatgaataccaagtat

SEQ ID NO: 344866 - DNA, 75 bp, Artificial Sequence
  Synthetic
taggtccttttggaactttttcaacagagcaggaaatgaataccaagtattaccaccacatgatcttagatttat

SEQ ID NO: 344867 - DNA, 75 bp, Artificial Sequence
  Synthetic
gtctcttgaaggattgagaaaagtgttctctgagaaactggctccccttacttacaagaaggaggttgaaaggat

SEQ ID NO: 344868 - DNA, 75 bp, Artificial Sequence
  Synthetic
ttctctgagaaactggctccccttacttacaagaaggaggttgaaaggatgatgttcattctacagaaagatttc

SEQ ID NO: 344869 - DNA, 75 bp, Artificial Sequence
  Synthetic
accaattatctgaaaacatgggtttggatgttgatgaagatatgtttggctaaatgcaagattttagtaattact

SEQ ID NO: 344870 - DNA, 75 bp, Artificial Sequence
  Synthetic
ggatgttgatgaagatatgtttggctaaatgcaagattttagtaattactagtaaaggtctggaacatctcacta

SEQ ID NO: 344871 - DNA, 75 bp, Artificial Sequence
  Synthetic
ccaactacagtatctagaacttttattttttgtattgatggagtgatagtacgtatgctaaggatgctgtaattc

SEQ ID NO: 344872 - DNA, 75 bp, Artificial Sequence
  Synthetic
ttttttgtattgatggagtgatagtacgtatgctaaggatgctgtaattcattggattattttgcttaaatcttg

SEQ ID NO: 344873 - DNA, 75 bp, Artificial Sequence
  Synthetic
acacaaagacggctaacatgggtaaatacctgtttattctacttctcctaatcccttcaacaggagcaattttcc

SEQ ID NO: 344874 - DNA, 75 bp, Artificial Sequence
  Synthetic
atacctgtttattctacttctcctaatcccttcaacaggagcaattttccaccagattattgatgcctccagaag

SEQ ID NO: 344875 - DNA, 75 bp, Artificial Sequence
  Synthetic
atcccttcaacaggagcaattttccaccagattattgatgcctccagaagaattctggaacatcctgaaaccaca

SEQ ID NO: 344876 - DNA, 75 bp, Artificial Sequence
  Synthetic
acagcctgaccaagagtgatcacaccacaattccagccacacaaatagttgaaaaaaatgcgaccaaagacaatt

SEQ ID NO: 344877 - DNA, 75 bp, Artificial Sequence
  Synthetic
cacaattccagccacacaaatagttgaaaaaaatgcgaccaaagacaatttcactagatatcttcaaaactatag

SEQ ID NO: 344878 - DNA, 75 bp, Artificial Sequence
  Synthetic
aatggattaatcatgatggatcttcatgatagaaaattcatcagggtgcactgcaatgacaatgaatcattcagt

SEQ ID NO: 344879 - DNA, 75 bp, Artificial Sequence
  Synthetic
atgatagaaaattcatcagggtgcactgcaatgacaatgaatcattcagtcaagattgcaggatgtgctcttccc

SEQ ID NO: 344880 - DNA, 75 bp, Artificial Sequence
  Synthetic
agatttagtttatgatgatgtaatctgccaatctgactatgacaacccctctacattaccacagcatgatacaaa

SEQ ID NO: 344881 - DNA, 75 bp, Artificial Sequence
  Synthetic
tgccaatctgactatgacaacccctctacattaccacagcatgatacaaagttctgtgaggtgggtcccatcaga

SEQ ID NO: 344882 - DNA, 75 bp, Artificial Sequence
  Synthetic
aatcaatccagcatgtgaactggttttggattgatggacagattagattcattgatgagttttcagtttcctgga

SEQ ID NO: 344883 - DNA, 75 bp, Artificial Sequence
  Synthetic
ttggattgatggacagattagattcattgatgagttttcagtttcctggattgaagggaaatttatttccttatt

SEQ ID NO: 344884 - DNA, 75 bp, Artificial Sequence
  Synthetic
tcacacagttgcaataaaacgatttgtctagagggatcttgcacaggggatgtccaattctgtacagaattcacc

SEQ ID NO: 344885 - DNA, 75 bp, Artificial Sequence
  Synthetic
gtctagagggatcttgcacaggggatgtccaattctgtacagaattcacctgtaaacttgatagtccagcttgca

SEQ ID NO: 344886 - DNA, 75 bp, Artificial Sequence
  Synthetic
tgtggcaatgatccacagtaaagtaggatccttcctgccagcatgttttggacgatcaatgtgggcggtgaaaaa

SEQ ID NO: 344887 - DNA, 75 bp, Artificial Sequence
  Synthetic
ggatccttcctgccagcatgttttggacgatcaatgtgggcggtgaaaaaacacatttctaaaagatcattgaac

SEQ ID NO: 344888 - DNA, 75 bp, Artificial Sequence
  Synthetic
aaacatcctgcaagccaaatgacatacaggtggtagttagacattttgatccagattactaccaggcatgtctag

SEQ ID NO: 344889 - DNA, 75 bp, Artificial Sequence
  Synthetic
acaggtggtagttagacattttgatccagattactaccaggcatgtctaggatccacttgtctgactggcagagc

SEQ ID NO: 344890 - DNA, 75 bp, Artificial Sequence
  Synthetic
ttcaagatggcagatagactgtctgatgctaaactgcaaattagcatttgggataaatcaaaaaggaatgaatat

SEQ ID NO: 344891 - DNA, 75 bp, Artificial Sequence
  Synthetic
atgctaaactgcaaattagcatttgggataaatcaaaaaggaatgaatataaaattaactcttactgtgaaatga

SEQ ID NO: 344892 - DNA, 75 bp, Artificial Sequence
  Synthetic
ctggttctgccgtgcaaattgggccaatattcattgcttctccaaagaacaaatcctaatcttggtgtttgcatt

SEQ ID NO: 344893 - DNA, 75 bp, Artificial Sequence
  Synthetic
aatattcattgcttctccaaagaacaaatcctaatcttggtgtttgcatttgccttatgcattgttgctatagcc

SEQ ID NO: 344894 - DNA, 75 bp, Artificial Sequence
  Synthetic
ttgtcgcagtattgtggaaaattctgtgcccgattgtgtgggtcatgtcagtgatttttaggactatcttaaaaa

SEQ ID NO: 344895 - DNA, 75 bp, Artificial Sequence
  Synthetic
gtgcccgattgtgtgggtcatgtcagtgatttttaggactatcttaaaaatcattagaaggaagtcatcatccat

SEQ ID NO: 344896 - DNA, 75 bp, Artificial Sequence
  Synthetic
aatggcttaaaaaatgaagagaggtttccaatgacttctgacttacaggtgagaacacagaaaaatggactgagc

SEQ ID NO: 344897 - DNA, 75 bp, Artificial Sequence
  Synthetic
ttccaatgacttctgacttacaggtgagaacacagaaaaatggactgagcacaagagagaaaatgtttcagatta

SEQ ID NO: 344898 - DNA, 75 bp, Artificial Sequence
  Synthetic
agtaatttgtatagccacaccagcatatggctgctcagattctttatcaatcacggcatccacccaacgctgcac

SEQ ID NO: 344899 - DNA, 75 bp, Artificial Sequence
  Synthetic
tatggctgctcagattctttatcaatcacggcatccacccaacgctgcacaacaaaccatgaaggtttcactacc

SEQ ID NO: 344900 - DNA, 75 bp, Artificial Sequence
  Synthetic
tacatgttagtccaaaagggcaggaaagttgcttaatgattaaaaatccttccaatcaagttgtggatgtgttgc

SEQ ID NO: 344901 - DNA, 75 bp, Artificial Sequence
  Synthetic
aagttgcttaatgattaaaaatccttccaatcaagttgtggatgtgttgcgcataagaactgaaagcataaagtt

SEQ ID NO: 344902 - DNA, 75 bp, Artificial Sequence
  Synthetic
tgggttcctcgagttacacaccaatgccttggagtaagaaggtgccatctgatgggggactgtgttggcgaaaag

SEQ ID NO: 344903 - DNA, 75 bp, Artificial Sequence
  Synthetic
gccttggagtaagaaggtgccatctgatgggggactgtgttggcgaaaagtgtgcagcatttaggctgacagatt

SEQ ID NO: 344904 - DNA, 75 bp, Artificial Sequence
  Synthetic
agaactgatgtctagacaaggctggagctactgtgtagagcagtgtggcggtgccttatgtcagtgttttaacct

SEQ ID NO: 344905 - DNA, 75 bp, Artificial Sequence
  Synthetic
agctactgtgtagagcagtgtggcggtgccttatgtcagtgttttaacctcagaccatcatgtttttatcttcga

SEQ ID NO: 344906 - DNA, 75 bp, Artificial Sequence
  Synthetic
atgcttacaacatgtttgaatgttcagaatggaactataaaattgaggcaacatttatttcaaactccaccaggt

SEQ ID NO: 344907 - DNA, 75 bp, Artificial Sequence
  Synthetic
agaatggaactataaaattgaggcaacatttatttcaaactccaccaggtctaacatcactctacaattaggagt

SEQ ID NO: 344908 - DNA, 75 bp, Artificial Sequence
  Synthetic
gtaagcctgtcaacggtgtctcagccaccttctattgcatattctgaatgttttggggaggatcaacatggtata

SEQ ID NO: 344909 - DNA, 75 bp, Artificial Sequence
  Synthetic
caccttctattgcatattctgaatgttttggggaggatcaacatggtataaagttccatgcagtctgcaacagga

SEQ ID NO: 344910 - DNA, 75 bp, Artificial Sequence
  Synthetic
aggagaaattcagtgtcccacaaaagctgatgctcttagcgtgtccaggcattgtttgacctcagaatctataat

SEQ ID NO: 344911 - DNA, 75 bp, Artificial Sequence
  Synthetic
gctgatgctcttagcgtgtccaggcattgtttgacctcagaatctataattttatccaaggtccacaaagattca

SEQ ID NO: 344912 - DNA, 75 bp, Artificial Sequence
  Synthetic
atccacagttgatcttatccaaaaataaattaccagcaacaattggctcagtaacattctggccaactccaggag

SEQ ID NO: 344913 - DNA, 75 bp, Artificial Sequence
  Synthetic
taaattaccagcaacaattggctcagtaacattctggccaactccaggaggaattgaggctgcagtacctaacct

SEQ ID NO: 344914 - DNA, 75 bp, Artificial Sequence
  Synthetic
ctagatggctattatgtacaatataagtctgacaacaataaatgcagtgccagatttcttaatgtaagtgggtgt

SEQ ID NO: 344915 - DNA, 75 bp, Artificial Sequence
  Synthetic
agtctgacaacaataaatgcagtgccagatttcttaatgtaagtgggtgttataattgtgaagcaggggcaaagc

SEQ ID NO: 344916 - DNA, 75 bp, Artificial Sequence
  Synthetic
tggttctgcccttggccttttaaattgtccagaactggattatagcacttattttgaggtgcatcagaacatcga

SEQ ID NO: 344917 - DNA, 75 bp, Artificial Sequence
  Synthetic
tgtccagaactggattatagcacttattttgaggtgcatcagaacatcgaaaaggtttatagaaccattcatgtc

SEQ ID NO: 344918 - DNA, 75 bp, Artificial Sequence
  Synthetic
gctcattcaaatgccctaattctgaaacaacattgacaatccagggcgagctcatttaccttttcaatgatgatg

SEQ ID NO: 344919 - DNA, 75 bp, Artificial Sequence
  Synthetic
aacaacattgacaatccagggcgagctcatttaccttttcaatgatgatgtgagacatcacaatcaatctttatc

SEQ ID NO: 344920 - DNA, 75 bp, Artificial Sequence
  Synthetic
ttgggatgggatccatttggctggctaaaaacttcatggtttagaatactgtgggctctgttaggtagcacattg

SEQ ID NO: 344921 - DNA, 75 bp, Artificial Sequence
  Synthetic
taaaaacttcatggtttagaatactgtgggctctgttaggtagcacattgtcaatcataattgggatagtggtca

SEQ ID NO: 344922 - DNA, 75 bp, Artificial Sequence
  Synthetic
aaaatctaagaagtcatagaatagtttggctcagcaatgctaatctactaaattaataaacgtaaaatgtaaaat

SEQ ID NO: 344923 - DNA, 75 bp, Artificial Sequence
  Synthetic
ttggctcagcaatgctaatctactaaattaataaacgtaaaatgtaaaatgaagtagaaaataaaacataaataa

SEQ ID NO: 344924 - DNA, 75 bp, Artificial Sequence
  Synthetic
acttacagttacactttactcaattggtttggtattcatcagttccacaccctttaaaactattaagattttaag

SEQ ID NO: 344925 - DNA, 75 bp, Artificial Sequence
  Synthetic
ggtttggtattcatcagttccacaccctttaaaactattaagattttaagtaccacatttgtttttccatgaagc

SEQ ID NO: 344926 - DNA, 75 bp, Artificial Sequence
  Synthetic
acacaaagacctccaactaagcgattgatcaatcatgactactgaggtggactgggtgcgctttgctattgatct

SEQ ID NO: 344927 - DNA, 75 bp, Artificial Sequence
  Synthetic
tgatcaatcatgactactgaggtggactgggtgcgctttgctattgatctctctgatgctcagtgggatgatgag

SEQ ID NO: 344928 - DNA, 75 bp, Artificial Sequence
  Synthetic
actgggtgcgctttgctattgatctctctgatgctcagtgggatgatgaggaaatcaccgccttcatcaacctgt

SEQ ID NO: 344929 - DNA, 75 bp, Artificial Sequence
  Synthetic
cgtggtccttcgaaggatccacgagctggcacagagagcagggctggacaggaatcagatgatccgggacatcag

SEQ ID NO: 344930 - DNA, 75 bp, Artificial Sequence
  Synthetic
ctggcacagagagcagggctggacaggaatcagatgatccgggacatcagggctctgattgtcctccatctgact

SEQ ID NO: 344931 - DNA, 75 bp, Artificial Sequence
  Synthetic
agaagcggctctcagaagccggtaagaaggagtttgctctcctgaaggcccgataccatctcgtggacaaggcca

SEQ ID NO: 344932 - DNA, 75 bp, Artificial Sequence
  Synthetic
gaaggagtttgctctcctgaaggcccgataccatctcgtggacaaggccaaggaagcagctgatttgaccctgtc

SEQ ID NO: 344933 - DNA, 75 bp, Artificial Sequence
  Synthetic
ctgacatgcaggcttctgccccaagtggtgactcacactgcagtcactcgctctcgcatggagagcctgagtcct

SEQ ID NO: 344934 - DNA, 75 bp, Artificial Sequence
  Synthetic
tggtgactcacactgcagtcactcgctctcgcatggagagcctgagtcctgaatatcctgtgcagatgatgcaca

SEQ ID NO: 344935 - DNA, 75 bp, Artificial Sequence
  Synthetic
gaccctgcctgaggagtccatcaaggacttggtggatgctcacaggctctatctcctggagttttcacgcaccat

SEQ ID NO: 344936 - DNA, 75 bp, Artificial Sequence
  Synthetic
gacttggtggatgctcacaggctctatctcctggagttttcacgcaccatcaacgtgaaacaccgtgggatggag

SEQ ID NO: 344937 - DNA, 75 bp, Artificial Sequence
  Synthetic
actcagctctccaagcgggcctggcaagctcatttctaacaccacctcagaaacgagcttacctgaaggctttca

SEQ ID NO: 344938 - DNA, 75 bp, Artificial Sequence
  Synthetic
aagctcatttctaacaccacctcagaaacgagcttacctgaaggctttcaagcttgtggatgagaacgggagagt

SEQ ID NO: 344939 - DNA, 75 bp, Artificial Sequence
  Synthetic
cttgctctcagaaagttgatttaagagcaagagaaatttagaattcggccaaattaaaacttttccaattggact

SEQ ID NO: 344940 - DNA, 75 bp, Artificial Sequence
  Synthetic
agcaagagaaatttagaattcggccaaattaaaacttttccaattggactccaaaagggcttaggcccaccctac

SEQ ID NO: 344941 - DNA, 75 bp, Artificial Sequence
  Synthetic
tagtgaaactggtgtccagaaggcgctccctaacctcttcaaactctgcccaatgctctgtaagatccactttct

SEQ ID NO: 344942 - DNA, 75 bp, Artificial Sequence
  Synthetic
ctccctaacctcttcaaactctgcccaatgctctgtaagatccactttctcagggtgaaccttcaagtttctcag

SEQ ID NO: 344943 - DNA, 75 bp, Artificial Sequence
  Synthetic
tggttcttcttgccaatacatgggaaaggcttgtagtagcaaggagcacactccatccacgtgaagaactgcttc

SEQ ID NO: 344944 - DNA, 75 bp, Artificial Sequence
  Synthetic
aaggcttgtagtagcaaggagcacactccatccacgtgaagaactgcttcctattgtgctcctcccatctggaca

SEQ ID NO: 344945 - DNA, 75 bp, Artificial Sequence
  Synthetic
aagaagacagatgtctttagacaggatctgtccggtcacctcaaactcagtgaagcccatcttcctaaccttctt

SEQ ID NO: 344946 - DNA, 75 bp, Artificial Sequence
  Synthetic
atctgtccggtcacctcaaactcagtgaagcccatcttcctaaccttctttctcaccttgagggctgcctggaag

SEQ ID NO: 344947 - DNA, 75 bp, Artificial Sequence
  Synthetic
tcttgagtctccggcgtttcttagggtcctgatcaccgaaaaggataatgctgcagattgtgagcatggcacctc

SEQ ID NO: 344948 - DNA, 75 bp, Artificial Sequence
  Synthetic
gtcctgatcaccgaaaaggataatgctgcagattgtgagcatggcacctctgagagttcgatttgagacgatgtt

SEQ ID NO: 344949 - DNA, 75 bp, Artificial Sequence
  Synthetic
aggatgagaggccttttcttctgcaggggccagccagagtgctcaacaatccgatttgcttcgtaatcccttaga

SEQ ID NO: 344950 - DNA, 75 bp, Artificial Sequence
  Synthetic
ggggccagccagagtgctcaacaatccgatttgcttcgtaatcccttagagactggagaccatcaaggaggatct

SEQ ID NO: 344951 - DNA, 75 bp, Artificial Sequence
  Synthetic
ccaggctattgaacccaggtccactccaggtgaagccctcttaatgtggatgatgctagggaagtagccttcatc

SEQ ID NO: 344952 - DNA, 75 bp, Artificial Sequence
  Synthetic
ctcatatctgggggacatatggtgtgactgggagagagatcactgggagtgatcttgaagtatgccatgcttaat

SEQ ID NO: 344953 - DNA, 75 bp, Artificial Sequence
  Synthetic
acacaaagacgccaagatgcttctagcgatatcatcaagaaccactcatgtccagggtctcaactgccctccagc

SEQ ID NO: 344954 - DNA, 75 bp, Artificial Sequence
  Synthetic
gcgatatcatcaagaaccactcatgtccagggtctcaactgccctccagcagtcacccacacctctagtcacatg

SEQ ID NO: 344955 - DNA, 75 bp, Artificial Sequence
  Synthetic
tccagggtctcaactgccctccagcagtcacccacacctctagtcacatgaggcctccaatccctgcctttctct

SEQ ID NO: 344956 - DNA, 75 bp, Artificial Sequence
  Synthetic
gatagactttgatctggacagtcttcctgttggatcagtcaccggctcttctataggcccaaaattcaagataaa

SEQ ID NO: 344957 - DNA, 75 bp, Artificial Sequence
  Synthetic
cctgttggatcagtcaccggctcttctataggcccaaaattcaagataaaaacgcagtctgcttcctcctttgtc

SEQ ID NO: 344958 - DNA, 75 bp, Artificial Sequence
  Synthetic
gtgatgcatctgatatgcctctgagggaccatttccccatagtcaatgacacttttgaccactggacccctgatt

SEQ ID NO: 344959 - DNA, 75 bp, Artificial Sequence
  Synthetic
ggaccatttccccatagtcaatgacacttttgaccactggacccctgatttcattgcacagaggcttgatggaag

SEQ ID NO: 344960 - DNA, 75 bp, Artificial Sequence
  Synthetic
aacagatctgactcagagcaatccttattgggagctttcaatactaaggtaggaaagtatgaggttgcactgcac

SEQ ID NO: 344961 - DNA, 75 bp, Artificial Sequence
  Synthetic
tattgggagctttcaatactaaggtaggaaagtatgaggttgcactgcacaatagagcagcattcactgatgttc

SEQ ID NO: 344962 - DNA, 75 bp, Artificial Sequence
  Synthetic
gacgacagtggtgaccaatctggatctgaatcagcaagaggtggatgagctttgctttaggttcctggttgcaag

SEQ ID NO: 344963 - DNA, 75 bp, Artificial Sequence
  Synthetic
ctgaatcagcaagaggtggatgagctttgctttaggttcctggttgcaagagctgttcatttagagatgacctct

SEQ ID NO: 344964 - DNA, 75 bp, Artificial Sequence
  Synthetic
atgtagatgaggacaagaggagcagagaagtcaaggcagcattccactctgttcaacctaattgggaagagactg

SEQ ID NO: 344965 - DNA, 75 bp, Artificial Sequence
  Synthetic
agaagtcaaggcagcattccactctgttcaacctaattgggaagagactgaaggcaagttttatccatttactaa

SEQ ID NO: 344966 - DNA, 75 bp, Artificial Sequence
  Synthetic
tctgaacctgacaaggagtacttaactcacatcataacagatgccatgaagcaggctaaagaagacttgaagaaa

SEQ ID NO: 344967 - DNA, 75 bp, Artificial Sequence
  Synthetic
ctcacatcataacagatgccatgaagcaggctaaagaagacttgaagaaaaaccattatctggatgaaattctca

SEQ ID NO: 344968 - DNA, 75 bp, Artificial Sequence
  Synthetic
tagagcagagagtctgacaatggtgcagagttatgaggctgagtttaatgcatctgctgagaggtcgccgtggag

SEQ ID NO: 344969 - DNA, 75 bp, Artificial Sequence
  Synthetic
cagagttatgaggctgagtttaatgcatctgctgagaggtcgccgtggagtcataaatccacaattcccttccca

SEQ ID NO: 344970 - DNA, 75 bp, Artificial Sequence
  Synthetic
acacaacctcaatctcaagacttgcagagctgcctgtaataactggtggttcagatgcaaccatcagagcatgga

SEQ ID NO: 344971 - DNA, 75 bp, Artificial Sequence
  Synthetic
agagctgcctgtaataactggtggttcagatgcaaccatcagagcatggagaacagcctatggctctgtatgcaa

SEQ ID NO: 344972 - DNA, 75 bp, Artificial Sequence
  Synthetic
gatgtagagcaggagagaagagctgccctttgttccttaacagttgaggagattgacgaggctaaggccatgaga

SEQ ID NO: 344973 - DNA, 75 bp, Artificial Sequence
  Synthetic
ccctttgttccttaacagttgaggagattgacgaggctaaggccatgagagtaaagtaccacaggtgcaaaattg

SEQ ID NO: 344974 - DNA, 75 bp, Artificial Sequence
  Synthetic
gctggctttgcagggtgtggaggctaaggagttcaggtctcacccagccatcatgaggaagcgacaagagtccaa

SEQ ID NO: 344975 - DNA, 75 bp, Artificial Sequence
  Synthetic
aaggagttcaggtctcacccagccatcatgaggaagcgacaagagtccaagaaaactttcccactgactgctgac

SEQ ID NO: 344976 - DNA, 75 bp, Artificial Sequence
  Synthetic
atcatgatgatgaaatgttcaatgatggtgagtctcaaacccctcctgcctcaatgatagaagcaatcaaggctg

SEQ ID NO: 344977 - DNA, 75 bp, Artificial Sequence
  Synthetic
tggtgagtctcaaacccctcctgcctcaatgatagaagcaatcaaggctggggctgaggcacaatcactgcatgg

SEQ ID NO: 344978 - DNA, 75 bp, Artificial Sequence
  Synthetic
tacaaagcttgcctgtggtttcttggccttcccataggcttgtggctcttcatgtgcacatgcataggggtggag

SEQ ID NO: 344979 - DNA, 75 bp, Artificial Sequence
  Synthetic
gccttcccataggcttgtggctcttcatgtgcacatgcataggggtggagctcagcatcagcttgaagcagcact

SEQ ID NO: 344980 - DNA, 75 bp, Artificial Sequence
  Synthetic
aaaactcaggttctttgacattttcctcctagttaagcccacgaattctggcagtcatgtcttctactcattggc

SEQ ID NO: 344981 - DNA, 75 bp, Artificial Sequence
  Synthetic
ctcctagttaagcccacgaattctggcagtcatgtcttctactcattggctttcccagagagtgctattctgggt

SEQ ID NO: 344982 - DNA, 75 bp, Artificial Sequence
  Synthetic
aaggactctcatttgaagatggatggttctggactgaattcagttcattcaagatgtcaaagctgaccaatgtcg

SEQ ID NO: 344983 - DNA, 75 bp, Artificial Sequence
  Synthetic
gttctggactgaattcagttcattcaagatgtcaaagctgaccaatgtcgtgaagacgttatcaactggctttaa

SEQ ID NO: 344984 - DNA, 75 bp, Artificial Sequence
  Synthetic
tatgaagttcctttctggacaggaagtgcaaaggattacctgtctgggaaaaagagagctcacaaaatgttcaag

SEQ ID NO: 344985 - DNA, 75 bp, Artificial Sequence
  Synthetic
gtgcaaaggattacctgtctgggaaaaagagagctcacaaaatgttcaagttctgtcttctgatgctcttggaag

SEQ ID NO: 344986 - DNA, 75 bp, Artificial Sequence
  Synthetic
cacactatccaggtacgtcatgatggagggttttgtgagtccaccctgtataccaaagccacagaaaatgattga

SEQ ID NO: 344987 - DNA, 75 bp, Artificial Sequence
  Synthetic
gagggttttgtgagtccaccctgtataccaaagccacagaaaatgattgaaaaattgccaagaatggctaggacc

SEQ ID NO: 344988 - DNA, 75 bp, Artificial Sequence
  Synthetic
aaatgctccaaaccatacttagggtttcagatttccccttcaagatcacagctggacacagatcagccaactgga

SEQ ID NO: 344989 - DNA, 75 bp, Artificial Sequence
  Synthetic
ttcagatttccccttcaagatcacagctggacacagatcagccaactggaatgggatcttcaactgggtgacagg

SEQ ID NO: 344990 - DNA, 75 bp, Artificial Sequence
  Synthetic
ttgatctccttgttctatctggggtacctaaagaataaggaagagtctcctgagagaaatgcaagcattgggatg

SEQ ID NO: 344991 - DNA, 75 bp, Artificial Sequence
  Synthetic
acctaaagaataaggaagagtctcctgagagaaatgcaagcattgggatgtacaagaaaatattggagtatgagg

SEQ ID NO: 344992 - DNA, 75 bp, Artificial Sequence
  Synthetic
tcttgggttgggggacccaccaagcgatgatctgagattccatgagtattctgttagctttctaaagcatctctg

SEQ ID NO: 344993 - DNA, 75 bp, Artificial Sequence
  Synthetic
gatgatctgagattccatgagtattctgttagctttctaaagcatctctgtctccatgctgagcatgatctgagg

SEQ ID NO: 344994 - DNA, 75 bp, Artificial Sequence
  Synthetic
gcatgatcacccgagatatagtggatgccatagcgtccattgatctggagagattggcaaccttgaaggcttcca

SEQ ID NO: 344995 - DNA, 75 bp, Artificial Sequence
  Synthetic
tgccatagcgtccattgatctggagagattggcaaccttgaaggcttccagcaacttcaatgaagaatggtatca

SEQ ID NO: 344996 - DNA, 75 bp, Artificial Sequence
  Synthetic
catagatgcaaagttctagagaaagtgagccagtacatcaagaagagcagctcacatctgcatcatattatggaa

SEQ ID NO: 344997 - DNA, 75 bp, Artificial Sequence
  Synthetic
tgagccagtacatcaagaagagcagctcacatctgcatcatattatggaagagtgtctcaggaaagtggaaggtc

SEQ ID NO: 344998 - DNA, 75 bp, Artificial Sequence
  Synthetic
caagaaacctcagcatggtggactgagagaaatttatgtgttaggatttgaggagagggtggttcagctggttat

SEQ ID NO: 344999 - DNA, 75 bp, Artificial Sequence
  Synthetic
agagaaatttatgtgttaggatttgaggagagggtggttcagctggttattgaaaccattgccagacagatttgc

SEQ ID NO: 345000 - DNA, 75 bp, Artificial Sequence
  Synthetic
ctaaccctaaacagaaactggccattccggaaactcacggactcagggctgtaaagacatgtggaatccatcacg

SEQ ID NO: 345001 - DNA, 75 bp, Artificial Sequence
  Synthetic
tccggaaactcacggactcagggctgtaaagacatgtggaatccatcacgaaactgtggccacctctgatgatgc

SEQ ID NO: 345002 - DNA, 75 bp, Artificial Sequence
  Synthetic
gtgactaaatttgctctcatgctttgccacttcactgatcctctctttcatggattcatcattcgtggttgctct

SEQ ID NO: 345003 - DNA, 75 bp, Artificial Sequence
  Synthetic
gccacttcactgatcctctctttcatggattcatcattcgtggttgctctctattcatgaggaagagaatcatga

SEQ ID NO: 345004 - DNA, 75 bp, Artificial Sequence
  Synthetic
tgactcccatacatctctggacacaactgatgagtacctacagaaaatccatcgaggttatcatggtagtattga

SEQ ID NO: 345005 - DNA, 75 bp, Artificial Sequence
  Synthetic
actgatgagtacctacagaaaatccatcgaggttatcatggtagtattgatgagcaacctaggtggatggttaga

SEQ ID NO: 345006 - DNA, 75 bp, Artificial Sequence
  Synthetic
caggcatgatgcaaggtatactgcattacacttcaagtttgctccacactctgctccaggagtggctgaagaact

SEQ ID NO: 345007 - DNA, 75 bp, Artificial Sequence
  Synthetic
ttacacttcaagtttgctccacactctgctccaggagtggctgaagaactttgctcaaaagtttatcagatcaaa

SEQ ID NO: 345008 - DNA, 75 bp, Artificial Sequence
  Synthetic
gttctcatagatgtccttcagagttcagatgattcaggcatgatgatatccttcccatcgatggataaagcaact

SEQ ID NO: 345009 - DNA, 75 bp, Artificial Sequence
  Synthetic
cagatgattcaggcatgatgatatccttcccatcgatggataaagcaactacagggaagtacagatacctagctg

SEQ ID NO: 345010 - DNA, 75 bp, Artificial Sequence
  Synthetic
agtcgggcggtatttggggatctactcatccgtgaaatccaccaacaacactttgcaccttcttgaattcaattc

SEQ ID NO: 345011 - DNA, 75 bp, Artificial Sequence
  Synthetic
tcatccgtgaaatccaccaacaacactttgcaccttcttgaattcaattcagaattcttcttccacatcaatcac

SEQ ID NO: 345012 - DNA, 75 bp, Artificial Sequence
  Synthetic
ctgcttgtgatactatctctgaacaggaatctttagcatctcgtcaggaggagatgtataacaaccttacatctg

SEQ ID NO: 345013 - DNA, 75 bp, Artificial Sequence
  Synthetic
ggaatctttagcatctcgtcaggaggagatgtataacaaccttacatctgttctcgagggtggaggtagcttctc

SEQ ID NO: 345014 - DNA, 75 bp, Artificial Sequence
  Synthetic
caactaatgcttcattacacactccttggcatgacagtctcacctcttttcctggagtatattaaactagtgtct

SEQ ID NO: 345015 - DNA, 75 bp, Artificial Sequence
  Synthetic
ttggcatgacagtctcacctcttttcctggagtatattaaactagtgtctgagatcaaggatccctcacttggtt

SEQ ID NO: 345016 - DNA, 75 bp, Artificial Sequence
  Synthetic
atctggcctctctggattcaaatacaatgtttgggtagcggttcagaacagtgtgcttggatctaggtacaggtg

SEQ ID NO: 345017 - DNA, 75 bp, Artificial Sequence
  Synthetic
aatgtttgggtagcggttcagaacagtgtgcttggatctaggtacaggtgtttgcttgaagcaatccaagattca

SEQ ID NO: 345018 - DNA, 75 bp, Artificial Sequence
  Synthetic
tggacacaacatcttcagggacttttgtgcagtccaccatcataagatttggagacagaaagaagtggcaaagat

SEQ ID NO: 345019 - DNA, 75 bp, Artificial Sequence
  Synthetic
tgtgcagtccaccatcataagatttggagacagaaagaagtggcaaagattagtggatagactaagtctccctgc

SEQ ID NO: 345020 - DNA, 75 bp, Artificial Sequence
  Synthetic
aaccctgaggtagtgtacaggaggccacgggatggatttgaggtctcgctgagaattgcagagaagatacattcc

SEQ ID NO: 345021 - DNA, 75 bp, Artificial Sequence
  Synthetic
cacgggatggatttgaggtctcgctgagaattgcagagaagatacattcccctggagtctccaattccctatcta

SEQ ID NO: 345022 - DNA, 75 bp, Artificial Sequence
  Synthetic
ctcatcctctgtgtacatactgagcaggaacatcctgagtgatggacttgcttggttgtatgatgaggaagagat

SEQ ID NO: 345023 - DNA, 75 bp, Artificial Sequence
  Synthetic
aggaacatcctgagtgatggacttgcttggttgtatgatgaggaagagatggtcaagagaccactgttgttcaag

SEQ ID NO: 345024 - DNA, 75 bp, Artificial Sequence
  Synthetic
tgcactcacgattgaccccagctcagctgtcgtccctgttcccaatgatggctgagtttgagaaactacaaattc

SEQ ID NO: 345025 - DNA, 75 bp, Artificial Sequence
  Synthetic
gctgtcgtccctgttcccaatgatggctgagtttgagaaactacaaattcacctgaggagctacaccaagataga

SEQ ID NO: 345026 - DNA, 75 bp, Artificial Sequence
  Synthetic
gtcataacccaaactagaataaacattctggaaacagagaggtttctgagagcaagaccagaggacctggtggca

SEQ ID NO: 345027 - DNA, 75 bp, Artificial Sequence
  Synthetic
ttctggaaacagagaggtttctgagagcaagaccagaggacctggtggcagacatgtggtttgggtacacccgaa

SEQ ID NO: 345028 - DNA, 75 bp, Artificial Sequence
  Synthetic
agaggagtggagacacctagtttctgtgtttccatggctaaaggactctcctaaagataccctggaatcatcccc

SEQ ID NO: 345029 - DNA, 75 bp, Artificial Sequence
  Synthetic
gtgtttccatggctaaaggactctcctaaagataccctggaatcatccccatttcagcatcatgtccaactgaga

SEQ ID NO: 345030 - DNA, 75 bp, Artificial Sequence
  Synthetic
aaggtagagacatcagaataattggagctccaattaaaaaatccagtggagtgagcaatgtgtcaacggccatca

SEQ ID NO: 345031 - DNA, 75 bp, Artificial Sequence
  Synthetic
agctccaattaaaaaatccagtggagtgagcaatgtgtcaacggccatcagggataatttctttccacggttcat

SEQ ID NO: 345032 - DNA, 75 bp, Artificial Sequence
  Synthetic
gccatggagagaattgaagcagctgggatcctaaaacatgctctgttcctgacagtgacaggaccatacacggac

SEQ ID NO: 345033 - DNA, 75 bp, Artificial Sequence
  Synthetic
ggatcctaaaacatgctctgttcctgacagtgacaggaccatacacggacgagaccaagctagaaatgtgcaggg

SEQ ID NO: 345034 - DNA, 75 bp, Artificial Sequence
  Synthetic
ctctttgagaccgaatcacgggaaaacccggagcaatgttctttctctgttccaggattacttctccagtgttgg

SEQ ID NO: 345035 - DNA, 75 bp, Artificial Sequence
  Synthetic
acccggagcaatgttctttctctgttccaggattacttctccagtgttggtcctgacattatcttcaacaggatc

SEQ ID NO: 345036 - DNA, 75 bp, Artificial Sequence
  Synthetic
gtggcttcacgtctcctcagactcccaaggagatagatggaaaggtggtctacactggagacggggtgtggagag

SEQ ID NO: 345037 - DNA, 75 bp, Artificial Sequence
  Synthetic
caaggagatagatggaaaggtggtctacactggagacggggtgtggagaggcatggtagatggcttccaagtgca

SEQ ID NO: 345038 - DNA, 75 bp, Artificial Sequence
  Synthetic
cagaagtctaatcaactgaagagcattacagtaaactcagatcggagcatcactgtgctcagcagtttttgtcac

SEQ ID NO: 345039 - DNA, 75 bp, Artificial Sequence
  Synthetic
ttacagtaaactcagatcggagcatcactgtgctcagcagtttttgtcactcgtggtgtaaggagatgggagttc

SEQ ID NO: 345040 - DNA, 75 bp, Artificial Sequence
  Synthetic
tcagaggatcaccagagcctctttcttcatgagggagtttaggatttccggatcacggcagcctctaggagcacc

SEQ ID NO: 345041 - DNA, 75 bp, Artificial Sequence
  Synthetic
ttcatgagggagtttaggatttccggatcacggcagcctctaggagcacccatattcattgtgagtgacaaaatc

SEQ ID NO: 345042 - DNA, 75 bp, Artificial Sequence
  Synthetic
caaatcttgagtttcgaataaggggaacaactctaaatctgacctacagagagaatgtgccaagagcgtggccca

SEQ ID NO: 345043 - DNA, 75 bp, Artificial Sequence
  Synthetic
aacaactctaaatctgacctacagagagaatgtgccaagagcgtggcccagaatgttcaacattctcagctacac

SEQ ID NO: 345044 - DNA, 75 bp, Artificial Sequence
  Synthetic
gagaatgctttcaagctcatgtctctttctccaaggcatagatttcatggacgagagccgagcacctcttggatc

SEQ ID NO: 345045 - DNA, 75 bp, Artificial Sequence
  Synthetic
tttctccaaggcatagatttcatggacgagagccgagcacctcttggatctgcatgagagcgcttcctatcaaca

SEQ ID NO: 345046 - DNA, 75 bp, Artificial Sequence
  Synthetic
ccagagcaatgaaaggatcagtgctgcaatcgataacgggaggcttgctgaatgcttcaagaatgttctagaatc

SEQ ID NO: 345047 - DNA, 75 bp, Artificial Sequence
  Synthetic
gcaatcgataacgggaggcttgctgaatgcttcaagaatgttctagaatcatcactgaggaggaagggagttttc

SEQ ID NO: 345048 - DNA, 75 bp, Artificial Sequence
  Synthetic
agaaaatgctggacagcatgagtaaggacatgatggacttctttgcagaagctggattggatgaggacctcctcc

SEQ ID NO: 345049 - DNA, 75 bp, Artificial Sequence
  Synthetic
ggacatgatggacttctttgcagaagctggattggatgaggacctcctccttgaagaagaaccctggctggaggg

SEQ ID NO: 345050 - DNA, 75 bp, Artificial Sequence
  Synthetic
gaagagtacctagaggaatacaacctgggtccgtttggcatgttcagcgttgagcaagaaatgaacacaaaatat

SEQ ID NO: 345051 - DNA, 75 bp, Artificial Sequence
  Synthetic
tgggtccgtttggcatgttcagcgttgagcaagaaatgaacacaaaatattaccatcacttgctcttagactctt

SEQ ID NO: 345052 - DNA, 75 bp, Artificial Sequence
  Synthetic
gtccctggatgggctgcggcgtttgttctctgagggagaggctcctctggagttccggaaggaggtagagcgaat

SEQ ID NO: 345053 - DNA, 75 bp, Artificial Sequence
  Synthetic
ttctctgagggagaggctcctctggagttccggaaggaggtagagcgaatgtttgcacttctgcagagagactct

SEQ ID NO: 345054 - DNA, 75 bp, Artificial Sequence
  Synthetic
agcttctctcagataacatgggtctggatgtagatgatgatatgtttggttaatttcctatctggggtgtttgtc

SEQ ID NO: 345055 - DNA, 75 bp, Artificial Sequence
  Synthetic
actgaatctctctttcttcccctcttaatcttatactctttctttcctttactttcatcttggcggactttgtgt

SEQ ID NO: 345056 - DNA, 75 bp, Artificial Sequence
  Synthetic
acacaaagacggctaacatggtaaggttgatcctacttcttctcgttctcgtacctccggggcaacccatcttta

SEQ ID NO: 345057 - DNA, 75 bp, Artificial Sequence
  Synthetic
gttgatcctacttcttctcgttctcgtacctccggggcaacccatctttaacaagatgatggatgtcatccggag

SEQ ID NO: 345058 - DNA, 75 bp, Artificial Sequence
  Synthetic
gtacctccggggcaacccatctttaacaagatgatggatgtcatccggagaatatccgaatcctccaataccact

SEQ ID NO: 345059 - DNA, 75 bp, Artificial Sequence
  Synthetic
atagactctctaaactggatacccacttagcttctatactgagtgtgggatcacacatagaagaggtgtcaacca

SEQ ID NO: 345060 - DNA, 75 bp, Artificial Sequence
  Synthetic
cttagcttctatactgagtgtgggatcacacatagaagaggtgtcaaccaatcacagtcagcatctgaataactt

SEQ ID NO: 345061 - DNA, 75 bp, Artificial Sequence
  Synthetic
agaaacatcctgacaatgctggatcccaagaccggcaaattcagaaggttgaaatgcctagacaatcagacgctc

SEQ ID NO: 345062 - DNA, 75 bp, Artificial Sequence
  Synthetic
ccaagaccggcaaattcagaaggttgaaatgcctagacaatcagacgctctcaaaggactgtagcacctgcttgg

SEQ ID NO: 345063 - DNA, 75 bp, Artificial Sequence
  Synthetic
taatcatctggtatatgatgatgggatttgccagtcagattacagtccatcagaggccatgcctgagcatgacac

SEQ ID NO: 345064 - DNA, 75 bp, Artificial Sequence
  Synthetic
atttgccagtcagattacagtccatcagaggccatgcctgagcatgacacccacctgtgtcgtgtaggatccctc

SEQ ID NO: 345065 - DNA, 75 bp, Artificial Sequence
  Synthetic
acaagcgcatccagcacgttccatggttctggattgatgggaagctgagcatctttgatgactactctatctcct

SEQ ID NO: 345066 - DNA, 75 bp, Artificial Sequence
  Synthetic
gttctggattgatgggaagctgagcatctttgatgactactctatctcctggatagaggggaagttcctttctct

SEQ ID NO: 345067 - DNA, 75 bp, Artificial Sequence
  Synthetic
tctagtgctcaatgtgacaaggctgtctgtttgcagggcaaatgcactggagacctccaattttgcactgagttc

SEQ ID NO: 345068 - DNA, 75 bp, Artificial Sequence
  Synthetic
tctgtttgcagggcaaatgcactggagacctccaattttgcactgagttctcatgcacttatgctaatgcagcct

SEQ ID NO: 345069 - DNA, 75 bp, Artificial Sequence
  Synthetic
aggcattgcacaggtacacacaaagagagggtccttcataccaacgtgttttggacagtcactatggtcagttag

SEQ ID NO: 345070 - DNA, 75 bp, Artificial Sequence
  Synthetic
agagggtccttcataccaacgtgttttggacagtcactatggtcagttaggaaaccactgagtaaaaggtctgtt

SEQ ID NO: 345071 - DNA, 75 bp, Artificial Sequence
  Synthetic
gtgaaagcagttgtcaatctgatcacatcttagtaatagtgagacactttactccagaccattatcaggcctgcc

SEQ ID NO: 345072 - DNA, 75 bp, Artificial Sequence
  Synthetic
catcttagtaatagtgagacactttactccagaccattatcaggcctgcctaggatcaacctgtctcactggccg

SEQ ID NO: 345073 - DNA, 75 bp, Artificial Sequence
  Synthetic
cccttcagaatggctgataggctgtccgattcgtcttttgagataaaaatgtggaacaaggagaggactcatgag

SEQ ID NO: 345074 - DNA, 75 bp, Artificial Sequence
  Synthetic
ccgattcgtcttttgagataaaaatgtggaacaaggagaggactcatgagtactttctaacatcgagatgtgagt

SEQ ID NO: 345075 - DNA, 75 bp, Artificial Sequence
  Synthetic
atgttggttctgccgagcaaattgggctaacttgcactgtttttcgaaggagcaagtgctgatattaatagtcat

SEQ ID NO: 345076 - DNA, 75 bp, Artificial Sequence
  Synthetic
gctaacttgcactgtttttcgaaggagcaagtgctgatattaatagtcataatctccttatgcaccataatcctg

SEQ ID NO: 345077 - DNA, 75 bp, Artificial Sequence
  Synthetic
tgattgctagcttcatttggaagctgctgaagcccttttactggatttgctctctcctctacagaacttgcaaga

SEQ ID NO: 345078 - DNA, 75 bp, Artificial Sequence
  Synthetic
gctgaagcccttttactggatttgctctctcctctacagaacttgcaagagaagagtcaataggaaggcagaaaa

SEQ ID NO: 345079 - DNA, 75 bp, Artificial Sequence
  Synthetic
gaggatggcttgtcagaacctctcactgaggccaaaagccagccagcacctgtgaaagccaggcctagcagcaga

SEQ ID NO: 345080 - DNA, 75 bp, Artificial Sequence
  Synthetic
ctgaggccaaaagccagccagcacctgtgaaagccaggcctagcagcagacagaaaatgtacaatttgactaggt

SEQ ID NO: 345081 - DNA, 75 bp, Artificial Sequence
  Synthetic
ctgcttcctcggaaccactgaggcttgctcagattctctgtctgtaactgcatccaaccagaggtgctcaaccaa

SEQ ID NO: 345082 - DNA, 75 bp, Artificial Sequence
  Synthetic
tgctcagattctctgtctgtaactgcatccaaccagaggtgctcaaccaactctcagggaatcaatacctgcttc

SEQ ID NO: 345083 - DNA, 75 bp, Artificial Sequence
  Synthetic
tgagtcccaagggccaagagagctgtcttattctcaagaatcccactggcgtggctgtggacacaataagaatta

SEQ ID NO: 345084 - DNA, 75 bp, Artificial Sequence
  Synthetic
tcttattctcaagaatcccactggcgtggctgtggacacaataagaattaagactaatgacattcgcctggagtg

SEQ ID NO: 345085 - DNA, 75 bp, Artificial Sequence
  Synthetic
cctagagtgactcacaggtgtgttggtgttcggaggtgccatctaatgggagattgtcaaggtgagagctgctca

SEQ ID NO: 345086 - DNA, 75 bp, Artificial Sequence
  Synthetic
gtgttcggaggtgccatctaatgggagattgtcaaggtgagagctgctcagcctttaagattactgactactctg

SEQ ID NO: 345087 - DNA, 75 bp, Artificial Sequence
  Synthetic
gatggctcagcttggatggagctactgtattgagcaatgcggaggggccctatgccagtgcttcaacatgcgtcc

SEQ ID NO: 345088 - DNA, 75 bp, Artificial Sequence
  Synthetic
tgtattgagcaatgcggaggggccctatgccagtgcttcaacatgcgtccctcctgcttctacctgaggaaaact

SEQ ID NO: 345089 - DNA, 75 bp, Artificial Sequence
  Synthetic
acaacatttatgagtgctcagagtggtcctacaggataaatgttgttgtgtacaccaataacactgagtcaaaca

SEQ ID NO: 345090 - DNA, 75 bp, Artificial Sequence
  Synthetic
gtcctacaggataaatgttgttgtgtacaccaataacactgagtcaaacataacattaaagctcggcgtgccaga

SEQ ID NO: 345091 - DNA, 75 bp, Artificial Sequence
  Synthetic
ctctcaaccgtatcccagcctccggctatagcttatactgagtgctttggtgaggatctgcacaacaccaaattc

SEQ ID NO: 345092 - DNA, 75 bp, Artificial Sequence
  Synthetic
ctatagcttatactgagtgctttggtgaggatctgcacaacaccaaattccatactgtttgcaatcgaagaacag

SEQ ID NO: 345093 - DNA, 75 bp, Artificial Sequence
  Synthetic
gattcaatgcccgactaaggcagatgccttggctatttctaagcgctgtgttagttctgacagcattgtgttctc

SEQ ID NO: 345094 - DNA, 75 bp, Artificial Sequence
  Synthetic
gccttggctatttctaagcgctgtgttagttctgacagcattgtgttctctaaagttcacaaggactctgttgac

SEQ ID NO: 345095 - DNA, 75 bp, Artificial Sequence
  Synthetic
aaacaatcagagacagaaataaattaccttccactgtgggctcagttaccttctggccaactgaaacaagtgttg

SEQ ID NO: 345096 - DNA, 75 bp, Artificial Sequence
  Synthetic
accttccactgtgggctcagttaccttctggccaactgaaacaagtgttgaggcagcagttccagacttggcttc

SEQ ID NO: 345097 - DNA, 75 bp, Artificial Sequence
  Synthetic
gggtaccaagtgcaatatcagtcagatagtaacaagtgtagtgttcggtttctaagcctaactgggtgttataac

SEQ ID NO: 345098 - DNA, 75 bp, Artificial Sequence
  Synthetic
atagtaacaagtgtagtgttcggtttctaagcctaactgggtgttataactgtgagactggtgctaagctggaga

SEQ ID NO: 345099 - DNA, 75 bp, Artificial Sequence
  Synthetic
tgcacttgcaatactagagtgcccatcccttggttacacaacttactatgaagtgagaaatgcactggagaaggc

SEQ ID NO: 345100 - DNA, 75 bp, Artificial Sequence
  Synthetic
tcccttggttacacaacttactatgaagtgagaaatgcactggagaaggccaccaggacaatgcatttgaatggg

SEQ ID NO: 345101 - DNA, 75 bp, Artificial Sequence
  Synthetic
tcaaatgtccaaactctgaaagccagataaaagtgaaaggtgaactcatttacttatttaatgatgacgtgcgcc

SEQ ID NO: 345102 - DNA, 75 bp, Artificial Sequence
  Synthetic
gataaaagtgaaaggtgaactcatttacttatttaatgatgacgtgcgccatcataatcaaaccttgtcacctgg

SEQ ID NO: 345103 - DNA, 75 bp, Artificial Sequence
  Synthetic
tgggacccttttgggtggtttaaggcctcctggatgaggtctatctgggccattctaggaggaactgtggcctta

SEQ ID NO: 345104 - DNA, 75 bp, Artificial Sequence
  Synthetic
cctcctggatgaggtctatctgggccattctaggaggaactgtggccttaatcattggtgttgttggaacataca

SEQ ID NO: 345105 - DNA, 75 bp, Artificial Sequence
  Synthetic
caagaagtcctaaagtctccttctcccataccctctcctcttccctctccttcgggagagacagcaggggtggaa

SEQ ID NO: 345106 - DNA, 75 bp, Artificial Sequence
  Synthetic
ccataccctctcctcttccctctccttcgggagagacagcaggggtggaatgccgccagtggagaaagccatgtc

SEQ ID NO: 345107 - DNA, 75 bp, Artificial Sequence
  Synthetic
ccactgcacaggattgctgttggggatccctgttaccatcagtggagactttatttggtattccatgtagccggt

SEQ ID NO: 345108 - DNA, 75 bp, Artificial Sequence
  Synthetic
ttggccaaaaaggctgatctctcccgggaccagatgctgagggacatcagggctctgatcaccctccatctgacc

SEQ ID NO: 345109 - DNA, 75 bp, Artificial Sequence
  Synthetic
agaagaggctgtctgaggagggcaagaaagaattcgccctgctgaaggccaggtaccagcttgtggacaaggcca

SEQ ID NO: 345110 - DNA, 75 bp, Artificial Sequence
  Synthetic
gaaagaattcgccctgctgaaggccaggtaccagcttgtggacaaggccaaggaggctgcagatctgacactctc

SEQ ID NO: 345111 - DNA, 75 bp, Artificial Sequence
  Synthetic
ctgacgtgccgcattctgccgcaagtggtggcccacacagccgtgactaggtcacggatggagagtctgagcgca

SEQ ID NO: 345112 - DNA, 75 bp, Artificial Sequence
  Synthetic
gtcacggatggagagtctgagcgcagactatccagtgtgcatgatgcacaatgcctttgctggcctgatcgatga

SEQ ID NO: 345113 - DNA, 75 bp, Artificial Sequence
  Synthetic
atctgctggagttctccaggaccatcaacgtgaagcaccgcggaatggaggccaaggagatcttggatgccaatg

SEQ ID NO: 345114 - DNA, 75 bp, Artificial Sequence
  Synthetic
aagctccttcctgactcccagtcagaagagagcttacctgctgagcttcaagctggtggacggaaatggcaaagt

SEQ ID NO: 345115 - DNA, 75 bp, Artificial Sequence
  Synthetic
actgtcctcagatcattgatctgaggtgttttggaatttgatttaattcggccaaattaaaactctctaattgga

SEQ ID NO: 345116 - DNA, 75 bp, Artificial Sequence
  Synthetic
gtgttttggaatttgatttaattcggccaaattaaaactctctaattggactctaaaagggcttcggcccaaact

SEQ ID NO: 345117 - DNA, 75 bp, Artificial Sequence
  Synthetic
cgatctgattcaaacatgaagttcatgtgcttcttcttcatcccataacgcttaggttcatagttgcaaggtgct

SEQ ID NO: 345118 - DNA, 75 bp, Artificial Sequence
  Synthetic
gatctcattctgagagcgagatcaaacagcatcttcccaagagagaccctggatctcttcttccgtctcagcctg

SEQ ID NO: 345119 - DNA, 75 bp, Artificial Sequence
  Synthetic
caccgttgatggtagtcttcagaggaattgtgctaggaaagtagccatcatccatcatctcccagagcgagtcgt

SEQ ID NO: 345120 - DNA, 75 bp, Artificial Sequence
  Synthetic
acacaaagacggctaacatggtaaggacatatctcttgcttttgctcctgtgcgggccagcaacgcctttcttca

SEQ ID NO: 345121 - DNA, 75 bp, Artificial Sequence
  Synthetic
gacatatctcttgcttttgctcctgtgcgggccagcaacgcctttcttcaatcacctgatggatgtgacccgtcg

SEQ ID NO: 345122 - DNA, 75 bp, Artificial Sequence
  Synthetic
tgcgggccagcaacgcctttcttcaatcacctgatggatgtgacccgtcgcttactagactccagcaacgcaacc

SEQ ID NO: 345123 - DNA, 75 bp, Artificial Sequence
  Synthetic
accgattgtcaaggctggatgctcatgtcatgtcaatgttaggggttggttcacacattgatgaagtcagtgtca

SEQ ID NO: 345124 - DNA, 75 bp, Artificial Sequence
  Synthetic
tgtcatgtcaatgttaggggttggttcacacattgatgaagtcagtgtcaatcacagccagcacctccacaactt

SEQ ID NO: 345125 - DNA, 75 bp, Artificial Sequence
  Synthetic
aggaggactttaaccatgatggatcccaaatcaggaaagttcaagcgcctgaaatgtaatgaaaaccagactctg

SEQ ID NO: 345126 - DNA, 75 bp, Artificial Sequence
  Synthetic
ccaaatcaggaaagttcaagcgcctgaaatgtaatgaaaaccagactctgtccaaggattgtgcctcttgcatag

SEQ ID NO: 345127 - DNA, 75 bp, Artificial Sequence
  Synthetic
tgagcatctggtctatgacgacgccatttgccaatctgattacagcagtcctgaggcaatgccagaccatgagac

SEQ ID NO: 345128 - DNA, 75 bp, Artificial Sequence
  Synthetic
atttgccaatctgattacagcagtcctgaggcaatgccagaccatgagacacatctttgcaggatcgggccattg

SEQ ID NO: 345129 - DNA, 75 bp, Artificial Sequence
  Synthetic
ctaagagggttcagcatgtctcttggttttggattgatgggaaactgagggtgtatgatgacttctcagtctcct

SEQ ID NO: 345130 - DNA, 75 bp, Artificial Sequence
  Synthetic
gttttggattgatgggaaactgagggtgtatgatgacttctcagtctcctggactgaggggaaattcctgtctct

SEQ ID NO: 345131 - DNA, 75 bp, Artificial Sequence
  Synthetic
aaggaccacaactgcaataaagcagtctgtttggagggcagatgttctggagatcttcagttttgcacagaattc

SEQ ID NO: 345132 - DNA, 75 bp, Artificial Sequence
  Synthetic
tctgtttggagggcagatgttctggagatcttcagttttgcacagaattcacatgctcatatgcaaaggctgact

SEQ ID NO: 345133 - DNA, 75 bp, Artificial Sequence
  Synthetic
tggggtggcagtagtgcataccaagcacggctccttcatgccagagtgtatgggtcagtctctttggtcagtgcg

SEQ ID NO: 345134 - DNA, 75 bp, Artificial Sequence
  Synthetic
cacggctccttcatgccagagtgtatgggtcagtctctttggtcagtgcgaaagcctttgtctaagagatcagta

SEQ ID NO: 345135 - DNA, 75 bp, Artificial Sequence
  Synthetic
gcgaaagtgactgcaaagtagaccacattttggtgatagtcaggcacttctacccagaccattaccaggcatgtc

SEQ ID NO: 345136 - DNA, 75 bp, Artificial Sequence
  Synthetic
cattttggtgatagtcaggcacttctacccagaccattaccaggcatgtctgggctccacatgtctcactggtcg

SEQ ID NO: 345137 - DNA, 75 bp, Artificial Sequence
  Synthetic
ccatttaagatggcagacaggctctcagattcacacttcgagatacgtatctgggataaggagaggtccaacgaa

SEQ ID NO: 345138 - DNA, 75 bp, Artificial Sequence
  Synthetic
cagattcacacttcgagatacgtatctgggataaggagaggtccaacgaatatttcttagaatctaggtgtgagt

SEQ ID NO: 345139 - DNA, 75 bp, Artificial Sequence
  Synthetic
atgctggttttgtagagcaaattgggccaacattcactgcttttctaaagagcaggttctaattctagttgcagt

SEQ ID NO: 345140 - DNA, 75 bp, Artificial Sequence
  Synthetic
gccaacattcactgcttttctaaagagcaggttctaattctagttgcagtgagctccttgtgcattttactgcta

SEQ ID NO: 345141 - DNA, 75 bp, Artificial Sequence
  Synthetic
tcattgccaccttcacctggaaaataataaagcccttttggtggatcctttccctgttgtgcagaacttgctcca

SEQ ID NO: 345142 - DNA, 75 bp, Artificial Sequence
  Synthetic
aataaagcccttttggtggatcctttccctgttgtgcagaacttgctccaaaagactgaacaaacgggcagagcg

SEQ ID NO: 345143 - DNA, 75 bp, Artificial Sequence
  Synthetic
gaagaaggactgaataatgtggatgaaggacccagagagcagaacaaccctgcaagagcagtggcaaggcccaat

SEQ ID NO: 345144 - DNA, 75 bp, Artificial Sequence
  Synthetic
aaggacccagagagcagaacaaccctgcaagagcagtggcaaggcccaatgttcgacaaaagatgtttaacttga

SEQ ID NO: 345145 - DNA, 75 bp, Artificial Sequence
  Synthetic
catgctgtgtctggcttgcccagttgaaagttgctcagactccatctctgtaacagcctccagtcagaggtgctc

SEQ ID NO: 345146 - DNA, 75 bp, Artificial Sequence
  Synthetic
gaaagttgctcagactccatctctgtaacagcctccagtcagaggtgctctactagctcagatggagtgaactcc

SEQ ID NO: 345147 - DNA, 75 bp, Artificial Sequence
  Synthetic
ttcaggtcagtcctaaggggcaagagagctgtctgatcctaaaggggccaactggaacagcagtggactctatta

SEQ ID NO: 345148 - DNA, 75 bp, Artificial Sequence
  Synthetic
gagctgtctgatcctaaaggggccaactggaacagcagtggactctattaggatcaagaccactgacatcaagct

SEQ ID NO: 345149 - DNA, 75 bp, Artificial Sequence
  Synthetic
tgggtccccagggtaacccataggtgcatagggaccaggcgatgccatctcatgggagcctgcaagggagaggcc

SEQ ID NO: 345150 - DNA, 75 bp, Artificial Sequence
  Synthetic
gcatagggaccaggcgatgccatctcatgggagcctgcaagggagaggcctgctctgagtttaagataaacgatt

SEQ ID NO: 345151 - DNA, 75 bp, Artificial Sequence
  Synthetic
ggagttgatggctcagctaggctggagctactgtgttgagcagtgtggcggagccctttgtcaatgcttcaacat

SEQ ID NO: 345152 - DNA, 75 bp, Artificial Sequence
  Synthetic
agctactgtgttgagcagtgtggcggagccctttgtcaatgcttcaacatgaggccctcttgcttctacttgagg

SEQ ID NO: 345153 - DNA, 75 bp, Artificial Sequence
  Synthetic
atgctttcaacatctatgaatgctcagaatggtcataccggataaatgtgcttgtatcgacaaattcaactcact

SEQ ID NO: 345154 - DNA, 75 bp, Artificial Sequence
  Synthetic
agaatggtcataccggataaatgtgcttgtatcgacaaattcaactcactcaaatttaacattaaagcttggtgt

SEQ ID NO: 345155 - DNA, 75 bp, Artificial Sequence
  Synthetic
attagcttgtctagcgtgtcccaaccgccagccatagcatactcagagtgctttggggaggatctacacggcaca

SEQ ID NO: 345156 - DNA, 75 bp, Artificial Sequence
  Synthetic
cgccagccatagcatactcagagtgctttggggaggatctacacggcacaaagttccacacagtctgcaacagaa

SEQ ID NO: 345157 - DNA, 75 bp, Artificial Sequence
  Synthetic
aggggagatacagtgccccaccaaagctgatgccctggcagtctctaagagatgcattagcagcgactccataat

SEQ ID NO: 345158 - DNA, 75 bp, Artificial Sequence
  Synthetic
gctgatgccctggcagtctctaagagatgcattagcagcgactccataattttctccaaggtccacaaggattca

SEQ ID NO: 345159 - DNA, 75 bp, Artificial Sequence
  Synthetic
atcccatgacaatcaggaatcggaacaaattgccatccactgtaggttcagtcactttctggccaacagaaacca

SEQ ID NO: 345160 - DNA, 75 bp, Artificial Sequence
  Synthetic
caaattgccatccactgtaggttcagtcactttctggccaacagaaaccagtgttgaggcagccatccctgactt

SEQ ID NO: 345161 - DNA, 75 bp, Artificial Sequence
  Synthetic
ttagatggttataccattcagttcagatctgattccaataagtgtagcccaagattcttatcattatcaggctgt

SEQ ID NO: 345162 - DNA, 75 bp, Artificial Sequence
  Synthetic
gatctgattccaataagtgtagcccaagattcttatcattatcaggctgttacaactgtgaggctggagcaaagc

SEQ ID NO: 345163 - DNA, 75 bp, Artificial Sequence
  Synthetic
tggaacagccttgggaatcctcgaatgcccaagcctaggctacacaacatattatgaggtgaagaacacgcttga

SEQ ID NO: 345164 - DNA, 75 bp, Artificial Sequence
  Synthetic
tgcccaagcctaggctacacaacatattatgaggtgaagaacacgcttgaaaagtccataaggacaatgcattta

SEQ ID NO: 345165 - DNA, 75 bp, Artificial Sequence
  Synthetic
gctactttcggtgccctaactctgagagtcagctaactataagaggagaactgatctatcttttcaatgatgaca

SEQ ID NO: 345166 - DNA, 75 bp, Artificial Sequence
  Synthetic
gagtcagctaactataagaggagaactgatctatcttttcaatgatgacatcagacaccacaatcagaccttgtc

SEQ ID NO: 345167 - DNA, 75 bp, Artificial Sequence
  Synthetic
tctggatgggatccttttggttggttcaaagcctcctggttgagagcaatttgggccatcctgggtgggactgtg

SEQ ID NO: 345168 - DNA, 75 bp, Artificial Sequence
  Synthetic
tcaaagcctcctggttgagagcaatttgggccatcctgggtgggactgtgtctctgataattggagtggtgatca

SEQ ID NO: 345169 - DNA, 75 bp, Artificial Sequence
  Synthetic
gaaagttaaaaaatcgtgaagtccccctattccccatccccctctacccctttcccttatccccccctcatcctc

SEQ ID NO: 345170 - DNA, 75 bp, Artificial Sequence
  Synthetic
cgacgccgctggagcattcattactaagtggtgttatccagggtggtccttagcagtgcccgtgaataccatatt

SEQ ID NO: 345171 - DNA, 75 bp, Artificial Sequence
  Synthetic
aagtggtgttatccagggtggtccttagcagtgcccgtgaataccatatttgttgttccatgtagccgtgtcttt

SEQ ID NO: 345172 - DNA, 75 bp, Artificial Sequence
  Synthetic
ttgatgaactctctgatctcttcttcttcccacgccgcctcagaaacttcgatcgcgaagcacacaaagacctcc

SEQ ID NO: 345173 - DNA, 75 bp, Artificial Sequence
  Synthetic
ggctttacgagctttctcagaaagcaggactggagaaggatcagatgatgagggacatcagggctctgataaccc

SEQ ID NO: 345174 - DNA, 75 bp, Artificial Sequence
  Synthetic
tccatctgaccagaggaaacaagctctcaagcattgagaaaagactgtctgaagcaggcaaaaaggagtttgctc

SEQ ID NO: 345175 - DNA, 75 bp, Artificial Sequence
  Synthetic
tgctcaaggccagatatcatctggtcgacaaagccaaggaggcttcagacctgacactctcccgcattgccattg

SEQ ID NO: 345176 - DNA, 75 bp, Artificial Sequence
  Synthetic
ctgacactctcccgcattgccattgccaatgctgggctgacgtgccgcatcctgcctcaagtggtcacccacact

SEQ ID NO: 345177 - DNA, 75 bp, Artificial Sequence
  Synthetic
catgatgcacaacgccttcgcaggcctggtagatgagactctgccagaagaatccatcaaggctttggtggatgc

SEQ ID NO: 345178 - DNA, 75 bp, Artificial Sequence
  Synthetic
tccaggaccatcaacgtgaaacacagggggatggagcccaaagacatcttggaggccaatgactctgccctccaa

SEQ ID NO: 345179 - DNA, 75 bp, Artificial Sequence
  Synthetic
gggggatggagcccaaagacatcttggaggccaatgactctgccctccaagctggtctggcaagcacctttctga

SEQ ID NO: 345180 - DNA, 75 bp, Artificial Sequence
  Synthetic
ggaggccaatgactctgccctccaagctggtctggcaagcacctttctgacctctcgtcagaaaagggcctacct

SEQ ID NO: 345181 - DNA, 75 bp, Artificial Sequence
  Synthetic
aatggcaaggcaagcaaggcagtggttcaggctgccacgaccctcagatcaatgatctgaggatcaatttggaat

SEQ ID NO: 345182 - DNA, 75 bp, Artificial Sequence
  Synthetic
ttcaggctgccacgaccctcagatcaatgatctgaggatcaatttggaatttagtaattcggccaaaattaaaaa

SEQ ID NO: 345183 - DNA, 75 bp, Artificial Sequence
  Synthetic
aatgatctgaggatcaatttggaatttagtaattcggccaaaattaaaaacctctaattggactctaaaagggct

SEQ ID NO: 345184 - DNA, 75 bp, Artificial Sequence
  Synthetic
tctcaaatgcctcccagtgctcatccagattgacgtacttggggtggaccttcaggttgtccaggtcagagtcaa

SEQ ID NO: 345185 - DNA, 75 bp, Artificial Sequence
  Synthetic
agatccatgtctgtctgttttcttgctaggagggcattgctcaaagtgggtgaagaaccttttgtccaccatagt

SEQ ID NO: 345186 - DNA, 75 bp, Artificial Sequence
  Synthetic
cacctgtctctctgagagttccattttcctgatcttagtccgcaacttgtgggccagttggaacagcatttctcc

SEQ ID NO: 345187 - DNA, 75 bp, Artificial Sequence
  Synthetic
ctcctcaatctagggttctgatctccaaacaaggcaatactgacaattgtcaggaaagcatttcggagggtttgg

SEQ ID NO: 345188 - DNA, 75 bp, Artificial Sequence
  Synthetic
caaacaaggcaatactgacaattgtcaggaaagcatttcggagggtttgggtccagatcatgtccaacttgaggt

SEQ ID NO: 345189 - DNA, 75 bp, Artificial Sequence
  Synthetic
tcttttcttttccagaggccatcccgttgcagacacaactctctgctcatcagcagggtcaagagagtacaaacc

SEQ ID NO: 345190 - DNA, 75 bp, Artificial Sequence
  Synthetic
actcttcaggggtatgatctttggaaagagaccatcatccatcatgtcccagagagtgttgtagaacttgttgat

SEQ ID NO: 345191 - DNA, 75 bp, Artificial Sequence
  Synthetic
ggggcttagggaatacccctgaggcaagtccttttccgaaatgatgtagtatgacatgcttaatgttggagggtc

SEQ ID NO: 345192 - DNA, 75 bp, Artificial Sequence
  Synthetic
tttgtgtgtgttgtatgtgatatgtgtgtgttatgtgtgtaattaatatattatgaagggggggtggtgtggtgg

SEQ ID NO: 345193 - DNA, 75 bp, Artificial Sequence
  Synthetic
cgagaacaaatcctcagcgaggactgaactgtcctcctgctgtgacctatacatcgagtcatatgagaccaccca

SEQ ID NO: 345194 - DNA, 75 bp, Artificial Sequence
  Synthetic
cctctggtgaatgacacatttgatcactggacccctgatttcatttctcagaggctcgatggaagcaaggttgtt

SEQ ID NO: 345195 - DNA, 75 bp, Artificial Sequence
  Synthetic
atcaggagcagtctctgatcagcgctttcaataccaaggttggcaagtatgaggttgccctacacaacagatcct

SEQ ID NO: 345196 - DNA, 75 bp, Artificial Sequence
  Synthetic
ggtagtcgtgagtgaaaccactgtcgtgactaacctcaatctaaatcagcaagaggtggatgagctttgcttcag

SEQ ID NO: 345197 - DNA, 75 bp, Artificial Sequence
  Synthetic
gtgactaacctcaatctaaatcagcaagaggtggatgagctttgcttcaggttcctggtttccagggcagtccac

SEQ ID NO: 345198 - DNA, 75 bp, Artificial Sequence
  Synthetic
aagaggtggatgagctttgcttcaggttcctggtttccagggcagtccacttggaaatgacaacgaagatgatca

SEQ ID NO: 345199 - DNA, 75 bp, Artificial Sequence
  Synthetic
ggacaagaggagtagagaggtcaaagcagctttccactcagttcagccagactgggaaaccactgaagcaaaatt

SEQ ID NO: 345200 - DNA, 75 bp, Artificial Sequence
  Synthetic
actgggaaaccactgaagcaaaattttctccattctctcggagaatgttctcaaacttctcacagatggagccag

SEQ ID NO: 345201 - DNA, 75 bp, Artificial Sequence
  Synthetic
tgttgactcaatcaaggcagcccaggatgatcttgacaagaaccactacctctctgagagcctcactgagcaaga

SEQ ID NO: 345202 - DNA, 75 bp, Artificial Sequence
  Synthetic
tctctgagagcctcactgagcaagagaggctagataggaacagggatgaaagtctcaagatggtgagagagtttg

SEQ ID NO: 345203 - DNA, 75 bp, Artificial Sequence
  Synthetic
aaggtcagcttggagccacaaatccacagttccattccctggggtgattcccaaggtctccggagataccacttc

SEQ ID NO: 345204 - DNA, 75 bp, Artificial Sequence
  Synthetic
acagttccattccctggggtgattcccaaggtctccggagataccacttctctctcaagactaacggaactgcct

SEQ ID NO: 345205 - DNA, 75 bp, Artificial Sequence
  Synthetic
ccatccgagcatggaggacagcttatggatcagttagcaatggcacagtggagaggtgtgatgaagacgtggaga

SEQ ID NO: 345206 - DNA, 75 bp, Artificial Sequence
  Synthetic
tttatcagtagaagagatcgaagaatctaaagctctcaggatgaagtatcaccgctgcaagattgacaatggcat

SEQ ID NO: 345207 - DNA, 75 bp, Artificial Sequence
  Synthetic
caaggagtagaagctaaggaattcaggaaccacccaacaatcatcaagaaaagagaggagtctaagaaaactttc

SEQ ID NO: 345208 - DNA, 75 bp, Artificial Sequence
  Synthetic
ggaaccacccaacaatcatcaagaaaagagaggagtctaagaaaactttccctctgacaactgataccagagaca

SEQ ID NO: 345209 - DNA, 75 bp, Artificial Sequence
  Synthetic
ttccatgttcaagcaagaattgtcacagacccccccagcgcctatgatcgaagctgtgaaggcaggagcagaagc

SEQ ID NO: 345210 - DNA, 75 bp, Artificial Sequence
  Synthetic
gaagacaacccctggtatcaatctgctctaacattcctaagtttgccaattgggttatggctctttatgtgcact

SEQ ID NO: 345211 - DNA, 75 bp, Artificial Sequence
  Synthetic
tcagccatcactggaaagctacaccgatctcagtgcttcaaaggcctccagttcgaagatgggtggttctggaca

SEQ ID NO: 345212 - DNA, 75 bp, Artificial Sequence
  Synthetic
agctaacaaatgtggtgaagtgcctctccacaggattcaatctcttttggttctggcgtgacttttatgaagtgc

SEQ ID NO: 345213 - DNA, 75 bp, Artificial Sequence
  Synthetic
ttatcttgctggaaagcaaagagccaacaaaatgtttaaattttgtctgctcatgctcttggaggacaaagctcg

SEQ ID NO: 345214 - DNA, 75 bp, Artificial Sequence
  Synthetic
acaaaaaatgattgagaagttaccagaactagcacggacaaagttccaggtttggctcatttcaagaatgctgca

SEQ ID NO: 345215 - DNA, 75 bp, Artificial Sequence
  Synthetic
ccctttaaaattacagcagggcacaagtctgcaagctggtctggcatgttcaactgggtcacaggagagcctgtt

SEQ ID NO: 345216 - DNA, 75 bp, Artificial Sequence
  Synthetic
agtctgcaagctggtctggcatgttcaactgggtcacaggagagcctgttgactcaacccagaagctcatttctt

SEQ ID NO: 345217 - DNA, 75 bp, Artificial Sequence
  Synthetic
caaagaggaatctccagagagaaacgctagtgttggtatgtacaagaaaatcttagaatatgaggacaagcatcc

SEQ ID NO: 345218 - DNA, 75 bp, Artificial Sequence
  Synthetic
tcttagaatatgaggacaagcatcctggccgatacacgtacttgggccttggagatcctcctgctgaagacacga

SEQ ID NO: 345219 - DNA, 75 bp, Artificial Sequence
  Synthetic
cttgaagcatctttgcattcacgcagaacacaatttgagacagaactggggagagtccttcaaggctatgatctc

SEQ ID NO: 345220 - DNA, 75 bp, Artificial Sequence
  Synthetic
gagagtccttcaaggctatgatctctcgagacatagttgacgccattgccagtttggacctagagagattggcca

SEQ ID NO: 345221 - DNA, 75 bp, Artificial Sequence
  Synthetic
cgaagaatggtatcaaaagcgcactgatggcaaggtttatcacaggagcaaagtgctggagaaggtgagcaagta

SEQ ID NO: 345222 - DNA, 75 bp, Artificial Sequence
  Synthetic
gcacatttgtttgttcaagaagcctcaacatggaggtctccgtgaaatctatgtcctgggatttgaggagagagt

SEQ ID NO: 345223 - DNA, 75 bp, Artificial Sequence
  Synthetic
gccagacaaatttgcaagaggttcaagtcagaaacactcaccaaccctaagcagaagttggcaatacctgagaca

SEQ ID NO: 345224 - DNA, 75 bp, Artificial Sequence
  Synthetic
gcagaagttggcaatacctgagacacacggactgcgagctgtgaaaacctgcggaatacatcatgagacagtggc

SEQ ID NO: 345225 - DNA, 75 bp, Artificial Sequence
  Synthetic
cacatcagatgatgcagcaaagtggaaccagtgccatcatgtgaccaaatttgctctgatgttgtgccatttcac

SEQ ID NO: 345226 - DNA, 75 bp, Artificial Sequence
  Synthetic
ttgctctgatgttgtgccatttcacagatcctttgttccatgggttcatcatcagaggatgctctatgtttatga

SEQ ID NO: 345227 - DNA, 75 bp, Artificial Sequence
  Synthetic
cttgatcaacatcattgatgcacacactacccttgagacttccaaccgatatcttcagcttattcatcggggata

SEQ ID NO: 345228 - DNA, 75 bp, Artificial Sequence
  Synthetic
gatcaacgaccagatgtgctagtggacgttttgcagagctctgatgactcaggaatgatgatatctttcccatca

SEQ ID NO: 345229 - DNA, 75 bp, Artificial Sequence
  Synthetic
caagttcaagaaggttataggaaaatacttgggcatctactcttccattaagtcaacaaacaacactttgcacct

SEQ ID NO: 345230 - DNA, 75 bp, Artificial Sequence
  Synthetic
ttccacataaaccacaacagacccttgctcagatggattacagcttgtgacactatttcagagcaggaatcactg

SEQ ID NO: 345231 - DNA, 75 bp, Artificial Sequence
  Synthetic
cactatttcagagcaggaatcactggcatcaagacaagaggagatgtataacaacctgacatctgttcttgaggg

SEQ ID NO: 345232 - DNA, 75 bp, Artificial Sequence
  Synthetic
ttctgtcagtatggccagcttctgctccactacactttgctagggatgacagtctcacctttgtttctggagtac

SEQ ID NO: 345233 - DNA, 75 bp, Artificial Sequence
  Synthetic
atccatccctgggattcttcctcatggatcatccttttgggagtggattatctggcttcaagtacaatgtctggg

SEQ ID NO: 345234 - DNA, 75 bp, Artificial Sequence
  Synthetic
ggatcatccttttgggagtggattatctggcttcaagtacaatgtctgggttgcagtacagaacagcattcttgg

SEQ ID NO: 345235 - DNA, 75 bp, Artificial Sequence
  Synthetic
gccatccaaaactctgatagtgctgctccaaagaaaactctggatacaacaacctcaggaacatttgttcaatcc

SEQ ID NO: 345236 - DNA, 75 bp, Artificial Sequence
  Synthetic
ctccaaagaaaactctggatacaacaacctcaggaacatttgttcaatccacaatcataaggtttggagacagga

SEQ ID NO: 345237 - DNA, 75 bp, Artificial Sequence
  Synthetic
gctgaatctgcctgaggattggttggaaatcattgatcaaaatccagaaattgtctacagacgacctagagatgg

SEQ ID NO: 345238 - DNA, 75 bp, Artificial Sequence
  Synthetic
gaaatcattgatcaaaatccagaaattgtctacagacgacctagagatgggactgaagtgagtttgaggattgct

SEQ ID NO: 345239 - DNA, 75 bp, Artificial Sequence
  Synthetic
gtttacatcctgagcagaaacattttgagtgatggattggcatggctgtatgatgaggaggatgaactcaaaagg

SEQ ID NO: 345240 - DNA, 75 bp, Artificial Sequence
  Synthetic
aaccagacttggatgcacattcaagactcaccccagctcaactgtcaaccctatttcccatgatggctgagtttg

SEQ ID NO: 345241 - DNA, 75 bp, Artificial Sequence
  Synthetic
ctacatgagaattgacggtgaattcatttcaaagaagaaagtgatcactcagaccagaataaacattctggagac

SEQ ID NO: 345242 - DNA, 75 bp, Artificial Sequence
  Synthetic
atttcaaagaagaaagtgatcactcagaccagaataaacattctggagactgagaggttcttgagagcccgacca

SEQ ID NO: 345243 - DNA, 75 bp, Artificial Sequence
  Synthetic
agaccagaataaacattctggagactgagaggttcttgagagcccgaccagaggacctcatagctgatatgtggt

SEQ ID NO: 345244 - DNA, 75 bp, Artificial Sequence
  Synthetic
catgtccaactgagaaacttcttcagcagattggacttgaaaggtagagacatcaggatcataggagccccaatc

SEQ ID NO: 345245 - DNA, 75 bp, Artificial Sequence
  Synthetic
catcaggatcataggagccccaatcaaaaagtccagtggaatcagcaatgtgtcaactgccatcagagacaactt

SEQ ID NO: 345246 - DNA, 75 bp, Artificial Sequence
  Synthetic
acatgcgttgttcctaactgtgactgggccatacacagatgatacaaggctggagatgtgcaaggacttcatcat

SEQ ID NO: 345247 - DNA, 75 bp, Artificial Sequence
  Synthetic
cttttccatgagagggccagacatcattttcaacagaattgaaatggccaactgtggagttgttggaggcttcac

SEQ ID NO: 345248 - DNA, 75 bp, Artificial Sequence
  Synthetic
acctacatgcccaagcagaagataaaccagttgaagtcaataacggtgaactcagacagaagcattgccacccta

SEQ ID NO: 345249 - DNA, 75 bp, Artificial Sequence
  Synthetic
acttcaaaatttctggctctcgacagacactgggtgctccgatcttcattgttggagaaaggatattcaggccaa

SEQ ID NO: 345250 - DNA, 75 bp, Artificial Sequence
  Synthetic
gtttagagtgagaggaaacaccctgaacctaacctacagagaatccatccctaaggcagggcaaagaatgttcaa

SEQ ID NO: 345251 - DNA, 75 bp, Artificial Sequence
  Synthetic
aacctaacctacagagaatccatccctaaggcagggcaaagaatgttcaacattctcagttacactgtgaaagac

SEQ ID NO: 345252 - DNA, 75 bp, Artificial Sequence
  Synthetic
tcaaattgatgtcgctctccccgagacacaagttccatggcagagaacccagcacttcatggatttgcatgagag

SEQ ID NO: 345253 - DNA, 75 bp, Artificial Sequence
  Synthetic
gctactggacagaatcctcaaccgtgaaaggattagtgcttccattgacaatgacaggctggctgaatgcttcaa

SEQ ID NO: 345254 - DNA, 75 bp, Artificial Sequence
  Synthetic
aggaaaggtgtgttcttgtctgaattctctagagcgacccaaaaaatgcttgacagtttgagcagagacatgctt

SEQ ID NO: 345255 - DNA, 75 bp, Artificial Sequence
  Synthetic
atgatgatcttgatctcgaggaggaaccttggcttggtgggctggacactttttcccttgatgatgaagactatc

SEQ ID NO: 345256 - DNA, 75 bp, Artificial Sequence
  Synthetic
accttggcttggtgggctggacactttttcccttgatgatgaagactatcttgaggagtacaacttgggaccctt

SEQ ID NO: 345257 - DNA, 75 bp, Artificial Sequence
  Synthetic
ttttcccttgatgatgaagactatcttgaggagtacaacttgggaccctttggcatgttcagcgtggagcaagaa

SEQ ID NO: 345258 - DNA, 75 bp, Artificial Sequence
  Synthetic
tcctgcttgactccctggtcgaagacatcatccaaaaactctcccttgatggtcttagaaaactattccaggaag

SEQ ID NO: 345259 - DNA, 75 bp, Artificial Sequence
  Synthetic
gatgacatgtttggataaaagatacacaagtgggttccgcatcaaagtcaagctagctctatctatctctaattc

SEQ ID NO: 345260 - DNA, 75 bp, Artificial Sequence
  Synthetic
cttcaatcacttgatggatgtcacaaggcggatgctggaatccagcaatgctacttggctgagagatcaaccaga

SEQ ID NO: 345261 - DNA, 75 bp, Artificial Sequence
  Synthetic
gaccatcttatgtcaattcttggcatcggatcccacattgatgaagtctccctgaatcacagccagcaccttttc

SEQ ID NO: 345262 - DNA, 75 bp, Artificial Sequence
  Synthetic
agggtagaagaacactgacgatgctggatcccaagtctggaatgtttaaaaggttggtctgcaatgtgaatcaga

SEQ ID NO: 345263 - DNA, 75 bp, Artificial Sequence
  Synthetic
ggatcccaagtctggaatgtttaaaaggttggtctgcaatgtgaatcagactttgtcaaaggactgctccagttg

SEQ ID NO: 345264 - DNA, 75 bp, Artificial Sequence
  Synthetic
aagagtgagcatttggtttatgatgatgggatttgtcaatctgactatagcagcatagcttccatgccagatcac

SEQ ID NO: 345265 - DNA, 75 bp, Artificial Sequence
  Synthetic
ttcgaatctacgatgattactccatttcatggaccgaaggaagatttctctccttgtttgactgcctgaatgaga

SEQ ID NO: 345266 - DNA, 75 bp, Artificial Sequence
  Synthetic
ttcatggaccgaaggaagatttctctccttgtttgactgcctgaatgagacttcaaaagtttacaactgcaataa

SEQ ID NO: 345267 - DNA, 75 bp, Artificial Sequence
  Synthetic
tccttgtttgactgcctgaatgagacttcaaaagtttacaactgcaataaagcaacctgcttagaaggtaagtgt

SEQ ID NO: 345268 - DNA, 75 bp, Artificial Sequence
  Synthetic
agttctcttgcacttatgcaaagtcagagtgcacctgtaaaaggaatcaagtcccaggagtggcagttgttcaca

SEQ ID NO: 345269 - DNA, 75 bp, Artificial Sequence
  Synthetic
agagtgcacctgtaaaaggaatcaagtcccaggagtggcagttgttcacactaagcatggttctttcatgccgca

SEQ ID NO: 345270 - DNA, 75 bp, Artificial Sequence
  Synthetic
gttagaaagccactggcgaagaggtcagtatcagttcgacaaccctgcatggactgtgagagcgactgcaaggca

SEQ ID NO: 345271 - DNA, 75 bp, Artificial Sequence
  Synthetic
ggactgtgagagcgactgcaaggcagatcacatcctagtaattgtcagacacttcactccagaccattaccaagc

SEQ ID NO: 345272 - DNA, 75 bp, Artificial Sequence
  Synthetic
ggcagggcctctgacaaagagttcagagtgcctttcaagatggctgacagactctcagactctcactttgaaatt

SEQ ID NO: 345273 - DNA, 75 bp, Artificial Sequence
  Synthetic
gagtgcctttcaagatggctgacagactctcagactctcactttgaaattaaaatgtgggacaaagagcgatcaa

SEQ ID NO: 345274 - DNA, 75 bp, Artificial Sequence
  Synthetic
atgagttcttcttgacttcgagatgcgagtccatcaatgcttgtgatgcaatcacctgctggttttgcagagcca

SEQ ID NO: 345275 - DNA, 75 bp, Artificial Sequence
  Synthetic
cgagtccatcaatgcttgtgatgcaatcacctgctggttttgcagagccaattgggcaaacattcactgtttctc

SEQ ID NO: 345276 - DNA, 75 bp, Artificial Sequence
  Synthetic
attgggcaaacattcactgtttctccaaggaacaggtgttgatccttgtatttgtctgctctgtgtgcatacttg

SEQ ID NO: 345277 - DNA, 75 bp, Artificial Sequence
  Synthetic
aaggtgttgaagcctttctggtggttgctttctctgctgctcagaacttgcaccaggaggctgaataagagagct

SEQ ID NO: 345278 - DNA, 75 bp, Artificial Sequence
  Synthetic
attcagatgcagtcagtggcaaggccaaatgtgaggcagaagatgtacagcttgacacgtctcagcccagctgtg

SEQ ID NO: 345279 - DNA, 75 bp, Artificial Sequence
  Synthetic
cggcctctgggtgttctgattctatttctatcacagcttcaagccagaggtgctcaactagctctgatggactta

SEQ ID NO: 345280 - DNA, 75 bp, Artificial Sequence
  Synthetic
caggaaagttgcctgataattaaaactccaactgggtctgcagtggattacattaaaatcaagacgacagacatc

SEQ ID NO: 345281 - DNA, 75 bp, Artificial Sequence
  Synthetic
ctccaactgggtctgcagtggattacattaaaatcaagacgacagacatcagactcgaatgtgttcggagagact

SEQ ID NO: 345282 - DNA, 75 bp, Artificial Sequence
  Synthetic
aatgtgagaccatcttgtttctacctgagaaagactttttcccctctgtctcaggatgcatttaatatttacgag

SEQ ID NO: 345283 - DNA, 75 bp, Artificial Sequence
  Synthetic
acgtcattgtgtcaaccaactcctctcagagcaatctgacactcaagctgggagttccagactcaatccctcacg

SEQ ID NO: 345284 - DNA, 75 bp, Artificial Sequence
  Synthetic
tcagagcaatctgacactcaagctgggagttccagactcaatccctcacggactgattagcttgtccagtgtttc

SEQ ID NO: 345285 - DNA, 75 bp, Artificial Sequence
  Synthetic
cagaagaactgattactcgctgggaaagattggagagattcaatgtccaacgaaagcagatgctctttcaatttc

SEQ ID NO: 345286 - DNA, 75 bp, Artificial Sequence
  Synthetic
attatcttttccaaagtgcatagggactcagtagattgcaggtctgcaatcactgatcccatgaccattaagagc

SEQ ID NO: 345287 - DNA, 75 bp, Artificial Sequence
  Synthetic
gtacagatcagattccaacaaatgcagctcgcgatttctgtccctatctggctgctacaactgtgaggctggtgc

SEQ ID NO: 345288 - DNA, 75 bp, Artificial Sequence
  Synthetic
tagaatgcccaagcctaggatacacaacctactatgaggctaagaacactctggagaagtctgtgcgaaccattc

SEQ ID NO: 345289 - DNA, 75 bp, Artificial Sequence
  Synthetic
ctggatctggatgggacccatttggctggttccgagcctcatggctgagagccatatgggcagtcctaggaggaa

SEQ ID NO: 345290 - DNA, 75 bp, Artificial Sequence
  Synthetic
accctattttagggttggggttacagccgcttgactccgctgctgggtttgacactattcaaggccactggttgc

SEQ ID NO: 345291 - DNA, 75 bp, Artificial Sequence
  Synthetic
gacactattcaaggccactggttgcaatccctggcagcatcttgggttgatttgtttgtttttccatgtagccgg

SEQ ID NO: 345292 - DNA, 75 bp, Artificial Sequence
  Synthetic
acacaaagacctccaactaagctaacgattcatcatggcggttccggaggactgggtgcgctttgcgatcgaaat

SEQ ID NO: 345293 - DNA, 75 bp, Artificial Sequence
  Synthetic
cgattcatcatggcggttccggaggactgggtgcgctttgcgatcgaaatctctgaggcagcgtgggaggaggac

SEQ ID NO: 345294 - DNA, 75 bp, Artificial Sequence
  Synthetic
actgggtgcgctttgcgatcgaaatctctgaggcagcgtgggaggaggacgagatcaaagagttcatcaatctct

SEQ ID NO: 345295 - DNA, 75 bp, Artificial Sequence
  Synthetic
tgtggtcttgaagagattgtttgaactggcacagaaagctgggctggacaaggaccagatgatgagggacatcag

SEQ ID NO: 345296 - DNA, 75 bp, Artificial Sequence
  Synthetic
ctggcacagaaagctgggctggacaaggaccagatgatgagggacatcagggctctgatcaccctgcatctcacc

SEQ ID NO: 345297 - DNA, 75 bp, Artificial Sequence
  Synthetic
agaagaggctgtctgaagctggtaagaaggagtttgccttgcttaaggcgagataccagctggtggacaaagcca

SEQ ID NO: 345298 - DNA, 75 bp, Artificial Sequence
  Synthetic
gaaggagtttgccttgcttaaggcgagataccagctggtggacaaagccaaggaagcatctgacctgaccctctc

SEQ ID NO: 345299 - DNA, 75 bp, Artificial Sequence
  Synthetic
ctgacgtgtcgcatcctccctcaggtggtggcacacactgcagtgacaaaggcaaggatggatggtctcagtgct

SEQ ID NO: 345300 - DNA, 75 bp, Artificial Sequence
  Synthetic
tggtggcacacactgcagtgacaaaggcaaggatggatggtctcagtgctgactatccagtgcacatgatgcaca

SEQ ID NO: 345301 - DNA, 75 bp, Artificial Sequence
  Synthetic
gactctaccagaggaatccatcaaggctttggtggatgctcaccggctctatctcctggagttctccagaaccat

SEQ ID NO: 345302 - DNA, 75 bp, Artificial Sequence
  Synthetic
gctttggtggatgctcaccggctctatctcctggagttctccagaaccatcaacgtgaagcacaggggaatggag

SEQ ID NO: 345303 - DNA, 75 bp, Artificial Sequence
  Synthetic
actctgccctccaagctggcctggcaagctcttttctgacatcccgccagaaaagagcatacctccagagcttca

SEQ ID NO: 345304 - DNA, 75 bp, Artificial Sequence
  Synthetic
aagctcttttctgacatcccgccagaaaagagcatacctccagagcttcaagctcgtggacggtaatggcaaggc

SEQ ID NO: 345305 - DNA, 75 bp, Artificial Sequence
  Synthetic
acgactcttagatcaatgatctaagagtcaatttggaatttggaaattcggccaaaattaaaaacctctaattgg

SEQ ID NO: 345306 - DNA, 75 bp, Artificial Sequence
  Synthetic
agtcaatttggaatttggaaattcggccaaaattaaaaacctctaattggattctaaaagggcttcggcccacct

SEQ ID NO: 345307 - DNA, 75 bp, Artificial Sequence
  Synthetic
cttttggaaagacgtgtccagcattctttccctcacactctcaaatgcctcccagtgctcatccagcttgacatg

SEQ ID NO: 345308 - DNA, 75 bp, Artificial Sequence
  Synthetic
ctttccctcacactctcaaatgcctcccagtgctcatccagcttgacatgatctggatggactttcaggttactc

SEQ ID NO: 345309 - DNA, 75 bp, Artificial Sequence
  Synthetic
gatgttttggcttgttaccatgcttgttggctttggttccaggtgggctttgctcgaaatgagtgaagaaccttt

SEQ ID NO: 345310 - DNA, 75 bp, Artificial Sequence
  Synthetic
gttggctttggttccaggtgggctttgctcgaaatgagtgaagaaccttttatccaccatggctcttctcagaac

SEQ ID NO: 345311 - DNA, 75 bp, Artificial Sequence
  Synthetic
tggatcaagcaaagatctttcactagattctttccagtgatctgtctttcggacagcctcattttgttgatcttt

SEQ ID NO: 345312 - DNA, 75 bp, Artificial Sequence
  Synthetic
gattctttccagtgatctgtctttcggacagcctcattttgttgatctttgatcgcaatttcaatgcaaacatga

SEQ ID NO: 345313 - DNA, 75 bp, Artificial Sequence
  Synthetic
tgccttttgctttctgcgtttctttgagttctgatcaccaaacagggcaatgctcactatggtgagaaaagcatc

SEQ ID NO: 345314 - DNA, 75 bp, Artificial Sequence
  Synthetic
gagttctgatcaccaaacagggcaatgctcactatggtgagaaaagcatctctcagagttttagtccaaaccatg

SEQ ID NO: 345315 - DNA, 75 bp, Artificial Sequence
  Synthetic
tcagaatcaaagccctctttttctcaagaggccatccagtggcattgacaatcctctgctcagtagaggagtcaa

SEQ ID NO: 345316 - DNA, 75 bp, Artificial Sequence
  Synthetic
aagaggccatccagtggcattgacaatcctctgctcagtagaggagtcaactatgtagaaaccactaatgatggt

SEQ ID NO: 345317 - DNA, 75 bp, Artificial Sequence
  Synthetic
agccacccagttgagggaaggtccacacctggaatagaactcttcaggggaatgattttagggaaaagaccgtca

SEQ ID NO: 345318 - DNA, 75 bp, Artificial Sequence
  Synthetic
agaacttgttgattggacttagggaataacccttaggaaggtccttctccgaaatgatgtagtatgacatgctta

SEQ ID NO: 345319 - DNA, 75 bp, Artificial Sequence
  Synthetic
acacaaagacgccaagatgcttttagcgatatgctcgagaacaaaccctcaaagaggactgaactgtcctccagc

SEQ ID NO: 345320 - DNA, 75 bp, Artificial Sequence
  Synthetic
gcgatatgctcgagaacaaaccctcaaagaggactgaactgtcctccagctgtgacctatgcatcgagtcacatg

SEQ ID NO: 345321 - DNA, 75 bp, Artificial Sequence
  Synthetic
aaagaggactgaactgtcctccagctgtgacctatgcatcgagtcacatgagaccaccaatcccatctttcctgc

SEQ ID NO: 345322 - DNA, 75 bp, Artificial Sequence
  Synthetic
catggattttgatcttgactccattccagcaggatcagtaactggatcttctattggaccaaagtttagagtgaa

SEQ ID NO: 345323 - DNA, 75 bp, Artificial Sequence
  Synthetic
ccagcaggatcagtaactggatcttctattggaccaaagtttagagtgaagactcaggctgcgtcttcttttgtc

SEQ ID NO: 345324 - DNA, 75 bp, Artificial Sequence
  Synthetic
gcgatgcttctgacatgccacttaaggatcacttcccgctgatcaatgacacttttgatcactggactcctgact

SEQ ID NO: 345325 - DNA, 75 bp, Artificial Sequence
  Synthetic
ggatcacttcccgctgatcaatgacacttttgatcactggactcctgactttatctctcagagattggatggcag

SEQ ID NO: 345326 - DNA, 75 bp, Artificial Sequence
  Synthetic
aatcgttctgatcaagaacagtctctgattagtgctttcaacacaaaggttggcaagtatgaagtggcactgcac

SEQ ID NO: 345327 - DNA, 75 bp, Artificial Sequence
  Synthetic
tgattagtgctttcaacacaaaggttggcaagtatgaagtggcactgcacaataggtcatctgccactccaatcc

SEQ ID NO: 345328 - DNA, 75 bp, Artificial Sequence
  Synthetic
gacgactgttgtgaccaacctaaatctgaatcagcaagaagttgatgaattgtgcttcagatttctggtttccag

SEQ ID NO: 345329 - DNA, 75 bp, Artificial Sequence
  Synthetic
ctgaatcagcaagaagttgatgaattgtgcttcagatttctggtttccagagcggtgcacctggagatgaccact

SEQ ID NO: 345330 - DNA, 75 bp, Artificial Sequence
  Synthetic
atgttgatgaggacaaaaggagcagagaagtgaaagcagccttccattcagttcaaccagactgggaaatgacag

SEQ ID NO: 345331 - DNA, 75 bp, Artificial Sequence
  Synthetic
agaagtgaaagcagccttccattcagttcaaccagactgggaaatgacagaagccaccttcgctccgttttctaa

SEQ ID NO: 345332 - DNA, 75 bp, Artificial Sequence
  Synthetic
atggaaccagacaaggagtatttggcacatatagtggttgactccatcagggcagctcaagaggatcttgataaa

SEQ ID NO: 345333 - DNA, 75 bp, Artificial Sequence
  Synthetic
cacatatagtggttgactccatcagggcagctcaagaggatcttgataaaaaccactacctttctgaaagcttga

SEQ ID NO: 345334 - DNA, 75 bp, Artificial Sequence
  Synthetic
cagggacgagagcttaaaaatggtgagaaattatgaaactgagttcaataagggagcagagagatctgcatgggg

SEQ ID NO: 345335 - DNA, 75 bp, Artificial Sequence
  Synthetic
agaaattatgaaactgagttcaataagggagcagagagatctgcatggggccacaagtcaaccattccatttcct

SEQ ID NO: 345336 - DNA, 75 bp, Artificial Sequence
  Synthetic
acacaacttccttatccagactcactgagctaccggtgatcacaggaggatctgatgcaactatcagggcttgga

SEQ ID NO: 345337 - DNA, 75 bp, Artificial Sequence
  Synthetic
tgagctaccggtgatcacaggaggatctgatgcaactatcagggcttggagaacagcctatgggtctgtgagcaa

SEQ ID NO: 345338 - DNA, 75 bp, Artificial Sequence
  Synthetic
gatgtggaaagagaacggagggctgctctatgctcacttaccgttgaggagatagaagagtcaaaggctctgagg

SEQ ID NO: 345339 - DNA, 75 bp, Artificial Sequence
  Synthetic
ctctatgctcacttaccgttgaggagatagaagagtcaaaggctctgagggtgaagtatcatcgctgtaaaattg

SEQ ID NO: 345340 - DNA, 75 bp, Artificial Sequence
  Synthetic
cttggctctccagggagttgaggcaaaggagttcaggaatcatcctaccatcatcaaaaagagggaggagtccaa

SEQ ID NO: 345341 - DNA, 75 bp, Artificial Sequence
  Synthetic
aaggagttcaggaatcatcctaccatcatcaaaaagagggaggagtccaaaaagacattccctctgacaacggat

SEQ ID NO: 345342 - DNA, 75 bp, Artificial Sequence
  Synthetic
ataaagatgaatccatgttcaaccctgacttggtgcagacccctccagcagccatgatagaagcggtgaaagctg

SEQ ID NO: 345343 - DNA, 75 bp, Artificial Sequence
  Synthetic
tgacttggtgcagacccctccagcagccatgatagaagcggtgaaagctggtgcagaggctcaatccctgcatgg

SEQ ID NO: 345344 - DNA, 75 bp, Artificial Sequence
  Synthetic
tatcattctgctctgagattcttgagtctccctattggaatctggttattcatgtgtacgtgcattggagtggag

SEQ ID NO: 345345 - DNA, 75 bp, Artificial Sequence
  Synthetic
gtctccctattggaatctggttattcatgtgtacgtgcattggagtggagttaagcatcagtctgaaacagcact

SEQ ID NO: 345346 - DNA, 75 bp, Artificial Sequence
  Synthetic
gaagctaaggttctttgacatcttccttctgattaagccaacaaactcaggaagccatgtcttttactccattgc

SEQ ID NO: 345347 - DNA, 75 bp, Artificial Sequence
  Synthetic
cttctgattaagccaacaaactcaggaagccatgtcttttactccattgcattccctgaatccgccatcttggga

SEQ ID NO: 345348 - DNA, 75 bp, Artificial Sequence
  Synthetic
agggtgttcagtttgaagatggttggttttggacagaatttaactccttcaagatgtccaagctgacaaatgtgg

SEQ ID NO: 345349 - DNA, 75 bp, Artificial Sequence
  Synthetic
gttttggacagaatttaactccttcaagatgtccaagctgacaaatgtggtcaagtgtctatccacaggctttaa

SEQ ID NO: 345350 - DNA, 75 bp, Artificial Sequence
  Synthetic
tatgaagttcccttctgggctggatcagagaaggattatctagctggaaaacaaagggccaacaagatgttcaag

SEQ ID NO: 345351 - DNA, 75 bp, Artificial Sequence
  Synthetic
cagagaaggattatctagctggaaaacaaagggccaacaagatgttcaagttctgcttgctaatgtttctggaag

SEQ ID NO: 345352 - DNA, 75 bp, Artificial Sequence
  Synthetic
cacactctctcgatacatcatgatggagggttttgtgagtcctccttgcatccccaagccccagaagatgataga

SEQ ID NO: 345353 - DNA, 75 bp, Artificial Sequence
  Synthetic
gagggttttgtgagtcctccttgcatccccaagccccagaagatgatagaaaagcttccagaactagctagaact

SEQ ID NO: 345354 - DNA, 75 bp, Artificial Sequence
  Synthetic
ggatgctacagacaataattagaatatctgacttccctttcaagatcactgcaggtcacaagtcagcaagttggt

SEQ ID NO: 345355 - DNA, 75 bp, Artificial Sequence
  Synthetic
atctgacttccctttcaagatcactgcaggtcacaagtcagcaagttggtctggaatgttcaactgggtgacagg

SEQ ID NO: 345356 - DNA, 75 bp, Artificial Sequence
  Synthetic
ttgatatcactattttatctgggatatctgaaaaacaaagaggaatcaccagaacggaatgccagtgtaggaatg

SEQ ID NO: 345357 - DNA, 75 bp, Artificial Sequence
  Synthetic
atctgaaaaacaaagaggaatcaccagaacggaatgccagtgtaggaatgtacaaaaagatactagagtatgaag

SEQ ID NO: 345358 - DNA, 75 bp, Artificial Sequence
  Synthetic
tcttggactgggagacccaccagcagaggacactaggtttcatgaatactcagtcagtcttctcaaacacctttg

SEQ ID NO: 345359 - DNA, 75 bp, Artificial Sequence
  Synthetic
gaggacactaggtttcatgaatactcagtcagtcttctcaaacacctttgcatccacgcagaacataatttgaga

SEQ ID NO: 345360 - DNA, 75 bp, Artificial Sequence
  Synthetic
caatgatctctcgagacatcattgatgcaatagccagcttggatctggaaaggctagctactctcaaagcatcaa

SEQ ID NO: 345361 - DNA, 75 bp, Artificial Sequence
  Synthetic
tgcaatagccagcttggatctggaaaggctagctactctcaaagcatcaagtaatttcaatgaagaatggtatca

SEQ ID NO: 345362 - DNA, 75 bp, Artificial Sequence
  Synthetic
cacagaagcaaagttttagagaaagtcagcaaatatgtcaagaaaagcagttcccatgttcaccatatcatggag

SEQ ID NO: 345363 - DNA, 75 bp, Artificial Sequence
  Synthetic
tcagcaaatatgtcaagaaaagcagttcccatgttcaccatatcatggaggaatgtttaaagaaggtggagaagc

SEQ ID NO: 345364 - DNA, 75 bp, Artificial Sequence
  Synthetic
caagaaacctcaacatggtggtcttcgggagatctatgttcttggttttgaggaaagagttgtgcagcttgtcat

SEQ ID NO: 345365 - DNA, 75 bp, Artificial Sequence
  Synthetic
cgggagatctatgttcttggttttgaggaaagagttgtgcagcttgtcatcgagaccatagcaagacagatatgc

SEQ ID NO: 345366 - DNA, 75 bp, Artificial Sequence
  Synthetic
cgaatcctaagcaaaaacttgcaatccctgaaacccatggccttagagctgtcaaaacctgtggaatccatcatg

SEQ ID NO: 345367 - DNA, 75 bp, Artificial Sequence
  Synthetic
ccctgaaacccatggccttagagctgtcaaaacctgtggaatccatcatgagactgttgctacctctgatgatgc

SEQ ID NO: 345368 - DNA, 75 bp, Artificial Sequence
  Synthetic
gtaacaaagtttgcactgatgttgtgtcacttcactgaccctctattccatggatttatcattcggggttgctcc

SEQ ID NO: 345369 - DNA, 75 bp, Artificial Sequence
  Synthetic
gtcacttcactgaccctctattccatggatttatcattcggggttgctccatgttcatgaagaagaggatcatga

SEQ ID NO: 345370 - DNA, 75 bp, Artificial Sequence
  Synthetic
agatgcccacacgaccctggacacttccaatcgataccttcagctaatccacagaggttatcatgggagcctgga

SEQ ID NO: 345371 - DNA, 75 bp, Artificial Sequence
  Synthetic
tccaatcgataccttcagctaatccacagaggttatcatgggagcctggaagaccaacctaaatggatgacacga

SEQ ID NO: 345372 - DNA, 75 bp, Artificial Sequence
  Synthetic
ctggaatgatgcaaggaatcttgcattacacctccagcttgttgcacactgttctccaagagtggttgaggtcct

SEQ ID NO: 345373 - DNA, 75 bp, Artificial Sequence
  Synthetic
ttacacctccagcttgttgcacactgttctccaagagtggttgaggtccttttctcaaaggttcatcagatccaa

SEQ ID NO: 345374 - DNA, 75 bp, Artificial Sequence
  Synthetic
gtcctagtagatgttcttcaaagttcagatgactctggaatgatgatatcctttccttcaactgacaagaactcc

SEQ ID NO: 345375 - DNA, 75 bp, Artificial Sequence
  Synthetic
cagatgactctggaatgatgatatcctttccttcaactgacaagaactccacaggaaagtatagatatctatcag

SEQ ID NO: 345376 - DNA, 75 bp, Artificial Sequence
  Synthetic
cattggaaagtatctcggaatctattcatcaattaaatctaccaacaacacgttgcatctccttgagttcaactc

SEQ ID NO: 345377 - DNA, 75 bp, Artificial Sequence
  Synthetic
tcatcaattaaatctaccaacaacacgttgcatctccttgagttcaactctgagttcttctttcacatcaaccac

SEQ ID NO: 345378 - DNA, 75 bp, Artificial Sequence
  Synthetic
cagcttgtgatactatctctgagcaggaatctcttgcttcccgacaagaggaaatgtacaacaatctgacatcag

SEQ ID NO: 345379 - DNA, 75 bp, Artificial Sequence
  Synthetic
ggaatctcttgcttcccgacaagaggaaatgtacaacaatctgacatcagtgcttgaaggaggaggaagcttctc

SEQ ID NO: 345380 - DNA, 75 bp, Artificial Sequence
  Synthetic
caactcttgctccactacacccttcttggaatgacagtatcccccctatttcttgagtacattaagatggtctca

SEQ ID NO: 345381 - DNA, 75 bp, Artificial Sequence
  Synthetic
ttggaatgacagtatcccccctatttcttgagtacattaagatggtctcagagatcaaagatccctcccttggct

SEQ ID NO: 345382 - DNA, 75 bp, Artificial Sequence
  Synthetic
aagtggactatctggtttcaagtacaatgtgtgggttgccgtgcaaaacagcatacttgggtctagatacagatg

SEQ ID NO: 345383 - DNA, 75 bp, Artificial Sequence
  Synthetic
aatgtgtgggttgccgtgcaaaacagcatacttgggtctagatacagatgtcttctagaagccattcagaattca

SEQ ID NO: 345384 - DNA, 75 bp, Artificial Sequence
  Synthetic
ttgacaccacaacatctggaacttttgttcagtccaccatcattaggtttggagacagaaaaaaatggcaaagat

SEQ ID NO: 345385 - DNA, 75 bp, Artificial Sequence
  Synthetic
tgttcagtccaccatcattaggtttggagacagaaaaaaatggcaaagattggtagaacgcttgaatctgccaga

SEQ ID NO: 345386 - DNA, 75 bp, Artificial Sequence
  Synthetic
aacccagagattgtttacaggcgtcctagagatgggactgaagtgggactgagaattgctgagaagatacactca

SEQ ID NO: 345387 - DNA, 75 bp, Artificial Sequence
  Synthetic
ctagagatgggactgaagtgggactgagaattgctgagaagatacactcacctggggtgtcaaactcattgtcca

SEQ ID NO: 345388 - DNA, 75 bp, Artificial Sequence
  Synthetic
ttcttcttcagtttacatcctgagcagaaatattctaagcgatggcctggcttggctatatgatgaagaagagga

SEQ ID NO: 345389 - DNA, 75 bp, Artificial Sequence
  Synthetic
agaaatattctaagcgatggcctggcttggctatatgatgaagaagaggaagtgaagagacctctcctattcaag

SEQ ID NO: 345390 - DNA, 75 bp, Artificial Sequence
  Synthetic
gtcactctcgactcactccctctcagctatcaactctatttccaatgatggcagaatttgaaaaactccaaactc

SEQ ID NO: 345391 - DNA, 75 bp, Artificial Sequence
  Synthetic
gctatcaactctatttccaatgatggcagaatttgaaaaactccaaactcatctgaggagttacatgaagattga

SEQ ID NO: 345392 - DNA, 75 bp, Artificial Sequence
  Synthetic
atcatcacgcagaccagaataaacatcttggagactgaaagattcctcagagccaggccagaagacctgattgct

SEQ ID NO: 345393 - DNA, 75 bp, Artificial Sequence
  Synthetic
tcttggagactgaaagattcctcagagccaggccagaagacctgattgctgacatgtggttcggtttcaccagaa

SEQ ID NO: 345394 - DNA, 75 bp, Artificial Sequence
  Synthetic
agaagaatggaatcatctcactgctgtgtttccctggttaaagcctaatcccgaagaaactcttgaactatctcc

SEQ ID NO: 345395 - DNA, 75 bp, Artificial Sequence
  Synthetic
gtgtttccctggttaaagcctaatcccgaagaaactcttgaactatctccatttcaacatcacgtgcagctcagg

SEQ ID NO: 345396 - DNA, 75 bp, Artificial Sequence
  Synthetic
aggggagagacattagaatcattggtgctccaatcaaaaagtcaagcggaattagcaatgtgtccactgcaatta

SEQ ID NO: 345397 - DNA, 75 bp, Artificial Sequence
  Synthetic
tgctccaatcaaaaagtcaagcggaattagcaatgtgtccactgcaattagagacaatttcttccctaggttcgt

SEQ ID NO: 345398 - DNA, 75 bp, Artificial Sequence
  Synthetic
gctctggagcgcatagaagcagcaggaattttgaagcatgcgctgttcttgactgttacaggtccatacacagat

SEQ ID NO: 345399 - DNA, 75 bp, Artificial Sequence
  Synthetic
gaattttgaagcatgcgctgttcttgactgttacaggtccatacacagataacacaaaattagagatgtgcagag

SEQ ID NO: 345400 - DNA, 75 bp, Artificial Sequence
  Synthetic
tctcctcaaaccaaaccatggaaaaacaaggagcaatgtgctgtccctgttccaggatttcttttccatgagagg

SEQ ID NO: 345401 - DNA, 75 bp, Artificial Sequence
  Synthetic
acaaggagcaatgtgctgtccctgttccaggatttcttttccatgagaggaccagacatcatcttcaaccgaatt

SEQ ID NO: 345402 - DNA, 75 bp, Artificial Sequence
  Synthetic
gaggtttcacatctcctcaggttcccaaagagattgatggtcgcattgtctacactggagatggagtttggagag

SEQ ID NO: 345403 - DNA, 75 bp, Artificial Sequence
  Synthetic
caaagagattgatggtcgcattgtctacactggagatggagtttggagaggaattgtagatggtttccaaatcca

SEQ ID NO: 345404 - DNA, 75 bp, Artificial Sequence
  Synthetic
cagaaagttaaccaattgaagtccatcaccgtgaactcagatagaagcattgccactctcagcagtttttgtcat

SEQ ID NO: 345405 - DNA, 75 bp, Artificial Sequence
  Synthetic
tcaccgtgaactcagatagaagcattgccactctcagcagtttttgtcattcttggtgcaaagaaatgggtgtgt

SEQ ID NO: 345406 - DNA, 75 bp, Artificial Sequence
  Synthetic
acagagattcacaaaggcttctttcttcatgttcaacttcaaaatttcaggatcaaggcagactctgggagctcc

SEQ ID NO: 345407 - DNA, 75 bp, Artificial Sequence
  Synthetic
ttcatgttcaacttcaaaatttcaggatcaaggcagactctgggagctccaattttcattgtcagtgaaaggatt

SEQ ID NO: 345408 - DNA, 75 bp, Artificial Sequence
  Synthetic
ccaacctggagttcaagataagaggcaacaccctgaatctgacctacaaagagtctttgccaaaggcaggtcaaa

SEQ ID NO: 345409 - DNA, 75 bp, Artificial Sequence
  Synthetic
caacaccctgaatctgacctacaaagagtctttgccaaaggcaggtcaaagaatgttcaacatcctgagctacac

SEQ ID NO: 345410 - DNA, 75 bp, Artificial Sequence
  Synthetic
gagaacgccttcaaactcatgtcattgtctccgagacacaaatttcatggaagagagccaagcacttcctggatc

SEQ ID NO: 345411 - DNA, 75 bp, Artificial Sequence
  Synthetic
tgtctccgagacacaaatttcatggaagagagccaagcacttcctggatctgtatgagagcactgcccatcacca

SEQ ID NO: 345412 - DNA, 75 bp, Artificial Sequence
  Synthetic
tctcaatcatgaaagaatcagtgcctcgattgacaatgacagacttgctgagtgcttcaaaagtgttcttgaatc

SEQ ID NO: 345413 - DNA, 75 bp, Artificial Sequence
  Synthetic
tcgattgacaatgacagacttgctgagtgcttcaaaagtgttcttgaatcagccctcagacggaaaggagtcttc

SEQ ID NO: 345414 - DNA, 75 bp, Artificial Sequence
  Synthetic
agaagatgctggatagcctgagtagagacatgctggatttctttgcagaggctggcctgaatgatgatctcgaac

SEQ ID NO: 345415 - DNA, 75 bp, Artificial Sequence
  Synthetic
agacatgctggatttctttgcagaggctggcctgaatgatgatctcgaacttgaagaagaaccttggctgggagg

SEQ ID NO: 345416 - DNA, 75 bp, Artificial Sequence
  Synthetic
gaggattatctggaggagtacaatctgggaccatttgggatgttcagcgtggagcaggagatgaacacaaagtat

SEQ ID NO: 345417 - DNA, 75 bp, Artificial Sequence
  Synthetic
tgggaccatttgggatgttcagcgtggagcaggagatgaacacaaagtattatcatcacctcctattagactctc

SEQ ID NO: 345418 - DNA, 75 bp, Artificial Sequence
  Synthetic
ttctcttgatggtctacgaaaactgttccaggagaatgaagcccctattgagtacaaaaaagaggtttgtcgatt

SEQ ID NO: 345419 - DNA, 75 bp, Artificial Sequence
  Synthetic
ttccaggagaatgaagcccctattgagtacaaaaaagaggtttgtcgattgttctcaatcctgcagaaagatgca

SEQ ID NO: 345420 - DNA, 75 bp, Artificial Sequence
  Synthetic
atcttctgtcagagaacatgggtcttgacgttgaggatgacatgtttggataaaagacatgttcttgggttggat

SEQ ID NO: 345421 - DNA, 75 bp, Artificial Sequence
  Synthetic
tattgctatcaaagtccttaaatctctttctttatctttgttcttcttttacttccatcttggcgaactttgtgt

SEQ ID NO: 345422 - DNA, 75 bp, Artificial Sequence
  Synthetic
acacaaaggaggctaacatggtaaggacatatctcctggttttgctcctttgtgggcctgttacgcccttcttca

SEQ ID NO: 345423 - DNA, 75 bp, Artificial Sequence
  Synthetic
gacatatctcctggttttgctcctttgtgggcctgttacgcccttcttcaatcaattgatggatgtcacaagaag

SEQ ID NO: 345424 - DNA, 75 bp, Artificial Sequence
  Synthetic
tgtgggcctgttacgcccttcttcaatcaattgatggatgtcacaagaaggattcttgactccagcaatactact

SEQ ID NO: 345425 - DNA, 75 bp, Artificial Sequence
  Synthetic
acaagctttccagatgggacaaccacctgatgtctatcctgggtttggggactcatgttgatgagatctccctga

SEQ ID NO: 345426 - DNA, 75 bp, Artificial Sequence
  Synthetic
cctgatgtctatcctgggtttggggactcatgttgatgagatctccctgaatcacagtcagcatctccacaactt

SEQ ID NO: 345427 - DNA, 75 bp, Artificial Sequence
  Synthetic
agaagaactctgacaatgctggacccaaaatctggaaagttcaagagactggcctgcatgaagaatcagaccttg

SEQ ID NO: 345428 - DNA, 75 bp, Artificial Sequence
  Synthetic
caaaatctggaaagttcaagagactggcctgcatgaagaatcagaccttgtctagagactgtgggagctgcacga

SEQ ID NO: 345429 - DNA, 75 bp, Artificial Sequence
  Synthetic
tgaacacctggtatacgatgacggaatttgccagtctgattatagcagcatcacctcaatgccagagcacagcac

SEQ ID NO: 345430 - DNA, 75 bp, Artificial Sequence
  Synthetic
atttgccagtctgattatagcagcatcacctcaatgccagagcacagcacccatttttgcagagttgggtcactg

SEQ ID NO: 345431 - DNA, 75 bp, Artificial Sequence
  Synthetic
caaagagggtccagcatgtcccctggttctggattgaaggccgcatcagaatttacgacgactactcaatctcct

SEQ ID NO: 345432 - DNA, 75 bp, Artificial Sequence
  Synthetic
gttctggattgaaggccgcatcagaatttacgacgactactcaatctcctggacagaaggcagatttctctctct

SEQ ID NO: 345433 - DNA, 75 bp, Artificial Sequence
  Synthetic
aaaatttatgattgtgtgaaggctgcctgtctggagggaaaatgcactggtgacattcagttctgcactgagttc

SEQ ID NO: 345434 - DNA, 75 bp, Artificial Sequence
  Synthetic
cctgtctggagggaaaatgcactggtgacattcagttctgcactgagttcccatgttcatattcaaagcctgaat

SEQ ID NO: 345435 - DNA, 75 bp, Artificial Sequence
  Synthetic
tggagttgctgttgttcacacaaagcacgggtcttttatgccagaatgttttggccagtctctgtgggcagtgag

SEQ ID NO: 345436 - DNA, 75 bp, Artificial Sequence
  Synthetic
cacgggtcttttatgccagaatgttttggccagtctctgtgggcagtgaggaaaccagtggccaaaagatcagtg

SEQ ID NO: 345437 - DNA, 75 bp, Artificial Sequence
  Synthetic
gtgaaagcaattgcaagtctgatcacattctggttattgtcaggcactttgatccagatcactatcaggcttgtc

SEQ ID NO: 345438 - DNA, 75 bp, Artificial Sequence
  Synthetic
cattctggttattgtcaggcactttgatccagatcactatcaggcttgtcttggctcaacttgtctgacagggcg

SEQ ID NO: 345439 - DNA, 75 bp, Artificial Sequence
  Synthetic
cccttcaaaatggctgatagactctcagactcaaactttgagattagaatgtgggacaaagagcgatccaatgag

SEQ ID NO: 345440 - DNA, 75 bp, Artificial Sequence
  Synthetic
cagactcaaactttgagattagaatgtgggacaaagagcgatccaatgagtattctctcacatcaaaatgtgaat

SEQ ID NO: 345441 - DNA, 75 bp, Artificial Sequence
  Synthetic
ctgctggttttgcagagccaattgggcaaacatccattgtttttccaaagaacaagtcataatactggtcattgt

SEQ ID NO: 345442 - DNA, 75 bp, Artificial Sequence
  Synthetic
gcaaacatccattgtttttccaaagaacaagtcataatactggtcattgtttgctcaatgtgcatattagtgatc

SEQ ID NO: 345443 - DNA, 75 bp, Artificial Sequence
  Synthetic
tcattgcagtgacagtctggagagttctgaaacctttctggtggcttatgtctctcctcctcagggcatgcagca

SEQ ID NO: 345444 - DNA, 75 bp, Artificial Sequence
  Synthetic
tctgaaacctttctggtggcttatgtctctcctcctcagggcatgcagcaggagaatcaataggaaggcagaacg

SEQ ID NO: 345445 - DNA, 75 bp, Artificial Sequence
  Synthetic
gaggaaggattagcagaaaataatcctatgacacctcttaatcagattccctctcaatctgtggtaagacccaat

SEQ ID NO: 345446 - DNA, 75 bp, Artificial Sequence
  Synthetic
ctatgacacctcttaatcagattccctctcaatctgtggtaagacccaatgtaagacaaaaaatgtttaacctga

SEQ ID NO: 345447 - DNA, 75 bp, Artificial Sequence
  Synthetic
aatcatctgcctgctgaatccagcgtctgggtgctcagactccatgtcaattactgcatccagccagagatgttc

SEQ ID NO: 345448 - DNA, 75 bp, Artificial Sequence
  Synthetic
tctgggtgctcagactccatgtcaattactgcatccagccagagatgttcgaccagctcagatggcttaagcacc

SEQ ID NO: 345449 - DNA, 75 bp, Artificial Sequence
  Synthetic
tacaggtcagccctaagggtcaggaaagctgcttgatcataaaaactccaactggcactgcagttgactatataa

SEQ ID NO: 345450 - DNA, 75 bp, Artificial Sequence
  Synthetic
aagctgcttgatcataaaaactccaactggcactgcagttgactatataaaaataaaaactactgacataagact

SEQ ID NO: 345451 - DNA, 75 bp, Artificial Sequence
  Synthetic
tgggtgccacgagtcactcatcggtgtgttggctcgaggagatgtcatctcatgggggcttgccagggtgatgct

SEQ ID NO: 345452 - DNA, 75 bp, Artificial Sequence
  Synthetic
gtgttggctcgaggagatgtcatctcatgggggcttgccagggtgatgcttgttcagaattcaaaattcaggatt

SEQ ID NO: 345453 - DNA, 75 bp, Artificial Sequence
  Synthetic
agaactgatggcacagttgggctggagttactgcattgagcaatgtggagggccattgtgccaatgttttaacgt

SEQ ID NO: 345454 - DNA, 75 bp, Artificial Sequence
  Synthetic
agttactgcattgagcaatgtggagggccattgtgccaatgttttaacgtcagaccatcttgcttctacctgagg

SEQ ID NO: 345455 - DNA, 75 bp, Artificial Sequence
  Synthetic
atgctttcaacatctatgagtgttctgagtggtcttatcgaattaatgtagttgcaaccactaattcctccagaa

SEQ ID NO: 345456 - DNA, 75 bp, Artificial Sequence
  Synthetic
tgagtggtcttatcgaattaatgtagttgcaaccactaattcctccagaacaaacttgactttgaaattaggagt

SEQ ID NO: 345457 - DNA, 75 bp, Artificial Sequence
  Synthetic
atcagtctttcaagtgtctctcagccaccagctgtctcttatgcagagtgttttggagaggatctgcatggagtg

SEQ ID NO: 345458 - DNA, 75 bp, Artificial Sequence
  Synthetic
caccagctgtctcttatgcagagtgttttggagaggatctgcatggagtgaaattccatacagtctgcaacaaga

SEQ ID NO: 345459 - DNA, 75 bp, Artificial Sequence
  Synthetic
aggtgagatacagtgcccgacgaaggcagatgccctttccatctcaaagagatgtatcagtacagacagcataat

SEQ ID NO: 345460 - DNA, 75 bp, Artificial Sequence
  Synthetic
gcagatgccctttccatctcaaagagatgtatcagtacagacagcataattttctccaaagtccacagggattct

SEQ ID NO: 345461 - DNA, 75 bp, Artificial Sequence
  Synthetic
acccaatgaccatcagaaacagaaacaaactgccttccactgttggttcagtcacgttctggccgactgaaacca

SEQ ID NO: 345462 - DNA, 75 bp, Artificial Sequence
  Synthetic
caaactgccttccactgttggttcagtcacgttctggccgactgaaaccagtgttgaggcagcaataccggattt

SEQ ID NO: 345463 - DNA, 75 bp, Artificial Sequence
  Synthetic
ctggatggatacatcctgcagtacaggtctgactccaacaagtgcaatgccagattcctatccttaacaggctgt

SEQ ID NO: 345464 - DNA, 75 bp, Artificial Sequence
  Synthetic
ggtctgactccaacaagtgcaatgccagattcctatccttaacaggctgttacaattgtgaaacaggtgccagac

SEQ ID NO: 345465 - DNA, 75 bp, Artificial Sequence
  Synthetic
cggaacagctttggcaattctagagtgccccagcataaagtatacgacatattatgaagctaaaaacactcttga

SEQ ID NO: 345466 - DNA, 75 bp, Artificial Sequence
  Synthetic
tgccccagcataaagtatacgacatattatgaagctaaaaacactcttgaaaaatcagtcaggaccattcatgta

SEQ ID NO: 345467 - DNA, 75 bp, Artificial Sequence
  Synthetic
gcagcttcaggtgccccaattcagagtctgaattgataatcaaaggagagcttgtatacctttttaatgatgatg

SEQ ID NO: 345468 - DNA, 75 bp, Artificial Sequence
  Synthetic
gtctgaattgataatcaaaggagagcttgtatacctttttaatgatgatgtccgacatcacaatcagacgctctc

SEQ ID NO: 345469 - DNA, 75 bp, Artificial Sequence
  Synthetic
ctaggctgggatccctttggatggttcagggcttcttggctgagagccatctgggcaatcctaggtggcactgtt

SEQ ID NO: 345470 - DNA, 75 bp, Artificial Sequence
  Synthetic
tcagggcttcttggctgagagccatctgggcaatcctaggtggcactgtttccatcatcatcggagccattgtca

SEQ ID NO: 345471 - DNA, 75 bp, Artificial Sequence
  Synthetic
gaaagcaaaaaaatcttaaggcactcaaatccccaccctctctctccacctttgtagattccctataatccccca

SEQ ID NO: 345472 - DNA, 75 bp, Artificial Sequence
  Synthetic
caaatccccaccctctctctccacctttgtagattccctataatcccccattcccttcccctcccttatagattc

SEQ ID NO: 345473 - DNA, 75 bp, Artificial Sequence
  Synthetic
acctcaactccttttggagttggggtttcagccacacgactttgctggtgtattgggtactgcactgttgcactc

SEQ ID NO: 345474 - DNA, 75 bp, Artificial Sequence
  Synthetic
tattgggtactgcactgttgcactcagagacatccctgtcagtgtcttgggatgatttgtttgtttttccatgta

SEQ ID NO: 345475 - DNA, 75 bp, Artificial Sequence
  Synthetic
acacaaagacgccaagatgttactagcgatttgttctaggagtgagacaaatcaaggactggactgccctcctgc

SEQ ID NO: 345476 - DNA, 75 bp, Artificial Sequence
  Synthetic
gcgatttgttctaggagtgagacaaatcaaggactggactgccctcctgcagtcacctatacctctagtcacatg

SEQ ID NO: 345477 - DNA, 75 bp, Artificial Sequence
  Synthetic
atcaaggactggactgccctcctgcagtcacctatacctctagtcacatgaggcctcccattccttctttcctct

SEQ ID NO: 345478 - DNA, 75 bp, Artificial Sequence
  Synthetic
gattgactttgatttggacactcttccagcaggatcagtgacaggatcctccattggtccaaaatttaaactcaa

SEQ ID NO: 345479 - DNA, 75 bp, Artificial Sequence
  Synthetic
ccagcaggatcagtgacaggatcctccattggtccaaaatttaaactcaagtcaaaggtggcctcgtcattcatc

SEQ ID NO: 345480 - DNA, 75 bp, Artificial Sequence
  Synthetic
gtgactccactgacgttccccttaaggatcattttcctctggaaaatgatacttttgaccattggactccagatt

SEQ ID NO: 345481 - DNA, 75 bp, Artificial Sequence
  Synthetic
ggatcattttcctctggaaaatgatacttttgaccattggactccagatttcattgctagaaggctggatggcag

SEQ ID NO: 345482 - DNA, 75 bp, Artificial Sequence
  Synthetic
aacagatcagatgcagaaccgtcactgatcagtgccttcaatacaaaggtggggaagtatgagttggcactccac

SEQ ID NO: 345483 - DNA, 75 bp, Artificial Sequence
  Synthetic
tgatcagtgccttcaatacaaaggtggggaagtatgagttggcactccacacacgatctgatggagtcaatattc

SEQ ID NO: 345484 - DNA, 75 bp, Artificial Sequence
  Synthetic
ctccaccgtggtcagtaacctgaacttgactcagcaagaagttgatgaactgtgtttcagatttcttgttgccag

SEQ ID NO: 345485 - DNA, 75 bp, Artificial Sequence
  Synthetic
ttgactcagcaagaagttgatgaactgtgtttcagatttcttgttgccagagctgttcatgctgagatgaccact

SEQ ID NO: 345486 - DNA, 75 bp, Artificial Sequence
  Synthetic
atgttgatgaggacaagaagtgcagagaagtgaaggcagcattccattcagtccgttttgattggcaaaccactg

SEQ ID NO: 345487 - DNA, 75 bp, Artificial Sequence
  Synthetic
agaagtgaaggcagcattccattcagtccgttttgattggcaaaccactgaagagaagtttgctccattctcaaa

SEQ ID NO: 345488 - DNA, 75 bp, Artificial Sequence
  Synthetic
aaggaacctgatgccatgtatcttggggaaataataagtcactcttttcaaactgctcaagatgaactcaggact

SEQ ID NO: 345489 - DNA, 75 bp, Artificial Sequence
  Synthetic
gggaaataataagtcactcttttcaaactgctcaagatgaactcaggactgaccattacttagaacaagtgctta

SEQ ID NO: 345490 - DNA, 75 bp, Artificial Sequence
  Synthetic
cagagaggaatgttctcagaaaatccagagtttcatggaagagttcaactctcaggctgagagatctccttggaa

SEQ ID NO: 345491 - DNA, 75 bp, Artificial Sequence
  Synthetic
cagagtttcatggaagagttcaactctcaggctgagagatctccttggaaccacaagtcaacaattccttttcca

SEQ ID NO: 345492 - DNA, 75 bp, Artificial Sequence
  Synthetic
ataccacttctttgatgcgcatggaagagctcccgacaataaccggtggctctgacgcaactatccgtgcctgga

SEQ ID NO: 345493 - DNA, 75 bp, Artificial Sequence
  Synthetic
agagctcccgacaataaccggtggctctgacgcaactatccgtgcctggagatcagcatatgctcaagtttgctc

SEQ ID NO: 345494 - DNA, 75 bp, Artificial Sequence
  Synthetic
gatgtggaaaaagagagacgagctgcaatttgtgatctgagtgtcaaagaactagaagaagctaaaagcatgagg

SEQ ID NO: 345495 - DNA, 75 bp, Artificial Sequence
  Synthetic
caatttgtgatctgagtgtcaaagaactagaagaagctaaaagcatgagggtaaaataccacagatgcaaaattg

SEQ ID NO: 345496 - DNA, 75 bp, Artificial Sequence
  Synthetic
gttggccatgcagggtgtagaagcaaaagtgtacaaggatcacccagccattcaaaagaagagggcagagtccaa

SEQ ID NO: 345497 - DNA, 75 bp, Artificial Sequence
  Synthetic
aaagtgtacaaggatcacccagccattcaaaagaagagggcagagtccaagaaaacattcccactaacaacagac

SEQ ID NO: 345498 - DNA, 75 bp, Artificial Sequence
  Synthetic
agaaagatggcaatctattctctgaagacttgtctcaaatggctccagctcctcttttggaagctgtcaaagcag

SEQ ID NO: 345499 - DNA, 75 bp, Artificial Sequence
  Synthetic
agacttgtctcaaatggctccagctcctcttttggaagctgtcaaagcaggagcagatgcacaagagcttcatgg

SEQ ID NO: 345500 - DNA, 75 bp, Artificial Sequence
  Synthetic
tttgactcagtcttatggttcttgaatttgcccataggaatctggctattcatgtgcacctgcattggagtggag

SEQ ID NO: 345501 - DNA, 75 bp, Artificial Sequence
  Synthetic
atttgcccataggaatctggctattcatgtgcacctgcattggagtggagttaagcattagtctgaagcagcatt

SEQ ID NO: 345502 - DNA, 75 bp, Artificial Sequence
  Synthetic
aaagatcagattctttgatatctttctgatgataaaaccaacgaactctggaagtcatgtcttttactcacttgc

SEQ ID NO: 345503 - DNA, 75 bp, Artificial Sequence
  Synthetic
ctgatgataaaaccaacgaactctggaagtcatgtcttttactcacttgctttcccagaatcagctatcaaaggt

SEQ ID NO: 345504 - DNA, 75 bp, Artificial Sequence
  Synthetic
aagggttgaactttgaagatggctggttctggacagaattcaattctttcaaaatgtccaaactgacaaatgtag

SEQ ID NO: 345505 - DNA, 75 bp, Artificial Sequence
  Synthetic
gttctggacagaattcaattctttcaaaatgtccaaactgacaaatgtagtcaaatgcttctccacaggaatgaa

SEQ ID NO: 345506 - DNA, 75 bp, Artificial Sequence
  Synthetic
tttgaagttcccttttggagtggtagtgagaaagactatgcagtggcatctgctaaagcccatcggatgttcaag

SEQ ID NO: 345507 - DNA, 75 bp, Artificial Sequence
  Synthetic
gtgagaaagactatgcagtggcatctgctaaagcccatcggatgttcaaggtttgtgtcatgatgctgttggagg

SEQ ID NO: 345508 - DNA, 75 bp, Artificial Sequence
  Synthetic
aaccatgtccaggtatgtgttaatggagggttttgtcagccctccatgcctgcccaagccacacaagatggttga

SEQ ID NO: 345509 - DNA, 75 bp, Artificial Sequence
  Synthetic
gagggttttgtcagccctccatgcctgcccaagccacacaagatggttgagaagttgccatcgtttgccagaaca

SEQ ID NO: 345510 - DNA, 75 bp, Artificial Sequence
  Synthetic
aactcctccagtccatgattaagatatccaactctcccttcagaatcacagcaggtcataaaactgcaaattgga

SEQ ID NO: 345511 - DNA, 75 bp, Artificial Sequence
  Synthetic
atccaactctcccttcagaatcacagcaggtcataaaactgcaaattggaccggaatgtttaactgggtaacagg

SEQ ID NO: 345512 - DNA, 75 bp, Artificial Sequence
  Synthetic
atgatatctctattttacctagggtatttgaaaaacaaagaagagtcccctgagaggaatgctagtgtaggcatg

SEQ ID NO: 345513 - DNA, 75 bp, Artificial Sequence
  Synthetic
atttgaaaaacaaagaagagtcccctgagaggaatgctagtgtaggcatgtacaagaagatcttagaattcgagg

SEQ ID NO: 345514 - DNA, 75 bp, Artificial Sequence
  Synthetic
tcttgggagaggggatccacctcctagtgatttgaaattccatgaatattcagtgagttttctcaaacatctatg

SEQ ID NO: 345515 - DNA, 75 bp, Artificial Sequence
  Synthetic
agtgatttgaaattccatgaatattcagtgagttttctcaaacatctatgcaaccatgctgaacaagatttaaga

SEQ ID NO: 345516 - DNA, 75 bp, Artificial Sequence
  Synthetic
ccatgattacaagagacatcatagactctatagccagcctagatctagagaggttgtcaaccttgaaagcgtcaa

SEQ ID NO: 345517 - DNA, 75 bp, Artificial Sequence
  Synthetic
ctctatagccagcctagatctagagaggttgtcaaccttgaaagcgtcaagcatgtttaatgaggaatggtacca

SEQ ID NO: 345518 - DNA, 75 bp, Artificial Sequence
  Synthetic
cataggtgcaaggtccttgagagggtttgtgaatataccaagaaaagcaactctcatgtgcatcacattatggag

SEQ ID NO: 345519 - DNA, 75 bp, Artificial Sequence
  Synthetic
tttgtgaatataccaagaaaagcaactctcatgtgcatcacattatggagtcatgtctgaagaaagttgaggcac

SEQ ID NO: 345520 - DNA, 75 bp, Artificial Sequence
  Synthetic
caagaagcctcagcatggagggttgagagaaatctatgttctaggctttgaagagagggttgtccagttggtctt

SEQ ID NO: 345521 - DNA, 75 bp, Artificial Sequence
  Synthetic
agagaaatctatgttctaggctttgaagagagggttgtccagttggtcttagaaaccatagcaaggcaaatttgc

SEQ ID NO: 345522 - DNA, 75 bp, Artificial Sequence
  Synthetic
ctaatcccaagcagaaactgatgattccagagactcatggcctcagagcagttaaagtttgtgggatccatcatg

SEQ ID NO: 345523 - DNA, 75 bp, Artificial Sequence
  Synthetic
tccagagactcatggcctcagagcagttaaagtttgtgggatccatcatgagacagtaggaacttctgatgatgc

SEQ ID NO: 345524 - DNA, 75 bp, Artificial Sequence
  Synthetic
gtaacaaaatttgctttgatgctttgccattttacagatcccatgttccatccattcattatccgaggctgctca

SEQ ID NO: 345525 - DNA, 75 bp, Artificial Sequence
  Synthetic
gccattttacagatcccatgttccatccattcattatccgaggctgctcaatgttcatgaagaaaaggatcatga

SEQ ID NO: 345526 - DNA, 75 bp, Artificial Sequence
  Synthetic
agactctcatgtgaatctagagtcaactgatgagtaccttaagaaaattcacagaggctaccatgggagcttgga

SEQ ID NO: 345527 - DNA, 75 bp, Artificial Sequence
  Synthetic
actgatgagtaccttaagaaaattcacagaggctaccatgggagcttggatgatcagcccagatggatggagaga

SEQ ID NO: 345528 - DNA, 75 bp, Artificial Sequence
  Synthetic
caggaatgatgcaggggatcctgcattacacttccagtttgctgcacactctcttacaggagtggttgagaagtt

SEQ ID NO: 345529 - DNA, 75 bp, Artificial Sequence
  Synthetic
ttacacttccagtttgctgcacactctcttacaggagtggttgagaagtttcacattgaaatttctagcgcagaa

SEQ ID NO: 345530 - DNA, 75 bp, Artificial Sequence
  Synthetic
gttcttgtggatgttttacagagttctgatgattctggcatgatgatatccttcccttccatggagaaacagaca

SEQ ID NO: 345531 - DNA, 75 bp, Artificial Sequence
  Synthetic
ctgatgattctggcatgatgatatccttcccttccatggagaaacagacaacaggaagataccggtacttgtcag

SEQ ID NO: 345532 - DNA, 75 bp, Artificial Sequence
  Synthetic
gattggcagatttcttgcaatatattcatcggtaaaatctacaaacaatactctgcatctgttagagtttaattc

SEQ ID NO: 345533 - DNA, 75 bp, Artificial Sequence
  Synthetic
tcatcggtaaaatctacaaacaatactctgcatctgttagagtttaattctgagttcttcttccacatcaaccac

SEQ ID NO: 345534 - DNA, 75 bp, Artificial Sequence
  Synthetic
ccgcttgtgacactatttctgaacaagagtctttggcctctagacaagaagaaatgtacaacaatctgacagctg

SEQ ID NO: 345535 - DNA, 75 bp, Artificial Sequence
  Synthetic
agagtctttggcctctagacaagaagaaatgtacaacaatctgacagctgtcttggaaggtggtggaagtttttc

SEQ ID NO: 345536 - DNA, 75 bp, Artificial Sequence
  Synthetic
cagctcagtttgcactacaccctattgggaatgacagtctcacctctgttcttagagtacatcaagttagtttca

SEQ ID NO: 345537 - DNA, 75 bp, Artificial Sequence
  Synthetic
tgggaatgacagtctcacctctgttcttagagtacatcaagttagtttcagagataaaggatccagctctgggct

SEQ ID NO: 345538 - DNA, 75 bp, Artificial Sequence
  Synthetic
atcaggtctgtctggcttcaaattcaatgtatgggttgctgtgagagggagccttctgggagccaggtacaagta

SEQ ID NO: 345539 - DNA, 75 bp, Artificial Sequence
  Synthetic
aatgtatgggttgctgtgagagggagccttctgggagccaggtacaagtacctgctggaggccatagagcattct

SEQ ID NO: 345540 - DNA, 75 bp, Artificial Sequence
  Synthetic
tggacacaaccaactctggaacttttgttcaatctaccatcattcgatttggtgacagaaagaagtggcagaggt

SEQ ID NO: 345541 - DNA, 75 bp, Artificial Sequence
  Synthetic
tgttcaatctaccatcattcgatttggtgacagaaagaagtggcagaggttggttgacaaacttggtctgccaga

SEQ ID NO: 345542 - DNA, 75 bp, Artificial Sequence
  Synthetic
aacccagaagtgatttacaggaggcctcgggatggggatgaggttgctctaaggatagcagagaagatccactct

SEQ ID NO: 345543 - DNA, 75 bp, Artificial Sequence
  Synthetic
ctcgggatggggatgaggttgctctaaggatagcagagaagatccactctccaggagtgtcaaactctttgtcca

SEQ ID NO: 345544 - DNA, 75 bp, Artificial Sequence
  Synthetic
ctcctcatctgtgtatatcttgagcagaaacatcttatctgatgggctcgcatggctatatgaagaagaagaggt

SEQ ID NO: 345545 - DNA, 75 bp, Artificial Sequence
  Synthetic
agaaacatcttatctgatgggctcgcatggctatatgaagaagaagaggtcaggaagaaacccctgctattcaaa

SEQ ID NO: 345546 - DNA, 75 bp, Artificial Sequence
  Synthetic
aacattccatgctcactcctgctcaactgtccactcttttcccattaatggctgagtttgaaaagctgcaaacac

SEQ ID NO: 345547 - DNA, 75 bp, Artificial Sequence
  Synthetic
actgtccactcttttcccattaatggctgagtttgaaaagctgcaaacacacttccatggatacttgagaatacg

SEQ ID NO: 345548 - DNA, 75 bp, Artificial Sequence
  Synthetic
gtgatcactcaaacgagaatcaatatcctggaaacggagaggttcttaagagcaaagccagaggatttggtcgca

SEQ ID NO: 345549 - DNA, 75 bp, Artificial Sequence
  Synthetic
tcctggaaacggagaggttcttaagagcaaagccagaggatttggtcgcagataagtggtttggatttacccgaa

SEQ ID NO: 345550 - DNA, 75 bp, Artificial Sequence
  Synthetic
agaggagtggcagcacctaaccactgtgtttccttggctccaggaggatccacaacagtcactgagggactcacc

SEQ ID NO: 345551 - DNA, 75 bp, Artificial Sequence
  Synthetic
gtgtttccttggctccaggaggatccacaacagtcactgagggactcaccttttcagcatcaggttcaactcagg

SEQ ID NO: 345552 - DNA, 75 bp, Artificial Sequence
  Synthetic
aggggagagacatcagaataattggggcaccaatcaagaagtctagcggcgtcagcaatgtatcaactgccatcc

SEQ ID NO: 345553 - DNA, 75 bp, Artificial Sequence
  Synthetic
ggcaccaatcaagaagtctagcggcgtcagcaatgtatcaactgccatccgtgataacttcttcccaagattcgt

SEQ ID NO: 345554 - DNA, 75 bp, Artificial Sequence
  Synthetic
gcaattgagaggactgaggctgcaggaattctaaagcacgccttgtttctaaccctgactgggccttacacagat

SEQ ID NO: 345555 - DNA, 75 bp, Artificial Sequence
  Synthetic
gaattctaaagcacgccttgtttctaaccctgactgggccttacacagatgacacaaaattagacatgtgtgaag

SEQ ID NO: 345556 - DNA, 75 bp, Artificial Sequence
  Synthetic
cgtcctgaaaccaaaccacggaaagactaggagcaatgtccttgctctctttcaggacttcttctctccaatggg

SEQ ID NO: 345557 - DNA, 75 bp, Artificial Sequence
  Synthetic
actaggagcaatgtccttgctctctttcaggacttcttctctccaatgggatccagcatcatcttcaatagaatt

SEQ ID NO: 345558 - DNA, 75 bp, Artificial Sequence
  Synthetic
gaggcttcacatctccccagacgcctaaagagattgatggaaaaattgtctacactggggatggtgtgtggagag

SEQ ID NO: 345559 - DNA, 75 bp, Artificial Sequence
  Synthetic
taaagagattgatggaaaaattgtctacactggggatggtgtgtggagaggagtagtggatgggttccaaatcca

SEQ ID NO: 345560 - DNA, 75 bp, Artificial Sequence
  Synthetic
caaaaagccaatcagctgaaatccataacagtgaattcagataaaagcatatctagcattgctggattttgtcac

SEQ ID NO: 345561 - DNA, 75 bp, Artificial Sequence
  Synthetic
taacagtgaattcagataaaagcatatctagcattgctggattttgtcactcatggtgcaaagagatgggtgtct

SEQ ID NO: 345562 - DNA, 75 bp, Artificial Sequence
  Synthetic
tcacagattctccagagcttccttctacatgttcaacttcaaaatcacagggtccagacaaacttttggggctcc

SEQ ID NO: 345563 - DNA, 75 bp, Artificial Sequence
  Synthetic
tacatgttcaacttcaaaatcacagggtccagacaaacttttggggctcccatcagcattgtgtcagatagaata

SEQ ID NO: 345564 - DNA, 75 bp, Artificial Sequence
  Synthetic
acaacctagtcttcagaatccgagggacaaccatcaatttgtcgtacagagaaggaggtgggaggcagagagtga

SEQ ID NO: 345565 - DNA, 75 bp, Artificial Sequence
  Synthetic
gacaaccatcaatttgtcgtacagagaaggaggtgggaggcagagagtgagaatgttcaacatcctcagttacac

SEQ ID NO: 345566 - DNA, 75 bp, Artificial Sequence
  Synthetic
gaaaatgcattcaagctcctaaccttatccaccaggcataagttccatggaaaggagcccagcacatcctggatc

SEQ ID NO: 345567 - DNA, 75 bp, Artificial Sequence
  Synthetic
tatccaccaggcataagttccatggaaaggagcccagcacatcctggatctgtatgagagctctgccgattccta

SEQ ID NO: 345568 - DNA, 75 bp, Artificial Sequence
  Synthetic
caaccaagggatcagaatcagtggagccatagacaatgacagacttgcggattgcttcaaggacgtcatggaatc

SEQ ID NO: 345569 - DNA, 75 bp, Artificial Sequence
  Synthetic
gccatagacaatgacagacttgcggattgcttcaaggacgtcatggaatcatccctgagaaggagaggagttttt

SEQ ID NO: 345570 - DNA, 75 bp, Artificial Sequence
  Synthetic
agaaaatgctagacggtcttagccaggacatgctggacttcttcgcatctgcaggaatggatgatggcatctctt

SEQ ID NO: 345571 - DNA, 75 bp, Artificial Sequence
  Synthetic
ggacatgctggacttcttcgcatctgcaggaatggatgatggcatctcttttgaggatgaaccctggttgacagg

SEQ ID NO: 345572 - DNA, 75 bp, Artificial Sequence
  Synthetic
gaggactacctagaggagtacaacctaggtcctttcggtgtattcagtgtggagcaagaaatgaacacaaaatac

SEQ ID NO: 345573 - DNA, 75 bp, Artificial Sequence
  Synthetic
taggtcctttcggtgtattcagtgtggagcaagaaatgaacacaaaatactatcatcacctgctgctggatgcca

SEQ ID NO: 345574 - DNA, 75 bp, Artificial Sequence
  Synthetic
gtccctagatgggctaaggaaggttttttctgacaaggttgctccagaaacatataagaaagaggtatctagagc

SEQ ID NO: 345575 - DNA, 75 bp, Artificial Sequence
  Synthetic
ttttctgacaaggttgctccagaaacatataagaaagaggtatctagagctctggacattctccagagagataaa

SEQ ID NO: 345576 - DNA, 75 bp, Artificial Sequence
  Synthetic
acaaagctggagacaatctgggcttggatgttgaggacgacatgtttggttgagtcaaaaaccttcttatatttt

SEQ ID NO: 345577 - DNA, 75 bp, Artificial Sequence
  Synthetic
atgcagctgtctcgtttctcttaccacacagtaagataactaaaggaactagttattgattgatttactttcatc

SEQ ID NO: 345578 - DNA, 75 bp, Artificial Sequence
  Synthetic
atttccagagtcagccattcttgggaagttgcacagatcccagtgttttaagggcttgcagtttgaggatgggtg

SEQ ID NO: 345579 - DNA, 75 bp, Artificial Sequence
  Synthetic
ttccaaaaccccagaagatgatcgagaagttgcctaatctggctaggactaagttccaggtgtggctgatatcca

SEQ ID NO: 345580 - DNA, 75 bp, Artificial Sequence
  Synthetic
gttatgaatcagcctgagctggacctccattccaggttgactccggcacagctgtcaacgttgtttcccatgatg

SEQ ID NO: 345581 - DNA, 75 bp, Artificial Sequence
  Synthetic
atgctggcattgcttttactatctctctctctttgaatgtatcttcctttacttccatcttggcggactttgtgt

SEQ ID NO: 345582 - DNA, 75 bp, Artificial Sequence
  Synthetic
cgccaagatgcttttagcgatatgctcgagaacaaatcctcagcggggactgaactgtccacccgctgtgaccta

SEQ ID NO: 345583 - DNA, 75 bp, Artificial Sequence
  Synthetic
tgaggttgccttgcacaacagatcttcatcggttagcatactcttcggagtggtggttgtgagtgaaacaactgt

SEQ ID NO: 345584 - DNA, 75 bp, Artificial Sequence
  Synthetic
aggacaagagaagcagagaggtcaaagcagccttccactctgttcagccagactgggacaccactgaagcaaagt

SEQ ID NO: 345585 - DNA, 75 bp, Artificial Sequence
  Synthetic
tttctcctttctcccggagaatgttctcaaatttctcacagatggagccagacaaagaatatctagcacacattg

SEQ ID NO: 345586 - DNA, 75 bp, Artificial Sequence
  Synthetic
aagtctcaagatggtgagagagtttgaaacagaattcaacaaaggtgctgaaaggtctgcctggagccacaaatc

SEQ ID NO: 345587 - DNA, 75 bp, Artificial Sequence
  Synthetic
cctaaggtctctggagataccacttccctttcaaggctaacggaactgcctgttatcactggagggtctgatgct

SEQ ID NO: 345588 - DNA, 75 bp, Artificial Sequence
  Synthetic
cgatctcagtgcttcaaaggcctccagtttgaggatgggtggttttggactgaattcaactcttttaagatgtcc

SEQ ID NO: 345589 - DNA, 75 bp, Artificial Sequence
  Synthetic
caacaaaatgttcaaattttgcctgctcatgcttctggaggacaaggctcgcacagaagagattgcaacactgtc

SEQ ID NO: 345590 - DNA, 75 bp, Artificial Sequence
  Synthetic
gtttggctcatctcaagaatgctacaaaccatcattagaatttcggattacccctttaaaataacagcaggacac

SEQ ID NO: 345591 - DNA, 75 bp, Artificial Sequence
  Synthetic
tattgaagcacctttgcattcatgcagaacacaatctaagacagaattggggagagtccttcaaagccatgatct

SEQ ID NO: 345592 - DNA, 75 bp, Artificial Sequence
  Synthetic
agaacacaatctaagacagaattggggagagtccttcaaagccatgatctctcgagacatagttgacgccattgc

SEQ ID NO: 345593 - DNA, 75 bp, Artificial Sequence
  Synthetic
atgtaaagaagagcagctcacatgtccatcacataatggaggagtgtctgaagaaggtggaaagtcaaggatgca

SEQ ID NO: 345594 - DNA, 75 bp, Artificial Sequence
  Synthetic
tacgtcctgggatttgaggagagagtggtccagttggtgattgaaactattgccagacaaatctgcaagagattc

SEQ ID NO: 345595 - DNA, 75 bp, Artificial Sequence
  Synthetic
tggtccagttggtgattgaaactattgccagacaaatctgcaagagattcaagtcagagacactcactaacccca

SEQ ID NO: 345596 - DNA, 75 bp, Artificial Sequence
  Synthetic
tttgctctgatgttgtgccatttcacagaccctctgttccatgggttcatcatcagaggatgctctatgttcatg

SEQ ID NO: 345597 - DNA, 75 bp, Artificial Sequence
  Synthetic
caccacccttgaaacctccaaccgataccttcaactcattcaccgaggatatcatggaagcttagaggatcaacc

SEQ ID NO: 345598 - DNA, 75 bp, Artificial Sequence
  Synthetic
aaccgacaaaaactcaacaggaaagtacagatacctatctgctttggtcttcaagttcaagaaggttataggaaa

SEQ ID NO: 345599 - DNA, 75 bp, Artificial Sequence
  Synthetic
gatcgaggtaccgatgtcttctggaggccattcaaaactctgacagtgctgctccaaagaaaactctggatacaa

SEQ ID NO: 345600 - DNA, 75 bp, Artificial Sequence
  Synthetic
attgtctacagacggcctagagatgggactgaagtgagtttaaggattgccgagaaaattcactctccaggagtg

SEQ ID NO: 345601 - DNA, 75 bp, Artificial Sequence
  Synthetic
gcattatcagggtcatatcatcctcagtttacatcctgagcagaaacattctgagtgatggattggcatggctgt

SEQ ID NO: 345602 - DNA, 75 bp, Artificial Sequence
  Synthetic
tcatgtccagctgagaaacttcttcagcagactggatttgaaaggtagggatatcaggatcattggagctccaat

SEQ ID NO: 345603 - DNA, 75 bp, Artificial Sequence
  Synthetic
atatcaggatcattggagctccaatcaaaaaatccagtggaattagtaatgtgtcaactgccatcagagataact

SEQ ID NO: 345604 - DNA, 75 bp, Artificial Sequence
  Synthetic
tgatggcagaatcgtttacactggcgatggtgtgtggcgtgggattgttgatggcttccaggtgcagctagtcat

SEQ ID NO: 345605 - DNA, 75 bp, Artificial Sequence
  Synthetic
gacacaagttccatggcagagaacccagcacttcatggatttgcatgagagcattgcctatcaacaccattgaca

SEQ ID NO: 345606 - DNA, 75 bp, Artificial Sequence
  Synthetic
gaggaaaggtgtgtttttgtctgaattctctagagcaacccagaaaatgcttgatagtttgagcagagacatgct

SEQ ID NO: 345607 - DNA, 75 bp, Artificial Sequence
  Synthetic
aacgatgatcttgatctcgaggaagaaccttggctaggtgggctggacactttctccctcgatgatgaagattat

SEQ ID NO: 345608 - DNA, 75 bp, Artificial Sequence
  Synthetic
tggtctcagaaaattattccaggaaagtgaagccccagtggagtacaagaaggaagtgtctcgcttgttttccat

SEQ ID NO: 345609 - DNA, 75 bp, Artificial Sequence
  Synthetic
ggatgacatgtttggataaaagatatataagtgggttccgcatcaaagtcaagctagttctatctatctctaatt

SEQ ID NO: 345610 - DNA, 75 bp, Artificial Sequence
  Synthetic
cggctaacatggtaaggacttatctcctaattttgctcctctgcgggccagtgatgcccttcttcaatcacttga

SEQ ID NO: 345611 - DNA, 75 bp, Artificial Sequence
  Synthetic
tgccagatcacgacactcatctgtgcagagtgggtccactgcacataaagcactgcagccatgacacaaaacgag

SEQ ID NO: 345612 - DNA, 75 bp, Artificial Sequence
  Synthetic
ctaccatctggaaggtgttgaagcctttctggtggttgctctctctgctgctcagaacttgcaccaggaggctga

SEQ ID NO: 345613 - DNA, 75 bp, Artificial Sequence
  Synthetic
agcaccagttctcttctccaagtgagcccaaaaggtcaggaaagttgcctgataattaaaactccaactgggtct

SEQ ID NO: 345614 - DNA, 75 bp, Artificial Sequence
  Synthetic
agtggggtcatgaggaagagctgatggcacagctggggtggagctactgcgttgaacagtgcgggggaccattgt

SEQ ID NO: 345615 - DNA, 75 bp, Artificial Sequence
  Synthetic
agatctccatggcgtgaagttccacaccgtttgcaacagaagaactgattactcgctgggaaagattggagagat

SEQ ID NO: 345616 - DNA, 75 bp, Artificial Sequence
  Synthetic
ctccacagtcggttctgtaacattctggccaacggaatcaagtgttgaagccgctatccctgacttagcatctgc

SEQ ID NO: 345617 - DNA, 75 bp, Artificial Sequence
  Synthetic
ggtgtccaaactctgagtcccaaattgtgataaaaggagagcttgtgtacctgtttaatgatgatgtgagacatc

SEQ ID NO: 345618 - DNA, 75 bp, Artificial Sequence
  Synthetic
attggagtcatcgtggtctacatgatcttcaatttatgcatgaaggccaaaaaatcctagaaaccccagcctgac

SEQ ID NO: 345619 - DNA, 75 bp, Artificial Sequence
  Synthetic
gctgctgggtttgacactattcaaggccactggttgcaatccctggcagcatcttgggttgatttgtttgttttt

SEQ ID NO: 345620 - DNA, 75 bp, Artificial Sequence
  Synthetic
gatcgaagtttctgaggcggcgtgggaagaagaagagatcagagagttcatcaacctcttctgatctcttcttct

SEQ ID NO: 345621 - DNA, 75 bp, Artificial Sequence
  Synthetic
gaagaagaagagatcagagagttcatcaacctcttctgatctcttcttcttcccacgaagacctccaactaagct

SEQ ID NO: 345622 - DNA, 75 bp, Artificial Sequence
  Synthetic
tcccacgaagacctccaactaagctatcgattcatcatggcgattccagaggactgggtgcgctttgcgatcgaa

SEQ ID NO: 345623 - DNA, 75 bp, Artificial Sequence
  Synthetic
cagactacccagtgcacatgatgcacaacgcctttgcaggcctggtagatgagactctgccagaagaatccatca

SEQ ID NO: 345624 - DNA, 75 bp, Artificial Sequence
  Synthetic
acctacagtctaccaacgactggccagtctttctcaaaagaagtgtccagcatgcgttctctgacactctcaaat

SEQ ID NO: 345625 - DNA, 75 bp, Artificial Sequence
  Synthetic
agtctttctcaaaagaagtgtccagcatgcgttctctgacactctcaaatgcctcccagtgctcatccagattga

SEQ ID NO: 345626 - DNA, 75 bp, Artificial Sequence
  Synthetic
ggaccaaccttctctgcaggttcaggatatggactagacacaaatccttcacaaggttctttcccgtcacctgtc

SEQ ID NO: 345627 - DNA, 75 bp, Artificial Sequence
  Synthetic
tcgagtcatacaacccttcgtcaacctcaagccagccagttgaaggcagatctactcccgggatggaactcttca

SEQ ID NO: 345628 - DNA, 75 bp, Artificial Sequence
  Synthetic
tcaggctgcttcatcatttgtccatgatttcacctttgcacactggtgtgatgcatcagacatgccactgaagga

SEQ ID NO: 345629 - DNA, 75 bp, Artificial Sequence
  Synthetic
cgatcagatcaggaacagtctctgatcagtgccttcaataccaaggttggcaagtatgaggttgccctacacaac

SEQ ID NO: 345630 - DNA, 75 bp, Artificial Sequence
  Synthetic
gcctccagtttgaggatgggtggttttggactgaattcaactctttcaagatgtccaagctgacaaatgtggtga

SEQ ID NO: 345631 - DNA, 75 bp, Artificial Sequence
  Synthetic
actgtcacgttacataatgatggaaggttttgtcagtccaccttgcattccgaagccacaaaaaatgattgaaaa

SEQ ID NO: 345632 - DNA, 75 bp, Artificial Sequence
  Synthetic
attgccagaactggcacggacaaagttccaggtttggctcatctcaagaatgctacaaaccatcatcagaatttc

SEQ ID NO: 345633 - DNA, 75 bp, Artificial Sequence
  Synthetic
tcagtctattgaagcacctttgcattcatgcagagcacaatctgagacagaattggggagagtccttcaaagcta

SEQ ID NO: 345634 - DNA, 75 bp, Artificial Sequence
  Synthetic
tcatgcagagcacaatctgagacagaattggggagagtccttcaaagctatgatctctcgagacatagttgacgc

SEQ ID NO: 345635 - DNA, 75 bp, Artificial Sequence
  Synthetic
ctagcaacactaaaggcgtccagcaactttaacgaggaatggtatcaaaagcgcactgatggtaaggtttatcac

SEQ ID NO: 345636 - DNA, 75 bp, Artificial Sequence
  Synthetic
gttcatcatcagaggatgctctatgttcatgaaaaagcgcattatgattgatcaaagcttgatcaacatcattga

SEQ ID NO: 345637 - DNA, 75 bp, Artificial Sequence
  Synthetic
ggagcctttgtccagactgagactggcatgatgcaaggaatcttgcattacacctccagcctattgcacactgtg

SEQ ID NO: 345638 - DNA, 75 bp, Artificial Sequence
  Synthetic
attcttcttccacataaaccacaacagacctctgctcagatggattacagcatgcgacaccatttctgagcagga

SEQ ID NO: 345639 - DNA, 75 bp, Artificial Sequence
  Synthetic
tctggaggccattcaaaactctgacagtgctgctccaaagaaaactctggatacaacaacctcaggaacatttgt

SEQ ID NO: 345640 - DNA, 75 bp, Artificial Sequence
  Synthetic
gaatgactcccagaacattcaaggaggagtgggatcatctgacagcagttttcccttggctgaagaacaaccctg

SEQ ID NO: 345641 - DNA, 75 bp, Artificial Sequence
  Synthetic
ataacttctttcctaggtttgtgctgactcatattccagatgaggcagcattggagagaattgaagcagctggca

SEQ ID NO: 345642 - DNA, 75 bp, Artificial Sequence
  Synthetic
gcttcacctctccacaaaccccaaaggagattgatggcagaatcgtttacactggcgatggtgtgtggcgtggaa

SEQ ID NO: 345643 - DNA, 75 bp, Artificial Sequence
  Synthetic
aagattcacaaaggcatccttctacatgttcaacttcaaaatttcaggctctcgacagacactgggtgctccgat

SEQ ID NO: 345644 - DNA, 75 bp, Artificial Sequence
  Synthetic
ctcgacagacactgggtgctccgattttcatcgtaggagagagaatattcagaccaatctgctgggatccctcaa

SEQ ID NO: 345645 - DNA, 75 bp, Artificial Sequence
  Synthetic
caccttaaacctaacctacagagaatccattcccaaagcagggcaaagaatgttcaacattctcagttacactgt

SEQ ID NO: 345646 - DNA, 75 bp, Artificial Sequence
  Synthetic
acaagaaggaagtatctcgcttgttttccatcttgcagcgagatgctagccgaatagtttggaagagcagagacc

SEQ ID NO: 345647 - DNA, 75 bp, Artificial Sequence
  Synthetic
ctaattctttttcttcttttacttcctctagatagtcaagttcgaccgtcttctcagcgctccgccagggccgtg

SEQ ID NO: 345648 - DNA, 75 bp, Artificial Sequence
  Synthetic
ttggtagagggaagcaacaatgcaggaaaggaatcaattcagatgcagtcagtggcaaggccaaatgtgaggcag

SEQ ID NO: 345649 - DNA, 75 bp, Artificial Sequence
  Synthetic
gaaaggaatcaattcagatgcagtcagtggcaaggccaaatgtgaggcagaagatgttcagcttgacacgtctca

SEQ ID NO: 345650 - DNA, 75 bp, Artificial Sequence
  Synthetic
ccttctgaatccggcctctgggtgttctgattctatttcaatcacagcttcaagccagaggtgttcaactagctc

SEQ ID NO: 345651 - DNA, 75 bp, Artificial Sequence
  Synthetic
ccaggaggtgccatttgatgggagcttgtaagcaggatgcttgctctgagttcaaaataacagactattctcctg

SEQ ID NO: 345652 - DNA, 75 bp, Artificial Sequence
  Synthetic
tctagcagtgctggaatgcccaagcctaggatacacaacctactatgaggctaagaacactctggagaagtctgt

SEQ ID NO: 345653 - DNA, 75 bp, Artificial Sequence
  Synthetic
acacaaagtcgccaagatgttattagcgatttgctcaagaaccaatcccatccgtggacttaactgtccggctgc

SEQ ID NO: 345654 - DNA, 75 bp, Artificial Sequence
  Synthetic
gcgatttgctcaagaaccaatcccatccgtggacttaactgtccggctgcggtgacttatacttctagccatatg

SEQ ID NO: 345655 - DNA, 75 bp, Artificial Sequence
  Synthetic
tccgtggacttaactgtccggctgcggtgacttatacttctagccatatgagaccacctatcccagcattcctgc

SEQ ID NO: 345656 - DNA, 75 bp, Artificial Sequence
  Synthetic
gatcgactttgaccttgataccttgccagctggatcagtgactggatcttccatcgtcccaaaatttaagattaa

SEQ ID NO: 345657 - DNA, 75 bp, Artificial Sequence
  Synthetic
ccagctggatcagtgactggatcttccatcgtcccaaaatttaagattaaaacccagctggcatcatccttcata

SEQ ID NO: 345658 - DNA, 75 bp, Artificial Sequence
  Synthetic
gtgatgcttctgacatgccactgagaaatcacttcccattggagaatgacactttcgaccactggactccagatt

SEQ ID NO: 345659 - DNA, 75 bp, Artificial Sequence
  Synthetic
aaatcacttcccattggagaatgacactttcgaccactggactccagatttcattgcaaagagactggacgggag

SEQ ID NO: 345660 - DNA, 75 bp, Artificial Sequence
  Synthetic
aacaggtcagacttggagcagtctttgattagtgccttcaacacaaaagtgggaaagtatgaggttgcactccac

SEQ ID NO: 345661 - DNA, 75 bp, Artificial Sequence
  Synthetic
tgattagtgccttcaacacaaaagtgggaaagtatgaggttgcactccacaatagaagcagaggggtggatatac

SEQ ID NO: 345662 - DNA, 75 bp, Artificial Sequence
  Synthetic
cactacagtagtaacaaacctaagactaaaccagcaagaagtggatgaactatgctttaggttcttggttgctag

SEQ ID NO: 345663 - DNA, 75 bp, Artificial Sequence
  Synthetic
ctaaaccagcaagaagtggatgaactatgctttaggttcttggttgctagagcagtgcatgctgagatgaccact

SEQ ID NO: 345664 - DNA, 75 bp, Artificial Sequence
  Synthetic
atgttgatgaggataagaggagcagggaagttaaggctgcttttcactcagttaaactcgattggggtgagactg

SEQ ID NO: 345665 - DNA, 75 bp, Artificial Sequence
  Synthetic
ggaagttaaggctgcttttcactcagttaaactcgattggggtgagactgaggcaaagttttacccattcagtga

SEQ ID NO: 345666 - DNA, 75 bp, Artificial Sequence
  Synthetic
ggagaaccagatcatgagtacttagggagaataattggttactcctttcagaatgctcaagatgatttggaaaat

SEQ ID NO: 345667 - DNA, 75 bp, Artificial Sequence
  Synthetic
ggagaataattggttactcctttcagaatgctcaagatgatttggaaaatgaccacttcttgaaggaggttttga

SEQ ID NO: 345668 - DNA, 75 bp, Artificial Sequence
  Synthetic
tctcgaagattgcaggaagaaaataacaagtttccagaagaacttcaatgatcaagctgagagaccacaattttc

SEQ ID NO: 345669 - DNA, 75 bp, Artificial Sequence
  Synthetic
acaagtttccagaagaacttcaatgatcaagctgagagaccacaattttctcacaagtcaacaattccgtttcca

SEQ ID NO: 345670 - DNA, 75 bp, Artificial Sequence
  Synthetic
acacatcatcaatctccagacttcaagacctaccaacaatcaccggtgggtcagatgcaacaataagagcgtgga

SEQ ID NO: 345671 - DNA, 75 bp, Artificial Sequence
  Synthetic
agacctaccaacaatcaccggtgggtcagatgcaacaataagagcgtggaggtcagcatacagttcagttgtaac

SEQ ID NO: 345672 - DNA, 75 bp, Artificial Sequence
  Synthetic
gatgttgaaagagagagacgtgcagccttatgctcattgtcctttgaggaaatggaagaatcaaagactatgcgg

SEQ ID NO: 345673 - DNA, 75 bp, Artificial Sequence
  Synthetic
ccttatgctcattgtcctttgaggaaatggaagaatcaaagactatgcggatgaagtaccacagatgcaagatag

SEQ ID NO: 345674 - DNA, 75 bp, Artificial Sequence
  Synthetic
gcttgcattgcagggagtagaagcaaaagagcacagagatcatcctgccttacagaagaagaggcaagaatctaa

SEQ ID NO: 345675 - DNA, 75 bp, Artificial Sequence
  Synthetic
aaagagcacagagatcatcctgccttacagaagaagaggcaagaatctaagaaaacattcccattaaatgcagat

SEQ ID NO: 345676 - DNA, 75 bp, Artificial Sequence
  Synthetic
aaagtgatggcgacatgtttaatgaggatctatctcaagctccacctgcctcagcaatagaagctatcaaatctg

SEQ ID NO: 345677 - DNA, 75 bp, Artificial Sequence
  Synthetic
ggatctatctcaagctccacctgcctcagcaatagaagctatcaaatctggtgcagaagctcaagaaatgcatgg

SEQ ID NO: 345678 - DNA, 75 bp, Artificial Sequence
  Synthetic
ttccagtctatgctctggtttctcagcctcccaatagggctttggctattcctgattacctgcataggggtggaa

SEQ ID NO: 345679 - DNA, 75 bp, Artificial Sequence
  Synthetic
gcctcccaatagggctttggctattcctgattacctgcataggggtggaactcagcatcagcctgaaacaacact

SEQ ID NO: 345680 - DNA, 75 bp, Artificial Sequence
  Synthetic
gaagattagattctttgacatatttctactgattaagcccactaactctggcagtcatgtctttttctcaatggc

SEQ ID NO: 345681 - DNA, 75 bp, Artificial Sequence
  Synthetic
ctactgattaagcccactaactctggcagtcatgtctttttctcaatggcattccctgaaagcgccattctgggc

SEQ ID NO: 345682 - DNA, 75 bp, Artificial Sequence
  Synthetic
aaggattgtcatttgaggatggctggttctggacagagttctcatcattcaaaatgtccaagttgacaaatgttg

SEQ ID NO: 345683 - DNA, 75 bp, Artificial Sequence
  Synthetic
gttctggacagagttctcatcattcaaaatgtccaagttgacaaatgttgttaaaacaatgtccacaggatctaa

SEQ ID NO: 345684 - DNA, 75 bp, Artificial Sequence
  Synthetic
tttgaagtaccgttctgggatggtagtaagaaagattacattcaaggcataaaaaaatccaatcagatgttcaaa

SEQ ID NO: 345685 - DNA, 75 bp, Artificial Sequence
  Synthetic
gtaagaaagattacattcaaggcataaaaaaatccaatcagatgttcaaaatttgcttaactatgttgctagaag

SEQ ID NO: 345686 - DNA, 75 bp, Artificial Sequence
  Synthetic
aacatcatccaggtacattatgatggaaggctttgttagtccaccttgtattccaaaaccacaaaagatgattga

SEQ ID NO: 345687 - DNA, 75 bp, Artificial Sequence
  Synthetic
gaaggctttgttagtccaccttgtattccaaaaccacaaaagatgattgaaaaactcccagagtttgccagaaca

SEQ ID NO: 345688 - DNA, 75 bp, Artificial Sequence
  Synthetic
agttgttgaatgctatattcagggttagtggcaatccctttaaaataactgctggtcaaaaatcagcgacttggg

SEQ ID NO: 345689 - DNA, 75 bp, Artificial Sequence
  Synthetic
tagtggcaatccctttaaaataactgctggtcaaaaatcagcgacttggggtggcttgttcaactggattaccgg

SEQ ID NO: 345690 - DNA, 75 bp, Artificial Sequence
  Synthetic
ttaatctctttgttttacttaggatacttaaagaacaaagaagaatccccagagagaaatgccagcataggtatg

SEQ ID NO: 345691 - DNA, 75 bp, Artificial Sequence
  Synthetic
acttaaagaacaaagaagaatccccagagagaaatgccagcataggtatgtacaaaaagattctggagtatgaag

SEQ ID NO: 345692 - DNA, 75 bp, Artificial Sequence
  Synthetic
tcttggttatggagacccagatccagatgatttgagatttcacgaatactccaccagctttctgaagcacctgtg

SEQ ID NO: 345693 - DNA, 75 bp, Artificial Sequence
  Synthetic
gatgatttgagatttcacgaatactccaccagctttctgaagcacctgtgcatccatgcagagcaagagttgcga

SEQ ID NO: 345694 - DNA, 75 bp, Artificial Sequence
  Synthetic
gcatgattacaagagatataattgactctatctctagtcttgatcttgagaggatggccactctgaaagcctcca

SEQ ID NO: 345695 - DNA, 75 bp, Artificial Sequence
  Synthetic
ctctatctctagtcttgatcttgagaggatggccactctgaaagcctccagcagatttaatgaggaatggtacca

SEQ ID NO: 345696 - DNA, 75 bp, Artificial Sequence
  Synthetic
cacaggtgcaaggtgcttgagcgagtatgtgaatatgttaagaaaagcagctctcatgttcatcacattatggaa

SEQ ID NO: 345697 - DNA, 75 bp, Artificial Sequence
  Synthetic
tatgtgaatatgttaagaaaagcagctctcatgttcatcacattatggaagaatgtttaaagaaggtggaatcac

SEQ ID NO: 345698 - DNA, 75 bp, Artificial Sequence
  Synthetic
caaaaagccccagcatggaggattaagagagatttatgtattgggttttgaagaaagagtggttcaactggtaat

SEQ ID NO: 345699 - DNA, 75 bp, Artificial Sequence
  Synthetic
agagagatttatgtattgggttttgaagaaagagtggttcaactggtaattgagacaattgctagacaagtctgc

SEQ ID NO: 345700 - DNA, 75 bp, Artificial Sequence
  Synthetic
ccaatccaaagcaaaaactcatgatcccagagacccatggcctccgagcagtcaaaacctgtggaatccatcatg

SEQ ID NO: 345701 - DNA, 75 bp, Artificial Sequence
  Synthetic
cccagagacccatggcctccgagcagtcaaaacctgtggaatccatcatgagaccgtgggaacatcagatgatgc

SEQ ID NO: 345702 - DNA, 75 bp, Artificial Sequence
  Synthetic
gtaactaagtttgctcttatgctttgtcacttcactgatcccatgtttcacccttttataattagaggttgctcc

SEQ ID NO: 345703 - DNA, 75 bp, Artificial Sequence
  Synthetic
gtcacttcactgatcccatgtttcacccttttataattagaggttgctccatgttcatgaagaagcgaataatga

SEQ ID NO: 345704 - DNA, 75 bp, Artificial Sequence
  Synthetic
tgattcccacactaacttagaaaccacagatgaatatcttaaaaaaatccacagaggctatcatggaagtttgac

SEQ ID NO: 345705 - DNA, 75 bp, Artificial Sequence
  Synthetic
acagatgaatatcttaaaaaaatccacagaggctatcatggaagtttgactgagcaacctagatggatggtcaga

SEQ ID NO: 345706 - DNA, 75 bp, Artificial Sequence
  Synthetic
caggtatgatgcaagggatcttgcactacacttctagcctcctgcacacacttctacaagagtggttgaaaacat

SEQ ID NO: 345707 - DNA, 75 bp, Artificial Sequence
  Synthetic
ctacacttctagcctcctgcacacacttctacaagagtggttgaaaacattttctttaaagtttttaagatcaaa

SEQ ID NO: 345708 - DNA, 75 bp, Artificial Sequence
  Synthetic
gtcttagttgatgtgcttcagagttcagatgattctggaatgatgatttcttttccgtccttggaaaagaagacc

SEQ ID NO: 345709 - DNA, 75 bp, Artificial Sequence
  Synthetic
cagatgattctggaatgatgatttcttttccgtccttggaaaagaagaccactggcaggtacagatacttgtctg

SEQ ID NO: 345710 - DNA, 75 bp, Artificial Sequence
  Synthetic
tattggaaagtttttagggatctactcttcagtgaaatctactaacaatactttgcatttgctagaatttaactc

SEQ ID NO: 345711 - DNA, 75 bp, Artificial Sequence
  Synthetic
tcttcagtgaaatctactaacaatactttgcatttgctagaatttaactctgagttcttcttccacataaatcat

SEQ ID NO: 345712 - DNA, 75 bp, Artificial Sequence
  Synthetic
ctgcctgtgacactatttctgagcaagagtccctagcgtccaggcaagaggagatgtacaacaatctgacagcag

SEQ ID NO: 345713 - DNA, 75 bp, Artificial Sequence
  Synthetic
agagtccctagcgtccaggcaagaggagatgtacaacaatctgacagcagtgcttgaagggggagggagcttctc

SEQ ID NO: 345714 - DNA, 75 bp, Artificial Sequence
  Synthetic
cagttaatactgcattacactctccttgggatgacagtgtcacctttgtttctggagtatatcaagatggtgtct

SEQ ID NO: 345715 - DNA, 75 bp, Artificial Sequence
  Synthetic
ttgggatgacagtgtcacctttgtttctggagtatatcaagatggtgtctgaaataaaggatccagcattaggtt

SEQ ID NO: 345716 - DNA, 75 bp, Artificial Sequence
  Synthetic
atctggtttatctggcttcaagtataatgtttggattgcagttcagaatagtctcctgggatcaagatatcgagc

SEQ ID NO: 345717 - DNA, 75 bp, Artificial Sequence
  Synthetic
aatgtttggattgcagttcagaatagtctcctgggatcaagatatcgagccttattggaggcaattgaggatgac

SEQ ID NO: 345718 - DNA, 75 bp, Artificial Sequence
  Synthetic
tggacacaacaacatcaggaaccttcgtccaatcaaccattattagatttggggataggaagaagtggcaaaggt

SEQ ID NO: 345719 - DNA, 75 bp, Artificial Sequence
  Synthetic
cgtccaatcaaccattattagatttggggataggaagaagtggcaaaggttagtagataggttaggattgccaga

SEQ ID NO: 345720 - DNA, 75 bp, Artificial Sequence
  Synthetic
aatccagagatcatttatagaaggccacgggatggtgatgaagttgctttaagaattgctgaaaaagtacattct

SEQ ID NO: 345721 - DNA, 75 bp, Artificial Sequence
  Synthetic
cacgggatggtgatgaagttgctttaagaattgctgaaaaagtacattctcctggcgtatcaaactccttatcaa

SEQ ID NO: 345722 - DNA, 75 bp, Artificial Sequence
  Synthetic
ctcttcatcagtttacatccttagcaggaatattttgagtgatggccttgcgtggctgtatgaagaagacgatgg

SEQ ID NO: 345723 - DNA, 75 bp, Artificial Sequence
  Synthetic
aggaatattttgagtgatggccttgcgtggctgtatgaagaagacgatggaaaaaagaggccactattttataag

SEQ ID NO: 345724 - DNA, 75 bp, Artificial Sequence
  Synthetic
ctcacctaaaattaacgccagcccaattgtccaccttgtttccgttaatggctgaatttgaaaaactacagactc

SEQ ID NO: 345725 - DNA, 75 bp, Artificial Sequence
  Synthetic
attgtccaccttgtttccgttaatggctgaatttgaaaaactacagactcattttcaagggtacttggaaataag

SEQ ID NO: 345726 - DNA, 75 bp, Artificial Sequence
  Synthetic
atcataacccagacaagaattaatatattggaaactgaaagattcttaagggcaaaacctgaagacttggttgca

SEQ ID NO: 345727 - DNA, 75 bp, Artificial Sequence
  Synthetic
tattggaaactgaaagattcttaagggcaaaacctgaagacttggttgcagatagatggtttgggtttaccagaa

SEQ ID NO: 345728 - DNA, 75 bp, Artificial Sequence
  Synthetic
agaggagtggcaacacctagttgctgttttcccgtggctcacagacaatcctgcaaacacacttgagaactcccc

SEQ ID NO: 345729 - DNA, 75 bp, Artificial Sequence
  Synthetic
gttttcccgtggctcacagacaatcctgcaaacacacttgagaactccccattccaacatcatgtccagctgaga

SEQ ID NO: 345730 - DNA, 75 bp, Artificial Sequence
  Synthetic
aaggaagagacataaggataattggggcacctatcaaaaaatctagcggtgtaagcaatgtctccacggcaatca

SEQ ID NO: 345731 - DNA, 75 bp, Artificial Sequence
  Synthetic
ggcacctatcaaaaaatctagcggtgtaagcaatgtctccacggcaatcagagacaatttctttcccagatttat

SEQ ID NO: 345732 - DNA, 75 bp, Artificial Sequence
  Synthetic
gctattgagaggacagaagctgcaggaatcttaaagcatgctttgttcctcaccatcactggaccctatacggat

SEQ ID NO: 345733 - DNA, 75 bp, Artificial Sequence
  Synthetic
gaatcttaaagcatgctttgttcctcaccatcactggaccctatacggatgcaacaaaaagagaaatgtgtgagg

SEQ ID NO: 345734 - DNA, 75 bp, Artificial Sequence
  Synthetic
agtcttgagaccaaatcatgggaaaaccaggagtaacgttttggccttattccaggattttttctctctgagagg

SEQ ID NO: 345735 - DNA, 75 bp, Artificial Sequence
  Synthetic
accaggagtaacgttttggccttattccaggattttttctctctgagaggtcctgatatcattttcaacaggatt

SEQ ID NO: 345736 - DNA, 75 bp, Artificial Sequence
  Synthetic
gtgggttcacttcacctcaaacaccaacagaggtgaatggtaacattgtatacactggggatggagtttggagag

SEQ ID NO: 345737 - DNA, 75 bp, Artificial Sequence
  Synthetic
aacagaggtgaatggtaacattgtatacactggggatggagtttggagaggagtagtggatggatttcaggttca

SEQ ID NO: 345738 - DNA, 75 bp, Artificial Sequence
  Synthetic
caaaaagtgaaccagctaaaatccatcacggtgaattcagataaaagcattcccacactaggcgggttttgtcat

SEQ ID NO: 345739 - DNA, 75 bp, Artificial Sequence
  Synthetic
tcacggtgaattcagataaaagcattcccacactaggcgggttttgtcattcatggtgtaaagaaatgggagttt

SEQ ID NO: 345740 - DNA, 75 bp, Artificial Sequence
  Synthetic
ctatagagttgctaaagcatcattttacatgttaaatttcaagatttcaggatctagacagtcctacggtgctcc

SEQ ID NO: 345741 - DNA, 75 bp, Artificial Sequence
  Synthetic
tacatgttaaatttcaagatttcaggatctagacagtcctacggtgctcccataatgattgtttcagataaaatc

SEQ ID NO: 345742 - DNA, 75 bp, Artificial Sequence
  Synthetic
aaaatctactgtttagaatcagaggaaacaccataaatctatcatacaaagagtttcagcaaggagccaagccaa

SEQ ID NO: 345743 - DNA, 75 bp, Artificial Sequence
  Synthetic
aaacaccataaatctatcatacaaagagtttcagcaaggagccaagccaagaatgttcaacattttaagctacac

SEQ ID NO: 345744 - DNA, 75 bp, Artificial Sequence
  Synthetic
gagatagcattgaaattgatgagtttatcacaaaagcataagtttcatggtcgagagcctagcacatcctggatt

SEQ ID NO: 345745 - DNA, 75 bp, Artificial Sequence
  Synthetic
tatcacaaaagcataagtttcatggtcgagagcctagcacatcctggatttgcatgagagcattacctattaaca

SEQ ID NO: 345746 - DNA, 75 bp, Artificial Sequence
  Synthetic
tcagggcaatcaaagaatcagtggttcaattgacaatgaaagactcgctgagtgttttaaagatgtcttggagtc

SEQ ID NO: 345747 - DNA, 75 bp, Artificial Sequence
  Synthetic
tcaattgacaatgaaagactcgctgagtgttttaaagatgtcttggagtcatccctgcgcaggaagggagttttc

SEQ ID NO: 345748 - DNA, 75 bp, Artificial Sequence
  Synthetic
agaagatgctggacactctaaaccaagacatgctggatttctttgctgaggctggtctctctgatgatctcatga

SEQ ID NO: 345749 - DNA, 75 bp, Artificial Sequence
  Synthetic
agacatgctggatttctttgctgaggctggtctctctgatgatctcatgatggattcggagccgtggttggaggg

SEQ ID NO: 345750 - DNA, 75 bp, Artificial Sequence
  Synthetic
gaagactaccttgaggagtacaacctgggtccttttgggatttttagtgttgagcaagaaatgaacactagatat

SEQ ID NO: 345751 - DNA, 75 bp, Artificial Sequence
  Synthetic
tgggtccttttgggatttttagtgttgagcaagaaatgaacactagatattatcatcatcttctgctggatgcgg

SEQ ID NO: 345752 - DNA, 75 bp, Artificial Sequence
  Synthetic
gtccctagatggtctgaggaagctattctctgaagagaccgcaccaataacctacaagtcagaaatactgagact

SEQ ID NO: 345753 - DNA, 75 bp, Artificial Sequence
  Synthetic
ttctctgaagagaccgcaccaataacctacaagtcagaaatactgagacttatggcaatcttgcaaagagatgca

SEQ ID NO: 345754 - DNA, 75 bp, Artificial Sequence
  Synthetic
accaagttgtagatcatatgggtctagaagtggaggaggatatgtttggttaatgacattgagatccgaaatcag

SEQ ID NO: 345755 - DNA, 75 bp, Artificial Sequence
  Synthetic
taataccgtgtcactgatttgatttaatggcctgattgctttttctgacagactattatgattctaagtgattgt

SEQ ID NO: 345756 - DNA, 75 bp, Artificial Sequence
  Synthetic
aatggcctgattgctttttctgacagactattatgattctaagtgattgttttacttgatcttggcggactttgt

SEQ ID NO: 345757 - DNA, 75 bp, Artificial Sequence
  Synthetic
acacaaagacggctaacatggtgaaaccaatcgtcttagtggtgctttttgcatgtgcagcgagagctattttta

SEQ ID NO: 345758 - DNA, 75 bp, Artificial Sequence
  Synthetic
accaatcgtcttagtggtgctttttgcatgtgcagcgagagctatttttaacaatgcttgggacgtctctaggag

SEQ ID NO: 345759 - DNA, 75 bp, Artificial Sequence
  Synthetic
gcatgtgcagcgagagctatttttaacaatgcttgggacgtctctaggagactactcgacagtactgcagacaca

SEQ ID NO: 345760 - DNA, 75 bp, Artificial Sequence
  Synthetic
atactcttgtgaaatcccttgacaacatgatgacctctctgaccattccaatgaacaacataaccatctccacaa

SEQ ID NO: 345761 - DNA, 75 bp, Artificial Sequence
  Synthetic
catgatgacctctctgaccattccaatgaacaacataaccatctccacaaatcactccactcatctcaggaacta

SEQ ID NO: 345762 - DNA, 75 bp, Artificial Sequence
  Synthetic
aggaattcaataaccatgttggatctcaaatctggaaattttactaagttgaaatgcagagacaatgagaccctg

SEQ ID NO: 345763 - DNA, 75 bp, Artificial Sequence
  Synthetic
tcaaatctggaaattttactaagttgaaatgcagagacaatgagaccctgagcccagactgtagcacctgcacaa

SEQ ID NO: 345764 - DNA, 75 bp, Artificial Sequence
  Synthetic
caaagatctagcttatgatgatgtggtttgtcaatcagactacagtccaacagaggctctaccctaccattccac

SEQ ID NO: 345765 - DNA, 75 bp, Artificial Sequence
  Synthetic
gtttgtcaatcagactacagtccaacagaggctctaccctaccattccaccaagatctgtaaagtgggacctctc

SEQ ID NO: 345766 - DNA, 75 bp, Artificial Sequence
  Synthetic
aaaaatctgtccaacatgtctcttggttctggatgaatggaaaggttaggatttttgatgattacacaatatcct

SEQ ID NO: 345767 - DNA, 75 bp, Artificial Sequence
  Synthetic
gttctggatgaatggaaaggttaggatttttgatgattacacaatatcctggcaggaggggaagttcatatcact

SEQ ID NO: 345768 - DNA, 75 bp, Artificial Sequence
  Synthetic
aatcagagtccctgtaacaaatccgtttgtctctccggatcctgctctggtgatgtgcacttttgcactgaattc

SEQ ID NO: 345769 - DNA, 75 bp, Artificial Sequence
  Synthetic
tttgtctctccggatcctgctctggtgatgtgcacttttgcactgaattctcctgcaagtcagactctcctgtct

SEQ ID NO: 345770 - DNA, 75 bp, Artificial Sequence
  Synthetic
tggcattgccatcattcacaccaggttaggttccttcatgcctgcatgttttgggaaatccctctgggctgtcag

SEQ ID NO: 345771 - DNA, 75 bp, Artificial Sequence
  Synthetic
ttaggttccttcatgcctgcatgttttgggaaatccctctgggctgtcagcaaatcaaggtcaaaaaggtctgca

SEQ ID NO: 345772 - DNA, 75 bp, Artificial Sequence
  Synthetic
gtgaaacaacctgcaaccccgatgcaatctatgttgttgttagacattttagcccaggtcattacagggcatgtc

SEQ ID NO: 345773 - DNA, 75 bp, Artificial Sequence
  Synthetic
aatctatgttgttgttagacattttagcccaggtcattacagggcatgtctgggatcaacctgtctcactggaat

SEQ ID NO: 345774 - DNA, 75 bp, Artificial Sequence
  Synthetic
ccctttaagatagcagataggctatctgactctgatcttgaaatcaggatttgggactctcacagacataatgaa

SEQ ID NO: 345775 - DNA, 75 bp, Artificial Sequence
  Synthetic
ctgactctgatcttgaaatcaggatttgggactctcacagacataatgaatacttcatcacatctaaatgcaagt

SEQ ID NO: 345776 - DNA, 75 bp, Artificial Sequence
  Synthetic
ctgctggttttgtagagcaaattgggctaatatacattgcttttccaaggaacagacattgattttgataattat

SEQ ID NO: 345777 - DNA, 75 bp, Artificial Sequence
  Synthetic
gctaatatacattgcttttccaaggaacagacattgattttgataattattttatctatttgtgttgttctgatc

SEQ ID NO: 345778 - DNA, 75 bp, Artificial Sequence
  Synthetic
tgataatatcaataatttggaaagttttaaaacctattatatggcttgtcagagttttgagcaaagcagcatcta

SEQ ID NO: 345779 - DNA, 75 bp, Artificial Sequence
  Synthetic
tttaaaacctattatatggcttgtcagagttttgagcaaagcagcatctagagttgccagcagaagagcagccag

SEQ ID NO: 345780 - DNA, 75 bp, Artificial Sequence
  Synthetic
gaggaaggcctgctgaatcctcctcagcctgccatagaacaaagagcagctgtcccagcaagagcaaatgaccgt

SEQ ID NO: 345781 - DNA, 75 bp, Artificial Sequence
  Synthetic
agcctgccatagaacaaagagcagctgtcccagcaagagcaaatgaccgtctaagaatgtttagactatccagaa

SEQ ID NO: 345782 - DNA, 75 bp, Artificial Sequence
  Synthetic
tttattaatttcttactccgagcagtgctcagattcaatctcagtgacagccccttcccataggtgcaccacaga

SEQ ID NO: 345783 - DNA, 75 bp, Artificial Sequence
  Synthetic
tgctcagattcaatctcagtgacagccccttcccataggtgcaccacagattctaatggctcctcccagtgtcaa

SEQ ID NO: 345784 - DNA, 75 bp, Artificial Sequence
  Synthetic
tgagtccaaaagggcaagaaagttgtttgatactcaaaaatcccaatggcctggcagttgacacaatcaaaataa

SEQ ID NO: 345785 - DNA, 75 bp, Artificial Sequence
  Synthetic
tttgatactcaaaaatcccaatggcctggcagttgacacaatcaaaataagaactaaggagataaaattggaatg

SEQ ID NO: 345786 - DNA, 75 bp, Artificial Sequence
  Synthetic
cctagggtgacccatcgatgcattggtgtcaggagatgtcatctcatgggagaatgcaaaggggacaagtgttct

SEQ ID NO: 345787 - DNA, 75 bp, Artificial Sequence
  Synthetic
gtgtcaggagatgtcatctcatgggagaatgcaaaggggacaagtgttctgaattcaagctggactcctattctc

SEQ ID NO: 345788 - DNA, 75 bp, Artificial Sequence
  Synthetic
catgtcacaactgggttggagctattgtgtcgagcagtgtggaggagctttatgtcagtgtttcaacttgaatcc

SEQ ID NO: 345789 - DNA, 75 bp, Artificial Sequence
  Synthetic
tgtgtcgagcagtgtggaggagctttatgtcagtgtttcaacttgaatccatcttgcttttatctcaggaagaca

SEQ ID NO: 345790 - DNA, 75 bp, Artificial Sequence
  Synthetic
acaacatgtttgaatgctcagaatgggcttacaaaattgatgttgtggtggtaacaaacacctctgagacaaacg

SEQ ID NO: 345791 - DNA, 75 bp, Artificial Sequence
  Synthetic
ggcttacaaaattgatgttgtggtggtaacaaacacctctgagacaaacgtgaccttgaaacttggggttcctga

SEQ ID NO: 345792 - DNA, 75 bp, Artificial Sequence
  Synthetic
ttgtcaacagtgtctcagccccccacagttgcatatggagagtgctttggagaggatgtacatggggtcaagttc

SEQ ID NO: 345793 - DNA, 75 bp, Artificial Sequence
  Synthetic
cagttgcatatggagagtgctttggagaggatgtacatggggtcaagttccatgcagaatgcaatcgaagaactg

SEQ ID NO: 345794 - DNA, 75 bp, Artificial Sequence
  Synthetic
aatccaatgtcccacaaaagcagatgccctttccgtgtcaaaaagctgcattagctctgagtctatcatccattc

SEQ ID NO: 345795 - DNA, 75 bp, Artificial Sequence
  Synthetic
gccctttccgtgtcaaaaagctgcattagctctgagtctatcatccattccagagtgcacaaggatgtagtggac

SEQ ID NO: 345796 - DNA, 75 bp, Artificial Sequence
  Synthetic
ccatcatcaaagagaaaaatcaactgccatcaactgttggcacagtgactttctggcctacggagaacagcgttg

SEQ ID NO: 345797 - DNA, 75 bp, Artificial Sequence
  Synthetic
gccatcaactgttggcacagtgactttctggcctacggagaacagcgttgaagcatcaattccagagcttgcttc

SEQ ID NO: 345798 - DNA, 75 bp, Artificial Sequence
  Synthetic
ggatttacttttacttacaaatcagacaacaataaatgcaatgcaaggtttctatctttgtctggatgttataat

SEQ ID NO: 345799 - DNA, 75 bp, Artificial Sequence
  Synthetic
acaacaataaatgcaatgcaaggtttctatctttgtctggatgttataattgtgaaccgggggctaaactggaga

SEQ ID NO: 345800 - DNA, 75 bp, Artificial Sequence
  Synthetic
tgctcttggtctcctgtcatgtccagaaattggctacacaacttactttgatgtgaagacaactctggagaagac

SEQ ID NO: 345801 - DNA, 75 bp, Artificial Sequence
  Synthetic
gaaattggctacacaacttactttgatgtgaagacaactctggagaagacagttaggacaatccatgtgaataac

SEQ ID NO: 345802 - DNA, 75 bp, Artificial Sequence
  Synthetic
tcaagtgtccaaactcagatatgacgctcagagtgaaaggagagcttgtgtatctgttcaatgatgatgtacgcc

SEQ ID NO: 345803 - DNA, 75 bp, Artificial Sequence
  Synthetic
gctcagagtgaaaggagagcttgtgtatctgttcaatgatgatgtacgccattccaaccaaaccctgacacctgg

SEQ ID NO: 345804 - DNA, 75 bp, Artificial Sequence
  Synthetic
tgggatccatttgggtggttcagggcttcttggttaagattggtgtggggccttcttggaggtaccatttccata

SEQ ID NO: 345805 - DNA, 75 bp, Artificial Sequence
  Synthetic
cttcttggttaagattggtgtggggccttcttggaggtaccatttccatagttattggcattatagtggtgtaca

SEQ ID NO: 345806 - DNA, 75 bp, Artificial Sequence
  Synthetic
taagaaacaataattctgaccatacagtcttatcccctttccccaatccctcttggcctaagggtcaagtcacag

SEQ ID NO: 345807 - DNA, 75 bp, Artificial Sequence
  Synthetic
agtcttatcccctttccccaatccctcttggcctaagggtcaagtcacagtgcacaggcattttatgacacagtg

SEQ ID NO: 345808 - DNA, 75 bp, Artificial Sequence
  Synthetic
ctatgctaggactaaggtgagtccactacttgctttgaaattttggtgattgcactattcgtggttatcttattt

SEQ ID NO: 345809 - DNA, 75 bp, Artificial Sequence
  Synthetic
ctatgctaggactaaggtgagtccactacttgctttgtaattttggtgattgcactattcgtggttatcttattt

SEQ ID NO: 345810 - DNA, 75 bp, Artificial Sequence
  Synthetic
ctatgctaggactaaggtgagtccactacttgctttgcaattttggtgattgcactattcgtggttatcttattt

SEQ ID NO: 345811 - DNA, 75 bp, Artificial Sequence
  Synthetic
ctatgctaggactaaggtgagtccactacttgctttggaattttggtgattgcactattcgtggttatcttattt

SEQ ID NO: 345812 - DNA, 75 bp, Artificial Sequence
  Synthetic
ctacttgctttgaaattttggtgattgcactattcgtggttatcttatttgatactccatgtagccggtctttgt

SEQ ID NO: 345813 - DNA, 75 bp, Artificial Sequence
  Synthetic
ctacttgctttgtaattttggtgattgcactattcgtggttatcttatttgatactccatgtagccggtctttgt

SEQ ID NO: 345814 - DNA, 75 bp, Artificial Sequence
  Synthetic
ctacttgctttgcaattttggtgattgcactattcgtggttatcttatttgatactccatgtagccggtctttgt

SEQ ID NO: 345815 - DNA, 75 bp, Artificial Sequence
  Synthetic
ctacttgctttggaattttggtgattgcactattcgtggttatcttatttgatactccatgtagccggtctttgt

SEQ ID NO: 345816 - DNA, 75 bp, Artificial Sequence
  Synthetic
acacaaagacctccaactaagctatcgattcatcatggcgattccggaggactgggtgcgcttcgcgatcgaagt

SEQ ID NO: 345817 - DNA, 75 bp, Artificial Sequence
  Synthetic
gagatcagagagttcatcaacctcttccagtatcaaggatttgatgctactgtggtcctgaggaggctttacgag

SEQ ID NO: 345818 - DNA, 75 bp, Artificial Sequence
  Synthetic
gactacccagtgcacatgatgcacaatgcctttgcgggcctggtagatgagactttgccagaagaatccatcaag

SEQ ID NO: 345819 - DNA, 75 bp, Artificial Sequence
  Synthetic
tacttgggatggactttcaggttgtccaggtcagagtcaaataggaactccagatgtttggttttggatccatgt

SEQ ID NO: 345820 - DNA, 75 bp, Artificial Sequence
  Synthetic
cagatgtttggttttggatccatgtctgtctgctttcttgctaggagggcattgctcaaaatgggtaaagaacct

SEQ ID NO: 345821 - DNA, 75 bp, Artificial Sequence
  Synthetic
aagattctttcccgtcacctgtctctctgagagccccattttcctgatcttagtccgcaacttgtgggccagctg

SEQ ID NO: 345822 - DNA, 75 bp, Artificial Sequence
  Synthetic
gttaaggatcagagctctcttcttctccagaggccatcccgttgcagacacaactctctgctcatcagcagggtc

SEQ ID NO: 345823 - DNA, 75 bp, Artificial Sequence
  Synthetic
gtagaacttgttgatagggcttagggaacacccctgaggcaagtccttttccgaaatgatgtagtatgacatgct

SEQ ID NO: 345824 - DNA, 75 bp, Artificial Sequence
  Synthetic
ccaagatgcttttagcgatatgctcgagaacaaatcctcagcgaggactgaactgtcctcctgctgtgacctata

SEQ ID NO: 345825 - DNA, 75 bp, Artificial Sequence
  Synthetic
ggatcggatgttttgatggactttgacctggacaccatccctccaggatcagtgactggatcttcaattggtcca

SEQ ID NO: 345826 - DNA, 75 bp, Artificial Sequence
  Synthetic
aaattcaaggtgaagactcaggctgcttcatcatttgtccatgatttcacctttgcacactggtgtgatgcatca

SEQ ID NO: 345827 - DNA, 75 bp, Artificial Sequence
  Synthetic
ctgggaaaccactgaagcaaaattttctccgttctctcggaggatgttctcaaacttctcacagatggagccaga

SEQ ID NO: 345828 - DNA, 75 bp, Artificial Sequence
  Synthetic
catccgagcatggaggacagcctatggatcagttagcaatggcacagtggagagatgtgatgaagatgtggagag

SEQ ID NO: 345829 - DNA, 75 bp, Artificial Sequence
  Synthetic
ttgtcagtagaggagatcgaagaatctaaagctctcaggatgaagtaccaccgctgcaagattgacaacggcatg

SEQ ID NO: 345830 - DNA, 75 bp, Artificial Sequence
  Synthetic
cctgaaacagcattgtggccgccagaagttcatcatcaagaaactgagattcttcgacatcttccttctgattaa

SEQ ID NO: 345831 - DNA, 75 bp, Artificial Sequence
  Synthetic
ttttattccatagcttttccagagtcagctatcactggaaagctacaccgatctcagtgcttcaaagggctccag

SEQ ID NO: 345832 - DNA, 75 bp, Artificial Sequence
  Synthetic
cagctatcactggaaagctacaccgatctcagtgcttcaaagggctccagttcgaagatgggtggttctggacag

SEQ ID NO: 345833 - DNA, 75 bp, Artificial Sequence
  Synthetic
caaaaaatgattgaaaaattaccagaactagcacggacaaagttccaggtttggctcatctctagaatgctgcaa

SEQ ID NO: 345834 - DNA, 75 bp, Artificial Sequence
  Synthetic
agtgctggagaaggtgagcaagtacgtaaagaagagcagctcacatgtccatcacataatggaggagtgtctgaa

SEQ ID NO: 345835 - DNA, 75 bp, Artificial Sequence
  Synthetic
aatggatgcaacggggtggagcctttgtccagactgagactggcatgatgcagggaatcttgcattacacctcca

SEQ ID NO: 345836 - DNA, 75 bp, Artificial Sequence
  Synthetic
cagatacctatctgctctggtcttcaagttcaagaaggttataggaaaatacttgggcatctactcttccattaa

SEQ ID NO: 345837 - DNA, 75 bp, Artificial Sequence
  Synthetic
aagttcaagaaggttataggaaaatacttgggcatctactcttccattaagtcaacgaataacactttgcacctt

SEQ ID NO: 345838 - DNA, 75 bp, Artificial Sequence
  Synthetic
taactcgctctcaaaaggaaactgcatcatcagggtcatatcatcctcagtttacatcctgagcagaaacattct

SEQ ID NO: 345839 - DNA, 75 bp, Artificial Sequence
  Synthetic
cccagaacattcaaggaggagtgggatcatttgacagcagttttcccttggctgaagaacaatcctgccgagacc

SEQ ID NO: 345840 - DNA, 75 bp, Artificial Sequence
  Synthetic
tttcccaggtttgtgctaactcatattccagatgaggcagcattggagagaattgaagcagctggcattctaaag

SEQ ID NO: 345841 - DNA, 75 bp, Artificial Sequence
  Synthetic
catgcgttgttcctaaccgtgactgggccatacacagatgacacaaggctggagatgtgcaaggactttatcatc

SEQ ID NO: 345842 - DNA, 75 bp, Artificial Sequence
  Synthetic
tggtgtgtggcgtgggattgttgatggcttccaggtgcagctagtcatcacctacatgcccaagcagaagataaa

SEQ ID NO: 345843 - DNA, 75 bp, Artificial Sequence
  Synthetic
ctactggacagaatcctcaaccgtgagagaattagtgcctccattgacaatgacaggctggctgaatgcttcaag

SEQ ID NO: 345844 - DNA, 75 bp, Artificial Sequence
  Synthetic
caagtgggttccgcatcaaagtcaagctagttctatctatctctaattctttttcttcttttacttccatcttgg

SEQ ID NO: 345845 - DNA, 75 bp, Artificial Sequence
  Synthetic
cacataaggcactgcagccatgacacaaagcgagttcagcatgttccatggttctggatagatggacgcattcgt

SEQ ID NO: 345846 - DNA, 75 bp, Artificial Sequence
  Synthetic
tcttgcacttatgcaaagtcagagtgcacctgcaaaaggaatcaagtcccaggagtggcagttgtccacactaag

SEQ ID NO: 345847 - DNA, 75 bp, Artificial Sequence
  Synthetic
gcacctgcaaaaggaatcaagtcccaggagtggcagttgtccacactaagcatggctctttcatgccgcaatgct

SEQ ID NO: 345848 - DNA, 75 bp, Artificial Sequence
  Synthetic
aaagccactggctaagaggtcagtttcagttcgacaaccctgcatggactgtgagagcgactgcaaggcagatca

SEQ ID NO: 345849 - DNA, 75 bp, Artificial Sequence
  Synthetic
tcagttcgacaaccctgcatggactgtgagagcgactgcaaggcagatcacatcctggtaatagtcagacacttc

SEQ ID NO: 345850 - DNA, 75 bp, Artificial Sequence
  Synthetic
ttggttctacatgcctaactggcagggcctctgataaagagttcagagtgcctttcaaaatggctgacagactct

SEQ ID NO: 345851 - DNA, 75 bp, Artificial Sequence
  Synthetic
ggcctctgataaagagttcagagtgcctttcaaaatggctgacagactctcagactcccactttgaaattaaaat

SEQ ID NO: 345852 - DNA, 75 bp, Artificial Sequence
  Synthetic
gcaagtgtcttcaaggccattagagtcatagcaactacagtttggaaagtgttgaagccattttggtggattctt

SEQ ID NO: 345853 - DNA, 75 bp, Artificial Sequence
  Synthetic
gttgaagccattttggtggattctttctctgctactaaggacttgcaccagaagattgaacaaacgagctgaacg

SEQ ID NO: 345854 - DNA, 75 bp, Artificial Sequence
  Synthetic
actgggtctgctgtggattacattaaaatcaagacgacagacatcagactcgagtgtgttcggagagatttgtac

SEQ ID NO: 345855 - DNA, 75 bp, Artificial Sequence
  Synthetic
gagaccatcttgcttctacctgagaaagactttttcccctctgtctcaggatgcatttaacatttacgagtgctc

SEQ ID NO: 345856 - DNA, 75 bp, Artificial Sequence
  Synthetic
gaactgattactcactgggaaagattggagagatccaatgtccgacgaaagcagatgctctttcaatttcaaaga

SEQ ID NO: 345857 - DNA, 75 bp, Artificial Sequence
  Synthetic
tgcccaagcctaggatacacaacctactatgaggccaagaacactctggagaagtctgtgcgaactattcatcta

SEQ ID NO: 345858 - DNA, 75 bp, Artificial Sequence
  Synthetic
acacaaagacctccaactaagctatcgattcatcatggctattccggaggattgggtgcgcttcgcaatcgaagt

SEQ ID NO: 345859 - DNA, 75 bp, Artificial Sequence
  Synthetic
tccagtatcaaggatttgatgctactgtggttctgaggaggctttacgagctctctcaaaaagcaggactggaca

SEQ ID NO: 345860 - DNA, 75 bp, Artificial Sequence
  Synthetic
ggctctgatcaccctccatctgaccagaggaaacaagctctcgagcattgaaaaaagactgtcagaagcaggtaa

SEQ ID NO: 345861 - DNA, 75 bp, Artificial Sequence
  Synthetic
agaggaaacaagctctcgagcattgaaaaaagactgtcagaagcaggtaaaaaggagtttgccctgctcaaggcc

SEQ ID NO: 345862 - DNA, 75 bp, Artificial Sequence
  Synthetic
aggaggcctcagatctgacactctcccgcattgccattgccaatgctgggctgacgtgtcgcatcctgcctcagg

SEQ ID NO: 345863 - DNA, 75 bp, Artificial Sequence
  Synthetic
ccgcattgccattgccaatgctgggctgacgtgtcgcatcctgcctcaggtggtcactcacactgcagtgaccag

SEQ ID NO: 345864 - DNA, 75 bp, Artificial Sequence
  Synthetic
gactacccggtgcacatgatgcacaacgcctttgcaggtctggttgatgagactctgccagaggaatccatcaag

SEQ ID NO: 345865 - DNA, 75 bp, Artificial Sequence
  Synthetic
agctcgtggatggtaatggaaaggcaagcaaggcagtggttcaggctgccacgacccttagatcaatgatctaag

SEQ ID NO: 345866 - DNA, 75 bp, Artificial Sequence
  Synthetic
aagcaaggcagtggttcaggctgccacgacccttagatcaatgatctaagggtcaatttggaatttagtaattcg

SEQ ID NO: 345867 - DNA, 75 bp, Artificial Sequence
  Synthetic
actctaaaagggcttcggcccaacctacagtctgccaacgactggccagtctttctcaaaggaggtgtccagcag

SEQ ID NO: 345868 - DNA, 75 bp, Artificial Sequence
  Synthetic
tacagtctgccaacgactggccagtctttctcaaaggaggtgtccagcaggcgttctctgacactctcaaaagcc

SEQ ID NO: 345869 - DNA, 75 bp, Artificial Sequence
  Synthetic
atttaggatggactttcaggttgtccaggtcagagtcaaataagaatttaagatgtttgttcttggagccatgct

SEQ ID NO: 345870 - DNA, 75 bp, Artificial Sequence
  Synthetic
caggtcagagtcaaataagaatttaagatgtttgttcttggagccatgcttgtccaccttagagctgggaggact

SEQ ID NO: 345871 - DNA, 75 bp, Artificial Sequence
  Synthetic
ttgtccaccatggtccctctcagaactaaccttttctgcaggttcagagagtggatgagacataaatcctttaca

SEQ ID NO: 345872 - DNA, 75 bp, Artificial Sequence
  Synthetic
ctaaccttttctgcaggttcagagagtggatgagacataaatcctttacaagattctttccagtcacttgcctct

SEQ ID NO: 345873 - DNA, 75 bp, Artificial Sequence
  Synthetic
agaccgcagtttttgagctagtaggaacagcattactcctggtgtcaatctggatttctgtttcctcctcagttt

SEQ ID NO: 345874 - DNA, 75 bp, Artificial Sequence
  Synthetic
aacagcattactcctggtgtcaatctggatttctgtttcctcctcagtttaggattctgatctccaaacaaggca

SEQ ID NO: 345875 - DNA, 75 bp, Artificial Sequence
  Synthetic
tccgaagagtttgggtccataccatgtctagcttgaggtacctgaagaagttcagaatcaaggctctcttctttt

SEQ ID NO: 345876 - DNA, 75 bp, Artificial Sequence
  Synthetic
gtctagcttgaggtacctgaagaagttcagaatcaaggctctcttcttttccaagggccatcccacagcagaaac

SEQ ID NO: 345877 - DNA, 75 bp, Artificial Sequence
  Synthetic
actgaataaaggccatggattattgaatcatacagtccctcttccacctctagccagccagtcgaaggcagatcc

SEQ ID NO: 345878 - DNA, 75 bp, Artificial Sequence
  Synthetic
tagccagccagtcgaaggcagatccactccaggaatggagcttttcagaggtataatcttcgggaatagaccatc

SEQ ID NO: 345879 - DNA, 75 bp, Artificial Sequence
  Synthetic
acacaaagacggctaacatggtaaggacttacctcctaattttgctcctctgcgggcctgtgatgccctttctca

SEQ ID NO: 345880 - DNA, 75 bp, Artificial Sequence
  Synthetic
gacttacctcctaattttgctcctctgcgggcctgtgatgccctttctcaatcacttgatggatgtcacaaggcg

SEQ ID NO: 345881 - DNA, 75 bp, Artificial Sequence
  Synthetic
tgcgggcctgtgatgccctttctcaatcacttgatggatgtcacaaggcggatgctagaatccagcaacgcgacc

SEQ ID NO: 345882 - DNA, 75 bp, Artificial Sequence
  Synthetic
acagactttcaagatggaacgaccatctcatgtcaattcttggcatcggatcccacattgatgaagtctccctga

SEQ ID NO: 345883 - DNA, 75 bp, Artificial Sequence
  Synthetic
tctcatgtcaattcttggcatcggatcccacattgatgaagtctccctgaatcacagtcaacatctattcaacta

SEQ ID NO: 345884 - DNA, 75 bp, Artificial Sequence
  Synthetic
aggagaacacttacaatgctggatcccaagtctggattgttcaaaagattggtttgcaatgtgaatcagaccctg

SEQ ID NO: 345885 - DNA, 75 bp, Artificial Sequence
  Synthetic
ccaagtctggattgttcaaaagattggtttgcaatgtgaatcagaccctgacaaaggactgctcctcttgcatta

SEQ ID NO: 345886 - DNA, 75 bp, Artificial Sequence
  Synthetic
tgagcacttggtttacgacgatgggatatgtcaatctgattacagcagcattgcttctatgccacaccacgacac

SEQ ID NO: 345887 - DNA, 75 bp, Artificial Sequence
  Synthetic
atatgtcaatctgattacagcagcattgcttctatgccacaccacgacacccatctgtgcgaagtgggcccactg

SEQ ID NO: 345888 - DNA, 75 bp, Artificial Sequence
  Synthetic
ctaagcgagttcagcatgttgcctggttttggatagatgggcgcgttcgtatctacgatgattactctatctcat

SEQ ID NO: 345889 - DNA, 75 bp, Artificial Sequence
  Synthetic
gttttggatagatgggcgcgttcgtatctacgatgattactctatctcatggaccgaggggagatttctttcttt

SEQ ID NO: 345890 - DNA, 75 bp, Artificial Sequence
  Synthetic
aaagtttacaattgcaataaagcagcctgcttggaaggcaagtgttcaggtgacattcaattctgcacagagttc

SEQ ID NO: 345891 - DNA, 75 bp, Artificial Sequence
  Synthetic
cctgcttggaaggcaagtgttcaggtgacattcaattctgcacagagttcacttgcacttacgcaaagtcagaat

SEQ ID NO: 345892 - DNA, 75 bp, Artificial Sequence
  Synthetic
aggagtggcagtagtccacactaagcatggttctttcatgccgcagtgttttgggcaatcattgtggacagtgag

SEQ ID NO: 345893 - DNA, 75 bp, Artificial Sequence
  Synthetic
catggttctttcatgccgcagtgttttgggcaatcattgtggacagtgaggaagccattggcgaagagatctgtt

SEQ ID NO: 345894 - DNA, 75 bp, Artificial Sequence
  Synthetic
gtgagagtgactgcaaggcagaccacatccttgtaattgtgaggcatttcactccagatcattaccaggcttgtc

SEQ ID NO: 345895 - DNA, 75 bp, Artificial Sequence
  Synthetic
catccttgtaattgtgaggcatttcactccagatcattaccaggcttgtcttggttctacatgtcttactggcag

SEQ ID NO: 345896 - DNA, 75 bp, Artificial Sequence
  Synthetic
ccttttaaaatggctgacagactatctgattctcattttgagatcaaaatatgggacaaggagcggtcaaatgaa

SEQ ID NO: 345897 - DNA, 75 bp, Artificial Sequence
  Synthetic
ccattaatgcttgtgatgcaatcacttgctggttttgcagggctaactgggctaatattcaatgcttctccaagg

SEQ ID NO: 345898 - DNA, 75 bp, Artificial Sequence
  Synthetic
ttgctggttttgcagggctaactgggctaatattcaatgcttctccaaggagcaggtgctgatccttgtgtttgt

SEQ ID NO: 345899 - DNA, 75 bp, Artificial Sequence
  Synthetic
aatcaaggagagcattcattacttggaggagggattagcagaaggaggcagtaaagcagagaaggagactattca

SEQ ID NO: 345900 - DNA, 75 bp, Artificial Sequence
  Synthetic
gaggagggattagcagaaggaggcagtaaagcagagaaggagactattcagatgcaaacagtggcaagaccaaat

SEQ ID NO: 345901 - DNA, 75 bp, Artificial Sequence
  Synthetic
cacgcctcagcccagctgtggtgggcatcatgtgtctcttgaatcctgcctctggatgttccgactccatctcaa

SEQ ID NO: 345902 - DNA, 75 bp, Artificial Sequence
  Synthetic
catcatgtgtctcttgaatcctgcctctggatgttccgactccatctcaatcacagcttcaagccagagatgctc

SEQ ID NO: 345903 - DNA, 75 bp, Artificial Sequence
  Synthetic
tgcttcgtcagcaccagttccctccttcaagtaagccctaaaggccaggagagttgcctgataatcaaaactcca

SEQ ID NO: 345904 - DNA, 75 bp, Artificial Sequence
  Synthetic
ttcaagtaagccctaaaggccaggagagttgcctgataatcaaaactccaacaggatctgcagtggattacatta

SEQ ID NO: 345905 - DNA, 75 bp, Artificial Sequence
  Synthetic
ggagtgcgttcgaagagatttgtactgggttccacgggtcacacacaggtgcattgggaccaggaggtgccattt

SEQ ID NO: 345906 - DNA, 75 bp, Artificial Sequence
  Synthetic
tgggttccacgggtcacacacaggtgcattgggaccaggaggtgccatttgatgggagcttgtaagcaggatgct

SEQ ID NO: 345907 - DNA, 75 bp, Artificial Sequence
  Synthetic
actctcctgagtggggtcacgaggaagaacttatggcgcagttaggctggagctattgtgtggagcaatgtgggg

SEQ ID NO: 345908 - DNA, 75 bp, Artificial Sequence
  Synthetic
agaacttatggcgcagttaggctggagctattgtgtggagcaatgtggggggccattgtgtcaatgcttcaatgt

SEQ ID NO: 345909 - DNA, 75 bp, Artificial Sequence
  Synthetic
aagacattttctcctttgtcccaggatgcattcaatatctatgaatgttcagagtggacctatagaataaacgta

SEQ ID NO: 345910 - DNA, 75 bp, Artificial Sequence
  Synthetic
atgcattcaatatctatgaatgttcagagtggacctatagaataaacgtagttgtgtcaactaacgcctctcaga

SEQ ID NO: 345911 - DNA, 75 bp, Artificial Sequence
  Synthetic
cccagactctattccgcatggcttaattagcttatccagtgtttctcaacctcctgcagttgcctatgcagagtg

SEQ ID NO: 345912 - DNA, 75 bp, Artificial Sequence
  Synthetic
attagcttatccagtgtttctcaacctcctgcagttgcctatgcagagtgctttggagaagatctccatggtgtg

SEQ ID NO: 345913 - DNA, 75 bp, Artificial Sequence
  Synthetic
gaactgattactccttggggaaaattggagagattcagtgcccgacgaaagcagatgccctttccatttccaaaa

SEQ ID NO: 345914 - DNA, 75 bp, Artificial Sequence
  Synthetic
tggagagattcagtgcccgacgaaagcagatgccctttccatttccaaaagatgcataagttcagatagcatcat

SEQ ID NO: 345915 - DNA, 75 bp, Artificial Sequence
  Synthetic
gtagattgtagatctgcaatcactgatcccatgaccataaagagtagaaacaagctgccctctacagttggttct

SEQ ID NO: 345916 - DNA, 75 bp, Artificial Sequence
  Synthetic
atcccatgaccataaagagtagaaacaagctgccctctacagttggttctgtcacattctggccaacagaatcga

SEQ ID NO: 345917 - DNA, 75 bp, Artificial Sequence
  Synthetic
agcatctgccactatgctcattaggctggacggatacatcctccagtacagatctgattccaacaaatgcagttc

SEQ ID NO: 345918 - DNA, 75 bp, Artificial Sequence
  Synthetic
ctggacggatacatcctccagtacagatctgattccaacaaatgcagttcgcgatttctttctctatctggctgc

SEQ ID NO: 345919 - DNA, 75 bp, Artificial Sequence
  Synthetic
tggagattgaacatgtgactgacttcgggacagctctagcagtgctggaatgcccaagcttgggatacacaacct

SEQ ID NO: 345920 - DNA, 75 bp, Artificial Sequence
  Synthetic
cgggacagctctagcagtgctggaatgcccaagcttgggatacacaacctattatgaggccaaaaacactttaga

SEQ ID NO: 345921 - DNA, 75 bp, Artificial Sequence
  Synthetic
aatggttcccatgtggaagcaaaatgcttcttcaggtgtcctaactctgaatcccagattgtgattaaaggggag

SEQ ID NO: 345922 - DNA, 75 bp, Artificial Sequence
  Synthetic
gcttcttcaggtgtcctaactctgaatcccagattgtgattaaaggggagcttgtgtatctgtttaatgatgatg

SEQ ID NO: 345923 - DNA, 75 bp, Artificial Sequence
  Synthetic
cccaggtttgagtgcaaaatcaggatatggatgggacccgtttggctggttccgagcttcatggctaagagccat

SEQ ID NO: 345924 - DNA, 75 bp, Artificial Sequence
  Synthetic
tatggatgggacccgtttggctggttccgagcttcatggctaagagccatttgggcagtcctaggaggaacagtg

SEQ ID NO: 345925 - DNA, 75 bp, Artificial Sequence
  Synthetic
tctacatgatcttcaatttatgcatgaaagccaaaagatcctaggagcctcagcccaactccccatcccacaacc

SEQ ID NO: 345926 - DNA, 75 bp, Artificial Sequence
  Synthetic
gaaagccaaaagatcctaggagcctcagcccaactccccatcccacaacccctttcctttcccttccccaaccct

SEQ ID NO: 345927 - DNA, 75 bp, Artificial Sequence
  Synthetic
ttgactccgctgctggatttgagactattcaaggccactggttgcaatccctggtagcatcttgggttgatttat

SEQ ID NO: 345928 - DNA, 75 bp, Artificial Sequence
  Synthetic
tattcaaggccactggttgcaatccctggtagcatcttgggttgatttatttgtttttccatgtagccggtcttt

SEQ ID NO: 345929 - DNA, 75 bp, Artificial Sequence
  Synthetic
agaccatcaaagagagaaagagaataaaaatatttttgtaaaactttttttatgagaccatcagaaagaggttta

SEQ ID NO: 345930 - DNA, 75 bp, Artificial Sequence
  Synthetic
ggtaggagttggccccaatccagtccattaatgcgtggtcgtgcaccatcagcacgttatcgaatcctttgccac

SEQ ID NO: 345931 - DNA, 75 bp, Artificial Sequence
  Synthetic
tgcactctgaatttcgagattaaatgcaataacaaagattcttcctccaaacagttaacgaaagcaaagaatgat

SEQ ID NO: 345932 - DNA, 75 bp, Artificial Sequence
  Synthetic
cattaatgcgtggtcgtgcaccatcagcacgttatcgaatcctttgccacgcaagtccgcatcttcatgacgacc

SEQ ID NO: 345933 - DNA, 75 bp, Artificial Sequence
  Synthetic
taactttttgtgaatgtagttaagaacatttttgttttgcaaaccggaatatagtgtccggtacacttttttaat

SEQ ID NO: 345934 - DNA, 75 bp, Artificial Sequence
  Synthetic
tcactgccactgaccggatgccgacgcgaagcgggtagatatcacactctgtctggcttttggctgtgacgcaca

SEQ ID NO: 345935 - DNA, 75 bp, Artificial Sequence
  Synthetic
tcgtggtgtgcctgaatcgttcgattaaccctactcatccaatttcagatgaatagagttatcgattcagacaca

SEQ ID NO: 345936 - DNA, 75 bp, Artificial Sequence
  Synthetic
aaagtgtaaagacaacgaatacaaacgccataatttgtgttgtttatcgtgtcctccgggaacatacgcttccag

SEQ ID NO: 345937 - DNA, 75 bp, Artificial Sequence
  Synthetic
cgctttgagttttgttgaatcgatgagtgaagtatcatcggttgcaccttcagatgccgatccgtcgacatactt

SEQ ID NO: 345938 - DNA, 75 bp, Artificial Sequence
  Synthetic
gcgaagcgggtagatatcacactctgtctggcttttggctgtgacgcacagttcatagagataaccttcacccgg

SEQ ID NO: 345939 - DNA, 75 bp, Artificial Sequence
  Synthetic
cagttgcaaccacctgttgatccgcatcacgcagttcaacgctgacatcaccattggccaccacctgccagtcaa

SEQ ID NO: 345940 - DNA, 75 bp, Artificial Sequence
  Synthetic
atcacgcagttcaacgctgacatcaccattggccaccacctgccagtcaacagacgcgtggttacagtcttgcgc

SEQ ID NO: 345941 - DNA, 75 bp, Artificial Sequence
  Synthetic
tttttgcgtaatggattagtgccactgtctagtagtagtttgacgacctcaacattattacaatgctcattaaaa

SEQ ID NO: 345942 - DNA, 75 bp, Artificial Sequence
  Synthetic
agagcattacgctgcgatggattccggcatagttaaagaaatcatggaagtaagactgctttttcttgccgtttt

SEQ ID NO: 345943 - DNA, 75 bp, Artificial Sequence
  Synthetic
tgatgtcgatagacacctcacagtctttgatcatagcaagagcttcttcatgagtgatcgcgggagagtccttac

SEQ ID NO: 345944 - DNA, 75 bp, Artificial Sequence
  Synthetic
ggcatagttaaagaaatcatggaagtaagactgctttttcttgccgttttcgtcggtaatcaccattcccggcgg

SEQ ID NO: 345945 - DNA, 75 bp, Artificial Sequence
  Synthetic
ttttcccggcaataacatacggcgtgacatcggcttcaaatggcgtatagccgccctgatgctccatcacttcct

SEQ ID NO: 345946 - DNA, 75 bp, Artificial Sequence
  Synthetic
gcggattctgagatggatttaatctgaggacatttggtgaatccaaagttcattctcagacctccaccgatgatg

SEQ ID NO: 345947 - DNA, 75 bp, Artificial Sequence
  Synthetic
gacatcggcttcaaatggcgtatagccgccctgatgctccatcacttcctgattattgacccacactttgccgta

SEQ ID NO: 345948 - DNA, 75 bp, Artificial Sequence
  Synthetic
gaatgaactttggattcaccaaatgtcctcagattaaatccatctcagaatccgctgatggaaacacagtgaatg

SEQ ID NO: 345949 - DNA, 75 bp, Artificial Sequence
  Synthetic
ccatgtcaaaaacttgtacaattattaataaaaataatttagtgtttaaattttaccagttccagattttacacc

SEQ ID NO: 345950 - DNA, 75 bp, Artificial Sequence
  Synthetic
gaatttcgagattaaatgcaataacaaaaatttttcctccaaacagttaacgaaagcaaagaatgatgacggtat

SEQ ID NO: 345951 - DNA, 75 bp, Artificial Sequence
  Synthetic
tctgactcggactctgtaatttccgttacggattggcaaatcttatcattggtcggtgtttggtcttgctttgtg

SEQ ID NO: 345952 - DNA, 75 bp, Artificial Sequence
  Synthetic
tcggtataaagacttcgcgctgataccagacgttgcccgcataattacgaatatctgcatcggcgaactgatcgt

SEQ ID NO: 345953 - DNA, 75 bp, Artificial Sequence
  Synthetic
ggtcggtgtttggtcttgctttgtgactttgataataacatcgattcccatatgatgtttgttttcttcttccgt

SEQ ID NO: 345954 - DNA, 75 bp, Artificial Sequence
  Synthetic
gtaactttgatagccgtagatctttgttccttcgccaacaggttaaagaaattaataaagaatttgtggtttcta

SEQ ID NO: 345955 - DNA, 75 bp, Artificial Sequence
  Synthetic
gccatcgttgattacaagactacaaagaatgttctagctgctattcctaacagaacatttgccaagattaatccg

SEQ ID NO: 345956 - DNA, 75 bp, Artificial Sequence
  Synthetic
tttcgcgatccagactgaatgcccacaggccgtcgagttttttgatttcacgggttggggtttctacaggacgta

SEQ ID NO: 345957 - DNA, 75 bp, Artificial Sequence
  Synthetic
ccagacgttgcccgcataattacgaatatctgcatcggcgaactgatcgttaaaactgcctggcacagcaattgc

SEQ ID NO: 345958 - DNA, 75 bp, Artificial Sequence
  Synthetic
acattctagtcgaggaattcatttatagcatagaaaaaaacaaaatgaaattctactatatttttacatacatat

SEQ ID NO: 345959 - DNA, 75 bp, Artificial Sequence
  Synthetic
ttatgattctacttccttaccgtgcaataaattagaatatattttctacttttacgagaaattaattattgtatt

SEQ ID NO: 345960 - DNA, 75 bp, Artificial Sequence
  Synthetic
gtaaaattaaattaattataaaattatgtatatgatttactaactttagttagataagttagtaatacataaatt

SEQ ID NO: 345961 - DNA, 75 bp, Artificial Sequence
  Synthetic
tttacgagaaattaattattgtatttattatttatgggtgaaaaacttactataaaaagcgggtgggtttggaat

SEQ ID NO: 345962 - DNA, 75 bp, Artificial Sequence
  Synthetic
aataaattagaatatattttctacttttacgagaaattaattattgtatttattatttatgggtgaaaaacttac

SEQ ID NO: 345963 - DNA, 75 bp, Artificial Sequence
  Synthetic
tataaaaagcgggtgggtttggaattagtgatcagtttatgtatatcgcaactaccgggcatatggctatcgaca

SEQ ID NO: 345964 - DNA, 75 bp, Artificial Sequence
  Synthetic
atatttatttagtgtctagaaaaaaatgtgtgaccaacgaccgtaggaaactctagagggtaagaaaaatcaatc

SEQ ID NO: 345965 - DNA, 75 bp, Artificial Sequence
  Synthetic
ttagtatattaatattatattttaaatatttatttagtgtctagaaaaaaatgtgtgaccaacgaccgtaggaaa

SEQ ID NO: 345966 - DNA, 75 bp, Artificial Sequence
  Synthetic
ctctagagggtaagaaaaatcaatcgctttatagagaccatcagaaagaggtttaatatttttgtgagaccatcg

SEQ ID NO: 345967 - DNA, 75 bp, Artificial Sequence
  Synthetic
agattgtatcagtttcgtagtcttgagtattggtattactatatagtatatagatgtcgacgctagatatacagt

SEQ ID NO: 345968 - DNA, 75 bp, Artificial Sequence
  Synthetic
tatttttgtgagaccatcgaaggagaaagagataaaacttttttacgactccatcagaaagaggtttaatatttt

SEQ ID NO: 345969 - DNA, 75 bp, Artificial Sequence
  Synthetic
atgaggtatccgaagaagttgtaaaaagagatcccaccacttattacagtatcgttggtgcgggtcttaacatga

SEQ ID NO: 345970 - DNA, 75 bp, Artificial Sequence
  Synthetic
aagagatcccaccacttattacagtatcgttggtgcgggtcttaacatgaactttggattcacaaaatgcccaaa

SEQ ID NO: 345971 - DNA, 75 bp, Artificial Sequence
  Synthetic
aggatatacaaagcaattgccgtctccagctcctggtatatgtttaccagctggaaaagttgttccacataccac

SEQ ID NO: 345972 - DNA, 75 bp, Artificial Sequence
  Synthetic
ataaaacttttttacgactccatcagaaagaggtttaatatttttgtgagaaaggagaaagagataaaacttttt

SEQ ID NO: 345973 - DNA, 75 bp, Artificial Sequence
  Synthetic
tagagatatttgagagggaaaagtcatctcttgtatcatatattaaaactaccaataagaagagaaaggtcaatt

SEQ ID NO: 345974 - DNA, 75 bp, Artificial Sequence
  Synthetic
cttattaaggacagagaagtattcctcacgaaatacgggattacagtctttatgattcatagtaatagttagttc

SEQ ID NO: 345975 - DNA, 75 bp, Artificial Sequence
  Synthetic
tatgattcatagtaatagttagttccgacgttgagatggattcactgagaccggtagtggtcgtccgagtacacg

SEQ ID NO: 345976 - DNA, 75 bp, Artificial Sequence
  Synthetic
cggaaaatacaagtatagatacaacggttactatcaatattattcatctagcgattatgaaaattataatgaata

SEQ ID NO: 345977 - DNA, 75 bp, Artificial Sequence
  Synthetic
tccatcagaaagaggtttaatatttttgtgagaccatcgaaggagaaagagataaaacttttttacgactccatc

SEQ ID NO: 345978 - DNA, 75 bp, Artificial Sequence
  Synthetic
tatgatgaaacacaagatcaaagtacacaactagtaggttacgacattaaactcaaaaccaatgaggatgatttt

SEQ ID NO: 345979 - DNA, 75 bp, Artificial Sequence
  Synthetic
aacacatgccttgcatccggatgatcctttgagaagacaataatatccgggagagcattcacagattctattgtg

SEQ ID NO: 345980 - DNA, 75 bp, Artificial Sequence
  Synthetic
tatatggatactaatggtatcaagaagtattctccagatgaatgggtgtcacatataaaattttaattaatgtaa

SEQ ID NO: 345981 - DNA, 75 bp, Artificial Sequence
  Synthetic
cgcataactctatcatggcaataatacaaccaaacacttgtaaaattcctaaattagtagaaaatacaacggata

SEQ ID NO: 345982 - DNA, 75 bp, Artificial Sequence
  Synthetic
aaagagataaaacttttttacgactccatcagaaagaggtttaatatttttgtgagaccatcgaagagagaaaga

SEQ ID NO: 345983 - DNA, 75 bp, Artificial Sequence
  Synthetic
tgttcccggacacaaattatggcgtttgtattcgttgtctttacactttccatcggatggtgcatgcggtgctat

SEQ ID NO: 345984 - DNA, 75 bp, Artificial Sequence
  Synthetic
ttgtattcgttgtctttacactttccatcggatggtgcatgcggtgctatatctcttccgtttattattatacat

SEQ ID NO: 345985 - DNA, 75 bp, Artificial Sequence
  Synthetic
gatggtctcataaaaaaagttttacaaaaatatttttattctctttctctcttcaatggtctcataaaaatatta

SEQ ID NO: 345986 - DNA, 75 bp, Artificial Sequence
  Synthetic
aaaaatatttttattctctttctctcttcaatggtctcataaaaatattaaacctctttctgatgtttcaactat

SEQ ID NO: 345987 - DNA, 75 bp, Artificial Sequence
  Synthetic
tcctacttctccaatcatatagatattttctttctatcatggataatatttgtaatggttctttccgtacaacat

SEQ ID NO: 345988 - DNA, 75 bp, Artificial Sequence
  Synthetic
ccctatgcccatctaggttactagacaattgcatcataaaataatgtttataatttacacgttaacatcatataa

SEQ ID NO: 345989 - DNA, 75 bp, Artificial Sequence
  Synthetic
tacttattctgattcttctagccatttccgtgttcgttcgaatgccacatcgacgttaaagataggggagtagtt

SEQ ID NO: 345990 - DNA, 75 bp, Artificial Sequence
  Synthetic
aatttattgagtgctttgtcgacgagtttacttttacgctccatcgatagatggcactgttctatgagatcgtcg

SEQ ID NO: 345991 - DNA, 75 bp, Artificial Sequence
  Synthetic
ccatataggggatactgctcacgttttttctttggtacaaaatttcacacaagtttttatacagacaaatattct

SEQ ID NO: 345992 - DNA, 75 bp, Artificial Sequence
  Synthetic
agagataaaacttttttacgactccatcagaaagaggtttaatatttttgtgagaccatcgaagagagaaagaga

SEQ ID NO: 345993 - DNA, 75 bp, Artificial Sequence
  Synthetic
cttatcgaatgatatatttttcataaatacacttttatagtcctcgtttaaacagaatttactatgtagttccgc

SEQ ID NO: 345994 - DNA, 75 bp, Artificial Sequence
  Synthetic
tcgtgtacgtaatatcatagcatctattagatatcgtcagagattaattagtctattatccaagaagctggatcc

SEQ ID NO: 345995 - DNA, 75 bp, Artificial Sequence
  Synthetic
gataaaatcacactacatcattgtttccttttagtgctcgacagtgtatactatttttaacgctcataaataaaa

SEQ ID NO: 345996 - DNA, 75 bp, Artificial Sequence
  Synthetic
tttttacgactccatcagaaagaggtttaatatttttgtgagaccatcgaaggagaacttttttacgactccatc

SEQ ID NO: 345997 - DNA, 75 bp, Artificial Sequence
  Synthetic
tccatcagaaagaggtttaatatttttgtgagaccatcgaagagagaaagagataaaacttttttacgactccat

SEQ ID NO: 345998 - DNA, 75 bp, Artificial Sequence
  Synthetic
gtgtcgtcgttcaatttatacggatttctatagttctctgttatataatgcggttttccatcatgattagacgac

SEQ ID NO: 345999 - DNA, 75 bp, Artificial Sequence
  Synthetic
tgcagggtattgttttgaagaaatgatatcgagaacagatttgatacgatatttgttggattcctgattatttac

SEQ ID NO: 346000 - DNA, 75 bp, Artificial Sequence
  Synthetic
cctacatggattttactagatcatttatataccaaaaaatattatacgatctacgttttattatatgattttaac

SEQ ID NO: 346001 - DNA, 75 bp, Artificial Sequence
  Synthetic
taaatgtttttatcatcttggacggaatcgattttgtaatatgtcatggaaacaaatgaaacaggacattatcgc

SEQ ID NO: 346002 - DNA, 75 bp, Artificial Sequence
  Synthetic
ctacgttttattatatgattttaacgtgtaaattataaacattattttatgatatacaattgtctggtaacctag

SEQ ID NO: 346003 - DNA, 75 bp, Artificial Sequence
  Synthetic
gtatctcaatctgtggcgtttgcttcgtttaaataatatatcaaacatggagacgcctgatatgtaggcattctt

SEQ ID NO: 346004 - DNA, 75 bp, Artificial Sequence
  Synthetic
agaaagaggtttaatatttttgtgagaccatcgaagagagaaagagaataaaaatattttatgactccattgaag

SEQ ID NO: 346005 - DNA, 75 bp, Artificial Sequence
  Synthetic
cagattatttacaaacttggtattttttggttctggaggaggcgaatttaaattcggacttggattcggattttg

SEQ ID NO: 346006 - DNA, 75 bp, Artificial Sequence
  Synthetic
ataaaaatattttagtgacaccatcagaaagaggtttaatattttttatgagaccatcaaagagagaaagagaat

SEQ ID NO: 346007 - DNA, 75 bp, Artificial Sequence
  Synthetic
atgtaacctactagaatgatagttcgtgtactagtcataatatctttaatccaatctaagaaatttaaaattaga

SEQ ID NO: 346008 - DNA, 75 bp, Artificial Sequence
  Synthetic
acaatgctcagtaaatgtatcgtgtctcattaaaaatttggcaacgagtacatctactatattaacatctaaaca

SEQ ID NO: 346009 - DNA, 75 bp, Artificial Sequence
  Synthetic
ccgtattgattatcgagcgtgatgttgtaacactcgctccatattccaataaccgctttgcaaattgtatattat

SEQ ID NO: 346010 - DNA, 75 bp, Artificial Sequence
  Synthetic
gtatatcaaatacatctatcagtatggtttcataacagtgatacccgcaattattaaatctcgataatatcagac

SEQ ID NO: 346011 - DNA, 75 bp, Artificial Sequence
  Synthetic
aacataacaatgagcaagttctataagctagttaactaataaataaaaagtttaatttgttgacgacgtatgtcg

SEQ ID NO: 346012 - DNA, 75 bp, Artificial Sequence
  Synthetic
atcatcagaataaatcaatatctctgtttttttgttatacagatgtattacagcctcatatattacgtaatagaa

SEQ ID NO: 346013 - DNA, 75 bp, Artificial Sequence
  Synthetic
attaacaaagtagtcgtgcagaggatagttgttgtccgttatctaacatgcatcgaacgaccatatcgccgtaat

SEQ ID NO: 346014 - DNA, 75 bp, Artificial Sequence
  Synthetic
attttacaaatctataacatgctaaaccttttgacgacaaccattcattaatttctgatatggaatctgtattct

SEQ ID NO: 346015 - DNA, 75 bp, Artificial Sequence
  Synthetic
cgagaggtaactttttgtgaatgtagttaagaacatttttgttttgcaaaccggaatatagtgtccggtacactt

SEQ ID NO: 346016 - DNA, 75 bp, Artificial Sequence
  Synthetic
ctcaagacaattgcatttagattatattatcatgaataaaaatagtagcacacaactacttcagcaaacattctt

SEQ ID NO: 346017 - DNA, 75 bp, Artificial Sequence
  Synthetic
atatcacaaaaataaatccacatttggctaatcaatttcgggcttggaaaaaacgtatcgccggaagggactata

SEQ ID NO: 346018 - DNA, 75 bp, Artificial Sequence
  Synthetic
tggttgagaaagaccggtagtattggatgggtaaagatcctccttcgtctctgccatggatggaaacattgttat

SEQ ID NO: 346019 - DNA, 75 bp, Artificial Sequence
  Synthetic
ctgccatggatggaaacattgttatcgatcaaacatttaattacatccttggatagagattgagattctctatga

SEQ ID NO: 346020 - DNA, 75 bp, Artificial Sequence
  Synthetic
ctctattctgaaataattagaactagaaacatgtttagaaagaaacgattatttctgaattattccaattatttg

SEQ ID NO: 346021 - DNA, 75 bp, Artificial Sequence
  Synthetic
gacgatatatagtaatgaagagagttcttacacatatcactgtcgtacatacaggtacgaaatacgtaaccggtg

SEQ ID NO: 346022 - DNA, 75 bp, Artificial Sequence
  Synthetic
acaggtacgaaatacgtaaccggtgctgtaacattctgatttaagaagccatagcaatacttctggtctcggatt

SEQ ID NO: 346023 - DNA, 75 bp, Artificial Sequence
  Synthetic
tttgtagagatcttataaaactgtcgaatgacatcgcatttatatctttagctaaatcgtatatgttaccatcgt

SEQ ID NO: 346024 - DNA, 75 bp, Artificial Sequence
  Synthetic
acagatcgaaatcatttatattcgacttgagttcgttagaggaattcgaatagctggatatcagtagatgcacaa

SEQ ID NO: 346025 - DNA, 75 bp, Artificial Sequence
  Synthetic
atcctttgccaaccaatacatatagctaaactcaggcatatgttccacacatccagtgcaacgaaattctccaga

SEQ ID NO: 346026 - DNA, 75 bp, Artificial Sequence
  Synthetic
aacaatcttaatgtctgtatcgcatttattgaagacgtaacaatgtagcgcattgtttcctcgtctatctatatg

SEQ ID NO: 346027 - DNA, 75 bp, Artificial Sequence
  Synthetic
acatgcatgccaggacgatatattgtttcatgattgctattgattgagtactgttctttatgattctacttcctt

SEQ ID NO: 346028 - DNA, 75 bp, Artificial Sequence
  Synthetic
tttattcaacatgtactgtacccactatgaataacgctaaattaacgtctaccgaaacatcgtttaatgataacc

SEQ ID NO: 346029 - DNA, 75 bp, Artificial Sequence
  Synthetic
tttactaagaaagtttctctactgtatctaccacacttctagatatccagatagagattcgatggtttgtcatcg

SEQ ID NO: 346030 - DNA, 75 bp, Artificial Sequence
  Synthetic
agttggatgaatagtatgtcttaataattgttattatttcattaattaatatttagtaacgagtacactctataa

SEQ ID NO: 346031 - DNA, 75 bp, Artificial Sequence
  Synthetic
ttattgaagacgtaacaatgtagcgcattgtttcctcgtctatctatatgtttcaatctctggttttattttttt

SEQ ID NO: 346032 - DNA, 75 bp, Artificial Sequence
  Synthetic
agcagtgcggatatgatccaagagggtgagatagtcgttctcgttcagaatctttcgcagcataagtagtatgtc

SEQ ID NO: 346033 - DNA, 75 bp, Artificial Sequence
  Synthetic
gtgagatagtcgttctcgttcagaatctttcgcagcataagtagtatgtcgatatacttatcgttgaagactctt

SEQ ID NO: 346034 - DNA, 75 bp, Artificial Sequence
  Synthetic
aagagctccgttgcatcagttctgaaagagatgagaagcctgtagagagaccctgcagtttctctatgggtccat

SEQ ID NO: 346035 - DNA, 75 bp, Artificial Sequence
  Synthetic
ctatgagaaacccacaggatgtattcagtcagacaatgtctgacgtcggccacggtattcagggagtccttagta

SEQ ID NO: 346036 - DNA, 75 bp, Artificial Sequence
  Synthetic
agggtggatatttgttcattggagttgataataatacacacaaagtatttggattcacggtgggttacgactacc

SEQ ID NO: 346037 - DNA, 75 bp, Artificial Sequence
  Synthetic
ggtagacctgtagccgtttatgctaatagagggctttaatttccatttttttaatgggttgtggatgaggaatga

SEQ ID NO: 346038 - DNA, 75 bp, Artificial Sequence
  Synthetic
gttatgtagaggtgtatttcctatattatttactttcggtttcatattttaccaactctttaataaatttctttt

SEQ ID NO: 346039 - DNA, 75 bp, Artificial Sequence
  Synthetic
aatcaagtctagaatatatagtggattaatatatttttatattagctaaagctatctatactatcagaaagcata

SEQ ID NO: 346040 - DNA, 75 bp, Artificial Sequence
  Synthetic
gataagctaattcactaaacacattatcgatttcggtatcgttactcgcagaataaagttcgttatgatcctgat

SEQ ID NO: 346041 - DNA, 75 bp, Artificial Sequence
  Synthetic
gctatctatactatcagaaagcatatcattctcaacttcatcatgagttaaatatttgtgtaatggatgtcatga

SEQ ID NO: 346042 - DNA, 75 bp, Artificial Sequence
  Synthetic
taccttctactagtttgtttatatcacagcattctacaaacagtctaaacaatagagaagacggacagactttaa

SEQ ID NO: 346043 - DNA, 75 bp, Artificial Sequence
  Synthetic
agcatagtttttcataattaatacaatatttaaaagacttattcggaaagtattttaatacatgtatcatcgatt

SEQ ID NO: 346044 - DNA, 75 bp, Artificial Sequence
  Synthetic
acttccaccgcatagttgtttgcaaatacggttaatcctttgacctcgtcgatttccgaccaatctgggcgtata

SEQ ID NO: 346045 - DNA, 75 bp, Artificial Sequence
  Synthetic
ttaataaatcaacagaaatatttaatcctccgtttgatacagatgcgccatatttatggatttcggattcacacg

SEQ ID NO: 346046 - DNA, 75 bp, Artificial Sequence
  Synthetic
atatttaaaagacttattcggaaagtattttaatacatgtatcatcgattatataatggatggagatccatatga

SEQ ID NO: 346047 - DNA, 75 bp, Artificial Sequence
  Synthetic
tgtgaatatcattctgcgatgcaagcatataaaagtaatatcattttaaaaaaatcatcaatttctcaacgagta

SEQ ID NO: 346048 - DNA, 75 bp, Artificial Sequence
  Synthetic
aaaatcatcaatttctcaacgagtaatgaactgaaattccagtaccaaactggttttaaaagagttaaactattt

SEQ ID NO: 346049 - DNA, 75 bp, Artificial Sequence
  Synthetic
tactcccttgcatcatatacgttcgtcaccagatcgtttgtttcggcctgaagttggtgcatatctttttcaaca

SEQ ID NO: 346050 - DNA, 75 bp, Artificial Sequence
  Synthetic
tcaatattgtattgttatttttatattatttacacaattaacaatatattattagtttatattactgaattaata

SEQ ID NO: 346051 - DNA, 75 bp, Artificial Sequence
  Synthetic
ataaggatacgctactaaaatattttacttaggactggagttagaatttatagacgactcatttcgtttatcatt

SEQ ID NO: 346052 - DNA, 75 bp, Artificial Sequence
  Synthetic
gcagttttgttcattaatagtatacatgctaaaataactagttataagtttgaatccgtcaattttgattccaaa

SEQ ID NO: 346053 - DNA, 75 bp, Artificial Sequence
  Synthetic
ttattagcgtacacattttggaagttccggctgccatgtatttcctggagagcaagtagatgatgaggaaccaga

SEQ ID NO: 346054 - DNA, 75 bp, Artificial Sequence
  Synthetic
caacagatattccagctatcagattatgcggtccagagggagatggatattgtttacacggtgactgtatccacg

SEQ ID NO: 346055 - DNA, 75 bp, Artificial Sequence
  Synthetic
tctgattccctggcacgtttaagatcttcatgcaattgagtcagctcttaacttcctctcttgcttcttcgtcat

SEQ ID NO: 346056 - DNA, 75 bp, Artificial Sequence
  Synthetic
ctagagatatcgacggtatgtattgtagatgctctcatggttatacaggcattagatgtcagcatgtagtattag

SEQ ID NO: 346057 - DNA, 75 bp, Artificial Sequence
  Synthetic
attagatgtcagcatgtagtattagtagactatcaacgttcagaaaacccaaacactacaacgtcatatatccca

SEQ ID NO: 346058 - DNA, 75 bp, Artificial Sequence
  Synthetic
tctattatctgtttataggttcactcgaagaactaataaactacctctacaagatatggttgtgccataattttt

SEQ ID NO: 346059 - DNA, 75 bp, Artificial Sequence
  Synthetic
ttggcgtcctctataatattcccagaaaagatattttcgtgttttagtttatcgagatctaatctgttcatatac

SEQ ID NO: 346060 - DNA, 75 bp, Artificial Sequence
  Synthetic
tgatatggatgtagaaagcgcataatacgatctataaaaataagtatataaatactttttatttactgtactctt

SEQ ID NO: 346061 - DNA, 75 bp, Artificial Sequence
  Synthetic
ctctagatattatacaaaaattttttatttcggcatattaaagtaaaatctagttaccttgaaaatgaatacagt

SEQ ID NO: 346062 - DNA, 75 bp, Artificial Sequence
  Synthetic
tatttcggcatattaaagtaaaatctagttaccttgaaaatgaatacagtgggtggttccgtatcaccagtaaga

SEQ ID NO: 346063 - DNA, 75 bp, Artificial Sequence
  Synthetic
ctacggcagatatacctactccgccaccaacgggtcatgtgacaagggagaatatcttgataagaggcataatca

SEQ ID NO: 346064 - DNA, 75 bp, Artificial Sequence
  Synthetic
cggtatgttggtaacgacaaataccgatcggtaatcgtttgccggtgtaatagaattatatatatctatctatta

SEQ ID NO: 346065 - DNA, 75 bp, Artificial Sequence
  Synthetic
ttttgaccgtgcgtaaaatgactcgagtatttaataaatttccagatatggcttattatcgaggagactgtttaa

SEQ ID NO: 346066 - DNA, 75 bp, Artificial Sequence
  Synthetic
cttcagaaaagtcaaatattgtatccatacatacatctccaaaactatcgcttatacgtttatctttaacgatac

SEQ ID NO: 346067 - DNA, 75 bp, Artificial Sequence
  Synthetic
catacatacatctccaaaactatcgcttatacgtttatctttaacgatacctatacctagatggttatttactaa

SEQ ID NO: 346068 - DNA, 75 bp, Artificial Sequence
  Synthetic
tatggatgtaaaaagcgcgtaatactatctataaacataagtatataataaatactttttatttacggtactctt

SEQ ID NO: 346069 - DNA, 75 bp, Artificial Sequence
  Synthetic
ccaagtaatgatcatctattgttatataacaataacataactcttttccgtttttatcagtatgtatatctatat

SEQ ID NO: 346070 - DNA, 75 bp, Artificial Sequence
  Synthetic
ataacaataacataactcttttccgtttttatcagtatgtatatctatatcaacgtcgtcgttgtagtgaatagt

SEQ ID NO: 346071 - DNA, 75 bp, Artificial Sequence
  Synthetic
tttttatcagtatgtatatctatatcaacgtcgtcgttgtagtgaatagtagtcattgatctattatatgaaacg

SEQ ID NO: 346072 - DNA, 75 bp, Artificial Sequence
  Synthetic
tacgtccagttaacactttcgttgatttaaagtctagagtctttgcaaacataatatccttatccgactttatat

SEQ ID NO: 346073 - DNA, 75 bp, Artificial Sequence
  Synthetic
tttaaagtctagagtctttgcaaacataatatccttatccgactttatatttcctgtagggtggtataattttat

SEQ ID NO: 346074 - DNA, 75 bp, Artificial Sequence
  Synthetic
tatagttattagttaagggtacccaattagaacacgtacgcttattatcatcatttggatcgtatttcataaaag

SEQ ID NO: 346075 - DNA, 75 bp, Artificial Sequence
  Synthetic
ttctacattttttaatcgtctatatagtatttttctgatattttctataatatcagaattgtcttccatcggaag

SEQ ID NO: 346076 - DNA, 75 bp, Artificial Sequence
  Synthetic
tccttatacaatcaaattcattattaaacagtttaatagtctgtagacctttatcgtcgtaaatatccattgtct

SEQ ID NO: 346077 - DNA, 75 bp, Artificial Sequence
  Synthetic
ttttacgttgctttattatattttataagaatgattgtttgacgaatcacgagaactattaagacacattattag

SEQ ID NO: 346078 - DNA, 75 bp, Artificial Sequence
  Synthetic
taagaatgattgtttgacgaatcacgagaactattaagacacattattaggtatatattataaaaaagtttttga

SEQ ID NO: 346079 - DNA, 75 bp, Artificial Sequence
  Synthetic
acacattaacatcatacatcaattaactacattcttataacatcgtaatcaaaagaattgcaattttgatgtata

SEQ ID NO: 346080 - DNA, 75 bp, Artificial Sequence
  Synthetic
gtgaaaaagtcaagaacgttcacattggcggacaatctaaaaacaatacagtgattgcagatttgccatatatgg

SEQ ID NO: 346081 - DNA, 75 bp, Artificial Sequence
  Synthetic
tcaacgaatatcgataacatgtgtcatttatacgttaaagtctgtccgtcttctctattgtttagactgtttgta

SEQ ID NO: 346082 - DNA, 75 bp, Artificial Sequence
  Synthetic
agtatatttggattaattagatatagagaatatgatccgtaacatatacaacttttattatggcgtctaagatat

SEQ ID NO: 346083 - DNA, 75 bp, Artificial Sequence
  Synthetic
taggactttgtattcagtatttttggaatcataaaaaataaaaaaaagttttactaatttaaaatttaaaaagta

SEQ ID NO: 346084 - DNA, 75 bp, Artificial Sequence
  Synthetic
gaatcataaaaaataaaaaaaagttttactaatttaaaatttaaaaagtatttacatttttttcactgtttagtc

SEQ ID NO: 346085 - DNA, 75 bp, Artificial Sequence
  Synthetic
taaattcatatcacgtagccattcttcccatgaatgtttccttttttaccaaaggaaatgcctcgttgattattc

SEQ ID NO: 346086 - DNA, 75 bp, Artificial Sequence
  Synthetic
tcatatgtatttcacgttctttgatgtggatacatcgtctcatctgtttaagctagttattaaacactgcgatct

SEQ ID NO: 346087 - DNA, 75 bp, Artificial Sequence
  Synthetic
ggatgaactcacttctcttcattactactgtaaacacatatccacgttctacgaaagcaattattacaagttaag

SEQ ID NO: 346088 - DNA, 75 bp, Artificial Sequence
  Synthetic
tctgtcaaatcatctttcggagaacccatatatacaccaaatatagcggcgtacaacttatccatttatacattg

SEQ ID NO: 346089 - DNA, 75 bp, Artificial Sequence
  Synthetic
gttggaggacatccgagttcattgttttcaatatcaaaaaagatggtttcttatcatttctccatagtggtacaa

SEQ ID NO: 346090 - DNA, 75 bp, Artificial Sequence
  Synthetic
gcggatatggaattcgatcctgccaaaatcaatatatcatgtaacaatattacaatacatagatgaaccaaatga

SEQ ID NO: 346091 - DNA, 75 bp, Artificial Sequence
  Synthetic
tattctacgatagagtgctactttaagatgcgacagatctgtgtcatcaaaaatatactccattaaaatgattat

SEQ ID NO: 346092 - DNA, 75 bp, Artificial Sequence
  Synthetic
cattgtttatggtgatgtttatcttcttccagcgcatatagtctaatagcgattcaaacgcgtgatagtttatac

SEQ ID NO: 346093 - DNA, 75 bp, Artificial Sequence
  Synthetic
atgatatcactctcattcctcatccacaacccattaaaaaaatggaaattaaagccctctattagcataaacggc

SEQ ID NO: 346094 - DNA, 75 bp, Artificial Sequence
  Synthetic
ccaataatacaacaaccatttctgagttggatatcatcaaaatactaaataaatacgaggacgtgtatagagtaa

SEQ ID NO: 346095 - DNA, 75 bp, Artificial Sequence
  Synthetic
tgtcctatatgtcgtacccgttttagaaacataacaatgagcaagttctataagctagttaactaataaataaaa

SEQ ID NO: 346096 - DNA, 75 bp, Artificial Sequence
  Synthetic
taaaaatagtagcacgcactacttcagccaaatattcttttttgaaacgccatctatcgtagtgaggacacaagt

SEQ ID NO: 346097 - DNA, 75 bp, Artificial Sequence
  Synthetic
atcctttgccaaccaatacatatagctaaactcaggcatatgttccacacatcctgaacaatgaaattctccaga

SEQ ID NO: 346098 - DNA, 75 bp, Artificial Sequence
  Synthetic
tgttttctagatggaaatattgtttacgagcgattaaactgtttattaatgatcacatgcttgataagataaaat

SEQ ID NO: 346099 - DNA, 75 bp, Artificial Sequence
  Synthetic
atcctgaacaatgaaattctccagaagatgttacaatgtctagatttggacatttggtttcaaccgcgttaacat

SEQ ID NO: 346100 - DNA, 75 bp, Artificial Sequence
  Synthetic
aaaatctccattctcttctctgcatttattatcttgtttcggtggctgattaggctgtagtcttggtttaggctt

SEQ ID NO: 346101 - DNA, 75 bp, Artificial Sequence
  Synthetic
ctccccacattccaccgccaccagatgtataagttttagtacctttattactaccatcatgtccatggataaaga

SEQ ID NO: 346102 - DNA, 75 bp, Artificial Sequence
  Synthetic
catatgctacgttgataaataaatctgaaccactaagtagataatgattaatgttaaggaagaggaaatattcag

SEQ ID NO: 346103 - DNA, 75 bp, Artificial Sequence
  Synthetic
agatgttacaatgtctagatttggacatttggtttcaaccgcgttaacatatgagtgaacacacccatacatgaa

SEQ ID NO: 346104 - DNA, 75 bp, Artificial Sequence
  Synthetic
gttttaagtaaatgatcactggcttctttagtcaatggatattcgaacattaaccgtttcatcatcattggacag

SEQ ID NO: 346105 - DNA, 75 bp, Artificial Sequence
  Synthetic
ttatttatcaattttaaaggtataaaaaatacttattgttgctcgaatattttgtatttgatggtatacggaaga

SEQ ID NO: 346106 - DNA, 75 bp, Artificial Sequence
  Synthetic
aaaatacttattgttgctcgaatattttgtatttgatggtatacggaagattagaaatgtaggtattatcatcaa

SEQ ID NO: 346107 - DNA, 75 bp, Artificial Sequence
  Synthetic
tccaaatgctgtctgtgaaacagataaatggaaatacgaaaatccatgcaaaaaaatgtgcacagtttctgatta

SEQ ID NO: 346108 - DNA, 75 bp, Artificial Sequence
  Synthetic
ccccaggacaaggtaaggactctcccgcgatcactcatgaagaagctcttgctatgatcaaagactgtgaggtgt

SEQ ID NO: 346109 - DNA, 75 bp, Artificial Sequence
  Synthetic
ataatatcatatgcttccacatatattttattttgttttaactcataatactcacgtaattctggattattggca

SEQ ID NO: 346110 - DNA, 75 bp, Artificial Sequence
  Synthetic
ctcacgtaattctggattattggcatatctatgaataattttagctccatgatcagtaaatattaatgagaacat

SEQ ID NO: 346111 - DNA, 75 bp, Artificial Sequence
  Synthetic
aacaactattttttatgttaaatcaattagtacaccgctatgtttaatacttattcatattttagtttttaggat

SEQ ID NO: 346112 - DNA, 75 bp, Artificial Sequence
  Synthetic
gatatttctctcaatgaatcaatcacataatctaatgtaggtttatgacataatagcattttcagcagttcaatg

SEQ ID NO: 346113 - DNA, 75 bp, Artificial Sequence
  Synthetic
cggacaacaactatcctctgcacgactactttgttaataataatctcgtcgatgtaaacgtcgtaaggtttatcg

SEQ ID NO: 346114 - DNA, 75 bp, Artificial Sequence
  Synthetic
taatagcattttcagcagttcaatgtttctagattcgttgatggcaatggctatacatgtatatccgttatttga

SEQ ID NO: 346115 - DNA, 75 bp, Artificial Sequence
  Synthetic
gtcaatcgccatttgttcgtatgtcataaattctttaattatatgacactgtgtattgtttagttcatccttgtt

SEQ ID NO: 346116 - DNA, 75 bp, Artificial Sequence
  Synthetic
tctagcagtaaagatactagagattgtttattatatctaacagccttgtgaagaagtgtttctcctcgtttgtca

SEQ ID NO: 346117 - DNA, 75 bp, Artificial Sequence
  Synthetic
ttgtttagataatccgcctctaatatagggctgacgtcgtatactctacacgtgtccacatcctttattaataat

SEQ ID NO: 346118 - DNA, 75 bp, Artificial Sequence
  Synthetic
caaagaccctttttgtatgtataagtgtagaaattataacattcatagttggatttacataggtgtccaatcggg

SEQ ID NO: 346119 - DNA, 75 bp, Artificial Sequence
  Synthetic
ggtgaatattgcaactacctacgtaattatagacttgatccattttctccatgcaaactatctaaatgtaattaa

SEQ ID NO: 346120 - DNA, 75 bp, Artificial Sequence
  Synthetic
gatatttcatcgtgtaagaatcaatattaatatttctaaagtatccgtgtatagcctctttatttaccacagttc

SEQ ID NO: 346121 - DNA, 75 bp, Artificial Sequence
  Synthetic
gaacatataaatgtagactctattaaacagttgtgtaaaatatcaaatcctaatgcatgttatagatgtggatgt

SEQ ID NO: 346122 - DNA, 75 bp, Artificial Sequence
  Synthetic
acaatttaacgatgtctatatctatatgagatgacttaatataatattgaagagctgtacaatagtttttatcta

SEQ ID NO: 346123 - DNA, 75 bp, Artificial Sequence
  Synthetic
atccagtagacgacatagaatagtgcactctctaccacaataatccatagctattctggtgctaattattcctat

SEQ ID NO: 346124 - DNA, 75 bp, Artificial Sequence
  Synthetic
gtttccatgacatattacaaaatcgattccgtccaagatgataaaaacatttaccggcatcataaacacggagtt

SEQ ID NO: 346125 - DNA, 75 bp, Artificial Sequence
  Synthetic
cgcacatatgctctcgtatccgactctgaatacagatgagagatgatatacagatgcaatacggtaccgcaattt

SEQ ID NO: 346126 - DNA, 75 bp, Artificial Sequence
  Synthetic
tgtcattacataattttctataactgaacgatggttttcacatttaacactcaagtcaaatccatgttctaccaa

SEQ ID NO: 346127 - DNA, 75 bp, Artificial Sequence
  Synthetic
tccagtggcttctagtagagccatcgctatatcctttaactttaacatgtctactatttgtgtattcttctaatg

SEQ ID NO: 346128 - DNA, 75 bp, Artificial Sequence
  Synthetic
ctacgaatatctgtcacagatatcatctttagagaatactagttgcgttaatagtactaaaatttgtattttttt

SEQ ID NO: 346129 - DNA, 75 bp, Artificial Sequence
  Synthetic
gtagtttgacgacctcaacattattacaatgcttattaaaaaggtatgcgtgtaaagcattattcttgaattggt

SEQ ID NO: 346130 - DNA, 75 bp, Artificial Sequence
  Synthetic
attttaattgctcgtcggtattcgaaatcgcgactccggaaccaattactgataatgtagaagatcatacagaca

SEQ ID NO: 346131 - DNA, 75 bp, Artificial Sequence
  Synthetic
agagccacctcctcattttccaaatagtcaaacattttgactgaatagaagtgaatgagctactgtgaactctat

SEQ ID NO: 346132 - DNA, 75 bp, Artificial Sequence
  Synthetic
ctgtttatcacacgcgtttggatctgcgccgtgcgtcagcagcatcgcgactattctattattaattttagaagc

SEQ ID NO: 346133 - DNA, 75 bp, Artificial Sequence
  Synthetic
gtgaatgagctactgtgaactctatacacccacacaactaatgtcattaaatattatttttttgaatgtatttat

SEQ ID NO: 346134 - DNA, 75 bp, Artificial Sequence
  Synthetic
agtcctagttgtatactgagaattgacgaaacaatgtttcttacatatttttttcttattagtaaccgacttaat

SEQ ID NO: 346135 - DNA, 75 bp, Artificial Sequence
  Synthetic
gcgtttaaaaaaattatacggagatgccgtaataatttccttattcacttgtataatttccccattgatagaaaa

SEQ ID NO: 346136 - DNA, 75 bp, Artificial Sequence
  Synthetic
tgcagagtatcgttgagacctcccacaacggacaccgacgtcttttggataagtaatggtatgtattacgaagaa

SEQ ID NO: 346137 - DNA, 75 bp, Artificial Sequence
  Synthetic
catacactacagtaagtacatcatctggaattgtcactactaaatcaaccaccgatgatgcggatctttatgata

SEQ ID NO: 346138 - DNA, 75 bp, Artificial Sequence
  Synthetic
aggttagcgctcagaatatctcattcaaatccataaataaagtatatgggcgatattctgccgtgtttaaagatt

SEQ ID NO: 346139 - DNA, 75 bp, Artificial Sequence
  Synthetic
ctccgttaaccccactttttacaccactggacgatcctcctccccacattccaccgccaccagatgtataagttt

SEQ ID NO: 346140 - DNA, 75 bp, Artificial Sequence
  Synthetic
cacacacaatctctgcgtcagaacgctcgtcaatatagatcttagacatttttagagagaactaacgcaatcagt

SEQ ID NO: 346141 - DNA, 75 bp, Artificial Sequence
  Synthetic
gtaaaactttttttatgagaccatcagaaagaggtttaatatttttgtgataccctgaaaggaaataggaatagg

SEQ ID NO: 346142 - DNA, 75 bp, Artificial Sequence
  Synthetic
agagcaatactaccaacctacactattatatgattatagtttctatttttataggaacgcgtacgagaaaatcaa

SEQ ID NO: 346143 - DNA, 75 bp, Artificial Sequence
  Synthetic
ttatatgattatagtttctatttttataggaacgcgtacgagaaaatcaaatgtctaatttctaacggtagtgtt

SEQ ID NO: 346144 - DNA, 75 bp, Artificial Sequence
  Synthetic
aataggaatagtgtcataatcgtatcacactattgagacagaaaaagaagaagtcgcgagaggtaactttttgtg

SEQ ID NO: 346145 - DNA, 75 bp, Artificial Sequence
  Synthetic
acattttccattattaataagaatgactcctatgtttcccctataatcttcgtctattacaccgcctcctatatc

SEQ ID NO: 346146 - DNA, 75 bp, Artificial Sequence
  Synthetic
cttactttgttctattaacttattagcattatatattatttgattataaaacttatattgcttattagcccaatc

SEQ ID NO: 346147 - DNA, 75 bp, Artificial Sequence
  Synthetic
atcgtaattggaaaaatagtgttcgagtgagttggattatgtgagtattggattgtatattttattttatatttt

SEQ ID NO: 346148 - DNA, 75 bp, Artificial Sequence
  Synthetic
tgtacatcactgtaagcatgtccgtaccatttattttaatttgacgcatatccgcaatttctttttcgcagtcgg

SEQ ID NO: 346149 - DNA, 75 bp, Artificial Sequence
  Synthetic
tccgcaatttctttttcgcagtcggttataaattctatatatgatggatacatgctacatgtgtacttataatcg

SEQ ID NO: 346150 - DNA, 75 bp, Artificial Sequence
  Synthetic
ttataaattctatatatgatggatacatgctacatgtgtacttataatcgactaatatgaagtacttgatacata

SEQ ID NO: 346151 - DNA, 75 bp, Artificial Sequence
  Synthetic
gttcattggatgagtaactactaatgtatacattttccatttataacacttatgtattaactttgttcatttata

SEQ ID NO: 346152 - DNA, 75 bp, Artificial Sequence
  Synthetic
atcgacgatcgttgaaccgatgatatcttcgtaactcactttcttatgagagatgttagacccgagtactggatg

SEQ ID NO: 346153 - DNA, 75 bp, Artificial Sequence
  Synthetic
tctaggtaatcaactgttttcttaatacattcgatggttggtaatttactcagaataatttccaatatcttaata

SEQ ID NO: 346154 - DNA, 75 bp, Artificial Sequence
  Synthetic
cagaataatttccaatatcttaatatataattctgctatttctgggatatatttatctgccagtataacacaaat

SEQ ID NO: 346155 - DNA, 75 bp, Artificial Sequence
  Synthetic
tatctattaaccattctactaggctgacactatgcgactcaatacaatgataaagtatactacatccatgtttat

SEQ ID NO: 346156 - DNA, 75 bp, Artificial Sequence
  Synthetic
tcggcgtcaacgctggaaggagtgaactcgccggcgcatcagtatcttcagacagccaatcaaaaagattagaca

SEQ ID NO: 346157 - DNA, 75 bp, Artificial Sequence
  Synthetic
tccaatttattattcttgacgatatcgagatcttttgtataggagtcagacttgtattcaacatgcttttctata

SEQ ID NO: 346158 - DNA, 75 bp, Artificial Sequence
  Synthetic
aggtagggaataatggcataatatttattaggttatcatcattgtcattatctacaactaagtttccatttttta

SEQ ID NO: 346159 - DNA, 75 bp, Artificial Sequence
  Synthetic
tattaggttatcatcattgtcattatctacaactaagtttccattttttaaaatatactcgacaactttaggatc

SEQ ID NO: 346160 - DNA, 75 bp, Artificial Sequence
  Synthetic
aaaatatattaatccactatatattctagacttgatttaaaaccgataaactactactacgtactgtataagttg

SEQ ID NO: 346161 - DNA, 75 bp, Artificial Sequence
  Synthetic
atgtagctccttcatcaatcatacatttaataacattgatgtatactgtatgataagatacatattctaacaata

SEQ ID NO: 346162 - DNA, 75 bp, Artificial Sequence
  Synthetic
tttaataacattgatgtatactgtatgataagatacatattctaacaatagatcttgtatagaatctgtatatct

SEQ ID NO: 346163 - DNA, 75 bp, Artificial Sequence
  Synthetic
tttatctttttttatcgcgttcatagttagatacatggtctcagaagtaggattatgtaacatcagcttcgataa

SEQ ID NO: 346164 - DNA, 75 bp, Artificial Sequence
  Synthetic
ataatgaatgcagatctaataaatggagaataattggaacacaagttgataaaatgttgatagctgaatctgata

SEQ ID NO: 346165 - DNA, 75 bp, Artificial Sequence
  Synthetic
ctaaaatataaaacgtatcacggtcgaataatagttgatcaactatataattatcgattttgtgatttttcttcc

SEQ ID NO: 346166 - DNA, 75 bp, Artificial Sequence
  Synthetic
gaataatagttgatcaactatataattatcgattttgtgatttttcttcctaaactgtttacgtaaatagttaga

SEQ ID NO: 346167 - DNA, 75 bp, Artificial Sequence
  Synthetic
caaatatttcccgtttaatatcgcatttgtcaagataataatagagtgtggtatgttcacgataagtataataac

SEQ ID NO: 346168 - DNA, 75 bp, Artificial Sequence
  Synthetic
atagtttatcacgtccaaagatgtagcataaccatcttgtgacctagtaataatataataatagagaactgtttt

SEQ ID NO: 346169 - DNA, 75 bp, Artificial Sequence
  Synthetic
attcatcatcccaattataatattcaccagcacgtctaatctgttctattttgatcttgtatccatactgtatgt

SEQ ID NO: 346170 - DNA, 75 bp, Artificial Sequence
  Synthetic
tagatagagagaaagaagaaatactaaaaaatgtagaaattgaaaataataaaaacattaacaagaatcatccca

SEQ ID NO: 346171 - DNA, 75 bp, Artificial Sequence
  Synthetic
accagcacgtctaatctgttctattttgatcttgtatccatactgtatgttgctacatgtaggtattcctttatc

SEQ ID NO: 346172 - DNA, 75 bp, Artificial Sequence
  Synthetic
ggttcgcatttatctgcggaagagacggtgtgagaatatgttccgagaccacacggagaacagatgacgtctccg

SEQ ID NO: 346173 - DNA, 75 bp, Artificial Sequence
  Synthetic
ttcgaatatatcaaaatcattgatatttttatagtcgactgacgacaataacaaaatcacaacatcgtttttgat

SEQ ID NO: 346174 - DNA, 75 bp, Artificial Sequence
  Synthetic
tttttatagtcgactgacgacaataacaaaatcacaacatcgtttttgatattattatttttcttggtaacgtat

SEQ ID NO: 346175 - DNA, 75 bp, Artificial Sequence
  Synthetic
acaaaatcacaacatcgtttttgatattattatttttcttggtaacgtatgcctttaatggagtttcaccatcat

SEQ ID NO: 346176 - DNA, 75 bp, Artificial Sequence
  Synthetic
gcatcgatgttaaatgttttacaactatcatagagtatcttatcgttaaccatgattggttgttgatgctatcgc

SEQ ID NO: 346177 - DNA, 75 bp, Artificial Sequence
  Synthetic
gatctttctccggtagatatgtatcatatcttagaaagttttctgcccttccaacaaacgagtttattagttttt

SEQ ID NO: 346178 - DNA, 75 bp, Artificial Sequence
  Synthetic
tcaatggtacaaattttatcctcgctttgtgtatcatattcgtccctactataaaattgtatattcagattatca

SEQ ID NO: 346179 - DNA, 75 bp, Artificial Sequence
  Synthetic
cggatgcaaggcatgtgtttcccaaacaaaatgtggaataggatacggagtatccggagacgtcatctgttctcc

SEQ ID NO: 346180 - DNA, 75 bp, Artificial Sequence
  Synthetic
acatggttactccttaaaaaaatacgaataatcaccttggctatttagtaagtgtcatttaacactatactcata

SEQ ID NO: 346181 - DNA, 75 bp, Artificial Sequence
  Synthetic
aaaattagtgttcgagtgagtcggattatgtgagtattggattgtatatttttatattttgtaataagaataaaa

SEQ ID NO: 346182 - DNA, 75 bp, Artificial Sequence
  Synthetic
tagttgtttgcaaatacggttaatcctttgacctcgtcgatttccgaccaatctgggcgtataatgaatctaaac

SEQ ID NO: 346183 - DNA, 75 bp, Artificial Sequence
  Synthetic
ttcatctttacatactgggtactagttttactatcataagtttataaattccacaagctactatggaataagcca

SEQ ID NO: 346184 - DNA, 75 bp, Artificial Sequence
  Synthetic
tattctccagatgaatgggtgtcacatataaaattttaattaatgtaactatagagaacaaataataggttgtaa

SEQ ID NO: 346185 - DNA, 75 bp, Artificial Sequence
  Synthetic
catcaaaaatatactccattaaaatgattattccggcagcgaacttgatattggatatatcacaacctttgttaa

SEQ ID NO: 346186 - DNA, 75 bp, Artificial Sequence
  Synthetic
gatggtctcatttcatcagtcatactgagccaacaaatataatcgtgtataacatctttgatagaatcagactct

SEQ ID NO: 346187 - DNA, 75 bp, Artificial Sequence
  Synthetic
tcgcgaacgatgcgtacaatctcgtccatctcataatgatttactttttcataattaaagatgtgaaagaaaacc

SEQ ID NO: 346188 - DNA, 75 bp, Artificial Sequence
  Synthetic
ttatcaaagtgtctaggacgcgtaattttcatatggtatagatcctgtaagcattgtctgtattctggagctatt

SEQ ID NO: 346189 - DNA, 75 bp, Artificial Sequence
  Synthetic
tttagttatctgatgaaagataaactaaatatataagtataatcccattctaatactttaacctgatgtattagc

SEQ ID NO: 346190 - DNA, 75 bp, Artificial Sequence
  Synthetic
aatatgttataaatttaaatcgaataacgaacataactttagtaaagtcgtctatattaactcttttattttcta

SEQ ID NO: 346191 - DNA, 75 bp, Artificial Sequence
  Synthetic
tctatattaactcttttattttctagccatcgtaataccatgtttaagatagtatattctctagttactacgatc

SEQ ID NO: 346192 - DNA, 75 bp, Artificial Sequence
  Synthetic
tagatctgttatttcagtcgctgattaatcaattagtagagatgagataagaacattataataatcaataatatt

SEQ ID NO: 346193 - DNA, 75 bp, Artificial Sequence
  Synthetic
ctgaatctacatccaattttagaaattggtctgtgttacatatctcttctatattattgttgatgtattgtcgta

SEQ ID NO: 346194 - DNA, 75 bp, Artificial Sequence
  Synthetic
atattattgttgatgtattgtcgtagaaaactattacgtagaccattttctttataaaacgaatatatagtactc

SEQ ID NO: 346195 - DNA, 75 bp, Artificial Sequence
  Synthetic
gaaaactattacgtagaccattttctttataaaacgaatatatagtactccaattatctttaccgatatatttgc

SEQ ID NO: 346196 - DNA, 75 bp, Artificial Sequence
  Synthetic
gcagcattttgaggatcgcgagtatgaagtacgatgttattgtttactggtatatctggaaagaaatctaccagt

SEQ ID NO: 346197 - DNA, 75 bp, Artificial Sequence
  Synthetic
agatatttggctaaactatataattctattagatcatcaacagaatcagtatatatttttctagatccaaagacg

SEQ ID NO: 346198 - DNA, 75 bp, Artificial Sequence
  Synthetic
gtgttgtctattatctgtttataggttcactcgacgaactaaactacctatacaagatatggttgtgccataatt

SEQ ID NO: 346199 - DNA, 75 bp, Artificial Sequence
  Synthetic
tcccagaaaagatattttcgtgttttagtttatcgagatctgatctgttcatatacgccatgattgtacggtacg

SEQ ID NO: 346200 - DNA, 75 bp, Artificial Sequence
  Synthetic
ctgaacacgttaacgatagtatcaataacgcaatcatgattttatggtattaataattaaccttatttttatgtt

SEQ ID NO: 346201 - DNA, 75 bp, Artificial Sequence
  Synthetic
attcataattgagattgatgtaatactttgttactttgaacgtaaagacagtacacggatccgtatctccaacaa

SEQ ID NO: 346202 - DNA, 75 bp, Artificial Sequence
  Synthetic
aagatgatgtttggcaccttcataaatttttatttctctattacaatttgcatgttgcatgaaataatatgcacc

SEQ ID NO: 346203 - DNA, 75 bp, Artificial Sequence
  Synthetic
ttagatagaaacttatactcatcatctgttttaggaatccatgtattattaccactttccaacttatcattatcc

SEQ ID NO: 346204 - DNA, 75 bp, Artificial Sequence
  Synthetic
tatgttaacgcggttgaaaccaaatgtccaaatctagacattgtaacatcttctggagaatttcattgttcagga

SEQ ID NO: 346205 - DNA, 75 bp, Artificial Sequence
  Synthetic
agaatttatataaatcattccatcgatacatccttctatgttgagatgtatatatccaggaattcttttattaat

SEQ ID NO: 346206 - DNA, 75 bp, Artificial Sequence
  Synthetic
agatgtgatttttcctaaatctaatataaaactcgtttactagcaaacactttcctgatttatcgaccaagacac

SEQ ID NO: 346207 - DNA, 75 bp, Artificial Sequence
  Synthetic
tatgaaatcggacgaggataccaagtttatagaacatctgggtgatggcatcaaagaagatgaaaccgttcgtac

SEQ ID NO: 346208 - DNA, 75 bp, Artificial Sequence
  Synthetic
taacatatattattacattcttgactgtcgctaatatctaaatatttattgttatcgtattggattctgcatata

SEQ ID NO: 346209 - DNA, 75 bp, Artificial Sequence
  Synthetic
tgtcgctaatatctaaatatttattgttatcgtattggattctgcatatagatggcttgtatgtcaaagatatag

SEQ ID NO: 346210 - DNA, 75 bp, Artificial Sequence
  Synthetic
ataagaagactggaactcctaaataagtagatttaatagttaccacgtgctgtaccacatctctaacatacgtac

SEQ ID NO: 346211 - DNA, 75 bp, Artificial Sequence
  Synthetic
ctaataaatttgataattataggttcacttgtgtcctcgctacgctagatggcatttataaaaagaatgtttgct

SEQ ID NO: 346212 - DNA, 75 bp, Artificial Sequence
  Synthetic
agagatttagaaaacattatatcctcggatgatgttatcactgtttctggagtaggatatattaaagtctttaca

SEQ ID NO: 346213 - DNA, 75 bp, Artificial Sequence
  Synthetic
tgttagagtagtatcattaaatctattatattttatgaaaaatatatcactgctcacctctatatttcgtacatt

SEQ ID NO: 346214 - DNA, 75 bp, Artificial Sequence
  Synthetic
tcccatatgatgtttgttttcttcttccgtacacgaggaggaggatgaggatgattgctgaagactggcaggcat

SEQ ID NO: 346215 - DNA, 75 bp, Artificial Sequence
  Synthetic
cttactctatacacgtcctcgtatttatttagtattttgatgatatccaactcagaaatggttgttgtattattg

SEQ ID NO: 346216 - DNA, 75 bp, Artificial Sequence
  Synthetic
ttacaacttttaacaagttgaccaattcatttctaatagtatcaaacgctccatgattaaatattttaatagtat

SEQ ID NO: 346217 - DNA, 75 bp, Artificial Sequence
  Synthetic
ccatgattaaatattttaatagtatccattttatatcactacggacacaaagtagctgacataaaccattgtata

SEQ ID NO: 346218 - DNA, 75 bp, Artificial Sequence
  Synthetic
catgttatagtgtttaacaaagatattaccagttgtggaagactgtacaaggaattgatgaagttcgatgatgtc

SEQ ID NO: 346219 - DNA, 75 bp, Artificial Sequence
  Synthetic
atccgtacttgcacttaaagtttacattgtcgttgtatgagtatgatcttttaaacccgctagacaagtatccgt

SEQ ID NO: 346220 - DNA, 75 bp, Artificial Sequence
  Synthetic
tgatacacgttcactatctccagagagtccgataacgttagccaccacttctctatcaatgattagtttcttgag

SEQ ID NO: 346221 - DNA, 75 bp, Artificial Sequence
  Synthetic
ttaaacccgctagacaagtatccgtttgatattgtaggatgtggacatttaacaatttgacacgtgggtggatcg

SEQ ID NO: 346222 - DNA, 75 bp, Artificial Sequence
  Synthetic
cttctcgcttctccatattaagttgtctagttagttgtgcagcagtagctccttcgattccaatggttttaatag

SEQ ID NO: 346223 - DNA, 75 bp, Artificial Sequence
  Synthetic
tctagttagttgtgcagcagtagctccttcgattccaatggttttaatagcctcacacacaatctctgcgttaga

SEQ ID NO: 346224 - DNA, 75 bp, Artificial Sequence
  Synthetic
aaaatcatctgataatttagataattttaccaaaatactatttggtaagactccgtataaatcaacagaagttaa

SEQ ID NO: 346225 - DNA, 75 bp, Artificial Sequence
  Synthetic
tccactattgcaactataagttacaacgctcccatcggtataaaaatcctcgtatccgttatgtcttccgttgga

SEQ ID NO: 346226 - DNA, 75 bp, Artificial Sequence
  Synthetic
tcgttagaggaattcgaatagctggatatcagtagatgcacaatctgagatttgacgtatctatgcttactgtat

SEQ ID NO: 346227 - DNA, 75 bp, Artificial Sequence
  Synthetic
atcttgatactttttctagaaaaaaaattgaattgatgatataggggtcttcataacgcataattattacgttag

SEQ ID NO: 346228 - DNA, 75 bp, Artificial Sequence
  Synthetic
acagattcacaaataggtgcctcgggattccataccatagatccagtagatcctaattcacaatacgatttagat

SEQ ID NO: 346229 - DNA, 75 bp, Artificial Sequence
  Synthetic
ggagaacagatgacgtctccggatactccgtatcctattccacattttgtttgggaaacacatgccttgcatccg

SEQ ID NO: 346230 - DNA, 75 bp, Artificial Sequence
  Synthetic
ttatcctatcatgtatttgagagttttatatgtagcaaacatgatagctgtgatgccaataagctttagatattc

SEQ ID NO: 346231 - DNA, 75 bp, Artificial Sequence
  Synthetic
tacaagagtacgttatactagagccaaagtctactccaccaatatcaagttggccattatcgatatctcgaggcg

SEQ ID NO: 346232 - DNA, 75 bp, Artificial Sequence
  Synthetic
ttatctggtggtgaaatgtccgttatataatctacaaaacaatcatcgcatatagtatgcgatagtagagtaaac

SEQ ID NO: 346233 - DNA, 75 bp, Artificial Sequence
  Synthetic
ttttttgctttctgtatccaggtagacatagatattctatagtgtctcctatgttgtaattagcattagcatcag

SEQ ID NO: 346234 - DNA, 75 bp, Artificial Sequence
  Synthetic
cagcatgatagaacgcatcctattcccaacaatgtcaggaacgtcacgctctccaccttcatatttatttatccg

SEQ ID NO: 346235 - DNA, 75 bp, Artificial Sequence
  Synthetic
ggaaatatatttgtagtacaacgaatactcccaaactgcattcgtgttacactatataacaattacactacattt

SEQ ID NO: 346236 - DNA, 75 bp, Artificial Sequence
  Synthetic
tgcatgcggtgctatatctcttccgtttattattatacatgagagaaacaatatatacgagtataatacggactt

SEQ ID NO: 346237 - DNA, 75 bp, Artificial Sequence
  Synthetic
agtttcatctttagtaaacatatcataatattcgatattacgagttgacatatcgaacaaattccaagtatttga

SEQ ID NO: 346238 - DNA, 75 bp, Artificial Sequence
  Synthetic
taatattcgatattacgagttgacatatcgaacaaattccaagtatttgattttggataatattcgtattttgca

SEQ ID NO: 346239 - DNA, 75 bp, Artificial Sequence
  Synthetic
aacggtatcaataaacggagcacaccatttagtcataaccgtaatccaaaattttttaaagtatatcttaacgaa

SEQ ID NO: 346240 - DNA, 75 bp, Artificial Sequence
  Synthetic
tacatggttaaagtacatgtacaattctatccatttgtcttccttaactatatatttgtatagataattacgagt

SEQ ID NO: 346241 - DNA, 75 bp, Artificial Sequence
  Synthetic
cataaactatactatgatgtctaggcatgggagacttttttatccaacgatttttagtgaaacattccacatcgt

SEQ ID NO: 346242 - DNA, 75 bp, Artificial Sequence
  Synthetic
ctaaggagatgcggattaactacttgaaattctccagacaatactctccgagtgtaaatattactggtatacggt

SEQ ID NO: 346243 - DNA, 75 bp, Artificial Sequence
  Synthetic
ggtataaactccacccattacatatatatcatcgtttacgaataccgacgcgcctgaatatctaggagtaattaa

SEQ ID NO: 346244 - DNA, 75 bp, Artificial Sequence
  Synthetic
taagaaaacagtttaataaatcaacagaaatatttaatcctccgtttgatacagatgcgccatatttatggattt

SEQ ID NO: 346245 - DNA, 75 bp, Artificial Sequence
  Synthetic
aggtgccaccaataaactatttctaagaccgtatgttctgattttatcttttagaggttcccaattccaaagatc

SEQ ID NO: 346246 - DNA, 75 bp, Artificial Sequence
  Synthetic
gtgccgtgtttcaaatattctgccacacccgttgaaatagaaaattctaatcctcctattacatataactttcca

SEQ ID NO: 346247 - DNA, 75 bp, Artificial Sequence
  Synthetic
tcctcctattacatataactttccatcgttaacacaagtactaacttctgattttaacgacgacatattagtaac

SEQ ID NO: 346248 - DNA, 75 bp, Artificial Sequence
  Synthetic
attttaacgacgacatattagtaaccgttttccattttttcgtttcaagatctacccgcgatacggaataaacat

SEQ ID NO: 346249 - DNA, 75 bp, Artificial Sequence
  Synthetic
aatgtatagacaattatgtaaaacatttgcattatagaattgtctatctgtattaccgactatcgtccaatattc

SEQ ID NO: 346250 - DNA, 75 bp, Artificial Sequence
  Synthetic
cccctttatgtaactgtaaatttctcaacgcgatatctccattaataatgatgtcgaattcgtgctgtataccca

SEQ ID NO: 346251 - DNA, 75 bp, Artificial Sequence
  Synthetic
cctcgtctctactaatcaattcgttggaaaacgtgagtccgggcattaggccacgctttttaagccaaaatatgg

SEQ ID NO: 346252 - DNA, 75 bp, Artificial Sequence
  Synthetic
gtggatatataatcagagtttttaatgactactatattatgttttataccatttcgtgtcactggctttgtagat

SEQ ID NO: 346253 - DNA, 75 bp, Artificial Sequence
  Synthetic
cataaacttgggatgtaaaatgttgatgatatctacatcgtttggatttttatgtatccactttaataatatcat

SEQ ID NO: 346254 - DNA, 75 bp, Artificial Sequence
  Synthetic
gcatacaatactagtctagaaagaaatttgtaatcatcttctgtgacgggagtccatatatctgtatcatcgtct

SEQ ID NO: 346255 - DNA, 75 bp, Artificial Sequence
  Synthetic
atgatatctacatcgtttggatttttatgtatccactttaataatatcatagctgtaacatcctcatgatttacg

SEQ ID NO: 346256 - DNA, 75 bp, Artificial Sequence
  Synthetic
tccaaattctggatcggatgtcaccgcagtaatattgttgattatttctgacatcgacgcattatatagtttttt

SEQ ID NO: 346257 - DNA, 75 bp, Artificial Sequence
  Synthetic
acatcatcgaacttctgatcattaatatgctcatgaacattaggaaatgtttctgatggaggtctatcaataact

SEQ ID NO: 346258 - DNA, 75 bp, Artificial Sequence
  Synthetic
ttgtataatttccccattgatagaaaacgtcacgctttccattcttgaagtactataagtaattatagtataatg

SEQ ID NO: 346259 - DNA, 75 bp, Artificial Sequence
  Synthetic
tactataagtaattatagtataatgtaaacgtttatatattcaatatttttataaaaatcattttgacattaatt

SEQ ID NO: 346260 - DNA, 75 bp, Artificial Sequence
  Synthetic
tgacaaaatcaactacataatcctcatctggaacatttagttcatcgctttctagaataagtttcatagatagat

SEQ ID NO: 346261 - DNA, 75 bp, Artificial Sequence
  Synthetic
ttatatggtatagggagagtataaaacattaaatgcccgtacttattaaagtattcagtagccaatcctaactct

SEQ ID NO: 346262 - DNA, 75 bp, Artificial Sequence
  Synthetic
acattaaatgcccgtacttattaaagtattcagtagccaatcctaactctttcgaatacttattaatggctcttg

SEQ ID NO: 346263 - DNA, 75 bp, Artificial Sequence
  Synthetic
tctatgtatctaaaataatgtctgactagatccgttagtttaatatcctcagtcatcttgtctagaatggcaaat

SEQ ID NO: 346264 - DNA, 75 bp, Artificial Sequence
  Synthetic
ctagatccgttagtttaatatcctcagtcatcttgtctagaatggcaaatctaactgcgggtttaggctttagtt

SEQ ID NO: 346265 - DNA, 75 bp, Artificial Sequence
  Synthetic
tattttatattttgtaataagaatagaatgctaatgtcaagtttattccaatagatgtcttattaaaaaacatat

SEQ ID NO: 346266 - DNA, 75 bp, Artificial Sequence
  Synthetic
gctaatattttattacaatcatccggatattcttctacgatctcactaactaatgtttctttggttatactagta

SEQ ID NO: 346267 - DNA, 75 bp, Artificial Sequence
  Synthetic
aatcagatgatcgatgaataatacatttaaattcatcatctgtaagatttttgagatgtctcattaaaatattat

SEQ ID NO: 346268 - DNA, 75 bp, Artificial Sequence
  Synthetic
aagtatataataaatactttttatttacggtactcttgtagtggtgataccctactcaattatttttttaaaaaa

SEQ ID NO: 346269 - DNA, 75 bp, Artificial Sequence
  Synthetic
ccttccaatgatatattttccatgaaatcaaacggattggtaacattataaatttttttaaatcccaattcagaa

SEQ ID NO: 346270 - DNA, 75 bp, Artificial Sequence
  Synthetic
aattgactttttggtccatttttccatacgtttatattcttttaatcctgcgttatccgtttccgttatatccag

SEQ ID NO: 346271 - DNA, 75 bp, Artificial Sequence
  Synthetic
agcaaagggtggtatcatggcagtctttctaatgggttgttacgacgatgaatccggtaaatggaagacggttac

SEQ ID NO: 346272 - DNA, 75 bp, Artificial Sequence
  Synthetic
tctgaacgttcaccaatgtctctagccactttggcactaatagcgatcattcgcttagcgtcttctatattatta

SEQ ID NO: 346273 - DNA, 75 bp, Artificial Sequence
  Synthetic
tcgcttagcgtcttctatattattaactggttgattcaatctatctagcaatggaccgtcggacagcgtcattct

SEQ ID NO: 346274 - DNA, 75 bp, Artificial Sequence
  Synthetic
acttcgtacgattccagagaatataaccactacatcatcgataacattctaaagagatttagacaacaggatgaa

SEQ ID NO: 346275 - DNA, 75 bp, Artificial Sequence
  Synthetic
acaacataagctttttaaaatcatcattataataggtttgatcgttgtcatttctccaaagaatatatctaataa

SEQ ID NO: 346276 - DNA, 75 bp, Artificial Sequence
  Synthetic
tcatcgtacaagacgttctcgtacaggacgtaactataaaccggtttatatttgttcaagatagatacaaatccg

SEQ ID NO: 346277 - DNA, 75 bp, Artificial Sequence
  Synthetic
ttttacgaatttgatatagaatagcgtttacatattctccataatggtcaatcgccatttgttcgtatgtcataa

SEQ ID NO: 346278 - DNA, 75 bp, Artificial Sequence
  Synthetic
tgctactaccttcgggtaaaattgtagcatcatataccatttctagtactttaggttcattattatccattgcag

SEQ ID NO: 346279 - DNA, 75 bp, Artificial Sequence
  Synthetic
agcatcatataccatttctagtactttaggttcattattatccattgcagaggacgtcatgatcgaatcataaaa

SEQ ID NO: 346280 - DNA, 75 bp, Artificial Sequence
  Synthetic
gtaagatactccttcatgaacataatcagttacaaaacgtttatatgaagtaaagtatctacgatttttacaaaa

SEQ ID NO: 346281 - DNA, 75 bp, Artificial Sequence
  Synthetic
gcgataaacggaataataatagatttatctagtctatctttttctatagctttcatagttagatacatggtctca

SEQ ID NO: 346282 - DNA, 75 bp, Artificial Sequence
  Synthetic
tcttacacattcgctcatacatgtatgaccgttaactacagagtctacactaaaatgattgaacaatagatagtc

SEQ ID NO: 346283 - DNA, 75 bp, Artificial Sequence
  Synthetic
tgattaggcatgttgatggaaaaattcttttcgttggtagatattgctctccgacaactaattgttaaccatttt

SEQ ID NO: 346284 - DNA, 75 bp, Artificial Sequence
  Synthetic
aatcatattgctttcctttatcattaataatttctagaacatcatctctatcataaaagatacaaatattaactg

SEQ ID NO: 346285 - DNA, 75 bp, Artificial Sequence
  Synthetic
gtgtaagaggactatctccgaatttgttttgtttattaacatccgttgatggaagtaaaagatctataatgtcta

SEQ ID NO: 346286 - DNA, 75 bp, Artificial Sequence
  Synthetic
aatatggagaggtgtatttccatcatgatctggttttgagggactaattcctagtttcatcatccatgagattgt

SEQ ID NO: 346287 - DNA, 75 bp, Artificial Sequence
  Synthetic
caaatttatccactatcctggcttcgaatccgatggacattatttttttaaacactctttctgaaggatctgtac

SEQ ID NO: 346288 - DNA, 75 bp, Artificial Sequence
  Synthetic
ataccctggtagaagaattcaagtcaggaactattaatcgcattttagttattactaaactacgtgaacatatgg

SEQ ID NO: 346289 - DNA, 75 bp, Artificial Sequence
  Synthetic
gctccatactgtaccaataaatttattctctctatgacttcatcatctgttcccgagagataatatagaggtgtt

SEQ ID NO: 346290 - DNA, 75 bp, Artificial Sequence
  Synthetic
gatctgcgccgtgcgtcagcagcatcgcgactattctattattattaattttagaagctatatgcaatggataat

SEQ ID NO: 346291 - DNA, 75 bp, Artificial Sequence; identical to SEQ ID NO: 48625
  Synthetic

SEQ ID NO: 346292 - DNA, 75 bp, Artificial Sequence
  Synthetic
tatagtgtgaaggatatgataaaaaatataattgttgtatttatcccattccaatcaccttatatgattctgtaa

SEQ ID NO: 346293 - DNA, 75 bp, Artificial Sequence
  Synthetic
agagtatcctctatgaagaagttcttcgacaaatcgttcatctagtcctttaattccacaatacgcatgtagaat

SEQ ID NO: 346294 - DNA, 75 bp, Artificial Sequence
  Synthetic
tcgacaaatcgttcatctagtcctttaattccacaatacgcatgtagaatgtgataattatttccagaaggttcg

SEQ ID NO: 346295 - DNA, 75 bp, Artificial Sequence
  Synthetic
ttagcgtcacagaatctaccacagcaggatcccatgacgagcgtcatattaaactaattcattttcaattataat

SEQ ID NO: 346296 - DNA, 75 bp, Artificial Sequence
  Synthetic
ggcataaagagatagataatactcggccgacataatgttgtccattgtagtataaaaattaatatttctatttct

SEQ ID NO: 346297 - DNA, 75 bp, Artificial Sequence
  Synthetic
gtatatttgcaacaatttactctctataacaaatatcataacttagttcttttatgtcaagaaggcactggttta

SEQ ID NO: 346298 - DNA, 75 bp, Artificial Sequence
  Synthetic
gttcatctataaatgtcacgccataactaccacgcatgccatactcagaattatgataaagatatttatccttgg

SEQ ID NO: 346299 - DNA, 75 bp, Artificial Sequence
  Synthetic
actaccacgcatgccatactcagaattatgataaagatatttatccttggggtgtaggtaatggggattaatctt

SEQ ID NO: 346300 - DNA, 75 bp, Artificial Sequence
  Synthetic
ttatatcacacgatgatgatttatgaattgattccggaagatcgctatcgtattttgtggttccacaattcattt

SEQ ID NO: 346301 - DNA, 75 bp, Artificial Sequence
  Synthetic
acgcggttacacacttaccttcaacagtataccaaacatagtcctcgtgtggtgtatgctcttttatctcgagga

SEQ ID NO: 346302 - DNA, 75 bp, Artificial Sequence
  Synthetic
aattgattccggaagatcgctatcgtattttgtggttccacaattcatttccatacatgttattgtcacactaat

SEQ ID NO: 346303 - DNA, 75 bp, Artificial Sequence
  Synthetic
gtttattatctttaccaacaccctcagccgctgccacaaatctctgatccgtatccatgatggtcatgtttattt

SEQ ID NO: 346304 - DNA, 75 bp, Artificial Sequence
  Synthetic
tttttatggaccatcacagaggagagagaataaaatatttttgtaaacttttttatgagaccatcacagagagag

SEQ ID NO: 346305 - DNA, 75 bp, Artificial Sequence
  Synthetic
caaaagagcaagactaatttgtaaaccatcttactcaaaatatgtaacaatagtacgatgcaatgagtaagacaa

SEQ ID NO: 346306 - DNA, 75 bp, Artificial Sequence
  Synthetic
ttttatgagaccatcacagagagagagaggatgaaaatatttttgtaaactttttttatgagaccatcacagaga

SEQ ID NO: 346307 - DNA, 75 bp, Artificial Sequence
  Synthetic
tgataaggattcctccataattgcacaatccaaactttttcacaaaactagactttacaagatctacaggaatgc

SEQ ID NO: 346308 - DNA, 75 bp, Artificial Sequence
  Synthetic
taggaaatctatcttatatacacataattattctatcaattttaccaattagttagtgtaatgttaacaaaaatg

SEQ ID NO: 346309 - DNA, 75 bp, Artificial Sequence
  Synthetic
agttccttgtttttgctaattatttcatccaatttattattcttgactatatcgagatcttttgtataggagtca

SEQ ID NO: 346310 - DNA, 75 bp, Artificial Sequence
  Synthetic
gcagaatagatattaatgtcgtatttgaacagagcctgtaacatctcaatgtctttattatctatagccaattta

SEQ ID NO: 346311 - DNA, 75 bp, Artificial Sequence
  Synthetic
tgattccactatctgtggtacgaacggtttcatcttctttgatgccatcacccagatgttctataaacttggtat

SEQ ID NO: 346312 - DNA, 75 bp, Artificial Sequence
  Synthetic
gtcgagcaagagaatcatcatatccacgtgtccattttttatagtgatgtgaatacaactaaggagaatagccag

SEQ ID NO: 346313 - DNA, 75 bp, Artificial Sequence
  Synthetic
cattaagcatgacggcatgataaaatgaagttttccatccagttttcccatagaacatcagtctccaatttttct

SEQ ID NO: 346314 - DNA, 75 bp, Artificial Sequence
  Synthetic
tgaagttttccatccagttttcccatagaacatcagtctccaatttttcttaacaaacagtttcaccgtttgcat

SEQ ID NO: 346315 - DNA, 75 bp, Artificial Sequence
  Synthetic
tagaacatcagtctccaatttttcttaacaaacagtttcaccgtttgcatgttaccactatcaaccgcataatac

SEQ ID NO: 346316 - DNA, 75 bp, Artificial Sequence
  Synthetic
cttggccaattgtctttctcttttactgagtgattctagttcaccttctatagatctgagaatggatgattctcc

SEQ ID NO: 346317 - DNA, 75 bp, Artificial Sequence
  Synthetic
tagcaaaatctttactattttggtatcttccaatgtggctgcctgatgtaatggaaattcattctctagaagatt

SEQ ID NO: 346318 - DNA, 75 bp, Artificial Sequence
  Synthetic
tttcaatgctccagcgttcaacaacgtacatactagacgcacgttattatcagctattgcataatacaaggcact

SEQ ID NO: 346319 - DNA, 75 bp, Artificial Sequence
  Synthetic
ctttcgtattgtgtatacaatcgttcgaactcgtctccccaaacattgtccaatccaggacattcatccggacac

SEQ ID NO: 346320 - DNA, 75 bp, Artificial Sequence
  Synthetic
tcagctgcttagacttccaagtattaattcgtgacagatccatgtctgaaacgagacgctaattagtgtatattt

SEQ ID NO: 346321 - DNA, 75 bp, Artificial Sequence
  Synthetic
ttgcaccagaattaataatatctctaatagatctgattagtagatacatggctatcgcaaaacaacatatacaca

SEQ ID NO: 346322 - DNA, 75 bp, Artificial Sequence
  Synthetic
tttaataaaaataatatttattaagaaaattcagatttcacgtacccatcaatataaataaaataatgattcctt

SEQ ID NO: 346323 - DNA, 75 bp, Artificial Sequence
  Synthetic
gatagttcgtgtactagtcataatatctttaatccatctaagaaatttaaaattagattttttacactgttaaag

SEQ ID NO: 346324 - DNA, 75 bp, Artificial Sequence
  Synthetic
tccagtaatatcatgtctgatgatgaacacaaatggtgtattaaattccagtttttcaggagatgatctcgccgt

SEQ ID NO: 346325 - DNA, 75 bp, Artificial Sequence
  Synthetic
gctacagttccttgttcgtcgacatctatctttgcattctgaaacattttataaatatataatgggtccctagtc

SEQ ID NO: 346326 - DNA, 75 bp, Artificial Sequence
  Synthetic
gattaaacatactaggagccatcatttcggctatcgacttaatatccctcttattttcgatagaaaatttaggga

SEQ ID NO: 346327 - DNA, 75 bp, Artificial Sequence
  Synthetic
tttgcagccgtaatagaatctgtgaaatgggtcatattatcacctattgccaggtacatactaatattagcatcc

SEQ ID NO: 346328 - DNA, 75 bp, Artificial Sequence
  Synthetic
attcttcgtcatcgattgtgattgtatttccttgcaatttagtaactacgttcatcatgggaaccgttttcgtac

SEQ ID NO: 346329 - DNA, 75 bp, Artificial Sequence
  Synthetic
ttcatcatgggaaccgttttcgtaccgtacttattagtaaaactagcattgcgtgttttagtgatatcaaacgga

SEQ ID NO: 346330 - DNA, 75 bp, Artificial Sequence
  Synthetic
gcgtgttttagtgatatcaaacggatattgccatgtacctttaaaatatatagtattaatgattgcccatagagt

SEQ ID NO: 346331 - DNA, 75 bp, Artificial Sequence
  Synthetic
actacattagacataccggatctacgttctactatagaattaattttattaaccgcatctcgtctaaagtttaat

SEQ ID NO: 346332 - DNA, 75 bp, Artificial Sequence
  Synthetic
tatacagatgcaatacggtaccgcaatttcgtagttgataatcatcatacgcgtatcagtactcgtcctcataaa

SEQ ID NO: 346333 - DNA, 75 bp, Artificial Sequence
  Synthetic
aaccgcatctcgtctaaagtttaatctatataggccgaatctatgatattgttgataatacaacggtttaatgca

SEQ ID NO: 346334 - DNA, 75 bp, Artificial Sequence
  Synthetic
cttcttcatttcgtgccaaaataatatacagtcttaaatagttacgcaatatctcaatagtttcataattgttag

SEQ ID NO: 346335 - DNA, 75 bp, Artificial Sequence
  Synthetic
cacagtattatctacgaaactttgataagttagatcagtgtacgtatatttagatgttttcagcttagctaatcc

SEQ ID NO: 346336 - DNA, 75 bp, Artificial Sequence
  Synthetic
tagatgttttcagcttagctaatcctgatattaattctgtaaatgctggacccagatctctttttctcaaatcca

SEQ ID NO: 346337 - DNA, 75 bp, Artificial Sequence
  Synthetic
attacctgatgcaggcaatagcgacataaacatagaaaacgaatagccaaacggtgagaagacaatattatcatc

SEQ ID NO: 346338 - DNA, 75 bp, Artificial Sequence
  Synthetic
acggtgagaagacaatattatcatcttgaatatttttatacgctactataccggcattggtaaatccttgcagac

SEQ ID NO: 346339 - DNA, 75 bp, Artificial Sequence
  Synthetic
ttgaatatttttatacgctactataccggcattggtaaatccttgcagacgataggtagacactgaacacgttaa

SEQ ID NO: 346340 - DNA, 75 bp, Artificial Sequence
  Synthetic
attgatgtctacacatccttttgtaattgacatctatatatccttttgtataatcaactctaatcactttaactt

SEQ ID NO: 346341 - DNA, 75 bp, Artificial Sequence
  Synthetic
ttacagttttccctaccagtttatccctatattcaacatatctatccatatgcatcttaacactctctgccaaga

SEQ ID NO: 346342 - DNA, 75 bp, Artificial Sequence
  Synthetic
ttctaaaacgtatcgatacgcattttcaaaatacatgtcgtttgataaatacgatggtataataactaaatgtca

SEQ ID NO: 346343 - DNA, 75 bp, Artificial Sequence
  Synthetic
ttctcgtatactctgccctttattacatcacccgcattgggcaacgaataacaaaatgcaagcatcttgttaacg

SEQ ID NO: 346344 - DNA, 75 bp, Artificial Sequence
  Synthetic
ggagtaggacgcctagccagtatggaagaggattttctagatcctctcttcaacatctttgatctcaatggaatg

SEQ ID NO: 346345 - DNA, 75 bp, Artificial Sequence
  Synthetic
gatgatatagaatcatcggtcgtatcattggtgtgattagtttcctttttataaaattgaagtaatatttagtat

SEQ ID NO: 346346 - DNA, 75 bp, Artificial Sequence
  Synthetic
agaatattcaggaatttctttttccggttgtatctcatcgcagtatatatcatttgtacattgtttcatattttt

SEQ ID NO: 346347 - DNA, 75 bp, Artificial Sequence
  Synthetic
catttgtacattgtttcatattttttaatagtttacaccttttagtaggactagtatcgtacaattcatagctgt

SEQ ID NO: 346348 - DNA, 75 bp, Artificial Sequence
  Synthetic
taatagtttacaccttttagtaggactagtatcgtacaattcatagctgtattttgaattccaatcacgcataaa

SEQ ID NO: 346349 - DNA, 75 bp, Artificial Sequence
  Synthetic
taatagatgctccacatgtatccgtaaagtaatttcctgtccaatttgaggtacctatataggccgttttatcgg

SEQ ID NO: 346350 - DNA, 75 bp, Artificial Sequence
  Synthetic
aaagtaatttcctgtccaatttgaggtacctatataggccgttttatcggttaccatatatttggcatggtttac

SEQ ID NO: 346351 - DNA, 75 bp, Artificial Sequence
  Synthetic
aaaagtcaagaacgttcacatcggcggacaatctaaaaacaatacagtgattgcagatttgccatatatggataa

SEQ ID NO: 346352 - DNA, 75 bp, Artificial Sequence
  Synthetic
actgatattatataaatattttagtgccgtataataaagatgacgatgaaaatgatggtacatatatatttcgta

SEQ ID NO: 346353 - DNA, 75 bp, Artificial Sequence
  Synthetic
cttctatatttatgtttttagattttagcatagcgatagatcttaaaaagtttctcatgataaacgaagatcgtt

SEQ ID NO: 346354 - DNA, 75 bp, Artificial Sequence
  Synthetic
tttctcatgataaacgaagatcgttgccagcaactaatcaatagcttaacggatacttgtctgtctatagcggat

SEQ ID NO: 346355 - DNA, 75 bp, Artificial Sequence
  Synthetic
aactcgtagctcgcaagtcgatgcgcgactattttcagtaatggtaacttcgaaaccgttatttatagcagatat

SEQ ID NO: 346356 - DNA, 75 bp, Artificial Sequence
  Synthetic
cgaataaataatagggataaagttcataacagatacataaacgaatttactcgcatttctaatacatgacaataa

SEQ ID NO: 346357 - DNA, 75 bp, Artificial Sequence
  Synthetic
agcggttaaatcattggttctttccatagtacatagttgttgcggcgcagaagcaataaatacagagtgtggaac

SEQ ID NO: 346358 - DNA, 75 bp, Artificial Sequence
  Synthetic
tgatctgtattataatacgacggataaaagtttttccaattatatggtagattgttaactccaagataccagtat

SEQ ID NO: 346359 - DNA, 75 bp, Artificial Sequence; identical to SEQ ID NO: 250912
  Synthetic

SEQ ID NO: 346360 - DNA, 75 bp, Artificial Sequence
  Synthetic
tcatttactttttcataattagagatgtacgaaagaaaaagaaaaagaaaaagaaaaacagaacaatatattttt

SEQ ID NO: 346361 - DNA, 75 bp, Artificial Sequence
  Synthetic
catatataggtcccattttttgctttctgtatccaggtagacatagatattctatagtgtctcctatgttgtaat

SEQ ID NO: 346362 - DNA, 75 bp, Artificial Sequence; identical to SEQ ID NO: 250914
  Synthetic

SEQ ID NO: 346363 - DNA, 75 bp, Artificial Sequence
  Synthetic
gataataaggaaattaatatcgacgacattaagtattcacaaacgggaaagaaattaattattcataatccagag

SEQ ID NO: 346364 - DNA, 75 bp, Artificial Sequence
  Synthetic
agaactcctcctaggatatttgtaatatctatgtatcgtacttcaactccggccatttgtagtctttcaacatcc

SEQ ID NO: 346365 - DNA, 75 bp, Artificial Sequence
  Synthetic
tttgggtaattgtacaatcttgtttaatattatcgtgccgaaattcgtacccacttcatccgataaactccaata

SEQ ID NO: 346366 - DNA, 75 bp, Artificial Sequence
  Synthetic
cctttagcgtcattgtaaaggaatggggtatggaaacattcattgaggacgaggataatattagatttactgtct

SEQ ID NO: 346367 - DNA, 75 bp, Artificial Sequence
  Synthetic
aatattatcgtgccgaaattcgtacccacttcatccgataaactccaataaaaagatgatatatctagtgttttt

SEQ ID NO: 346368 - DNA, 75 bp, Artificial Sequence
  Synthetic
atttttcttagtacaaaagtcaatgttttaaaatatatggacaagaatttgtctgtataaaaacttgtgtgaaat

SEQ ID NO: 346369 - DNA, 75 bp, Artificial Sequence; identical to SEQ ID NO: 250919
  Synthetic

SEQ ID NO: 346370 - DNA, 75 bp, Artificial Sequence
  Synthetic
tcacaccgtctcttccgcagataaatgcgaacccgtacccagaaatacctttaactatatcgatgtggaaattaa

SEQ ID NO: 346371 - DNA, 75 bp, Artificial Sequence
  Synthetic
actctattaaaaatccaagtttctatttctttcatgactgattttttaacttcatccgtttccttataaagatga

SEQ ID NO: 346372 - DNA, 75 bp, Artificial Sequence
  Synthetic
ttcatccgtttccttataaagatgatgtttggcaccttcataaatttttatttctctattacaatttgcatgttg

SEQ ID NO: 346373 - DNA, 75 bp, Artificial Sequence
  Synthetic
caataaccgctttgcaaattgtatattattgacatcgaccgcgtaatatagtagagttttattctcattatcgat

SEQ ID NO: 346374 - DNA, 75 bp, Artificial Sequence
  Synthetic
tgttggtagccttcaagacctgactagcaaatccagccttaattttttcatgattgattaatgggtcgtattggt

SEQ ID NO: 346375 - DNA, 75 bp, Artificial Sequence
  Synthetic
atacacgggtgttaatggggcggtatacacattttcaaataataaactaaacaaaactggtttaactaatactaa

SEQ ID NO: 346376 - DNA, 75 bp, Artificial Sequence
  Synthetic
atttataaactttatccatatctctagatactgattctggacatagctttccgactggcgcatttggtgtgatgg

SEQ ID NO: 346377 - DNA, 75 bp, Artificial Sequence
  Synthetic
ttatctagcgattatgaaaattataatgaatattattatgatgattatgatagaactggtatgaacagtgagagt

SEQ ID NO: 346378 - DNA, 75 bp, Artificial Sequence
  Synthetic
ttcccataagtttggcagctagcagattcagttttgaaacagcatctgcattaactagaggagacattagaatca

SEQ ID NO: 346379 - DNA, 75 bp, Artificial Sequence
  Synthetic
atttagtgtagtatatctacacatgtatttttccgcgctatagtattctggactagtgataaaactatcgttata

SEQ ID NO: 346380 - DNA, 75 bp, Artificial Sequence
  Synthetic
tagaactggtatgaacagtgagagtgataatatatcaatcaaaacagaatatgaattctatgatgaaacacaaga

SEQ ID NO: 346381 - DNA, 75 bp, Artificial Sequence
  Synthetic
gctcccatggaatgacccaataagtagatttaatagttaccacgtgctgtaccaaagtcatcaatcatcattttt

SEQ ID NO: 346382 - DNA, 75 bp, Artificial Sequence
  Synthetic
accaaagtcatcaatcatcattttttcaccattacttcttccatgtccaatatgatcatgtgagaatactaaaat

SEQ ID NO: 346383 - DNA, 75 bp, Artificial Sequence
  Synthetic
tcctaacgatgatatgttttcagctagttcgtcataacgtccagaatgtttaccagctccatgacttatgaatac

SEQ ID NO: 346384 - DNA, 75 bp, Artificial Sequence
  Synthetic
cataccgtagacgaattctacaagatagacagcgtatcagatgtagatgacgcggaacacatatctccgataact

SEQ ID NO: 346385 - DNA, 75 bp, Artificial Sequence
  Synthetic
tttagatgccgatccgtcgacatacttgaatccatccttgacctcaagttcagatgattccttgcacatgtctcc

SEQ ID NO: 346386 - DNA, 75 bp, Artificial Sequence
  Synthetic
cattgtccagattgaacatacagtttgcactcatgattcacgttatataactatcaatattaacagttcgtttga

SEQ ID NO: 346387 - DNA, 75 bp, Artificial Sequence
  Synthetic
tgcactcatgattcacgttatataactatcaatattaacagttcgtttgatgatcatattatttttatgttttat

SEQ ID NO: 346388 - DNA, 75 bp, Artificial Sequence
  Synthetic
tactgtcttttgtgagatagtcatggcgactaaattagattatgaggatgctgttttttactttgtggatgatga

SEQ ID NO: 346389 - DNA, 75 bp, Artificial Sequence
  Synthetic
ctgttttttactttgtggatgatgataaaatatgtagtcgcgactccatcatcgatctaatagatgaatatatta

SEQ ID NO: 346390 - DNA, 75 bp, Artificial Sequence; identical to SEQ ID NO: 48315
  Synthetic

SEQ ID NO: 346391 - DNA, 75 bp, Artificial Sequence
  Synthetic
taaaaagattaatatttataaagaaaatatggaatccgcatcgactgagtatacacctatcggagacaacaaggc

SEQ ID NO: 346392 - DNA, 75 bp, Artificial Sequence
  Synthetic
ttttagatttcattcagaggatgtggaattatgttatgggcatttgtattttgataggatctataatgtagtaaa

SEQ ID NO: 346393 - DNA, 75 bp, Artificial Sequence
  Synthetic
tgatcaggaaagtctattcgctaccataggaatatgtgctaaaatcactgaacattggggatacaaaaagatttc

SEQ ID NO: 346394 - DNA, 75 bp, Artificial Sequence
  Synthetic
ttaggaatctatccaaaatggcaattatactagaactataggtgcgttgtatacacatattgatgtgtctgttta

SEQ ID NO: 346395 - DNA, 75 bp, Artificial Sequence
  Synthetic
acgtcacatcttcatccagtagacgacatagaatacatgtgcaatccatagctattctggtgctaattattccta

SEQ ID NO: 346396 - DNA, 75 bp, Artificial Sequence
  Synthetic
ccaacacaaagggtggatatttgttcattggagttgataataatacacacaaagtatttggattcacggtgggtt

SEQ ID NO: 346397 - DNA, 75 bp, Artificial Sequence
  Synthetic
aattcggttataaatgaaattgtcgccaatcttacacccaaccccttgttatccattagtatagtattaacttcg

SEQ ID NO: 346398 - DNA, 75 bp, Artificial Sequence
  Synthetic
gatattcatgtccctattataatcattactaactttatcacaatatatgttgataatatctatatatgatctagt

SEQ ID NO: 346399 - DNA, 75 bp, Artificial Sequence
  Synthetic
ttactaactttatcacaatatatgttgataatatctatatatgatctagtctttgtgggcaactgtctatacaag

SEQ ID NO: 346400 - DNA, 75 bp, Artificial Sequence
  Synthetic
ttactatttgtaatatttagacatagataaacgtgataaaagtctatttgtttatatttattgcggatagcagta

SEQ ID NO: 346401 - DNA, 75 bp, Artificial Sequence
  Synthetic
tggactggaactataaatccaggcgtggtctcgcataaagatgatatatatgttgtatgcgacatcaaagatgaa

SEQ ID NO: 346402 - DNA, 75 bp, Artificial Sequence
  Synthetic
gtcccgttccgttgatagataatcgagtatgttagtggacttgtcaaatctatataccatattttctggaagtgg

SEQ ID NO: 346403 - DNA, 75 bp, Artificial Sequence
  Synthetic
gatataacacgaatacgtataacggatgggaattggttacgacgacagaaagcagattatcagctctgcatacta

SEQ ID NO: 346404 - DNA, 75 bp, Artificial Sequence
  Synthetic
gcagccaatactattacagaagttttgaaagattcggaagaagattatcaagatgtgtatgtttgtgaaaattgt

SEQ ID NO: 346405 - DNA, 75 bp, Artificial Sequence
  Synthetic
ttgctagcctcatcttctatatcctgtactataccattatctatatcatctacataatctacgatattattacac

SEQ ID NO: 346406 - DNA, 75 bp, Artificial Sequence
  Synthetic
gttacattgttatgaatcgtatatgttacaagatacatttaatgtgtacactcgcgaatggaatcatatgtgtca

SEQ ID NO: 346407 - DNA, 75 bp, Artificial Sequence
  Synthetic
ctcctccttgattctagcatcctcttcattattttcttctacgtacataaacatgtccaatacgttagacaacac

SEQ ID NO: 346408 - DNA, 75 bp, Artificial Sequence
  Synthetic
ctcgcgaatggaatcatatgtgtcatcaacattcgaatagttatatcatgtacaatatactacccatctactaaa

SEQ ID NO: 346409 - DNA, 75 bp, Artificial Sequence
  Synthetic
aacccttgatctcctctatctgtactatctagagattgtacttcttccagttctggataatatatacgttgatag

SEQ ID NO: 346410 - DNA, 75 bp, Artificial Sequence
  Synthetic
tcaacattcgaatagttatatcatgtacaatatactacccatctactaaatataatagaataaaataaatgagta

SEQ ID NO: 346411 - DNA, 75 bp, Artificial Sequence
  Synthetic
taattattgattccacggaagaactaccaacagttactccaattacaacaacatataattatactatcgatgata

SEQ ID NO: 346412 - DNA, 75 bp, Artificial Sequence
  Synthetic
tttcccctataatcttcgtctattacaccacctcctatatcaatgccttttagggacagaccagacctaggagct

SEQ ID NO: 346413 - DNA, 75 bp, Artificial Sequence
  Synthetic
aatttgttaagtatgaatacggggtacaaacataaactgaaatttaacattatttatttatgatatatatcgtta

SEQ ID NO: 346414 - DNA, 75 bp, Artificial Sequence
  Synthetic
cctagtaggagatttagctctgttagtttccttaacaaatctaactggtgagttaatattcatgttgaacataaa

SEQ ID NO: 346415 - DNA, 75 bp, Artificial Sequence
  Synthetic
gtttccttaacaaatctaactggtgagttaatattcatgttgaacataaaactaatattttatttcaaaattatt

SEQ ID NO: 346416 - DNA, 75 bp, Artificial Sequence
  Synthetic
gtatctatatacgattcacgataaaatcctcctatcaatagcagtttattatccactatgatcaattctggatta

SEQ ID NO: 346417 - DNA, 75 bp, Artificial Sequence
  Synthetic
atcctcctatcaatagcagtttattatccactatgatcaattctggattatccctcggataaataggatcatcta

SEQ ID NO: 346418 - DNA, 75 bp, Artificial Sequence
  Synthetic
accaagaataaccttctaccgaacactaacgcgcatgatttataatgaggataataagtggatggtccaaactgc

SEQ ID NO: 346419 - DNA, 75 bp, Artificial Sequence
  Synthetic
ctaacgcgcatgatttataatgaggataataagtggatggtccaaactgccactgatcatgattgggtagcaaat

SEQ ID NO: 346420 - DNA, 75 bp, Artificial Sequence
  Synthetic
accttacgacgtttacatcgacgagattattattaacaaagttgttgtccgtcgtcttatccaacatgcattgaa

SEQ ID NO: 346421 - DNA, 75 bp, Artificial Sequence
  Synthetic
ttgtttatagatgccactgctggattacatctaggtttcagaagactcggcatattaacccaagcagcatccccg

SEQ ID NO: 346422 - DNA, 75 bp, Artificial Sequence
  Synthetic
tacatctaggtttcagaagactcggcatattaacccaagcagcatccccgtggaaccaacgctcaacagatgtgg

SEQ ID NO: 346423 - DNA, 75 bp, Artificial Sequence
  Synthetic
ctagcatacagtctggggctattcatcggaggaattggaatccaattgtttgatatataatttacagctatagca

SEQ ID NO: 346424 - DNA, 75 bp, Artificial Sequence
  Synthetic
tcggaggaattggaatccaattgtttgatatataatttacagctatagcattgttatgtatttcattgttcatcc

SEQ ID NO: 346425 - DNA, 75 bp, Artificial Sequence
  Synthetic
tggaatatatctataatttgatccatgttcataggatactctatgaatggatacttgtatgatttgcgtggttgt

SEQ ID NO: 346426 - DNA, 75 bp, Artificial Sequence
  Synthetic
actctacacgtgtccacatcctttattaataatctctatatctatggttgagcaagaccagtagtattggatgga

SEQ ID NO: 346427 - DNA, 75 bp, Artificial Sequence
  Synthetic
atatacccgaagatatgcacactgataaatttgtcatttatgatatatacacttttgacgctttcaagaataaac

SEQ ID NO: 346428 - DNA, 75 bp, Artificial Sequence
  Synthetic
aataagtttcatagatagataatcaaaattgtctatgatgtcatcttccagttccaaaaagtgtttggcaataaa

SEQ ID NO: 346429 - DNA, 75 bp, Artificial Sequence
  Synthetic
aaattgtctatgatgtcatcttccagttccaaaaagtgtttggcaataaagtttttagtatgacataagagattg

SEQ ID NO: 346430 - DNA, 75 bp, Artificial Sequence
  Synthetic
aaattgggctcaagggtttatttattaatgctttagtgaaattttaacttgtgttctaaatggatgcggctatta

SEQ ID NO: 346431 - DNA, 75 bp, Artificial Sequence
  Synthetic
tctaaaatctcgtaagataaagtttatacaagtgtagatgataaattctacagaggttaatatagaagcacgtaa

SEQ ID NO: 346432 - DNA, 75 bp, Artificial Sequence
  Synthetic
atacaagtgtagatgataaattctacagaggttaatatagaagcacgtaataaattgacgacgttatgactatct

SEQ ID NO: 346433 - DNA, 75 bp, Artificial Sequence
  Synthetic
agtcagaattttcatggatgtagatttagacgcgtgtctagacgaaatagattatttaacggccattcaagattt

SEQ ID NO: 346434 - DNA, 75 bp, Artificial Sequence
  Synthetic
aatgtcaaggtctagacaaacccttgtaactggatctttatttttcgtgtatttttgacgtaaatgtgtgcgaaa

SEQ ID NO: 346435 - DNA, 75 bp, Artificial Sequence
  Synthetic
gtaactggatctttatttttcgtgtatttttgacgtaaatgtgtgcgaaagtaaggagataactttttcaatatc

SEQ ID NO: 346436 - DNA, 75 bp, Artificial Sequence
  Synthetic
gtagaagcatttaaatgcgacgagttaaaaagatatattgagaataatccagaatgtacactattcgaaagtctt

SEQ ID NO: 346437 - DNA, 75 bp, Artificial Sequence
  Synthetic
tttcttagtcatagacaatgctaatatattcttacagtacacagtattgacaaatatcggcatttatgtttcttt

SEQ ID NO: 346438 - DNA, 75 bp, Artificial Sequence
  Synthetic
gttttcatcatttcacaattcattcctataagtttaactggaagagccgcagtaagaaattcttgttcaatggat

SEQ ID NO: 346439 - DNA, 75 bp, Artificial Sequence
  Synthetic
taattatgatcttgatttatagatgaagatcagcctttagaggattttaaccagtatgtttaatatgaaaaaaat

SEQ ID NO: 346440 - DNA, 75 bp, Artificial Sequence
  Synthetic
atctccccagaataatatacttgcgtgtcgtcgttcaatttatacggatttctatagttctctgttatataatgc

SEQ ID NO: 346441 - DNA, 75 bp, Artificial Sequence
  Synthetic
tgcagcaaaggcaataagtctctctccataaccggcgctgtcatgtatccacttttgagcccaatcggccttctt

SEQ ID NO: 346442 - DNA, 75 bp, Artificial Sequence
  Synthetic
ccataaccggcgctgtcatgtatccacttttgagcccaatcggccttcttttttacacaaggcatcgtttctatg

SEQ ID NO: 346443 - DNA, 75 bp, Artificial Sequence
  Synthetic
caaaagactatacatttccgaatgaatgttttcaatggccatctgaaatccgtagaaacatctagcctcggtaat

SEQ ID NO: 346444 - DNA, 75 bp, Artificial Sequence
  Synthetic
atgttttcaatggccatctgaaatccgtagaaacatctagcctcggtaatctgtacttctgtacaaaatcgttcc

SEQ ID NO: 346445 - DNA, 75 bp, Artificial Sequence
  Synthetic
cgtacccaacacattgattatacatcagtacatacagtaaatagcatagatatggaggaggatacaaatatttca

SEQ ID NO: 346446 - DNA, 75 bp, Artificial Sequence
  Synthetic
atgttttataaaatatttttcgtctggtgttagtttattccaatcattgatatctttagatatatctacttcttc

SEQ ID NO: 346447 - DNA, 75 bp, Artificial Sequence
  Synthetic
ggtgttagtttattccaatcattgatatctttagatatatctacttcttccactgtccaaaatgatgcctctgcc

SEQ ID NO: 346448 - DNA, 75 bp, Artificial Sequence
  Synthetic
tctatttggatttggtgcaaggatgggttccataactaaattaacaataacaataaattttttttcagttatcta

SEQ ID NO: 346449 - DNA, 75 bp, Artificial Sequence
  Synthetic
atccatctaaccaagacggataagaaatatatacttcaattgataagacacggtagatcatagaacagaccaaat

SEQ ID NO: 346450 - DNA, 75 bp, Artificial Sequence
  Synthetic
catcgatatcgccgcaatcactacaataattacaagtattattgatagcattgttattagtactatcataattaa

SEQ ID NO: 346451 - DNA, 75 bp, Artificial Sequence
  Synthetic
taaatcgtttgcgagattgttgtgggaagcgggcatggaggatgaattatcgttattattatttaaagcctccca

SEQ ID NO: 346452 - DNA, 75 bp, Artificial Sequence
  Synthetic
gattattgtctaatatggtctctacgcaaactttttcacagagcgatagagtttttgataactcgtttttcttaa

SEQ ID NO: 346453 - DNA, 75 bp, Artificial Sequence
  Synthetic
ttcaacattttatggaaactataattttgtgaaaacagataacaagaaaactcgtcatcgttcaaatttttaacg

SEQ ID NO: 346454 - DNA, 75 bp, Artificial Sequence
  Synthetic
ctcgtcatcgttcaaatttttaacgatagtaaaccgattaaacgtcgagctaatttctaacgctagcgactctgt

SEQ ID NO: 346455 - DNA, 75 bp, Artificial Sequence
  Synthetic
cgtatactttaaagcaaaatggttgacgccattcgaaaaggaatttaccagtgattatcccttttacgtatctcc

SEQ ID NO: 346456 - DNA, 75 bp, Artificial Sequence
  Synthetic
tggatatgggtttccagatatatatcttttcagttcccctacgtatctataatcatctgtaggaaatggaagata

SEQ ID NO: 346457 - DNA, 75 bp, Artificial Sequence
  Synthetic
ttgatatcgatctgattgatcctagaactagatatattaataacgtgctcattaggcagtttatggcagcttgat

SEQ ID NO: 346458 - DNA, 75 bp, Artificial Sequence
  Synthetic
cattaagcgcgaaagatgttatttcgcatcgtattttaacttcgcaataatttctggttagataacgcactctac

SEQ ID NO: 346459 - DNA, 75 bp, Artificial Sequence
  Synthetic
gcatcgtattttaacttcgcaataatttctggttagataacgcactctaccagtcaagtcaatgatattagcctt

SEQ ID NO: 346460 - DNA, 75 bp, Artificial Sequence
  Synthetic
atactcctttgtatgtaccagaatcttcgtacctcaaactcgatatatttaaacaagttaatgagatattaacgc

SEQ ID NO: 346461 - DNA, 75 bp, Artificial Sequence
  Synthetic
aaacaagttaatgagatattaacgcgttttatgaatgatgatatataaccagaagttttatcctcggtggctagc

SEQ ID NO: 346462 - DNA, 75 bp, Artificial Sequence
  Synthetic
tctttgctttcgttaactgtttggaggaaaaatttttgttattgcatttaatctcgaaattcagagtgcacacct

SEQ ID NO: 346463 - DNA, 75 bp, Artificial Sequence
  Synthetic
cactaatcggttcggtaacgtctgtggatggaggtgctacttctacagaacctgtagcctcagttgtcaacggag

SEQ ID NO: 346464 - DNA, 75 bp, Artificial Sequence
  Synthetic
gttagtgtgggtacaaatatgtacattatcgtctacgtcgtattcgatacatccgcatacagccaacaaatataa

SEQ ID NO: 346465 - DNA, 75 bp, Artificial Sequence
  Synthetic
ccaaaatcaatacatcatctatagatcatgtaacaatattacaatacatagatgaaccaaatgatataagactaa

SEQ ID NO: 346466 - DNA, 75 bp, Artificial Sequence
  Synthetic
gtacccatcttgatgcggtttaataaatgttttgatttcaatttattgtaaaaaaagattcggttttatactgtt

SEQ ID NO: 346467 - DNA, 75 bp, Artificial Sequence
  Synthetic
ccgtggttagcatgcacctcatcaaccggtaaaagactatcggactcttctatcattataactctagaatattta

SEQ ID NO: 346468 - DNA, 75 bp, Artificial Sequence
  Synthetic
ccggtaaaagactatcggactcttctatcattataactctagaatatttaatttggtcattattaatcaagtcaa

SEQ ID NO: 346469 - DNA, 75 bp, Artificial Sequence
  Synthetic
ttttagaaatatacagactctatcgtgtgtctatatcttctttttatatccaatgtatttatgtctgatttttct

SEQ ID NO: 346470 - DNA, 75 bp, Artificial Sequence
  Synthetic
attctacacgtgcttcggattcatccagatcattaaggttcttataattgtaacatccttctcttccctcttcta

SEQ ID NO: 346471 - DNA, 75 bp, Artificial Sequence
  Synthetic
cctgtatcagttgcattttcagcactcgactgaatattagcgcattcattgtctattattaccatatttctaaac

SEQ ID NO: 346472 - DNA, 75 bp, Artificial Sequence
  Synthetic
actaatccattttcaattataatatatgattagtaatgaccattaaaataaaaaatattcttcataaccggcaag

SEQ ID NO: 346473 - DNA, 75 bp, Artificial Sequence
  Synthetic
ataatggttcaggatatagatagcgtatatctctattaaatgcgtcaatcatagtctctagagtgggatggtagc

SEQ ID NO: 346474 - DNA, 75 bp, Artificial Sequence
  Synthetic
atcttttcacgttaaatgagtgtccatattttgcaatttcttcatatgatggcggtgtacgtggacgaagctgct

SEQ ID NO: 346475 - DNA, 75 bp, Artificial Sequence
  Synthetic
gtttagtcgcggatatggaattcgatcctgccaaaatcaatatatcatctatagatcatgtaacaatattacaat

SEQ ID NO: 346476 - DNA, 75 bp, Artificial Sequence
  Synthetic
ttttttattaattaaacgtataaaaacgttccgtatctgtatttaagagccagatttcgtctaatagaacaaata

SEQ ID NO: 346477 - DNA, 75 bp, Artificial Sequence
  Synthetic
acgttccgtatctgtatttaagagccagatttcgtctaatagaacaaatagctacagtaaaaataactagaataa

SEQ ID NO: 346478 - DNA, 75 bp, Artificial Sequence
  Synthetic
ataataggtggaacgtatattttatttaaggacttaacaattgtctgtaaaccacaatttgcttccgcggatcct

SEQ ID NO: 346479 - DNA, 75 bp, Artificial Sequence
  Synthetic
catggcttgtacgatggattcatcctgttgtctaaatctctttagaatgttatcgatgatgtagtggttatattc

SEQ ID NO: 346480 - DNA, 75 bp, Artificial Sequence
  Synthetic
agataatgaatatctgtaggcttcttgttgtactgtaacttctcgttttgttagatggttgcatcgtgctttaac

SEQ ID NO: 346481 - DNA, 75 bp, Artificial Sequence
  Synthetic
tccgatatctaatttctgtatatctataatattattaacctccgcatacgcattacagttcttttctagcttgga

SEQ ID NO: 346482 - DNA, 75 bp, Artificial Sequence
  Synthetic
tttgtattcaatgatccattatcatacgctatcatggtcttgtaatattcattctttaaaatataatattgtgtt

SEQ ID NO: 346483 - DNA, 75 bp, Artificial Sequence
  Synthetic
tctattcctatttcttcagcgatagctcttctatccttttccggaagcaatgaaatcacttcaataaatgattca

SEQ ID NO: 346484 - DNA, 75 bp, Artificial Sequence
  Synthetic
ctcttctatccttttccggaagcaatgaaatcacttcaataaatgattcaaccatgagtgtgaaactaagtcgag

SEQ ID NO: 346485 - DNA, 75 bp, Artificial Sequence
  Synthetic
aaaataactacagtttgaaaaataacagtatcatttaaacatttaacttgcggggttaatttcacaactttactg

SEQ ID NO: 346486 - DNA, 75 bp, Artificial Sequence
  Synthetic
gtaacagctacttgagataccgaagtctgatattcagaaagctgtggatgttctggttcggcatccaccgatggt

SEQ ID NO: 346487 - DNA, 75 bp, Artificial Sequence
  Synthetic
cctataacctctcctatatgaatagcacaagtgacattagtagggatagaatgttgagctaatttttgtaaataa

SEQ ID NO: 346488 - DNA, 75 bp, Artificial Sequence
  Synthetic
cacaagtgacattagtagggatagaatgttgagctaatttttgtaaataactatctataaaaagattatacaaag

SEQ ID NO: 346489 - DNA, 75 bp, Artificial Sequence
  Synthetic
ttgtctagaaacgctctacgaatatctgtgacagatatcatctttagagaatatactagtcgcgttaatagtact

SEQ ID NO: 346490 - DNA, 75 bp, Artificial Sequence
  Synthetic
cataataaatttttccaagaaactaattgggtgaagaatggaaacctttaatctatatttatcacagtctgtctt

SEQ ID NO: 346491 - DNA, 75 bp, Artificial Sequence
  Synthetic
gctgtactaaattcgatatctttttcgatttctggatatgtttttaataaagtatgaacaaagaaatggaaatcg

SEQ ID NO: 346492 - DNA, 75 bp, Artificial Sequence
  Synthetic
aattgttttttattttcttgttaatgattccagccacttgggaaaagtcaaagtcgtttaatgccgatttaatac

SEQ ID NO: 346493 - DNA, 75 bp, Artificial Sequence
  Synthetic
gttcattaaaaacaaactttttatcctttagatgaattattattggttcattggaatcaaaaagtaagatattat

SEQ ID NO: 346494 - DNA, 75 bp, Artificial Sequence
  Synthetic
gtaattctttctccgcctattaacgcgcctataaaaacctttatgttgcctaaacaagatatagtaggtttggat

SEQ ID NO: 346495 - DNA, 75 bp, Artificial Sequence
  Synthetic
attttaatgtataacagagccatctgtaaaaagataaactttatgtattgtaccaaagatttaaatcctaatttg

SEQ ID NO: 346496 - DNA, 75 bp, Artificial Sequence
  Synthetic
gtaaaaagataaactttatgtattgtaccaaagatttaaatcctaatttgatagctagctcggtatctactttat

SEQ ID NO: 346497 - DNA, 75 bp, Artificial Sequence
  Synthetic
cttcaacagtataccaaacatagtcctcgtgtggtgtatgctcttttatctcgaggagccgatacgaggatacgt

SEQ ID NO: 346498 - DNA, 75 bp, Artificial Sequence
  Synthetic
tcgtagttagttctcttttcatgttcgaaaaagtgaaacatgcggttaaaatagtttataacattaatattactg

SEQ ID NO: 346499 - DNA, 75 bp, Artificial Sequence
  Synthetic
ttaataactgccggataaaagtgggatagtaatttcacgaatttgatactgtcctttctctcgttaaacgccttt

SEQ ID NO: 346500 - DNA, 75 bp, Artificial Sequence
  Synthetic
ttgtatcaataatagcaacatatgaagaacccgtttatacagagtatgtaaaaatgttaatttatagtttaatcc

SEQ ID NO: 346501 - DNA, 75 bp, Artificial Sequence
  Synthetic
agaacccgtttatacagagtatgtaaaaatgttaatttatagtttaatcccatggcccacgcacacacgattaat

SEQ ID NO: 346502 - DNA, 75 bp, Artificial Sequence
  Synthetic
ctccgccgtagtttccatgggactatataattttgtggcctcgaatacaaattttactacatagttatctatctt

SEQ ID NO: 346503 - DNA, 75 bp, Artificial Sequence
  Synthetic
attttactacatagttatctatcttaaaaactataccatatcctcctgtagatatgtgataaaaatcgtcgttta

SEQ ID NO: 346504 - DNA, 75 bp, Artificial Sequence
  Synthetic
tcattctcttctatctttagtagtgtttccttattaaaattcttaaaataatttaacaatctaactgacggagcc

SEQ ID NO: 346505 - DNA, 75 bp, Artificial Sequence
  Synthetic
tttccttattaaaattcttaaaataatttaacaatctaactgacggagcccaattttggtgtaaatctaattggg

SEQ ID NO: 346506 - DNA, 75 bp, Artificial Sequence
  Synthetic
aatctatggggagacatccattgatattcaggggatgaatcattggcaacacccatttattgtacaaaaagcccc

SEQ ID NO: 346507 - DNA, 75 bp, Artificial Sequence
  Synthetic
acccatttattgtacaaaaagccccaatttacaaacgaaagtccaggtttgatagagacaaactattaactattt

SEQ ID NO: 346508 - DNA, 75 bp, Artificial Sequence
  Synthetic
ttattcacaatatcagtatcttctttatctaccagagattttactaacttgataaccttggctgtctcattcaat

SEQ ID NO: 346509 - DNA, 75 bp, Artificial Sequence
  Synthetic
ttttagaagtgattctttgatggtgccagcatacgaattacaataatgcagaaactcggttaacatgcaggaatt

SEQ ID NO: 346510 - DNA, 75 bp, Artificial Sequence
  Synthetic
tcttaagcgtagaagttgtaaatgacaatgagatgtaccatcttattccccatagactatcgactattatactct

SEQ ID NO: 346511 - DNA, 75 bp, Artificial Sequence
  Synthetic
gagcaatggtgtccttgcgtttctctgatagaatgcgagcagcgattttggcgttatcatttgacgatatttctg

SEQ ID NO: 346512 - DNA, 75 bp, Artificial Sequence
  Synthetic
tggtaaaagaaataaatcagacaataagagcagcacaaactcattacgagacattgaaactaggatacataaaat

SEQ ID NO: 346513 - DNA, 75 bp, Artificial Sequence
  Synthetic
tcaacatctgtttaagttcatcgagagccacctcctcattttccaaatagtcaaacattttgactgaatgagcta

SEQ ID NO: 346514 - DNA, 75 bp, Artificial Sequence
  Synthetic
gaatgacgaatcctgtttctactaactttttggtaggacaaagtgaaacaatcaagaagatagcttctcctccta

SEQ ID NO: 346515 - DNA, 75 bp, Artificial Sequence
  Synthetic
acacgataaattcgtaataatctgttttgttcaaatttttataaggaatctacaggcataaaaataaaaatataa

SEQ ID NO: 346516 - DNA, 75 bp, Artificial Sequence
  Synthetic
ccttgacagatattggaccgaattacagaagtacctggaatgtaaagccctgaaaccccctcattttttaagcag

SEQ ID NO: 346517 - DNA, 75 bp, Artificial Sequence
  Synthetic
gaatccatctctatgtttcagtttaaccaagaaacagtcagctggtctaaaatttccatctctatctaatacagc

SEQ ID NO: 346518 - DNA, 75 bp, Artificial Sequence
  Synthetic
tgagtaaatccttaagttcataatcatcactgtcatcagttatgtacgatccaaacaatgtttctaccggcatag

SEQ ID NO: 346519 - DNA, 75 bp, Artificial Sequence
  Synthetic
atcactgtcatcagttatgtacgatccaaacaatgtttctaccggcatagtggatacgaagatgctatccatcag

SEQ ID NO: 346520 - DNA, 75 bp, Artificial Sequence
  Synthetic
tttccaaatcagtaactatgttcatttttttaggagtaggacgcctagccagtatggaagaggattttctagatc

SEQ ID NO: 346521 - DNA, 75 bp, Artificial Sequence
  Synthetic
gactgtatatctagcgtcgacatctatatactatatagtaataccaatactcaagactacgaaactgatacaatc

SEQ ID NO: 346522 - DNA, 75 bp, Artificial Sequence
  Synthetic
ttttcactttttataattttaccatctgactcatggattcattaatatctttataagagctactaacgtataatt

SEQ ID NO: 346523 - DNA, 75 bp, Artificial Sequence
  Synthetic
ctgactcatggattcattaatatctttataagagctactaacgtataattctttataactgaactgagatatata

SEQ ID NO: 346524 - DNA, 75 bp, Artificial Sequence
  Synthetic
taatggcaaatgtatagaacaacgaaattatactagagttgttaaagttaatattttctatgagctgttccaata

SEQ ID NO: 346525 - DNA, 75 bp, Artificial Sequence
  Synthetic
aattatactagagttgttaaagttaatattttctatgagctgttccaataaattatttgttgtaactgcgttcaa

SEQ ID NO: 346526 - DNA, 75 bp, Artificial Sequence
  Synthetic
tattattatcccattgtaaagcccctaattcgactatcgaatatcctgctctgatagcagtttcaatatcgacgg

SEQ ID NO: 346527 - DNA, 75 bp, Artificial Sequence
  Synthetic
atatgttaccatcgtaatatctacccgcgtctatcttaaacgtttccatcgctttaaagacgtttccgatagatg

SEQ ID NO: 346528 - DNA, 75 bp, Artificial Sequence
  Synthetic
taattcgactatcgaatatcctgctctgatagcagtttcaatatcgacggacgtcaatactgtaataaaggtggt

SEQ ID NO: 346529 - DNA, 75 bp, Artificial Sequence
  Synthetic
acaatactagtctagaaagaaatttgtaatcattttctgtgacgggagtccatatatctgtatcatcgtctagtt

SEQ ID NO: 346530 - DNA, 75 bp, Artificial Sequence
  Synthetic
cggtaactttacacaacgcgatatataactttccttttgtaccatttttaacgtagttgggacgtcctgcagggt

SEQ ID NO: 346531 - DNA, 75 bp, Artificial Sequence
  Synthetic
ataatcaatgagacatcactatccgataacgaatgaagtctagcactagtatgccatttacttaatattgtcgtc

SEQ ID NO: 346532 - DNA, 75 bp, Artificial Sequence
  Synthetic
ggataatacatccccattccagtattctcggatactctattaatgacactagttaagaacatgtcttctattcta

SEQ ID NO: 346533 - DNA, 75 bp, Artificial Sequence
  Synthetic
tctcggatactctattaatgacactagttaagaacatgtcttctattctagaaaacgaaaacatcctacatggac

SEQ ID NO: 346534 - DNA, 75 bp, Artificial Sequence
  Synthetic
agaatattgatttactaaaatatctatgtttaacttttgttctataacgtccttatcggcggtatcggtacatat

SEQ ID NO: 346535 - DNA, 75 bp, Artificial Sequence
  Synthetic
gatttcaaggatgccatagattctttgaccaacgatttagtattgcgtttagcatctgatttttttattaaatcg

SEQ ID NO: 346536 - DNA, 75 bp, Artificial Sequence
  Synthetic
tgaccaacgatttagtattgcgtttagcatctgatttttttattaaatcgaatggtcggctctctggtttgctac

SEQ ID NO: 346537 - DNA, 75 bp, Artificial Sequence
  Synthetic
gcatccatccaaataaccctagcaccatcggatgatattaatgtattattatagattttccatccacaattattg

SEQ ID NO: 346538 - DNA, 75 bp, Artificial Sequence
  Synthetic
gcattggtccattatcagtaatagctccataaactgatacggcgatggtttttatatgtgtttgatctaacgagg

SEQ ID NO: 346539 - DNA, 75 bp, Artificial Sequence
  Synthetic
tccataaactgatacggcgatggtttttatatgtgtttgatctaacgaggaagaaattcgcgcccacaattcatc

SEQ ID NO: 346540 - DNA, 75 bp, Artificial Sequence
  Synthetic
tatatgtttctaaatttttaatccaaatataatgatgacctatatgccctattatcatactgtcaactatagtac

SEQ ID NO: 346541 - DNA, 75 bp, Artificial Sequence
  Synthetic
tacctgtatgtacaacagtgatatgtgtaagaactctcttcattactatatatcgtctcatagagaatctcaatc

SEQ ID NO: 346542 - DNA, 75 bp, Artificial Sequence
  Synthetic
tataatatcgatcaacggataatctgaagtttttggagaataatatgactcatgatctatttcgtccataaacaa

SEQ ID NO: 346543 - DNA, 75 bp, Artificial Sequence
  Synthetic
tctattttggtggaggattatatgatataattcgtggataatcattcttaagacacatttctttattcgtaaatc

SEQ ID NO: 346544 - DNA, 75 bp, Artificial Sequence
  Synthetic
ttacgcaatatctcaatagtttcataattgttagctgttttcatcaagatttgtatcctgtttaacatgatggcg

SEQ ID NO: 346545 - DNA, 75 bp, Artificial Sequence
  Synthetic
ttgtatcctgtttaacatgatggcgttctatacgtttctattttctattttttaaatttttaacgatttactgtg

SEQ ID NO: 346546 - DNA, 75 bp, Artificial Sequence
  Synthetic
tttaaatttttaacgatttactgtggctagatacccaatctctctcaaatatttttttagcctcgcttacaagct

SEQ ID NO: 346547 - DNA, 75 bp, Artificial Sequence
  Synthetic
gctagatacccaatctctctcaaatatttttttagcctcgcttacaagctgtttatctatactattaaaactgac

SEQ ID NO: 346548 - DNA, 75 bp, Artificial Sequence
  Synthetic
gaacatattcgtcgtcgactatcaacaattttgtattattctgaatagtgaaaaccttcacagatagatcatttt

SEQ ID NO: 346549 - DNA, 75 bp, Artificial Sequence
  Synthetic
ggcggttgccatagaatatacgtcgttcttatcccaattaccaactagaagtctgatcttaactcctctattaat

SEQ ID NO: 346550 - DNA, 75 bp, Artificial Sequence
  Synthetic
gtctgatcttaactcctctattaatggctgcttctataatggagttgtaaatgtcgggccaatagtagctattac

SEQ ID NO: 346551 - DNA, 75 bp, Artificial Sequence
  Synthetic
taatttcgaaatcaagttatcgtctgtattaatgttgtccactatggagtcgatcctctcattgttctttacagt

SEQ ID NO: 346552 - DNA, 75 bp, Artificial Sequence
  Synthetic
atgtcgggccaatagtagctattaccgtcgacacgtgtagtgggaactatggccaaatgttcaatatctatacta

SEQ ID NO: 346553 - DNA, 75 bp, Artificial Sequence
  Synthetic
agaatatcccaataggtgttccggagaatcagtaaagaacactccacctataggattcttaatatgatacgcagt

SEQ ID NO: 346554 - DNA, 75 bp, Artificial Sequence
  Synthetic
tatttatctcttcattatatagcacgcgtgtgttccaatttttccacatcccatataatacaggattataatctc

SEQ ID NO: 346555 - DNA, 75 bp, Artificial Sequence
  Synthetic
gaatcagtaaagaacactccacctataggattcttaatatgatacgcagtgctaactggcagacaacaagccgca

SEQ ID NO: 346556 - DNA, 75 bp, Artificial Sequence
  Synthetic
atcaaatcttctacgaagatctgttgccagcgggggataatcagaatatacacctaacgttttaatcgtatgtat

SEQ ID NO: 346557 - DNA, 75 bp, Artificial Sequence
  Synthetic
gccagcgggggataatcagaatatacacctaacgttttaatcgtatgtatagatcctccagtaaatgacgcgttt

SEQ ID NO: 346558 - DNA, 75 bp, Artificial Sequence
  Synthetic
cagtgatgcctacatgccgttttttgaaactgaatagatgcgtctagaagcgatgctacgctagtcacaatcacc

SEQ ID NO: 346559 - DNA, 75 bp, Artificial Sequence
  Synthetic
tcccacattattttttttatctatattaacggttataaaatttatatccgggcagtgactttgtagctctcccag

SEQ ID NO: 346560 - DNA, 75 bp, Artificial Sequence
  Synthetic
ttaacggttataaaatttatatccgggcagtgactttgtagctctcccagatttcttttccctcgttcatctagc

SEQ ID NO: 346561 - DNA, 75 bp, Artificial Sequence
  Synthetic
aataagcgctcccctagtcgtactcagaggattacaacaaaaagatgctatgtatatatatttcttagctagagt

SEQ ID NO: 346562 - DNA, 75 bp, Artificial Sequence
  Synthetic
agaggattacaacaaaaagatgctatgtatatatatttcttagctagagtgataatttcgttaaaacattcaaat

SEQ ID NO: 346563 - DNA, 75 bp, Artificial Sequence
  Synthetic
cagcctacattttgctcccgcaggtaccgatgcaaatggccacatttagttaacataaaaacttatacatcctgt

SEQ ID NO: 346564 - DNA, 75 bp, Artificial Sequence
  Synthetic
ctatttatcagaacactacagtagtaattaatgaaacggagactgttgaagtacttaatgaagataccaaacaga

SEQ ID NO: 346565 - DNA, 75 bp, Artificial Sequence
  Synthetic
cggctatatcgctaaaattttcatcaaagtcgacatcacaacctaactcagtcaatatattaagaagttccatga

SEQ ID NO: 346566 - DNA, 75 bp, Artificial Sequence
  Synthetic
cgtatccattgtagattgttgaccgattatcgagtttaaatcattactaatactcaatccttcagaatacaatct

SEQ ID NO: 346567 - DNA, 75 bp, Artificial Sequence
  Synthetic
ttggtctaatactgatgatagagatattattacttcccataatggatcttctagtagtcaccttaaagcccattg

SEQ ID NO: 346568 - DNA, 75 bp, Artificial Sequence
  Synthetic
attatcgagtttaaatcattactaatactcaatccttcagaatacaatctgtatttcattgtaaatttataggcg

SEQ ID NO: 346569 - DNA, 75 bp, Artificial Sequence
  Synthetic
aaaaacattattctatttcgaatttaggcttccaaaaatttttcatccgtaaaccgataataatatatatagact

SEQ ID NO: 346570 - DNA, 75 bp, Artificial Sequence
  Synthetic
aggcttccaaaaatttttcatccgtaaaccgataataatatatatagacttgttaatagtcggaataaatagatt

SEQ ID NO: 346571 - DNA, 75 bp, Artificial Sequence
  Synthetic
ttttttgctgtttcgaaactttatcaatacacgttaatacaaacccaggaaggagatattgaaactgaggctgtt

SEQ ID NO: 346572 - DNA, 75 bp, Artificial Sequence
  Synthetic
aatacacgttaatacaaacccaggaaggagatattgaaactgaggctgttgaaaatgaaacggtgaatacaataa

SEQ ID NO: 346573 - DNA, 75 bp, Artificial Sequence
  Synthetic
atcgtctacccaattcggttatgaatgaaattgtcgccaatcttacacccaaacccttgttatccattagcatag

SEQ ID NO: 346574 - DNA, 75 bp, Artificial Sequence
  Synthetic
cgtttacaaacgacatactgtatgtaaacaatctgtcactgattaattatttgccgttgtctgtattcattatta

SEQ ID NO: 346575 - DNA, 75 bp, Artificial Sequence
  Synthetic
taatggatgtcgatggtatgtatctaggagtatctattttaacaaagcatcgatttgctaatatacaattatcat

SEQ ID NO: 346576 - DNA, 75 bp, Artificial Sequence
  Synthetic
cgatttgctaatatacaattatcattttgattaattgttattttattcatattcttaaaaggtttcatatttatc

SEQ ID NO: 346577 - DNA, 75 bp, Artificial Sequence
  Synthetic
actcctcattacgtttcattttttgtctataatatccattttgttcatctcggtacatagattatccaattgaga

SEQ ID NO: 346578 - DNA, 75 bp, Artificial Sequence
  Synthetic
aactagttatagttaacattttattatttgataccctgatattaatacccctgccgttactattatttataactg

SEQ ID NO: 346579 - DNA, 75 bp, Artificial Sequence
  Synthetic
cttccaaaattgtctattataaactcaccgataatttttttattacatgttttcatattcattaggattatcaaa

SEQ ID NO: 346580 - DNA, 75 bp, Artificial Sequence
  Synthetic
taatttattgcacggtaaggaagtagaatcataaagaacagtactcaatcaatagcaatcatgaaacaatatatc

SEQ ID NO: 346581 - DNA, 75 bp, Artificial Sequence
  Synthetic
cgttgatattgcaagacgtcattctaaaagacggaggatctccatcaaatgccaaacaatcacgtacaaagtaca

SEQ ID NO: 346582 - DNA, 75 bp, Artificial Sequence
  Synthetic
gtagaaatactaatttgttttactctataaaatactaatgcatctatttcatcgttttgtataacgtctttccaa

SEQ ID NO: 346583 - DNA, 75 bp, Artificial Sequence
  Synthetic
gtgccaaattccaaatttttttcattgatagtaccaaattcttctatctctttaactacttgcatagataggtaa

SEQ ID NO: 346584 - DNA, 75 bp, Artificial Sequence
  Synthetic
cagatgtagcgaagaagagaaagacagcgacatcaagacccatccagtactcgggtctaacatctctcataagaa

SEQ ID NO: 346585 - DNA, 75 bp, Artificial Sequence
  Synthetic
cgttaaagtatgcgatgttagaactgtagaatgcgaaggaagtaaagcttcctgcgtactcaaagtagataaacc

SEQ ID NO: 346586 - DNA, 75 bp, Artificial Sequence
  Synthetic
gttttttatctctttcagtatgtgaatagataggtattttatctctattcatcatcgaatttaagagatccgata

SEQ ID NO: 346587 - DNA, 75 bp, Artificial Sequence
  Synthetic
atagataggtattttatctctattcatcatcgaatttaagagatccgataaacattgtttgtattctccagatgt

SEQ ID NO: 346588 - DNA, 75 bp, Artificial Sequence
  Synthetic
catgtaccttccccttatcactaaggagaatagtatttgagaaatatgtatacatgatattatcatgaattagat

SEQ ID NO: 346589 - DNA, 75 bp, Artificial Sequence
  Synthetic
gagaatagtatttgagaaatatgtatacatgatattatcatgaattagatatacagaatttgtaacactctcgaa

SEQ ID NO: 346590 - DNA, 75 bp, Artificial Sequence
  Synthetic
tttcatctagatacactagacattttttaaagctaaaatagtctttagtagtgacagtaactatgcgattatttt

SEQ ID NO: 346591 - DNA, 75 bp, Artificial Sequence
  Synthetic
ataccatgtgtatatctaacgtattctagcatagttgccatacgtgcattaaacttttcaggatctttggataga

SEQ ID NO: 346592 - DNA, 75 bp, Artificial Sequence
  Synthetic
acatttttatcatgttcaatagttgaaacgtcggatccactatatagatattatctataaagattttaggaacta

SEQ ID NO: 346593 - DNA, 75 bp, Artificial Sequence
  Synthetic
tttggattaattagatatagagaatatgatccgtaacatatacaacttttattatggcgtctaagatattcttcc

SEQ ID NO: 346594 - DNA, 75 bp, Artificial Sequence
  Synthetic
atgatccgtaacatatacaacttttattatggcgtctaagatattcttccatcaacttattaacatttttgacta

SEQ ID NO: 346595 - DNA, 75 bp, Artificial Sequence
  Synthetic
acgttcatagaatttagcatatctcttgccaattcttccattgatgttacattataagaaattttagatgaaatt

SEQ ID NO: 346596 - DNA, 75 bp, Artificial Sequence
  Synthetic
attggaaggatatacaaagcaattgccgtctccagctcctggtatatgtttaccagctggaaaagttgttccaca

SEQ ID NO: 346597 - DNA, 75 bp, Artificial Sequence
  Synthetic
ttgccaattcttccattgatgttacattataagaaattttagatgaaattacatttggagctttaatagtaagaa

SEQ ID NO: 346598 - DNA, 75 bp, Artificial Sequence
  Synthetic
agtatcattctttgctttcgttaactgtttggaggaagaatctttgttattgcatttaatctcgaaattcagagt

SEQ ID NO: 346599 - DNA, 75 bp, Artificial Sequence
  Synthetic
atcgtaaataatttacctatattatatgtttgagtctgtttagaaaagtagctaagtatacgatcttttatttct

SEQ ID NO: 346600 - DNA, 75 bp, Artificial Sequence
  Synthetic
gctaagtatacgatcttttatttctgatgcagatgtatcaacatcggaaaaaaatctttttttattcttttttac

SEQ ID NO: 346601 - DNA, 75 bp, Artificial Sequence
  Synthetic
tagcttgtaattttaacatatgatattcgttcacactaggtactctgcctaaataggtttctataatctttaatg

SEQ ID NO: 346602 - DNA, 75 bp, Artificial Sequence
  Synthetic
gcaaataaaatctatatgaccgataagagacgtgttattacatcccggttaaacattaatcctgttaaggaagaa

SEQ ID NO: 346603 - DNA, 75 bp, Artificial Sequence
  Synthetic
tggaacgaattctacaacattattataaaggactttgggtagataagtgggatgaaatcctattttaattaatgc

SEQ ID NO: 346604 - DNA, 75 bp, Artificial Sequence
  Synthetic
taaaactctgattattgtctaatatggtctcaacacaaactttttcacagagcgatagagtttttgataactcgt

SEQ ID NO: 346605 - DNA, 75 bp, Artificial Sequence
  Synthetic
attttatctaattcgatacaaactcctgatactggttcagaaagtaattcattaattttcagtcctttatagaag

SEQ ID NO: 346606 - DNA, 75 bp, Artificial Sequence
  Synthetic
gaatctaatgatgacgtacccaagaagtttatctactgccaatttagctgcattatttttagcatctcgtttaga

SEQ ID NO: 346607 - DNA, 75 bp, Artificial Sequence
  Synthetic
ttccagttcatatttattagataccgcattgcccagattttgatattctatgaattcctctgaaaataaatccaa

SEQ ID NO: 346608 - DNA, 75 bp, Artificial Sequence
  Synthetic
tgaattcctctgaaaataaatccaaaataactagacattctattttttgtggattagtgtactctcttccctcta

SEQ ID NO: 346609 - DNA, 75 bp, Artificial Sequence
  Synthetic
tgataaatatctagagggaatataatatagtccataggatgccaatctagcaatgtcgaataactgtaatttgat

SEQ ID NO: 346610 - DNA, 75 bp, Artificial Sequence
  Synthetic
gtatggctttaagatagctgtgataccgtatacaggtcggtgtcggagattcgaatctctttgaggcgacttatg

SEQ ID NO: 346611 - DNA, 75 bp, Artificial Sequence
  Synthetic
tcattccatcgatacatccttctatgttgagatgtatatatccaggaattcttttattaatgtcaggaaatgtat

SEQ ID NO: 346612 - DNA, 75 bp, Artificial Sequence
  Synthetic
tcttcgttcttcattatgaattgattcttgaggtataaacctaacacaaattatattattagacttttcgtatgt

SEQ ID NO: 346613 - DNA, 75 bp, Artificial Sequence
  Synthetic
aatgtctttcatgttataagtttttaatcctggaatagaatctattttaatgaggcttttaaacgcagagttctc

SEQ ID NO: 346614 - DNA, 75 bp, Artificial Sequence
  Synthetic
aatcctggaatagaatctattttaatgaggcttttaaacgcagagttctccaacgagtcaaaacataatactctg

SEQ ID NO: 346615 - DNA, 75 bp, Artificial Sequence
  Synthetic
tttttgaattagtttataattacaacataatagataaggaagtgtgcaaatagtacgcggaaaaaacataatagc

SEQ ID NO: 346616 - DNA, 75 bp, Artificial Sequence
  Synthetic
acacaattaacaatatattattagtttatattactgaattaataatataaaattcccaatcttgtcataaacaca

SEQ ID NO: 346617 - DNA, 75 bp, Artificial Sequence
  Synthetic
tattttttaatgtaaagagtgatcaaatcattgtgtttattgtaccatcttgttgtaaatgtgtattcggttatc

SEQ ID NO: 346618 - DNA, 75 bp, Artificial Sequence
  Synthetic
aatcattgtgtttattgtaccatcttgttgtaaatgtgtattcggttatcggatctgctcctttttctattaaag

SEQ ID NO: 346619 - DNA, 75 bp, Artificial Sequence
  Synthetic
tgtatacacataaccattactaacgtagaatgtataggaagagatgtaacgggaacagggtttgttgattcgcaa

SEQ ID NO: 346620 - DNA, 75 bp, Artificial Sequence
  Synthetic
gcgtatctagtcagatcgtatagcctatccaataatccatcgtctgtgcgtagatcacatcgtacactttttaat

SEQ ID NO: 346621 - DNA, 75 bp, Artificial Sequence
  Synthetic
ttaatacgtcttgcacgtaatctattatagatgccaagatatctatataattattttgtaagatgatgttaacta

SEQ ID NO: 346622 - DNA, 75 bp, Artificial Sequence
  Synthetic
ccgcagtaagaaattcttgttcaatggatactgcatctgttataatagatctaacggtttcttcactcggtggat

SEQ ID NO: 346623 - DNA, 75 bp, Artificial Sequence
  Synthetic
aactctgtctttgtgatgtctagtttcgtaatatctatagcatcctcaaaaaatatattcgcatatattcccaag

SEQ ID NO: 346624 - DNA, 75 bp, Artificial Sequence
  Synthetic
tcgtaatatctatagcatcctcaaaaaatatattcgcatatattcccaagtcttcagttctatcttctaaaaaat

SEQ ID NO: 346625 - DNA, 75 bp, Artificial Sequence
  Synthetic
atttcctagatttactaggattagagaagataaaacgtggaaagaatctactcatctaaacgatttagtaaactt

SEQ ID NO: 346626 - DNA, 75 bp, Artificial Sequence
  Synthetic
aaaaaaattatttaacttttcattaatagggatttgacgtatgtagcgtacaaaatgattgttcctggtatatag

SEQ ID NO: 346627 - DNA, 75 bp, Artificial Sequence
  Synthetic
atgatatagtttttgacactatcttctgtcaattgattcttattcactatatctaagaaacggatagcgtcccta

SEQ ID NO: 346628 - DNA, 75 bp, Artificial Sequence
  Synthetic
atctaagaaacggatagcgtccctaggacgaactactgccattaatatctctattatagcttctggacataattc

SEQ ID NO: 346629 - DNA, 75 bp, Artificial Sequence
  Synthetic
actattccgtatctatctaacatagttttaagaaagtcagaatctaagacctgatgttcatatattggttcatac

SEQ ID NO: 346630 - DNA, 75 bp, Artificial Sequence
  Synthetic
aagaagtatactatcgtcatttttttctctagatccagctactgctgataatgatagaatagacgctatttatcc

SEQ ID NO: 346631 - DNA, 75 bp, Artificial Sequence
  Synthetic
ttgttgatgaaggatagaatatactcaatagaatttgtaccaacaaactgttctcttatgaatcgtatatcatca

SEQ ID NO: 346632 - DNA, 75 bp, Artificial Sequence
  Synthetic
caatagaatttgtaccaacaaactgttctcttatgaatcgtatatcatcatctgaaataatcatgtaaggcatac

SEQ ID NO: 346633 - DNA, 75 bp, Artificial Sequence
  Synthetic
taatttatgtgtgaggcaaatttgtccacgttctttaattttgttatagtagatatcaaatccaatggagctaca

SEQ ID NO: 346634 - DNA, 75 bp, Artificial Sequence
  Synthetic
attataaaggactttgggtagataagtgggatgaaatcctattttaattaatgctatcgcattgtcctcgtgcag

SEQ ID NO: 346635 - DNA, 75 bp, Artificial Sequence
  Synthetic
aggattcacttccgtgggacaatatcgacaattgcgtggagatcattaaatgtttcatcagaaatgactccatga

SEQ ID NO: 346636 - DNA, 75 bp, Artificial Sequence
  Synthetic
cgacaattgcgtggagatcattaaatgtttcatcagaaatgactccatgaaaaccgccgaagaacttcgtgcaat

SEQ ID NO: 346637 - DNA, 75 bp, Artificial Sequence
  Synthetic
tacgaatatctgtgacagatatcatctttagagaatatactagtcgcgttaatagtactacaatttgtatttttt

SEQ ID NO: 346638 - DNA, 75 bp, Artificial Sequence
  Synthetic
aatagtactacaatttgtattttttaatctatctcaataaaaaaattaatatgtatgattcaatgtataactaaa

SEQ ID NO: 346639 - DNA, 75 bp, Artificial Sequence
  Synthetic
tactcttccgtcgatgtctacacaggcataaaatgtaggagagttactaggccccactgattcaatacgaaaaga

SEQ ID NO: 346640 - DNA, 75 bp, Artificial Sequence
  Synthetic
tagcatctttccaatcaataatttttttagccggaataacatcatcaaaagacttatgatcctctctcattgatt

SEQ ID NO: 346641 - DNA, 75 bp, Artificial Sequence
  Synthetic
tttagccggaataacatcatcaaaagacttatgatcctctctcattgatttttcgcgggatacatcatctattat

SEQ ID NO: 346642 - DNA, 75 bp, Artificial Sequence
  Synthetic
gtcgtttgataaatacgatggtataataactaaatgtcataaagaaacaatattgctcaaactatccactgttct

SEQ ID NO: 346643 - DNA, 75 bp, Artificial Sequence
  Synthetic
accaacgaggaggaatatcgtcggagctgtacaccatagcactacgttgaagatcgtacagagctttattaactt

SEQ ID NO: 346644 - DNA, 75 bp, Artificial Sequence
  Synthetic
gctgtacaccatagcactacgttgaagatcgtacagagctttattaacttctcgcttctccatattaagttgtct

SEQ ID NO: 346645 - DNA, 75 bp, Artificial Sequence
  Synthetic
tttagagagaactaacacaatcagtaataaaactaatttattttatcattttttttattcatcatcctctggtgg

SEQ ID NO: 346646 - DNA, 75 bp, Artificial Sequence
  Synthetic
ttaaaggtatctaatgcagatttagaaaattctctatctcttaatgaatttttaaaatcattatatagtgttgct

SEQ ID NO: 346647 - DNA, 75 bp, Artificial Sequence
  Synthetic
ctgattaacccgtcatctataggtgatgctggttctggagattctggaggagatggattattatctggaagaatc

SEQ ID NO: 346648 - DNA, 75 bp, Artificial Sequence
  Synthetic
aggtggtgtcctagtacacaatatcataaacaaactaataaacatcccacattcagattccaacagctgattaac

SEQ ID NO: 346649 - DNA, 75 bp, Artificial Sequence
  Synthetic
gcgaaatgctctaaatttgggaggcttaaagtgttgtttgcaatctctacacgcgtgtctaactagtggaggttc

SEQ ID NO: 346650 - DNA, 75 bp, Artificial Sequence
  Synthetic
agttaggacacggtgtattgtatttctcgtcaagaacgttaaaataatcgttgtaactcacatcctttattttat

SEQ ID NO: 346651 - DNA, 75 bp, Artificial Sequence
  Synthetic
ctcgtcaagaacgttaaaataatcgttgtaactcacatcctttattttatctatattgtattctactcctttctt

SEQ ID NO: 346652 - DNA, 75 bp, Artificial Sequence
  Synthetic
gcagttacaagatttttagcgtattatcctccgatgatgtgttattttttaactgctacacctagaccagctaac

SEQ ID NO: 346653 - DNA, 75 bp, Artificial Sequence
  Synthetic
cgctagtacccttaatcatatcacatagtgttttatattccaaatttgtggcaatagacggtttatttctatacg

SEQ ID NO: 346654 - DNA, 75 bp, Artificial Sequence
  Synthetic
tagtgttttatattccaaatttgtggcaatagacggtttatttctatacgatagtttgtttctggaatcctttga

SEQ ID NO: 346655 - DNA, 75 bp, Artificial Sequence
  Synthetic
tagattttgtattacctatattcttgatgtagtactttgatgatttttccatggcccattctattaagtcttcca

SEQ ID NO: 346656 - DNA, 75 bp, Artificial Sequence
  Synthetic
aatgaataacccaggaaaacaagttccgtttatgaggacggacatgctacaaaatatgttcgcggctaatcgcga

SEQ ID NO: 346657 - DNA, 75 bp, Artificial Sequence
  Synthetic
gatgtagtactttgatgatttttccatggcccattctattaagtcttccaagttggcatcatccacatattgtga

SEQ ID NO: 346658 - DNA, 75 bp, Artificial Sequence
  Synthetic
ttaactttgttcatttatattttttcattattatgttgatattaacaaaagtgaatatatatatgttaataattg

SEQ ID NO: 346659 - DNA, 75 bp, Artificial Sequence
  Synthetic
taccggcatcataaacacggagtttattttatatgtctcgcataaacattactaaaaaaatatattgttcggttt

SEQ ID NO: 346660 - DNA, 75 bp, Artificial Sequence
  Synthetic
ccatctatcgtagtgaggacacaagtgaacctataatgagcaaatttattagtatcggttacatgaaggacttta

SEQ ID NO: 346661 - DNA, 75 bp, Artificial Sequence
  Synthetic
atgatcaatgacgatagctttactctgaaaagaaagtatcaaatcgatagtgcggagtcaacaataaaaatggat

SEQ ID NO: 346662 - DNA, 75 bp, Artificial Sequence
  Synthetic
acataaaatttaagagaatgattatgactactactctagaagatatagcaccatctattccaaataatcagaaaa

SEQ ID NO: 346663 - DNA, 75 bp, Artificial Sequence
  Synthetic
gactactactctagaagatatagcaccatctattccaaataatcagaaaacttataaactattctcggacatttc

SEQ ID NO: 346664 - DNA, 75 bp, Artificial Sequence
  Synthetic
aaaaacccttacaactacagtagtattggagtaaatatacaatgcatttttatatacattactgaattattatta

SEQ ID NO: 346665 - DNA, 75 bp, Artificial Sequence
  Synthetic
tatatacattactgaattattattactgaattattattactgaattattattaattatatcgtatttgtgctata

SEQ ID NO: 346666 - DNA, 75 bp, Artificial Sequence
  Synthetic
tgctttacatgtttcccaatttgtttggagatgaccatagattcattcgttatagaatgcatccaatgagtaaaa

SEQ ID NO: 346667 - DNA, 75 bp, Artificial Sequence
  Synthetic
tctcgcggagtcgagagactttgtagaaacaacgaaggattaactccgctaggagtatacagtaagcatagatac

SEQ ID NO: 346668 - DNA, 75 bp, Artificial Sequence
  Synthetic
ttcacccacacgtttttcgaaaaaattagttttaccttctaatgatatattttccatgaaatcaaacggattggt

SEQ ID NO: 346669 - DNA, 75 bp, Artificial Sequence
  Synthetic
tctgaagaagataccctctttatcaaacagatggtagaacaatgtgtgacatcccaggaattggtggaaaaagtg

SEQ ID NO: 346670 - DNA, 75 bp, Artificial Sequence
  Synthetic
gaccgatggagtaggtgcaacaattttttgttcgatgtatgtatgtactggagccattgttttaactataatggt

SEQ ID NO: 346671 - DNA, 75 bp, Artificial Sequence
  Synthetic
aacagatggtagaacaatgtgtgacatcccaggaattggtggaaaaagtgttgaagatactgtttagagatttgt

SEQ ID NO: 346672 - DNA, 75 bp, Artificial Sequence
  Synthetic
ggatttattggattggatacactaaaattaaacattgttcatgatatagttgaaccatgtatgcctgttcgtagg

SEQ ID NO: 346673 - DNA, 75 bp, Artificial Sequence
  Synthetic
aattaaacattgttcatgatatagttgaaccatgtatgcctgttcgtaggccagtggctaagatactgtgtaaag

SEQ ID NO: 346674 - DNA, 75 bp, Artificial Sequence
  Synthetic
acatttttaaactgtttgtataatatctctctgatacaatcagatatatctattgtgtcggtagatgataccgtt

SEQ ID NO: 346675 - DNA, 75 bp, Artificial Sequence
  Synthetic
tattgtgtcggtagatgataccgttacatttgaattaatggtgttccattttacaacttttaacaagttgaccaa

SEQ ID NO: 346676 - DNA, 75 bp, Artificial Sequence
  Synthetic
aattaataaagtagtatatggaagagagtctcacgtaaaatggcgggatatatggcaagaacataatgatggcgt

SEQ ID NO: 346677 - DNA, 75 bp, Artificial Sequence
  Synthetic
aaaaacttgtgtgaaattttgtaccaaagaaaaaacgtgagcagtatcccctatatggattttactagatcattt

SEQ ID NO: 346678 - DNA, 75 bp, Artificial Sequence
  Synthetic
cttcaagagtgcattgactttgttagtgaataggcatttcatctttctccaatactaattcaaattgttaaatta

SEQ ID NO: 346679 - DNA, 75 bp, Artificial Sequence
  Synthetic
agtatgatatcgccggtcgtcataaggaactaaagcgctatagagtagacattaatagaatgaagaatgcctaca

SEQ ID NO: 346680 - DNA, 75 bp, Artificial Sequence
  Synthetic
gtgaataggcatttcatctttctccaatactaattcaaattgttaaattaataatggatagtataaatagttatt

SEQ ID NO: 346681 - DNA, 75 bp, Artificial Sequence
  Synthetic
tgcaattgtctagtaacctagatgggcatagggatattgataatctctacgagaatatattgttggacgttatcg

SEQ ID NO: 346682 - DNA, 75 bp, Artificial Sequence
  Synthetic
aaagaaaaaacgtgagcagtatcccctatatggattttactagatcatttatatgccaaaaaatattatactata

SEQ ID NO: 346683 - DNA, 75 bp, Artificial Sequence
  Synthetic
ataactctcttctataaaaatggattttattcgtagaaagtatcttatatacacagtagaaaataatatagattt

SEQ ID NO: 346684 - DNA, 75 bp, Artificial Sequence
  Synthetic
tttattcgtagaaagtatcttatatacacagtagaaaataatatagattttttaaaggatgatacattaagtaaa

SEQ ID NO: 346685 - DNA, 75 bp, Artificial Sequence
  Synthetic
cattgaagagagaaagagaataaaaatatttttgtaaaactttttttatgagaccatcgaagagagaataggaat

SEQ ID NO: 346686 - DNA, 75 bp, Artificial Sequence
  Synthetic
caattttcctcaacacgttattactaaggatgtattagctaataccaatttttttgttttcatacatatggtacg

SEQ ID NO: 346687 - DNA, 75 bp, Artificial Sequence
  Synthetic
aaggatgtattagctaataccaatttttttgttttcatacatatggtacgatgttgtaaagtgtacgaagcggtt

SEQ ID NO: 346688 - DNA, 75 bp, Artificial Sequence
  Synthetic
gaattatttatcgtttagtaacgcaatacaatcgtacaaggaaaccgtgcataaactaacacaagatgaaaaatt

SEQ ID NO: 346689 - DNA, 75 bp, Artificial Sequence
  Synthetic
atacaatcgtacaaggaaaccgtgcataaactaacacaagatgaaaaatttttagaggttgccgaatacatggac

SEQ ID NO: 346690 - DNA, 75 bp, Artificial Sequence
  Synthetic
gatacaataaagatgtagatttggtcaaattgtttttggagaatggaaagcctcacggaataatgtgtagtattg

SEQ ID NO: 346691 - DNA, 75 bp, Artificial Sequence
  Synthetic
atttcacggaggggaacccatcaaagatatggaaatcatttttttaaaactgtttaagaaaacagacttcaaagt

SEQ ID NO: 346692 - DNA, 75 bp, Artificial Sequence
  Synthetic
tgtttaagaaaacagacttcaaagttgttaaaaaattaagtgttataagattacttatttgggcttacctaagca

SEQ ID NO: 346693 - DNA, 75 bp, Artificial Sequence
  Synthetic
actctatttcaacaaactggtagaatcgtccatagcaatctaacagaaacgtttagagattatatctttcccgga

SEQ ID NO: 346694 - DNA, 75 bp, Artificial Sequence
  Synthetic
tcgtccatagcaatctaacagaaacgtttagagattatatctttcccggagataagactagctattgggtgtggt

SEQ ID NO: 346695 - DNA, 75 bp, Artificial Sequence
  Synthetic
tccaaagttcatgttaagacccgcaccaacgatactgtaataagtggtgggatctctttttacaacttcttcgga

SEQ ID NO: 346696 - DNA, 75 bp, Artificial Sequence
  Synthetic
attaccatgtatgataaaattcttagttatatatactctgagataaaacaaggacgcgttaataaaaacatgctt

SEQ ID NO: 346697 - DNA, 75 bp, Artificial Sequence
  Synthetic
gttatatatactctgagataaaacaaggacgcgttaataaaaacatgcttaagttagtttatatctttgagcctg

SEQ ID NO: 346698 - DNA, 75 bp, Artificial Sequence
  Synthetic
gatatcctatctattattgatgcaaaaaacgacgattggaaaaaatattttattagtttttataaagctaatttt

SEQ ID NO: 346699 - DNA, 75 bp, Artificial Sequence
  Synthetic
aaaacgacgattggaaaaaatattttattagtttttataaagctaattttattaacggtaatacatttattagtg

SEQ ID NO: 346700 - DNA, 75 bp, Artificial Sequence
  Synthetic
gaatatttcgataatgaacgaattatgtctttattctctacgagtgctgcggacattaaacgatttgatgagtta

SEQ ID NO: 346701 - DNA, 75 bp, Artificial Sequence
  Synthetic
tgtctttattctctacgagtgctgcggacattaaacgatttgatgagttagatattaataacagttatatatcta

SEQ ID NO: 346702 - DNA, 75 bp, Artificial Sequence
  Synthetic
aagaagtgtcaaatctttaacgaggatacgtcgtattatgttaaggaatacaatacatacctgtttttgcacgag

SEQ ID NO: 346703 - DNA, 75 bp, Artificial Sequence
  Synthetic
ttctttacaggagaaaggtgtgcactctgaatttcgagattaaatgcaataacaaagattcttcctccaaacagt

SEQ ID NO: 346704 - DNA, 75 bp, Artificial Sequence
  Synthetic
atacgtcgtattatgttaaggaatacaatacatacctgtttttgcacgagtcggatcccatggtcatagagaacg

SEQ ID NO: 346705 - DNA, 75 bp, Artificial Sequence
  Synthetic
ttgtttagcaaaaacattttaaaatattatttagacggacaattggctcgtctaggtcttgtgttagatgattat

SEQ ID NO: 346706 - DNA, 75 bp, Artificial Sequence
  Synthetic
ccttcatatagtcttgtatctcttttctctttcgtattgtgtatataatcgttcgaactcgtctccccaaacatt

SEQ ID NO: 346707 - DNA, 75 bp, Artificial Sequence
  Synthetic
attatttagacggacaattggctcgtctaggtcttgtgttagatgattataaaggagacttgttagttaaaatga

SEQ ID NO: 346708 - DNA, 75 bp, Artificial Sequence
  Synthetic
gttcgaactcgtctccccaaacattgtttaatccagaacattcatccaaacacatcaacgaccactctccgtcat

SEQ ID NO: 346709 - DNA, 75 bp, Artificial Sequence
  Synthetic
acagataaaaaccctagtattcttccatcgctaatcaaaactattttagctagttataatatttccatcatcgtc

SEQ ID NO: 346710 - DNA, 75 bp, Artificial Sequence
  Synthetic
gtattttttatacctttaaaattgataaataaattttttctagtgatattttggcaagatgagaatcctatttct

SEQ ID NO: 346711 - DNA, 75 bp, Artificial Sequence
  Synthetic
taaataaattttttctagtgatattttggcaagatgagaatcctatttctcatcgctttcatgtatgggtgtgtt

SEQ ID NO: 346712 - DNA, 75 bp, Artificial Sequence
  Synthetic
ttggcaagatgagaatcctatttctcatcgctttcatgtatgggtgtgttcactcatatgttaacgcggttgaaa

SEQ ID NO: 346713 - DNA, 75 bp, Artificial Sequence
  Synthetic
gtacattgtgtgttagtcttgctatcgcataatctggaagcgtatgttcccggaggacacgataaacaacacaaa

SEQ ID NO: 346714 - DNA, 75 bp, Artificial Sequence
  Synthetic
ataaatgggaactgctgcaacaattcagactcccaccaaattaatgaataaagaaaatgcagaaatgattttgga

SEQ ID NO: 346715 - DNA, 75 bp, Artificial Sequence
  Synthetic
actctacagaaagtccttcatgtgactgatactaataaatttgataattataggttcacttgtgtcctcactacg

SEQ ID NO: 346716 - DNA, 75 bp, Artificial Sequence
  Synthetic
cagaaaataatcctgaatatattgattttcgtaacagatacgaagactatagatctctcattataaaaagtgatc

SEQ ID NO: 346717 - DNA, 75 bp, Artificial Sequence
  Synthetic
atttttatttatgatataatctaatggaattaatttgaattgatatttatccaatactaaagattatattagaat

SEQ ID NO: 346718 - DNA, 75 bp, Artificial Sequence
  Synthetic
acgcaacaaatgattatcaaacacatatacgaacaatatcttattccagtatctgaagtactattaaaacctata

SEQ ID NO: 346719 - DNA, 75 bp, Artificial Sequence
  Synthetic
tatacgaacaatatcttattccagtatctgaagtactattaaaacctataatgtccatgggtgacataattacat

SEQ ID NO: 346720 - DNA, 75 bp, Artificial Sequence
  Synthetic
taagataaaatctatactgcagaatagactagtatatgtggaaatgtcatagaaagttaaaagttaatgagagca

SEQ ID NO: 346721 - DNA, 75 bp, Artificial Sequence
  Synthetic
aactttaacaatctccgcacatggaactcatgtagcataggcaatgtaacgcgtctgttttatacattttttagt

SEQ ID NO: 346722 - DNA, 75 bp, Artificial Sequence
  Synthetic
atggctttaagatagctgtgataccgtatgtcttctgttcttaataccgtatacaggtcggtgtcggagattcga

SEQ ID NO: 346723 - DNA, 75 bp, Artificial Sequence
  Synthetic
tagttgataaaaagcggtaggatataaatattatggctgccaccgttccgcgttttgacgacgtgtacaaaaatg

SEQ ID NO: 346724 - DNA, 75 bp, Artificial Sequence
  Synthetic
aaatattatggctgccaccgttccgcgttttgacgacgtgtacaaaaatgcacaaagaagaattctagatcaaga

SEQ ID NO: 346725 - DNA, 75 bp, Artificial Sequence
  Synthetic
atctatatgatccgtgtttaagccataacataattttctaatacgagacgtgattttatcaaacatgacattttc

SEQ ID NO: 346726 - DNA, 75 bp, Artificial Sequence
  Synthetic
atccgccttgtatatgatgtttctgttttcaaacaccaagtcgaataccgtcttatcgtctttagtcggaaggtt

SEQ ID NO: 346727 - DNA, 75 bp, Artificial Sequence
  Synthetic
tatttgataattacgcgtatggatggataccagaaactgcaatttggagtagtagatacgcaaacctagatgcaa

SEQ ID NO: 346728 - DNA, 75 bp, Artificial Sequence
  Synthetic
gttttgattgttgtattcctgtatctctagataagttagttatatagtcccttccggcgatacgttttttccaag

SEQ ID NO: 346729 - DNA, 75 bp, Artificial Sequence
  Synthetic
tttgaaaggcggtatgaagaggagtcatggtattatagtattcgtctttctgaatgtcgaacctatttagtagat

SEQ ID NO: 346730 - DNA, 75 bp, Artificial Sequence
  Synthetic
catggtattatagtattcgtctttctgaatgtcgaacctatttagtagataccgtagtatattgagagtgtaact

SEQ ID NO: 346731 - DNA, 75 bp, Artificial Sequence
  Synthetic
gagtcctatatatttgaaaatcgttacggctcgattaaactttaatgattgcatagtgaatatatcattaggatt

SEQ ID NO: 346732 - DNA, 75 bp, Artificial Sequence
  Synthetic
ccagaaattaccatcaaaagcattaatacagttatgccgatcgcagttagaacggttatagcatccaccatttat

SEQ ID NO: 346733 - DNA, 75 bp, Artificial Sequence
  Synthetic
cttccttttgtaatttcccgtatttttgttcgtgccaattgagtaacattatgagaatatgacctgttgcacaat

SEQ ID NO: 346734 - DNA, 75 bp, Artificial Sequence
  Synthetic
tctggtagatacgtatcatatcttcgaaagttttctgctcttccaacaaacgagtttattagttttttgttactg

SEQ ID NO: 346735 - DNA, 75 bp, Artificial Sequence
  Synthetic
cttcacagactgaagattgtcgagattgtataccaaaaaggaagatgtccatgcggatactttggtggaatagat

SEQ ID NO: 346736 - DNA, 75 bp, Artificial Sequence
  Synthetic
tgatattactaaacacacattattcagatacgtctatacagataatgccaaacacctggcgttggctaggtatat

SEQ ID NO: 346737 - DNA, 75 bp, Artificial Sequence
  Synthetic
agatacgtctatacagataatgccaaacacctggcgttggctaggtatatgcatcaaacaggagactataagcct

SEQ ID NO: 346738 - DNA, 75 bp, Artificial Sequence
  Synthetic
acttaatagtaggaactggaaagctagacttgattattctataagtatagatacccttccaaataatattctctt

SEQ ID NO: 346739 - DNA, 75 bp, Artificial Sequence
  Synthetic
aggtatcaaagatatagatcaccctaatcttagtagagcaagaagtccatccgattatgagacattagctaatat

SEQ ID NO: 346740 - DNA, 75 bp, Artificial Sequence
  Synthetic
atttccacattagatggtaaatccaatagtgaaactatctttttaggaatgtatggactcgcgtttagaggagtg

SEQ ID NO: 346741 - DNA, 75 bp, Artificial Sequence
  Synthetic
aatataaaaatacttatggcatagtaactcataattgctgacgcgataaattcgtaataatctgttttgttcaaa

SEQ ID NO: 346742 - DNA, 75 bp, Artificial Sequence
  Synthetic
cgccatcatgaataacagcagtgaattgattgctgttattaatggatttagaaatagtggacgattttgtgatat

SEQ ID NO: 346743 - DNA, 75 bp, Artificial Sequence
  Synthetic
gacgtcaatcgtttaaagtaaacttcgtaaaatattctttgatcactgccgagtttaaaacttctatcgataatt

SEQ ID NO: 346744 - DNA, 75 bp, Artificial Sequence
  Synthetic
cgtaaaatattctttgatcactgccgagtttaaaacttctatcgataattgtctcatatgttttaatatttacaa

SEQ ID NO: 346745 - DNA, 75 bp, Artificial Sequence
  Synthetic
tcattcttatattctttgcttacggaacctatatttagaaacatctactaacgattttttatgcttgcattatta

SEQ ID NO: 346746 - DNA, 75 bp, Artificial Sequence
  Synthetic
atctcgtccatttcatccatctcataatgatttactttttcataattaaagatgtgaaagaaaaagaaaaccgaa

SEQ ID NO: 346747 - DNA, 75 bp, Artificial Sequence
  Synthetic
cgttctccaagttctatagtttctggattatttttattatattcagtaaccaaatacatattagggttatctgcg

SEQ ID NO: 346748 - DNA, 75 bp, Artificial Sequence
  Synthetic
agacgatctactatcaaattcggatcgtaaatctgtttctaaagaacggagaatatctatacatacctgattaga

SEQ ID NO: 346749 - DNA, 75 bp, Artificial Sequence
  Synthetic
taatcatattcttatgaaacttggaaacatctcttctagtttcactagtacctttattaattctctcaggtacag

SEQ ID NO: 346750 - DNA, 75 bp, Artificial Sequence
  Synthetic
ttatacatcaagagagcagaaataaccgaattagtcgtcgaatatatgattgaacgatttatctcctttagcgtc

SEQ ID NO: 346751 - DNA, 75 bp, Artificial Sequence
  Synthetic
gattgcataatcagattcttatataccgcctcaaactctattttaaaattattaaacaatactctattattaatc

SEQ ID NO: 346752 - DNA, 75 bp, Artificial Sequence
  Synthetic
gtctatctctgtaaacacggagtcggtatctccatacacgctacgaaaacgaaatctgtaatctataggcaacga

SEQ ID NO: 346753 - DNA, 75 bp, Artificial Sequence
  Synthetic
gtatctccatacacgctacgaaaacgaaatctgtaatctataggcaacgatgttttcacaatcggattaatatct

SEQ ID NO: 346754 - DNA, 75 bp, Artificial Sequence
  Synthetic
aacaaagtagtcgtgagaggatagttgttgtccgttgtcttatccatggtcgctccgttatctaacatgcatcga

SEQ ID NO: 346755 - DNA, 75 bp, Artificial Sequence
  Synthetic
ttttcacgatgcatcttattaaatgacgttttctcataagtggacatatagatgcagaagtattacctctatcat

SEQ ID NO: 346756 - DNA, 75 bp, Artificial Sequence
  Synthetic
accgttagataactctgctccatttagtaccgattctagatacaagatcattctacgtcctatggatgtgcaact

SEQ ID NO: 346757 - DNA, 75 bp, Artificial Sequence
  Synthetic
gattccaacagctgattaacttctacattaatacagcctattttcgctccaaatgtacattcgaaaaatctgaat

SEQ ID NO: 346758 - DNA, 75 bp, Artificial Sequence
  Synthetic
catatactgagttggctactatcttgtacgtatattgcatggaatcatagatggccttttcagttgaactggtag

SEQ ID NO: 346759 - DNA, 75 bp, Artificial Sequence
  Synthetic
aatagtctaggaatggttccttctatcgatctatcgaaaattgctatttcagagatgaggttcggtagtctaggt

SEQ ID NO: 346760 - DNA, 75 bp, Artificial Sequence
  Synthetic
tcgatctatcgaaaattgctatttcagagatgaggttcggtagtctaggttcacaatgaaccgtaatatatctag

SEQ ID NO: 346761 - DNA, 75 bp, Artificial Sequence
  Synthetic
cgtgttaaaaccatcggagaaggaatagaaataaaaattattatagtggtggaattcagttggaatattgcctcc

SEQ ID NO: 346762 - DNA, 75 bp, Artificial Sequence
  Synthetic
ctattggtactaacaacgacaccgactaatgtttccggagatagatttccaaagatacacacattaggatacaga

SEQ ID NO: 346763 - DNA, 75 bp, Artificial Sequence
  Synthetic
gtacgaaggtctacataaaccatccattcatgtacatgattaaagacaacacaggacgtatactttttataggga

SEQ ID NO: 346764 - DNA, 75 bp, Artificial Sequence
  Synthetic
ctaatgtttccggagatagatttccaaagatacacacattaggatacagactgttataatcaaagattaatacat

SEQ ID NO: 346765 - DNA, 75 bp, Artificial Sequence
  Synthetic
caaccatcgaccccattacgatagtatgcaggcaacccccattagagaggtacgtgtaatcagttttagtatttt

SEQ ID NO: 346766 - DNA, 75 bp, Artificial Sequence
  Synthetic
ggaaacttttgttttgtttctgatctaactaagatagttttagtttccaacaatagctttaacagtggacccttg

SEQ ID NO: 346767 - DNA, 75 bp, Artificial Sequence
  Synthetic
taactaagatagttttagtttccaacaatagctttaacagtggacccttgatgactgtactcgctctatattcga

SEQ ID NO: 346768 - DNA, 75 bp, Artificial Sequence
  Synthetic
gtttctactccataatactcccacaaatactgacacaaacaagcatcatgaatacagtatctagccatatctaaa

SEQ ID NO: 346769 - DNA, 75 bp, Artificial Sequence
  Synthetic
aatactgacacaaacaagcatcatgaatacagtatctagccatatctaaagctatgtttagattataatccttat

SEQ ID NO: 346770 - DNA, 75 bp, Artificial Sequence
  Synthetic
tccagtagacgacatagaatacatgtgcaatctctgacgcaatccatagctattctggtgctaattattcctata

SEQ ID NO: 346771 - DNA, 75 bp, Artificial Sequence
  Synthetic
attagtttccttgtttagagatgaccaaaaagactatacggtaacttctcagttcaataactacactatcgatac

SEQ ID NO: 346772 - DNA, 75 bp, Artificial Sequence
  Synthetic
tcattaggtaaagtaggacataatagtacgactttaaatccattttcccaaatatctttacgaattactttacat

SEQ ID NO: 346773 - DNA, 75 bp, Artificial Sequence
  Synthetic
gtacgactttaaatccattttcccaaatatctttacgaattactttacatataatatcctcatcaacagtcacat

SEQ ID NO: 346774 - DNA, 75 bp, Artificial Sequence
  Synthetic
ttattcagagaggcggtctcgatattgttacagccaagaaacatcaagtagaaattccattggaaaactttaata

SEQ ID NO: 346775 - DNA, 75 bp, Artificial Sequence
  Synthetic
gcaatcattcctcataagatgataaaaagtaaggtgggtgtgataaaaagtgtagtgagtgagtgagtgagaaag

SEQ ID NO: 346776 - DNA, 75 bp, Artificial Sequence
  Synthetic
tctgtagtatcgtcaccgatgaacgtcatttctctaactcctctatttaatactttacccatgcaactgaacgcg

SEQ ID NO: 346777 - DNA, 75 bp, Artificial Sequence
  Synthetic
tcatttctctaactcctctatttaatactttacccatgcaactgaacgcgttcttggatatagaatccaatttgt

SEQ ID NO: 346778 - DNA, 75 bp, Artificial Sequence
  Synthetic
atagttccattattgttattaacgtgaaacgtagtattggccatgccgcctactcccttatgactagactgattt

SEQ ID NO: 346779 - DNA, 75 bp, Artificial Sequence
  Synthetic
ttcagctgtagaaccagctgctccatgatttagaatagataaagtagataaaatagaaactggagaaatcaaaac

SEQ ID NO: 346780 - DNA, 75 bp, Artificial Sequence
  Synthetic
ttagaaccacgcaaggagattgatgtttcagaagttaaaactttatcatcttatatagatttcgaaaatactaaa

SEQ ID NO: 346781 - DNA, 75 bp, Artificial Sequence
  Synthetic
cttcctttttgtccggagatctaaagataatcttctctcctgttaataactctagacgattagtaatatatctca

SEQ ID NO: 346782 - DNA, 75 bp, Artificial Sequence
  Synthetic
gagggctttaatttccatttttttaatgggttgtggatgaggaatgagagtgtcttatttcgtccttggtttaca

SEQ ID NO: 346783 - DNA, 75 bp, Artificial Sequence
  Synthetic
aacaattgtttagctattcgtaacaaaactatttcagaacataaaactagttctcgttcgtaatccatttccatt

SEQ ID NO: 346784 - DNA, 75 bp, Artificial Sequence
  Synthetic
aaactatttcagaacataaaactagttctcgttcgtaatccatttccattagtgactgtatcctcaaacatcctc

SEQ ID NO: 346785 - DNA, 75 bp, Artificial Sequence
  Synthetic
ggtttccaaatagcttaagaaggcatttacacataatggagatatattccagcagaaaactggataaccgtccaa

SEQ ID NO: 346786 - DNA, 75 bp, Artificial Sequence
  Synthetic
tttacacataatggagatatattccagcagaaaactggataaccgtccaaagtattatttgatatagtagttttt

SEQ ID NO: 346787 - DNA, 75 bp, Artificial Sequence
  Synthetic
agcgtaaacaataatcgtttaccacttaaatcgatataacagtaacttgtatgcgagattgggttaataaataca

SEQ ID NO: 346788 - DNA, 75 bp, Artificial Sequence
  Synthetic
ttaaatcgatataacagtaacttgtatgcgagattgggttaataaatacagaaggaaacttcttatcgaagtgac

SEQ ID NO: 346789 - DNA, 75 bp, Artificial Sequence
  Synthetic
tatactatgagtaacgtctgatttctgtttaagtttcgtatacaagtcaatgttatagacataatccatatcaga

SEQ ID NO: 346790 - DNA, 75 bp, Artificial Sequence
  Synthetic
tgtttaagtttcgtatacaagtcaatgttatagacataatccatatcagagttagagtcataaatatcttttagt

SEQ ID NO: 346791 - DNA, 75 bp, Artificial Sequence
  Synthetic
tttttagcgaaacagttacgtggatcgtcacaatgataacatccattgttaatctttgtcaaatattgctcgtcc

SEQ ID NO: 346792 - DNA, 75 bp, Artificial Sequence
  Synthetic
cgtcacaatgataacatccattgttaatctttgtcaaatattgctcgtccaacgagtaacatccgtctggagata

SEQ ID NO: 346793 - DNA, 75 bp, Artificial Sequence
  Synthetic
ccatgtcattaacaagtcatttgaatccatcgatagaaaaacatgtgggtatttaattatggtacgttattatcg

SEQ ID NO: 346794 - DNA, 75 bp, Artificial Sequence
  Synthetic
ccatgtcattaacaagtcatttgaatccatcgatagaaaaacatgtgggtatttatttatggtacgttattatcg

SEQ ID NO: 346795 - DNA, 75 bp, Artificial Sequence
  Synthetic
ccatgtcattaacaagtcatttgaatccatcgatagaaaaacatgtgggtatttacttatggtacgttattatcg

SEQ ID NO: 346796 - DNA, 75 bp, Artificial Sequence
  Synthetic
ccatgtcattaacaagtcatttgaatccatcgatagaaaaacatgtgggtatttagttatggtacgttattatcg

SEQ ID NO: 346797 - DNA, 75 bp, Artificial Sequence
  Synthetic
taagtcctcataagtcgtaaactctttgaatattggtcccatatcatcaatgtttagattatgtacaattctcaa

SEQ ID NO: 346798 - DNA, 75 bp, Artificial Sequence
  Synthetic
ttgaatattggtcccatatcatcaatgtttagattatgtacaattctcaaatacgctttgacaagattataaaac

SEQ ID NO: 346799 - DNA, 75 bp, Artificial Sequence
  Synthetic
gcattttgtatgctgcgtttctttggctcttctatcaaccacatatctgcgacggagcattttctatctttaata

SEQ ID NO: 346800 - DNA, 75 bp, Artificial Sequence
  Synthetic
tctagattataacttattgtctcgtcaatgtctatagttctcatctttcccaacggcctcgcattaaatggagga

SEQ ID NO: 346801 - DNA, 75 bp, Artificial Sequence
  Synthetic
aaactcctaaaagaataattttgtcagggctccatctctcatcaagttacatgtatttgtaataacgtcatttac

SEQ ID NO: 346802 - DNA, 75 bp, Artificial Sequence
  Synthetic
agggctccatctctcatcaagttacatgtatttgtaataacgtcatttacagtactatttttttgtaaatctaaa

SEQ ID NO: 346803 - DNA, 75 bp, Artificial Sequence
  Synthetic
cgatgaaatatctactaaaaaaggaagggagatgccatcaattatctcgatgatggagagatcccgattggacac

SEQ ID NO: 346804 - DNA, 75 bp, Artificial Sequence
  Synthetic
aggaaatcgtataaatacggtctcaccatttcgacatctggatttcagatataaaaatctgttttcaccgtgact

SEQ ID NO: 346805 - DNA, 75 bp, Artificial Sequence
  Synthetic
aaatctacatctttattgtatctataatcactatttagataatcagccataattactcgagtgcaacatgttaga

SEQ ID NO: 346806 - DNA, 75 bp, Artificial Sequence
  Synthetic
ccatttcgacatctggatttcagatataaaaatctgttttcaccgtgactttcaaaccaattaatgcaccgaaca

SEQ ID NO: 346807 - DNA, 75 bp, Artificial Sequence
  Synthetic
ggatattttatcatccatgtttaaaaaataacctatatgttaatacttgatattgatattaataattagtataat

SEQ ID NO: 346808 - DNA, 75 bp, Artificial Sequence
  Synthetic
aaataacctatatgttaatacttgatattgatattaataattagtataattactatgtattatatttcattatta

SEQ ID NO: 346809 - DNA, 75 bp, Artificial Sequence
  Synthetic
ttcgttttataaaccattagataaagttgatctcaagccgtcttttctggtctaatattgtttagtagatactta

SEQ ID NO: 346810 - DNA, 75 bp, Artificial Sequence
  Synthetic
ttggggaagagccgtatggaccattatttttatagtactttcgcaagcgggtttagacggcaacatagaagcgtg

SEQ ID NO: 346811 - DNA, 75 bp, Artificial Sequence
  Synthetic
atttttatagtactttcgcaagcgggtttagacggcaacatagaagcgtgtaaacgaaaactatatactatagtt

SEQ ID NO: 346812 - DNA, 75 bp, Artificial Sequence
  Synthetic
tagaatcattgctgtaaacaagtttggattatcgtaagaggctagtatagaaattgttgctcccatggaatgacc

SEQ ID NO: 346813 - DNA, 75 bp, Artificial Sequence
  Synthetic
gtaatagtaataggaataggaataggaattacttttcgtttgtctcactattataaaaagatgttatatctcaat

SEQ ID NO: 346814 - DNA, 75 bp, Artificial Sequence
  Synthetic
gtatcgttactcgcagaataaagttcgttatgatcctgatattcggaaatctgtggagtttcaggttttggtgga

SEQ ID NO: 346815 - DNA, 75 bp, Artificial Sequence
  Synthetic
gaattacttttcgtttgtctcactattataaaaagatgttatatctcaatcactgctataaagatccatcatata

SEQ ID NO: 346816 - DNA, 75 bp, Artificial Sequence
  Synthetic
ggacaataatgtcatgtctagcgatgatctgaattatatttattattttttcatcagattatttaacaatttggc

SEQ ID NO: 346817 - DNA, 75 bp, Artificial Sequence
  Synthetic
aaaaattaataatacctagaaaatattccatgagcatttcttttatcgatatagcatttggatagcctgtcaata

SEQ ID NO: 346818 - DNA, 75 bp, Artificial Sequence
  Synthetic
ttccatgagcatttcttttatcgatatagcatttggatagcctgtcaatatcgacatcattgaacaacggattca

SEQ ID NO: 346819 - DNA, 75 bp, Artificial Sequence
  Synthetic
cttaacccattataaaacttatgattagtcacgactgaaataaccgcgtgattattttttggtataattctacac

SEQ ID NO: 346820 - DNA, 75 bp, Artificial Sequence
  Synthetic
attattttttggtataattctacacggcatggtttctgtgactatgaattcaacccccgttacattagtgaaatc

SEQ ID NO: 346821 - DNA, 75 bp, Artificial Sequence
  Synthetic
tttatgatatgggtagagtttttgtccccgctccttttggaggatcgcaagaatttatttctaaatctatgagag

SEQ ID NO: 346822 - DNA, 75 bp, Artificial Sequence
  Synthetic
ggcatggtttctgtgactatgaattcaacccccgttacattagtgaaatctttaacaaacagcaagggttcgtca

SEQ ID NO: 346823 - DNA, 75 bp, Artificial Sequence
  Synthetic
cgaattagatcattgtcttcagggaacttagttagccaatcaagaataatatcaatgacctcatcttctttgaca

SEQ ID NO: 346824 - DNA, 75 bp, Artificial Sequence
  Synthetic
acttagttagccaatcaagaataatatcaatgacctcatcttctttgacatctagatagtcgcagtttatgatat

SEQ ID NO: 346825 - DNA, 75 bp, Artificial Sequence
  Synthetic
aaaataaaaaatatccttatcctttaccaccaaataaaattctgattggtcaatgtgaatgtattcacttaacag

SEQ ID NO: 346826 - DNA, 75 bp, Artificial Sequence
  Synthetic
aatgtttcaatctcattagcaatgttttcctcaatcatagtcatgacattgtatttatcctccatttccttatat

SEQ ID NO: 346827 - DNA, 75 bp, Artificial Sequence
  Synthetic
tttcctcaatcatagtcatgacattgtatttatcctccatttccttatatctattgctaaacaactcatacatct

SEQ ID NO: 346828 - DNA, 75 bp, Artificial Sequence
  Synthetic
gaggcacatacatcgtcggtattttttatggcaaactttactcttccagcatccgtttctaaaaaaatattaacg

SEQ ID NO: 346829 - DNA, 75 bp, Artificial Sequence
  Synthetic
tggcccaagatctcagaatcaaggaagcgagcaagatcaaacatttcaactacatcttccaactcaagattatcc

SEQ ID NO: 346830 - DNA, 75 bp, Artificial Sequence
  Synthetic
atccattacacaaatatttaactcatgatgaagttgagaatgatatgctttctgatagtatagatagctttagct

SEQ ID NO: 346831 - DNA, 75 bp, Artificial Sequence
  Synthetic
aatacaaataagaaggtacggtacctttgtccaccatctcctccaattcatgctctattttgtcattaactttaa

SEQ ID NO: 346832 - DNA, 75 bp, Artificial Sequence
  Synthetic
agcgagcaagatcaaacatttcaactacatcttccaactcaagattatccatgactcctgtgtatatgaaatcaa

SEQ ID NO: 346833 - DNA, 75 bp, Artificial Sequence
  Synthetic
tgctctattttgtcattaactttaatgtatgaaaacagtacgccacatgcttccatgacagtgtgtaacactttg

SEQ ID NO: 346834 - DNA, 75 bp, Artificial Sequence
  Synthetic
tctggatcattacttagcatctcagcaaagtatgtagaaaatccagatacagccaccttatgtgcgataatgtcg

SEQ ID NO: 346835 - DNA, 75 bp, Artificial Sequence
  Synthetic
caaagtatgtagaaaatccagatacagccaccttatgtgcgataatgtcgttgttatcttttgtgtggaatgtta

SEQ ID NO: 346836 - DNA, 75 bp, Artificial Sequence
  Synthetic
atagatagtagctataatatattctatgatggtattgaagaagatgacaaccttggcatattgatcatttaacac

SEQ ID NO: 346837 - DNA, 75 bp, Artificial Sequence
  Synthetic
atgatggtattgaagaagatgacaaccttggcatattgatcatttaacacagacatggtatcaacagatagcttg

SEQ ID NO: 346838 - DNA, 75 bp, Artificial Sequence
  Synthetic
tttcagatactatatttgttcctgtagataataactaaaaattaaactctaatgaccacatctttttttagagat

SEQ ID NO: 346839 - DNA, 75 bp, Artificial Sequence
  Synthetic
taagagattcaatttcccgtttgtattggtccatgtctccattgctaccaccattagatttacaggctgctagtt

SEQ ID NO: 346840 - DNA, 75 bp, Artificial Sequence
  Synthetic
tcatatctatgtttcacacacaattctttctcatgttcgttaaggtcgtacccacgaacaaaatagtaatcactc

SEQ ID NO: 346841 - DNA, 75 bp, Artificial Sequence
  Synthetic
ctttctcatgttcgttaaggtcgtacccacgaacaaaatagtaatcactcattctgacgacagcataaacagtaa

SEQ ID NO: 346842 - DNA, 75 bp, Artificial Sequence
  Synthetic
gtataccaacatgtctgatattttgatgtattccattaaattatttagttttttctttttattctcgttaaacag

SEQ ID NO: 346843 - DNA, 75 bp, Artificial Sequence
  Synthetic
atgtattccattaaattatttagttttttctttttattctcgttaaacagcatttctgtcaacggaccccaacat

SEQ ID NO: 346844 - DNA, 75 bp, Artificial Sequence
  Synthetic
tgtgtaaatagatacttcttaataatgtatagatgctgtctataaaaaaatcattcatgggtttgtgtttggacg

SEQ ID NO: 346845 - DNA, 75 bp, Artificial Sequence
  Synthetic
tgtatagatgctgtctataaaaaaatcattcatgggtttgtgtttggacgcttttcatagactgtagtaagtggt

SEQ ID NO: 346846 - DNA, 75 bp, Artificial Sequence
  Synthetic
atatacaagtcacgcacgatagctatctatctaattaattgttctagtcgcacacatatttggaggtatatagct

SEQ ID NO: 346847 - DNA, 75 bp, Artificial Sequence
  Synthetic
cagacagcaatttctttattctctacagatgtaagatacttgaagacattcctatgatgatgcagaattttggat

SEQ ID NO: 346848 - DNA, 75 bp, Artificial Sequence
  Synthetic
tctatctaattaattgttctagtcgcacacatatttggaggtatatagctaatatcgattatgtttcctatatga

SEQ ID NO: 346849 - DNA, 75 bp, Artificial Sequence
  Synthetic
aacacggtattgatggtatctgttaccataattcctttgatggctgatagtgtcagagcacaagatttccaatct

SEQ ID NO: 346850 - DNA, 75 bp, Artificial Sequence
  Synthetic
ccataattcctttgatggctgatagtgtcagagcacaagatttccaatctttgacaatttttagcaccattatct

SEQ ID NO: 346851 - DNA, 75 bp, Artificial Sequence
  Synthetic
agagatggagatctgatagacagttgcctattaaagtgaaattttcagcgtgtgttgatgctttttcaggaacgc

SEQ ID NO: 346852 - DNA, 75 bp, Artificial Sequence
  Synthetic
gcctattaaagtgaaattttcagcgtgtgttgatgctttttcaggaacgcgtgtaaaattaccgattaatacagg

SEQ ID NO: 346853 - DNA, 75 bp, Artificial Sequence
  Synthetic
ttaagacggaaagatgaaatgattctctcaacatcttcaatggataccttgctattttttctggcattatctata

SEQ ID NO: 346854 - DNA, 75 bp, Artificial Sequence
  Synthetic
tctcaacatcttcaatggataccttgctattttttctggcattatctatatgtgcgagaatatcctctagagaat

SEQ ID NO: 346855 - DNA, 75 bp, Artificial Sequence
  Synthetic
ttatcaccatatagtttctaagatatgggattttacttaatataatattatttcccgtgataaattttattagaa

SEQ ID NO: 346856 - DNA, 75 bp, Artificial Sequence
  Synthetic
atgtattttgtttttttgtagtatctgtaaaaagtcctgctatagcagttttaccctttacagagtaatattctg

SEQ ID NO: 346857 - DNA, 75 bp, Artificial Sequence
  Synthetic
tgtaaaaagtcctgctatagcagttttaccctttacagagtaatattctgttacaaagactggattgcaatctgt

SEQ ID NO: 346858 - DNA, 75 bp, Artificial Sequence
  Synthetic
cttcttattctatcaccagattgcatggtgatttgtcttctttcttttatcataatgtaatctctaaattcatcg

SEQ ID NO: 346859 - DNA, 75 bp, Artificial Sequence
  Synthetic
cgtcgatatctacacaggcataaaatgtaggagagttactaggccccactgattcaatacgaaaagaccaatctc

SEQ ID NO: 346860 - DNA, 75 bp, Artificial Sequence
  Synthetic
cataatgtaatctctaaattcatcggcaaattgtctatatctaaaatcataatatgagatgtttacctctacaaa

SEQ ID NO: 346861 - DNA, 75 bp, Artificial Sequence
  Synthetic
ttaaacatacatctgtttcagctaagcaactaagaacacgtatacggcagcagcttcctttatactctcatcttt

SEQ ID NO: 346862 - DNA, 75 bp, Artificial Sequence
  Synthetic
gttttgtacttagtcgattacaagatgatacgttaactggatatagttcaaaatctagagaaatgtagttaaatg

SEQ ID NO: 346863 - DNA, 75 bp, Artificial Sequence
  Synthetic
tgatacgttaactggatatagttcaaaatctagagaaatgtagttaaatgtagttaaatgtatctgtaatgtatt

SEQ ID NO: 346864 - DNA, 75 bp, Artificial Sequence
  Synthetic
taaacatggcaacggatttaattttatattcctctattaagtcctcgtcgataataacagaatgtagataatcat

SEQ ID NO: 346865 - DNA, 75 bp, Artificial Sequence
  Synthetic
atattcctctattaagtcctcgtcgataataacagaatgtagataatcatttaatccatcgtacatggttggaag

SEQ ID NO: 346866 - DNA, 75 bp, Artificial Sequence
  Synthetic
ttcattggagttgataataatacacacaaagtatttggattcacggtgggtcatgactacctcagactggtagag

SEQ ID NO: 346867 - DNA, 75 bp, Artificial Sequence
  Synthetic
aataataatgcgaatattagtattgtgtttatgtttatgtttatcatgatgagtatttatgataacaaagttttg

SEQ ID NO: 346868 - DNA, 75 bp, Artificial Sequence
  Synthetic
aatgatatagaaaagcatatcaaaagactttgtgttgtgtatttctgtgagaagaaagaggacattaagtacgcg

SEQ ID NO: 346869 - DNA, 75 bp, Artificial Sequence
  Synthetic
tgtttatgtttatgtttatcatgatgagtatttatgataacaaagttttgtattatccggagtggtacagcattg

SEQ ID NO: 346870 - DNA, 75 bp, Artificial Sequence
  Synthetic
taacatcttgattaataaaatttataacattgtccataggatactttgtaactagttttatacacatctcttcat

SEQ ID NO: 346871 - DNA, 75 bp, Artificial Sequence
  Synthetic
aacattgtccataggatactttgtaactagttttatacacatctcttcatcggtaagtttagacagaatatcgtg

SEQ ID NO: 346872 - DNA, 75 bp, Artificial Sequence
  Synthetic
aactattgactgcaggtaccgtacattttaatcctggaccacattgacattttcgtggtttattaggtccacatg

SEQ ID NO: 346873 - DNA, 75 bp, Artificial Sequence
  Synthetic
ttttaatcctggaccacattgacattttcgtggtttattaggtccacatggttgtatctctaccatattgcttaa

SEQ ID NO: 346874 - DNA, 75 bp, Artificial Sequence
  Synthetic
ctatattgtttaatatattatatagatgtagtgtagctcctacaggaatatctttaactaagtcaatgatttcat

SEQ ID NO: 346875 - DNA, 75 bp, Artificial Sequence
  Synthetic
atgtagtgtagctcctacaggaatatctttaactaagtcaatgatttcatcaaccgttagatctattttaaagtt

SEQ ID NO: 346876 - DNA, 75 bp, Artificial Sequence
  Synthetic
cattaggacacgttttaccaaatgatgtatatactaggcaggttacgatagcggataaaaagatagtattcatct

SEQ ID NO: 346877 - DNA, 75 bp, Artificial Sequence
  Synthetic
tgtatatactaggcaggttacgatagcggataaaaagatagtattcatcttcatgctatttaatacatctaatat

SEQ ID NO: 346878 - DNA, 75 bp, Artificial Sequence
  Synthetic
cattaattaaccattccaagtcactgtgtgtaagaagattatattctatcataagcttgactacatttggtcccg

SEQ ID NO: 346879 - DNA, 75 bp, Artificial Sequence
  Synthetic
aatcattgattcgcttctttaattttttataaactaacattgttaattgaaaagggataacatgttacagaatat

SEQ ID NO: 346880 - DNA, 75 bp, Artificial Sequence
  Synthetic
tccagaacaattttatcttagtcactctttatctgtaagtcgagcattgataaatgtggcatgttgtctgttaat

SEQ ID NO: 346881 - DNA, 75 bp, Artificial Sequence
  Synthetic
ataccattaaagaattcttatgatataaggaaacagattttaggtactcatctactctacaagaattttggagag

SEQ ID NO: 346882 - DNA, 75 bp, Artificial Sequence
  Synthetic
tctttatctgtaagtcgagcattgataaatgtggcatgttgtctgttaattattatttttttaaaatacgttagt

SEQ ID NO: 346883 - DNA, 75 bp, Artificial Sequence
  Synthetic
aacgggatacatatccatgatatattttaatatgtcattggctatataatacatatatcgcgcatctgttatgta

SEQ ID NO: 346884 - DNA, 75 bp, Artificial Sequence
  Synthetic
ttgagaatatcggagttaatagcttccagatacagtgattttggcaatagtccgtgtaatccataatccagtaac

SEQ ID NO: 346885 - DNA, 75 bp, Artificial Sequence
  Synthetic
tttaatatgtcattggctatataatacatatatcgcgcatctgttatgtacgtattaattatatcatataatgga

SEQ ID NO: 346886 - DNA, 75 bp, Artificial Sequence
  Synthetic
tttcaatgtttaatttttttgaaataagctttgataaagccttcctcgcaaattccggatacatgaacatgtcgg

SEQ ID NO: 346887 - DNA, 75 bp, Artificial Sequence
  Synthetic
tatgtcctctttgtaacatttaccaactagtatatcgtatatgctaatattagttctcgaattaatgtgtaactt

SEQ ID NO: 346888 - DNA, 75 bp, Artificial Sequence
  Synthetic
actagtatatcgtatatgctaatattagttctcgaattaatgtgtaactttgtcaacttatcgatgttatttcta

SEQ ID NO: 346889 - DNA, 75 bp, Artificial Sequence
  Synthetic
agtaataggcttaggcaaatgcttgtcgtacgcgggcacttcctcatccatcaagtatttataatcgggttctac

SEQ ID NO: 346890 - DNA, 75 bp, Artificial Sequence
  Synthetic
aatatcgatatacaaaggagatgatttatcgatggcattaagaattcgtttttcgacatctgtcaaaaccaattc

SEQ ID NO: 346891 - DNA, 75 bp, Artificial Sequence
  Synthetic
ttctcaataccccaatagatgatagaatatcacccaatgcgtccatgttgtctatttccaacaggtcgctatatc

SEQ ID NO: 346892 - DNA, 75 bp, Artificial Sequence
  Synthetic
tacggcgatatggtcgttcgatgcatgttagataacggacaacaactatcctctacacgactactttgttaataa

SEQ ID NO: 346893 - DNA, 75 bp, Artificial Sequence; identical to SEQ ID NO: 251628
  Synthetic

SEQ ID NO: 346894 - DNA, 75 bp, Artificial Sequence
  Synthetic
aatcgctatatccctctccatatactcgatgcatttattacagtaatccaatccagctaacataagagccaatct

SEQ ID NO: 346895 - DNA, 75 bp, Artificial Sequence
  Synthetic
tcgatgcatttattacagtaatccaatccagctaacataagagccaatctcaatgttggtttaatgatatcatgt

SEQ ID NO: 346896 - DNA, 75 bp, Artificial Sequence
  Synthetic
attcattttcgggtttaaattctttaatatcgacaatttcatacgctcctcttttgaaactaaacttatttagaa

SEQ ID NO: 346897 - DNA, 75 bp, Artificial Sequence
  Synthetic
aatatcgacaatttcatacgctcctcttttgaaactaaacttatttagaatatccagtgcatttctacaaaaagg

SEQ ID NO: 346898 - DNA, 75 bp, Artificial Sequence
  Synthetic
gaatgatataaccatgtttacattaggtctcttatcgagaatattcttaacaagataccattggtggcccgacaa

SEQ ID NO: 346899 - DNA, 75 bp, Artificial Sequence
  Synthetic
ggtctcttatcgagaatattcttaacaagataccattggtggcccgacaacatattattttccatggttaacatt

SEQ ID NO: 346900 - DNA, 75 bp, Artificial Sequence
  Synthetic
gtacaaattcctcggccattttaatatttaagtgatataaaactatctcgacttatttaactctttagtcgagat

SEQ ID NO: 346901 - DNA, 75 bp, Artificial Sequence
  Synthetic
taataagtaccacaaatgaatccatgacaatattggcattagtatgtgagataatagatacatgtaatggtgtca

SEQ ID NO: 346902 - DNA, 75 bp, Artificial Sequence
  Synthetic
gacaatattggcattagtatgtgagataatagatacatgtaatggtgtcataccagatgttttacatactgcgtt

SEQ ID NO: 346903 - DNA, 75 bp, Artificial Sequence
  Synthetic
agccaactacagaaggcaaacgctataaaaaacataattacgacgagcatatttataaatatttttattcagcat

SEQ ID NO: 346904 - DNA, 75 bp, Artificial Sequence
  Synthetic
cttatgtaggggatttgaaatatcttataatgacttaataacttactttccagataggaaataccataaatatat

SEQ ID NO: 346905 - DNA, 75 bp, Artificial Sequence
  Synthetic
tatcgtacggctcatattcatcagtatataagttagtaggtatattatatttagcaacaatatgatgaataatgc

SEQ ID NO: 346906 - DNA, 75 bp, Artificial Sequence
  Synthetic
acattaactctctcattttctttaacaaattctgcaatatcttcgtaaaaagattcttgaaactttttagaatat

SEQ ID NO: 346907 - DNA, 75 bp, Artificial Sequence
  Synthetic
caaattctgcaatatcttcgtaaaaagattcttgaaactttttagaatatctatcgactctagatgaaatagcgt

SEQ ID NO: 346908 - DNA, 75 bp, Artificial Sequence
  Synthetic
atataagttagtaggtatattatatttagcaacaatatgatgaataatgcatggagtgtcggctactctaattaa

SEQ ID NO: 346909 - DNA, 75 bp, Artificial Sequence
  Synthetic
tcaggcaatctattatgtcataatacatataattttgagcagtgcatatatatgaagttaatggagtatacccta

SEQ ID NO: 346910 - DNA, 75 bp, Artificial Sequence
  Synthetic
tctagtgacaaaatgctagcgatcctaggatcctttagaatcacatagattgacgattcgtctctcttagtaact

SEQ ID NO: 346911 - DNA, 75 bp, Artificial Sequence
  Synthetic
tatattagggaagcaaatgatgacttgatagaatatctcctcaaggaatacactcctcagatttatacatattct

SEQ ID NO: 346912 - DNA, 75 bp, Artificial Sequence
  Synthetic
taggatcctttagaatcacatagattgacgattcgtctctcttagtaactctagtaaaataatcatacaatctag

SEQ ID NO: 346913 - DNA, 75 bp, Artificial Sequence
  Synthetic
catataattttgagcagtgcatatatatgaagttaatggagtataccctaaacaattgacggctgttatatcagc

SEQ ID NO: 346914 - DNA, 75 bp, Artificial Sequence
  Synthetic
caaaattaattctttgtggattttctcaagttacatttatggcgtatacaacgtctcatataacaacaaataaaa

SEQ ID NO: 346915 - DNA, 75 bp, Artificial Sequence
  Synthetic
ttgagaacatcgataagttcatcgggaatgacatacatactatctttaatagaactcttttcatccagttgaatg

SEQ ID NO: 346916 - DNA, 75 bp, Artificial Sequence
  Synthetic
gaatgacatacatactatctttaatagaactcttttcatccagttgaatggattcgtccttaaccaactgattaa

SEQ ID NO: 346917 - DNA, 75 bp, Artificial Sequence
  Synthetic
ttggatctaatatatgaacaacagacaacatagagagatatgtgtgtagtaccatattaccaatattgtcgggtt

SEQ ID NO: 346918 - DNA, 75 bp, Artificial Sequence
  Synthetic
caacatagagagatatgtgtgtagtaccatattaccaatattgtcgggttcatttatatcattcccgtactcgtg

SEQ ID NO: 346919 - DNA, 75 bp, Artificial Sequence
  Synthetic
gaagacaagtccttccagcactatctttataatgtagttttattcctggttgtaaaaaggagtaaacgactgata

SEQ ID NO: 346920 - DNA, 75 bp, Artificial Sequence
  Synthetic
ttaaattgtgtagcgcttctttttagtctagcagccaatactttaacatcactaatatcgatatacaaaggagat

SEQ ID NO: 346921 - DNA, 75 bp, Artificial Sequence
  Synthetic
tttataatgtagttttattcctggttgtaaaaaggagtaaacgactgatatatcgatattccgagctagtgttat

SEQ ID NO: 346922 - DNA, 75 bp, Artificial Sequence
  Synthetic
ttttagaatttccaaattcaccagcgatttatcggttttggtgaaatccaaggatttattaatgtccacaaatgc

SEQ ID NO: 346923 - DNA, 75 bp, Artificial Sequence
  Synthetic
ttcctttttgcctgtatcatccagttttccatcctttgtaaagaaattattttctactagactattaataagact

SEQ ID NO: 346924 - DNA, 75 bp, Artificial Sequence
  Synthetic
attctatatacaagtttgttatttttggattaatattatctatattggctatgtatatcataatcggactcattc

SEQ ID NO: 346925 - DNA, 75 bp, Artificial Sequence
  Synthetic
tttctactagactattaataagactgataaggattcctccataattgcacaatccaaactttttaacaaaactag

SEQ ID NO: 346926 - DNA, 75 bp, Artificial Sequence
  Synthetic
gataaggattcctccataattgcacaatccaaactttttaacaaaactagactttacaagatctacaggaatgcg

SEQ ID NO: 346927 - DNA, 75 bp, Artificial Sequence
  Synthetic
tggattaatattatctatattggctatgtatatcataatcggactcattccattaacgcatttcatatccatatc

SEQ ID NO: 346928 - DNA, 75 bp, Artificial Sequence
  Synthetic
tatcatgtacgtgtgcaacggagtgataagatcacgattctgtaaatttacatttactccgttattgcataacca

SEQ ID NO: 346929 - DNA, 75 bp, Artificial Sequence
  Synthetic
ataagatcacgattctgtaaatttacatttactccgttattgcataaccactctaatatatctatatcaacatcc

SEQ ID NO: 346930 - DNA, 75 bp, Artificial Sequence
  Synthetic
tgaccaactcatctaccatttcattgattttagcagtgaaataagctttcaatgcacgggcactgatactattga

SEQ ID NO: 346931 - DNA, 75 bp, Artificial Sequence
  Synthetic
atcgtgtaacacgactcacaatagaatctgtgaatgctctcccggatattattgtcttctcaaaggatcatccgg

SEQ ID NO: 346932 - DNA, 75 bp, Artificial Sequence
  Synthetic
catttaagttcaccaaacaacttttaaatacaaatatatcaatagtagtagaataagaactataaaaaaaataat

SEQ ID NO: 346933 - DNA, 75 bp, Artificial Sequence
  Synthetic
ataattaagatttacaattcctacatctaccatatatttagtcaagtctagttttatatggcgagttctcggtga

SEQ ID NO: 346934 - DNA, 75 bp, Artificial Sequence
  Synthetic
tctaccatatatttagtcaagtctagttttatatggcgagttctcggtgaattgaaatacgtatatagaatatcc

SEQ ID NO: 346935 - DNA, 75 bp, Artificial Sequence
  Synthetic
ccggagacgtcatctgttctccgtgtggtctcggaacatattctcacaccgtctcttccgcagataaatgcgaac

SEQ ID NO: 346936 - DNA, 75 bp, Artificial Sequence
  Synthetic
attatctttaataatacatttgacgaattttttatactgatcaaccaacgatttgttttttctatccgcttttag

SEQ ID NO: 346937 - DNA, 75 bp, Artificial Sequence
  Synthetic
aattttttatactgatcaaccaacgatttgttttttctatccgcttttagcattaaagtcatactaccgatgata

SEQ ID NO: 346938 - DNA, 75 bp, Artificial Sequence
  Synthetic
caccaaatatagcggcgtacaacttatccatttatacattgaatattggcttttctttatcgctatcttcatcat

SEQ ID NO: 346939 - DNA, 75 bp, Artificial Sequence
  Synthetic
atccatttatacattgaatattggcttttctttatcgctatcttcatcatattcatcatcaatatcaacaagtcc

SEQ ID NO: 346940 - DNA, 75 bp, Artificial Sequence
  Synthetic
aatacaataatatttctttttaaaaacttttatgcgtttagctctaactatgtgattataactgtatatatcccc

SEQ ID NO: 346941 - DNA, 75 bp, Artificial Sequence
  Synthetic
acttttatgcgtttagctctaactatgtgattataactgtatatatccccatcgctacagtatccatcatctgga

SEQ ID NO: 346942 - DNA, 75 bp, Artificial Sequence
  Synthetic
ggtttaacggcgtttcggaaaatgaaaaggtactagatacgtataaaaaggtatctaatttgatataatgaattc

SEQ ID NO: 346943 - DNA, 75 bp, Artificial Sequence
  Synthetic
acactcaccaataatagtagaattaatgtcataatttacaccaatagtgagttcggcggcaaagtaccaataccg

SEQ ID NO: 346944 - DNA, 75 bp, Artificial Sequence
  Synthetic
ggataaaacaaaaatgctccgcataactctatcatggcaataacacaaccaaatacttgtaagattcctaaatta

SEQ ID NO: 346945 - DNA, 75 bp, Artificial Sequence
  Synthetic
ttggccaattgtctttctcttttactgagtgattctagttcaccttctatagatctgagaatggatgattctcca

SEQ ID NO: 346946 - DNA, 75 bp, Artificial Sequence
  Synthetic
aaagtatgtcgaatatatcagttttctgacattaactatagcgtgttcggttaatgatgctattttgataactat

SEQ ID NO: 346947 - DNA, 75 bp, Artificial Sequence
  Synthetic
ctgacattaactatagcgtgttcggttaatgatgctattttgataactataatcaaaaactgtcagtgtgttggt

SEQ ID NO: 346948 - DNA, 75 bp, Artificial Sequence
  Synthetic
cgtttaatttgttgatgaagatggattcatccttaaatgttttctctgtaatagtttccaccgaaagactatgca

SEQ ID NO: 346949 - DNA, 75 bp, Artificial Sequence
  Synthetic
ataaaaattagaagtgttagattatattaattatactataaaaattagaagtgttagactattaactaacttata

SEQ ID NO: 346950 - DNA, 75 bp, Artificial Sequence
  Synthetic
attaattatactataaaaattagaagtgttagactattaactaacttataaaactatcttataaaactatcttat

SEQ ID NO: 346951 - DNA, 75 bp, Artificial Sequence
  Synthetic
cttaatgtttccatagacggcttctagaagttgatacaacataggactagccgcggtaacttttatttttagaaa

SEQ ID NO: 346952 - DNA, 75 bp, Artificial Sequence
  Synthetic
agaagttgatacaacataggactagccgcggtaacttttatttttagaaagtatccatcgcttctatcttgttta

SEQ ID NO: 346953 - DNA, 75 bp, Artificial Sequence
  Synthetic
gaagggtgggtggagaaaactctatatgatagcttgtgaaacaattagatccctaatttctaatggaagttttga

SEQ ID NO: 346954 - DNA, 75 bp, Artificial Sequence
  Synthetic
atgatagcttgtgaaacaattagatccctaatttctaatggaagttttgataggagattgtcatcagttgataca

SEQ ID NO: 346955 - DNA, 75 bp, Artificial Sequence
  Synthetic
agtcatttgactagataaactatcagtaagttttatagagatagacgaacaattagcgtattgagaagcatttag

SEQ ID NO: 346956 - DNA, 75 bp, Artificial Sequence
  Synthetic
cattttccagattagcagaatagatattaatgtcgtatttgaacagagcctgtaacatctcaatgtctttattat

SEQ ID NO: 346957 - DNA, 75 bp, Artificial Sequence
  Synthetic
aattagcgtattgagaagcatttagtgtaacgtattcgatacattttgcattagatttactaatcgattttgcat

SEQ ID NO: 346958 - DNA, 75 bp, Artificial Sequence
  Synthetic
gacaaaatgaagatccaagattcgtagaagcatttaaatgcgacgagttagaaagatatattgagaataatccag

SEQ ID NO: 346959 - DNA, 75 bp, Artificial Sequence
  Synthetic
atgctcgtttacttctgtgtaaatcttgaatcctttagtgatacactgtgtcaaaactggatgtttagaatacct

SEQ ID NO: 346960 - DNA, 75 bp, Artificial Sequence
  Synthetic
ttgaatcctttagtgatacactgtgtcaaaactggatgtttagaatacctatgtagaatatgggaagcatgcttg

SEQ ID NO: 346961 - DNA, 75 bp, Artificial Sequence
  Synthetic
cttggtgaagtttcaactctcttcttgattaccttactcatgattaaacctaaataattgtactttgtaatataa

SEQ ID NO: 346962 - DNA, 75 bp, Artificial Sequence
  Synthetic
catctgcctaatgtactccaattcttgtttacaatcaattatataatcaaagagtgatgatgcatacacattaca

SEQ ID NO: 346963 - DNA, 75 bp, Artificial Sequence
  Synthetic
tgtttacaatcaattatataatcaaagagtgatgatgcatacacattacaaagtgaataatctaccatcataaaa

SEQ ID NO: 346964 - DNA, 75 bp, Artificial Sequence
  Synthetic
attttatccttgtccaatgtgaattgaatgggagcggatgcgggtttcgtacgtagatagtacattcccgttttt

SEQ ID NO: 346965 - DNA, 75 bp, Artificial Sequence
  Synthetic
gaatgggagcggatgcgggtttcgtacgtagatagtacattcccgtttttagaccgagactccatccgtaaaaat

SEQ ID NO: 346966 - DNA, 75 bp, Artificial Sequence
  Synthetic
ctataaggataatttactactgagtataaatagttcattttactttaacgatagtctgttaataaccaatactaa

SEQ ID NO: 346967 - DNA, 75 bp, Artificial Sequence
  Synthetic
tatagataattttatacagtcaatagacaatggttctctaagcaatatttctaatattttaagatgtgcttccct

SEQ ID NO: 346968 - DNA, 75 bp, Artificial Sequence
  Synthetic
gacaatggttctctaagcaatatttctaatattttaagatgtgcttccctactggcgataacagatcccctatcc

SEQ ID NO: 346969 - DNA, 75 bp, Artificial Sequence
  Synthetic
gattgactttgatcgatgaaggctcccctgtctgcagccatttttatgatcgtcttttgtggaatttcccaaata

SEQ ID NO: 346970 - DNA, 75 bp, Artificial Sequence
  Synthetic
gattatttcctgcacgtttaggtttggtacgttgatttctagcccctgcagatataaagtcatcgtctacaattt

SEQ ID NO: 346971 - DNA, 75 bp, Artificial Sequence
  Synthetic
tgctccattttctaatagccatgatactaaatctatataacctgcatagatagcgcgataaagcaaggtccttcc

SEQ ID NO: 346972 - DNA, 75 bp, Artificial Sequence
  Synthetic
actaaatctatataacctgcatagatagcgcgataaagcaaggtccttccaccagcatctagttgattaatatct

SEQ ID NO: 346973 - DNA, 75 bp, Artificial Sequence
  Synthetic
tctcggttaaaactctaaggagatgcggattaactacttgaaattctccagacaatactctccgagtgtaaatat

SEQ ID NO: 346974 - DNA, 75 bp, Artificial Sequence
  Synthetic
tacaaggaatcccctagtatactgaattattttatataaatctaacttaacatcattttcatctgggataccaca

SEQ ID NO: 346975 - DNA, 75 bp, Artificial Sequence
  Synthetic
attattttatataaatctaacttaacatcattttcatctgggataccacaatttaaaataaactcaacaacacta

SEQ ID NO: 346976 - DNA, 75 bp, Artificial Sequence
  Synthetic
aatgcgaggaaatgtataatttggtaatggtttctcatgtggatctgaagaagaggtaagatatctactagaaag

SEQ ID NO: 346977 - DNA, 75 bp, Artificial Sequence
  Synthetic
atatattacagccccatgatctaccataaaattaacaatgtctatttttacatatgcattagatagatagtaaag

SEQ ID NO: 346978 - DNA, 75 bp, Artificial Sequence
  Synthetic
ataaaattaacaatgtctatttttacatatgcattagatagatagtaaagtaagagatcttgcacagaattacaa

SEQ ID NO: 346979 - DNA, 75 bp, Artificial Sequence
  Synthetic
cattccaaagatcatattgtagaataccgttactggcgtacgatcctacatatgtatcgtatggtccttccttct

SEQ ID NO: 346980 - DNA, 75 bp, Artificial Sequence
  Synthetic
aactattactatgaatcataaagactgtaatcccgtatttcgtgaggaatacttctctgtccttaataaggtagc

SEQ ID NO: 346981 - DNA, 75 bp, Artificial Sequence
  Synthetic
ccgtatggatttggtcataatagaatgtattgttttaaattggtagctgaatgttataaaaatgccggtattgat

SEQ ID NO: 346982 - DNA, 75 bp, Artificial Sequence
  Synthetic
tgcagatataatatctttatatgtaatatatgtaaacagtctatctactatatactgatcaatattatctctatg

SEQ ID NO: 346983 - DNA, 75 bp, Artificial Sequence
  Synthetic
atatatgtaaacagtctatctactatatactgatcaatattatctctatgaatcctaaaataatcatacagaaca

SEQ ID NO: 346984 - DNA, 75 bp, Artificial Sequence
  Synthetic
atcttcttatttagatcttgtgcttccaggctatcaaatggataatttaagagaataaacgcgtccgctaatcct

SEQ ID NO: 346985 - DNA, 75 bp, Artificial Sequence
  Synthetic
tttgatggtctcataaaaaaagttttacaaaaatatttttattctctttctctctttgatggtctcataaaaaaa

SEQ ID NO: 346986 - DNA, 75 bp, Artificial Sequence
  Synthetic
gtcaacaactggttctagaacataacagtcaacacccaatccatgttttacatagtcatctaccaaagataatga

SEQ ID NO: 346987 - DNA, 75 bp, Artificial Sequence
  Synthetic
cagtcaacacccaatccatgttttacatagtcatctaccaaagataatgaccaaatgttgaggtcgtcgtgaaac

SEQ ID NO: 346988 - DNA, 75 bp, Artificial Sequence; identical to SEQ ID NO: 251684
  Synthetic

SEQ ID NO: 346989 - DNA, 75 bp, Artificial Sequence
  Synthetic
gagaaaatcaaatcgcccatctattacaaacatgttcaaggcaacagatgccagattacaaacggctacctcatt

SEQ ID NO: 346990 - DNA, 75 bp, Artificial Sequence
  Synthetic
gtcttattcgccattgattttcattttttataattatgtacatgatttccttctattctcaagagtctacaaaat

SEQ ID NO: 346991 - DNA, 75 bp, Artificial Sequence
  Synthetic
ttttataattatgtacatgatttccttctattctcaagagtctacaaaatatatattttttcgatatctaagtac

SEQ ID NO: 346992 - DNA, 75 bp, Artificial Sequence
  Synthetic
ttcctaaattttgttgattactctttttgttacacgcatccttataaagaatgaatggagtaccagtttcaatct

SEQ ID NO: 346993 - DNA, 75 bp, Artificial Sequence
  Synthetic
gagataaattatacaatcttcgctatcaaaccatttttgtagtttaaagcctgaagtaattagccaactgttttt

SEQ ID NO: 346994 - DNA, 75 bp, Artificial Sequence
  Synthetic
tcaaaccatttttgtagtttaaagcctgaagtaattagccaactgtttttattagcggcttttttcgatctatca

SEQ ID NO: 346995 - DNA, 75 bp, Artificial Sequence
  Synthetic
ctccgtcatccttcactcgtttcataaagagatcaggaatccaaagagctataaatagatctctggttctatgtt

SEQ ID NO: 346996 - DNA, 75 bp, Artificial Sequence
  Synthetic
acggttgttagtataatcacatgaataataatattctaattcctcgtattaactacttacagatactcgaaatag

SEQ ID NO: 346997 - DNA, 75 bp, Artificial Sequence
  Synthetic
taataatattctaattcctcgtattaactacttacagatactcgaaatagtctgaaaaattcttcaaagatattt

SEQ ID NO: 346998 - DNA, 75 bp, Artificial Sequence
  Synthetic
ataaatatcctttccatcaaaggtcataattggataattgtccagcaatatatctgctgtattagttatatcact

SEQ ID NO: 346999 - DNA, 75 bp, Artificial Sequence
  Synthetic
ataattggataattgtccagcaatatatctgctgtattagttatatcacttccatttattttcagattgaagtaa

SEQ ID NO: 347000 - DNA, 75 bp, Artificial Sequence; identical to SEQ ID NO: 251693
  Synthetic

SEQ ID NO: 347001 - DNA, 75 bp, Artificial Sequence
  Synthetic
atattactaattgatagacctattccccctgccattttagagattaatgcgcatcgttttaacgtgtcatagata

SEQ ID NO: 347002 - DNA, 75 bp, Artificial Sequence
  Synthetic
tacgtaaatagctatacgcgaatccattgttacttttttatttcatacgtctattaataaatatatgtattactt

SEQ ID NO: 347003 - DNA, 75 bp, Artificial Sequence
  Synthetic
attgttacttttttatttcatacgtctattaataaatatatgtattacttaagactagaaaaatcaaaagtgagt

SEQ ID NO: 347004 - DNA, 75 bp, Artificial Sequence
  Synthetic
attataacatcatattccggcgtatgaattgatgagttgtacatcttgacattttctttcttctcttctcccttt

SEQ ID NO: 347005 - DNA, 75 bp, Artificial Sequence
  Synthetic
gtgacgactagttcccgcattaaataaggtaggagaagcgtgcgtaaaccatttttcagaaagtagattgtacgt

SEQ ID NO: 347006 - DNA, 75 bp, Artificial Sequence
  Synthetic
tacaaaatgcgtcaagaatctagagtttagcgttcgtatcggagacatgtgcaaggaatcatctgaacttgaggt

SEQ ID NO: 347007 - DNA, 75 bp, Artificial Sequence
  Synthetic
tcatctctgaatcctgataaatcatgcatatcattgatacaactacgcagtaaactagtaggaatacaaatatct

SEQ ID NO: 347008 - DNA, 75 bp, Artificial Sequence
  Synthetic
gcatatcattgatacaactacgcagtaaactagtaggaatacaaatatctggatatgtacgtaaatagtcgatta

SEQ ID NO: 347009 - DNA, 75 bp, Artificial Sequence
  Synthetic
tgatgaattcctactgcgacacgcattaacatgtgctgaggtctttcaacgatcttgttgtttattttcaacaag

SEQ ID NO: 347010 - DNA, 75 bp, Artificial Sequence
  Synthetic
ataatacttcactcatcgattcaacaaaactcaaagcgtgtgtctgaatcgataactctattcatctgaaattgg

SEQ ID NO: 347011 - DNA, 75 bp, Artificial Sequence
  Synthetic
gatttactgtctatctaaatttcgttgaaccagaggaattgaatcttagtaagtttatgatggttcttccggggg

SEQ ID NO: 347012 - DNA, 75 bp, Artificial Sequence
  Synthetic
ataatattacacagtggatacttatcagaagtatacctcttacagatttctatacataaagtaatatcattattg

SEQ ID NO: 347013 - DNA, 75 bp, Artificial Sequence
  Synthetic
ttcgtaaataataaccgagttgagtttatccttatatttgttaactatatccatggtgatacttgaaataatcgg

SEQ ID NO: 347014 - DNA, 75 bp, Artificial Sequence
  Synthetic
ttatccttatatttgttaactatatccatggtgatacttgaaataatcggagaatgtttcccatttttaggatta

SEQ ID NO: 347015 - DNA, 75 bp, Artificial Sequence
  Synthetic
cagaagtatacctcttacagatttctatacataaagtaatatcattattgtatgttttgcttattagtatcatat

SEQ ID NO: 347016 - DNA, 75 bp, Artificial Sequence
  Synthetic
attatctcgaatatccactatcacgtctaaagtttgactcagtgatctataattagatgtattttgtgtttccaa

SEQ ID NO: 347017 - DNA, 75 bp, Artificial Sequence
  Synthetic
cttgtgtagatttgatacggctattctggcggctagaatggcataatccggatgttgtgtagtacaagtggctgc

SEQ ID NO: 347018 - DNA, 75 bp, Artificial Sequence
  Synthetic
tctaaagtttgactcagtgatctataattagatgtattttgtgtttccaaatcatgttttatatgctcgataaat

SEQ ID NO: 347019 - DNA, 75 bp, Artificial Sequence
  Synthetic
tctaccgttgttactccattatatattccttgaataaccttcatagctattttaataggatctatatgatccgtg

SEQ ID NO: 347020 - DNA, 75 bp, Artificial Sequence
  Synthetic
atacaggctagtatttttagtactacataacgaaaataatgattcgtttttatagcatttatctaaaaatattat

SEQ ID NO: 347021 - DNA, 75 bp, Artificial Sequence
  Synthetic
cataacgaaaataatgattcgtttttatagcatttatctaaaaatattataatattatctatagaaggtctgtta

SEQ ID NO: 347022 - DNA, 75 bp, Artificial Sequence
  Synthetic
atctgtaaaagaatcattcggcaacttttcaatcatagaactgccatatgttggagatactagtatgatggtcat

SEQ ID NO: 347023 - DNA, 75 bp, Artificial Sequence
  Synthetic
tattaacatcaatgcagaaataccctttatagttggtttatcgatactatatccaatagataataaatatttcat

SEQ ID NO: 347024 - DNA, 75 bp, Artificial Sequence
  Synthetic
tttatagttggtttatcgatactatatccaatagataataaatatttcattgcatctttgagtagacaaacggtg

SEQ ID NO: 347025 - DNA, 75 bp, Artificial Sequence
  Synthetic
gaaaatcgttacggctcgattaaactttaatgattgcattgtgaatatatcattaggatttaactccttgactat

SEQ ID NO: 347026 - DNA, 75 bp, Artificial Sequence
  Synthetic
ctttatcatttgacaatgatatgcatcattagtttcgtaatcacacttttcatattcatcggtgtatgagtctac

SEQ ID NO: 347027 - DNA, 75 bp, Artificial Sequence
  Synthetic
tcattagtttcgtaatcacacttttcatattcatcggtgtatgagtctacaggaatattatatttagtaataaca

SEQ ID NO: 347028 - DNA, 75 bp, Artificial Sequence
  Synthetic
tcgcagttagaacggttatagcatccaccatttatatctaaaaattagatcaaagaatatgtgacaaagtcctag

SEQ ID NO: 347029 - DNA, 75 bp, Artificial Sequence
  Synthetic
tatacaatgctttaccatgtttaatactttatcagacatcagacaatctattatgtcgtgatacatataattttg

SEQ ID NO: 347030 - DNA, 75 bp, Artificial Sequence
  Synthetic
actttatcagacatcagacaatctattatgtcgtgatacatataattttgtgcggtacatatgtaggacgttaat

SEQ ID NO: 347031 - DNA, 75 bp, Artificial Sequence
  Synthetic
tagtaatagttagttccgacgttgagatggattcactgagaccggtagtggtcgtccgagtacacgacgtgtcgt

SEQ ID NO: 347032 - DNA, 75 bp, Artificial Sequence
  Synthetic
atgttctctttgataaaagttccagaaaatgtagaattttttaaaaagttatcttttgctattaccaagattgtg

SEQ ID NO: 347033 - DNA, 75 bp, Artificial Sequence
  Synthetic
aagatatttaacaacttttatgtttatattgttattgatactcgaatcatatgtcaaattttattaacgatacat

SEQ ID NO: 347034 - DNA, 75 bp, Artificial Sequence
  Synthetic
atattgttattgatactcgaatcatatgtcaaattttattaacgatacataaatctagaaagatatgtgtgtagt

SEQ ID NO: 347035 - DNA, 75 bp, Artificial Sequence
  Synthetic
aggaccactagcaaaagataaagaggataaagtaaagaaaagatatccagagtttagattagtcaacacaggacc

SEQ ID NO: 347036 - DNA, 75 bp, Artificial Sequence
  Synthetic
taaaagtttaacgacatcgatatttatataatttcgtaacatatagctgtgaagacaagtttttccaacactatc

SEQ ID NO: 347037 - DNA, 75 bp, Artificial Sequence
  Synthetic
atataatttcgtaacatatagctgtgaagacaagtttttccaacactatctttgtaatcaaggattgcactatta

SEQ ID NO: 347038 - DNA, 75 bp, Artificial Sequence
  Synthetic
ggaaaggatgattcgtcaaacgaataaacaatttcacaaatggatgttaatgtattagtaggaaattttttgacg

SEQ ID NO: 347039 - DNA, 75 bp, Artificial Sequence
  Synthetic
tcttctcttctcccttcctccctcttctccctttcccagaaacaaacttttttacccactataaaataaaatgag

SEQ ID NO: 347040 - DNA, 75 bp, Artificial Sequence
  Synthetic
atgatgttctacctatttcatccgataacatgttaatttccgacaccaacggttttaatatttcgatgatatacg

SEQ ID NO: 347041 - DNA, 75 bp, Artificial Sequence
  Synthetic
atacagatacaatatctctggtatattagttatcttgttatcgtccatgtaaatctttataatttcttcgtctat

SEQ ID NO: 347042 - DNA, 75 bp, Artificial Sequence
  Synthetic
ggttttaatatttcgatgatatacggtagtctctctttcggacttatatagcttattccacaatacgagtcatta

SEQ ID NO: 347043 - DNA, 75 bp, Artificial Sequence
  Synthetic
gtagtctctctttcggacttatatagcttattccacaatacgagtcattatatactccaaaaaacaaaataacta

SEQ ID NO: 347044 - DNA, 75 bp, Artificial Sequence
  Synthetic
ttagttatcttgttatcgtccatgtaaatctttataatttcttcgtctatattcatcgcattatatattatataa

SEQ ID NO: 347045 - DNA, 75 bp, Artificial Sequence
  Synthetic
tagttcaataactttctttaacacgcttgctgaaattaattcgtctctccgtaaatatgaatgtaatggagtaat

SEQ ID NO: 347046 - DNA, 75 bp, Artificial Sequence
  Synthetic
cttgctgaaattaattcgtctctccgtaaatatgaatgtaatggagtaattagattattgttttgttcatttata

SEQ ID NO: 347047 - DNA, 75 bp, Artificial Sequence
  Synthetic
gaatccggaacattgaacgtattaatacttaattctttttctgtggtaagtaccgataggttattgacattgtat

SEQ ID NO: 347048 - DNA, 75 bp, Artificial Sequence
  Synthetic
attaccgagatatgtatgcaatataccaaatccatattcgtttttataattaatatctacgcctttagcaatcat

SEQ ID NO: 347049 - DNA, 75 bp, Artificial Sequence
  Synthetic
gaaaattatttttatcaccacgtgtgtttcaggatcatcgtcgacgcccgtcaaccaaccgaatggagtaaaata

SEQ ID NO: 347050 - DNA, 75 bp, Artificial Sequence
  Synthetic
ccaaatccatattcgtttttataattaatatctacgcctttagcaatcatccatttaaccaattttatgttgatg

SEQ ID NO: 347051 - DNA, 75 bp, Artificial Sequence
  Synthetic
ttctctattacaatttgcatgttgcatgaaataatatgcacctaaaacatcgctaatcttattgtttgttccctg

SEQ ID NO: 347052 - DNA, 75 bp, Artificial Sequence
  Synthetic
ttatcatcttctcgtaggcgaatgattccatgatcaagagtgatttgagaacatcctccggagtattaatgggct

SEQ ID NO: 347053 - DNA, 75 bp, Artificial Sequence
  Synthetic
ttccatgatcaagagtgatttgagaacatcctccggagtattaatgggcttagtaaacagtccatcgttgcaata

SEQ ID NO: 347054 - DNA, 75 bp, Artificial Sequence
  Synthetic
tttgtcactgttttcataatgactatctcgtcctcatcatcactatcatcactatcatcatccttcgttcttatt

SEQ ID NO: 347055 - DNA, 75 bp, Artificial Sequence
  Synthetic
tctcgtcctcatcatcactatcatcactatcatcatccttcgttcttattatcatctttatcatcatccttattg

SEQ ID NO: 347056 - DNA, 75 bp, Artificial Sequence
  Synthetic
cctcatctgacggagacaattttttggtaggttttagagactttgaagctacttgtttaacaaagttattcatcg

SEQ ID NO: 347057 - DNA, 75 bp, Artificial Sequence
  Synthetic
agtaatttgactattgcgtgcagagtatcgttgagacctcccacaacggatgcagacgtcttttggataagtaat

SEQ ID NO: 347058 - DNA, 75 bp, Artificial Sequence
  Synthetic
gtctttagtcggaaggttgatgtcgtatccgatgtatgaggcaacattgttgttacaattttgaaaggcggtatt

SEQ ID NO: 347059 - DNA, 75 bp, Artificial Sequence
  Synthetic
ctcatcattaattagttctgtagtaatatctttaataatttggctatatatctgttcaatactatctattgatga

SEQ ID NO: 347060 - DNA, 75 bp, Artificial Sequence
  Synthetic
atatctttaataatttggctatatatctgttcaatactatctattgatgatttctttttatgacttgaactaatg

SEQ ID NO: 347061 - DNA, 75 bp, Artificial Sequence
  Synthetic
atcatatgtttgatcgtcgtaattaatagtgtggctaatggtactgttaataagtttatagacaatatcatagta

SEQ ID NO: 347062 - DNA, 75 bp, Artificial Sequence
  Synthetic
atagtgtggctaatggtactgttaataagtttatagacaatatcatagtattttctttccagaactagattattt

SEQ ID NO: 347063 - DNA, 75 bp, Artificial Sequence
  Synthetic
gggtgtacaatcaagattattacgtatcctcgtatcggctcctcgagataaaagagcatacaccacacgaggact

SEQ ID NO: 347064 - DNA, 75 bp, Artificial Sequence
  Synthetic
cggggtgttaatcttggaaattatttttctaaccttgttggtagccttcaagacctgactagcaaatccagcctt

SEQ ID NO: 347065 - DNA, 75 bp, Artificial Sequence
  Synthetic
attccgtgatgtagcagtagttgatgcatggtctatatcgttaaaatgtatcgtatataatagttttctgacgtg

SEQ ID NO: 347066 - DNA, 75 bp, Artificial Sequence
  Synthetic
gcatggtctatatcgttaaaatgtatcgtatataatagttttctgacgtggagtacagaattttcgattaatgag

SEQ ID NO: 347067 - DNA, 75 bp, Artificial Sequence
  Synthetic
ccagctatgtttactgctgcgttaaacattcagacgagtgtaaacactgttgttagagattttgaaaattatgtg

SEQ ID NO: 347068 - DNA, 75 bp, Artificial Sequence
  Synthetic
agttttttatcatatttttctaatactatataaaaatatcattatgtataatcatcactgtcgctatcattattg

SEQ ID NO: 347069 - DNA, 75 bp, Artificial Sequence
  Synthetic
tctaagataacacagcaatagatcggatgatttactaaagtcatcaatggtgtccgttagtatatcaaagatctt

SEQ ID NO: 347070 - DNA, 75 bp, Artificial Sequence
  Synthetic
ggagaaggaatagaaataaaaattattatagtggtggaattcagttggaatattgcctccggagtcataaaagga

SEQ ID NO: 347071 - DNA, 75 bp, Artificial Sequence
  Synthetic
ttatagtggtggaattcagttggaatattgcctccggagtcataaaaggatactaaacattgttttttatcataa

SEQ ID NO: 347072 - DNA, 75 bp, Artificial Sequence
  Synthetic
ctatataaaaatatcattatgtataatcatcactgtcgctatcattattgtgtttgtgtagttctgtcctatcat

SEQ ID NO: 347073 - DNA, 75 bp, Artificial Sequence
  Synthetic
actggatattcgataacagcatttgagtagtttttgtcttttacagtatatacgttattgtcaaaatctaaacaa

SEQ ID NO: 347074 - DNA, 75 bp, Artificial Sequence
  Synthetic
agtagtttttgtcttttacagtatatacgttattgtcaaaatctaaacaaatattagcataatacctatctataa

SEQ ID NO: 347075 - DNA, 75 bp, Artificial Sequence
  Synthetic
agaggtagaacttttaattttgtctttaagtatatacgataagatatgtttattcataaacgcgtcaaatttttc

SEQ ID NO: 347076 - DNA, 75 bp, Artificial Sequence
  Synthetic
ttaagtatatacgataagatatgtttattcataaacgcgtcaaatttttcatgaatcgctaaggagtttaagaat

SEQ ID NO: 347077 - DNA, 75 bp, Artificial Sequence
  Synthetic
atcattccatcgatacatccttctatgttgagatgtatatatccaggaattcgtttattaatatcgggaaatgta

SEQ ID NO: 347078 - DNA, 75 bp, Artificial Sequence
  Synthetic
acagcgttagatcaataaataaacaatcttataacgcaactttttacgatctagttgtatgagtttatcgtttac

SEQ ID NO: 347079 - DNA, 75 bp, Artificial Sequence
  Synthetic
agagactaagttcttaatacttcgattgctcatccaggctcctctctcaggctctattttcatcttgacgacctt

SEQ ID NO: 347080 - DNA, 75 bp, Artificial Sequence
  Synthetic
tgtttaataactagcttaaacagatgagacgatgtatccacatcaaagaacgtaaaatacatatgacaaacattg

SEQ ID NO: 347081 - DNA, 75 bp, Artificial Sequence
  Synthetic
tggattttcaccagtatgtattcctttacgtgataaatcatcgattttcaaatccatttgtgagaagtctatcgc

SEQ ID NO: 347082 - DNA, 75 bp, Artificial Sequence
  Synthetic
tacatttaatgttcacggtcttagtatttttagatatcaattgtaatttacacccatatttaactcccttgtgta

SEQ ID NO: 347083 - DNA, 75 bp, Artificial Sequence
  Synthetic
taccgtcgtccataaatacgttaggtatgtaccacatactgtcgcgaacgatgcgtacaatctcgtccatctcat

SEQ ID NO: 347084 - DNA, 75 bp, Artificial Sequence
  Synthetic
atgcgtacaatctcgtccatctcataatgatttactttttcataattaaagatgtgaaagaaaaccgaacaatat

SEQ ID NO: 347085 - DNA, 75 bp, Artificial Sequence
  Synthetic
tactagtaggtaactcaaagacatcatatatagaatggtaacgcgtctttaactcgtcggttaactctttctttt

SEQ ID NO: 347086 - DNA, 75 bp, Artificial Sequence
  Synthetic
gatcgagttcgtcgctactattgggtctgctcaggtgccccgactctactagttccaacatcataccgataggaa

SEQ ID NO: 347087 - DNA, 75 bp, Artificial Sequence
  Synthetic
tatccgttacaatttgttaagaatttagatacatctatattgctacataatccagctagtgaatatatatgacat

SEQ ID NO: 347088 - DNA, 75 bp, Artificial Sequence
  Synthetic
tagatacatctatattgctacataatccagctagtgaatatatatgacataataaattggtaaatcctagttctg

SEQ ID NO: 347089 - DNA, 75 bp, Artificial Sequence
  Synthetic
gaatttaccagatatcttcttttttccaaactgcgttaatgtattctcttacaaatattcacaagatgaattcag

SEQ ID NO: 347090 - DNA, 75 bp, Artificial Sequence
  Synthetic
ccaaactgcgttaatgtattctcttacaaatattcacaagatgaattcagtaatatgagtaaaacggaacgtgat

SEQ ID NO: 347091 - DNA, 75 bp, Artificial Sequence; identical to SEQ ID NO: 47053
  Synthetic

SEQ ID NO: 347092 - DNA, 75 bp, Artificial Sequence
  Synthetic
tcgtataaaagattaatttgattctaatataatctttagtattggataaatatcaattcaaattaattccattag

SEQ ID NO: 347093 - DNA, 75 bp, Artificial Sequence
  Synthetic
tacaaagttagtacagaagcacgtggaaaaaaagtatctcctccatcactaggaaaacccgcacacataaaccta

SEQ ID NO: 347094 - DNA, 75 bp, Artificial Sequence
  Synthetic
gaagaattcttggataaaagcatccatctaaccaagacggataagaaatatatacttcaattgataagacacgga

SEQ ID NO: 347095 - DNA, 75 bp, Artificial Sequence
  Synthetic
tagttttctaaaatgtataacaaatacagaaatcaattcgttcgatgagtatatattaagaggactattagaagc

SEQ ID NO: 347096 - DNA, 75 bp, Artificial Sequence
  Synthetic
acagaaatcaattcgttcgatgagtatatattaagaggactattagaagctggtaatagtttacagatattttcc

SEQ ID NO: 347097 - DNA, 75 bp, Artificial Sequence
  Synthetic
tccatttagcaaaattccattggcctcattaactcctaaagcacaacgagagatattttcagcgtggatttctca

SEQ ID NO: 347098 - DNA, 75 bp, Artificial Sequence
  Synthetic
tagacctgtagttttaactggaggaactggagtgggtaagacgtcacaggtacccaagttattgctttggtttaa

SEQ ID NO: 347099 - DNA, 75 bp, Artificial Sequence
  Synthetic
actagagtatataaaatctcgttacatgttattgaaggaagaggatatcgatgagaacatagtatccactttatt

SEQ ID NO: 347100 - DNA, 75 bp, Artificial Sequence
  Synthetic
aaaaccagtatttgtagcaagtcaaatccgtttattacagaactcaacaataaatttagtgagaataatccgttt

SEQ ID NO: 347101 - DNA, 75 bp, Artificial Sequence
  Synthetic
ctagataaaatcactgactttcacgaaagaccagtcattctatctcttcctaggatagctttagttagattgcat

SEQ ID NO: 347102 - DNA, 75 bp, Artificial Sequence
  Synthetic
aaagaccagtcattctatctcttcctaggatagctttagttagattgcatagcaataccattttaaaatcattgg

SEQ ID NO: 347103 - DNA, 75 bp, Artificial Sequence
  Synthetic
ccggaagaattaataaacaaacaaccaaaaaaatatggaattgtattttctacccataagttatctctaacaaaa

SEQ ID NO: 347104 - DNA, 75 bp, Artificial Sequence
  Synthetic
tagacgaagttcatgagcatgatcaaataggagatattattatagcagtagcgagaaagcatcatacgaaaatag

SEQ ID NO: 347105 - DNA, 75 bp, Artificial Sequence
  Synthetic
atcttaagcgtagaagttgtaaatgacaatgagatgtaccatcttattcctcatagattatcgacgattatactc

SEQ ID NO: 347106 - DNA, 75 bp, Artificial Sequence
  Synthetic
aaagtatttttacctaatcccgcatttatacatattcctggagatacactgtttaaaattagcgaggtatttatt

SEQ ID NO: 347107 - DNA, 75 bp, Artificial Sequence
  Synthetic
ttatacatattcctggagatacactgtttaaaattagcgaggtatttattcataataagataaatccatcttcca

SEQ ID NO: 347108 - DNA, 75 bp, Artificial Sequence
  Synthetic
cactgagtaaatgtgtcgtagttagcaagggtcctacaaccatattggttgttaaagcggatatacctagcaaac

SEQ ID NO: 347109 - DNA, 75 bp, Artificial Sequence
  Synthetic
atgtatactcctcctgatggatcatccggtatagtctttgtggcatccgttgcacagtgtcacgaatataaatca

SEQ ID NO: 347110 - DNA, 75 bp, Artificial Sequence
  Synthetic
aatacacaagtaatagattatcttatacgtatcaacggagatataaatgcgttaaccgacaataacaaacacgct

SEQ ID NO: 347111 - DNA, 75 bp, Artificial Sequence
  Synthetic
atacggatatgactgccgtcattcctaaaaaaagtggtaggagaaagaataagaacatggttattttccgtcaag

SEQ ID NO: 347112 - DNA, 75 bp, Artificial Sequence
  Synthetic
ccggtatagtctttgtggcatccgttgcacagtgtcacgaatataaatcatatttagaaaaaagattaccgtatg

SEQ ID NO: 347113 - DNA, 75 bp, Artificial Sequence
  Synthetic
aatgtatccggccaattgatagtagataatgaggtgtacagcgcatgataatttacacagtaaccaaaatgaaaa

SEQ ID NO: 347114 - DNA, 75 bp, Artificial Sequence
  Synthetic
aaagtgtattcatcacctaatgtatcgataattatttctactccttatttggaatccagcgttactatacgcaat

SEQ ID NO: 347115 - DNA, 75 bp, Artificial Sequence
  Synthetic
gtagataagaatgtgataagatcgttggtggatcaacttccatctctacctatctttcgtcgcttatcatactag

SEQ ID NO: 347116 - DNA, 75 bp, Artificial Sequence
  Synthetic
gagattaaatcgtctaacaaacaattagtttttatgacattaacatataataaataaattaatcattattgactt

SEQ ID NO: 347117 - DNA, 75 bp, Artificial Sequence
  Synthetic
tagtttttatgacattaacatataataaataaattaatcattattgacttaacgatgacgaaagttatcatcatc

SEQ ID NO: 347118 - DNA, 75 bp, Artificial Sequence
  Synthetic
atacgtatatttctatgatctgtcttatatgaagtctatacagcgaatagattcagaatttctacataattatat

SEQ ID NO: 347119 - DNA, 75 bp, Artificial Sequence
  Synthetic
tatatgaagtctatacagcgaatagattcagaatttctacataattatatattgtacgctaataagtttaatcta

SEQ ID NO: 347120 - DNA, 75 bp, Artificial Sequence
  Synthetic
ttactgaaactatacgtaactgtcaaaaaatagaaacatatatggtctatatatacactacaatttagttattaa

SEQ ID NO: 347121 - DNA, 75 bp, Artificial Sequence
  Synthetic
aggtgtctcatattataattcacaagaattaaagtgttgtaaactatgtaagccaggaacatattcagatcatcg

SEQ ID NO: 347122 - DNA, 75 bp, Artificial Sequence
  Synthetic
gaattaaagtgttgtaaactatgtaagccaggaacatattcagatcatcgatgtgataaatacagcgataccatt

SEQ ID NO: 347123 - DNA, 75 bp, Artificial Sequence
  Synthetic
gcgtacaaaggaatatatagactcgttcgatattagtacagaaacatggaataaattattatccaattattatat

SEQ ID NO: 347124 - DNA, 75 bp, Artificial Sequence
  Synthetic
ttcgatattagtacagaaacatggaataaattattatccaattattatatgaagatgatagagtatgctaaactt

SEQ ID NO: 347125 - DNA, 75 bp, Artificial Sequence
  Synthetic
aaagaaaactgttcatggaggcactaatgcaaattacttttccggtaaaaagtctgacgagtatctgagcactac

SEQ ID NO: 347126 - DNA, 75 bp, Artificial Sequence
  Synthetic
ttggtgtcatagttgtagaggtccatgtggtactaatcgagtagaggtcacaccttgtacacctaccacaaatag

SEQ ID NO: 347127 - DNA, 75 bp, Artificial Sequence
  Synthetic
gggagaattaactagtattgtacgagaagccattttatctctaaatttacgaattaagattttaaattttaaaca

SEQ ID NO: 347128 - DNA, 75 bp, Artificial Sequence
  Synthetic
gattattataaaataacaatagttcctggttcctcttccacgtctactagctcgtggtattatacacatgcctag

SEQ ID NO: 347129 - DNA, 75 bp, Artificial Sequence
  Synthetic
gaattaagattttaaattttaaacataaagatgatgatacgtatatacacttttgtaaaatattattcggtgtct

SEQ ID NO: 347130 - DNA, 75 bp, Artificial Sequence
  Synthetic
tgtggtactaatcgagtagaggtcacaccttgtacacctaccacaaatagaatctgtcattgtgactcgaatagt

SEQ ID NO: 347131 - DNA, 75 bp, Artificial Sequence
  Synthetic
acaaagtccaatgattgcacgaagttcttcggcggttttcatggagtcatttctgatgaaacatttaatgatctc

SEQ ID NO: 347132 - DNA, 75 bp, Artificial Sequence
  Synthetic
aacaaaatgtggtcgtgggtatggaaagaaaggagaagatgaaatgggtaataccatttgtaagaaatgtcggaa

SEQ ID NO: 347133 - DNA, 75 bp, Artificial Sequence
  Synthetic
gggtacttattcagatattgtatctgactctgatcaatgtaaaccaatgacaagataagacttactcgcatctac

SEQ ID NO: 347134 - DNA, 75 bp, Artificial Sequence
  Synthetic
aattattaatatcaataacaatcgagtattaatatataggtcatttttaaatcccttttgggttccgtcccaaac

SEQ ID NO: 347135 - DNA, 75 bp, Artificial Sequence
  Synthetic
gtattaatatataggtcatttttaaatcccttttgggttccgtcccaaacggcgtttcggtctgcgtcgccgcca

SEQ ID NO: 347136 - DNA, 75 bp, Artificial Sequence
  Synthetic
cctttcttcttgagatcccacatcatttcaaccagagacgttttatccaatgatttacctcgtactataccacat

SEQ ID NO: 347137 - DNA, 75 bp, Artificial Sequence
  Synthetic
gttacagatggaagggtcaaacttaataaaggatatttgttcgactttgtgattagtttgatgcgattcaaaaaa

SEQ ID NO: 347138 - DNA, 75 bp, Artificial Sequence
  Synthetic
tttcaaccagagacgttttatccaatgatttacctcgtactataccacatacaaaactagattttgcagtgacgt

SEQ ID NO: 347139 - DNA, 75 bp, Artificial Sequence
  Synthetic
tatggcagctcggtggcgtctgccagcgtgcacatacgaatggcatttctaagaaaagtctacggtatcctttgt

SEQ ID NO: 347140 - DNA, 75 bp, Artificial Sequence
  Synthetic
gcgtgcacatacgaatggcatttctaagaaaagtctacggtatcctttgtctacaatttcttttaacaacggcaa

SEQ ID NO: 347141 - DNA, 75 bp, Artificial Sequence
  Synthetic
aattctaaggtagaatctctatttgccaatatgtcatctatggaattaccactagcaaaaaatgatagaaatata

SEQ ID NO: 347142 - DNA, 75 bp, Artificial Sequence
  Synthetic
ccaatatgtcatctatggaattaccactagcaaaaaatgatagaaatatatattgatacatcgcagctggttttg

SEQ ID NO: 347143 - DNA, 75 bp, Artificial Sequence
  Synthetic
agtcctgttctaatattggcatcaatgttcggatctataggcttaattttcgcattgactttacacagacataaa

SEQ ID NO: 347144 - DNA, 75 bp, Artificial Sequence
  Synthetic
gtaagatatctttatattccataatcaatgagacatcactatctgataacgaatgaagtctagcactagtatgcc

SEQ ID NO: 347145 - DNA, 75 bp, Artificial Sequence
  Synthetic
tgttcggatctataggcttaattttcgcattgactttacacagacataaacatcccctgaatctgtacctgcttt

SEQ ID NO: 347146 - DNA, 75 bp, Artificial Sequence
  Synthetic
tcagctgaaaaactatgttttacacgtattccttcggcatttctttttaatgatatatcttgtttagacaatgat

SEQ ID NO: 347147 - DNA, 75 bp, Artificial Sequence
  Synthetic
tatgatgtgcatgtcgttatgcaagctttcatgctgactactgcagcgtttcttgctctgactacatatactcta

SEQ ID NO: 347148 - DNA, 75 bp, Artificial Sequence
  Synthetic
ctttcatgctgactactgcagcgtttcttgctctgactacatatactctacaatcaaagagagatttcagtaaac

SEQ ID NO: 347149 - DNA, 75 bp, Artificial Sequence
  Synthetic
aaagttatcatgtccatgagagacgcgtctccgtatcgtataaatatttcattagatgttagacgcttcattagg

SEQ ID NO: 347150 - DNA, 75 bp, Artificial Sequence
  Synthetic
ttggggatatttgtgcaaaatgagacagtgaagctggtcctgtctgcttttggggcccttgtattctgtggattc

SEQ ID NO: 347151 - DNA, 75 bp, Artificial Sequence
  Synthetic
aactactatcggatgttgttgggtatctctagtgttacacatggccttactaaagtttgggtaaataactatgat

SEQ ID NO: 347152 - DNA, 75 bp, Artificial Sequence
  Synthetic
tctctagtgttacacatggccttactaaagtttgggtaaataactatgatatctctattaattatagatgtatat

SEQ ID NO: 347153 - DNA, 75 bp, Artificial Sequence
  Synthetic
cagtgaagctggtcctgtctgcttttggggcccttgtattctgtggattcattatctatgacacgcactcactaa

SEQ ID NO: 347154 - DNA, 75 bp, Artificial Sequence
  Synthetic
ttggatatcatcaatctgttcttgcatctgttgcagcttttggaagtatctaataagaaataaagtttaaaatag

SEQ ID NO: 347155 - DNA, 75 bp, Artificial Sequence
  Synthetic
tgtaatgtaatcatataaatcatgcgatagccaaggaaaatttaaatagatgttcatcatataatcgtcgctata

SEQ ID NO: 347156 - DNA, 75 bp, Artificial Sequence
  Synthetic
atctgttgcagcttttggaagtatctaataagaaataaagtttaaaatagaattaataaaaacatataggtcatt

SEQ ID NO: 347157 - DNA, 75 bp, Artificial Sequence
  Synthetic
tgttcatcatataatcgtcgctataattcatattaatacgttgacattgactaatttgtaatatagcctcgccac

SEQ ID NO: 347158 - DNA, 75 bp, Artificial Sequence
  Synthetic
tatttttttcacatcatccacccatgggtaacaccaaggttgttagttaataatatacaagatattttttctcac

SEQ ID NO: 347159 - DNA, 75 bp, Artificial Sequence
  Synthetic
atcgataaaggataccgttaaatataactggttgccgatagtctcatagtctattaagtggtaagtttcgtacaa

SEQ ID NO: 347160 - DNA, 75 bp, Artificial Sequence
  Synthetic
aactggttgccgatagtctcatagtctattaagtggtaagtttcgtacaaatacagaatccctaaaatattatct

SEQ ID NO: 347161 - DNA, 75 bp, Artificial Sequence
  Synthetic
aactattttaccgtttgtacttactggaatagacgaaggaataatctccggacatgctggtaaagacccaaatgt

SEQ ID NO: 347162 - DNA, 75 bp, Artificial Sequence
  Synthetic
gacatgctggtaaagacccaaatgtctgtttgaagaaatccaatgttccaggtcctaatctcttaacaaaaatta

SEQ ID NO: 347163 - DNA, 75 bp, Artificial Sequence
  Synthetic
gaatcaatattaatatttctaaagtatccgtgtatagcctctttatttaccacagttccatattccaacatgcat

SEQ ID NO: 347164 - DNA, 75 bp, Artificial Sequence
  Synthetic
cattctatttaccagcatatcacgaactatattaagattatctatcatgtctattctcccaccgttatataaatc

SEQ ID NO: 347165 - DNA, 75 bp, Artificial Sequence
  Synthetic
actatattaagattatctatcatgtctattctcccaccgttatataaatcgcctccgctaagaaacgttagtata

SEQ ID NO: 347166 - DNA, 75 bp, Artificial Sequence
  Synthetic
tttaatgtgaaatcgtatactagaaagggaaaaattatctttgagttttccgttagaaaaaaaccacgaaactaa

SEQ ID NO: 347167 - DNA, 75 bp, Artificial Sequence
  Synthetic
tataatttccccattgatagaaaatatcacgctttccattcttgaagtactataagtaattatagtataatgtaa

SEQ ID NO: 347168 - DNA, 75 bp, Artificial Sequence
  Synthetic
aagaacttcgtgcaatcattggactttgtactcaatcagctatcgtctctggaagagtcttcaacgataagtata

SEQ ID NO: 347169 - DNA, 75 bp, Artificial Sequence
  Synthetic
tgttctgattgcgtccgattccgttgctgaattaatggatttacaccaaaaactcatataacttctagatgtaga

SEQ ID NO: 347170 - DNA, 75 bp, Artificial Sequence
  Synthetic
catcgaccccattacgatagtatgcaggcaacccccattagagaggtacgtgtaatcagtctctccagttttagt

SEQ ID NO: 347171 - DNA, 75 bp, Artificial Sequence
  Synthetic
cggttaacgattggaaatcattaacggtatcgaaaacaaaattagaaagtgatagaggtagacttctagccgctg

SEQ ID NO: 347172 - DNA, 75 bp, Artificial Sequence
  Synthetic
agcattcgctaaaaaattagtagaatcaaaggatataagtagatgttccaacaagtgagcaattcccaagatttc

SEQ ID NO: 347173 - DNA, 75 bp, Artificial Sequence
  Synthetic
tcaaaggatataagtagatgttccaacaagtgagcaattcccaagatttcatctatatcattttcgaatccgaaa

SEQ ID NO: 347174 - DNA, 75 bp, Artificial Sequence
  Synthetic
acgaactttattcggtaagacaatcatttactaaggagtaaaataggaagtaatgttcgtatgtcgttatcatcg

SEQ ID NO: 347175 - DNA, 75 bp, Artificial Sequence
  Synthetic
aattgtagcatcatataccatttctagtactttaggttcattattatccattgcagaggacgtcatgatcgcatc

SEQ ID NO: 347176 - DNA, 75 bp, Artificial Sequence
  Synthetic
atttactaaggagtaaaataggaagtaatgttcgtatgtcgttatcatcgtataaattaaaggtgtgttttttac

SEQ ID NO: 347177 - DNA, 75 bp, Artificial Sequence
  Synthetic
atttgcgcactcgcgacggttgatgcatcggtaaatatagctgtatctaatgttctagtcggtatttcatcattt

SEQ ID NO: 347178 - DNA, 75 bp, Artificial Sequence
  Synthetic
atttcgtttcttaaatattccaacaacatcaactgaaaaagttagtcatgaaccaatacaacgtaaagtatctag

SEQ ID NO: 347179 - DNA, 75 bp, Artificial Sequence
  Synthetic
tcgagtacaccacacgacaatgaacaaacataagacagattatgctggttatgcttgctgcgtaatatgcggtct

SEQ ID NO: 347180 - DNA, 75 bp, Artificial Sequence
  Synthetic
aatctcagattgtgcatctactgatatccagctattcgaattcctctaacgaactcaagtcgaatataaatgatt

SEQ ID NO: 347181 - DNA, 75 bp, Artificial Sequence
  Synthetic
catcggtaaatatagctgtatctaatgttctagtcggtatttcatcatttcgctgtctaataatagcgttttctc

SEQ ID NO: 347182 - DNA, 75 bp, Artificial Sequence
  Synthetic
aaataataagaaatacatacgaataacaaaaataaaataagatataataaagatgccatttagagatctaatttt

SEQ ID NO: 347183 - DNA, 75 bp, Artificial Sequence
  Synthetic
acttactttccagataggaaataccataaatatatttctaaagtatttgaacatgtagatttatcggaggaatta

SEQ ID NO: 347184 - DNA, 75 bp, Artificial Sequence
  Synthetic
ttaatgaaaggaatagataacacggcttattcatatatagacgatctaacatgttgcactcgaggaattatggct

SEQ ID NO: 347185 - DNA, 75 bp, Artificial Sequence
  Synthetic
gtacaagtattccaagtgtatacggccgtgttataaattaggagataatctaaaaggcatagttgttataaagga

SEQ ID NO: 347186 - DNA, 75 bp, Artificial Sequence
  Synthetic
tttatagctaagaatgccacgaagaatggaactaaaaaacggaaatatatttgtagtacaacgaatactcccaaa

SEQ ID NO: 347187 - DNA, 75 bp, Artificial Sequence
  Synthetic
agtcgatccaataaattatcaaatacttcaaaatttatttgataaaggaagcggaacaataaacaaaatactcag

SEQ ID NO: 347188 - DNA, 75 bp, Artificial Sequence
  Synthetic
attacggcgatatggtaagtatacctatcattcaatgcatgttggataacggagcaaccatggataagacgacgg

SEQ ID NO: 347189 - DNA, 75 bp, Artificial Sequence
  Synthetic
gtgaaatccaaggatttattaatgtccacaaatgccatttgttttgtctgtggattgtatttgaaaatggaaacg

SEQ ID NO: 347190 - DNA, 75 bp, Artificial Sequence
  Synthetic
agtttcctattagggttccgcgcttcacgtcacccagcatacttgaatcaccatcctttaaaaaaaatgataaga

SEQ ID NO: 347191 - DNA, 75 bp, Artificial Sequence
  Synthetic
ctgacattttcacaaatactacaatacggtttaccgaaaataatcagtacgttcttcatttatgggtatcaaaaa

SEQ ID NO: 347192 - DNA, 75 bp, Artificial Sequence
  Synthetic
gataagactttgaacattattgatacccgtctgtttaattttttctacagatattttagttttggcagattctat

SEQ ID NO: 347193 - DNA, 75 bp, Artificial Sequence
  Synthetic
acggtttaccgaaaataatcagtacgttcttcatttatgggtatcaaaaacttaaaatcgttactgctggaaaat

SEQ ID NO: 347194 - DNA, 75 bp, Artificial Sequence
  Synthetic
aatatacaatttgcaaagcggttattggaatatggagcgagtgtcacgctcgataatcaatacggccatccagaa

SEQ ID NO: 347195 - DNA, 75 bp, Artificial Sequence
  Synthetic
atttgtggatacaatgagtatttatatagccgtcgccaattgtgtcagaaacttagaagagttaactacggtatt

SEQ ID NO: 347196 - DNA, 75 bp, Artificial Sequence
  Synthetic
cgagagatagaagaacatatgagacaaacgctgatagatgatccagataataacctcctgaaaatggccaaagcg

SEQ ID NO: 347197 - DNA, 75 bp, Artificial Sequence
  Synthetic
gttaccatcccactctagagactatgattgacgcatttaatagagatatacgctatctatatcctgaaccattat

SEQ ID NO: 347198 - DNA, 75 bp, Artificial Sequence
  Synthetic
atagccgtcgccaattgtgtcagaaacttagaagagttaactacggtattcataaaatacgtaaacggatgggta

SEQ ID NO: 347199 - DNA, 75 bp, Artificial Sequence
  Synthetic
aaacgctgatagatgatccagataataacctcctgaaaatggccaaagcgggttataaagtaaatcccacagaac

SEQ ID NO: 347200 - DNA, 75 bp, Artificial Sequence
  Synthetic
taaacaagacgttagagacaagagacgtaaatattctaaattaaccaaggacagaaaaatgctagaattagaaaa

SEQ ID NO: 347201 - DNA, 75 bp, Artificial Sequence
  Synthetic
cgtaaatattctaaattaaccaaggacagaaaaatgctagaattagaaaagtgtacatccgaaatacaaaatgtt

SEQ ID NO: 347202 - DNA, 75 bp, Artificial Sequence
  Synthetic
atagacagcaatcccatggttccataaacagtgagtttatctttctttgaagcgatagtttgtagagatcttata

SEQ ID NO: 347203 - DNA, 75 bp, Artificial Sequence
  Synthetic
taaactcacatttcaaatatatttatctgattctgataacataaaaatatcattgaatgagatactaacacattt

SEQ ID NO: 347204 - DNA, 75 bp, Artificial Sequence
  Synthetic
tctgattctgataacataaaaatatcattgaatgagatactaacacatttcaacaataatgagaatgttacatta

SEQ ID NO: 347205 - DNA, 75 bp, Artificial Sequence
  Synthetic
acacgtcctcgtatttatccagtattttgatgatatccaactcagaaatggttgttgtattattgggtgtatagg

SEQ ID NO: 347206 - DNA, 75 bp, Artificial Sequence
  Synthetic
aacacatttctctaccacaggagaatggccgttgataataagtaccgatcaggatactatgctatttgcatctac

SEQ ID NO: 347207 - DNA, 75 bp, Artificial Sequence
  Synthetic
tggccgttgataataagtaccgatcaggatactatgctatttgcatctactgataatcatcctaagatgataaaa

SEQ ID NO: 347208 - DNA, 75 bp, Artificial Sequence
  Synthetic
agcaaaattaacggcgttagtgaatggatgtgatttctttcctggactctatggggcatctataacacccaccaa

SEQ ID NO: 347209 - DNA, 75 bp, Artificial Sequence
  Synthetic
ggatgtgatttctttcctggactctatggggcatctataacacccaccaacttaaacaaaatacaattgtttagt

SEQ ID NO: 347210 - DNA, 75 bp, Artificial Sequence
  Synthetic
cgacagtatgtggtacatacctaacgtatttatggacgacggtaagaatgaaggtcacgtttctgtcaacaatgt

SEQ ID NO: 347211 - DNA, 75 bp, Artificial Sequence
  Synthetic
aaggtcacgtttctgtcaacaatgtttgtcatatgtattttacgttctttgatgtagatacatcgtctcatctgt

SEQ ID NO: 347212 - DNA, 75 bp, Artificial Sequence
  Synthetic
tagaaagactaactctaccgtagacgtgcgtaatattgttacgtttataaacgattacgctaatttagacgatgt

SEQ ID NO: 347213 - DNA, 75 bp, Artificial Sequence
  Synthetic
gatatagatattaaacaagtgatacgtgagaatatactacaattgtctaatgatatccgcgaacgatatttgtga

SEQ ID NO: 347214 - DNA, 75 bp, Artificial Sequence
  Synthetic
ttacattgctatacgatgaatacacgatttaatccatctgtattaaagatattgttacaccacggcatgcgtaac

SEQ ID NO: 347215 - DNA, 75 bp, Artificial Sequence
  Synthetic
tgatgtagaagaagacgaggattttgattttggtttacatgtaatacattttgtactctttgattttgtatcaca

SEQ ID NO: 347216 - DNA, 75 bp, Artificial Sequence
  Synthetic
tgatgtttcagaagttaaaactttatcatcttatatagatttcgaaaatactaaatcagatatcgatgttataaa

SEQ ID NO: 347217 - DNA, 75 bp, Artificial Sequence
  Synthetic
gtaaatcatccgatctattgctgtgttatcttagatataaattcaatgggagcttaaactattacgttctgtaca

SEQ ID NO: 347218 - DNA, 75 bp, Artificial Sequence
  Synthetic
agttcgtcgagtgaacctataaacagataatagacaacacgtaataataataatgcctactaatacaagcataat

SEQ ID NO: 347219 - DNA, 75 bp, Artificial Sequence
  Synthetic
actactgagtataaataattcattttactttaacgatagtctgttaataaccaatactaaaagtgataatataat

SEQ ID NO: 347220 - DNA, 75 bp, Artificial Sequence
  Synthetic
tactttaacgatagtctgttaataaccaatactaaaagtgataatataataaatataggttactagattaaaaat

SEQ ID NO: 347221 - DNA, 75 bp, Artificial Sequence
  Synthetic
tctacgaaagcaattattacaagtcaagtcacactaagatgcgagccgagaagcgattcatctacgcgataatag

SEQ ID NO: 347222 - DNA, 75 bp, Artificial Sequence
  Synthetic
aagcgattcatctacgcgataatagattatggagcaaacattaacgcggttacacacttaccttcaacagtatac

SEQ ID NO: 347223 - DNA, 75 bp, Artificial Sequence
  Synthetic
gatataaattgattatacgaaaaaaatcattaaaggatgtactcgtcagtgtaaagaacgaatgttgtaggttaa

SEQ ID NO: 347224 - DNA, 75 bp, Artificial Sequence
  Synthetic
atcattaaaggatgtactcgtcagtgtaaagaacgaatgttgtaggttaaaattatctacacaaatagaacctca

SEQ ID NO: 347225 - DNA, 75 bp, Artificial Sequence
  Synthetic
aaaaatgtataaagtgtatgtcttatgtatatttataaaaatgctaagtatgcgatgtatctatgttatttgtat

SEQ ID NO: 347226 - DNA, 75 bp, Artificial Sequence
  Synthetic
taatcttgattgtacacccatcatggaacgattgtgcaacaggtcatattctcataatgttactcaattggcacg

SEQ ID NO: 347227 - DNA, 75 bp, Artificial Sequence
  Synthetic
aacaaaaggaagaaggacaacatctactttatctattcataaaacataatcaaggatacactctcaatatactac

SEQ ID NO: 347228 - DNA, 75 bp, Artificial Sequence
  Synthetic
gttaattttatcaagacatatgcgcctagaggttctattatttttattaattataccatgtcattaacaagtcat

SEQ ID NO: 347229 - DNA, 75 bp, Artificial Sequence
  Synthetic
tcactgattaattatttgccgttgtctgtattcattattagacgagttaccgactatttggatagacacatatgc

SEQ ID NO: 347230 - DNA, 75 bp, Artificial Sequence
  Synthetic
ttctgcaacaagtcggggatcgtgttctacatatttggcggcgttatccagtatctgcctattgatcttcatttc

SEQ ID NO: 347231 - DNA, 75 bp, Artificial Sequence
  Synthetic
ttataccatgtcattaacaagtcatttgaatccatcgatagaaaaacatgtgggtatttattatggtacgttatt

SEQ ID NO: 347232 - DNA, 75 bp, Artificial Sequence
  Synthetic
ggtatctattagataggttcgacattcagaaagacgaatactataataccgcctttcaaaattgtaacaacaatg

SEQ ID NO: 347233 - DNA, 75 bp, Artificial Sequence
  Synthetic
tcccattggatagtttttttgaaggatatcttagtgcaaaagtatacatgttagagaatattcaagttatgaaaa

SEQ ID NO: 347234 - DNA, 75 bp, Artificial Sequence
  Synthetic
cgacttggtgtttgaaaacagaaacatcatatacaaggcggatgttgtgaatgacatcatccaccacagactgaa

SEQ ID NO: 347235 - DNA, 75 bp, Artificial Sequence
  Synthetic
agtatctctacctatgattaaatcgttgttctacaagatgtctctccctacgacgattactacgtaaaaaagata

SEQ ID NO: 347236 - DNA, 75 bp, Artificial Sequence
  Synthetic
agaaagctgtggatgttctggttcggcatccaccgatggtgtcacatcactaattggttcagtaacgtctgtgga

SEQ ID NO: 347237 - DNA, 75 bp, Artificial Sequence
  Synthetic
attctgtttaaacgaggactataaaagtgtatttatgaaaaatatatcattcgataagatagattccatcatcgt

SEQ ID NO: 347238 - DNA, 75 bp, Artificial Sequence
  Synthetic
gccaaaacttcacagacgataatagatggataaagatatatgattctaataatttaacattttggcaaattgatt

SEQ ID NO: 347239 - DNA, 75 bp, Artificial Sequence
  Synthetic
cgaatggcataggatctccgaatctgaaaacgtataaataggagttagaataataatatttgagagtattggtaa

SEQ ID NO: 347240 - DNA, 75 bp, Artificial Sequence
  Synthetic
atggataaagatatatgattctaataatttaacattttggcaaattgattaccttaaagggtgagttaatatgca

SEQ ID NO: 347241 - DNA, 75 bp, Artificial Sequence
  Synthetic
gccatcactctcataatgtaaagatattctaaaatggtaaacttttgcatatcggacgcagaaattggtataaat

SEQ ID NO: 347242 - DNA, 75 bp, Artificial Sequence
  Synthetic
atggactagtcacagctccatcagttttatatcctttagagtatttctcactcgtgtctagcattctagagcatt

SEQ ID NO: 347243 - DNA, 75 bp, Artificial Sequence
  Synthetic
agatggagtaggtgcaacaattttttgttctacacatgtatgtactggagccattgttttaactataatggtgct

SEQ ID NO: 347244 - DNA, 75 bp, Artificial Sequence
  Synthetic
tttattatattactattggcaattgtagatataacttctggtaaatatttttctaccttttcaatctcttctatt

SEQ ID NO: 347245 - DNA, 75 bp, Artificial Sequence
  Synthetic
tagatataacttctggtaaatatttttctaccttttcaatctcttctattttcaagccggctatatattctgcta

SEQ ID NO: 347246 - DNA, 75 bp, Artificial Sequence
  Synthetic
tatgcctgagagtaaacattgacggataaaacaaaaatgctccgcataactctatcatggcaataacacaaccaa

SEQ ID NO: 347247 - DNA, 75 bp, Artificial Sequence
  Synthetic
ttcactatatcagttttaactggtagttccattagcctttccacttctgcagaataatcagaaattggttcttta

SEQ ID NO: 347248 - DNA, 75 bp, Artificial Sequence
  Synthetic
gttccattagcctttccacttctgcagaataatcagaaattggttctttaccagaaaatccagctactataatag

SEQ ID NO: 347249 - DNA, 75 bp, Artificial Sequence
  Synthetic
gcatatttcatttccaataattctgctagttcttgagacattgatttatttgatgaatctagttggttctctaga

SEQ ID NO: 347250 - DNA, 75 bp, Artificial Sequence
  Synthetic
ctagttcttgagacattgatttatttgatgaatctagttggttctctagatactctaccatttctgccgcataca

SEQ ID NO: 347251 - DNA, 75 bp, Artificial Sequence
  Synthetic
atagtgggcttgcatgtattaaagaatgcggtagtatgagtaaaccgttttaacgaattatatagtctccagaaa

SEQ ID NO: 347252 - DNA, 75 bp, Artificial Sequence
  Synthetic
aatgacatcgaagattgtccaatatttttaatagctgctctttgtccattatttctatatttgactcgcaacaat

SEQ ID NO: 347253 - DNA, 75 bp, Artificial Sequence
  Synthetic
ctttttcgatgccggacaatagcacaattgtttagctttggactctatgtattcagaattaatagatatatctct

SEQ ID NO: 347254 - DNA, 75 bp, Artificial Sequence
  Synthetic
aattgtttagctttggactctatgtattcagaattaatagatatatctcttaatacagattgcactatacatttt

SEQ ID NO: 347255 - DNA, 75 bp, Artificial Sequence
  Synthetic
ttaaataatttacaaaaatttaaaatgagcatccgtataaaaatcgataaactgcgccaaattgtggcatatttt

SEQ ID NO: 347256 - DNA, 75 bp, Artificial Sequence
  Synthetic
aatcttccggtgtccaaggtaaaatcgtgtttgtgtagttttcacaatgatgccatcatagatatagaacctgat

SEQ ID NO: 347257 - DNA, 75 bp, Artificial Sequence
  Synthetic
ctagttatcatgtagtaagtgtcgattgtaacaaggaactgatgcctattaggacagatactactatttgtctaa

SEQ ID NO: 347258 - DNA, 75 bp, Artificial Sequence
  Synthetic
aggacagatactactatttgtctaagtatagatcaaaagaaatcttacgtgtttaattttcacaagtatgaagaa

SEQ ID NO: 347259 - DNA, 75 bp, Artificial Sequence
  Synthetic
gtttaattttcacaagtatgaagaaaaatgttgtggtagaaccgtcattcatttagaatggttgttgggctttat

SEQ ID NO: 347260 - DNA, 75 bp, Artificial Sequence
  Synthetic
tttttttatgagaccatcaaagagagaaagagaataaaaatatttttgtaaaactttttttatgagaccatcaaa

SEQ ID NO: 347261 - DNA, 75 bp, Artificial Sequence
  Synthetic
tggatgagtagggttaatcgaacgattcaggcacaccacgaattaaaaaagtgtaccggacactatattccggtt

SEQ ID NO: 347262 - DNA, 75 bp, Artificial Sequence
  Synthetic
atattattatgaagactcctggtaatactgatgcattttccagggaatattctatgactgaatgttctcaagaac

SEQ ID NO: 347263 - DNA, 75 bp, Artificial Sequence
  Synthetic
tactgatgcattttccagggaatattctatgactgaatgttctcaagaactacaaaagttttctttcaaaatagc

SEQ ID NO: 347264 - DNA, 75 bp, Artificial Sequence
  Synthetic
ttcgaacgaagacctccttcgttttataaaccattagataaagttgatctcaagccgtcttttctggtctaatat

SEQ ID NO: 347265 - DNA, 75 bp, Artificial Sequence
  Synthetic
ttgaaactagaatcgtaatggataatgacgataacattctaggaatgttgttttcggatagagttcaatccttta

SEQ ID NO: 347266 - DNA, 75 bp, Artificial Sequence
  Synthetic
agattaatactttcaatgagataaatatgggtggcggagtaagtgttgagctccctaaacgggatccgcctccgg

SEQ ID NO: 347267 - DNA, 75 bp, Artificial Sequence
  Synthetic
aaacgttgataaaatgcatgacgtgatagctcccgctaagcttttagaatatgtgcatataggaccactagcaaa

SEQ ID NO: 347268 - DNA, 75 bp, Artificial Sequence; identical to SEQ ID NO: 251909
  Synthetic

SEQ ID NO: 347269 - DNA, 75 bp, Artificial Sequence
  Synthetic
aaaatgcgatgttgatttattcgactggtgtcagggggatacgttcgatagaaacatatgccatcagtggatcgg

SEQ ID NO: 347270 - DNA, 75 bp, Artificial Sequence; identical to SEQ ID NO: 47469
  Synthetic

SEQ ID NO: 347271 - DNA, 75 bp, Artificial Sequence
  Synthetic
ttcagcctttaataggagtgatagaactgtagagggtcaacaatcgttaataaatctgtataataagatgcaaac

SEQ ID NO: 347272 - DNA, 75 bp, Artificial Sequence
  Synthetic
atttacgcgcacacaatacagaagatagcaaagagatgatcgattatattctaagacaacagtctgcggacttta

SEQ ID NO: 347273 - DNA, 75 bp, Artificial Sequence
  Synthetic
tagcaaagagatgatcgattatattctaagacaacagtctgcggactttaaacagaaatatatgagatgtagtta

SEQ ID NO: 347274 - DNA, 75 bp, Artificial Sequence; identical to SEQ ID NO: 251917
  Synthetic

SEQ ID NO: 347275 - DNA, 75 bp, Artificial Sequence
  Synthetic
cgtaattataataatttaggactttgcaatattgtacgatgtaatactagcgtgaacaacttacagatggataaa

SEQ ID NO: 347276 - DNA, 75 bp, Artificial Sequence
  Synthetic
tactgttcccgtcaatagagcaaaagtagttcaacataatattaaacactcgttcgacctaaaattgcatttgat

SEQ ID NO: 347277 - DNA, 75 bp, Artificial Sequence
  Synthetic
gtagttcaacataatattaaacactcgttcgacctaaaattgcatttgatcagtttattatctctcttggtaata

SEQ ID NO: 347278 - DNA, 75 bp, Artificial Sequence
  Synthetic
gacggtgaatacactcagcgaacgtatctcgtctaaattagaacaagaagcgaacgctagtgctcaaacaaaatg

SEQ ID NO: 347279 - DNA, 75 bp, Artificial Sequence
  Synthetic
atctcgtctaaattagaacaagaagcgaacgctagtgctcaaacaaaatgtgatatagaaatcggaaatttttat

SEQ ID NO: 347280 - DNA, 75 bp, Artificial Sequence
  Synthetic
gggtgttaatggggcggtatacacattttcaaataataaactaaacaaaactggtttagctaatactaattatat

SEQ ID NO: 347281 - DNA, 75 bp, Artificial Sequence
  Synthetic
ggacgcggatgctcagttggatgctgtgttatcagccgctacagaaacatatagtggattaacaccggaacaaaa

SEQ ID NO: 347282 - DNA, 75 bp, Artificial Sequence
  Synthetic
tctagcgcggtcgtcgataacaaattaaagatacaaaacgtaatcatagatgaatgttacggagccccaggatct

SEQ ID NO: 347283 - DNA, 75 bp, Artificial Sequence
  Synthetic
taaagatacaaaacgtaatcatagatgaatgttacggagccccaggatctccaacaaatttggaatttattaata

SEQ ID NO: 347284 - DNA, 75 bp, Artificial Sequence
  Synthetic
aactactatgctctaagcggaatcgggtacgagagtctagacttgtgcttggaaggagtagggattcatcatcac

SEQ ID NO: 347285 - DNA, 75 bp, Artificial Sequence
  Synthetic
actaaggccactactcaaatagcacctagacaagttgctggtacaggagttcagttttatatgattgttatcggt

SEQ ID NO: 347286 - DNA, 75 bp, Artificial Sequence
  Synthetic
ctagacaagttgctggtacaggagttcagttttatatgattgttatcggtgttataatattggcagcgttgttta

SEQ ID NO: 347287 - DNA, 75 bp, Artificial Sequence
  Synthetic
gttacaacttagacaagcgggtaaatgattattgcgagatgtgaaggtacccgaaccacacggcgtacattgtgt

SEQ ID NO: 347288 - DNA, 75 bp, Artificial Sequence
  Synthetic
cttattttagccaataaggaaaacgtccattggactacttacatggacacattctttagaacttctccgatggtt

SEQ ID NO: 347289 - DNA, 75 bp, Artificial Sequence
  Synthetic
tccattggactacttacatggacacattctttagaacttctccgatggttattgctaccacggatatgcaaaact

SEQ ID NO: 347290 - DNA, 75 bp, Artificial Sequence
  Synthetic
gagtccgatagtgtagttattgaactgagaagtttttggtcatctctaaacaaggaatctacactattgaacgat

SEQ ID NO: 347291 - DNA, 75 bp, Artificial Sequence
  Synthetic
atttcctgcacgtttaggtttggtacgttgatttctagcccctgcggatataaagtcatcgtctacaattttgga

SEQ ID NO: 347292 - DNA, 75 bp, Artificial Sequence
  Synthetic
tcgtctagacgatatagtgaaacaaaatatagcggatgaaaaatttgtagattttgttatacacggtctagagca

SEQ ID NO: 347293 - DNA, 75 bp, Artificial Sequence
  Synthetic
tcaatgtcctgctatacttcgaccattaattaggttgtttattgatatactattatttgttatagtaatttatat

SEQ ID NO: 347294 - DNA, 75 bp, Artificial Sequence
  Synthetic
tggcgctagtcatcacattaactattttttattactttatactataatagtactagactgacttctaacaaacat

SEQ ID NO: 347295 - DNA, 75 bp, Artificial Sequence
  Synthetic
tttttattactttatactataatagtactagactgacttctaacaaacatctcacctgccataaataaatgcttg

SEQ ID NO: 347296 - DNA, 75 bp, Artificial Sequence
  Synthetic
tctgacattatcgctaattgacacatcggtgagtgatatgcctataaagtaataatcttctttgggcacatatac

SEQ ID NO: 347297 - DNA, 75 bp, Artificial Sequence
  Synthetic
tcggtgagtgatatgcctataaagtaataatcttctttgggcacatataccagtgtaccaggttctaacaaccta

SEQ ID NO: 347298 - DNA, 75 bp, Artificial Sequence
  Synthetic
cgtttgcttggtcaatagcgatatgtgattttttatcaaccactcgaaaaagtaattggagtgttcatatcctct

SEQ ID NO: 347299 - DNA, 75 bp, Artificial Sequence
  Synthetic
tatataaaagacgcttgttaataagtaaatgaaaaaaaactagtcgtttataataaaacacgatatggatgccaa

SEQ ID NO: 347300 - DNA, 75 bp, Artificial Sequence
  Synthetic
tgattttttatcaaccactcgaaaaagtaattggagtgttcatatcctctacgggctattgtctcatggccgtgt

SEQ ID NO: 347301 - DNA, 75 bp, Artificial Sequence
  Synthetic
gccgcaaatagatagaactaccaatatgtctgtacaaatgttaaacattaattgattaacagaaaaaacaatgtt

SEQ ID NO: 347302 - DNA, 75 bp, Artificial Sequence
  Synthetic
atgtctgtacaaatgttaaacattaattgattaacagaaaaaacaatgttcgttctgggaatagaaaccagatca

SEQ ID NO: 347303 - DNA, 75 bp, Artificial Sequence
  Synthetic
atgcttcagaattagaacagaggtctaccgcatacgaaataaataatgaattggaactagtatttattaagccgc

SEQ ID NO: 347304 - DNA, 75 bp, Artificial Sequence
  Synthetic
taccgcatacgaaataaataatgaattggaactagtatttattaagccgccattaattactttgacaaatgtagt

SEQ ID NO: 347305 - DNA, 75 bp, Artificial Sequence
  Synthetic
ttatacatcaagagagcagaaattaccgaattagtcgtcgaatatatgattgaacgattcatctcctttagcgtc

SEQ ID NO: 347306 - DNA, 75 bp, Artificial Sequence
  Synthetic
aaaacacgataggtcagaagataatgaatatctgtacgcttctttttgtactgtaacttctggttttgttagatg

SEQ ID NO: 347307 - DNA, 75 bp, Artificial Sequence
  Synthetic
tctggatctcaccaacgacgatagttctgaccagcaactcatttcttcatcatccacctgttttaacatataata

SEQ ID NO: 347308 - DNA, 75 bp, Artificial Sequence
  Synthetic
acactattatatgattatagtttctatttttacagtaccttaactaaagtttctagtcacaagagcaatactacc

SEQ ID NO: 347309 - DNA, 75 bp, Artificial Sequence
  Synthetic
aatacatctctggaaatagaattcacacctagagacaatgaaacagttccatatgatgaactaataaaggaattg

SEQ ID NO: 347310 - DNA, 75 bp, Artificial Sequence
  Synthetic
tatcacctcgtttggttggatttttgtctatattatcgtttgtaacatcggtacgggtattcatttatcacaaaa

SEQ ID NO: 347311 - DNA, 75 bp, Artificial Sequence
  Synthetic
tggcttctccagagaatgtaattctttctccgcctattaacgcacctataaagacttttatgttgcctaaacaag

SEQ ID NO: 347312 - DNA, 75 bp, Artificial Sequence
  Synthetic
atttataatttaggactttgtattcagtatttttggaatcataaaaaaataaaaaagttttaccattttaaaatt

SEQ ID NO: 347313 - DNA, 75 bp, Artificial Sequence
  Synthetic
ctagaaaacctcatcgaagaagataccatattttttgcaggaagtatatctgagtatgatgatttacaaatggtt

SEQ ID NO: 347314 - DNA, 75 bp, Artificial Sequence
  Synthetic
tgagtatgatgatttacaaatggttattgccggcgcaaaatccaaatttccaagatctatgctttctatttttaa

SEQ ID NO: 347315 - DNA, 75 bp, Artificial Sequence
  Synthetic
attgccggcgcaaaatccaaatttccaagatctatgctttctatttttaatatagtacctagaacgatgtcaaaa

SEQ ID NO: 347316 - DNA, 75 bp, Artificial Sequence
  Synthetic
ttaccgtcgtccataaatacgttaggtatgtaccacatactgtcgcgaacgatgctcacaatctcgtccatctca

SEQ ID NO: 347317 - DNA, 75 bp, Artificial Sequence
  Synthetic
cacaatgtataatataagaaacaatttgggtctaggagatgataaactaactattgaagccattgaaaactattt

SEQ ID NO: 347318 - DNA, 75 bp, Artificial Sequence
  Synthetic
taaaattaacaaggatcccaaaaaaattccagagtggttagtagttaataaaatctatattcccgattttgtagt

SEQ ID NO: 347319 - DNA, 75 bp, Artificial Sequence
  Synthetic
actcgctccatattccaataaccgctttgcaaattgtatattattgacatcgaccgcgtaatatagtagagtttt

SEQ ID NO: 347320 - DNA, 75 bp, Artificial Sequence
  Synthetic
ctattgaagccattgaaaactatttcttggatcctaacaatgaagttatgcctcttattattaataatacggata

SEQ ID NO: 347321 - DNA, 75 bp, Artificial Sequence
  Synthetic
ccacatccataagattgaatgccatttacggattcaccaataaaaataaactagagaaacttagtactaataagg

SEQ ID NO: 347322 - DNA, 75 bp, Artificial Sequence
  Synthetic
ttacggattcaccaataaaaataaactagagaaacttagtactaataaggaactagaatcgtatagttctagccc

SEQ ID NO: 347323 - DNA, 75 bp, Artificial Sequence
  Synthetic
ttaaaaagaatattcctctaacagatattccgacaaaggattgattactataaatggagaatgttcctaatgtat

SEQ ID NO: 347324 - DNA, 75 bp, Artificial Sequence
  Synthetic
taaatggagaatgttcctaatgtatactttaatcctgtgtttatagagcccacgtttaaacattctttattaagt

SEQ ID NO: 347325 - DNA, 75 bp, Artificial Sequence
  Synthetic
gacgtatactttttatagggaaatactgctatccgcaataaatataaacaaatagacttttatcacgtttatcta

SEQ ID NO: 347326 - DNA, 75 bp, Artificial Sequence
  Synthetic
tctaatatatgtattttttagatctgaattaaatatgttcttcatgcctaaacgaaaaatacccgatcctattga

SEQ ID NO: 347327 - DNA, 75 bp, Artificial Sequence
  Synthetic
tgtgaagacgataaattaatgatctatggattaccatggatgacaactcaaacatctgcgttatcaataaatagt

SEQ ID NO: 347328 - DNA, 75 bp, Artificial Sequence
  Synthetic
aacatctgcgttatcaataaatagtaaaccgatagtgtataaagattgtgcaaagcttttgcgatcaataaatgg

SEQ ID NO: 347329 - DNA, 75 bp, Artificial Sequence
  Synthetic
aaaccgatagtgtataaagattgtgcaaagcttttgcgatcaataaatggatcacaaccagtatctcttaacgat

SEQ ID NO: 347330 - DNA, 75 bp, Artificial Sequence
  Synthetic
atgaatcttcattatctgatatattgcaaatcactcaatatctagactttctgttattattattgatccaatcaa

SEQ ID NO: 347331 - DNA, 75 bp, Artificial Sequence
  Synthetic
gcaaatcactcaatatctagactttctgttattattattgatccaatcaaaaaataaattagaagccgtgggtca

SEQ ID NO: 347332 - DNA, 75 bp, Artificial Sequence
  Synthetic
actctcaagattttaaaaaactgtttaacaaggtccctattgttacagatggaagggtcaaacttaataaaggat

SEQ ID NO: 347333 - DNA, 75 bp, Artificial Sequence
  Synthetic
tgtagcgtatttctctacaatattaataccatttttgatactatttatttctatacctttcgaaattagtaattt

SEQ ID NO: 347334 - DNA, 75 bp, Artificial Sequence
  Synthetic
tcaagaataaacgattggtatttgtacaggtgcctccatcattaggagatgatagctatttgactaatccgttat

SEQ ID NO: 347335 - DNA, 75 bp, Artificial Sequence
  Synthetic
tattccgtatggatttggtcatgatagaatgtattgttttaaattggtagctgactgttataaaaatgccggtgt

SEQ ID NO: 347336 - DNA, 75 bp, Artificial Sequence
  Synthetic
gatcaacattattgctagcctcatcttctatatcatgtactataccattatctatatcctctatatcctgtacta

SEQ ID NO: 347337 - DNA, 75 bp, Artificial Sequence
  Synthetic
tatcgcattttctaacgtgatggatatattaaagtcgaataaagtgaacaataattaattctttattgtcatcat

SEQ ID NO: 347338 - DNA, 75 bp, Artificial Sequence
  Synthetic
atattaaagtcgaataaagtgaacaataattaattctttattgtcatcatgaacggcggacatattcagttgata

SEQ ID NO: 347339 - DNA, 75 bp, Artificial Sequence
  Synthetic
acgttatcaaatagctcaatataaatgcgtgactataaaatattctaacgataatagatacggaacgggactatg

SEQ ID NO: 347340 - DNA, 75 bp, Artificial Sequence
  Synthetic
tgcgtgactataaaatattctaacgataatagatacggaacgggactatggacgcatgataagaataattttgaa

SEQ ID NO: 347341 - DNA, 75 bp, Artificial Sequence
  Synthetic
tctgtgagcgtatggcaaacgaaggaaaaatagttatagtagccgcactcgatgggacatttcaacgtaaaccgt

SEQ ID NO: 347342 - DNA, 75 bp, Artificial Sequence
  Synthetic
aaaaatagttatagtagccgcactcgatgggacatttcaacgtaaaccgtttaataatattttgaatcttattcc

SEQ ID NO: 347343 - DNA, 75 bp, Artificial Sequence
  Synthetic
aggaggcttccttttctaaacgattgggtgaggaaaccgagatagaaataataggaggtaatgatatgtatcaat

SEQ ID NO: 347344 - DNA, 75 bp, Artificial Sequence
  Synthetic
gtgtatggtactagatcctcataagtgtatatatctagagtaatgtttaatttatcaaatggttgataatatgga

SEQ ID NO: 347345 - DNA, 75 bp, Artificial Sequence
  Synthetic
ctcataatattatattttttatctaaaaaactaaaaataaacattgattaaattttaatataatacttaaaaatg

SEQ ID NO: 347346 - DNA, 75 bp, Artificial Sequence
  Synthetic
aattttaatataatacttaaaaatggatgttgtgtcgttagataaaccgtttatgtattttgaggaaattgataa

SEQ ID NO: 347347 - DNA, 75 bp, Artificial Sequence
  Synthetic
gatgttgtgtcgttagataaaccgtttatgtattttgaggaaattgataatgagttagattacgaaccagaaagt

SEQ ID NO: 347348 - DNA, 75 bp, Artificial Sequence
  Synthetic
actaggagaattattttttcttagtaagttacagcgacacggtatattagatggtgccaccgtagtgtatatagg

SEQ ID NO: 347349 - DNA, 75 bp, Artificial Sequence
  Synthetic
atggtgccaccgtagtgtatataggatctgctcctggtacacatatacgttatttgagagatcatttctataatt

SEQ ID NO: 347350 - DNA, 75 bp, Artificial Sequence
  Synthetic
attttaaatggattgcgtgatgtgactctagtgactcggttcgttgatgaggaatatctacgatccatcaaaaaa

SEQ ID NO: 347351 - DNA, 75 bp, Artificial Sequence
  Synthetic
ctctagtgactcggttcgttgatgaggaatatctacgatccatcaaaaaacaactgcatccttctaagattattt

SEQ ID NO: 347352 - DNA, 75 bp, Artificial Sequence
  Synthetic
gtgacgagggagaatatcttgataagaggcataatcaatgttgtaatcggtgtccacctggagaatttgccaagg

SEQ ID NO: 347353 - DNA, 75 bp, Artificial Sequence
  Synthetic
gatttactaagtaattacgctctacaaaatgtcatgattagtattttaaaccccgtggcatctagtcttaaatgg

SEQ ID NO: 347354 - DNA, 75 bp, Artificial Sequence
  Synthetic
aaaatgtcatgattagtattttaaaccccgtggcatctagtcttaaatggagatgcccgtttccagatcaatgga

SEQ ID NO: 347355 - DNA, 75 bp, Artificial Sequence
  Synthetic
catccgtagttatcccctttatgtaactgtaaatttctcaacgcgatatctccattaataatgatgtcgaattcg

SEQ ID NO: 347356 - DNA, 75 bp, Artificial Sequence
  Synthetic
ccttcatattcagctgaaatgagattattaagtatttataccggtgagaacatgagactgactcgagttaccaaa

SEQ ID NO: 347357 - DNA, 75 bp, Artificial Sequence
  Synthetic
tattaagtatttataccggtgagaacatgagactgactcgagttaccaaatcagacgctgtaaattatgaaaaaa

SEQ ID NO: 347358 - DNA, 75 bp, Artificial Sequence
  Synthetic
cgtataaaaaggtatctaatttgatataatgaattcagtgactgtatcacacgcgccatatactattacttatca

SEQ ID NO: 347359 - DNA, 75 bp, Artificial Sequence
  Synthetic
gattatcctaatcaggaatatgactattttcacatgtactttatgctgaggaccgtatactgcaataaaacattt

SEQ ID NO: 347360 - DNA, 75 bp, Artificial Sequence
  Synthetic
aacgtactactgagatatactaccgatatagagtataatgatttagttactttaataaccgttagacataaaatt

SEQ ID NO: 347361 - DNA, 75 bp, Artificial Sequence
  Synthetic
atatagagtataatgatttagttactttaataaccgttagacataaaattgattctatgaaaactgtgtttcagg

SEQ ID NO: 347362 - DNA, 75 bp, Artificial Sequence
  Synthetic
gaaccaatcattataacatcgtatcttcaaaaaggtcataacaagtttcctgtaaattttctatacatagatgtg

SEQ ID NO: 347363 - DNA, 75 bp, Artificial Sequence
  Synthetic
ttgttagactagatactacagaaactaatatagttaatagtgtactacaaacaggcgatggtaaaaagactcttc

SEQ ID NO: 347364 - DNA, 75 bp, Artificial Sequence
  Synthetic
cctaatataccattaaaaattgttagatttttccgcaataacatggtaactggagtagagatagccgatagatct

SEQ ID NO: 347365 - DNA, 75 bp, Artificial Sequence
  Synthetic
ttagtagagatgagataagaacattataataatcaataatatatcttatatcttatatcttatatcttatatctt

SEQ ID NO: 347366 - DNA, 75 bp, Artificial Sequence
  Synthetic
tgctaatattaaaatagctaacgctagtaatccaatcggaagccatttgatatctataatagggtatctaatttc

SEQ ID NO: 347367 - DNA, 75 bp, Artificial Sequence
  Synthetic
ttctcggtagctactcgtttggaatcacaaacattatttacatctaatttactatctgtaatggaaacgtttccc

SEQ ID NO: 347368 - DNA, 75 bp, Artificial Sequence
  Synthetic
agaggctggtaacaacgcatcgcttcgtttacatggctcgtaccaacaataatagggtaatcttgtatctattcc

SEQ ID NO: 347369 - DNA, 75 bp, Artificial Sequence
  Synthetic
ctttgttagcatcacagaatgcataaatttgttcgtccgtcatgataaaaatttaaagtgtaaatataactatta

SEQ ID NO: 347370 - DNA, 75 bp, Artificial Sequence
  Synthetic
ttaaaagaaactgacttgataaaaatggctgtaatctctaaggttacgtatagtctatatgatcaaaaagagatt

SEQ ID NO: 347371 - DNA, 75 bp, Artificial Sequence
  Synthetic
tggctgtaatctctaaggttacgtatagtctatatgatcaaaaagagattaatgctacagatattatcattagtc

SEQ ID NO: 347372 - DNA, 75 bp, Artificial Sequence
  Synthetic
cattattagtattcttcttgtcatcttgttcagaaatatacagcaatgctatgcctaatactaaatacattatca

SEQ ID NO: 347373 - DNA, 75 bp, Artificial Sequence
  Synthetic
gctatggatggggcattatgtaagacttgtgggaaaacggaattggaatgtttcggtcactggggtaaagtaagt

SEQ ID NO: 347374 - DNA, 75 bp, Artificial Sequence
  Synthetic
cttgtgggaaaacggaattggaatgtttcggtcactggggtaaagtaagtatttataaaactcatatagttaagc

SEQ ID NO: 347375 - DNA, 75 bp, Artificial Sequence
  Synthetic
tgcggattattgcgttcacgagaaccgtattccgacgatattaacctaaaagagttatcgggacacgctcttagg

SEQ ID NO: 347376 - DNA, 75 bp, Artificial Sequence
  Synthetic
cgtattccgacgatattaacctaaaagagttatcgggacacgctcttaggagattaaaggataaaatattatcca

SEQ ID NO: 347377 - DNA, 75 bp, Artificial Sequence
  Synthetic
actttttcaaagaaaaaggtttgtttcgtcaacaagttggatgatattaacgttcctaattctctcatctatcaa

SEQ ID NO: 347378 - DNA, 75 bp, Artificial Sequence
  Synthetic
tttggccattattagaaattcatcaatatccagctaacttattttatacagactactttcccatccctccgttga

SEQ ID NO: 347379 - DNA, 75 bp, Artificial Sequence
  Synthetic
aatgaattaacttacttattaggtatgatcgttaagaattgtaacttgaatgctgatgaacaggttatccagaag

SEQ ID NO: 347380 - DNA, 75 bp, Artificial Sequence
  Synthetic
aaccgttagatgtagaggtaaaaagacgaagctcattagacaagcgaatgagggacgaaaacgtggaggaggtat

SEQ ID NO: 347381 - DNA, 75 bp, Artificial Sequence
  Synthetic
gacggctagatctgtaattggtcccagtacatctatcaccgttaatgaggtaggaatgcccgcatatattagaaa

SEQ ID NO: 347382 - DNA, 75 bp, Artificial Sequence
  Synthetic
agtacatctatcaccgttaatgaggtaggaatgcccgcatatattagaaatacacttacagaaaagatatttgtt

SEQ ID NO: 347383 - DNA, 75 bp, Artificial Sequence
  Synthetic
tgttcccctctatcatctactccatgtctattagacaatgtgagaagactgaagaggaaacatggggattgaaaa

SEQ ID NO: 347384 - DNA, 75 bp, Artificial Sequence
  Synthetic
taaattttactttaataaacgattaaaccaattaacaagaatacgccaaggaaagtttattaaaaataaaataca

SEQ ID NO: 347385 - DNA, 75 bp, Artificial Sequence
  Synthetic
aaccaattaacaagaatacgccaaggaaagtttattaaaaataaaatacatttattgcctggtgattgggtagaa

SEQ ID NO: 347386 - DNA, 75 bp, Artificial Sequence
  Synthetic
acatagatacaacgtcatcgcttcatctatcagagctaccgaaggagatactatcaaaatatctcccggaattgc

SEQ ID NO: 347387 - DNA, 75 bp, Artificial Sequence
  Synthetic
tctatcagagctaccgaaggagatactatcaaaatatctcccggaattgccaactctcaaaatgctgatttcgac

SEQ ID NO: 347388 - DNA, 75 bp, Artificial Sequence; identical to SEQ ID NO: 47280
  Synthetic

SEQ ID NO: 347389 - DNA, 75 bp, Artificial Sequence
  Synthetic
acaaagtattcttatgtatccgacgacgttactcaaacacgatattcatggagcccctgtttatggatctattca

SEQ ID NO: 347390 - DNA, 75 bp, Artificial Sequence
  Synthetic
acgttactcaaacacgatattcatggagcccctgtttatggatctattcaagatgaaatcgtagcagcgtattca

SEQ ID NO: 347391 - DNA, 75 bp, Artificial Sequence
  Synthetic
ctttgcattctatctcaaaataggtactctgttagtatctagctctgtaaagcatattccattaatgacggacct

SEQ ID NO: 347392 - DNA, 75 bp, Artificial Sequence
  Synthetic
gaaatatggaagagagttcgatcctaaaggtaaatgtaaattcagcggtaaagatatctatacttacttgatagg

SEQ ID NO: 347393 - DNA, 75 bp, Artificial Sequence
  Synthetic
aaaggtaaatgtaaattcagcggtaaagatatctatacttacttgataggtgaaaagattaattatccgggtctc

SEQ ID NO: 347394 - DNA, 75 bp, Artificial Sequence
  Synthetic
ggctatgaggcatctgtcattggctggactcttatccgatcataagtcgaacgtggaaggtatcaactttattat

SEQ ID NO: 347395 - DNA, 75 bp, Artificial Sequence
  Synthetic
ggactcttatccgatcataagtcgaacgtggaaggtatcaactttattatcaagttatcttatgtttttaagaga

SEQ ID NO: 347396 - DNA, 75 bp, Artificial Sequence
  Synthetic
ttcgacgttcactaataaattggaggccatcaacgtagaaaaaatagaacttatcaaagaagcatacgccaaata

SEQ ID NO: 347397 - DNA, 75 bp, Artificial Sequence
  Synthetic
ttatcaaagaagcatacgccaaatatctcaacgatgtaagagacgggaaaatagttccattatctaaagctttag

SEQ ID NO: 347398 - DNA, 75 bp, Artificial Sequence
  Synthetic
gatgctggttgccagatctcaatctactgatatcgtctgtgaaacatcacgtaccggaacactggctagaaaaat

SEQ ID NO: 347399 - DNA, 75 bp, Artificial Sequence
  Synthetic
actgatatcgtctgtgaaacatcacgtaccggaacactggctagaaaaatcattaaaaagatggaggatatggtg

SEQ ID NO: 347400 - DNA, 75 bp, Artificial Sequence
  Synthetic
cgccaattataccaaaattctaggctcagtatgtaaacctgtagatcttatctatccagatgagtccatgacttg

SEQ ID NO: 347401 - DNA, 75 bp, Artificial Sequence
  Synthetic
tcagtatgtaaacctgtagatcttatctatccagatgagtccatgacttggtatttggaaattagtgctctgtgg

SEQ ID NO: 347402 - DNA, 75 bp, Artificial Sequence
  Synthetic
aagttaaacatccttatacaatttgtggaattaatattatgaatcatagtttttacacatagatctactacaggc

SEQ ID NO: 347403 - DNA, 75 bp, Artificial Sequence
  Synthetic
aaagacattggcgccgtttaatttcctagtattcgtcaaacccaccactgaggataatgctattaaggttaagga

SEQ ID NO: 347404 - DNA, 75 bp, Artificial Sequence
  Synthetic
ctagtattcgtcaaacccaccactgaggataatgctattaaggttaaggatctgtacgatatgattcataacgtc

SEQ ID NO: 347405 - DNA, 75 bp, Artificial Sequence
  Synthetic
tagacgacgacaatagtgttctgaatttagatagttgatcagaatgaatgtttattggcgttggaaaaattatcc

SEQ ID NO: 347406 - DNA, 75 bp, Artificial Sequence
  Synthetic
tatggagtatatattcttgacgcatcttaatccttctagaattagaattacaaaagaaacggctatcactatctt

SEQ ID NO: 347407 - DNA, 75 bp, Artificial Sequence
  Synthetic
cttaatccttctagaattagaattacaaaagaaacggctatcactatctttgaaaagttctatgaaaaactcaat

SEQ ID NO: 347408 - DNA, 75 bp, Artificial Sequence
  Synthetic
gtctgagaagtttacacaacaagccctgtccagttttcacactactgaaaaaagtggtgccgtcaaacaaaaact

SEQ ID NO: 347409 - DNA, 75 bp, Artificial Sequence
  Synthetic
acattaattcctttttaaatttccgtctatcatctatagaaacatattctatgaatttataaaatgcttttacgt

SEQ ID NO: 347410 - DNA, 75 bp, Artificial Sequence
  Synthetic
tggtttcaacgagtttaataacctgactaatttgagtaagaataagaccgaaattatcactctggtatccgatga

SEQ ID NO: 347411 - DNA, 75 bp, Artificial Sequence
  Synthetic
ataatatatcaatcaaaacagaatatgagaatgaatatgaattctatgatgaaacacaagatcaaagtacacaac

SEQ ID NO: 347412 - DNA, 75 bp, Artificial Sequence
  Synthetic
acgaaagaaacgaatagaatatactctattcttcaagagatgtctgaaacgtattctcttccaccacatccatca

SEQ ID NO: 347413 - DNA, 75 bp, Artificial Sequence
  Synthetic
aaaaagctcaataagatgactgtagaactcatgaatctaaaagaattgggttctttcgatttggaaaacgtcaac

SEQ ID NO: 347414 - DNA, 75 bp, Artificial Sequence
  Synthetic
aactcatgaatctaaaagaattgggttctttcgatttggaaaacgtcaacgtgtatcctggagtatggaatacat

SEQ ID NO: 347415 - DNA, 75 bp, Artificial Sequence
  Synthetic
ttaaacacctatggagaagggttcgattatctgtatcagccttgtgatcttctcgctagtttactatgtgctagt

SEQ ID NO: 347416 - DNA, 75 bp, Artificial Sequence
  Synthetic
attatctgtatcagccttgtgatcttctcgctagtttactatgtgctagttacgaaccagaatcagtgaataaat

SEQ ID NO: 347417 - DNA, 75 bp, Artificial Sequence
  Synthetic
aaagcattgttaaacgcggctcttcataaaaagtcagaacctattaacgataatagtagctgccacttttttagc

SEQ ID NO: 347418 - DNA, 75 bp, Artificial Sequence
  Synthetic
ataaaaagtcagaacctattaacgataatagtagctgccacttttttagcaaggtccctaatataggaactggat

SEQ ID NO: 347419 - DNA, 75 bp, Artificial Sequence
  Synthetic
ctatctgataagatatcttctcaaaagatcaaggaaatggaagaaacagaagacttttaattcttatcaataaca

SEQ ID NO: 347420 - DNA, 75 bp, Artificial Sequence
  Synthetic
ttgaaacaggaaacgctgtatatggaaaagttcaacatgattattctactatcaaagagaaggccaaagaaatga

SEQ ID NO: 347421 - DNA, 75 bp, Artificial Sequence
  Synthetic
agatcaaggaaatggaagaaacagaagacttttaattcttatcaataacatatttttctatgatctgtcttttaa

SEQ ID NO: 347422 - DNA, 75 bp, Artificial Sequence
  Synthetic
acgtataaaaaatatagcataggcaatgactccttatttttagacattagatatgccaaaatcatagccccgctt

SEQ ID NO: 347423 - DNA, 75 bp, Artificial Sequence
  Synthetic
acgtacatggaaaggaaattatgagaatgagattcaaaaagggtgcggtgcttccgatcccaaatctggtaaaag

SEQ ID NO: 347424 - DNA, 75 bp, Artificial Sequence
  Synthetic
atgactccttatttttagacattagatatgccaaaatcatagccccgcttctatttactcccgcagcacaatgaa

SEQ ID NO: 347425 - DNA, 75 bp, Artificial Sequence
  Synthetic
ctaccatctatggtacgaacggtttcatcctccttgataccctcacccaaatgttctataaatttagcatcctcg

SEQ ID NO: 347426 - DNA, 75 bp, Artificial Sequence
  Synthetic
accaatacatatagctaaactcaggcatatgttccacacatcctgaacaatgaaattctccagaagatgttacga

SEQ ID NO: 347427 - DNA, 75 bp, Artificial Sequence
  Synthetic
tcgtcaaaatatttactaatatcggtagttgtatcatctaccaacggtatatgaataatattaatattagagtta

SEQ ID NO: 347428 - DNA, 75 bp, Artificial Sequence
  Synthetic
aatttaaaacatatttgaacttaacttcagatgatggtgcatccatagcatttttataatttcccaaatacacat

SEQ ID NO: 347429 - DNA, 75 bp, Artificial Sequence
  Synthetic
ccagttgaacgtagtagtaagtatttatacaaacttttcttatccatttataacgtacaaatggataaaactact

SEQ ID NO: 347430 - DNA, 75 bp, Artificial Sequence
  Synthetic
aatacgttagagaaaaggctatagtaggcgtacaagcagccaaaacatcaacacttatattctttgttattatat

SEQ ID NO: 347431 - DNA, 75 bp, Artificial Sequence
  Synthetic
acacttatattctttgttattatattggcaattagtgcgctattactctggtttcagacgtctgataatccagtc

SEQ ID NO: 347432 - DNA, 75 bp, Artificial Sequence
  Synthetic
acatacatctgtttcagctaagcaactaagaacacgtatacggcagcagcttccttctatactctcatcttttac

SEQ ID NO: 347433 - DNA, 75 bp, Artificial Sequence
  Synthetic
gaattaaaaatacggttaacgattggaaatcattaacggatagcaaaacaaaattagaaagtgatagaggtaaac

SEQ ID NO: 347434 - DNA, 75 bp, Artificial Sequence
  Synthetic
ggcgcctattttatagctatgcgattggataagaaaacatatctgccgcaagctattaggcgaggtactggagac

SEQ ID NO: 347435 - DNA, 75 bp, Artificial Sequence
  Synthetic
tggataagaaaacatatctgccgcaagctattaggcgaggtactggagacgcgtggatggttaaaaaggcggcaa

SEQ ID NO: 347436 - DNA, 75 bp, Artificial Sequence
  Synthetic
tctaataatgttattacttgtggtaatgagatgttaaatgaattaggttatagcggttattttatgtcaccgcat

SEQ ID NO: 347437 - DNA, 75 bp, Artificial Sequence
  Synthetic
atgagatgttaaatgaattaggttatagcggttattttatgtcaccgcattggtgttccgattttagtaatatgg

SEQ ID NO: 347438 - DNA, 75 bp, Artificial Sequence
  Synthetic
agcttagatttaacgttaaagatgagcataaacataataaacaaaattacaatcaaacctataacattaatatca

SEQ ID NO: 347439 - DNA, 75 bp, Artificial Sequence
  Synthetic
atcgtaattggaaaattagtgttcgagtgagtcggattatgtgagtactggattgtatattttattttatatttt

SEQ ID NO: 347440 - DNA, 75 bp, Artificial Sequence
  Synthetic
aacaagtcgaggatcgtgttctacatatttggcggcgttatccagtatctgcctattgatcttcatttcgttttc

SEQ ID NO: 347441 - DNA, 75 bp, Artificial Sequence
  Synthetic
ctacatctttattgtatctataatcagccataattactcgagtgcaacatgttagatcgtctatatatgaataag

SEQ ID NO: 347442 - DNA, 75 bp, Artificial Sequence
  Synthetic
taatttcatctacgatgttcagcgccgtagtaactctaataatataggctgataagctaacatcataccctcctg

SEQ ID NO: 347443 - DNA, 75 bp, Artificial Sequence
  Synthetic
cgtagtaactctaataatataggctgataagctaacatcataccctcctgtatatgtgaatatggcatgattttt

SEQ ID NO: 347444 - DNA, 75 bp, Artificial Sequence
  Synthetic
tctgtaggatatctatttttttgtcatgcattgccttcaagacgggacgaagaaacgtaatatcctcaataacgt

SEQ ID NO: 347445 - DNA, 75 bp, Artificial Sequence
  Synthetic
atgcattgccttcaagacgggacgaagaaacgtaatatcctcaataacgttatcgttttctacaataactacata

SEQ ID NO: 347446 - DNA, 75 bp, Artificial Sequence
  Synthetic
ttttttgtcctatatatcagatacagttaatatctatatatgtattttaataaatcatggattttatatagatgc

SEQ ID NO: 347447 - DNA, 75 bp, Artificial Sequence
  Synthetic
ctaaatgtctagcgatatttcttttcgtttcctctgtacacatagtgttacaaaaccctgaaaagaagtgagtat

SEQ ID NO: 347448 - DNA, 75 bp, Artificial Sequence
  Synthetic
acttgtcatcatttctaatgtttcctccagtccactgtataaacgcataatccttgtaatgatctggatcatcct

SEQ ID NO: 347449 - DNA, 75 bp, Artificial Sequence
  Synthetic
tctgggagaaagataatttgacctgattacatttttgataaggagtagcagatttcctaatttatttcttcgctt

SEQ ID NO: 347450 - DNA, 75 bp, Artificial Sequence
  Synthetic
tgatggaggtctatcaataactggcacaacaataacaggagttttcaccgccgccatttagttattgaaattaat

SEQ ID NO: 347451 - DNA, 75 bp, Artificial Sequence
  Synthetic
ccgccatttagttattgaaattaatcatatacaactctttaatacgagttatattttcgtctatccattgtttca

SEQ ID NO: 347452 - DNA, 75 bp, Artificial Sequence
  Synthetic
catatacaactctttaatacgagttatattttcgtctatccattgtttcacatttacatatttcgacaaaaagat

SEQ ID NO: 347453 - DNA, 75 bp, Artificial Sequence
  Synthetic
caaacacgtcactgtctggcaataaatgatatcttagaatattgtaacaatttattttgtattgcacatgttcgt

SEQ ID NO: 347454 - DNA, 75 bp, Artificial Sequence
  Synthetic
caacgacacgtcgtgtactcggacgaccactaccggtctcagtgaatccatctcaacgtcggaactaactattac

SEQ ID NO: 347455 - DNA, 75 bp, Artificial Sequence
  Synthetic
gaagaagttaatatagacaattcttttgtattcatagacactcggttttttattcatggcatcatagaagatacc

SEQ ID NO: 347456 - DNA, 75 bp, Artificial Sequence
  Synthetic
tggatcgttctctggtagatacgtatcatatcttcgaaagttttctgctcttccaacaaacgagtttattagttt

SEQ ID NO: 347457 - DNA, 75 bp, Artificial Sequence
  Synthetic
actctttagcggtataattagtttttttctctcaatttctatttttagatgtgatggaaaaatgactaattttgt

SEQ ID NO: 347458 - DNA, 75 bp, Artificial Sequence
  Synthetic
gtgatggaaaaatgactaattttgtagcattagtatcatgaactctaatcaagatcttaatatcttcgtcacacg

SEQ ID NO: 347459 - DNA, 75 bp, Artificial Sequence
  Synthetic
agatgtataagttttagatcctttattactaccatcatgtccatggataaagacactccacatgccgccactacc

SEQ ID NO: 347460 - DNA, 75 bp, Artificial Sequence
  Synthetic
atctaatatttttagatccgaattcaggtaatggactacaatacgaaattgcaaaatatgctctagatactgcaa

SEQ ID NO: 347461 - DNA, 75 bp, Artificial Sequence
  Synthetic
gtaattgggttctaacgccgatctctgaatggatactagttttctaagttctaatgtgattctctgaaaatgtaa

SEQ ID NO: 347462 - DNA, 75 bp, Artificial Sequence
  Synthetic
tgaatggatactagttttctaagttctaatgtgattctctgaaaatgtaaatccaattcctccggcattatagat

SEQ ID NO: 347463 - DNA, 75 bp, Artificial Sequence
  Synthetic
aaaatgttttgatttctccagtttctattttatctactttatctattctaaatcatggagcagctggttctacag

SEQ ID NO: 347464 - DNA, 75 bp, Artificial Sequence
  Synthetic
aataactctgtagacgatacttgactttcgaataagtttgcagacaaacgaagaaagaacagacctctcttaatt

SEQ ID NO: 347465 - DNA, 75 bp, Artificial Sequence
  Synthetic
tttcgaataagtttgcagacaaacgaagaaagaacagacctctcttaatttcagaagaaaactttttttcgtatt

SEQ ID NO: 347466 - DNA, 75 bp, Artificial Sequence
  Synthetic
aagtcctagttgtatattgagaattgacaaaacaatgtttcttacatattttttttttattagtaaccgacttaa

SEQ ID NO: 347467 - DNA, 75 bp, Artificial Sequence
  Synthetic
atgttgtatttcattacccaagtttgagatttcataatattatcaaaagacatgataatattaaagataaagcgc

SEQ ID NO: 347468 - DNA, 75 bp, Artificial Sequence
  Synthetic
gagatttcataatattatcaaaagacatgataatattaaagataaagcgctgactatgaacgaaatagctatatg

SEQ ID NO: 347469 - DNA, 75 bp, Artificial Sequence
  Synthetic
catgtgatcagggatatcattcttcggatccaaatgctgtctgcgaaacagataaatggaaatacgaaaatccat

SEQ ID NO: 347470 - DNA, 75 bp, Artificial Sequence
  Synthetic
ggatccaaatgctgtctgcgaaacagataaatggaaatacgaaaatccatgcaaaaaaatgtgcacagtttctga

SEQ ID NO: 347471 - DNA, 75 bp, Artificial Sequence
  Synthetic
ttaatcacgtcagcggcatctaaattaaatataggtatatttattccacacactctacaatatgccacaccatct

SEQ ID NO: 347472 - DNA, 75 bp, Artificial Sequence
  Synthetic
taaatataggtatatttattccacacactctacaatatgccacaccatcttcataataaataaattcgttagcaa

SEQ ID NO: 347473 - DNA, 75 bp, Artificial Sequence
  Synthetic
atatacaagatattttttctcactctgatccatgtaaaccaaggacgagataagacactctcattcctcatccac

SEQ ID NO: 347474 - DNA, 75 bp, Artificial Sequence
  Synthetic
aatctaatttgatgctcacacggtgcgaattccactctaacatcccttttccatgcctcaggttcatcgatctct

SEQ ID NO: 347475 - DNA, 75 bp, Artificial Sequence
  Synthetic
gagatctgtatagtaactatgtaaatgataactagatagaaagatgtagctatatagatgacgatcctttaagag

SEQ ID NO: 347476 - DNA, 75 bp, Artificial Sequence
  Synthetic
aaaaagaatttttataaatttttccagtattttccaaatatacgtacttaacatctaaaaaatccttaatgataa

SEQ ID NO: 347477 - DNA, 75 bp, Artificial Sequence
  Synthetic
ttgattgaacaatcacatcggttatccaatcaataaccacattaataactaaattgtagtgtatatatagaccat

SEQ ID NO: 347478 - DNA, 75 bp, Artificial Sequence
  Synthetic
taggaatggataatccgtctattttataaagaaatacatatcgcacattatacttttttttggaaatgggaatac

SEQ ID NO: 347479 - DNA, 75 bp, Artificial Sequence
  Synthetic
agttggtccaaattcttttccaagtacggtaatagatttttcatattgaacggtatcttcttaatctctggttct

SEQ ID NO: 347480 - DNA, 75 bp, Artificial Sequence
  Synthetic
acggtaatagatttttcatattgaacggtatcttcttaatctctggttctaattccgcattaaatgatgaaacta

SEQ ID NO: 347481 - DNA, 75 bp, Artificial Sequence
  Synthetic
ggcgtcatatttttaatctccgttatagtattagtttgttcctgtgacaaaaataatgaccaatataagttccat

SEQ ID NO: 347482 - DNA, 75 bp, Artificial Sequence
  Synthetic
accagaatactgatcttcttttgtcgtaaatacatgtctaatgtgttaaaaaaaagatcatacaagttatacgtc

SEQ ID NO: 347483 - DNA, 75 bp, Artificial Sequence
  Synthetic
gtaaatacatgtctaatgtgttaaaaaaaagatcatacaagttatacgtcatttcatctgtagtattcttgtcat

SEQ ID NO: 347484 - DNA, 75 bp, Artificial Sequence
  Synthetic
tatcctatatacgaaaaaatagcaaccagtgtttgatcatccgcgtcaatattctgttctatcgtagtgtataac

SEQ ID NO: 347485 - DNA, 75 bp, Artificial Sequence
  Synthetic
tcaatcctataacttctaatcttgtaatattcatcatcgacataacactatctatgttatcatcgtatattagta

SEQ ID NO: 347486 - DNA, 75 bp, Artificial Sequence
  Synthetic
tcgatacgttataaaggttgataacgaaaatatttttatttcgtgaaataaagtcatcgtaggattttggactta

SEQ ID NO: 347487 - DNA, 75 bp, Artificial Sequence
  Synthetic
aagtcatcgtaggattttggacttatattcgcgtctagtagatatgcttttatttttggaatgatctcaattaga

SEQ ID NO: 347488 - DNA, 75 bp, Artificial Sequence
  Synthetic
tattcgcgtctagtagatatgcttttatttttggaatgatctcaattagaatagtctctttagagtccatttaaa

SEQ ID NO: 347489 - DNA, 75 bp, Artificial Sequence
  Synthetic
ataaattttagaaataacattagcgaattgttgtgcattgatgtcgttattctgaaacagtatgattttaggtag

SEQ ID NO: 347490 - DNA, 75 bp, Artificial Sequence
  Synthetic
tatagattctttattctatacttaaaaaatgaaaataaatacaaaggttcttgagggttgtgttaaattgaaagc

SEQ ID NO: 347491 - DNA, 75 bp, Artificial Sequence
  Synthetic
aaaatgaaaataaatacaaaggttcttgagggttgtgttaaattgaaagcgagaaataatcataaattatttcat

SEQ ID NO: 347492 - DNA, 75 bp, Artificial Sequence
  Synthetic
gtttatagatgttcacattcccaagtttaaggtaacaggctcgtataatctggtggatactctagtaaagtcagg

SEQ ID NO: 347493 - DNA, 75 bp, Artificial Sequence
  Synthetic
taaagcggatactagtagcttcacaaagatggctgaaatcagagctcatctaaaaaatagcgctgaaaataaaga

SEQ ID NO: 347494 - DNA, 75 bp, Artificial Sequence
  Synthetic
tatggatttagcacgtttgggaagcatgagctcatatgatttcagtactgtagtgtcagtactattagtttcgat

SEQ ID NO: 347495 - DNA, 75 bp, Artificial Sequence
  Synthetic
agagtcatgcgacgtcggatttgattccatagatatagatgttataaacgactataaaattattgatatgtatac

SEQ ID NO: 347496 - DNA, 75 bp, Artificial Sequence
  Synthetic
aaagcgtggctgctgtagagctcgatgatagcgacggggatgatgaacctatggtacaagttgaagctggtaaag

SEQ ID NO: 347497 - DNA, 75 bp, Artificial Sequence
  Synthetic
tgatagcgacggggatgatgaacctatggtacaagttgaagctggtaaagtaaatcatagtgctagaagcgatct

SEQ ID NO: 347498 - DNA, 75 bp, Artificial Sequence
  Synthetic
ttattactagaatctctgcagtatcgacggttctagaggatgttcaagcagctggtatctctagacaatttactt

SEQ ID NO: 347499 - DNA, 75 bp, Artificial Sequence
  Synthetic
gacggttctagaggatgttcaagcagctggtatctctagacaatttacttctatgactaaagctattacaacact

SEQ ID NO: 347500 - DNA, 75 bp, Artificial Sequence
  Synthetic
aaacttgtaagaagtaaatgcgtgcacttttttataaagatggtaaactctttaccgataataattttttaaatc

SEQ ID NO: 347501 - DNA, 75 bp, Artificial Sequence
  Synthetic
tgaggttttgcaacatgttaaaattcctactcatttaacagatgtagtagtatatgaacaaacgtgggaagaggc

SEQ ID NO: 347502 - DNA, 75 bp, Artificial Sequence
  Synthetic
acttttacggaaaaatgcatgtacagaatcgcaacgctaaaagagatcgtatttttgttagagtatataacgtta

SEQ ID NO: 347503 - DNA, 75 bp, Artificial Sequence
  Synthetic
gatagaatcagactctaaagaaaaggaatcggctttattatacgcattcatgataaacttaatgaaaaatgtttt

SEQ ID NO: 347504 - DNA, 75 bp, Artificial Sequence
  Synthetic
gaatcgcaacgctaaaagagatcgtatttttgttagagtatataacgttatgaaacgaattaattgttttataaa

SEQ ID NO: 347505 - DNA, 75 bp, Artificial Sequence
  Synthetic
ttatgttaatggaaactatgttttttattagatttggtaaaatgaaatatcttaaggagaatgaaacagtagggt

SEQ ID NO: 347506 - DNA, 75 bp, Artificial Sequence
  Synthetic
ccatatcaatttgtacatcgagcatccgtatgctactagaggtagcaaaaagattcctatttacaaacgcggtga

SEQ ID NO: 347507 - DNA, 75 bp, Artificial Sequence
  Synthetic
agaaataagtcccgatgaaatagttatcaagtttgtaggaaaggacaaagtttcacatgaatttgttgttcataa

SEQ ID NO: 347508 - DNA, 75 bp, Artificial Sequence
  Synthetic
aataaggtagcgacttcaggtttctttacaggagaaaggtgtgcactctgaatttcgagattaaatgcaataaca

SEQ ID NO: 347509 - DNA, 75 bp, Artificial Sequence
  Synthetic
ccgaagaatttctgttcaacaaactaagtgaacgaaaggtatacgaatgtatcaaacagtttggtattagaatca

SEQ ID NO: 347510 - DNA, 75 bp, Artificial Sequence
  Synthetic
tatgtctgacacctaaaaagagtgtatatacatgcgcaattagatccaaagaagatgttcccaatttcaaggaca

SEQ ID NO: 347511 - DNA, 75 bp, Artificial Sequence
  Synthetic
tttatatatcgctacgaatttaaacagagaaatcagtttaggaaaaaaaattatctatctacatcatcacgtctc

SEQ ID NO: 347512 - DNA, 75 bp, Artificial Sequence
  Synthetic
aggatctccgaacgtatggagtcaattatacgtttttatataatttttggacaaatgtaaagtccatatctcctc

SEQ ID NO: 347513 - DNA, 75 bp, Artificial Sequence
  Synthetic
cgtaaaagtagaaaatatattctaatttattgcacggtaaggaagtagaatcatcaatagcaattatgaaacaat

SEQ ID NO: 347514 - DNA, 75 bp, Artificial Sequence
  Synthetic
gtggtaggtcatactccatcaatttcaaaaagagcttatatggcaacgactattttagaaatggtaaaggataaa

SEQ ID NO: 347515 - DNA, 75 bp, Artificial Sequence
  Synthetic
caaaaagagcttatatggcaacgactattttagaaatggtaaaggataaaaattttttagatgtagtatctaaaa

SEQ ID NO: 347516 - DNA, 75 bp, Artificial Sequence
  Synthetic
aaacaaacatcatatgggaatcgatgttattatcaaagccgaccgatgataagatttgccaatccgtaacggaaa

SEQ ID NO: 347517 - DNA, 75 bp, Artificial Sequence
  Synthetic
tcgtccatctcataatgatttactttttcataattaaagatgtgaaagaaaaacagaacaatatatttttttagt

SEQ ID NO: 347518 - DNA, 75 bp, Artificial Sequence
  Synthetic
acggatggatgatatagatctttacacaaataattacaagaccgataaatggaaatggataagcgtatgaaatct

SEQ ID NO: 347519 - DNA, 75 bp, Artificial Sequence
  Synthetic
attgataatgtctatatttaaacgccatccaaacaataccattttttcagtggataaggatggtcagtttatgat

SEQ ID NO: 347520 - DNA, 75 bp, Artificial Sequence
  Synthetic
catccaaacaataccattttttcagtggataaggatggtcagtttatgattgatttcgaatacgataattataag

SEQ ID NO: 347521 - DNA, 75 bp, Artificial Sequence
  Synthetic
tgatttcgaatacgataattataaggcttctcaatatttggatctgaccctcactccgatatctggagatgaatg

SEQ ID NO: 347522 - DNA, 75 bp, Artificial Sequence
  Synthetic
ttaaagaggatattagcgaatacatcaaaactactccccgtcttaaacgatttataaaaaaataccgcaatagat

SEQ ID NO: 347523 - DNA, 75 bp, Artificial Sequence
  Synthetic
caaaactactccccgtcttaaacgatttataaaaaaataccgcaatagatcagatactcgcatcagtcgagatac

SEQ ID NO: 347524 - DNA, 75 bp, Artificial Sequence
  Synthetic
gatgcctagtgcttgcgccaatggatggatacaatacgataaacattgttatttagatactaacattaaaatgtc

SEQ ID NO: 347525 - DNA, 75 bp, Artificial Sequence
  Synthetic
atgtatataatattaattataaaattatgtatatgatttactaactttagttagataaattaataatacataaat

SEQ ID NO: 347526 - DNA, 75 bp, Artificial Sequence
  Synthetic
tgatacattttttgacgatgatgattgatcgctattgcacaattttgtttttttactttctaatatagcgtttag

SEQ ID NO: 347527 - DNA, 75 bp, Artificial Sequence
  Synthetic
ggagaaagagataaaacttttttacgactccatcagaaagaggtttaatatttttgtgagaccatcgaaggagaa

SEQ ID NO: 347528 - DNA, 75 bp, Artificial Sequence
  Synthetic
tgttaaaattagaactaagattccattatctaaggtacatggtctagatgtaaaaaatgtacagttagtagatgc

SEQ ID NO: 347529 - DNA, 75 bp, Artificial Sequence
  Synthetic
ttatctaaggtacatggtctagatgtaaaaaatgtacagttagtagatgctatagataacatagtttgggaaaag

SEQ ID NO: 347530 - DNA, 75 bp, Artificial Sequence
  Synthetic
atcgacagaggaacgtcatatatttttggattacaagaaatatggatcctctatccgactagaattagtcaatct

SEQ ID NO: 347531 - DNA, 75 bp, Artificial Sequence
  Synthetic
catccaaagtcaaggcctaatacatctctggaaatagaattcacacctagagacaatgaaaaagttccatatgat

SEQ ID NO: 347532 - DNA, 75 bp, Artificial Sequence
  Synthetic
caaggaatcatctgaacttgaggtcaaggatggatttaagtatgtcgacggatcggcatctgaaggtgcaaccga

SEQ ID NO: 347533 - DNA, 75 bp, Artificial Sequence
  Synthetic
ttatgttgcctaaacaagatatagtaggtttggatctggaaaatctatatgccgtaactaagactgacggcattc

SEQ ID NO: 347534 - DNA, 75 bp, Artificial Sequence
  Synthetic
cacaaaaagttacctctcgcgacttcttctttttctgtctcaatagtgtgatacgattatgacactattcctatt

SEQ ID NO: 347535 - DNA, 75 bp, Artificial Sequence
  Synthetic
ttaagagaataatagattccgaagtagtagtctttggtgaggcagttaaggataagaactggaccgtatatctca

SEQ ID NO: 347536 - DNA, 75 bp, Artificial Sequence
  Synthetic
aagtatgttgaatctaaactagtggatatttgtgatcggatagtattcaagtcaaagaaatacgaaggtccgttt

SEQ ID NO: 347537 - DNA, 75 bp, Artificial Sequence
  Synthetic
agatctccagatttcataatatggtcgcatgccttaaatgtcagtgcttccataatatagtctggaacactaatg

SEQ ID NO: 347538 - DNA, 75 bp, Artificial Sequence
  Synthetic
actacaactagtgaagtcgtcgatatgttatctacatatttaccaaagcaaccagaaggtgttattctgttctat

SEQ ID NO: 347539 - DNA, 75 bp, Artificial Sequence
  Synthetic
tgttatctacatatttaccaaagcaaccagaaggtgttattctgttctattcaaagggacctaaatctaacattg

SEQ ID NO: 347540 - DNA, 75 bp, Artificial Sequence
  Synthetic
agatctgatgaccgacgataatataaacatcttgatactttttctagaaaaaaaattgaattgatgatatagggg

SEQ ID NO: 347541 - DNA, 75 bp, Artificial Sequence
  Synthetic
cgactatctaggtatttgtatctcactgatagagaacatataaatgtagactctattaaacagttgtgtaaaata

SEQ ID NO: 347542 - DNA, 75 bp, Artificial Sequence
  Synthetic
tttaggtacatgtccagtgaaccaattatctttggagaatcgtctatctttgtagagtataagaaatttagcaac

SEQ ID NO: 347543 - DNA, 75 bp, Artificial Sequence
  Synthetic
taggagatgatagctatttgactaacccgttattgtctccgtattatcgtaattcagtagccagacaaatggtca

SEQ ID NO: 347544 - DNA, 75 bp, Artificial Sequence
  Synthetic
ttatctttggagaatcgtctatctttgtagagtataagaaatttagcaacgataaaggctttcctaaagaatatg

SEQ ID NO: 347545 - DNA, 75 bp, Artificial Sequence
  Synthetic
atttgtgtttgtaacttattcgtcttttatggaatagtttttaactagtaaagctgtaattacatactttgtccg

SEQ ID NO: 347546 - DNA, 75 bp, Artificial Sequence
  Synthetic
tattgtttggaatatattaatacacataatgaagtgggtattaagtccgtggttgtacctattaagtttatagca

SEQ ID NO: 347547 - DNA, 75 bp, Artificial Sequence
  Synthetic
ataatgaagtgggtattaagtccgtggttgtacctattaagtttatagcagaattcttagttaatggagaaatac

SEQ ID NO: 347548 - DNA, 75 bp, Artificial Sequence
  Synthetic
aaaacaagtcccgtttatgaggacggacatgctacaaaatatgttcgcggctaatcgcgataatgtagcttctag

SEQ ID NO: 347549 - DNA, 75 bp, Artificial Sequence
  Synthetic
tctgatgcatcaactatttcttaaacaataacgtccaacaacatatactcgtcgagcttatcaacatcccctatg

SEQ ID NO: 347550 - DNA, 75 bp, Artificial Sequence
  Synthetic
tatggaaatcaacataatatcatagtcgaacatttaagagatcaaagcatcaaaataggagatatctttaacgag

SEQ ID NO: 347551 - DNA, 75 bp, Artificial Sequence
  Synthetic
tatttttgtgagaccatcgaagagagaaagagaataaaaatattttatgactccattgaagagagaaagagaata

SEQ ID NO: 347552 - DNA, 75 bp, Artificial Sequence
  Synthetic
caaaataggagatatctttaacgaggataaactatcggatgtgggacatcaatacgccaataatgataaatttag

SEQ ID NO: 347553 - DNA, 75 bp, Artificial Sequence
  Synthetic
catcttaagcgtagaagttgtaaatgacaatgagatgtaccatcttattccccatagattatcgacgattatact

SEQ ID NO: 347554 - DNA, 75 bp, Artificial Sequence
  Synthetic
tgggaattttatcaaactacgtcaagactcttcttatttctatgtattgttccaaaacatttttagacgattcca

SEQ ID NO: 347555 - DNA, 75 bp, Artificial Sequence
  Synthetic
gactcttcttatttctatgtattgttccaaaacatttttagacgattccaacaaacgaaaggtattggcgattga

SEQ ID NO: 347556 - DNA, 75 bp, Artificial Sequence
  Synthetic
gcttaggcggattcagtacaatgttatatttttcgtaccaactcatttaaatatcataatctaaaatagttctgt

SEQ ID NO: 347557 - DNA, 75 bp, Artificial Sequence
  Synthetic
tattggtagcgacggatccggatgctgatgctatagctagaggaaatgaaagatacaacaaattaaactctggaa

SEQ ID NO: 347558 - DNA, 75 bp, Artificial Sequence
  Synthetic
tgatgctatagctagaggaaatgaaagatacaacaaattaaactctggaattaaaaccaagtactacaaatttga

SEQ ID NO: 347559 - DNA, 75 bp, Artificial Sequence
  Synthetic
tctctcttcgatggtctcacaaaaatattaaacctctttctgatggtctctataaagcgatcgatctttcttaca

SEQ ID NO: 347560 - DNA, 75 bp, Artificial Sequence
  Synthetic
gtctggtaacctagatgggcataggggatgttgataagctcgacgagtatatgttgttggacgttattgtttaag

SEQ ID NO: 347561 - DNA, 75 bp, Artificial Sequence
  Synthetic
aagtattctattttggaaagtttaatatcatcgactggcagtttgctatccattattcttttcatccgagacatt

SEQ ID NO: 347562 - DNA, 75 bp, Artificial Sequence
  Synthetic
tatcatcgactggcagtttgctatccattattcttttcatccgagacattatgctaccgtcatgaataacttatc

SEQ ID NO: 347563 - DNA, 75 bp, Artificial Sequence
  Synthetic
ataaaattagtaaaattaaattaattataaaattatatatataatttactaactttagttagataaattaataat

SEQ ID NO: 347564 - DNA, 75 bp, Artificial Sequence
  Synthetic
tataaaattatatatataatttactaactttagttagataaattaataatatataagttttagtacattaatatt

SEQ ID NO: 347565 - DNA, 75 bp, Artificial Sequence
  Synthetic
acaaattatcaaaattaacagataaaaagacttttataattcataagaatttacctagtagcgaaaactatatgt

SEQ ID NO: 347566 - DNA, 75 bp, Artificial Sequence
  Synthetic
ttacctagtagcgaaaactatatgtctgtagaaaaaatagctgatgatagaatagtggtatataatccatcaaca

SEQ ID NO: 347567 - DNA, 75 bp, Artificial Sequence
  Synthetic
atagcagaacttaggcatggacatactaatatctgtcttaattaactgtcgttctccaggagggatagtataatc

SEQ ID NO: 347568 - DNA, 75 bp, Artificial Sequence
  Synthetic
agtgtttaacgaatacggatttgttcttgtagataacgttgatttcgctacaattatagaacgaagtaaaaagtt

SEQ ID NO: 347569 - DNA, 75 bp, Artificial Sequence
  Synthetic
gtgtcgacgctatgatccacaaaacgtatatagatgtcaatgaagagtatacagaagcagctgcagcaacttgtg

SEQ ID NO: 347570 - DNA, 75 bp, Artificial Sequence
  Synthetic
cttgtagataacgttgatttcgctacaattatagaacgaagtaaaaagtttattaatggcgcatctacaatggaa

SEQ ID NO: 347571 - DNA, 75 bp, Artificial Sequence
  Synthetic
atgtgaaggtttagatgtcgaagacttacttagttactatgttgtttatgtcttttctaagcggtaaataataat

SEQ ID NO: 347572 - DNA, 75 bp, Artificial Sequence
  Synthetic
tctaaatgcattaaataattccaatagagcgatttttgttcctataggaccttccaactgtggatactctgtatt

SEQ ID NO: 347573 - DNA, 75 bp, Artificial Sequence
  Synthetic
cttccaactgtggatactctgtattgttaatagatatattaatacttttgtcgggtaacagaggttctacgtctt

SEQ ID NO: 347574 - DNA, 75 bp, Artificial Sequence
  Synthetic
gttaatagatatattaatacttttgtcgggtaacagaggttctacgtcttctaaaaataaaagtttgataacatc

SEQ ID NO: 347575 - DNA, 75 bp, Artificial Sequence
  Synthetic
caaatctagccattgtcttatagatgtgagctactgtaggtgtaccatttgattttctttctaatactatatatt

SEQ ID NO: 347576 - DNA, 75 bp, Artificial Sequence
  Synthetic
gtgagctactgtaggtgtaccatttgattttctttctaatactatatatttctctcgaagaagttcttgcacatc

SEQ ID NO: 347577 - DNA, 75 bp, Artificial Sequence
  Synthetic
cgatattgatggacatttttatagttaaggataataagtatcccaaagtcgataacgacgataacgaagtattta

SEQ ID NO: 347578 - DNA, 75 bp, Artificial Sequence
  Synthetic
gataacgacgataacgaagtatttatacttttaggaaatcacaatgactttatcagatcaaaattaacaaaatta

SEQ ID NO: 347579 - DNA, 75 bp, Artificial Sequence
  Synthetic
ttatgagaccatcaaagagagaaagagaataaaaatatttttgtgagaccatcaaagagagaaagagaataaaaa

SEQ ID NO: 347580 - DNA, 75 bp, Artificial Sequence
  Synthetic
atctttatgcgtcgaattaaatgggtctagttttcagcacggcggtagatatatagaggtggaggaatttataga

SEQ ID NO: 347581 - DNA, 75 bp, Artificial Sequence
  Synthetic
accatcaaagagagaaagagaataaaaatattttttatgagaccatcaaagagagaaagagaataaaaatatttt

SEQ ID NO: 347582 - DNA, 75 bp, Artificial Sequence
  Synthetic
ggattttgtgagttcttgatcttattatacagcgcatataggatggcgacggtaactgctacgcaaataccgatc

SEQ ID NO: 347583 - DNA, 75 bp, Artificial Sequence
  Synthetic
gagagaaagagaataaaaatattttatgagaccatcaaagagagaaagagaataaaaatattttttatgagacca

SEQ ID NO: 347584 - DNA, 75 bp, Artificial Sequence
  Synthetic
ggtcaatgatatgatttttaatcaagattcatttttaaaatatttattagaacatctgattagaagccactatag

SEQ ID NO: 347585 - DNA, 75 bp, Artificial Sequence
  Synthetic
gattcatttttaaaatatttattagaacatctgattagaagccactatagagtttctaaacatataacaatagtt

SEQ ID NO: 347586 - DNA, 75 bp, Artificial Sequence
  Synthetic
ataatgatggtatcattacatgctgtatactctatagtctttgtagatgttataatcataaaagtacagaggtat

SEQ ID NO: 347587 - DNA, 75 bp, Artificial Sequence
  Synthetic
ctaccattgtttcgtattcagatagtacagcgtagtacatagcatcttcacaaattatatcattgtctaatagat

SEQ ID NO: 347588 - DNA, 75 bp, Artificial Sequence
  Synthetic
agataagtttaaggcgtttgtattcgcttggtttaacggcgtttcggaaaatgaaaaggtactagatacgtataa

SEQ ID NO: 347589 - DNA, 75 bp, Artificial Sequence
  Synthetic
ttatcttcttccagcgcatatagtctaatagcgattcaaacgcgtgatagtttataccattcaatataatcgctt

SEQ ID NO: 347590 - DNA, 75 bp, Artificial Sequence
  Synthetic
ttggctgctacgagacgagacgtcgcctattcctgataagttctttatacagttgaaacaaccgcttagaaataa

SEQ ID NO: 347591 - DNA, 75 bp, Artificial Sequence
  Synthetic
cctattcctgataagttctttatacagttgaaacaaccgcttagaaataaacgagtatgtgtgtgtggtatagat

SEQ ID NO: 347592 - DNA, 75 bp, Artificial Sequence
  Synthetic
tcatagacaatgctaatatattcttacagtacacagtattaacaaatatcggcatttatgtttctttaaaagtca

SEQ ID NO: 347593 - DNA, 75 bp, Artificial Sequence
  Synthetic
aaaaaaatcaattaaggagatagcttcatctatatctagattaaccggagtaattgattataaaggttataacct

SEQ ID NO: 347594 - DNA, 75 bp, Artificial Sequence
  Synthetic
taattgattataaaggttataaccttaatataatagacggggttataccctggaattattacttaagttgtaaat

SEQ ID NO: 347595 - DNA, 75 bp, Artificial Sequence
  Synthetic
ctgctgcagcatataactaaacacgttagtgttctttattgtttgggtaaaacagatttctcgaatatacgggcc

SEQ ID NO: 347596 - DNA, 75 bp, Artificial Sequence
  Synthetic
ttagtgttctttattgtttgggtaaaacagatttctcgaatatacgggccaagttagaatccccggtaactacca

SEQ ID NO: 347597 - DNA, 75 bp, Artificial Sequence
  Synthetic
gccttactcggtgtatataagacctacctctcttaaaatggttgagaccaagcttcgttgtagaaacactgaagc

SEQ ID NO: 347598 - DNA, 75 bp, Artificial Sequence
  Synthetic
tcatttgaaattatcaacgttttactggaattagacaacaaggcacctataaattgggctcaagggtttatttat

SEQ ID NO: 347599 - DNA, 75 bp, Artificial Sequence
  Synthetic
aaattgggctcaagggtttatttattaatgctttagtgaaattttaacttgtgttctaaatggatgcaactatta

SEQ ID NO: 347600 - DNA, 75 bp, Artificial Sequence
  Synthetic
ttagctatgtaccaatttaccaaccctcttaatattgattgataatcacatcggttatccaattaataactaaat

SEQ ID NO: 347601 - DNA, 75 bp, Artificial Sequence
  Synthetic
ttttaaaggtatctaatgcggatttagaaaactctctatctcttaatgaatttttaaaatcattatatagtgttg

SEQ ID NO: 347602 - DNA, 75 bp, Artificial Sequence
  Synthetic
aatacccgagagatgcgatacaaaagagcaagactaatttgtaaaccatcttactcaaaatatgtaacaatagta

SEQ ID NO: 347603 - DNA, 75 bp, Artificial Sequence
  Synthetic
attatttaacggctattcaagattttattatcgaggtgtcaaactgtgtagctagattcgcgtttacagaatgcg

SEQ ID NO: 347604 - DNA, 75 bp, Artificial Sequence
  Synthetic
tattatcgaggtgtcaaactgtgtagctagattcgcgtttacagaatgcggcgccattcatgaaaatgtaataaa

SEQ ID NO: 347605 - DNA, 75 bp, Artificial Sequence
  Synthetic
tttatgatcgtcttttgtggaatttcccaaatagttttataaactcgcttaatatcttctggaaggtttgtattc

SEQ ID NO: 347606 - DNA, 75 bp, Artificial Sequence
  Synthetic
caagttttcatattatctttttagatacgtataccactatggatacattgatagctatgaaacgaacactattag

SEQ ID NO: 347607 - DNA, 75 bp, Artificial Sequence
  Synthetic
tacgtataccactatggatacattgatagctatgaaacgaacactattagaattaagtagatcatctgaaaatcc

SEQ ID NO: 347608 - DNA, 75 bp, Artificial Sequence
  Synthetic
gggttgtaggtactaggaaaaatccaaattgcgacactattcatgtaatgcaaccaccgcatgataatatagaag

SEQ ID NO: 347609 - DNA, 75 bp, Artificial Sequence
  Synthetic
aaattgcgacactattcatgtaatgcaaccaccgcatgataatatagaagattacctattcacttacgtggatat

SEQ ID NO: 347610 - DNA, 75 bp, Artificial Sequence
  Synthetic
ttcctgataagttatgggaaccagggtttatttcattcgaagacgctataaaaagagtttcaaaaatattcatta

SEQ ID NO: 347611 - DNA, 75 bp, Artificial Sequence
  Synthetic
gtttatttcattcgaagacgctataaaaagagtttcaaaaatattcattaattctataataaactttaatgatct

SEQ ID NO: 347612 - DNA, 75 bp, Artificial Sequence
  Synthetic
cttgtgcattatgtaaaaaacgatcgcataaacatccgcatcaactatcgttggaaaatggtgctattagaattt

SEQ ID NO: 347613 - DNA, 75 bp, Artificial Sequence
  Synthetic
gcataaacatccgcatcaactatcgttggaaaatggtgctattagaatttacaaaactggtaatccacatagttg

SEQ ID NO: 347614 - DNA, 75 bp, Artificial Sequence
  Synthetic
aaagaattttagacactaactctgttttattaaccgaacgaggagaccatatagtttggattaataattcatgga

SEQ ID NO: 347615 - DNA, 75 bp, Artificial Sequence
  Synthetic
atagtttggattaataattcatggaaatttaacagcgaagaacccttgataacaaaactaattttgtcaataaga

SEQ ID NO: 347616 - DNA, 75 bp, Artificial Sequence
  Synthetic
aaagactgtagaagctaacatacgagacatgttagtagattcagtggagaccgatacctatccggataaacttcc

SEQ ID NO: 347617 - DNA, 75 bp, Artificial Sequence
  Synthetic
gacatgttagtagattcagtggagaccgatacctatccggataaacttccgtttaaaaatggtgtattggacctg

SEQ ID NO: 347618 - DNA, 75 bp, Artificial Sequence
  Synthetic
tgtatcaaccggatttaaatttgacgatacaaagttcgtcgaagacagtccagaaatggaagagttaatgaatat

SEQ ID NO: 347619 - DNA, 75 bp, Artificial Sequence
  Synthetic
gatacaaagttcgtcgaagacagtccagaaatggaagagttaatgaatatcattaacgatatccaaccattaacg

SEQ ID NO: 347620 - DNA, 75 bp, Artificial Sequence
  Synthetic
caccaactgtatgaaaattaagaaaacagtttaataaatcaacagaaatatttaatcctccgtttgatacagatg

SEQ ID NO: 347621 - DNA, 75 bp, Artificial Sequence
  Synthetic
taatagccgcacacacaatctctgcgtcagaacgctcgtcaatatagatcttagacatttttagagagaactaac

SEQ ID NO: 347622 - DNA, 75 bp, Artificial Sequence
  Synthetic
tttatgcggtgctaccaaaggatgtttaacattcttttttggagaaactgcaactggaaagtcgacaaccaaacg

SEQ ID NO: 347623 - DNA, 75 bp, Artificial Sequence
  Synthetic
ttaacattcttttttggagaaactgcaactggaaagtcgacaaccaaacgtttgttaaagtctgctatcggtgac

SEQ ID NO: 347624 - DNA, 75 bp, Artificial Sequence
  Synthetic
acctaatccatttatcgctaacatgcatttgaaaagatctgtattctgtagcgaactacctgattttgcctgtag

SEQ ID NO: 347625 - DNA, 75 bp, Artificial Sequence
  Synthetic
ggaaatgtataaactaaaacattgcccgaaagcggtgcctctatctgcgttatatccgttcttaacttacaaaat

SEQ ID NO: 347626 - DNA, 75 bp, Artificial Sequence
  Synthetic
aatattaaaaagttgacagaaccttgtgtcattggaagaccgtgtttctccaataaaattaataatagaaaccat

SEQ ID NO: 347627 - DNA, 75 bp, Artificial Sequence
  Synthetic
tcttcacaaattatatcattgtctaatagatatttgacgcatcttatggatcccacttcaacagccatcttaaaa

SEQ ID NO: 347628 - DNA, 75 bp, Artificial Sequence
  Synthetic
acaaacctgtttttgataggatagataacgcattaatgagaagaattgccgtcgtgcgattcagaacacactttt

SEQ ID NO: 347629 - DNA, 75 bp, Artificial Sequence
  Synthetic
taacgcattaatgagaagaattgccgtcgtgcgattcagaacacacttttctcaaccttctggtagagaggctgc

SEQ ID NO: 347630 - DNA, 75 bp, Artificial Sequence
  Synthetic
aagatgcgctgggctcaatgtcttaataagaagtgtaagaggactatctccgaatttgttttgtttattaacatc

SEQ ID NO: 347631 - DNA, 75 bp, Artificial Sequence
  Synthetic
atcagatccagataataaacaaattttgtcgccctaactaattctatattgttatatattttacaattggttatg

SEQ ID NO: 347632 - DNA, 75 bp, Artificial Sequence
  Synthetic
cactttatacattttttttgtaaaaatactcataaaaaaatttataaaaattatggcacaaccatatcttgtaga

SEQ ID NO: 347633 - DNA, 75 bp, Artificial Sequence
  Synthetic
tccattaatgacggacctctccaaaaagggatatatattgtacgataatgtggttactcttccgttgactacttt

SEQ ID NO: 347634 - DNA, 75 bp, Artificial Sequence
  Synthetic
aagggatatatattgtacgataatgtggttactcttccgttgactactttccaacagaaaatatccaagtatttt

SEQ ID NO: 347635 - DNA, 75 bp, Artificial Sequence
  Synthetic
gaaatttgccaatgttagtgatgaatatctgcaatatatattcatagaggatatttcatctccgtaaatatatgc

SEQ ID NO: 347636 - DNA, 75 bp, Artificial Sequence
  Synthetic
tatctgcaatatatattcatagaggatatttcatctccgtaaatatatgctcatatatttatagaagatatcaca

SEQ ID NO: 347637 - DNA, 75 bp, Artificial Sequence
  Synthetic
attatcgcgattgcgtagatggagtactattatataccttgtaattaaatttttttattaattaaacgtataaaa

SEQ ID NO: 347638 - DNA, 75 bp, Artificial Sequence
  Synthetic
gtataccaactatattacctcatcagttagctactctagattatctagttagaactatcatagatgagaacagaa

SEQ ID NO: 347639 - DNA, 75 bp, Artificial Sequence
  Synthetic
aaagtccttcatgtaaccgatactaataaatttgctcattataggttcacttgtgtcctcactacgatagatggc

SEQ ID NO: 347640 - DNA, 75 bp, Artificial Sequence
  Synthetic
gcgtgttattgttccatattatgggatcaggtaaaacaataatcgctttgttgttcgccttggtagcttccagat

SEQ ID NO: 347641 - DNA, 75 bp, Artificial Sequence
  Synthetic
aattataatatgggtgtagctatgaacttgtttaatgacgaattcatagctgagaatatctttattcattccaca

SEQ ID NO: 347642 - DNA, 75 bp, Artificial Sequence
  Synthetic
aagtatataaatactttttatttactgtactcttactgtgtagtggtgataccctactcgattatttttttaaaa

SEQ ID NO: 347643 - DNA, 75 bp, Artificial Sequence
  Synthetic
acttgtttaatgacgaattcatagctgagaatatctttattcattccacaacaagtttttattctcttaattata

SEQ ID NO: 347644 - DNA, 75 bp, Artificial Sequence
  Synthetic
ccgttacactgttatctaatgaatgaaggatttgaatcatctgttttaaaaaacctattaaaggagtatgtcatg

SEQ ID NO: 347645 - DNA, 75 bp, Artificial Sequence
  Synthetic
tttatcgttgatgaggcacataatatctttgggaataatactggagaacttatgaccgtgataaaaaataaaaac

SEQ ID NO: 347646 - DNA, 75 bp, Artificial Sequence
  Synthetic
aagattccttttctactattgtctggatctcccattactaacacacctaatactctgggtcatattatagattta

SEQ ID NO: 347647 - DNA, 75 bp, Artificial Sequence
  Synthetic
agtaattcagacacttcttaacgaacgaggtgtgaatgtacttaaggatttgcttaaaggaagaatatcatatta

SEQ ID NO: 347648 - DNA, 75 bp, Artificial Sequence
  Synthetic
cgaggtgtgaatgtacttaaggatttgcttaaaggaagaatatcatattacgaaatgcctgataaagatctacca

SEQ ID NO: 347649 - DNA, 75 bp, Artificial Sequence
  Synthetic
taccgtggccgacgtcagacattgtctgactgaatacatcctgtgggtttctcatagatggacccatagagaaac

SEQ ID NO: 347650 - DNA, 75 bp, Artificial Sequence
  Synthetic
tcacatgtctaaacttcaagagagagattatatgattactagacgacagctatgttatcatgaaatgtttgataa

SEQ ID NO: 347651 - DNA, 75 bp, Artificial Sequence
  Synthetic
gattatatgattactagacgacagctatgttatcatgaaatgtttgataaaaatatgtataacgtgtcaatggca

SEQ ID NO: 347652 - DNA, 75 bp, Artificial Sequence
  Synthetic
acaggataaggaattgtacccaaatctgaaaataaataatggcgtgttatacggagaagaattggtaacgttaaa

SEQ ID NO: 347653 - DNA, 75 bp, Artificial Sequence
  Synthetic
ctgaaaataaataatggcgtgttatacggagaagaattggtaacgttaaacattagttccaaatttaagtacttt

SEQ ID NO: 347654 - DNA, 75 bp, Artificial Sequence
  Synthetic
ttctacatatggcggattggtaattaaatatatcatgctcagtaatggatattctgaatataatggttctcaggg

SEQ ID NO: 347655 - DNA, 75 bp, Artificial Sequence
  Synthetic
aatatgtacatattaatgaattattcggaggattctctattatcgatattccatacgagggaaactctagtatgg

SEQ ID NO: 347656 - DNA, 75 bp, Artificial Sequence
  Synthetic
aaaccaaaaacatttgctatcgttactagtaaaatgaaatcgtctttagaggatctattagatgtgtataattct

SEQ ID NO: 347657 - DNA, 75 bp, Artificial Sequence
  Synthetic
gaagctagttgatttattactgagctaccatcccactctagagactatgattgacgcatttaatagagatatacg

SEQ ID NO: 347658 - DNA, 75 bp, Artificial Sequence
  Synthetic
tatgtccgaatcctatactctaaaagaggtaaggcatatttggtttatgactatcccagatactttttctcaata

SEQ ID NO: 347659 - DNA, 75 bp, Artificial Sequence
  Synthetic
gaggtaaggcatatttggtttatgactatcccagatactttttctcaatacaaccaaattcttggacgatctatt

SEQ ID NO: 347660 - DNA, 75 bp, Artificial Sequence
  Synthetic
aaacgaatagaatatactctattcttcaagagatgtctgaaacgtattctcttccaccacatccatcaattgtaa

SEQ ID NO: 347661 - DNA, 75 bp, Artificial Sequence
  Synthetic
tcaagagatgtctgaaacgtattctcttccaccacatccatcaattgtaaaagttttattgggagaattggtcag

SEQ ID NO: 347662 - DNA, 75 bp, Artificial Sequence
  Synthetic
aataataatatcatttacaattaatagtataaactaaaaattaaacaaatcgttattataagtaatatcaaaatg

SEQ ID NO: 347663 - DNA, 75 bp, Artificial Sequence
  Synthetic
agtataaactaaaaattaaacaaatcgttattataagtaatatcaaaatgatgatatacggattaatagcgtgtc

SEQ ID NO: 347664 - DNA, 75 bp, Artificial Sequence
  Synthetic
ttaaaatggttacatcagttataaaaaataaagaagacgctaggaattacatagatgatattgtaaacggtcact

SEQ ID NO: 347665 - DNA, 75 bp, Artificial Sequence
  Synthetic
aaaggatagagatgtttgtgaactattaatctcatctgataaagcgtgtgcgtgtatagagttaaattcatataa

SEQ ID NO: 347666 - DNA, 75 bp, Artificial Sequence
  Synthetic
aaataaagaagacgctaggaattacatagatgatattgtaaacggtcacttctttgtatcgaataaagtatttga

SEQ ID NO: 347667 - DNA, 75 bp, Artificial Sequence
  Synthetic
ccgttatagtattagtttgttcctgtgacaaaaataatgaccaatataagttccataaattgctaccgtgaatat

SEQ ID NO: 347668 - DNA, 75 bp, Artificial Sequence
  Synthetic
gactttcctacgaaccatttgtttggggagttaactttcgtaaagaatataacgtggtatcttctccataaaact

SEQ ID NO: 347669 - DNA, 75 bp, Artificial Sequence
  Synthetic
gggagttaactttcgtaaagaatataacgtggtatcttctccataaaactgatgagatatataaagaaataaatg

SEQ ID NO: 347670 - DNA, 75 bp, Artificial Sequence
  Synthetic
gctgacgttagacataaaaactaatattaggaatgccgtatataagacgtatctccatagagaaattagtggtaa

SEQ ID NO: 347671 - DNA, 75 bp, Artificial Sequence
  Synthetic
attaggaatgccgtatataagacgtatctccatagagaaattagtggtaaaatggccaagaaaatagaaattcgt

SEQ ID NO: 347672 - DNA, 75 bp, Artificial Sequence
  Synthetic
atacaaataacatagatacatcgcatatttagcatttttataaatatacataagacatacactttatacattttt

SEQ ID NO: 347673 - DNA, 75 bp, Artificial Sequence
  Synthetic
tatttagcatttttataaatatacataagacatacactttatacatttttgtaaaaatactcataaaaaaaattt

SEQ ID NO: 347674 - DNA, 75 bp, Artificial Sequence
  Synthetic
aaacgttccgtgtgtaataacctacgcgtattatcacgttggggatatagttagaggaacattaaacatcgaaga

SEQ ID NO: 347675 - DNA, 75 bp, Artificial Sequence
  Synthetic
gcgtattatcacgttggggatatagttagaggaacattaaacatcgaagatgaatcaaatgtaactattcaatgt

SEQ ID NO: 347676 - DNA, 75 bp, Artificial Sequence
  Synthetic
gccagagcttcttcacgagtgatcgcgggagagtccttaccttgtcctggggacacgctggacaatctagcattc

SEQ ID NO: 347677 - DNA, 75 bp, Artificial Sequence
  Synthetic
cgattcaaagtactgcttttttcgaaatggtaatgcgtatgacaatggcagcgaagtcactgccgttctaatgga

SEQ ID NO: 347678 - DNA, 75 bp, Artificial Sequence
  Synthetic
gcgaagtcactgccgttctaatggaggctcaacaaggtatcgaatctagttttgtttttctcgcgaatatcgtcg

SEQ ID NO: 347679 - DNA, 75 bp, Artificial Sequence
  Synthetic
tttagaggattttaaccagtatgtttaatatgaaaaaaataaacataacatattttgagattaagcgctattgtg

SEQ ID NO: 347680 - DNA, 75 bp, Artificial Sequence
  Synthetic
taattgcgaatgttttattcccttcgatatatttttgataatatgaaaaacatgtctctctcaaatcggacaacc

SEQ ID NO: 347681 - DNA, 75 bp, Artificial Sequence
  Synthetic
atctccccagaataatatacttctgtgtcatcgttcaatttatacggatttctatagttctctgttatataatgc

SEQ ID NO: 347682 - DNA, 75 bp, Artificial Sequence
  Synthetic
gttgcttctacataaacttcgattcccatatattctttattgtcagaatcgcataccgatttatcatcatacact

SEQ ID NO: 347683 - DNA, 75 bp, Artificial Sequence
  Synthetic
cattctaaaagacggaggatctccatcaaatgccagacaatcacgtacaaagtacatggaaataggttttgttct

SEQ ID NO: 347684 - DNA, 75 bp, Artificial Sequence
  Synthetic
ctaggcagcaaattgtctagataaaatactgaatcaaacggtgcagacgtattggcggatctaatggaatccaat

SEQ ID NO: 347685 - DNA, 75 bp, Artificial Sequence
  Synthetic
gaatatagaaataatgataagtccatcatcgtgtttttttgcctcttcataagaactatattttttcttattcca

SEQ ID NO: 347686 - DNA, 75 bp, Artificial Sequence
  Synthetic
tggatccataatcgtcttcctttccccaatatatatgtagtgatgataacacatattcattggggagaaaccctc

SEQ ID NO: 347687 - DNA, 75 bp, Artificial Sequence
  Synthetic
tggatagtggttggtttcgactcattataatgtatgtctaacggcttcaatcgcgcgttagaaattgctttttta

SEQ ID NO: 347688 - DNA, 75 bp, Artificial Sequence
  Synthetic
aagactataccatgtgtatatctaacgtattctagcatggttgccatacgtgcattaaacttttcaggatctttg

SEQ ID NO: 347689 - DNA, 75 bp, Artificial Sequence
  Synthetic
tataatgtatgtctaacggcttcaatcgcgcgttagaaattgcttttttagtttctatattaataggagatagtt

SEQ ID NO: 347690 - DNA, 75 bp, Artificial Sequence
  Synthetic
tatgggaattacaatggatgaggaagtgatatttgaaactcctagagaattaatatctattaaacgaataaaaga

SEQ ID NO: 347691 - DNA, 75 bp, Artificial Sequence
  Synthetic
tgatagtatagatagctttagctaatataaaaatatattaatccactatatattctagacttgatttaaaaccga

SEQ ID NO: 347692 - DNA, 75 bp, Artificial Sequence
  Synthetic
taatatctattaaacgaataaaagatattccaagatcaaaagacacgcatgtgtttgctgcgtgtataacaagtg

SEQ ID NO: 347693 - DNA, 75 bp, Artificial Sequence
  Synthetic
atattatctcaacaaaattcagattctatctttagagtatccactaaactattacggtttatgtactacaatgaa

SEQ ID NO: 347694 - DNA, 75 bp, Artificial Sequence
  Synthetic
ctatctttagagtatccactaaactattacggtttatgtactacaatgaactaagagaaatctttagacggttga

SEQ ID NO: 347695 - DNA, 75 bp, Artificial Sequence
  Synthetic
ttgggtggtaaactagataaaaaggaatctattaaagattgtttaagaagagaattaaaagaggaaagtgatgaa

SEQ ID NO: 347696 - DNA, 75 bp, Artificial Sequence
  Synthetic
aatctattaaagattgtttaagaagagaattaaaagaggaaagtgatgaacgtataacagtaaaagaatttggaa

SEQ ID NO: 347697 - DNA, 75 bp, Artificial Sequence
  Synthetic
ataggttattgcatggcgtgttttattaatcaatcgttggaggatttatcgcatactagtatttacaatgtagaa

SEQ ID NO: 347698 - DNA, 75 bp, Artificial Sequence
  Synthetic
ttaatcaatcgttggaggatttatcgcatactagtatttacaatgtagaaattagaaagattaaatcattaaatg

SEQ ID NO: 347699 - DNA, 75 bp, Artificial Sequence
  Synthetic
ctagttaatagtaaatgaacttttacagatctagtataattagtcagattattaagtataatagacgactagcta

SEQ ID NO: 347700 - DNA, 75 bp, Artificial Sequence
  Synthetic
atgtaggcattcttcattctattaatgtctactctatagcgctttagttccttatgacgaccggcgatatcatac

SEQ ID NO: 347701 - DNA, 75 bp, Artificial Sequence
  Synthetic
cagatctagtataattagtcagattattaagtataatagacgactagctaagtctattatttgcgaggatgactc

SEQ ID NO: 347702 - DNA, 75 bp, Artificial Sequence
  Synthetic
aacgagtatccgtgtccgctattttattaactactgataacaaaatattagtatgtaacagacgagatagttttc

SEQ ID NO: 347703 - DNA, 75 bp, Artificial Sequence
  Synthetic
gattatatagatgaatcaattaataaagtagtatatgtctcacgtaagatggcggaatatatggcaagaacataa

SEQ ID NO: 347704 - DNA, 75 bp, Artificial Sequence
  Synthetic
actactgataatgatagaatagatgctatttatccgggtggcatacccaaaaggggtgagaatgttccagagtgt

SEQ ID NO: 347705 - DNA, 75 bp, Artificial Sequence
  Synthetic
atatagatagacgaggaaacaatgcgctacattgttacgtcttcaataaatgcgatacagacattaagattgttc

SEQ ID NO: 347706 - DNA, 75 bp, Artificial Sequence
  Synthetic
catagacactcggttttttattcatggcatcatagaagataccattattaataaattttttgaggtaatcttctt

SEQ ID NO: 347707 - DNA, 75 bp, Artificial Sequence
  Synthetic
gtggaacatatgcctgagtttagctatatgtattggttggcaaaggataccaagtttatagaacatctgggtgat

SEQ ID NO: 347708 - DNA, 75 bp, Artificial Sequence
  Synthetic
gtaatcatgaaatcaaggatctaatatttttagatccgaattcaggtaatggactccaatacgaaattgcaaaat

SEQ ID NO: 347709 - DNA, 75 bp, Artificial Sequence
  Synthetic
ttttttcattattatgttgatattaacaaaagtgaatatatatgttaataattgtattgtggttatacggctaca

SEQ ID NO: 347710 - DNA, 75 bp, Artificial Sequence
  Synthetic
aggatgattgattagaaaatataaattaatttaccatcgtgtatttttataacgggattgtccggcatatcatgt

SEQ ID NO: 347711 - DNA, 75 bp, Artificial Sequence
  Synthetic
atccttcaactcaccaccaaagagctccgttgcatcagttctgaaagagatgagaagcctgtagagagaccctgc

SEQ ID NO: 347712 - DNA, 75 bp, Artificial Sequence
  Synthetic
ttaatttaccatcgtgtatttttataacgggattgtccggcatatcatgtagatagttaccgtctacatcgtata

SEQ ID NO: 347713 - DNA, 75 bp, Artificial Sequence
  Synthetic
gaattggaataccaaatattagtaccctcaattagtttattggtaatattttttttagacgatagatcgatggct

SEQ ID NO: 347714 - DNA, 75 bp, Artificial Sequence
  Synthetic
gtcatgacatactcctttaataggttttttaaaacagatgattcaaatccttcattcattagataacagtgtaac

SEQ ID NO: 347715 - DNA, 75 bp, Artificial Sequence
  Synthetic
cctcaattagtttattggtaatattttttttagacgatagatcgatggctcttgaaaccaaggttttccaaccgg

SEQ ID NO: 347716 - DNA, 75 bp, Artificial Sequence
  Synthetic
gattaactacttgaaattctccagacaatactctccgagtgtaaatattactggtatatggtttcaccgactcat

SEQ ID NO: 347717 - DNA, 75 bp, Artificial Sequence
  Synthetic
aatgatgtatgtttaaacactctaaacaattggacaaattcttttgatttgctttgaatgatttcaaataggtct

SEQ ID NO: 347718 - DNA, 75 bp, Artificial Sequence
  Synthetic
gacgaaggaggatctttacccatccaatactactggtctttctcaaccatagatatagagattgttaaattatta

SEQ ID NO: 347719 - DNA, 75 bp, Artificial Sequence
  Synthetic
acaattggacaaattcttttgatttgctttgaatgatttcaaataggtcttcgtctacagtaggcataccattag

SEQ ID NO: 347720 - DNA, 75 bp, Artificial Sequence
  Synthetic
aatactactggtctttctcaaccatagatatagagattgttaaattattattaataaaggatgtggacacgtgta

SEQ ID NO: 347721 - DNA, 75 bp, Artificial Sequence
  Synthetic
ctttcaaacttaatcttattagaatattagtggaagaaagattctataataatgaatgcagatctaataaatgga

SEQ ID NO: 347722 - DNA, 75 bp, Artificial Sequence
  Synthetic
aaactatttctaagaccgtatgttttgattttatcttttagaggtttccaattccaaagatctgacggtacaaca

SEQ ID NO: 347723 - DNA, 75 bp, Artificial Sequence
  Synthetic
gtaagaacgtgactattgagacgaatggctcttcctactatctgacgaagagacgcctcgttccaagtcatatct

SEQ ID NO: 347724 - DNA, 75 bp, Artificial Sequence
  Synthetic
ttccaaagatcatattgtagaataccgttactggcgtacgatcttacatatgattcataaggtccttccttttca

SEQ ID NO: 347725 - DNA, 75 bp, Artificial Sequence
  Synthetic
agaagagaatacgcatgttttaatgcattctccgttagtgtttgattcttggttaaactcagccaccgccttgat

SEQ ID NO: 347726 - DNA, 75 bp, Artificial Sequence
  Synthetic
cattctccgttagtgtttgattcttggttaaactcagccaccgccttgattctagtatcttttgttctagatgag

SEQ ID NO: 347727 - DNA, 75 bp, Artificial Sequence
  Synthetic
ggttaaactcagccaccgccttgattctagtatcttttgttctagatgagaactctatattagagataccaaaga

SEQ ID NO: 347728 - DNA, 75 bp, Artificial Sequence
  Synthetic
tcaaagactagacatttaccatgggatgctaatattcccaaacatacatctataaatttgacgcttttctctttt

SEQ ID NO: 347729 - DNA, 75 bp, Artificial Sequence
  Synthetic
caaattgtccatctattacaaacatgtttaacgcgacagatgccagattacaaacggctacctcattagcatctg

SEQ ID NO: 347730 - DNA, 75 bp, Artificial Sequence
  Synthetic
aagcaagtacatggataatatagatatgatcgataatgagaataaaactctactatattacgcggtcgatgtcaa

SEQ ID NO: 347731 - DNA, 75 bp, Artificial Sequence
  Synthetic
tcgcccggatcacgattttgtctttcaggaaagctatcgaacgtaaacgtagtagccatacgtctcagaattcta

SEQ ID NO: 347732 - DNA, 75 bp, Artificial Sequence
  Synthetic
caggaaagctatcgaacgtaaacgtagtagccatacgtctcagaattctaaatgatgatatacctgtttttattt

SEQ ID NO: 347733 - DNA, 75 bp, Artificial Sequence
  Synthetic
tgagatggacgagattgtacgcatcgttcgcgacagtatgtggtacatacctaacgtatttatggacgacggtaa

SEQ ID NO: 347734 - DNA, 75 bp, Artificial Sequence
  Synthetic
tattatcgaacgagtacaacctcatactactattattgacgatactccacctcctacgtttcgtagagagttatt

SEQ ID NO: 347735 - DNA, 75 bp, Artificial Sequence
  Synthetic
acgtatcgcattaatactgttttcttagcgaatgatgcagacccttctacgtcatcaaaaatagaaaactcgtta

SEQ ID NO: 347736 - DNA, 75 bp, Artificial Sequence
  Synthetic
aaaaaatttataaaaattatggcacaaccatatcttgtataggtagtttagttcgtcgagtgaacctataaacag

SEQ ID NO: 347737 - DNA, 75 bp, Artificial Sequence
  Synthetic
atcgactagacgtttattctcaaatagcgattggtgttgtaaggatcctggtcgtagtaagttaaccaacatggt

SEQ ID NO: 347738 - DNA, 75 bp, Artificial Sequence
  Synthetic
agcgattggtgttgtaaggatcctggtcgtagtaagttaaccaacatggtgaattcttgcacactattgacgata

SEQ ID NO: 347739 - DNA, 75 bp, Artificial Sequence
  Synthetic
aagaatgcctacatatcaggcgtctccatgtttgatatattatttaaacgaagcaaacgccacagattgagatac

SEQ ID NO: 347740 - DNA, 75 bp, Artificial Sequence
  Synthetic
gtcgtagtaagttaaccaacatggtgaattcttgcacactattgacgataggtgtagccgataaacaaatcatct

SEQ ID NO: 347741 - DNA, 75 bp, Artificial Sequence
  Synthetic
tgataaacctattccccctgccattttagagattaatgcgcatcgttttaacgtatcatagatgccctctatact

SEQ ID NO: 347742 - DNA, 75 bp, Artificial Sequence
  Synthetic
gtaggacggatcttaccatcttctttgattaatgatttagaaatgaagttatgacattcatcaataatgacgcat

SEQ ID NO: 347743 - DNA, 75 bp, Artificial Sequence
  Synthetic
gaagtgattctttgatggtgtcagcatacgaattacaataatgcagaaactcggttaacatgcaggaattatagt

SEQ ID NO: 347744 - DNA, 75 bp, Artificial Sequence
  Synthetic
tgatattagtaaaaaatttatttctaaaattttgatcatcgtaattaataaaaatacaatccttcgttatctctg

SEQ ID NO: 347745 - DNA, 75 bp, Artificial Sequence
  Synthetic
ttaccgcgacacgcattaacatgtgctgaggtttttcaacgatcttgttgtttatttttaacaagtaggattttt

SEQ ID NO: 347746 - DNA, 75 bp, Artificial Sequence
  Synthetic
aaaatacaatccttcgttatctctggagcgtatctgagtatagtgttcatccaaggatcttctatcaaagccttt

SEQ ID NO: 347747 - DNA, 75 bp, Artificial Sequence
  Synthetic
ccaaggatcttctatcaaagcctttttcaccaataagataatagcccaattcgtataaatatccttaagatgttt

SEQ ID NO: 347748 - DNA, 75 bp, Artificial Sequence
  Synthetic
ataaaagagaatgcatactgtctaatcctaagaaaactcttgctacaaaatgttgataatccttgaggcgtacta

SEQ ID NO: 347749 - DNA, 75 bp, Artificial Sequence
  Synthetic
gtatataggtatgtcttggcgtcatatcttgtactaaacacgctaaacagtttgttaatgtgatcaatttccaat

SEQ ID NO: 347750 - DNA, 75 bp, Artificial Sequence
  Synthetic
gatgctaaattacgtggattataacatcatattccggcgtatgaattgatgagttgtacatcttgacattttctt

SEQ ID NO: 347751 - DNA, 75 bp, Artificial Sequence
  Synthetic
taatcgatataggccgcgtgtgatttactcatttatgagtgataagtaataactatgttttaaaaatcacagcag

SEQ ID NO: 347752 - DNA, 75 bp, Artificial Sequence
  Synthetic
tactcatttatgagtgataagtaataactatgttttaaaaatcacagcagtagtttaactagtcttctctgatgt

SEQ ID NO: 347753 - DNA, 75 bp, Artificial Sequence
  Synthetic
aactatgttttaaaaatcacagcagtagtttaactagtcttctctgatgtttgttttcgatactttttgaatcag

SEQ ID NO: 347754 - DNA, 75 bp, Artificial Sequence
  Synthetic
tctatatagtatttttctgatattttctataatatcagaattgtcttccatcgaaagttgtatactatcagaatc

SEQ ID NO: 347755 - DNA, 75 bp, Artificial Sequence
  Synthetic
actctattcgaaaactctaagaacttattaatgaattccgtatccactggattgtttaaaatactaaattgaaca

SEQ ID NO: 347756 - DNA, 75 bp, Artificial Sequence
  Synthetic
tattaatgaattccgtatccactggattgtttaaaatactaaattgaacactgttcacatccttccaagaagaag

SEQ ID NO: 347757 - DNA, 75 bp, Artificial Sequence
  Synthetic
tgacggtaccataaactattttaccagcattagtaacagcttggacaatctgaccatccatcgcattgtacgatg

SEQ ID NO: 347758 - DNA, 75 bp, Artificial Sequence
  Synthetic
aaaacaagttccgtttatgagaacggacatgctacaaaatatgttcgcggctaatcgcgacaacgtggcgtcgag

SEQ ID NO: 347759 - DNA, 75 bp, Artificial Sequence
  Synthetic
atagatcatgtaacaatattacaatacatagatgaaccaaatgatataagactaacagtatgcattatccaaaat

SEQ ID NO: 347760 - DNA, 75 bp, Artificial Sequence
  Synthetic
caaacatcactagccaccataatggcgctatctttcaaccagctatcgcttacgcattttagcagtctaacattt

SEQ ID NO: 347761 - DNA, 75 bp, Artificial Sequence
  Synthetic
tacgcattttagcagtctaacatttttaaagagactacaatatattctcatagtatcgattacacctctaccgaa

SEQ ID NO: 347762 - DNA, 75 bp, Artificial Sequence
  Synthetic
tatttttcgtttacaaaatcaaataatggtcgaaacacgtcgaaggttaacatcttataatcgctaatgtataga

SEQ ID NO: 347763 - DNA, 75 bp, Artificial Sequence
  Synthetic
aattatgatgatacattttttgacgacgatgattgatcgctattgcacaattttgtttttttactttctaatata

SEQ ID NO: 347764 - DNA, 75 bp, Artificial Sequence
  Synthetic
atggtcgaaacacgtcgaaggttaacatcttataatcgctaatgtatagattgttttcagtgagatgattattag

SEQ ID NO: 347765 - DNA, 75 bp, Artificial Sequence
  Synthetic
tcggcaactacggcgtccgctttagtactcctcccataatactttacgctattaatctttaaaatttcatagact

SEQ ID NO: 347766 - DNA, 75 bp, Artificial Sequence
  Synthetic
tactcctcccataatactttacgctattaatctttaaaatttcatagactttatctagatcgctttctggtaaca

SEQ ID NO: 347767 - DNA, 75 bp, Artificial Sequence
  Synthetic
gactgtttatgtaacaatgacttataaaaatactaaaactgattacacgtacctctctaatgggggttgcctgca

SEQ ID NO: 347768 - DNA, 75 bp, Artificial Sequence
  Synthetic
tcattaactctagaaatctgaagaaagtaattagctccgtattccagactaggtaatgggcttttacctagagac

SEQ ID NO: 347769 - DNA, 75 bp, Artificial Sequence
  Synthetic
aaaatggaagaaggacatgcgttccctcccggatattttttacaatttcatccatttacaactctatagtttgtt

SEQ ID NO: 347770 - DNA, 75 bp, Artificial Sequence
  Synthetic
cataatcttggtaatacttaccccttgatcgtaagataccttatacaggtcattacatacaactaccaattgttt

SEQ ID NO: 347771 - DNA, 75 bp, Artificial Sequence
  Synthetic
gtgtactcggacgaccactaccggtctcagtgaatccatctcaacgtcggaactaactattactatgaatcataa

SEQ ID NO: 347772 - DNA, 75 bp, Artificial Sequence
  Synthetic
tgatcgtaagataccttatacaggtcattacatacaactaccaattgtttttgtacataatagattggatggttg

SEQ ID NO: 347773 - DNA, 75 bp, Artificial Sequence
  Synthetic
agatacattagccgtaatagttgtcggcctaaagaatatctttggtgtaaagttaaaagttagggttcttgttcc

SEQ ID NO: 347774 - DNA, 75 bp, Artificial Sequence
  Synthetic
ggcctaaagaatatctttggtgtaaagttaaaagttagggttcttgttccattattgctttttgtcagtagttca

SEQ ID NO: 347775 - DNA, 75 bp, Artificial Sequence
  Synthetic
aaatctaacttctagtctagaaataatatcggtcttattcttaaaatctattcccttgatgaagggatcgttaat

SEQ ID NO: 347776 - DNA, 75 bp, Artificial Sequence
  Synthetic
catctatatactatatagtaataccaatactcaagactacgaaactgatacaatctcttatcatgtgggtaatgt

SEQ ID NO: 347777 - DNA, 75 bp, Artificial Sequence
  Synthetic
atatcggtcttattcttaaaatctattcccttgatgaagggatcgttaatgaacaaatccttggcctttgattcg

SEQ ID NO: 347778 - DNA, 75 bp, Artificial Sequence
  Synthetic
ttacaacaatatgattatgctcttactctctatgatggtctcataacataagtttacaacaatatgatgatctca

SEQ ID NO: 347779 - DNA, 75 bp, Artificial Sequence
  Synthetic
tacaggaatagatgtatcgatgatgttgatactatgtgatatgtgagcaaagattgttctcttagtggcatcact

SEQ ID NO: 347780 - DNA, 75 bp, Artificial Sequence
  Synthetic
agattgttctcttagtggcatcactatatgttccagtaatggcggaaaactttttagaaatgttatatataaaag

SEQ ID NO: 347781 - DNA, 75 bp, Artificial Sequence
  Synthetic
aataactagatcatccaacaatctactcacatatgcatctatataatctttttcatcttgtgagtaccctggata

SEQ ID NO: 347782 - DNA, 75 bp, Artificial Sequence
  Synthetic
tttcatcttgtgagtaccctggatacgaaataaatttattatccgtatttccataataaggtttagtataaacag

SEQ ID NO: 347783 - DNA, 75 bp, Artificial Sequence
  Synthetic
atttgacctattactctcctaggtttctctataaacgatggtttaatttgtacattcttaaccatatatccaata

SEQ ID NO: 347784 - DNA, 75 bp, Artificial Sequence
  Synthetic
tacattcttaaccatatatccaataaagctcaattcaggaacataaacaaattctttgttgaacgtttcaaagtc

SEQ ID NO: 347785 - DNA, 75 bp, Artificial Sequence
  Synthetic
ggtacacttttttaattcgtggtgtgcctgaatcgttcgattaaccctactcatccaatttcagatgaatagagt

SEQ ID NO: 347786 - DNA, 75 bp, Artificial Sequence
  Synthetic
ttacggtaatttttgaatcggatagtttaagactgctgaatgtatcttccacatcaaacggagttttaatataaa

SEQ ID NO: 347787 - DNA, 75 bp, Artificial Sequence
  Synthetic
tttaagactgctgaatgtatcttccacatcaaacggagttttaatataaacgtatactgtagatggttctttaat

SEQ ID NO: 347788 - DNA, 75 bp, Artificial Sequence
  Synthetic
cttgacctcaagttcagatgattccttgcacatgtctccgatacgaacgctaaactctagattcttgacgcattt

SEQ ID NO: 347789 - DNA, 75 bp, Artificial Sequence
  Synthetic
atccagagtgtttcaaagcaattgtattattgatacaattattatataattcttcgccctcaatttcccaaataa

SEQ ID NO: 347790 - DNA, 75 bp, Artificial Sequence
  Synthetic
gtgattaatacatttatatccaacatatggtacgtaaccgaatcttcccatacctttaacttctggaagttccaa

SEQ ID NO: 347791 - DNA, 75 bp, Artificial Sequence
  Synthetic
gctctggccacccagataaccaaaaagtcacacgctccaggatatacattgtataaaaagctatcgttttttagt

SEQ ID NO: 347792 - DNA, 75 bp, Artificial Sequence
  Synthetic
tacctttaacttctggaagttccaaactcagaaccaaatgattaagcgcagtaatatactgatccctaatttcga

SEQ ID NO: 347793 - DNA, 75 bp, Artificial Sequence
  Synthetic
actcagaaccaaatgattaagcgcagtaatatactgatccctaatttcgaagctagcgatagcctgattgtctgg

SEQ ID NO: 347794 - DNA, 75 bp, Artificial Sequence
  Synthetic
aagttggaatttgactatcgactgcgaagacattagaccgtttaatagagtcatccccaccgatcaaagaattaa

SEQ ID NO: 347795 - DNA, 75 bp, Artificial Sequence
  Synthetic
aaaatggaaaaagcttacaataaactccgtagagaaatatctataatttgtgagttttccttaaagtaacagctt

SEQ ID NO: 347796 - DNA, 75 bp, Artificial Sequence
  Synthetic
attaagagggttggtaaattggtacatagctaataatacctatactccaaatacacccaataatacaacaaccat

SEQ ID NO: 347797 - DNA, 75 bp, Artificial Sequence
  Synthetic
ctcgataatcaatacggccatccagaaaagcagttaccaaagagaaaacaaaacgaagctagttgatttattact

SEQ ID NO: 347798 - DNA, 75 bp, Artificial Sequence
  Synthetic
ttccttatcttcatagaatactaaaggcaacaaagaaatttttggttcttctctaagagctacgtgagacttaac

SEQ ID NO: 347799 - DNA, 75 bp, Artificial Sequence
  Synthetic
ggcaacaaagaaatttttggttcttctctaagagctacgtgagacttaaccatagacgccaacgaatccctacat

SEQ ID NO: 347800 - DNA, 75 bp, Artificial Sequence
  Synthetic
aataggtctaaaaaccaaatcttgattacaaaaccaacacttatcaattacactatttgtcttaatagacacatc

SEQ ID NO: 347801 - DNA, 75 bp, Artificial Sequence
  Synthetic
ttacaaaaccaacacttatcaattacactatttgtcttaatagacacatctgccatagatttataatactttggt

SEQ ID NO: 347802 - DNA, 75 bp, Artificial Sequence
  Synthetic
ccgatgatggagtaataagtggtaggaggatctacatcctcgactgatgtggaatcatcttctgattccacctcg

SEQ ID NO: 347803 - DNA, 75 bp, Artificial Sequence
  Synthetic
ctacttcagcaaacattctttttataaatgccatctagcgtagcgaggacacaagtgaacctataattatcaaat

SEQ ID NO: 347804 - DNA, 75 bp, Artificial Sequence
  Synthetic
tgctgaaataaccacatctggaaggcttactcgcttagccatttaattacggaactatttttttatacttctaat

SEQ ID NO: 347805 - DNA, 75 bp, Artificial Sequence
  Synthetic
cttactcgcttagccatttaattacggaactatttttttatacttctaatgagcaagtagaaaacctctcatcta

SEQ ID NO: 347806 - DNA, 75 bp, Artificial Sequence
  Synthetic
gatctcatatgtgctaaaaagttttcccatactaattggttactattatttttcgtataatttttaacagtttga

SEQ ID NO: 347807 - DNA, 75 bp, Artificial Sequence
  Synthetic
gcatgccaggacgatatattgtttcataattgctattgattgagtactgttctttatgattctacttccttaccg

SEQ ID NO: 347808 - DNA, 75 bp, Artificial Sequence
  Synthetic
tgatatcgaatattttatccaaaaagaatgaataattaattgtcttagaaggagtgttttcttggcaaaagaata

SEQ ID NO: 347809 - DNA, 75 bp, Artificial Sequence
  Synthetic
ttcagtttctcatcttttacttgattgattatttcaaagactaacttataatcctttttatttattctctcgtta

SEQ ID NO: 347810 - DNA, 75 bp, Artificial Sequence
  Synthetic
tgattatttcaaagactaacttataatcctttttatttattctctcgttagccttaagaaaactagatacaaaat

SEQ ID NO: 347811 - DNA, 75 bp, Artificial Sequence
  Synthetic
cagaccatatactgagttggctactatcttgtacgtatattgcatggaatcataaatggccttttcagttgaact

SEQ ID NO: 347812 - DNA, 75 bp, Artificial Sequence
  Synthetic
agttccgagataatttctccagaacattgatgagacaataatctccgcaatacatttctcaaatgaataagttta

SEQ ID NO: 347813 - DNA, 75 bp, Artificial Sequence
  Synthetic
attgatgagacaataatctccgcaatacatttctcaaatgaataagtttattagacacgtggaagtttgactttt

SEQ ID NO: 347814 - DNA, 75 bp, Artificial Sequence
  Synthetic
ttggaggaagaatctttgttattgcatttaatctcgaaattcagagtgcacacctttctcctgtaaagaaacctg

SEQ ID NO: 347815 - DNA, 75 bp, Artificial Sequence
  Synthetic
atcattctttgctttcgttaactgtttggaggaagaatctttgttattgcatttaatctcgaaattcagagtgca

SEQ ID NO: 347816 - DNA, 75 bp, Artificial Sequence
  Synthetic
tcatatccttgttcagatactataccgttatgtctacaaccgctacataatcgtagattcatgttaacactctac

SEQ ID NO: 347817 - DNA, 75 bp, Artificial Sequence
  Synthetic
cggattcagtacaatgttatatttttcgtaccaactcatttaaatatcataatctaaaatagttctgtaatatgt

SEQ ID NO: 347818 - DNA, 75 bp, Artificial Sequence
  Synthetic
tcgtaccaactcatttaaatatcataatctaaaatagttctgtaatatgtctagcgctaatatattgatcataat

SEQ ID NO: 347819 - DNA, 75 bp, Artificial Sequence
  Synthetic
gaatttattgtaacagtattattaatattgccaagttatccgatctaaaaaaaactatctatgcagtagatagtt

SEQ ID NO: 347820 - DNA, 75 bp, Artificial Sequence
  Synthetic
tcttccatagttagaagatcgtcgtcaaagttagcaacgtgattcatcaacatttgctgttttgaggcagcaaat

SEQ ID NO: 347821 - DNA, 75 bp, Artificial Sequence
  Synthetic
caaagttagcaacgtgattcatcaacatttgctgttttgaggcagcaaatactgaaccatcgccattcaaccatt

SEQ ID NO: 347822 - DNA, 75 bp, Artificial Sequence
  Synthetic
aaacaggactattgttacaaaagttaataataattattataattataataattataataattataataattataa

SEQ ID NO: 347823 - DNA, 75 bp, Artificial Sequence
  Synthetic
tcttttttacgtagtaatcgtcgtagggagagacatcttgtagaacaacgatttaatcataggtagagatacttt

SEQ ID NO: 347824 - DNA, 75 bp, Artificial Sequence
  Synthetic
cagtctgtggtggatgatgtcattcacaacatccgccttgtatatgatgtttctgttttcaaacaccaagtcgaa

SEQ ID NO: 347825 - DNA, 75 bp, Artificial Sequence
  Synthetic
agagctcgcattaatctagcatttctagctcccggattgaaaacagaaagaggatcgtacatccagggtccattt

SEQ ID NO: 347826 - DNA, 75 bp, Artificial Sequence
  Synthetic
aggatcgtacatccagggtccattttctgtaaatagaatcgtataatgtcccttcaagaagatatcagacgatcc

SEQ ID NO: 347827 - DNA, 75 bp, Artificial Sequence
  Synthetic
ttatcatcgggtgtattctcattcatattctctatatattttgatagttgttcagctgtagaaccagctgctcca

SEQ ID NO: 347828 - DNA, 75 bp, Artificial Sequence
  Synthetic
gtcgaacctatctaatagataccgtagtatattgagagtgtatccttgattatgttttatgaatagataaagtag

SEQ ID NO: 347829 - DNA, 75 bp, Artificial Sequence
  Synthetic
tatacatgataccgtttagcatgatttctggtgatacgtcaatcggagtatcatctattagagatctaaagccgg

SEQ ID NO: 347830 - DNA, 75 bp, Artificial Sequence
  Synthetic
atgttgtccttcttccttttgttcgtgccaattgagtaacattatgagaatatgacctgttgcacaatcgttcca

SEQ ID NO: 347831 - DNA, 75 bp, Artificial Sequence
  Synthetic
ttctggtgatacgtcaatcggagtatcatctattagagatctaaagccggtgtaacattctccaccaaacatatt

SEQ ID NO: 347832 - DNA, 75 bp, Artificial Sequence
  Synthetic
taatgttgtccactatggagtcgatcctctcattgttctttacagtatctgtaatgatggacgttagttcttttt

SEQ ID NO: 347833 - DNA, 75 bp, Artificial Sequence
  Synthetic
caggggaatgaacagcactacccatcacattagttcccaatggatcaatgtgtgtaactccagaacatcttccat

SEQ ID NO: 347834 - DNA, 75 bp, Artificial Sequence
  Synthetic
cacattagttcccaatggatcaatgtgtgtaactccagaacatcttccatatcctatgttaggaggagcgaacac

SEQ ID NO: 347835 - DNA, 75 bp, Artificial Sequence
  Synthetic
acaccacacgaggactatgtttggtatactgttgaaggtaagtgtgtaaccgcgttaatgtttgctccataatct

SEQ ID NO: 347836 - DNA, 75 bp, Artificial Sequence
  Synthetic
tgatagaaatcggactgtcggatgttgtgatcatcttcataggattaacaactatgtatggtgccgcctgaagtt

SEQ ID NO: 347837 - DNA, 75 bp, Artificial Sequence
  Synthetic
taatatttcggataatgcatactgttagtcttatatcatttggttcatctatgtattgtaatattgttacatgat

SEQ ID NO: 347838 - DNA, 75 bp, Artificial Sequence
  Synthetic
gtggatatgtgtttacagtagtaatgaagagaagtgagttcatcctcgtcggcgcaattagggtcggatcctttg

SEQ ID NO: 347839 - DNA, 75 bp, Artificial Sequence
  Synthetic
tcatatcgtaactgatgccgtttataggtctagccacagaaaccaacgtaggtctaaatccaactatagacaaaa

SEQ ID NO: 347840 - DNA, 75 bp, Artificial Sequence
  Synthetic
aactccgtgtttatgatgccggtaaatgtttttatcatcttggacggaatcgattttgtaatatgtcatggaaac

SEQ ID NO: 347841 - DNA, 75 bp, Artificial Sequence
  Synthetic
cagcaatagatcggatgatttactaaagtcatcaatggtgtccgttagtatatcaaagatcttgttatcgattga

SEQ ID NO: 347842 - DNA, 75 bp, Artificial Sequence
  Synthetic
tagaagccaatatctgttcctcatctgtcataacttgagagcatccagtatgaataatcttcattagatggggat

SEQ ID NO: 347843 - DNA, 75 bp, Artificial Sequence
  Synthetic
tgtcataacttgagagcatccagtatgaataatcttcattagatggggatctaccgcatcatcatcgttacaata

SEQ ID NO: 347844 - DNA, 75 bp, Artificial Sequence
  Synthetic
ctgtctagtagtagtttgacgacctcgacattattacaatgctcattaaaaaggtatgcgtgtaaagcattattc

SEQ ID NO: 347845 - DNA, 75 bp, Artificial Sequence
  Synthetic
tgtttgctctctgaatctctgtggaaattagatctgatacacctgtaatcactatcggattatcctccgtaagac

SEQ ID NO: 347846 - DNA, 75 bp, Artificial Sequence
  Synthetic
aattagatctgatacacctgtaatcactatcggattatcctccgtaagacgattaaccaacaacatataattata

SEQ ID NO: 347847 - DNA, 75 bp, Artificial Sequence
  Synthetic
attgttgacagaaacgtgaccttcattcttaccgtcgtccataaatacgttaggtatgtaccacatactgtcgcg

SEQ ID NO: 347848 - DNA, 75 bp, Artificial Sequence
  Synthetic
ctccatgtacatacgcgttctcgagcgcaggaagtttaataccgaatagtgccatcagaataggatgaatatagt

SEQ ID NO: 347849 - DNA, 75 bp, Artificial Sequence
  Synthetic
cgcaggaagtttaataccgaatagtgccatcagaataggatgaatatagtaattagtttctggttttctataaat

SEQ ID NO: 347850 - DNA, 75 bp, Artificial Sequence
  Synthetic
atcgtgtagtcgacagaagaatatgatgattagatggagagtatattttatctaactctttgagttggtcaccga

SEQ ID NO: 347851 - DNA, 75 bp, Artificial Sequence
  Synthetic
atgattagatggagagtatattttatctaactctttgagttggtcaccgattctaggactagctcgagaatgaat

SEQ ID NO: 347852 - DNA, 75 bp, Artificial Sequence
  Synthetic
tgctctttacatgggtaaggagttgaaatagctcgtttctatttgttctgacaatatttagtttattcataatgt

SEQ ID NO: 347853 - DNA, 75 bp, Artificial Sequence
  Synthetic
acagccgcgtgtccatattttccacgataaaccttacgacgtttacatcgacgagattattattaacaaagtagt

SEQ ID NO: 347854 - DNA, 75 bp, Artificial Sequence
  Synthetic
gataaaccttacgacgtttacatcgacgagattattattaacaaagtagtcgtgcagaggatagttgttgtccgt

SEQ ID NO: 347855 - DNA, 75 bp, Artificial Sequence
  Synthetic
cattcttcattctattaatgtctactctatagcgctttagttccttatgacgaccggcgatatcatactttactt

SEQ ID NO: 347856 - DNA, 75 bp, Artificial Sequence
  Synthetic
gcatacactacaagacaaagatttatcagaagtgtgaatatgatcttcatctaccaaagaaagagtttgattagt

SEQ ID NO: 347857 - DNA, 75 bp, Artificial Sequence
  Synthetic
tcagaagtgtgaatatgatcttcatctaccaaagaaagagtttgattagtataactagattttagtcctgcgtta

SEQ ID NO: 347858 - DNA, 75 bp, Artificial Sequence
  Synthetic
agtctctagagtgggatggtaactcagtaataaatcaactagcttcgttttgttttctctttggtaactgctttt

SEQ ID NO: 347859 - DNA, 75 bp, Artificial Sequence
  Synthetic
ctggatggccgtattgattatcgagcgtgacactcgctccatattccaataaccgctttgcaaattgtatattat

SEQ ID NO: 347860 - DNA, 75 bp, Artificial Sequence
  Synthetic
tagtttttactcgaaagcgtgattttaatatccaatcttattacttttggaatcgttcaaaacctttgactaatt

SEQ ID NO: 347861 - DNA, 75 bp, Artificial Sequence
  Synthetic
ttcgtcaccagatcgtttgtttcggcctgaagttggtgcatatctttttcaacactcgacatgagatccttaagg

SEQ ID NO: 347862 - DNA, 75 bp, Artificial Sequence
  Synthetic
gtcgtgtagaggatagttgttgtccgtcgtcttatccatggttgctccgttatccaacatgcattgaatgatagg

SEQ ID NO: 347863 - DNA, 75 bp, Artificial Sequence
  Synthetic
tgtaaccgttggagtagtacaagaaatatttccatccgattgttgtgtacatgtagttgttggtaacgtctgaga

SEQ ID NO: 347864 - DNA, 75 bp, Artificial Sequence
  Synthetic
gttttttgatctttattaaatttagagataatatcctgaacagcattgctcggcgtcaacgctggaaggagtgaa

SEQ ID NO: 347865 - DNA, 75 bp, Artificial Sequence
  Synthetic
ctcgccggcgcatcagtatctgcagacagccaatcaaaaagattagacatatcagatgatgtattagtttgttgt

SEQ ID NO: 347866 - DNA, 75 bp, Artificial Sequence
  Synthetic
aatagaatgctcttaaataatgtcatttttttatccgctaaaaatttaaagaatgtataaacctttttcagagat

SEQ ID NO: 347867 - DNA, 75 bp, Artificial Sequence
  Synthetic
acagccaatcaaaaagattagacatatcagatgatgtattagtttgttgtcgtggttttggtgtaggagcagtac

SEQ ID NO: 347868 - DNA, 75 bp, Artificial Sequence
  Synthetic
atgacgtctctcaataagaagattaacgatttccatgtctacattatatggggttactctaaatcgcttgtttag

SEQ ID NO: 347869 - DNA, 75 bp, Artificial Sequence
  Synthetic
gttatatgaatagttggttgtagcggttggataggctgtctgctggcggccgtcatattatctctagctagttgt

SEQ ID NO: 347870 - DNA, 75 bp, Artificial Sequence
  Synthetic
gttggataggctgtctgctggcggccgtcatattatctctagctagttgttctcgcaactgtctttgataatacg

SEQ ID NO: 347871 - DNA, 75 bp, Artificial Sequence
  Synthetic
ggatccttttcttcagaataatagattgacgactttggtgtagaggattctgccagcccctgtgagaacttgtta

SEQ ID NO: 347872 - DNA, 75 bp, Artificial Sequence
  Synthetic
ttgacgactttggtgtagaggattctgccagcccctgtgagaacttgttaaagaagtccatttaaggctttaaaa

SEQ ID NO: 347873 - DNA, 75 bp, Artificial Sequence
  Synthetic
tatgaatccgatgatctcaccgaatacgaggatgatgaagaagaggaagaagatggagagtcactagaaactagt

SEQ ID NO: 347874 - DNA, 75 bp, Artificial Sequence
  Synthetic
acgaggatgatgaagaagaggaagaagatggagagtcactagaaactagtgatatagatcccaaatcttcttata

SEQ ID NO: 347875 - DNA, 75 bp, Artificial Sequence
  Synthetic
aaacatatagggaatcatatatctgctcttaaacgacgctatactagacgtataagtctatttgaaatagcgggt

SEQ ID NO: 347876 - DNA, 75 bp, Artificial Sequence
  Synthetic
ctcttaaacgacgctatactagacgtataagtctatttgaaatagcgggtataatagcagaaagctataacttgc

SEQ ID NO: 347877 - DNA, 75 bp, Artificial Sequence
  Synthetic
aagcaaaatatgctacatgtaattatacaagagatagaggagggttcttgtcctatagtcatcgaaaagaacgga

SEQ ID NO: 347878 - DNA, 75 bp, Artificial Sequence
  Synthetic
acaaagatggtctaaaattccatctagactatattatcaaaatttggaaacttcaaaaacgatattagaatttat

SEQ ID NO: 347879 - DNA, 75 bp, Artificial Sequence
  Synthetic
ttattgtcgtactttatatcgtgttcattaacgatatcttgcaaaatagtaatgattctatcttccttcgataga

SEQ ID NO: 347880 - DNA, 75 bp, Artificial Sequence
  Synthetic
atacccgtctgtttaattttttctacagatattttagttttggcagattctatcgtatctgtcaatagacatcca

SEQ ID NO: 347881 - DNA, 75 bp, Artificial Sequence
  Synthetic
aagaaaactgtacatggaggcactaatgcaaattacttttccggtaaaaagtctgatgagtatctgagtactaca

SEQ ID NO: 347882 - DNA, 75 bp, Artificial Sequence
  Synthetic
ttgatgtcgttattctgaaacagtatgattttaggtagcattttcttaacaaagagaacgtatttattgttactc

SEQ ID NO: 347883 - DNA, 75 bp, Artificial Sequence
  Synthetic
tgattttaggtagcattttcttaacaaagagaacgtatttattgttactcagttgaacagatgatatatccagat

SEQ ID NO: 347884 - DNA, 75 bp, Artificial Sequence
  Synthetic
gatggagtggaagacactgaatcaattgagagattggcagaggagttcttcaatagatcagaacttcaggctggt

SEQ ID NO: 347885 - DNA, 75 bp, Artificial Sequence
  Synthetic
aattgtttgtattcattcaatgtctccttttcagaaattagtttagagtcgaatactgcaataattttcaagaga

SEQ ID NO: 347886 - DNA, 75 bp, Artificial Sequence
  Synthetic
tagttttcatcagataagattttatttagtgtagatatgataaaactattgttttgttggagaacttgatacgcc

SEQ ID NO: 347887 - DNA, 75 bp, Artificial Sequence
  Synthetic
ggacatggttactccttaaaaaaatacgaataatcaccttggctatttagtaagtgtcatttaacactatactca

SEQ ID NO: 347888 - DNA, 75 bp, Artificial Sequence
  Synthetic
gtcagaatctaagacttgatgttcatatattggttcatacatgaaatgatctctattgatgatagtgactatttc

SEQ ID NO: 347889 - DNA, 75 bp, Artificial Sequence
  Synthetic
aaatatgagcattagtatttctgtggattaatagatttctagtatgggatcattaatcatctctaatctctaaat

SEQ ID NO: 347890 - DNA, 75 bp, Artificial Sequence
  Synthetic
gtggctacaaacttttccttttccacatcatctagtttattatataccgatttcacaacggcaccagatttaagg

SEQ ID NO: 347891 - DNA, 75 bp, Artificial Sequence
  Synthetic
catcatctagtttattatataccgatttcacaacggcaccagatttaaggaaccagaatgaaaaactctgataac

SEQ ID NO: 347892 - DNA, 75 bp, Artificial Sequence
  Synthetic
tttcacaacggcaccagatttaaggaaccagaatgaaaaactctgataactacaatatttcatcatagttacgat

SEQ ID NO: 347893 - DNA, 75 bp, Artificial Sequence
  Synthetic
ctggaaccaacgtcataaaaatgtttaaatcaaaatccatatcaacatctgatgcgctaagaccagtctcgcgtt

SEQ ID NO: 347894 - DNA, 75 bp, Artificial Sequence
  Synthetic
taaatcaaaatccatatcaacatctgatgcgctaagaccagtctcgcgttcaagattatctttactaatggtgac

SEQ ID NO: 347895 - DNA, 75 bp, Artificial Sequence
  Synthetic
tactgctatccgcaataaatataaacaaatagacttttatcacgtttatctatgtctaaatattacaaatagtat

SEQ ID NO: 347896 - DNA, 75 bp, Artificial Sequence
  Synthetic
agttgtttaatttatttgtgctcttccagagttgggatagtatttttctaacgtcggtattatattattaggatc

SEQ ID NO: 347897 - DNA, 75 bp, Artificial Sequence
  Synthetic
ccagagttgggatagtatttttctaacgtcggtattatattattaggatctacgttcatatgtatcataatatta

SEQ ID NO: 347898 - DNA, 75 bp, Artificial Sequence
  Synthetic
aaacaaaggagaaaaatatttagctacggcatcagacgcaataacattttttgtaaatgtaacgtatttagacga

SEQ ID NO: 347899 - DNA, 75 bp, Artificial Sequence
  Synthetic
acggcatcagacgcaataacattttttgtaaatgtaacgtatttagacgacagatcttcgttaaaaagttttcca

SEQ ID NO: 347900 - DNA, 75 bp, Artificial Sequence
  Synthetic
cgtctctgtattctacgatagagtgctactttaagatgcgacagatccgtgtcatcaaatatatactccattaaa

SEQ ID NO: 347901 - DNA, 75 bp, Artificial Sequence
  Synthetic
aggagtttgaatagtttgttttggaaatagatccttcaataacttatagttgggtgggaaaaaatcgattttatc

SEQ ID NO: 347902 - DNA, 75 bp, Artificial Sequence
  Synthetic
aatagatccttcaataacttatagttgggtgggaaaaaatcgattttatcactagactctttcttttttactatc

SEQ ID NO: 347903 - DNA, 75 bp, Artificial Sequence
  Synthetic
atcggacgcgttcattggaaaatataccatgtcgttaactataagaatatttttatcctcgtttacaaactgaat

SEQ ID NO: 347904 - DNA, 75 bp, Artificial Sequence
  Synthetic
actatatcatcaccagcacaacatctaactatatgatatccactagtttcctttagtcgtttattatcttgttcc

SEQ ID NO: 347905 - DNA, 75 bp, Artificial Sequence
  Synthetic
aaatgacattttggattctgttacaactttaccaaaattaaggatatacggacttactatctttttctcaacgtc

SEQ ID NO: 347906 - DNA, 75 bp, Artificial Sequence
  Synthetic
gaaaacaacaagggatacaatatttccgcatatcatgaaatatattaagaaatcccaccttattatatttcccca

SEQ ID NO: 347907 - DNA, 75 bp, Artificial Sequence
  Synthetic
aatcccaccttattatatttccccaaaggatccatgcacgtaaacattatgccgttatcattaataaagacttct

SEQ ID NO: 347908 - DNA, 75 bp, Artificial Sequence
  Synthetic
gccgttatcattaataaagacttctttctcatcggatttgtaaaagttgttactgatttttttcattccaggatc

SEQ ID NO: 347909 - DNA, 75 bp, Artificial Sequence
  Synthetic
aaaagatacagcaccatatgctacgttgataaataaatctgaaccactaagtagataatgattaatgttaaggaa

SEQ ID NO: 347910 - DNA, 75 bp, Artificial Sequence
  Synthetic
ctattcttattctttgtattttggcatatcctagaccagtaaacagtttccactttggtaaaatcagcagacttt

SEQ ID NO: 347911 - DNA, 75 bp, Artificial Sequence
  Synthetic
atatcctagaccagtaaacagtttccactttggtaaaatcagcagacttttgaacgctattaaacatggcattaa

SEQ ID NO: 347912 - DNA, 75 bp, Artificial Sequence
  Synthetic
ttcactttaatagatatatggtttttggccaaaatgatagatatttttttatccgaggatagtaaaatattatta

SEQ ID NO: 347913 - DNA, 75 bp, Artificial Sequence
  Synthetic
atccgaggatagtaaaatattattagtcgccgtctctataaaaatgaagctagtctcgatatccaattttattct

SEQ ID NO: 347914 - DNA, 75 bp, Artificial Sequence
  Synthetic
accttatacgttatatctcccttgatgcgttccatttgtgtatctatatcggacacaagatctgtaaatagtttt

SEQ ID NO: 347915 - DNA, 75 bp, Artificial Sequence
  Synthetic
tagtctttttggtcatctctaaacaaggaaactaatacctctacactattgaacgatttatcttccgtaatgggt

SEQ ID NO: 347916 - DNA, 75 bp, Artificial Sequence
  Synthetic
tgcgttccatttgtgtatctatatcggacacaagatctgtaaatagttttacgttattaatcatcacggtatcgc

SEQ ID NO: 347917 - DNA, 75 bp, Artificial Sequence
  Synthetic
aactgttcatcgtttagaataaaatgattaccggtcatattaataaagtgttcatcgtatctagataacaacgac

SEQ ID NO: 347918 - DNA, 75 bp, Artificial Sequence
  Synthetic
gattaccggtcatattaataaagtgttcatcgtatctagataacaacgacttataattaatgtccaagtcttgaa

SEQ ID NO: 347919 - DNA, 75 bp, Artificial Sequence
  Synthetic
atcattttgatattacttataataacgatttgtttaatttttagtttatactattaattgtaaatgatattatta

SEQ ID NO: 347920 - DNA, 75 bp, Artificial Sequence
  Synthetic
tattagtatcagtcacatgaaggactttctgtagagtgacgattctaccatctatggtacgaacggtttcatcct

SEQ ID NO: 347921 - DNA, 75 bp, Artificial Sequence
  Synthetic
atattgttaaactttgattctacagtaatgtccaaatctagttgtggaaatacttccatcaacattgtttcaaac

SEQ ID NO: 347922 - DNA, 75 bp, Artificial Sequence
  Synthetic
gtatatacgaagggattaaaaatagtattatcaacgtaactatattccaaattattcttatgagaatagataata

SEQ ID NO: 347923 - DNA, 75 bp, Artificial Sequence
  Synthetic
tattatcaacgtaactatattccaaattattcttatgagaatagataataatatcgtccttaatatctaacaaat

SEQ ID NO: 347924 - DNA, 75 bp, Artificial Sequence
  Synthetic
ctcttaactatttccggctgttgtatatttaaatgacttcgtaaaaaataatatatgggcgacttctcatctatg

SEQ ID NO: 347925 - DNA, 75 bp, Artificial Sequence
  Synthetic
gaaagctgggggatgttctggttcgacatccaccgatggtgtcacatcactaatcggttcggtaacgtctgtgga

SEQ ID NO: 347926 - DNA, 75 bp, Artificial Sequence; identical to SEQ ID NO: 45066
  Synthetic

SEQ ID NO: 347927 - DNA, 75 bp, Artificial Sequence
  Synthetic
tatttaaatgacttcgtaaaaaataatatatgggcgacttctcatctatgtaatcatatggagtgagatataggg

SEQ ID NO: 347928 - DNA, 75 bp, Artificial Sequence
  Synthetic
actatatatcgcatatttatatcgtggggtaaagtgaaaatctactaccgatgatgtaagtcttacaatgttcga

SEQ ID NO: 347929 - DNA, 75 bp, Artificial Sequence
  Synthetic
accagtaccagatcttaatttggaggcctccgtagaactaggggaggtaaatatagatcaaacaacacctatgat

SEQ ID NO: 347930 - DNA, 75 bp, Artificial Sequence
  Synthetic
gatctaaggatgatgagagaaaactagcactacgattctttttacaaagactttattttttagatcatagagaga

SEQ ID NO: 347931 - DNA, 75 bp, Artificial Sequence
  Synthetic
agcactacgattctttttacaaagactttattttttagatcatagagagattcattatttgttcagatgcgttga

SEQ ID NO: 347932 - DNA, 75 bp, Artificial Sequence
  Synthetic
cttatatagcacttttaactatcgcatcaaaaggatgcaaacttacagaaacaatgattgaagcattctttccag

SEQ ID NO: 347933 - DNA, 75 bp, Artificial Sequence
  Synthetic
atcaaaaggatgcaaacttacagaaacaatgattgaagcattctttccagaactatataatgaacatagtaagaa

SEQ ID NO: 347934 - DNA, 75 bp, Artificial Sequence
  Synthetic
cgctatacggtactatggtattgataaaattaatgagattgtcgaagctatgagcgaaggagaccactacatcaa

SEQ ID NO: 347935 - DNA, 75 bp, Artificial Sequence
  Synthetic
agtttggaaactatcacgtttatgattttgaaccgtattactctacagtagctctggctattcgagatgaacatt

SEQ ID NO: 347936 - DNA, 75 bp, Artificial Sequence
  Synthetic
ttttgaaccgtattactctacagtagctctggctattcgagatgaacattcatctggcatttttaatatccgtca

SEQ ID NO: 347937 - DNA, 75 bp, Artificial Sequence
  Synthetic
tcgacggatgagttaatgtatatttttgccgccttgggtggatctgtaaacatttgggccattatacctctcagt

SEQ ID NO: 347938 - DNA, 75 bp, Artificial Sequence
  Synthetic
taattaatctaaaatctgatcttgttcaatggagtgctagtacgggcgctgtaattaatcaaatggtaaatactg

SEQ ID NO: 347939 - DNA, 75 bp, Artificial Sequence
  Synthetic
taccattaataatgcaagcataaaaaatcgttagtagatgtttctaaatataggttccgtaagcaaagaatataa

SEQ ID NO: 347940 - DNA, 75 bp, Artificial Sequence
  Synthetic
gtaattaatcaaatggtaaatactgtattgattacagtgtatgaaaagttacaactggtcatagaaaatgattca

SEQ ID NO: 347941 - DNA, 75 bp, Artificial Sequence
  Synthetic
taaagatagaaatgaattatttacaaaattcatcaacgagttaaaaaagaccagttcattcaagataagcaaacg

SEQ ID NO: 347942 - DNA, 75 bp, Artificial Sequence
  Synthetic
tttttttatagagtgtggtagtgttacggatatctaatattaatattagactatctctatcgcgctacacgacca

SEQ ID NO: 347943 - DNA, 75 bp, Artificial Sequence
  Synthetic
ccagttcattcaagataagcaaacgcgataaggatacgctattaaaatattttacttaggactggagttagaatt

SEQ ID NO: 347944 - DNA, 75 bp, Artificial Sequence
  Synthetic
tccgtctatcatctatagaaaacatattctatgaatttataaaatgcttttacgtgtcctatcgtaggcgataga

SEQ ID NO: 347945 - DNA, 75 bp, Artificial Sequence
  Synthetic
ctaaatacattatcatgcttgcaatggctctaacaacgacgaaccaaaatgaatttggtcgtagcttttgttcac

SEQ ID NO: 347946 - DNA, 75 bp, Artificial Sequence
  Synthetic
ggctctaacaacgacgaaccaaaatgaatttggtcgtagcttttgttcacaaaaatacataaagaaatgtctaca

SEQ ID NO: 347947 - DNA, 75 bp, Artificial Sequence
  Synthetic
attagatttcgaacgaaggcctccttcgttttataaaccattagataaagttgatctcaagccgtcttttctggt

SEQ ID NO: 347948 - DNA, 75 bp, Artificial Sequence
  Synthetic
gtattaagattaactccataatgtctagcagcatctgcgatgttataagcgtcgtcaaagcggggtcgatcttgt

SEQ ID NO: 347949 - DNA, 75 bp, Artificial Sequence
  Synthetic
gaatttggtcgtagcttttgttcacaaaaatacataaagaaatgtctacataaatctatggcgccattggctact

SEQ ID NO: 347950 - DNA, 75 bp, Artificial Sequence
  Synthetic
catttattcatcatcaaaagagacagagtcaccatctgtcatatttagattttttttcatgtgttcaaagtatcc

SEQ ID NO: 347951 - DNA, 75 bp, Artificial Sequence
  Synthetic
gagtcaccatctgtcatatttagattttttttcatgtgttcaaagtatcctctactcatttcattataatagttt

SEQ ID NO: 347952 - DNA, 75 bp, Artificial Sequence
  Synthetic
gatattcgaaaatctgtggagtttcaggttttggtggaggtgtaactgctacttgggatactgaagtctgatatt

SEQ ID NO: 347953 - DNA, 75 bp, Artificial Sequence
  Synthetic
gtcagtagtaatttgtgcatcgtctattctgcatccgcttcgtcgaataatgtatagcatcgctttgagattctc

SEQ ID NO: 347954 - DNA, 75 bp, Artificial Sequence
  Synthetic
attctgcatccgcttcgtcgaataatgtatagcatcgctttgagattctccatagctatcaagtctttatacaat

SEQ ID NO: 347955 - DNA, 75 bp, Artificial Sequence
  Synthetic
gatctgaagaagaggtaagatatctactagaaagataccgatcacgttctagttctcttttgtagaacttaactt

SEQ ID NO: 347956 - DNA, 75 bp, Artificial Sequence
  Synthetic
aacatcatcgcctactttagcattgaaaatacgttctattgtgtagatggatgtaacaagatttttaaacaacaa

SEQ ID NO: 347957 - DNA, 75 bp, Artificial Sequence
  Synthetic
aacttaactttttctttctccgcatctagttgatattccaacctcttcacgttcgcatgggttacctccgcagtt

SEQ ID NO: 347958 - DNA, 75 bp, Artificial Sequence
  Synthetic
gctgactagcatattattatctttagaaattgtattcttcaatgaagcgtttatcatatctgtgatttcgttagt

SEQ ID NO: 347959 - DNA, 75 bp, Artificial Sequence
  Synthetic
gaaattgtattcttcaatgaagcgtttatcatatctgtgatttcgttagtcatattacagtctgactgggttgta

SEQ ID NO: 347960 - DNA, 75 bp, Artificial Sequence
  Synthetic
aataatcctatctaagatgttgtatggcattgcgcagaaaatatcttctcctgtaatatctccactctcgataaa

SEQ ID NO: 347961 - DNA, 75 bp, Artificial Sequence
  Synthetic
ggcattgcgcagaaaatatcttctcctgtaatatctccactctcgataaatctactcagattattcttaaatgcc

SEQ ID NO: 347962 - DNA, 75 bp, Artificial Sequence
  Synthetic
cgcagaaaagataccacgagtatcaattctatccaagatacttatcggttccgagtcacagataatggtttcctc

SEQ ID NO: 347963 - DNA, 75 bp, Artificial Sequence
  Synthetic
attctatccaagatacttatcggttccgagtcacagataatggtttcctctccttcgggagatcctgcatagaaa

SEQ ID NO: 347964 - DNA, 75 bp, Artificial Sequence
  Synthetic
ttccctggcacgtttaagatcttcatgcaattgagtcagctcttaacacaatctcttgcttcttcgtcatagtac

SEQ ID NO: 347965 - DNA, 75 bp, Artificial Sequence
  Synthetic
atctcttgcttcttcgtcatagtacttacaatcactatgggatccattgttaccacgtctacactcggcgagctc

SEQ ID NO: 347966 - DNA, 75 bp, Artificial Sequence
  Synthetic
gtcactaactgataccatgaaattgagaagatcaaacgctgaagtaatcaatttttctgcctcgtttttactaca

SEQ ID NO: 347967 - DNA, 75 bp, Artificial Sequence
  Synthetic
ttgtattggtccatgtttccattgctaccaccattagatttacaggctgctagttgtcgttcgagatcagaaata

SEQ ID NO: 347968 - DNA, 75 bp, Artificial Sequence
  Synthetic
tagataggtaattacagtgatgcctacatgccgttttttgaaactgaatagatgcgtctagaagcgatgctacac

SEQ ID NO: 347969 - DNA, 75 bp, Artificial Sequence
  Synthetic
atcataaacacggagtttattttatatgtctcgcataaacattactaaaaaaatatattgttctgtttttctttt

SEQ ID NO: 347970 - DNA, 75 bp, Artificial Sequence
  Synthetic
gtcaccttaaagcccattgatgcgaatagcagatagataaagtcttggtatgactcctttctaatatagtacgga

SEQ ID NO: 347971 - DNA, 75 bp, Artificial Sequence
  Synthetic
ccacataagccataacaacctctttaatagccgtttcatgaggtttatcagccataagcctgagtagttggaaga

SEQ ID NO: 347972 - DNA, 75 bp, Artificial Sequence
  Synthetic
tctttcctgggaaactctcgtatagtcatagatgaaatactcttcaaagtttctgaaataagattagtaacagtc

SEQ ID NO: 347973 - DNA, 75 bp, Artificial Sequence
  Synthetic
tccagaaggcggtaatagaatacgatgatattaaaattatttctaataacactaccagtatcaatttatcatata

SEQ ID NO: 347974 - DNA, 75 bp, Artificial Sequence
  Synthetic
aacatactctaataggtgttttctctgcggagataatatcagaaaggatagagcaataagtagtattattgtgat

SEQ ID NO: 347975 - DNA, 75 bp, Artificial Sequence
  Synthetic
gagcaataagtagtattattgtgattataaagaccgaatacataacaggtagaatttataaacatcatgtcctga

SEQ ID NO: 347976 - DNA, 75 bp, Artificial Sequence
  Synthetic
cataataataagttgtggtagtatgatctccatatttataatttaggactttgtattcagtatttttggaatcat

SEQ ID NO: 347977 - DNA, 75 bp, Artificial Sequence
  Synthetic
ctgcagcattttgaggatttcgagtatgaagtacgatgttattgtttactggtatatctggaaagaattctacca

SEQ ID NO: 347978 - DNA, 75 bp, Artificial Sequence
  Synthetic
atgaagtacgatgttattgtttactggtatatctggaaagaattctaccagtctaggaataagagattgatatcg

SEQ ID NO: 347979 - DNA, 75 bp, Artificial Sequence
  Synthetic
ctgttgttctacgtctaggagcaccagaagtatttttggagcccttggatgttgatgtagaagaagacgaggatt

SEQ ID NO: 347980 - DNA, 75 bp, Artificial Sequence
  Synthetic
tcatcatcgaagagcattttgttaccattgtaataaatatccactctgtcatatgtataaatgaagtactgttca

SEQ ID NO: 347981 - DNA, 75 bp, Artificial Sequence
  Synthetic
atatgtataaatgaagtactgttcaaacatgatgagatgtttatatgttggcatagtagtgagatcgacgtttgg

SEQ ID NO: 347982 - DNA, 75 bp, Artificial Sequence
  Synthetic
gcatagtagtgagatcgacgtttggtaatggcaatgtattaagattaactccataatgtctagcagcatctgcga

SEQ ID NO: 347983 - DNA, 75 bp, Artificial Sequence
  Synthetic
ctaacacctataagattatcaaaatcttgtctgcttaatacaccgttaacaatttttgccttgaattcttttatt

SEQ ID NO: 347984 - DNA, 75 bp, Artificial Sequence
  Synthetic
cttgtctgcttaatacaccgttaacaatttttgccttgaattcttttattggtgcattaataacatccttataga

SEQ ID NO: 347985 - DNA, 75 bp, Artificial Sequence
  Synthetic
aagacggtattcgacttggtgtttgaaaacagaaacatcatatacaaggcggatgttgtgaatgacatcatccac

SEQ ID NO: 347986 - DNA, 75 bp, Artificial Sequence
  Synthetic
tctgctagaacatccattgagtcggagccatctggtttaatataaccaccgataaatctagctctgtattctgta

SEQ ID NO: 347987 - DNA, 75 bp, Artificial Sequence
  Synthetic
agccatctggtttaatataaccaccgataaatctagctctgtattctgtatccgtcaatctaatattaagaaggt

SEQ ID NO: 347988 - DNA, 75 bp, Artificial Sequence
  Synthetic
aagatcatgaacacgatgatatagaatcattggtgtgattagtttcctttttataaaattgaagtaatatttagt

SEQ ID NO: 347989 - DNA, 75 bp, Artificial Sequence
  Synthetic
ttagtttccgaactaatgttaattggggtattaataatatctatatttccagcgttaagtgtaacattaaacagt

SEQ ID NO: 347990 - DNA, 75 bp, Artificial Sequence
  Synthetic
ttaaataattaatgcccaatttggatatagcagcctgaagctcatcttgtttagttacggatcctaatgagttat

SEQ ID NO: 347991 - DNA, 75 bp, Artificial Sequence
  Synthetic
aatataatcttcagtattggataaatatcaattcaaattaattccattagattatatcataaataaaaatagtag

SEQ ID NO: 347992 - DNA, 75 bp, Artificial Sequence
  Synthetic
actttgtaatctagacatagatgcggaagaacggtagaaactatacgaaataaatattcagagtcctctaattga

SEQ ID NO: 347993 - DNA, 75 bp, Artificial Sequence
  Synthetic
gaagaacggtagaaactatacgaaataaatattcagagtcctctaattgatcaagagtaactattgacttaatag

SEQ ID NO: 347994 - DNA, 75 bp, Artificial Sequence
  Synthetic
ttttttgaaacgccatctatcgtagtgaggacacaagtgaacctataattatcaaatttattagtatcagtcaca

SEQ ID NO: 347995 - DNA, 75 bp, Artificial Sequence
  Synthetic
tagaatgctcttaaataatgtcatttttttatccgctaaaaatttaaagaatgtataaacttttttcaaagattt

SEQ ID NO: 347996 - DNA, 75 bp, Artificial Sequence
  Synthetic
aaacgatttaattacagagttttcagaagataattatccatctaacaaaaattatgaaataactcttcgtcaaat

SEQ ID NO: 347997 - DNA, 75 bp, Artificial Sequence
  Synthetic
gaagataattatccatctaacaaaaattatgaaataactcttcgtcaaatgtctattctaactcacgttaacaac

SEQ ID NO: 347998 - DNA, 75 bp, Artificial Sequence
  Synthetic
atatgttccacacatcctgaacaatgaaattctccagaagatgttacaatgtctagatttggacatttggtttca

SEQ ID NO: 347999 - DNA, 75 bp, Artificial Sequence
  Synthetic
taatgtttttattgttttacgtacctgggtattcaattactacaaaaattactccagcagtagaatatctaatgg

SEQ ID NO: 348000 - DNA, 75 bp, Artificial Sequence
  Synthetic
tcgaaaaatgctgaagcaataatggaatctagatctatgataacttctatgccaacacaaacaccatccttggga

SEQ ID NO: 348001 - DNA, 75 bp, Artificial Sequence
  Synthetic
aatctagatctatgataacttctatgccaacacaaacaccatccttgggagtagtttatgataaagataaaagaa

SEQ ID NO: 348002 - DNA, 75 bp, Artificial Sequence
  Synthetic
tgattaatgttaaggaagaggaaatattcagtatatagatatgccttagcatcatatcttgtactaaacacgcta

SEQ ID NO: 348003 - DNA, 75 bp, Artificial Sequence
  Synthetic
aacagtttattgatgtgatcaatttccaacagaataattagagcagcgggaataccaacaaacatattaccacat

SEQ ID NO: 348004 - DNA, 75 bp, Artificial Sequence
  Synthetic
aataccaacaaacatattaccacatccgtattttctatgaatatcacatatcatgttaaaaaatcttgatagaag

SEQ ID NO: 348005 - DNA, 75 bp, Artificial Sequence
  Synthetic
ctacgctagtcacaatcaccactttcatatttagaatatatgtatgtaaaaatatagtagaatttcattttgttt

SEQ ID NO: 348006 - DNA, 75 bp, Artificial Sequence
  Synthetic
aattcttaattgcaaagatctatataatcattatagcgttgacttatggactctggaatcttagacgatgtacag

SEQ ID NO: 348007 - DNA, 75 bp, Artificial Sequence
  Synthetic
ataaaacgattaaacaatatcacgaaagtagaaaacgaaaaattatcgtcactaacgtgattattattgtcataa

SEQ ID NO: 348008 - DNA, 75 bp, Artificial Sequence
  Synthetic
actcggatttgaagaaatcaaaggactgagtaccgatatcacttcagaaattatcgatgtggagatcggagatga

SEQ ID NO: 348009 - DNA, 75 bp, Artificial Sequence
  Synthetic
ttatcgatgtggagatcggagatgactgcgatgctgtagcatctaaactaggaatcggtaacagtccggttctta

SEQ ID NO: 348010 - DNA, 75 bp, Artificial Sequence
  Synthetic
ctgcgatgctgtagcatctaaactaggaatcggtaacagtccggttcttaatattgtattgtttatactcaagat

SEQ ID NO: 348011 - DNA, 75 bp, Artificial Sequence
  Synthetic
tccgatgatatctctaaacttcaatctgttaagattaatttcgaatttgtatgtttgggagaattaaatccagac

SEQ ID NO: 348012 - DNA, 75 bp, Artificial Sequence
  Synthetic
acaacaatcgtctggattaatctgttcctgtcgtctcataccggacgacatattaatctttttattagtaggcat

SEQ ID NO: 348013 - DNA, 75 bp, Artificial Sequence
  Synthetic
agatctcccatgtggtggaatactaccatctatcgcatgtggatggacagtaggtaatggccatgggaacagtaa

SEQ ID NO: 348014 - DNA, 75 bp, Artificial Sequence
  Synthetic
ataagacatgtcacaaagaccctttttgtatgtataagtgtaaaaattataacatccatagttggatttacatag

SEQ ID NO: 348015 - DNA, 75 bp, Artificial Sequence
  Synthetic
agtattactgcatattgtcccaatgtttcgatgtgatgttctaacctatcaactgccgctgtatcacaacaatag

SEQ ID NO: 348016 - DNA, 75 bp, Artificial Sequence
  Synthetic
tccacgaacttctaattggccgtctctgacggtaccataaactattttaccagcattagtaacagcttggacaat

SEQ ID NO: 348017 - DNA, 75 bp, Artificial Sequence
  Synthetic
tccgagttcattgttttcaatatcaaaaagatggtttccttatcatttctccatagtggtacaatactacacatt

SEQ ID NO: 348018 - DNA, 75 bp, Artificial Sequence
  Synthetic
tgtatcacatgcgccggcagtcacatctgtttgagaattaagattattgttgcctcctttgacggctgcatctcc

SEQ ID NO: 348019 - DNA, 75 bp, Artificial Sequence
  Synthetic
ttattagtctgtctgtagataaactaggatttaaacaagaaagttatcggaaacatcaagaatccgatcccactt

SEQ ID NO: 348020 - DNA, 75 bp, Artificial Sequence
  Synthetic
tctgtttgagaattaagattattgttgcctcctttgacggctgcatctccaccgatttgcgctagtagattttta

SEQ ID NO: 348021 - DNA, 75 bp, Artificial Sequence
  Synthetic
tctaacggctaaattttttttatccgccatttagaagctaaaaatatttttatttatgcagaagatttaactaga

SEQ ID NO: 348022 - DNA, 75 bp, Artificial Sequence
  Synthetic
tatttatgcagaagatttaactagattatacaatgaactaatatgatccttttccagattatttacaaacttggt

SEQ ID NO: 348023 - DNA, 75 bp, Artificial Sequence
  Synthetic
attttttggttctggaggaggcgaatttaaattcggacttggatttggattttgtaagttcttgatcttattata

SEQ ID NO: 348024 - DNA, 75 bp, Artificial Sequence
  Synthetic
tgattccgtgattaattagacatttaacaacttccggacgcacatatgctctcgtatccgactttgaatacagat

SEQ ID NO: 348025 - DNA, 75 bp, Artificial Sequence
  Synthetic
aaagaataccaatcatttattgacaataacttcactattgatcaagtatgcaatatatcatcttttcactaaata

SEQ ID NO: 348026 - DNA, 75 bp, Artificial Sequence
  Synthetic
caatatatcatcttttcactaaataagtagtaataatgattcaacaatgtcgagatatatggacgataataattt

SEQ ID NO: 348027 - DNA, 75 bp, Artificial Sequence
  Synthetic
atctctttattatgaaaaccggcattatgatcatatatgtcgtgatatacctgtgatccgtttacgttaaaccat

SEQ ID NO: 348028 - DNA, 75 bp, Artificial Sequence
  Synthetic
tggggcgcgcagtgctttccccacatagaataaattagcattccgactgtgataataataccaagtataaacgcc

SEQ ID NO: 348029 - DNA, 75 bp, Artificial Sequence
  Synthetic
tagaataaattagcattccgactgtgataataataccaagtataaacgccataatactcaatactttccatgtac

SEQ ID NO: 348030 - DNA, 75 bp, Artificial Sequence
  Synthetic
catatagctgaatatattaaagtcatttatgttgctaaatccagtggcttctagtagagccatcgctatatcctt

SEQ ID NO: 348031 - DNA, 75 bp, Artificial Sequence
  Synthetic
agaatcaaaagaatgattccagcgattagcacgccggaaaaataatttccaatcataagcatcatgtccatttaa

SEQ ID NO: 348032 - DNA, 75 bp, Artificial Sequence
  Synthetic
ttagcacgccggaaaaataatttccaatcataagcatcatgtccatttaactaataaaaattttaaatcgccgaa

SEQ ID NO: 348033 - DNA, 75 bp, Artificial Sequence
  Synthetic
aataatatctatttttgttttcgaagatatggtaaaattaaatagtagtacacagcatgttataactaacagcag

SEQ ID NO: 348034 - DNA, 75 bp, Artificial Sequence
  Synthetic
gatatggtaaaattaaatagtagtacacagcatgttataactaacagcagcaacggctcgtaattacttatcatt

SEQ ID NO: 348035 - DNA, 75 bp, Artificial Sequence
  Synthetic
tatcacccatccattttatgcgatgtttatatactctaatctttaatagatctatagacgacgggtttaccaaca

SEQ ID NO: 348036 - DNA, 75 bp, Artificial Sequence
  Synthetic
tttatatactctaatctttaatagatctatagacgacgggtttaccaacaatatagattttatcgattcatctaa

SEQ ID NO: 348037 - DNA, 75 bp, Artificial Sequence
  Synthetic
ctctacctgatgaatcggacaatgtactgggccatgtagaataaattatcaacgaattatcgtctacgaacattt

SEQ ID NO: 348038 - DNA, 75 bp, Artificial Sequence
  Synthetic
gacaagtttaacaataaaattaatcacgagtaccctactaccaacctacactattatatgattatagtttctatt

SEQ ID NO: 348039 - DNA, 75 bp, Artificial Sequence
  Synthetic
aataacagatattacaaccagtgttatggccgcgcccaaccaggtaggcagttttattttatcttttactacagg

SEQ ID NO: 348040 - DNA, 75 bp, Artificial Sequence
  Synthetic
tatcggctcaaagagaattgttaaaattccgtatatagcacaaatgtgcttaaacgacgaaggtggtccatcatc

SEQ ID NO: 348041 - DNA, 75 bp, Artificial Sequence
  Synthetic
tagacgtaagttccgcttgggaattttttaacgctaaagagttaacgttaatcgtgcacccaacgtatttacatc

SEQ ID NO: 348042 - DNA, 75 bp, Artificial Sequence
  Synthetic
ttttaacgctaaagagttaacgttaatcgtgcacccaacgtatttacatctagttctttgaacatcttgattata

SEQ ID NO: 348043 - DNA, 75 bp, Artificial Sequence
  Synthetic
ataccctaggtcctaaatatttatctccggaattagattttggataattcgcgcaccaacaatttctatttcctt

SEQ ID NO: 348044 - DNA, 75 bp, Artificial Sequence
  Synthetic
tccggaattagattttggataattcgcgcaccaacaatttctatttcctttatgatcgttacaaaagacgtataa

SEQ ID NO: 348045 - DNA, 75 bp, Artificial Sequence
  Synthetic
tttaatagcctcacacacaatctctgcgttagaacgttcgtcgatatagattttagacatttttagagagaacta

SEQ ID NO: 348046 - DNA, 75 bp, Artificial Sequence
  Synthetic
cagaacaatatctcgcatccatatgtttggagcaaatatcggaataagtagacatagccggtttccgttttgcac

SEQ ID NO: 348047 - DNA, 75 bp, Artificial Sequence
  Synthetic
gggtaggagaatccgaaatattaaaccagacaaccccatataattttatagctaaaaatgccacgaagaatggaa

SEQ ID NO: 348048 - DNA, 75 bp, Artificial Sequence
  Synthetic
tccaggatcgtttctacaaaatccagtcatgaaatcatcacaatgttctgtcttgtaattattattaaatatttt

SEQ ID NO: 348049 - DNA, 75 bp, Artificial Sequence
  Synthetic
tatcgcccaggagataatccttttttataaaatgacatcgttgcccggatgctatataatcagtagcgtgtttta

SEQ ID NO: 348050 - DNA, 75 bp, Artificial Sequence
  Synthetic
tataaaatgacatcgttgcccggatgctatataatcagtagcgtgttttaaatccttaatatattcaggagttac

SEQ ID NO: 348051 - DNA, 75 bp, Artificial Sequence
  Synthetic
atggttctccatgaattaatacatattgtttagcaaattcaggaactataaaactactacaatgatctatcgaca

SEQ ID NO: 348052 - DNA, 75 bp, Artificial Sequence
  Synthetic
tctactaagcccaaaaccaaacgagccactactcctcgtaaaccagcggctactaaaagatcaaccaaaaaggag

SEQ ID NO: 348053 - DNA, 75 bp, Artificial Sequence
  Synthetic
caaacttaacagctctattatattcaggataattaaaacctaattccatatatttgtctcgtatatctgctattc

SEQ ID NO: 348054 - DNA, 75 bp, Artificial Sequence
  Synthetic
aggataattaaaacctaattccatatatttgtctcgtatatctgctattcctggtgctattttgattctattaag

SEQ ID NO: 348055 - DNA, 75 bp, Artificial Sequence
  Synthetic
tgttggtatatcaacatctaccttatttcccgcagtataaggtttgttgcaggtatactgttcaggaatggttac

SEQ ID NO: 348056 - DNA, 75 bp, Artificial Sequence
  Synthetic
atttatacttcttctatagtcctgtctttcgatgttcatcacatatgcaaagaacagaataaacaaaataatgta

SEQ ID NO: 348057 - DNA, 75 bp, Artificial Sequence
  Synthetic
acacttatgtattaactttgttcatttatattttttcattattatgttgatattaacaaaagtgaatatatatat

SEQ ID NO: 348058 - DNA, 75 bp, Artificial Sequence
  Synthetic
taattacagcagctacaatacacacaatagacattcccacagtgttgccattacctccacgatacatttgagtta

SEQ ID NO: 348059 - DNA, 75 bp, Artificial Sequence
  Synthetic
aatagacattcccacagtgttgccattacctccacgatacatttgagttactaagcaataggtaataactaagct

SEQ ID NO: 348060 - DNA, 75 bp, Artificial Sequence
  Synthetic
cacaatctaatattgataaaatctccattctcttctctgcatttattatcttgtttcggtggctgattaggctgt

SEQ ID NO: 348061 - DNA, 75 bp, Artificial Sequence
  Synthetic
gaggagggctatatagagccaagacgaacaaaatcaaaccgagtaacgttctaacatcattatttttgaagattc

SEQ ID NO: 348062 - DNA, 75 bp, Artificial Sequence
  Synthetic
gaacaaaatcaaaccgagtaacgttctaacatcattatttttgaagattcccaaataatcattcattcctccata

SEQ ID NO: 348063 - DNA, 75 bp, Artificial Sequence
  Synthetic
aaatattaatattgattcttacacgatgaaatatctactaaaaaaggaagggagatgccatcaattatctcgatt

SEQ ID NO: 348064 - DNA, 75 bp, Artificial Sequence
  Synthetic
gaactattaatctcatcagacatatcgtgtgcatgcgtggagttaaattcatatcacgtagccattcttcccatg

SEQ ID NO: 348065 - DNA, 75 bp, Artificial Sequence
  Synthetic
cctctgtaaataaatctttatcaagcactccagcacccgcagagaagtcgtcaagcatattgtaatatcttaaat

SEQ ID NO: 348066 - DNA, 75 bp, Artificial Sequence
  Synthetic
cactattaaagatggagtataatctttatgccgaactaaaaaaaatgacttgtggtcaacccctaagtcttttta

SEQ ID NO: 348067 - DNA, 75 bp, Artificial Sequence
  Synthetic
tgtggtcaacccctaagtctttttaacgaagacggggatttcgtagaagttgaaccgggatcatcctttaagttt

SEQ ID NO: 348068 - DNA, 75 bp, Artificial Sequence
  Synthetic
acgaagacggggatttcgtagaagttgaaccgggatcatcctttaagtttctgatacctaagggattttacgcct

SEQ ID NO: 348069 - DNA, 75 bp, Artificial Sequence
  Synthetic
tgtttgtatcttattcgtcttttatggaatagttttttactagtaaagctgcaattacacactttgtccgtaaaa

SEQ ID NO: 348070 - DNA, 75 bp, Artificial Sequence
  Synthetic
aataaaatcactagtatcaatccaacaaatgcgccaaagttatatcctcttcaacgcaaagtcgtatctgaagta

SEQ ID NO: 348071 - DNA, 75 bp, Artificial Sequence
  Synthetic
caaatgcgccaaagttatatcctcttcaacgcaaagtcgtatctgaagtagtttctaatatgaggaaaatgatcg

SEQ ID NO: 348072 - DNA, 75 bp, Artificial Sequence
  Synthetic
ataataaactaaacaaaactggtttagctaatactaattatatcacaacatctataaaagtagagaatgaggata

SEQ ID NO: 348073 - DNA, 75 bp, Artificial Sequence
  Synthetic
aagactattaccacgtgttatcttatggctacacacggtagaaaaaccgtcatttgcgtacccaataaaatgtta

SEQ ID NO: 348074 - DNA, 75 bp, Artificial Sequence
  Synthetic
tggctacacacggtagaaaaaccgtcatttgcgtacccaataaaatgttaatacatcaatggaagacacaggtag

SEQ ID NO: 348075 - DNA, 75 bp, Artificial Sequence
  Synthetic
ttaaaggaactaaagactcaaagtccggatgtattaatagtagtcagtagacatctgacaaacgatgccttttgt

SEQ ID NO: 348076 - DNA, 75 bp, Artificial Sequence
  Synthetic
cggatgtattaatagtagtcagtagacatctgacaaacgatgccttttgtaaatatatcaataagcattatgatt

SEQ ID NO: 348077 - DNA, 75 bp, Artificial Sequence
  Synthetic
tataccatcaaatacaaaatattcgagcaacaataagtattttttatacctttaaaattgataaataaatttttt

SEQ ID NO: 348078 - DNA, 75 bp, Artificial Sequence
  Synthetic
ctaaacatcgtaacatcttctggagaatttcgttgcactggatgtgtgaaatttatgcctaattttagctacatg

SEQ ID NO: 348079 - DNA, 75 bp, Artificial Sequence
  Synthetic
tggacccatccttttattctagatttagaaatgctatcgaaagcaaattaaaccaacacgctaatcgttataata

SEQ ID NO: 348080 - DNA, 75 bp, Artificial Sequence
  Synthetic
tggaccatctaataaatatcatatatataccgagaagttattatctgtagacgagcctagaaatcaacttattct

SEQ ID NO: 348081 - DNA, 75 bp, Artificial Sequence
  Synthetic
tagaaatgctatcgaaagcaaattaaaccaacacgctaatcgttataataggttcgaacacgatagagatcgcgt

SEQ ID NO: 348082 - DNA, 75 bp, Artificial Sequence
  Synthetic
aatttcgttgcactggatgtgtgaaatttatgcctaattttagctacatgtattggttggcaaaggatatgagat

SEQ ID NO: 348083 - DNA, 75 bp, Artificial Sequence
  Synthetic
gatgaaaccgttcgtaccatagatggtagaatcgtcactctacagaaagtccttcatgtgactgatactaataaa

SEQ ID NO: 348084 - DNA, 75 bp, Artificial Sequence
  Synthetic
atgtacaaatattaaaatctatttccatcactaataatataacactatacgatactattataaataagtcagagt

SEQ ID NO: 348085 - DNA, 75 bp, Artificial Sequence
  Synthetic
catcactaataatataacactatacgatactattataaataagtcagagtttcctatacgtcgtgcaaatgacaa

SEQ ID NO: 348086 - DNA, 75 bp, Artificial Sequence
  Synthetic
ttataggagacgcccaaaatagacgtactccagatatggtcaaatcaatcaaggaactaaatagatttatattcg

SEQ ID NO: 348087 - DNA, 75 bp, Artificial Sequence
  Synthetic
tactccagatatggtcaaatcaatcaaggaactaaatagatttatattcgtatccaccttattttattccggtac

SEQ ID NO: 348088 - DNA, 75 bp, Artificial Sequence
  Synthetic
tgtgtgctactatttttattcatgataatataatctaaatgcaattgtcttgagaatccatccaatacggcagat

SEQ ID NO: 348089 - DNA, 75 bp, Artificial Sequence
  Synthetic
aagttattaaaaatgcattagagaaatgcactctgactaatgccgtcctcgagtatatgatgtcatctcgatctc

SEQ ID NO: 348090 - DNA, 75 bp, Artificial Sequence
  Synthetic
taatataatctaaatgcaattgtcttgagaatccatccaatacggcagattatattagaaacaacgaattgaatt

SEQ ID NO: 348091 - DNA, 75 bp, Artificial Sequence
  Synthetic
atgcactctgactaatgccgtcctcgagtatatgatgtcatctcgatctcaatcatcttatttgagtcgtattcc

SEQ ID NO: 348092 - DNA, 75 bp, Artificial Sequence
  Synthetic
tcaacaatatgcaaatagagcaattactagggagggtatgtcgagaaacagaactattagataggacggtatatg

SEQ ID NO: 348093 - DNA, 75 bp, Artificial Sequence
  Synthetic
gtaatctatatacaagatatatgagagagaatgatatcacagagtatcatatagagaatacgaggtctgtttcta

SEQ ID NO: 348094 - DNA, 75 bp, Artificial Sequence
  Synthetic
gtttctctatgggtccatctatgagaaacccacaggatgtattcagtcagacaatgtctgacgtcggccacggta

SEQ ID NO: 348095 - DNA, 75 bp, Artificial Sequence
  Synthetic
agagaatgatatcacagagtatcatatagagaatacgaggtctgtttctacacagacatgaataatgaatacaca

SEQ ID NO: 348096 - DNA, 75 bp, Artificial Sequence
  Synthetic
ttcagggagtccttagtagcgtggcaatgacagggtctgaactgggcacaaggaaaggccattgtaaaggtagac

SEQ ID NO: 348097 - DNA, 75 bp, Artificial Sequence
  Synthetic
ttgtattcctgtatctctagataagttagtcatatagtcccttccggcgatacgttttttccaagcccgaaattg

SEQ ID NO: 348098 - DNA, 75 bp, Artificial Sequence
  Synthetic
cctccagagaagaacgtgtattaaatagaatatttaactcgcaaaatcgttaagaagtttaagcgacgatccgca

SEQ ID NO: 348099 - DNA, 75 bp, Artificial Sequence
  Synthetic
tagaatatttaactcgcaaaatcgttaagaagtttaagcgacgatccgcatgctgcgcaggccagtgtattaccc

SEQ ID NO: 348100 - DNA, 75 bp, Artificial Sequence
  Synthetic
attataatattgaaatcgtaatttgagttgtttgataatcatggatatcaaaaatgatatacgtaacattagcaa

SEQ ID NO: 348101 - DNA, 75 bp, Artificial Sequence
  Synthetic
ataagccaaccatcttagtataacacacatgtcttaaagtttattaattaattacatgttgttttatatatatcg

SEQ ID NO: 348102 - DNA, 75 bp, Artificial Sequence
  Synthetic
gagaagaaattaaggcgcataaaactatcttggctgccggatctacgtattttaaaacaatgttcacgacaccta

SEQ ID NO: 348103 - DNA, 75 bp, Artificial Sequence
  Synthetic
aaccaatttagactgacaggcagaacacgtcatgcaatcatcatcgtcatcgataactgtagtcttgggcttctt

SEQ ID NO: 348104 - DNA, 75 bp, Artificial Sequence
  Synthetic
cgataactgtagtcttgggcttctttttgcgactcttcattccggaacgcacattggtgctatccatttaggtag

SEQ ID NO: 348105 - DNA, 75 bp, Artificial Sequence
  Synthetic
gcatataagttctatgaatgtaatagacgtattaaaatgcgccgactatcttctaatcgatgatctagtcactaa

SEQ ID NO: 348106 - DNA, 75 bp, Artificial Sequence
  Synthetic
gacgtattaaaatgcgccgactatcttctaatcgatgatctagtcactaactgtgaatcctatattaaagattat

SEQ ID NO: 348107 - DNA, 75 bp, Artificial Sequence
  Synthetic
cggccacctttgccttaattccagatgttgtaaaattataactaaacagtctatcatcgacacaaatgaaattct

SEQ ID NO: 348108 - DNA, 75 bp, Artificial Sequence
  Synthetic
ggatattatgtttgcaaagactctagactttaaatcaaagaaagtgttaactggacgtaagacaattgccgttct

SEQ ID NO: 348109 - DNA, 75 bp, Artificial Sequence
  Synthetic
tgttgtaaaattataactaaacagtctatcatcgacacaaatgaaattcttgtttagacgtttgtagtttacgta

SEQ ID NO: 348110 - DNA, 75 bp, Artificial Sequence
  Synthetic
agtcaaatatattaaacgtatgctgatgagtaatataccaacattgataactacgaacgcatttaaaaaaacagt

SEQ ID NO: 348111 - DNA, 75 bp, Artificial Sequence
  Synthetic
atgagtaatataccaacattgataactacgaacgcatttaaaaaaacagtatttgaaatattattcgatattatt

SEQ ID NO: 348112 - DNA, 75 bp, Artificial Sequence
  Synthetic
taaaaataagaatgaaataacataggattaaaaataaagttatcatgacttctagcgctgatttaactaacttaa

SEQ ID NO: 348113 - DNA, 75 bp, Artificial Sequence
  Synthetic
gattaaaaataaagttatcatgacttctagcgctgatttaactaacttaaaagaattacttagtctgtacaaaag

SEQ ID NO: 348114 - DNA, 75 bp, Artificial Sequence
  Synthetic
actattgaagtggctagaatacaactacatcaccgaagaacagctgttgtgtatactgtcctgtatagatataca

SEQ ID NO: 348115 - DNA, 75 bp, Artificial Sequence
  Synthetic
gaataggataataattaatatctataattttattgagatttctgacaattactttgaccacatccttcagtttga

SEQ ID NO: 348116 - DNA, 75 bp, Artificial Sequence
  Synthetic
tacatcaccgaagaacagctgttgtgtatactgtcctgtatagatatacaaaatctagataaaaagtctagacta

SEQ ID NO: 348117 - DNA, 75 bp, Artificial Sequence
  Synthetic
aatggggaacatctacttactggaaaataggcgtgcaaaaggtagctaatgtcgagacgtcaatatctgattatt

SEQ ID NO: 348118 - DNA, 75 bp, Artificial Sequence
  Synthetic
aataggcgtgcaaaaggtagctaatgtcgagacgtcaatatctgattattatgatgaggtaaaaaataaaccgtt

SEQ ID NO: 348119 - DNA, 75 bp, Artificial Sequence
  Synthetic
tctattagataataaacagaatagaaacattataccccaccagttatgtttagcgtgtcatgatactaactataa

SEQ ID NO: 348120 - DNA, 75 bp, Artificial Sequence
  Synthetic
cttgcgccaatggatggatacaatacgataaacattgttatttagatactaacattaaaatgtctacagataatg

SEQ ID NO: 348121 - DNA, 75 bp, Artificial Sequence
  Synthetic
aacattataccccaccagttatgtttagcgtgtcatgatactaactataatgtatgtaacccgtgtatagtagtg

SEQ ID NO: 348122 - DNA, 75 bp, Artificial Sequence
  Synthetic
tctttatttattcgaagggtaaaaatatggtagaacttggatctggaaactcttttcaaataccagatgatatgc

SEQ ID NO: 348123 - DNA, 75 bp, Artificial Sequence
  Synthetic
tcttaaccaagaaatcgtatataaccacggagatggcgtatttaagagtggattcttctaccgttttgttcttgg

SEQ ID NO: 348124 - DNA, 75 bp, Artificial Sequence
  Synthetic
tatggtagaacttggatctggaaactcttttcaaataccagatgatatgcgaagtgcgtgtaacaaagtattaga

SEQ ID NO: 348125 - DNA, 75 bp, Artificial Sequence
  Synthetic
cataattaattacgcatccgcaattgtagataatgacataataatagctagaggatataactttaataatccatc

SEQ ID NO: 348126 - DNA, 75 bp, Artificial Sequence
  Synthetic
gtagataatgacataataatagctagaggatataactttaataatccatcattaaacaaggtatataaaataaac

SEQ ID NO: 348127 - DNA, 75 bp, Artificial Sequence
  Synthetic
ccactaagtagataatgattaatgttaaggaaaagaaaatattcagtgtataggtatgtcttggcgtcatatctt

SEQ ID NO: 348128 - DNA, 75 bp, Artificial Sequence
  Synthetic
ggataatggaagatgctatatcaaaatatcagtctccagttaatatatttaaactagctagtgagtacggattaa

SEQ ID NO: 348129 - DNA, 75 bp, Artificial Sequence
  Synthetic
tcgtttttcattggctgtaatcgatgacacaatttatgctataggtggtcaaaacggtacgaacgtagaacgaac

SEQ ID NO: 348130 - DNA, 75 bp, Artificial Sequence
  Synthetic
ccaaaaaggagatgtccatgcggatactttggtggaatagatgaacaaggaaatcctatttgtaaatcgtgttgt

SEQ ID NO: 348131 - DNA, 75 bp, Artificial Sequence
  Synthetic
aatagaggaagacacattatttgacgacgagttatactctattatagaacgctctttcgatgataaatttccaaa

SEQ ID NO: 348132 - DNA, 75 bp, Artificial Sequence
  Synthetic
aaaaaatgaattaataataagtcgttaacgtacgccgccatggacgccgcgtttgttattactccaatgggtgtg

SEQ ID NO: 348133 - DNA, 75 bp, Artificial Sequence
  Synthetic
aaatagaacatactttcctgtagtgttgattctagactccgcatcaacaccattattaaaaatagttttatatac

SEQ ID NO: 348134 - DNA, 75 bp, Artificial Sequence
  Synthetic
catgtgtgtattagaatcaatacatatacattataggcggtcgtacccaacacattgattatacatcagtaaata

SEQ ID NO: 348135 - DNA, 75 bp, Artificial Sequence
  Synthetic
actttttcaaattctcgttcatgtatattgagtccatcaaggtagatcgtataggagataatatttttattccta

SEQ ID NO: 348136 - DNA, 75 bp, Artificial Sequence
  Synthetic
tattgagtccatcaaggtagatcgtataggagataatatttttattcctagcgttataacaaaatcaggaaaaaa

SEQ ID NO: 348137 - DNA, 75 bp, Artificial Sequence
  Synthetic
gacactgtcaataatatatgggaaacattacctaacttctggactggaactataaatccaggcgtggtctcgcat

SEQ ID NO: 348138 - DNA, 75 bp, Artificial Sequence
  Synthetic
atacatttgtaaaagtaaaaaagaaaaacacattttccattttatacgactatgatgggaacggaacagaaacta

SEQ ID NO: 348139 - DNA, 75 bp, Artificial Sequence
  Synthetic
atgtctactcgtatgttcctccttgtcaatgcactgttcaagaatttatattttccgcattagatgaaaaatgga

SEQ ID NO: 348140 - DNA, 75 bp, Artificial Sequence
  Synthetic
aaacacattttccattttatacgactatgatgggaacggaacagaaactagaggagaagtaataaaacgaattat

SEQ ID NO: 348141 - DNA, 75 bp, Artificial Sequence
  Synthetic
ttttttttattcatcatcctctggtggttcgtcgtttctatcgaatgtagctctgattaacccgtcatctatagg

SEQ ID NO: 348142 - DNA, 75 bp, Artificial Sequence
  Synthetic
ttggtagtgcaggcttaaagcaattgactaataaattagatattaatgagtgcgcaactgtcgatgagttagttg

SEQ ID NO: 348143 - DNA, 75 bp, Artificial Sequence
  Synthetic
gactaataaattagatattaatgagtgcgcaactgtcgatgagttagttgatgagattaataaatccggaactgt

SEQ ID NO: 348144 - DNA, 75 bp, Artificial Sequence
  Synthetic
tgggatatccagaagcggattttataacgttagttaataacatgcggttcaaaatagaaaattgtaaggttgtaa

SEQ ID NO: 348145 - DNA, 75 bp, Artificial Sequence
  Synthetic
aacgttagttaataacatgcggttcaaaatagaaaattgtaaggttgtaaatttcaatattgaaaatactaattg

SEQ ID NO: 348146 - DNA, 75 bp, Artificial Sequence
  Synthetic
tctcaatctttaatgtcgtcaccgatgtcaaaaaaagattattcgagtgaaataatatgcgcctttgatataggt

SEQ ID NO: 348147 - DNA, 75 bp, Artificial Sequence
  Synthetic
tgtcaaaaaaagattattcgagtgaaataatatgcgcctttgatataggtgcaaaaaatcctgccagaactgttt

SEQ ID NO: 348148 - DNA, 75 bp, Artificial Sequence
  Synthetic
tggagttctgattgggaaaggcgcatagctaaagatttgtcacaatatgaatacactacagttcttctagaacgt

SEQ ID NO: 348149 - DNA, 75 bp, Artificial Sequence
  Synthetic
aatttatctattttattaaaggctttttatatcatacatcggctgccaaagttatttgcgtctcgcctgtcatgt

SEQ ID NO: 348150 - DNA, 75 bp, Artificial Sequence
  Synthetic
gttatttgcgtctcgcctgtcatgtctggtaattcatatagagatcgaaaaaagagatcggtcgaagcatttctt

SEQ ID NO: 348151 - DNA, 75 bp, Artificial Sequence
  Synthetic
ctggtaattcatatagagatcgaaaaaagagatcggtcgaagcatttcttgattggatggacacattcggattgc

SEQ ID NO: 348152 - DNA, 75 bp, Artificial Sequence
  Synthetic
aatttggctatgagatacgtattagataaatggaatactaattatacaccttataataggtgtaaatctagaaat

SEQ ID NO: 348153 - DNA, 75 bp, Artificial Sequence
  Synthetic
ataaatggaatactaattatacaccttataataggtgtaaatctagaaattacataaaaaaaatgtaataacgtt

SEQ ID NO: 348154 - DNA, 75 bp, Artificial Sequence
  Synthetic
tagatatgccagaactatttttaactttcatctaataagttgcgatgaaataggagatatatatggtcttatgaa

SEQ ID NO: 348155 - DNA, 75 bp, Artificial Sequence
  Synthetic
tttcatctaataagttgcgatgaaataggagatatatatggtcttatgaaagaacgcatttcctcagaggatatg

SEQ ID NO: 348156 - DNA, 75 bp, Artificial Sequence
  Synthetic
agtgtattgcgacatccaacttactaaacacattattaatcagaatacgtatccggtatttaacgattcttcaca

SEQ ID NO: 348157 - DNA, 75 bp, Artificial Sequence
  Synthetic
aaacacattattaatcagaatacgtatccggtatttaacgattcttcacaagtgaaatgttgtcattatttcgac

SEQ ID NO: 348158 - DNA, 75 bp, Artificial Sequence
  Synthetic
cagcggctactaaaagatcaaccaaaaaggataaagaaaaggaggaagtggaagaagaagtagttatagaggaat

SEQ ID NO: 348159 - DNA, 75 bp, Artificial Sequence
  Synthetic
gagtagatatcattaatcactctatagtaacgcgtggaaaaagctctatattacaaactatagaaattattttta

SEQ ID NO: 348160 - DNA, 75 bp, Artificial Sequence
  Synthetic
agtaacgcgtggaaaaagctctatattacaaactatagaaattatttttactaatagaacatgtgtgaaaatatt

SEQ ID NO: 348161 - DNA, 75 bp, Artificial Sequence
  Synthetic
atgattgggaaccagtaatgagtcaattggtagagttttataacgaagtagccagttggctgctacgagacgaga

SEQ ID NO: 348162 - DNA, 75 bp, Artificial Sequence
  Synthetic
ggtgtatacacatgattgacaaattattctatgtctattataatttatttctgttgttcgaagatatcatccaaa

SEQ ID NO: 348163 - DNA, 75 bp, Artificial Sequence
  Synthetic
attctatgtctattataatttatttctgttgttcgaagatatcatccaaaacgagtactttaaagaagtagctaa

SEQ ID NO: 348164 - DNA, 75 bp, Artificial Sequence
  Synthetic
attgcacatgtattctatgtcgtctactggatgaagatgtgacgtacaaaaaaataaaactagaaattgaaacgt

SEQ ID NO: 348165 - DNA, 75 bp, Artificial Sequence
  Synthetic
taattaagaaaatggctgaacacgatgtttatggagttagcaatttcaaaatagggatgtttaacctgacattta

SEQ ID NO: 348166 - DNA, 75 bp, Artificial Sequence
  Synthetic
caattctgtacctatcaaggaacaaatattgtacggtagaattgataatataaatatgagcattagtatttctgt

SEQ ID NO: 348167 - DNA, 75 bp, Artificial Sequence
  Synthetic
tgtttatggagttagcaatttcaaaatagggatgtttaacctgacatttattaagtcgttggatcataccgtttt

SEQ ID NO: 348168 - DNA, 75 bp, Artificial Sequence
  Synthetic
atcattaatcatctctaatctctaaatacctcataaaacgaaaaaaaagctattatcaaatactgtacggaatgg

SEQ ID NO: 348169 - DNA, 75 bp, Artificial Sequence
  Synthetic
agctcaatattgtagcattacgatctctggaggattgtataaattacgtgactaaatccgagaatatgatagaaa

SEQ ID NO: 348170 - DNA, 75 bp, Artificial Sequence
  Synthetic
tgatgaaggaaagatcgactattttaaatagcatagatatagaaacggaatcggtagatcgtctaaaagaattgc

SEQ ID NO: 348171 - DNA, 75 bp, Artificial Sequence
  Synthetic
ataagtttttggtgcctgatcctaaagccggagttttttatagaccgttacatttccaatatgtatcgtattcta

SEQ ID NO: 348172 - DNA, 75 bp, Artificial Sequence
  Synthetic
agccggagttttttatagaccgttacatttccaatatgtatcgtattctaattttatattgcatcgattgcatga

SEQ ID NO: 348173 - DNA, 75 bp, Artificial Sequence
  Synthetic
tctataaatgtagactcgacggatgagttaatgtatatttttgccgccttgggcggatctgtaaacatttgggcc

SEQ ID NO: 348174 - DNA, 75 bp, Artificial Sequence
  Synthetic
gaattatgatagaaattagcaatgttaaagtgactcctccagattactcacctataatcgcgagtattaaaggta

SEQ ID NO: 348175 - DNA, 75 bp, Artificial Sequence
  Synthetic
taaagtgactcctccagattactcacctataatcgcgagtattaaaggtaagagttatgacgcattagccacgtt

SEQ ID NO: 348176 - DNA, 75 bp, Artificial Sequence
  Synthetic
ataatttacacagtaaccaaaatgaaaacactttagtaattataagaaatatagacggtaatgtcatcatcaaca

SEQ ID NO: 348177 - DNA, 75 bp, Artificial Sequence
  Synthetic
ctaaaataagtagttatgagggaaaagattctcatttgataaaaattccgctactaataggatacgggaataaaa

SEQ ID NO: 348178 - DNA, 75 bp, Artificial Sequence
  Synthetic
agattctcatttgataaaaattccgctactaataggatacgggaataaaaatccacttgatacagccaagtatct

SEQ ID NO: 348179 - DNA, 75 bp, Artificial Sequence
  Synthetic
tattccagtattatccccgcatgtatacgtacctggtaagatatctttatattctataatcaatgagacatcact

SEQ ID NO: 348180 - DNA, 75 bp, Artificial Sequence
  Synthetic
agaatataaccactacatcatcgataacattctaaagagatttagacaacaggatgaatccatcgtacaagccat

SEQ ID NO: 348181 - DNA, 75 bp, Artificial Sequence
  Synthetic
aagtaggaattaatctagtagaaaagattacaacatggccaaaatttagggttgttaagccaaactcattcactt

SEQ ID NO: 348182 - DNA, 75 bp, Artificial Sequence
  Synthetic
gattacaacatggccaaaatttagggttgttaagccaaactcattcactttctcgttttcctccgtatcccctcc

SEQ ID NO: 348183 - DNA, 75 bp, Artificial Sequence
  Synthetic
cacaattggaagcgtcgaatatatcatcgacaaagacatttataacggtcaatattgttttgctgtctcaatatt

SEQ ID NO: 348184 - DNA, 75 bp, Artificial Sequence
  Synthetic
atcgacaaagacatttataacggtcaatattgttttgctgtctcaatatttatctagagtgagtctagaattcat

SEQ ID NO: 348185 - DNA, 75 bp, Artificial Sequence
  Synthetic
attcttttcactgatactatcggctcaaagagaattgttaaaattccgtatatagcacaaatgtgcttaaacgac

SEQ ID NO: 348186 - DNA, 75 bp, Artificial Sequence
  Synthetic
acgcgataatagatagtgctaaacgaattactgaatctattactgactttaatattgatacatacattaatgacc

SEQ ID NO: 348187 - DNA, 75 bp, Artificial Sequence
  Synthetic
aattactgaatctattactgactttaatattgatacatacattaatgacctggtggaagctgaacacattaaaca

SEQ ID NO: 348188 - DNA, 75 bp, Artificial Sequence
  Synthetic
ttttacctcatatgaactatacacccgatcaactaaagggattttatatgatatctttactaagaaagtttctct

SEQ ID NO: 348189 - DNA, 75 bp, Artificial Sequence
  Synthetic
actgtatctaccacacttctagatatccagatagagattcgatggtttgtcatcgcatcctaacgtacggcaaat

SEQ ID NO: 348190 - DNA, 75 bp, Artificial Sequence
  Synthetic
tgattgacgcatttaatagagatatacgctatctatatcctgaaccattattcgcctgtatcagatacgccttaa

SEQ ID NO: 348191 - DNA, 75 bp, Artificial Sequence
  Synthetic
attttgagacgttggcacatgatgaattagagaattacataggcaacatccgaaacgatatcatgaacaatcaca

SEQ ID NO: 348192 - DNA, 75 bp, Artificial Sequence
  Synthetic
tgagtggaaagttcaaaaagtcagacggtagttatcgaacacatcctcactattcatggatgcagaatatttcta

SEQ ID NO: 348193 - DNA, 75 bp, Artificial Sequence
  Synthetic
cggtagttatcgaacacatcctcactattcatggatgcagaatatttctattcctagaagtgttggattttatcc

SEQ ID NO: 348194 - DNA, 75 bp, Artificial Sequence
  Synthetic
cggagacgccgtaataatttccttattcacttgtataatttccccattgatagaaaatatcacgctttccattct

SEQ ID NO: 348195 - DNA, 75 bp, Artificial Sequence
  Synthetic
ttatatttcttcctatatttttttattcttcattcgttcagacttttaacgcgtctgaatgtatcgacaaagggc

SEQ ID NO: 348196 - DNA, 75 bp, Artificial Sequence
  Synthetic
attcctataactatcagagttacatcaaacgggttgtattgttattttacacatcttggttatattattagatat

SEQ ID NO: 348197 - DNA, 75 bp, Artificial Sequence
  Synthetic
gtcaatatctttacttttgttcatcggacgttccggaaagaggtcctcaggtaggtttagtatctcaattgtctg

SEQ ID NO: 348198 - DNA, 75 bp, Artificial Sequence
  Synthetic
tttcctattccatcaaactgtataggtatgtcctctgccaagtacataaattctagcatcgagcaagatacttta

SEQ ID NO: 348199 - DNA, 75 bp, Artificial Sequence
  Synthetic
tgactattatcccatttcgttgggattacttaaaaagttcgagtttctcatgtctctatataaaggtcctattcc

SEQ ID NO: 348200 - DNA, 75 bp, Artificial Sequence
  Synthetic
aacgtctgagtatttggatttggaaaagaaaatttgtgagtatatcagatcatattataaagatgatataagtta

SEQ ID NO: 348201 - DNA, 75 bp, Artificial Sequence
  Synthetic
ttaatccaaatatgatatgtgattttgtaactgactttagacgtagaaaacggatgggattcttcggtaacttgg

SEQ ID NO: 348202 - DNA, 75 bp, Artificial Sequence
  Synthetic
aaaaacaaaaaactttacgatagactttaagctaaaatattttctaggatccggtgcccagtctaaaagttcttt

SEQ ID NO: 348203 - DNA, 75 bp, Artificial Sequence
  Synthetic
tcacatgaatgaaattcgcattaatattggagcgggaagattagtcagaccattcttggttgtggataacggaga

SEQ ID NO: 348204 - DNA, 75 bp, Artificial Sequence
  Synthetic
cattctctgacattcagaaagagtttccgcatgtcatcgaaatggtagatatagaacaatttacttttagtaacg

SEQ ID NO: 348205 - DNA, 75 bp, Artificial Sequence
  Synthetic
atagaacaatttacttttagtaacgtatgtgaatcggttcaaaaatttagaatgatgtcaaaggatgaaagaaag

SEQ ID NO: 348206 - DNA, 75 bp, Artificial Sequence
  Synthetic
atcttcattagtgggaatcaatcacaattctggacccagagctattcttggatgtgctcaagctaaacaagctat

SEQ ID NO: 348207 - DNA, 75 bp, Artificial Sequence
  Synthetic
tatttttcaccatatagatcaatcattagatcatcaaaatatgtttcaatcatcctaaagagtatggtgaatgac

SEQ ID NO: 348208 - DNA, 75 bp, Artificial Sequence
  Synthetic
gatgtgctcaagctaaacaagctatctcttgtctgagttcggatatacgaaataaaatagacaatggaattcatt

SEQ ID NO: 348209 - DNA, 75 bp, Artificial Sequence
  Synthetic
aagattgcggctaattgcttcggacaacatgttactatagcattaatgtcgtacaaaggtatcaatcaagaggat

SEQ ID NO: 348210 - DNA, 75 bp, Artificial Sequence
  Synthetic
ttcagagaggcggtctcgatatagttaccgcaaagaaacatcaagtagaaattccgttggaaaactttaataaca

SEQ ID NO: 348211 - DNA, 75 bp, Artificial Sequence
  Synthetic
gttagactgaatgctttcttggaatccggagacgctatagcacgaaatatctcatcaagaactcttgaagatgat

SEQ ID NO: 348212 - DNA, 75 bp, Artificial Sequence
  Synthetic
ccggagacgctatagcacgaaatatctcatcaagaactcttgaagatgattttgctagagataatcagattagct

SEQ ID NO: 348213 - DNA, 75 bp, Artificial Sequence
  Synthetic
atatataataaataacaatggctgaatggcataaaattatcgaggatatctcaaaaaataataagttcgaggatg

SEQ ID NO: 348214 - DNA, 75 bp, Artificial Sequence
  Synthetic
gaatagaatgctaatgtcaagtttattccaatagatgtcttattaaaaacatatataataaataacaatggctga

SEQ ID NO: 348215 - DNA, 75 bp, Artificial Sequence
  Synthetic
aaaaattaatgcatcattaattttagaaatacttagtttccacgtagtcaatgaaacatttgaactcatcgtaca

SEQ ID NO: 348216 - DNA, 75 bp, Artificial Sequence
  Synthetic
gtacaagtagaacttactgacaaagttaaggtacgagtattaaccatgaaagaaagaagacccattctaggagac

SEQ ID NO: 348217 - DNA, 75 bp, Artificial Sequence
  Synthetic
ttaaggtacgagtattaaccatgaaagaaagaagacccattctaggagacaaatttaccactagaacgagtcaaa

SEQ ID NO: 348218 - DNA, 75 bp, Artificial Sequence
  Synthetic
aatggtatcacaccagatgtcattattaattctacatccatcttctctagaaaaactatatctatgttgatagaa

SEQ ID NO: 348219 - DNA, 75 bp, Artificial Sequence
  Synthetic
ctaagccgtacaacaataagggagaaaaccgacctgtctgttttcctagtagtaacgaaacatccatcgatacat

SEQ ID NO: 348220 - DNA, 75 bp, Artificial Sequence
  Synthetic
gatgaagaattgtcggataaaatcttttgtgaaaagattctctatgatcctgaaacggataagccttatgcatcc

SEQ ID NO: 348221 - DNA, 75 bp, Artificial Sequence
  Synthetic
tcaaaacttaatctctctcctctcttaacaaaaattgataccacgcacgtatctaaagtatttcttactcaaatg

SEQ ID NO: 348222 - DNA, 75 bp, Artificial Sequence
  Synthetic
actgtaaagaacagtgagaggatcgactccatagtggacaacattaatacagacgataacttgatttcgaaatta

SEQ ID NO: 348223 - DNA, 75 bp, Artificial Sequence
  Synthetic
gcacctataaattgggctcaagggtttatttattaatgctttagtgaaattttaacttgtgttctaaatggatgc

SEQ ID NO: 348224 - DNA, 75 bp, Artificial Sequence
  Synthetic
aatattctagtttggtagtagatacatatcaatatcatcaaattcgagatccgaattataaaatgggcgtggatt

SEQ ID NO: 348225 - DNA, 75 bp, Artificial Sequence
  Synthetic
agagattggtagaggagttcttcaatagatcagaacttcaggctggtaaatctattaatgttaaacatacatctg

SEQ ID NO: 348226 - DNA, 75 bp, Artificial Sequence
  Synthetic
gaaagctgtggatgttctggttcggcatccaccgatggtgttacaccactactaattggttcagtaacgtctgtg

SEQ ID NO: 348227 - DNA, 75 bp, Artificial Sequence
  Synthetic
catccaccgatggtgttacaccactactaattggttcagtaacgtctgtggacgatggaggcaccacttctacag

SEQ ID NO: 348228 - DNA, 75 bp, Artificial Sequence
  Synthetic
gacgatggaggcaccacttctacaggttctggttctttatcctcagtcatcaacggagctacttcaatgcgagga

SEQ ID NO: 348229 - DNA, 75 bp, Artificial Sequence
  Synthetic
tcaatcgataacaagatctttgatatactaacggacaccattgatgactttagtaaatcatccgatctattgctg

SEQ ID NO: 348230 - DNA, 75 bp, Artificial Sequence
  Synthetic
ttgatattccaacctcttcacgttactacgttcagattccaattcacgttcgcatgggttacctccgcagttttt

SEQ ID NO: 348231 - DNA, 75 bp, Artificial Sequence
  Synthetic
attactactgtaaacacatatccacgttctacaaaagcaattattacaagtcaagtcacactaagatgcgagccg

SEQ ID NO: 348232 - DNA, 75 bp, Artificial Sequence
  Synthetic
atgcgtctctccctctctctatcgagtttatcagagcagtctttctgaaggcgatcgaactccataaatttctcc

SEQ ID NO: 348233 - DNA, 75 bp, Artificial Sequence
  Synthetic
gtttatcagagcagtctttctgaaggcgatcgaactccataaatttctccaacgctttgattgtttccatagatt

SEQ ID NO: 348234 - DNA, 75 bp, Artificial Sequence
  Synthetic
ataataggttgtaatatcatatagacaataactaacaattaattagtaactgttatctctttttaactaactaac

SEQ ID NO: 348235 - DNA, 75 bp, Artificial Sequence
  Synthetic
tccatcatccacatgtatcgacggtaaatggaatcccgtactcccaatatgtgtacgaactaacgaagaatttga

SEQ ID NO: 348236 - DNA, 75 bp, Artificial Sequence
  Synthetic
gattctttttctttcgaattcacagctggatgtacaaccgtttccattaccgccatctctaagtttcttttctag

SEQ ID NO: 348237 - DNA, 75 bp, Artificial Sequence
  Synthetic
gtcgaaatatcgttccagctccttttcgacatcaataactttagcacgttgtctctcaagctctcttttgtagtt

SEQ ID NO: 348238 - DNA, 75 bp, Artificial Sequence
  Synthetic
gtgttacacgatcgcgtcttccgttacaacttagacaagcgggtaaatgattattgcgagatgtgaaggtacccg

SEQ ID NO: 348239 - DNA, 75 bp, Artificial Sequence
  Synthetic
gaaatacgggttttcttggaattgatttcgtcgatgtacttggcatcgaaacacttattaagttctttttccaat

SEQ ID NO: 348240 - DNA, 75 bp, Artificial Sequence
  Synthetic
acacttattaagttctttttccaattctacgattttatttctttcgcgagtcaattccctcctgtagtaactatc

SEQ ID NO: 348241 - DNA, 75 bp, Artificial Sequence
  Synthetic
aacagtgccatctatcgatggagcgtaaaagtaaactcgtcgacaaagcactcaataaattagagtctaccatcg

SEQ ID NO: 348242 - DNA, 75 bp, Artificial Sequence
  Synthetic
ttattatttatgggtgaaaaacttactataaaaagcgggtgggtttggaattagtgaaagcttaaaaattgaaat

SEQ ID NO: 348243 - DNA, 75 bp, Artificial Sequence
  Synthetic
tttgttccctagcacgtccgagtttagttttatatgctgaatagagttctgattcatcctttgagcagatctcta

SEQ ID NO: 348244 - DNA, 75 bp, Artificial Sequence
  Synthetic
gcctggtaccaggaggaggaattcagcttaaagatgacttcgaaagtttatgatccagaacaaaggaaacggatg

SEQ ID NO: 348245 - DNA, 75 bp, Artificial Sequence
  Synthetic
gcttaaagatgacttcgaaagtttatgatccagaacaaaggaaacggatgataactggtccgcagtggtgggcca

SEQ ID NO: 348246 - DNA, 75 bp, Artificial Sequence
  Synthetic
gaagatgttccgttaccgttgcgtttacactcgttaagctgtctatcaagatccatgattctatctctaagacgt

SEQ ID NO: 348247 - DNA, 75 bp, Artificial Sequence
  Synthetic
tacactcgttaagctgtctatcaagatccatgattctatctctaagacgttgcatctctctttccatatcagcat

SEQ ID NO: 348248 - DNA, 75 bp, Artificial Sequence
  Synthetic
gaaaaacatgcagaaaatgctgttatttttttacatggtaacgcggcctcttcttatttatggcgacatgttgtg

SEQ ID NO: 348249 - DNA, 75 bp, Artificial Sequence
  Synthetic
tatgagatcgtcgtacatgggaaatgaaatgtgactgtctgaatgtatggctttaagatagctgtgataccgtat

SEQ ID NO: 348250 - DNA, 75 bp, Artificial Sequence
  Synthetic
tttttttacatggtaacgcggcctcttcttatttatggcgacatgttgtgccacatattgagccagtagcgcggt

SEQ ID NO: 348251 - DNA, 75 bp, Artificial Sequence
  Synthetic
attctatctctaagacgtcgcatctctctctgtttcggcattggtttcattattacgtctacagtcgttcaactg

SEQ ID NO: 348252 - DNA, 75 bp, Artificial Sequence
  Synthetic
ctctctgtttcggcattggtttcattattacgtctacagtcgttcaactgtctttcaagatctgatattctagat

SEQ ID NO: 348253 - DNA, 75 bp, Artificial Sequence
  Synthetic
ggttcttataggttacttgatcattacaaatatcttactgcatggtttgaacttcttaatttaccaaagaagatc

SEQ ID NO: 348254 - DNA, 75 bp, Artificial Sequence
  Synthetic
acaaatatcttactgcatggtttgaacttcttaatttaccaaagaagatcatttttgtcggccatgattggggtg

SEQ ID NO: 348255 - DNA, 75 bp, Artificial Sequence
  Synthetic
taaaagcattttaactttagaagacgtggatagttttttaactacgttatcatccgtaactaaagaatcgcatca

SEQ ID NO: 348256 - DNA, 75 bp, Artificial Sequence
  Synthetic
ttcaagatctgagattttagattggagtctgctaatctctgtaagatttcctcctccgctctcgatgcagtcggt

SEQ ID NO: 348257 - DNA, 75 bp, Artificial Sequence
  Synthetic
atagttcacgctgaaagtgtagtagatgtgattgaatcatgggatgaatggcctgatattgaagaagatattgcg

SEQ ID NO: 348258 - DNA, 75 bp, Artificial Sequence
  Synthetic
ctcctccgctctcgatgcagtcggtcaacttattctctagttctctaatacgcgaacgcagtgcatcaacttctt

SEQ ID NO: 348259 - DNA, 75 bp, Artificial Sequence
  Synthetic
atgtgattgaatcatgggatgaatggcctgatattgaagaagatattgcgttgatcaaatctgaagaaggagaaa

SEQ ID NO: 348260 - DNA, 75 bp, Artificial Sequence
  Synthetic
ctaacgcgtcgtcgttcttcctcaagttctctgcgtactacagaaagcgtgtccctatcttgttgatatttagca

SEQ ID NO: 348261 - DNA, 75 bp, Artificial Sequence
  Synthetic
gttctctgcgtactacagaaagcgtgtccctatcttgttgatatttagcaatttctgattctagagtactgattt

SEQ ID NO: 348262 - DNA, 75 bp, Artificial Sequence
  Synthetic
atcatgagaaagttagaaccagaagaatttgcagcatatcttgaaccattcaaagagaaaggtgaagttcgtcgt

SEQ ID NO: 348263 - DNA, 75 bp, Artificial Sequence
  Synthetic
aatttgcagcatatcttgaaccattcaaagagaaaggtgaagttcgtcgtccaacattatcatggcctcgtgaaa

SEQ ID NO: 348264 - DNA, 75 bp, Artificial Sequence
  Synthetic
gataacacaaaatgtgaacgctgcccacctcatacatataccacaatcccaattattctaatggatgtcatcaat

SEQ ID NO: 348265 - DNA, 75 bp, Artificial Sequence
  Synthetic
tatttgtcgcattccttgatatccctacgaagtctggacagttcccattcgacattacgacgtttatcgatttca

SEQ ID NO: 348266 - DNA, 75 bp, Artificial Sequence
  Synthetic
tacgaagtctggacagttcccattcgacattacgacgtttatcgatttcagctcggagatcgtcatcgcgttgtt

SEQ ID NO: 348267 - DNA, 75 bp, Artificial Sequence
  Synthetic
tataatgcttatctacgtgcaagtgatgatttaccaaaaatgtttattgaatcggatccaggattcttttccaat

SEQ ID NO: 348268 - DNA, 75 bp, Artificial Sequence
  Synthetic
atgatttaccaaaaatgtttattgaatcggatccaggattcttttccaatgctattgttgaaggcgccaagaagt

SEQ ID NO: 348269 - DNA, 75 bp, Artificial Sequence
  Synthetic
tttccattcctaatagtatccagttccttttctagttctgaacgcatttctcgttccctatcaagcgattctctc

SEQ ID NO: 348270 - DNA, 75 bp, Artificial Sequence
  Synthetic
ccttttctagttctgaacgcatttctcgttccctatcaagcgattctctcaattctcggatagtcttcttatcaa

SEQ ID NO: 348271 - DNA, 75 bp, Artificial Sequence
  Synthetic
atccaacgtactaggtagcaaattgtctagataaaatactgaatcaaacggcgcagacgtattagcggatctaat

SEQ ID NO: 348272 - DNA, 75 bp, Artificial Sequence
  Synthetic
gatgcacctgatgaaatgggaaaatatatcaaatcgttcgttgagcgagttctcaaaaatgaacaagcggccgcc

SEQ ID NO: 348273 - DNA, 75 bp, Artificial Sequence
  Synthetic
atatcaaatcgttcgttgagcgagttctcaaaaatgaacaagcggccgccgccaccatgagcaagggcgaggaac

SEQ ID NO: 348274 - DNA, 75 bp, Artificial Sequence
  Synthetic
tctttgatctcttttgtaagtcggtcgattctttcggttttataaacagaatccctttccaaagtcctaatctta

SEQ ID NO: 348275 - DNA, 75 bp, Artificial Sequence
  Synthetic
cgattctttcggttttataaacagaatccctttccaaagtcctaatcttactgagtttatcactaagttctgcat

SEQ ID NO: 348276 - DNA, 75 bp, Artificial Sequence
  Synthetic
gggcacaaattttctgtcagcggagagggtgaaggtgatgccacatacggaaagctcaccctgaaattcatctgc

SEQ ID NO: 348277 - DNA, 75 bp, Artificial Sequence
  Synthetic
gaatcatccagtccactgaatagcaaaatctttactattttggtatcttccaatgtggctgcctgatgtaatgga

SEQ ID NO: 348278 - DNA, 75 bp, Artificial Sequence
  Synthetic
agggtgaaggtgatgccacatacggaaagctcaccctgaaattcatctgcaccactggaaagctccctgtgccat

SEQ ID NO: 348279 - DNA, 75 bp, Artificial Sequence
  Synthetic
ccactatttccgcattcttcctcgcatttatctaaccattcaattagtttattaataactagttggtaatcagcg

SEQ ID NO: 348280 - DNA, 75 bp, Artificial Sequence
  Synthetic
atttatctaaccattcaattagtttattaataactagttggtaatcagcgattcctatagccgttcttgtaattg

SEQ ID NO: 348281 - DNA, 75 bp, Artificial Sequence
  Synthetic
tacccagaccatatgaagcagcatgactttttcaagagcgccatgcccgagggctatgtgcaggagagaaccatc

SEQ ID NO: 348282 - DNA, 75 bp, Artificial Sequence
  Synthetic
gttcacgtaaatacaaaacagaaaacaaagtctagatttttaacttacataaatgtctgggatagtaaaatctat

SEQ ID NO: 348283 - DNA, 75 bp, Artificial Sequence
  Synthetic
actttttcaagagcgccatgcccgagggctatgtgcaggagagaaccatctttttcaaagatgacgggaactaca

SEQ ID NO: 348284 - DNA, 75 bp, Artificial Sequence
  Synthetic
tctttatcattattagggggatggacaaccttaattggttggtcctcatctcctccagtagcgtgtggttcttca

SEQ ID NO: 348285 - DNA, 75 bp, Artificial Sequence
  Synthetic
gagctgaagggcattgactttaaggaggatggaaacattctcggccacaagctggaatacaactataactcccac

SEQ ID NO: 348286 - DNA, 75 bp, Artificial Sequence
  Synthetic
aggatggaaacattctcggccacaagctggaatacaactataactcccacaatgtgtacatcatggccgacaagc

SEQ ID NO: 348287 - DNA, 75 bp, Artificial Sequence
  Synthetic
gtagtagaataagaactataaaaaaaataataattaaccaataccaaccccaacaaccggtattattagttgatg

SEQ ID NO: 348288 - DNA, 75 bp, Artificial Sequence
  Synthetic
ggatccgtgcagctggccgaccattatcaacagaacactccaatcggcgacggccctgtgctcctcccagacaac

SEQ ID NO: 348289 - DNA, 75 bp, Artificial Sequence
  Synthetic
tagtagaagaactctgtttctgtatctatcaacgctggaatcaatactcaagttaaggatagcgaatacctcatc

SEQ ID NO: 348290 - DNA, 75 bp, Artificial Sequence
  Synthetic
agaccacatggtcctgctggagtttgtgaccgctgctgggatcacacatggcatggacgagctgtacaagtgagc

SEQ ID NO: 348291 - DNA, 75 bp, Artificial Sequence
  Synthetic
ccatcatatgacatttcatgaagtctaacgtattgataaatagaatcagatttagtattaaacagatccttaacc

SEQ ID NO: 348292 - DNA, 75 bp, Artificial Sequence
  Synthetic
tttagtattaaacagatccttaacctttttagtaaacgcatatgtatattttagatctccagatttcataatatg

SEQ ID NO: 348293 - DNA, 75 bp, Artificial Sequence
  Synthetic
cttaacttgactaaatattcataactaatttttattaatgatacaaaaacgaaataaaactgcatattatacact

SEQ ID NO: 348294 - DNA, 75 bp, Artificial Sequence
  Synthetic
gaaataaaactgcatattatacactggttaacgcccttataggctctaaccattttcaagatgaggtccctgatt

SEQ ID NO: 348295 - DNA, 75 bp, Artificial Sequence
  Synthetic
tccataatatagtctggaacactaattggtgatgaaaaagataccggaccatatgctacgttgataaataactct

SEQ ID NO: 348296 - DNA, 75 bp, Artificial Sequence
  Synthetic
ttggtgatgaaaaagataccggaccatatgctacgttgataaataactctgaaccactaagtagataatgattaa

SEQ ID NO: 348297 - DNA, 75 bp, Artificial Sequence
  Synthetic
gttggcaccggaatactattcatggaaatgtttttcgattacaataaaaatagtatcaacaatcaactaatgtat

SEQ ID NO: 348298 - DNA, 75 bp, Artificial Sequence
  Synthetic
caccattattaaaaatagttttatatacatctttaatctgctcaccgttaatcgtcgaacgttctagtatacgga

SEQ ID NO: 348299 - DNA, 75 bp, Artificial Sequence
  Synthetic
atcgtcgaacgttctagtatacggaaacactttgatttcttatctgtagttaatgacttagtgatatcacgaaga

SEQ ID NO: 348300 - DNA, 75 bp, Artificial Sequence
  Synthetic
acgtatctatgcttactgtatactcctagcggagttaatccttcgttgtttctacaaagtctctcgactccgcga

SEQ ID NO: 348301 - DNA, 75 bp, Artificial Sequence
  Synthetic
caactcatcgttccatagtttttctacctcagtggcgaaatctttggagtgcttggtacatttttcaataaggtt

SEQ ID NO: 348302 - DNA, 75 bp, Artificial Sequence
  Synthetic
acctcagtggcgaaatctttggagtgcttggtacatttttcaataaggttcgtgacctccatttattataaaaaa

SEQ ID NO: 348303 - DNA, 75 bp, Artificial Sequence
  Synthetic
taaacctaaataattgtactttgtaatataatgatatatattttcactttatctcatttgagaataaaaatgttt

SEQ ID NO: 348304 - DNA, 75 bp, Artificial Sequence
  Synthetic
atgaaggcaatcattcctcataagatgataaaaagtgtagtgagagagcatgaaggagatttagtatttagcagt

SEQ ID NO: 348305 - DNA, 75 bp, Artificial Sequence
  Synthetic
gctgtatcacaacaatagtgtccgatgaaattaagattatgatccaatgtgtttaatatatgattatcaagtctt

SEQ ID NO: 348306 - DNA, 75 bp, Artificial Sequence
  Synthetic
tgaaattaagattatgatccaatgtgtttaatatatgattatcaagtcttatacgatccgcgtcttttttgacag

SEQ ID NO: 348307 - DNA, 75 bp, Artificial Sequence
  Synthetic
ctgggaaacggtggtctagggtgaggctccggtatcggagtgggttttggattataatcatcatcgtctatgaca

SEQ ID NO: 348308 - DNA, 75 bp, Artificial Sequence
  Synthetic
tatagatattttctttctatcatggataatatttgtaatggttctttccgtacaacatactgtttagatgatatt

SEQ ID NO: 348309 - DNA, 75 bp, Artificial Sequence
  Synthetic
gaattcgcttatcgttatcgggtttagcttctgtcaccttagcaattccttttttattaaactctacataatcat

SEQ ID NO: 348310 - DNA, 75 bp, Artificial Sequence
  Synthetic
agttccgcgaatgactcgtcccttaataggcagtaggctagtatcttttttacgtagtaatcgtcgtagggagag

SEQ ID NO: 348311 - DNA, 75 bp, Artificial Sequence
  Synthetic
tttttattaaactctacataatcatatccatttctattgtttgttctaatataaacgagtatagcatcattgcta

SEQ ID NO: 348312 - DNA, 75 bp, Artificial Sequence
  Synthetic
ttcaggaacactcaaactaaatgtccaggattctcctaaatacgtaaactttaatagtgcgaaatcattcaaaaa

SEQ ID NO: 348313 - DNA, 75 bp, Artificial Sequence
  Synthetic
tgatccgtttacgttaaaccataaatacatgggtgatcctataaacatgaatttatttctaattctcagagctat

SEQ ID NO: 348314 - DNA, 75 bp, Artificial Sequence
  Synthetic
tacatgggtgatcctataaacatgaatttatttctaattctcagagctatagttaattgaccgtgtaatatttgc

SEQ ID NO: 348315 - DNA, 75 bp, Artificial Sequence
  Synthetic
tatctcagaatcgtatatataaggagtaccatcgtgattcttaccagatattatacaaaatactatatataaaat

SEQ ID NO: 348316 - DNA, 75 bp, Artificial Sequence
  Synthetic
cggatcttcttaattcatcttctatataaggccaaaacaaaatattgcctgccttcgaataaataatagggataa

SEQ ID NO: 348317 - DNA, 75 bp, Artificial Sequence
  Synthetic
agataaaagcattttaactttagaagaagtggatagttttttaactacgttatcatccgtaactaaagaattgca

SEQ ID NO: 348318 - DNA, 75 bp, Artificial Sequence
  Synthetic
tattcaatgatccattatcatacgctagcatggtcttatgatattcattctttaaaatataatattgtgttagcc

SEQ ID NO: 348319 - DNA, 75 bp, Artificial Sequence
  Synthetic
cctcggtacgtacttaacgctattagtcctcatgcctatgatgtgtttagaaaatctaataacttgaaagagata

SEQ ID NO: 348320 - DNA, 75 bp, Artificial Sequence
  Synthetic
taggctttcataaagtccctaataacttcgtgaataatgtttctatgttttctactgatgcatgtatttgcttcg

SEQ ID NO: 348321 - DNA, 75 bp, Artificial Sequence
  Synthetic
tcatagatttaaacgcagtaatgctcgcaacattaacatcttgaaccgttggtacaattccgttccataaattta

SEQ ID NO: 348322 - DNA, 75 bp, Artificial Sequence
  Synthetic
aaaagagttaagttactcatatggacgccgtccagtctgaacatcaatctttttagccagagatatcatagccgc

SEQ ID NO: 348323 - DNA, 75 bp, Artificial Sequence
  Synthetic
cgccgtccagtctgaacatcaatctttttagccagagatatcatagccgctcttagagtttcagcgtgattttcc

SEQ ID NO: 348324 - DNA, 75 bp, Artificial Sequence
  Synthetic
aaactttgttgttacattagtaatctttttttccaaattagttagccgttgtttgagagtttcctcattgtcgtc

SEQ ID NO: 348325 - DNA, 75 bp, Artificial Sequence
  Synthetic
tttttttccaaattagttagccgttgtttgagagtttcctcattgtcgtcttcatcggctttaacaattgcttcg

SEQ ID NO: 348326 - DNA, 75 bp, Artificial Sequence
  Synthetic
cggatctacgtattttaaaacaatgttcacgacacctatgatagcgagagatctagtaactagagtaaatctaca

SEQ ID NO: 348327 - DNA, 75 bp, Artificial Sequence
  Synthetic
tggaattgcaagatcgtcatctccggggaaaagagttccgtccatttaaagtacagattttagaaactgacactc

SEQ ID NO: 348328 - DNA, 75 bp, Artificial Sequence
  Synthetic
catggattataaatatcgatgttaataacatcagaaaatgtaaagtctatacattgttgcatcgtgttaaatttt

SEQ ID NO: 348329 - DNA, 75 bp, Artificial Sequence
  Synthetic
acattgttgcatcgtgttaaattttctaatggatctagtattattgggtccaacttctgcctgaaatccaaatat

SEQ ID NO: 348330 - DNA, 75 bp, Artificial Sequence
  Synthetic
ctaatggatctagtattattgggtccaacttctgcctgaaatccaaatatggaagcggatacaaaaccgtttcct

SEQ ID NO: 348331 - DNA, 75 bp, Artificial Sequence
  Synthetic
gacatcttgaactctcctatctaatgccggtgttccacctatagattttgaatattcgaatgctgcatgagtagc

SEQ ID NO: 348332 - DNA, 75 bp, Artificial Sequence
  Synthetic
tttttttatgagtatttttacaaaaaaaatgtataaagtgtatgtcttatgtatatttataaaaatgctaagtat

SEQ ID NO: 348333 - DNA, 75 bp, Artificial Sequence
  Synthetic
gccggtgttccacctatagattttgaatattcgaatgctgcatgagtagcattaaattccttaatattgccataa

SEQ ID NO: 348334 - DNA, 75 bp, Artificial Sequence
  Synthetic
cgctaccacaataaaaaaaattgatagagagttcatttataatctattagaagctgacaaaatttttttacacgc

SEQ ID NO: 348335 - DNA, 75 bp, Artificial Sequence
  Synthetic
agagagttcatttataatctattagaagctgacaaaatttttttacacgcatcagacaatgctttaataaatagt

SEQ ID NO: 348336 - DNA, 75 bp, Artificial Sequence
  Synthetic
tacgtaaactgtttatacaagattgaaattatattcttttttttatagagtgtggtagtgttacggatatttaat

SEQ ID NO: 348337 - DNA, 75 bp, Artificial Sequence
  Synthetic
attacatccgaaaaagttgactatgttcatagtcattaagtcattaacaaacaacattccagactctggattata

SEQ ID NO: 348338 - DNA, 75 bp, Artificial Sequence
  Synthetic
cctaccttaatcatgtgattatgaatattggctattagagcaccttctaagaaatctataatatctttgaaacac

SEQ ID NO: 348339 - DNA, 75 bp, Artificial Sequence
  Synthetic
gaaatctataatatctttgaaacacgatttaaaatcaaaccacgaatatacttctacgaagaaagttagtttacc

SEQ ID NO: 348340 - DNA, 75 bp, Artificial Sequence
  Synthetic
gatttaaaatcaaaccacgaatatacttctacgaagaaagttagtttacccataggagaaataactataaatgga

SEQ ID NO: 348341 - DNA, 75 bp, Artificial Sequence
  Synthetic
tacaatgggtgatgataagtggaagatgttacccaatatgcccatagcattatctagttatggcatgtgtgtatt

SEQ ID NO: 348342 - DNA, 75 bp, Artificial Sequence
  Synthetic
taatttaacaatctctatatctatggttgagaaagaccagtagtattggatgggtaaagatcctccttcgtctct

SEQ ID NO: 348343 - DNA, 75 bp, Artificial Sequence
  Synthetic
tctattaaatacctccacatctaaaaatgttaattttgaaactatgtcttcgtttattaccgtacctgaactaaa

SEQ ID NO: 348344 - DNA, 75 bp, Artificial Sequence
  Synthetic
aatgttaattttgaaactatgtcttcgtttattaccgtacctgaactaaacgctataagctctattgtttgagaa

SEQ ID NO: 348345 - DNA, 75 bp, Artificial Sequence
  Synthetic
gtatataattattttaaacctaaagatgccattcctgttatcatatctataggaaaggataaagatgtctgtgaa

SEQ ID NO: 348346 - DNA, 75 bp, Artificial Sequence
  Synthetic
ggtcggtttatctaccatagttacagaatttgtatccttatctataatataataatcaaaatcgtataaagttat

SEQ ID NO: 348347 - DNA, 75 bp, Artificial Sequence
  Synthetic
aataatcaaaatcgtataaagttatataattatcgcgttcagattgtgatcttttcaaatagactaaaaacccca

SEQ ID NO: 348348 - DNA, 75 bp, Artificial Sequence
  Synthetic
ttgatggtgaaccagcagagactcgagtattgggtagagtcttaccttactatcttccagactctaaggatccag

SEQ ID NO: 348349 - DNA, 75 bp, Artificial Sequence
  Synthetic
ggaatatgctctaccgcagttagccattcctcattgacagcggtagatgtattagacaaaactattccaatgttt

SEQ ID NO: 348350 - DNA, 75 bp, Artificial Sequence
  Synthetic
attcctcattgacagcggtagatgtattagacaaaactattccaatgtttaacaagggccattttacgagattat

SEQ ID NO: 348351 - DNA, 75 bp, Artificial Sequence
  Synthetic
attgaattctcttcccgcggatgctgcatgatgaacgacgggatgttgttcgattgatttggaattctttttcga

SEQ ID NO: 348352 - DNA, 75 bp, Artificial Sequence
  Synthetic
gcatgatgaacgacgggatgttgttcgattgatttggaattctttttcgactttttgtttatattaaatatttta

SEQ ID NO: 348353 - DNA, 75 bp, Artificial Sequence
  Synthetic
aacatataacgtaaccagaattgtaaaattagaggtacgggataaaataataccttctactatgcaattaccaga

SEQ ID NO: 348354 - DNA, 75 bp, Artificial Sequence
  Synthetic
ttgcgcatcgatatctttattattagataaatttatcaataaatgtgagaagtttgcctcgttaaggtcttccat

SEQ ID NO: 348355 - DNA, 75 bp, Artificial Sequence
  Synthetic
ttggtacatagctaataatacctatacacccaataatacaacaaccatttctgagttggatatcatcaaaatact

SEQ ID NO: 348356 - DNA, 75 bp, Artificial Sequence
  Synthetic
tcttctacaatatctatgactctgatttcttgaacatcatctgcactaattaacagttttactatatacctgcct

SEQ ID NO: 348357 - DNA, 75 bp, Artificial Sequence
  Synthetic
atttttaacatggcatctattttaaatacacttaggtttttggaaaaaacatcattttataattgtaacgattca

SEQ ID NO: 348358 - DNA, 75 bp, Artificial Sequence
  Synthetic
aacataagggaatgtcatttgtattttataagccaaagcattctaccgttgttaaatacttgtctggaggaggta

SEQ ID NO: 348359 - DNA, 75 bp, Artificial Sequence
  Synthetic
aagatgatgctattttacatggatttatcatatcatggagtgacaagtagtggagcaatttacaaattgggatcg

SEQ ID NO: 348360 - DNA, 75 bp, Artificial Sequence
  Synthetic
ataaacactcatattatcaggaacattatcaatttttacatacacatcagcatcttgaatagaaacgataccatc

SEQ ID NO: 348361 - DNA, 75 bp, Artificial Sequence
  Synthetic
ctggtatccgatgatatctctaaacttcaatctgttaagattaatttcgaatttgtatgtttgggagaattaaat

SEQ ID NO: 348362 - DNA, 75 bp, Artificial Sequence
  Synthetic
tatcatatcatggagtgacaagtagtggagcaatttacaaattgggatcgtctatcgatagactttctctaaata

SEQ ID NO: 348363 - DNA, 75 bp, Artificial Sequence
  Synthetic
atcggcggtatcggtacatatacgtaattcaccttcacaaaatacggagtcttcgataataatagccaatcgatt

SEQ ID NO: 348364 - DNA, 75 bp, Artificial Sequence
  Synthetic
tacggttataccgtcgcaagaccacaggtttaaactaatactagatccgaaaatcaacgtaacgataggagaacc

SEQ ID NO: 348365 - DNA, 75 bp, Artificial Sequence
  Synthetic
aattcaccttcacaaaatacggagtcttcgataataatagccaatcgattattggatctagctgtctgtatcata

SEQ ID NO: 348366 - DNA, 75 bp, Artificial Sequence
  Synthetic
tagcatattttccgcgtctgagatggaaatgttaaaactacaaaaatgcgtaatgttagcccgtcctaatattgg

SEQ ID NO: 348367 - DNA, 75 bp, Artificial Sequence
  Synthetic
cttaggcatggacatactaatatctgtcttaattaactgtctttctcctggagggatagtataatcgtaagcgct

SEQ ID NO: 348368 - DNA, 75 bp, Artificial Sequence
  Synthetic
gaaatgttaaaactacaaaaatgcgtaatgttagcccgtcctaatattggtacgtgtctataagtttggcatagt

SEQ ID NO: 348369 - DNA, 75 bp, Artificial Sequence
  Synthetic
agtattgcattttgatagtttatcgcctacatcatcaaaaataagtaaaaagtgtgctgattttttatgattttg

SEQ ID NO: 348370 - DNA, 75 bp, Artificial Sequence
  Synthetic
ttacttttagttcgtatcagattatattctagagattcctgactactaacgaaattaatatgatttggccaaatg

SEQ ID NO: 348371 - DNA, 75 bp, Artificial Sequence
  Synthetic
cgggtgtaaacaagaatatatgtttatattttttaactagtgtagaaaacagagatagtaaatagatagtttttc

SEQ ID NO: 348372 - DNA, 75 bp, Artificial Sequence
  Synthetic
atattttttaactagtgtagaaaacagagatagtaaatagatagtttttccagatccagatcctcccgttaaaac

SEQ ID NO: 348373 - DNA, 75 bp, Artificial Sequence
  Synthetic
tattatttatctagcgattatgaaaattataatgaatattattatgatgattatgatagaactggtatgaacagt

SEQ ID NO: 348374 - DNA, 75 bp, Artificial Sequence
  Synthetic
ggaaacaattcataattatatttacagttactaaattaatttgataataaatcaaaatatggaaaactaaggtcg

SEQ ID NO: 348375 - DNA, 75 bp, Artificial Sequence
  Synthetic
tttttttatagcgtgaaggatatgataaaaaatataattgttgtatttatcccattccaatcaccttatatgatt

SEQ ID NO: 348376 - DNA, 75 bp, Artificial Sequence
  Synthetic
ttatcatgatgacaccagaaaacgacgaagagcagacatctgtgttctccgctactgtttacggagacaaaattc

SEQ ID NO: 348377 - DNA, 75 bp, Artificial Sequence
  Synthetic
gattggtctatgtattagaatatctatggttatttcactactatctatgattaccatgtcagcgtttctcatagt

SEQ ID NO: 348378 - DNA, 75 bp, Artificial Sequence
  Synthetic
tacgtaattatagacttgatccatttcctccatgcaaactatctaaatgtaattaattatgattttgatgataat

SEQ ID NO: 348379 - DNA, 75 bp, Artificial Sequence
  Synthetic
atggttatttcactactatctatgattaccatgtcagcgtttctcatagtgcgcctaaatcaatgcatgtctgct

SEQ ID NO: 348380 - DNA, 75 bp, Artificial Sequence
  Synthetic
tactcatagaaaggttgcgtctagcactacgcaatatgatcacaaagaaagctgtaatggtttatattaccaggg

SEQ ID NO: 348381 - DNA, 75 bp, Artificial Sequence
  Synthetic
tgttacatgatctatagatgatgtattgattttggtaggatcaaattccatatccgcgactaaacagtgaaaaaa

SEQ ID NO: 348382 - DNA, 75 bp, Artificial Sequence
  Synthetic
gctgtaatggtttatattaccagggttcttgttatatattacattcagactaccagttattctcggatgctaaag

SEQ ID NO: 348383 - DNA, 75 bp, Artificial Sequence
  Synthetic
atttataatatactcttacaacgccatcatgaatagcagcagtaaattaattgctgttattaatggatttagaaa

SEQ ID NO: 348384 - DNA, 75 bp, Artificial Sequence
  Synthetic
actacctggctcattgattatgttgaggatacatggggatctgatggtaatccaattacaaaaactacatccgat

SEQ ID NO: 348385 - DNA, 75 bp, Artificial Sequence
  Synthetic
aggatacatggggatctgatggtaatccaattacaaaaactacatccgattatcaagattctgatgtatcacaag

SEQ ID NO: 348386 - DNA, 75 bp, Artificial Sequence
  Synthetic
cgtgaaataggaataattagcaccagaatagctatggattattgtggtagagagtgcactattctatgtcgtcta

SEQ ID NO: 348387 - DNA, 75 bp, Artificial Sequence
  Synthetic
tacattaataaatgaaatcgcttaatagacaaactgtaagtaggtttaagaagttgtcggtgccggccgctataa

SEQ ID NO: 348388 - DNA, 75 bp, Artificial Sequence
  Synthetic
tagacaaactgtaagtaggtttaagaagttgtcggtgccggccgctataatgatgatactctcaaccattattag

SEQ ID NO: 348389 - DNA, 75 bp, Artificial Sequence
  Synthetic
tcctcataaagaacactgcagccattttctatgaacaaatcaataattttaggaacaggatcattgtcattacat

SEQ ID NO: 348390 - DNA, 75 bp, Artificial Sequence
  Synthetic
catctgagagtattgtttagtattttttataaagattattgggtaagtttaaaaaagaccaatgataaatggtta

SEQ ID NO: 348391 - DNA, 75 bp, Artificial Sequence
  Synthetic
tttataaagattattgggtaagtttaaaaaagaccaatgataaatggttagatattaataatgataaagatatag

SEQ ID NO: 348392 - DNA, 75 bp, Artificial Sequence
  Synthetic
atatcgacttacgtctgctaaaatacctaattgtggataaacggatacgtccgtccaagaatacgaattatgcaa

SEQ ID NO: 348393 - DNA, 75 bp, Artificial Sequence
  Synthetic
gaagcgtgttatatatacaagtctggaaaactggttaaaacagtatgtaaaagtactcaatctgtactatgtgtt

SEQ ID NO: 348394 - DNA, 75 bp, Artificial Sequence
  Synthetic
tataggaccatacattataggtaacataaaaactgtccaaatagatgtacgggatataaaatattccgacatgca

SEQ ID NO: 348395 - DNA, 75 bp, Artificial Sequence
  Synthetic
aaaatgctactttagctataagggtaaaatagttcctcaggattctaatgatttggctagattcaacatttatag

SEQ ID NO: 348396 - DNA, 75 bp, Artificial Sequence
  Synthetic
atgatatcatgttagatatagaagataaacatcagccattttatctattcccatctattgatgtttttaacgcta

SEQ ID NO: 348397 - DNA, 75 bp, Artificial Sequence
  Synthetic
taaacatcagccattttatctattcccatctattgatgtttttaacgctacaatcatagaagcgtataacctgta

SEQ ID NO: 348398 - DNA, 75 bp, Artificial Sequence
  Synthetic
tgaaattgtcgtttaattcttcattctgcatatcagacggcaatggatggatcataattgatgggaaatgcaata

SEQ ID NO: 348399 - DNA, 75 bp, Artificial Sequence
  Synthetic
ctgcatatcagacggcaatggatggatcataattgatgggaaatgcaatagtaattttttatcataaaagttgta

SEQ ID NO: 348400 - DNA, 75 bp, Artificial Sequence
  Synthetic
aatcagaaatgatgctggtacctcttatcacggtgaccgtagttgcgggaacaatattagtatgttatatattat

SEQ ID NO: 348401 - DNA, 75 bp, Artificial Sequence
  Synthetic
tatcacggtgaccgtagttgcgggaacaatattagtatgttatatattatatatttgtaggaaaaagatacgtac

SEQ ID NO: 348402 - DNA, 75 bp, Artificial Sequence
  Synthetic
gaactctcttcattactatatatcgtctcatagagaatctctatccaaggatgtaattaaatgtttgatcgataa

SEQ ID NO: 348403 - DNA, 75 bp, Artificial Sequence
  Synthetic
gttctaattccagcaaatctagtaaatcaactgatagcgaatcagactgggaggatcactgtagtgctatggaac

SEQ ID NO: 348404 - DNA, 75 bp, Artificial Sequence
  Synthetic
atcaactgatagcgaatcagactgggaggatcactgtagtgctatggaacaaaacaatgacgtagataatatttc

SEQ ID NO: 348405 - DNA, 75 bp, Artificial Sequence
  Synthetic
tttagacaacaggatgaatccatcgtacaagccatactgataaactacttacattacggcgatatggtaagtata

SEQ ID NO: 348406 - DNA, 75 bp, Artificial Sequence
  Synthetic
ataacgaatccaatgttatggcgcctagcacagaacacatttacgatagtgttgctggaagcacgctgctaataa

SEQ ID NO: 348407 - DNA, 75 bp, Artificial Sequence
  Synthetic
gttgctggaagcacgctgctaataaataatgatcgtaatgaacagactatttatcagaacactacagtagtaatt

SEQ ID NO: 348408 - DNA, 75 bp, Artificial Sequence; identical to SEQ ID NO: 46456
  Synthetic

SEQ ID NO: 348409 - DNA, 75 bp, Artificial Sequence
  Synthetic
ctaaacattttgcagaaaaaagtttattagtgtttagataatcgtatacttcatcagtgtagatagtaaatgtga

SEQ ID NO: 348410 - DNA, 75 bp, Artificial Sequence
  Synthetic
ctctactatattacgcggtcgatgtcaataatatacaatttgcaaagcggttattggaatatggagcgagtgtca

SEQ ID NO: 348411 - DNA, 75 bp, Artificial Sequence
  Synthetic
gagatggacgagattgtgagcatcgttcgcgacagtatgtggtacatacctaacgtatttatggacgacggtaag

SEQ ID NO: 348412 - DNA, 75 bp, Artificial Sequence
  Synthetic
ctgtattcggcatttctaaaattagcaattttattgctaataatgactgtagatattatatagatacagaacatc

SEQ ID NO: 348413 - DNA, 75 bp, Artificial Sequence
  Synthetic
attgtaaatacagatagtgaatcgactatagacataatactatctggatctacacattcaccggaaactagttct

SEQ ID NO: 348414 - DNA, 75 bp, Artificial Sequence
  Synthetic
tatacggattaatagcgtgacttcatccatcgctagtccacccattacggaagataaatcgttcaatagtgtaga

SEQ ID NO: 348415 - DNA, 75 bp, Artificial Sequence
  Synthetic
ctatagacataatactatctggatctacacattcaccggaaactagttctgagaaacctgattatatagataatt

SEQ ID NO: 348416 - DNA, 75 bp, Artificial Sequence
  Synthetic
cgcgactccggaaccaattactgataatgtagaagatcatacagacaccgtcacatacactagtgatagcattaa

SEQ ID NO: 348417 - DNA, 75 bp, Artificial Sequence
  Synthetic
aggaagtagaatcataaagaacagtactcaatcaatagcaatcatgaaacaatatatcgtcctggcatgcatgtg

SEQ ID NO: 348418 - DNA, 75 bp, Artificial Sequence
  Synthetic
acgtatctcaatataatattactctcattcctcatccacaacccattaaaaaaatggaaattaaagccctctatt

SEQ ID NO: 348419 - DNA, 75 bp, Artificial Sequence
  Synthetic
atatgagcattagtatttctgtgtattaatagatttctagtatggggatcattaatcatctctaatctctaaata

SEQ ID NO: 348420 - DNA, 75 bp, Artificial Sequence
  Synthetic
caaatactgtacggaatggattcattctcttctctttttatgaaactctgttgtatatctactgataaaactgga

SEQ ID NO: 348421 - DNA, 75 bp, Artificial Sequence
  Synthetic
ttgtatatctactgataaaactggaagcaaaaaatctgatagaaagaataagaataagatcaagatcaaggatta

SEQ ID NO: 348422 - DNA, 75 bp, Artificial Sequence
  Synthetic
tagtatacacgttagattattctcaaactcctaattatgacagactacgtagactgtttatacaagattgaaatt

SEQ ID NO: 348423 - DNA, 75 bp, Artificial Sequence
  Synthetic
ctctcttaaaatggttgagaccaagcttcgttgtagaaacactgaagctaacgatgagattcatcgtcgcgtgat

SEQ ID NO: 348424 - DNA, 75 bp, Artificial Sequence
  Synthetic
cgtctactagctcgtggtattatacacatgcctagtaatagtctctttgcgttgacggaaagcagactagaaata

SEQ ID NO: 348425 - DNA, 75 bp, Artificial Sequence
  Synthetic
aaaaaagatactagcctactgcctattaagggacgagtcattcgcggaactacatagtaaattctgtttaaacga

SEQ ID NO: 348426 - DNA, 75 bp, Artificial Sequence
  Synthetic
tggattttgttgtgctgttgtacatactgtaccaccagtaggtgtaggagtacatacagtggccacaataggagg

SEQ ID NO: 348427 - DNA, 75 bp, Artificial Sequence
  Synthetic
acatgcctagtaatagtctctttgcgttgacggaaagcagactagaaataacaggctaaaatgttcagacaccat

SEQ ID NO: 348428 - DNA, 75 bp, Artificial Sequence
  Synthetic
cgggtaccttcacatctcgcaataatcatttacccgcttgtctaagttgtaacggaagacgcgatcgtgtaacac

SEQ ID NO: 348429 - DNA, 75 bp, Artificial Sequence
  Synthetic
tctctccctacgacgattactacgtaaaaaagatactagcctactgcctattaagggacgagtcattcgcggaac

SEQ ID NO: 348430 - DNA, 75 bp, Artificial Sequence
  Synthetic
aactcaatcccaaacccaaaaccgttaaaatgtatccggccaattgatagtagataatgaggtgtacagcgcatg

SEQ ID NO: 348431 - DNA, 75 bp, Artificial Sequence
  Synthetic
tagataatgaggtgtacagcgcatgataatttacacagtaaccaaaatgaaaatactttagtaattataagaaat

SEQ ID NO: 348432 - DNA, 75 bp, Artificial Sequence
  Synthetic
gaacgttcacatcgacggacaatctaaaaacaatacagtgattgcagatttgccatatctggataatgctgtatc

SEQ ID NO: 348433 - DNA, 75 bp, Artificial Sequence
  Synthetic
ttttttctatgctataaatgaattctcattttgcatctgctcatactccgttttatatcaataccaaagaaggaa

SEQ ID NO: 348434 - DNA, 75 bp, Artificial Sequence
  Synthetic
aaagataaacatcaacattgtttggtaatcattaaaccaattagtatgaagttgaactaatttcacagtagattt

SEQ ID NO: 348435 - DNA, 75 bp, Artificial Sequence
  Synthetic
aggtcttatcacgtgcaaggcatttggtctatacaaatccattaatgtggaatatagattcttggtaattaatag

SEQ ID NO: 348436 - DNA, 75 bp, Artificial Sequence
  Synthetic
ggtctatacaaatccattaatgtggaatatagattcttggtaattaatagattaggtgcagatctagatgcggtg

SEQ ID NO: 348437 - DNA, 75 bp, Artificial Sequence
  Synthetic
tcgtcttggaagttttattataagttaaaatatcatggttgtccaatttccatctaatatactttgtcggattat

SEQ ID NO: 348438 - DNA, 75 bp, Artificial Sequence
  Synthetic
ccagattatgcgatagcaagactaacacacaatgtacgccgtgtggttcgggtaccttcacatctcgcaataatc

SEQ ID NO: 348439 - DNA, 75 bp, Artificial Sequence
  Synthetic
gtctttgtagttgttataacaaccaacgtatagaggtatatcaacgatattctaactcttgacattttttattta

SEQ ID NO: 348440 - DNA, 75 bp, Artificial Sequence
  Synthetic
taataaagatgccatttagagatctaattttgtttaacttgtccaaattcctacttacagaagatgaggaatcgt

SEQ ID NO: 348441 - DNA, 75 bp, Artificial Sequence
  Synthetic
tttaaaatgatacctttgttatttattttattctattttgctaacggtattgaatggcataagtttgaaacgagt

SEQ ID NO: 348442 - DNA, 75 bp, Artificial Sequence
  Synthetic
cattttttctttggtacaaaatttcacacaagtttttatacagacaaattcttgtccatatattttaaaacattg

SEQ ID NO: 348443 - DNA, 75 bp, Artificial Sequence
  Synthetic
ataacggaaatcccaaatgttggaaaatagacggttcagacgacccaaaacatagaggtagaggatacgctcctt

SEQ ID NO: 348444 - DNA, 75 bp, Artificial Sequence
  Synthetic
atgtgaacgctgcccacctcatacatataccgcaatccccaattattctaatggatgtcatcaatgtagaaaatg

SEQ ID NO: 348445 - DNA, 75 bp, Artificial Sequence
  Synthetic
cgagccactactcctcgtaaaccagcggctactaaaagatcaaccaaaaaggaggaagtggaagaagaagtagtt

SEQ ID NO: 348446 - DNA, 75 bp, Artificial Sequence
  Synthetic
accatgtggttatgatttatacacggcggataacgtaattccaaaagatggtttacgaggagcattcgtcgataa

SEQ ID NO: 348447 - DNA, 75 bp, Artificial Sequence
  Synthetic
tctttttatttttttaaacagatcaatggtgtgatgttgattaggtcttttacgaatttgatatagaatagcgtt

SEQ ID NO: 348448 - DNA, 75 bp, Artificial Sequence
  Synthetic
atggagtcgtaaaaaagttttatctctttctctcttcgatggtctcacaaaaatattaaacctctttctgatgga

SEQ ID NO: 348449 - DNA, 75 bp, Artificial Sequence
  Synthetic
ggaagaagttatagacaaattattcattctaaaactataaaaacagataatgatacgatactatatgtattcttc

SEQ ID NO: 348450 - DNA, 75 bp, Artificial Sequence
  Synthetic
agtcgaattagaatgtgacatcgacggaagaagttatagacaaattattcattctaaaactataaaaacagataa

SEQ ID NO: 348451 - DNA, 75 bp, Artificial Sequence
  Synthetic
tccttcgatggtctcacaaaaatattaaacctctttctgatggagtcgtaaaaaagttttatctctttctccttc

SEQ ID NO: 348452 - DNA, 75 bp, Artificial Sequence
  Synthetic
tatgaataccattaaacaatctttttctacgtcaaaattggaaggatatacaaagcaattgccgtctccagctcc

SEQ ID NO: 348453 - DNA, 75 bp, Artificial Sequence
  Synthetic
tctttctgatggagtcgtaaaaaagttttatctctttctcctttctcacaaaaatattaaacctctttctgatgg

SEQ ID NO: 348454 - DNA, 75 bp, Artificial Sequence
  Synthetic
caacctatcttcgaaggaccgtctggtgttaaatggttcgatataaaggagaaggaaaatgaacatcgggaatat

SEQ ID NO: 348455 - DNA, 75 bp, Artificial Sequence
  Synthetic
taaacaaactcgcagtgcacaagtcaatgcacaactattttcagtaatggtaactgcgaaaccgttatttatagc

SEQ ID NO: 348456 - DNA, 75 bp, Artificial Sequence
  Synthetic
agatcgtttgtttcggcctgaagttggtgcatatctctttcaacattcgacatgagatccttaagggccatatcg

SEQ ID NO: 348457 - DNA, 75 bp, Artificial Sequence
  Synthetic
ccacgaatgaaaaaatacttaaaatgtaatcttaattcgagtacaccacacgacaatgaacaaacataagacaga

SEQ ID NO: 348458 - DNA, 75 bp, Artificial Sequence
  Synthetic
atggtctcataataaaagttttacataaatattttcattctctctctctctgtgatggtctcataaaaaaagttt

SEQ ID NO: 348459 - DNA, 75 bp, Artificial Sequence
  Synthetic
tttttacagcgacactattaaaagttgtagaacgtaaattagttcatacaccatcaatagataaaacgataaaag

SEQ ID NO: 348460 - DNA, 75 bp, Artificial Sequence
  Synthetic
gatggagtcgtaaaaaagttttatctctttctccttcgatggtctcacaaaaatattaaacctctttctgatgga

SEQ ID NO: 348461 - DNA, 75 bp, Artificial Sequence
  Synthetic
atcttagcgaactgaaggaatcaggtggatggagtcccagaccagaaatgcaggaatttgaatatccagatggag

SEQ ID NO: 348462 - DNA, 75 bp, Artificial Sequence
  Synthetic
ccatcaatagataaaacgataaaagatgcatatattagagaagattgtcctactgactggataagctataataat

SEQ ID NO: 348463 - DNA, 75 bp, Artificial Sequence
  Synthetic
aaaaagttttatctctttctccttcgatggtctcacaaaaatattaaacctctttctgatggtctctataaagcg

SEQ ID NO: 348464 - DNA, 75 bp, Artificial Sequence
  Synthetic
tgcatgcaaagctctaaatccaaattcggatctaattaagatagagactccaaacgagttaagttttttaagaag

SEQ ID NO: 348465 - DNA, 75 bp, Artificial Sequence
  Synthetic
atttcagatgaatagagttatcgattcagacacacgctttgagttttgttgaatcgatgagtgaagtattatcgg

SEQ ID NO: 348466 - DNA, 75 bp, Artificial Sequence
  Synthetic
ccgtactgttcttgtttttataaaaataacaattaacaattatcaaattttttctttaatattttacgtggttga

SEQ ID NO: 348467 - DNA, 75 bp, Artificial Sequence
  Synthetic
tttctttaatattttacgtggttgaccattcttggtggtaaaataatctcttagtgttggaatggaatgctgttt

SEQ ID NO: 348468 - DNA, 75 bp, Artificial Sequence
  Synthetic
cgcaatagtcagactgtagttctatcatgcttcctacatcagaaggaggaacagttttaaagtctcttggtttta

SEQ ID NO: 348469 - DNA, 75 bp, Artificial Sequence
  Synthetic
atcctttgttttatccacttcacattttaaataaatgtccactatacattcttctgttaattttactagatcgtc

SEQ ID NO: 348470 - DNA, 75 bp, Artificial Sequence
  Synthetic
ttaatttccacatcgatatagttaaaggtatttctgggtacgggttcgcatttatctgcggaagagacggtgtga

SEQ ID NO: 348471 - DNA, 75 bp, Artificial Sequence
  Synthetic
cttctgttaattttactagatcgtcatgggtcatagaatttataggttccgtagtccatggatccaaactagcaa

SEQ ID NO: 348472 - DNA, 75 bp, Artificial Sequence
  Synthetic
cagaaatatttaatcctccgtttgatacagatgcgccatatttatggatttcggattcacacgttgtttgtctga

SEQ ID NO: 348473 - DNA, 75 bp, Artificial Sequence
  Synthetic
agaggtctaccgcatacgaaataaataatgaattggaactagtatttattaagccgccattaattactttgacaa

SEQ ID NO: 348474 - DNA, 75 bp, Artificial Sequence
  Synthetic
ttattgtcagaatcgcataccgatttatcatcatacactgtttgaaaactaaatggtatacacatcaaaataata

SEQ ID NO: 348475 - DNA, 75 bp, Artificial Sequence
  Synthetic
aaatggtatacacatcaaaataataaataataacgagtacattctgcaatattgttatcgtaattggaaaattag

SEQ ID NO: 348476 - DNA, 75 bp, Artificial Sequence
  Synthetic
caatggctgaatggcataaaattatcgaggatatctcaaaaaataataagttcgaggatgccgccatcgttgatt

SEQ ID NO: 348477 - DNA, 75 bp, Artificial Sequence
  Synthetic
aagattaatccgggtgaaattattcctctcatcactaatcgtaatattctaaaacctcttattggtcagaaatat

SEQ ID NO: 348478 - DNA, 75 bp, Artificial Sequence
  Synthetic
tgtattgtatatactaactctctaatggatgagaacacgtatgctatggagttgcttactgggtacgcccctgta

SEQ ID NO: 348479 - DNA, 75 bp, Artificial Sequence
  Synthetic
tggatgagaacacgtatgctatggagttgcttactgggtacgcccctgtatctccgatcgttatagcgagaactc

SEQ ID NO: 348480 - DNA, 75 bp, Artificial Sequence
  Synthetic
gtgtatagaacgtgtagagatcacgctacccgtgtacgcgcaactggtaattaaaataaaaagtaatattcatat

SEQ ID NO: 348481 - DNA, 75 bp, Artificial Sequence
  Synthetic
ctacccgtgtacgcgcaactggtaattaaaataaaaagtaatattcatatgtagtgtcaattttaaatgatgatg

SEQ ID NO: 348482 - DNA, 75 bp, Artificial Sequence
  Synthetic
acatttttaacagcaacacattcaatattgtattgttatttttatattatttacacaattaacaatatattatta

SEQ ID NO: 348483 - DNA, 75 bp, Artificial Sequence
  Synthetic
agagttacatcaaacgggttgtattgttattttacacatcttgggtatattattagatatccagttaagagaata

SEQ ID NO: 348484 - DNA, 75 bp, Artificial Sequence
  Synthetic
atacagttcatcgatttttagatttcattcagaggatgtggaattatgttatgggcatttgtattttgataggat

SEQ ID NO: 348485 - DNA, 75 bp, Artificial Sequence
  Synthetic
ttcatcctgttgtctaaatctctttagaatgttatcgatgatgtagtggttatattctctggaatcgtacgaagt

SEQ ID NO: 348486 - DNA, 75 bp, Artificial Sequence
  Synthetic
agatgaactagacgataatgtcttttttacacatggttattttttaaaacacaaatatggttcacttaatcctag

SEQ ID NO: 348487 - DNA, 75 bp, Artificial Sequence
  Synthetic
aaatttggcaacgagtacatctactatattaacatctaaacataagacttattctctacatcggtccacgtgtat

SEQ ID NO: 348488 - DNA, 75 bp, Artificial Sequence
  Synthetic
tcaagaataaacgattggtattcgtacaggtacctccgtcgttaggagatgatagtcatttgactaatccgttat

SEQ ID NO: 348489 - DNA, 75 bp, Artificial Sequence
  Synthetic
atattaacatctaaacataagacttattctctacatcggtccacgtgtattactataataggatacgattctatt

SEQ ID NO: 348490 - DNA, 75 bp, Artificial Sequence
  Synthetic
atatggtataaagatataaatgacaagtataatggcatctatgattttactgcaatatgtatgctaatagcgtct

SEQ ID NO: 348491 - DNA, 75 bp, Artificial Sequence
  Synthetic
tgcaatatgtatgctaatagcgtctacattgatagtgaccatatacgtgtttaaaaaaataaaaatgaactctta

SEQ ID NO: 348492 - DNA, 75 bp, Artificial Sequence
  Synthetic
attatgctatgctattagaaatggataaaatcaaaattacggttgattcaaaaattggtaatgttgttaccatat

SEQ ID NO: 348493 - DNA, 75 bp, Artificial Sequence
  Synthetic
cgtggatatgtgtttacagtagtaatgaagagaagtgagtccatcctcgtcggcgcaattagggtcggatccttt

SEQ ID NO: 348494 - DNA, 75 bp, Artificial Sequence
  Synthetic
gtcagagattaattagtctattatccaagaagctggatcctggagataaatggtcgtgttttcctaacgaaataa

SEQ ID NO: 348495 - DNA, 75 bp, Artificial Sequence
  Synthetic
aaaaccgaacaatatatttttttagtaatgtttatgcgagacatataaaataaactccgtgtttatgatgccggt

SEQ ID NO: 348496 - DNA, 75 bp, Artificial Sequence
  Synthetic
gaaaaggatgtattattagcgcaatcagttgctgtcgaagaggcaaaagatgtcaaggtagaagaaaaaaatatt

SEQ ID NO: 348497 - DNA, 75 bp, Artificial Sequence
  Synthetic
cagttgctgtcgaagaggcaaaagatgtcaaggtagaagaaaaaaatattatcgatattgaagatgacgatgata

SEQ ID NO: 348498 - DNA, 75 bp, Artificial Sequence
  Synthetic
aaaattatttttatcaccacgtgtgtttcaggatcatcgtcgacgcccgtcaaccaaccgaacggagtaaaataa

SEQ ID NO: 348499 - DNA, 75 bp, Artificial Sequence
  Synthetic
ggagtagttgaaatctagttctgcattgttggtacgcacctcaaatgtagtgttggatatcttcaacgtatagtt

SEQ ID NO: 348500 - DNA, 75 bp, Artificial Sequence
  Synthetic
ttgttggtacgcacctcaaatgtagtgttggatatcttcaacgtatagttgttgagtagtgatggttttctaaat

SEQ ID NO: 348501 - DNA, 75 bp, Artificial Sequence
  Synthetic
tggaattctagatccttgttctattcccaatggtttcatcaatagaagattaaacatatcgtacgaacacgatgg

SEQ ID NO: 348502 - DNA, 75 bp, Artificial Sequence
  Synthetic
agagtaatcgtagcaaaagtaagcatttcctttaatcttagatcccggatactggatatattttgcagccaacac

SEQ ID NO: 348503 - DNA, 75 bp, Artificial Sequence
  Synthetic
catcgactgtacgatacataatgttaccgtgttgcttacattgctcgtaaaagactttcgtcaatttgtctcctt

SEQ ID NO: 348504 - DNA, 75 bp, Artificial Sequence
  Synthetic
accgtgttgcttacattgctcgtaaaagactttcgtcaatttgtctccttctccgtaaattccagtgggtcttag

SEQ ID NO: 348505 - DNA, 75 bp, Artificial Sequence
  Synthetic
tcataaccagttgctcggccatacgtttactttttgcgtatacatgtcctggtgatatatcataaagggtatgct

SEQ ID NO: 348506 - DNA, 75 bp, Artificial Sequence
  Synthetic
tttactttttgcgtatacatgtcctggtgatatatcataaagggtatgctcatggccgatgaatggatcaccgtg

SEQ ID NO: 348507 - DNA, 75 bp, Artificial Sequence
  Synthetic
taggagattgtatctgtcaagttactgctgtagacgtacatggaaaggaaattatgagaatgagattcaaaaagg

SEQ ID NO: 348508 - DNA, 75 bp, Artificial Sequence
  Synthetic
tgggttgtggatgaggaatgagagtgatatcatattgagatacgtagttatgtagaggtgtatttcctatattat

SEQ ID NO: 348509 - DNA, 75 bp, Artificial Sequence
  Synthetic
tgtacgatctaacgaaaaatttgatccagtggatgatggtcccgacgatgagacagatttgagcaaactctcgaa

SEQ ID NO: 348510 - DNA, 75 bp, Artificial Sequence
  Synthetic
ttcctaggtccacacaagctgccaaaatagtctgtgttccataatagtttactttcatgatttcattatcggtgt

SEQ ID NO: 348511 - DNA, 75 bp, Artificial Sequence
  Synthetic
aatagtctgtgttccataatagtttactttcatgatttcattatcggtgtattttccaaatacatccactagagc

SEQ ID NO: 348512 - DNA, 75 bp, Artificial Sequence
  Synthetic
caaagtcgtttatatcacattgtatatagtttataaccttaactttcgaggttattggttgtggatcttctacaa

SEQ ID NO: 348513 - DNA, 75 bp, Artificial Sequence
  Synthetic
ctacttattctattttactaaataatggctgtttgtataatagaccacgataatatcagaggagttatttacttt

SEQ ID NO: 348514 - DNA, 75 bp, Artificial Sequence
  Synthetic
agcattgaaaatacgttctattgtgtagatggatgtagcaagatttttaaacaacaatgccattttacacgatga

SEQ ID NO: 348515 - DNA, 75 bp, Artificial Sequence
  Synthetic
atccggaacgtatagtttgataattcatcgttacggagatattagtcaaggatgtgattccataggcagtccaga

SEQ ID NO: 348516 - DNA, 75 bp, Artificial Sequence
  Synthetic
catcgttacggagatattagtcaaggatgtgattccataggcagtccagaaatatttatcggtaacatctttgta

SEQ ID NO: 348517 - DNA, 75 bp, Artificial Sequence
  Synthetic
gatgtgattccataggcagtccagaaatatttatcggtaacatctttgtaaacagatatggtgtagcatatgttt

SEQ ID NO: 348518 - DNA, 75 bp, Artificial Sequence
  Synthetic
atttcaaaaaatgatcagagattagcgtgtggagttattggtatttcttacataaatgaaaagataatacatttt

SEQ ID NO: 348519 - DNA, 75 bp, Artificial Sequence
  Synthetic
aaaacgatagatactttggtttattggattcgtgtaatcatatattttgcataacatgcatcaatatatggcata

SEQ ID NO: 348520 - DNA, 75 bp, Artificial Sequence
  Synthetic
cgtgtggagttattggtatttcttacataaatgaaaagataatacattttcttacaattaacgagaatggcgttt

SEQ ID NO: 348521 - DNA, 75 bp, Artificial Sequence
  Synthetic
tactcagcaaaataaattagtcatacgtaatgaagttaatgatacacactacactgtcgaatttgatagggacaa

SEQ ID NO: 348522 - DNA, 75 bp, Artificial Sequence
  Synthetic
agtagttgacacgtttatttcatataatagacataatgacaccatagagataagaggggtgcttccagaggaaac

SEQ ID NO: 348523 - DNA, 75 bp, Artificial Sequence
  Synthetic
ataagtatagttttaaactgattttagcagaatatataagacacagaaatactatatccggcaatatttattcgg

SEQ ID NO: 348524 - DNA, 75 bp, Artificial Sequence
  Synthetic
agcagaatatataagacacagaaatactatatccggcaatatttattcggcattgatgacactagatgatttggc

SEQ ID NO: 348525 - DNA, 75 bp, Artificial Sequence
  Synthetic
tagactccgattcgggactatttgactttgtcaactttgtaaaggatatgatatgttgtgattctagaatagtag

SEQ ID NO: 348526 - DNA, 75 bp, Artificial Sequence
  Synthetic
ctttgtcaactttgtaaaggatatgatatgttgtgattctagaatagtagtagctctatctagtctagtatctaa

SEQ ID NO: 348527 - DNA, 75 bp, Artificial Sequence
  Synthetic
atatatctgatagtattccaatatctgagctatctagactacgatacaatctatgtaagtatctacgcgggcaca

SEQ ID NO: 348528 - DNA, 75 bp, Artificial Sequence
  Synthetic
gtatgcgatgttagaactgtagaatgcgaaggaagtaaagcttcctgcgtactcaaagtagataaaccctcatcg

SEQ ID NO: 348529 - DNA, 75 bp, Artificial Sequence
  Synthetic
ggtcagatactggtttgataaactgtttattccacataagtatgtttgactttatggttagacccgcatacttta

SEQ ID NO: 348530 - DNA, 75 bp, Artificial Sequence
  Synthetic
gcttctttttgtactgtaacttctggttttgttagatggttgcatcgtgctttaacgtcaatggtacaaatttta

SEQ ID NO: 348531 - DNA, 75 bp, Artificial Sequence
  Synthetic
cgttctggaacattaaatgtattttttatgatatactccaacgcatttatgtgggcatacaacaagtcattacta

SEQ ID NO: 348532 - DNA, 75 bp, Artificial Sequence
  Synthetic
tttcaacagactgtttatgaactcgaatgccgcctcattgtcgcttatattgatgatgtcgaattctcccaatat

SEQ ID NO: 348533 - DNA, 75 bp, Artificial Sequence
  Synthetic
ttatcgggatccaagttttctaaagatgtcattaaaccctcgatcatgaatggatttatcatcatcgtttttatg

SEQ ID NO: 348534 - DNA, 75 bp, Artificial Sequence
  Synthetic
aattatttcatatatccctctctttaactccaggaacttgtcaggatggtctactttaatatgttctcgtctaag

SEQ ID NO: 348535 - DNA, 75 bp, Artificial Sequence
  Synthetic
aactccaggaacttgtcaggatggtctactttaatatgttctcgtctaagagatgaaaatctttggatggttgca

SEQ ID NO: 348536 - DNA, 75 bp, Artificial Sequence
  Synthetic
tgtatatacatgcgcaattagatccaaagaagatgttcccaatttcaaggacaaaatggccagagttatcaagag

SEQ ID NO: 348537 - DNA, 75 bp, Artificial Sequence
  Synthetic
atccatcttatccttggacaagatggacagtctattttccttagatggtttaatatttttgttacccatgatcta

SEQ ID NO: 348538 - DNA, 75 bp, Artificial Sequence
  Synthetic
gacagtctattttccttagatggtttaatatttttgttacccatgatctataaaggtagacctaatcgtctcgga

SEQ ID NO: 348539 - DNA, 75 bp, Artificial Sequence
  Synthetic
tatgttaggtttacaaaaatgtctcgtggggcattaatcgtttttgaaggattggacaaatctggaaaaacaaca

SEQ ID NO: 348540 - DNA, 75 bp, Artificial Sequence
  Synthetic
gtggggcattaatcgtttttgaaggattggacaaatctggaaaaacaacacaatgtatgaacatcatggaatcta

SEQ ID NO: 348541 - DNA, 75 bp, Artificial Sequence
  Synthetic
ttgttagtagttagatatttagcaattgcattcccatcatttctcaatctcgtactccaatcatgcgtagatgct

SEQ ID NO: 348542 - DNA, 75 bp, Artificial Sequence; identical to SEQ ID NO: 48371
  Synthetic

SEQ ID NO: 348543 - DNA, 75 bp, Artificial Sequence
  Synthetic
tcatatagttaatctattattttgtgcaaatagatgggagtttgcatcttttatacaagaacaactagaacaggg

SEQ ID NO: 348544 - DNA, 75 bp, Artificial Sequence
  Synthetic
ccgctaaaggcgcgtcaatgactctcagtaagagttatgaatctggattgcctaaacccgacttagttatattct

SEQ ID NO: 348545 - DNA, 75 bp, Artificial Sequence
  Synthetic
taaaatacttacggttataccgtcgcaagaccacaggtttaaactaatactagatccaaaaatcaacgtaacgat

SEQ ID NO: 348546 - DNA, 75 bp, Artificial Sequence
  Synthetic
cctaaacccgacttagttatattcttggaatctggtagcaaagaaattaatagaaacgtcggcgaggaaatttat

SEQ ID NO: 348547 - DNA, 75 bp, Artificial Sequence
  Synthetic
ttaacgataacgaactatccacatatctaaaaatcttataaacattattaaaatataaaatctaagtggataaaa

SEQ ID NO: 348548 - DNA, 75 bp, Artificial Sequence
  Synthetic
tgaagaaggagatattcattggcaaattatttcttctgaattcgaggaagatgtaaagaaggagttgattaagaa

SEQ ID NO: 348549 - DNA, 75 bp, Artificial Sequence
  Synthetic
atgtaaagaaggagttgattaagaatatagttatagaggctatacacacggttactggaccagtggggcaactgt

SEQ ID NO: 348550 - DNA, 75 bp, Artificial Sequence
  Synthetic
tataaatggatgaagcatattactctggcaacttggaatcagtactcggatacgtgtccgatatgcataccgaac

SEQ ID NO: 348551 - DNA, 75 bp, Artificial Sequence
  Synthetic
ataaattttagaaataacattagcgaattgttgtgcgttgatgtcgttattctgaaacagtatgattttaggtag

SEQ ID NO: 348552 - DNA, 75 bp, Artificial Sequence
  Synthetic
tcgcatcaatatctcaattagttattgccaagatagaaactatagataatgatatattaaacaaggacattgtaa

SEQ ID NO: 348553 - DNA, 75 bp, Artificial Sequence
  Synthetic
gatacagatacagatacagatacagatacagatgttacaaatgtagaagatatcataaatgaaatagatagagag

SEQ ID NO: 348554 - DNA, 75 bp, Artificial Sequence
  Synthetic
attttatcatgtgtagatcaaacttggataatccatttatctctttcctagatactgtatatactattatagatc

SEQ ID NO: 348555 - DNA, 75 bp, Artificial Sequence
  Synthetic
taattcattagacgacaatgaaattatcgattgtatagttaataagtttatgagcttttataaggataacctaga

SEQ ID NO: 348556 - DNA, 75 bp, Artificial Sequence
  Synthetic
tgagcttttataaggataacctagaaaatatagtagatgctatcatcactctaaaatatataatgaataatccag

SEQ ID NO: 348557 - DNA, 75 bp, Artificial Sequence
  Synthetic
caaaacctggtatatcgtctctatctttatcacaatatagtgtatcgacatctttattattattgacctcgttta

SEQ ID NO: 348558 - DNA, 75 bp, Artificial Sequence
  Synthetic
gatattaaacaagtgatacgtgagaatatactacaattgtctaataatatccgcgaacgatatttgtgaaaatat

SEQ ID NO: 348559 - DNA, 75 bp, Artificial Sequence
  Synthetic
tagataaacgtgataaaagtctatttgtttatatttattgcggatagcagtatttccctataaaaagtatacgtc

SEQ ID NO: 348560 - DNA, 75 bp, Artificial Sequence
  Synthetic
aattatgctgtgctatatatcacgcatcaggatataaagaaaaatctaaattaattagagactttataacagata

SEQ ID NO: 348561 - DNA, 75 bp, Artificial Sequence
  Synthetic
atcaggatataaagaaaaatctaaattaattagagactttataacagatagggatgataaatatttgatcattaa

SEQ ID NO: 348562 - DNA, 75 bp, Artificial Sequence
  Synthetic
aaattataaaattatatagtataatatttaaacaatctcaggaagatatgctacaagatttaggatacggatata

SEQ ID NO: 348563 - DNA, 75 bp, Artificial Sequence
  Synthetic
ttatgcttgtattagtaggcattattattattacgtgttgtctattatctgtttataggttcactcgaagaacta

SEQ ID NO: 348564 - DNA, 75 bp, Artificial Sequence
  Synthetic
tttaaaatgtgtagtcatgcttattgataaagatctaaaaattaaagcgggccctcggtacgtacttaacgctat

SEQ ID NO: 348565 - DNA, 75 bp, Artificial Sequence
  Synthetic
gccatcatcggactttgtgcatatgctgctacttactggggaggtgaagaccatcccactagtaacagtctgaac

SEQ ID NO: 348566 - DNA, 75 bp, Artificial Sequence
  Synthetic
tctagactttatatctatttctgttatgactccaattaatcccatgttagcggaatcgtgtgattctgtcaataa

SEQ ID NO: 348567 - DNA, 75 bp, Artificial Sequence
  Synthetic
atgactccaattaatcccatgttagcggaatcgtgtgattctgtcaataaggcgtttaaaaaatttccatcagga

SEQ ID NO: 348568 - DNA, 75 bp, Artificial Sequence
  Synthetic
ggcaccggactacgattcatggaaatgtttttcgattacaataaaaatagtatcaacaatcaactaatgtatgat

SEQ ID NO: 348569 - DNA, 75 bp, Artificial Sequence
  Synthetic
taataacgagtttgccttctttagtagaaacatgaaaccagtactctctcataaagtggattatctcaaagaata

SEQ ID NO: 348570 - DNA, 75 bp, Artificial Sequence
  Synthetic
ataaagtggattatctcaaagaatacataccgaaagcatttaaaaaagctacgtctatcgtattggattctgaaa

SEQ ID NO: 348571 - DNA, 75 bp, Artificial Sequence
  Synthetic
tatcgcgctacacgaccaatatcgattactatggatatcttcagggaaatcgcatcttctatgaaaggagagaat

SEQ ID NO: 348572 - DNA, 75 bp, Artificial Sequence
  Synthetic
atacacaaaaagaaagaatataaaaactctaacatgtgtttgttcgtgtttgactgtttgtactttgatggattc

SEQ ID NO: 348573 - DNA, 75 bp, Artificial Sequence
  Synthetic
actctaacatgtgtttgttcgtgtttgactgtttgtactttgatggattcgatatgacggacattccattgtacg

SEQ ID NO: 348574 - DNA, 75 bp, Artificial Sequence
  Synthetic
gtattctcagagttgacgaatattagtaacgagtctcagttaactgacgtattggatgatgcactaacgagaaaa

SEQ ID NO: 348575 - DNA, 75 bp, Artificial Sequence
  Synthetic
aacgataacgatatatatcataaataaataatgttaaatttcagtttatgtttgtaccccgtattcatacttaac

SEQ ID NO: 348576 - DNA, 75 bp, Artificial Sequence
  Synthetic
actgttctagacactacactatatgcagttttaagatgtcataattcgaaaaagttaagaagatacctcaacgag

SEQ ID NO: 348577 - DNA, 75 bp, Artificial Sequence
  Synthetic
gtaacgagtctcagttaactgacgtattggatgatgcactaacgagaaaattagaaggattggtcttaaaagata

SEQ ID NO: 348578 - DNA, 75 bp, Artificial Sequence
  Synthetic
gactatttgaacgagggttccatggcagattctgccgatttagtagtactaggtgcctactatggtaaaggagca

SEQ ID NO: 348579 - DNA, 75 bp, Artificial Sequence
  Synthetic
caattcaattcgttgtttctaatataatctgccgtattggatggattctcaagacaattgcatttagattatatt

SEQ ID NO: 348580 - DNA, 75 bp, Artificial Sequence
  Synthetic
ttaataaaatctatattcccgattttgtagtagaggatccgaaacaatctcagatatgggaaatttcaggagcag

SEQ ID NO: 348581 - DNA, 75 bp, Artificial Sequence
  Synthetic
ccatagaacaaaatctaacagatacaaattttaagaaatggtgtaactctctggaagctacgtttatcgatgttc

SEQ ID NO: 348582 - DNA, 75 bp, Artificial Sequence
  Synthetic
cctagatttactaggataagagaggataaaacgtggaaagaatctactcatctaaacgatttagtaaacttgact

SEQ ID NO: 348583 - DNA, 75 bp, Artificial Sequence
  Synthetic
tggtggtcgccatggatggtgttattgtatactgtctaaacgcgttagtaaaacatggcgaggaaataaatcata

SEQ ID NO: 348584 - DNA, 75 bp, Artificial Sequence
  Synthetic
aaaagcccatatatgttcgctattgtagaaattgtttttcacagttgctcaaaaacgatggcagtgacttatgag

SEQ ID NO: 348585 - DNA, 75 bp, Artificial Sequence
  Synthetic
ttcagaaaaaccaaacactacaacgtcatatatcccatctcccggtattatgcttgtattagtaggcattattat

SEQ ID NO: 348586 - DNA, 75 bp, Artificial Sequence
  Synthetic
ttatctactgccaatttagctgcattatttttagcatctcgtttagattttccatcggccttatcgaatactctt

SEQ ID NO: 348587 - DNA, 75 bp, Artificial Sequence
  Synthetic
cagatttgctaatttgataaagatagatgacgatgacaagactcctactggtgtatataattattttaaacctaa

SEQ ID NO: 348588 - DNA, 75 bp, Artificial Sequence
  Synthetic
tcgcagtgtagaccctcgtctctactaattagttcgttggaaaacgtgagtccgggcattaggccacgcttttta

SEQ ID NO: 348589 - DNA, 75 bp, Artificial Sequence
  Synthetic
gtgtatataattattttaaacctaaagatgttattcctgttatcatatctataggaaaggataaagatgtctgtg

SEQ ID NO: 348590 - DNA, 75 bp, Artificial Sequence
  Synthetic
aatgtatatcttttagccgccgtatattccgatttcaatgacgaagtgacgtcattaaacgattacacacaggat

SEQ ID NO: 348591 - DNA, 75 bp, Artificial Sequence
  Synthetic
gtgtgcatgcgtggagttaaattcatatcacgtagccattcttcccatggatgtttccttttttaccaaaggaaa

SEQ ID NO: 348592 - DNA, 75 bp, Artificial Sequence
  Synthetic
atatcgccgaatgtcatatactcaattagtatatgttggaggacatccgagttcattgttttcaatatcaaaaag

SEQ ID NO: 348593 - DNA, 75 bp, Artificial Sequence
  Synthetic
tcttaagaagtgtaaccgataataatgttattatatctagacaccagcgtctacatgacgagcttccgagttcca

SEQ ID NO: 348594 - DNA, 75 bp, Artificial Sequence
  Synthetic
atatagatcttagacatttttagagagaactaacgcaaccagcaataaaactgaacctactttatcattttttta

SEQ ID NO: 348595 - DNA, 75 bp, Artificial Sequence
  Synthetic
aaagtccgactattgttctatattatatatggttgttgatggatctgtgatgcatgcgatagctgataatagaac

SEQ ID NO: 348596 - DNA, 75 bp, Artificial Sequence
  Synthetic
ataggtatcgatgaaggacagttctttccagacattgttgaattagatcgataaaaattaattaattacccgggt

SEQ ID NO: 348597 - DNA, 75 bp, Artificial Sequence
  Synthetic
ttccagacattgttgaattagatcgataaaaattaattaattacccgggtaccaggcctagatctgtcgagatcc

SEQ ID NO: 348598 - DNA, 75 bp, Artificial Sequence
  Synthetic
agtgtagatgctgttattttgaaccacagattaggattcttgatagagatgagatgctcaatggatcatcgtgtg

SEQ ID NO: 348599 - DNA, 75 bp, Artificial Sequence
  Synthetic
tctaggcctgtacggaagtgttacttctgctctaaaagctgctgcagggggggggggggggtgggggggccggtt

SEQ ID NO: 348600 - DNA, 75 bp, Artificial Sequence
  Synthetic
tctgctctaaaagctgctgcagggggggggggggggtgggggggccggttagggccgccatcccctcagagcgtc

SEQ ID NO: 348601 - DNA, 75 bp, Artificial Sequence
  Synthetic
gaatttacctgatgtaggcgaatttggatctagtatgttggggaaatatgaacctgacatgattaagattgctct

SEQ ID NO: 348602 - DNA, 75 bp, Artificial Sequence
  Synthetic
ctgaaactatacgtaactgtcaaaaaaatagaaacatatatggtctatatatacactacaatttagttattaatt

SEQ ID NO: 348603 - DNA, 75 bp, Artificial Sequence
  Synthetic
aatcgagactacattcccgggagacgaggatatagctactacgtttacggtatagcctctagataatttttttaa

SEQ ID NO: 348604 - DNA, 75 bp, Artificial Sequence
  Synthetic
gtggcagttcagaatgatggatcaagctagatcagcattctctaacttgtttggtggagaaccattgtcatatac

SEQ ID NO: 348605 - DNA, 75 bp, Artificial Sequence
  Synthetic
tatagcctctagataatttttttaagcacgaaataaaaaacataattttaaaccaatctatttcatactattttg

SEQ ID NO: 348606 - DNA, 75 bp, Artificial Sequence
  Synthetic
gctagatcagcattctctaacttgtttggtggagaaccattgtcatatacccggttcagcctggctcggcaagta

SEQ ID NO: 348607 - DNA, 75 bp, Artificial Sequence
  Synthetic
aaatgctgacaataacacaaaggccaatgtcacaaaaccaaaaaggtgtagtggaagtatctgctatgggactat

SEQ ID NO: 348608 - DNA, 75 bp, Artificial Sequence
  Synthetic
ttacggtgactactaggagggaaaatgaagaaagaaaaaaatatctacctctccaaaaagaaaaaactactgatg

SEQ ID NO: 348609 - DNA, 75 bp, Artificial Sequence
  Synthetic
tgaagaaagaaaaaaatatctacctctccaaaaagaaaaaactactgatgttatcaaacctgattatcttgagta

SEQ ID NO: 348610 - DNA, 75 bp, Artificial Sequence
  Synthetic
aatgtcacaaaaccaaaaaggtgtagtggaagtatctgctatgggactattgctgtgatcgtctttttcttgatt

SEQ ID NO: 348611 - DNA, 75 bp, Artificial Sequence
  Synthetic
tgagtgtgagagactggcaggaaccgagtctccagtgagggaggagccaggagaggacttccctgcagcacgtcg

SEQ ID NO: 348612 - DNA, 75 bp, Artificial Sequence
  Synthetic
ttatgtacagaggtctattaggcctcagaataaaatatggacgactctttaacgaaattaaaaaattcgacaatg

SEQ ID NO: 348613 - DNA, 75 bp, Artificial Sequence
  Synthetic
cagaataaaatatggacgactctttaacgaaattaaaaaattcgacaatgatgcggaagaacaattcggtactat

SEQ ID NO: 348614 - DNA, 75 bp, Artificial Sequence
  Synthetic
gctggttattatacatgtgttttagaatatatatacggtggcaaaacatataacgtaaccagaattgtaaaatta

SEQ ID NO: 348615 - DNA, 75 bp, Artificial Sequence
  Synthetic
gagtctccagtgagggaggagccaggagaggacttccctgcagcacgtcgcttatattgggatgacctgaagaga

SEQ ID NO: 348616 - DNA, 75 bp, Artificial Sequence
  Synthetic
aatatatatacggtggcaaaacatataacgtaaccagaattgtaaaattagaggtacgggatagaataatacatc

SEQ ID NO: 348617 - DNA, 75 bp, Artificial Sequence
  Synthetic
gctgaatgaaaattcatatgtccctcgtgaggctggatctcaaaaagatgaaaatcttgcgttgtatgttgaaaa

SEQ ID NO: 348618 - DNA, 75 bp, Artificial Sequence
  Synthetic
actttatagattatataaaggtacaaaaacaggatatcgtcaaacttactgtatacgattgcatatctatgatag

SEQ ID NO: 348619 - DNA, 75 bp, Artificial Sequence
  Synthetic
cgtgaggctggatctcaaaaagatgaaaatcttgcgttgtatgttgaaaatcaatttcgtgaatttaaactcagc

SEQ ID NO: 348620 - DNA, 75 bp, Artificial Sequence
  Synthetic
gtatacgattgcatatctatgataggattgtgtgcatgcgtggtagatgtttggagaaatgagaaactgttttct

SEQ ID NO: 348621 - DNA, 75 bp, Artificial Sequence
  Synthetic
ataaaatatttttattctctttctctctttgatggtctcacaaaaatatttttattctctttctctctttgatgg

SEQ ID NO: 348622 - DNA, 75 bp, Artificial Sequence
  Synthetic
tcaaaactcggtgatcatagttgataagaacggtagacttgtttacctggtggagaatcctgggggttatgtggc

SEQ ID NO: 348623 - DNA, 75 bp, Artificial Sequence
  Synthetic
aagaacggtagacttgtttacctggtggagaatcctgggggttatgtggcgtatagtaaggctgcaacagttact

SEQ ID NO: 348624 - DNA, 75 bp, Artificial Sequence
  Synthetic
aaaaatgtagaaattgaaaataataaaaacattaacaagaatcatcccaatgaatatattagagaagcactcgtt

SEQ ID NO: 348625 - DNA, 75 bp, Artificial Sequence
  Synthetic
gcttgataagataaaatctatactgcagaatagactagtgtatgtggaaatgtcatagaaagttaatgagagcaa

SEQ ID NO: 348626 - DNA, 75 bp, Artificial Sequence
  Synthetic
atacactcctgtgaatggatctatagtgattgtcagagcagggaaaatcacctttgcagaaaaggttgcaaatgc

SEQ ID NO: 348627 - DNA, 75 bp, Artificial Sequence
  Synthetic
aaaaatacattcgatggtctatctatcagattattatgtgttataaggtactttttctcataataaactagagta

SEQ ID NO: 348628 - DNA, 75 bp, Artificial Sequence
  Synthetic
catgttatgcaaaatatatgattacacgaatccaataaaccaaagtatctatcgttttgagtaaacaacttcata

SEQ ID NO: 348629 - DNA, 75 bp, Artificial Sequence
  Synthetic
tcagattattatgtgttataaggtactttttctcataataaactagagtatgagtaagatagtgtttttcaaaac

SEQ ID NO: 348630 - DNA, 75 bp, Artificial Sequence
  Synthetic
gtgattgtcagagcagggaaaatcacctttgcagaaaaggttgcaaatgctgaaagcttaaatgcaattggtgtg

SEQ ID NO: 348631 - DNA, 75 bp, Artificial Sequence
  Synthetic
attctttggacatgctcatctggggacaggtgacccttacacacctggattcccttccttcaatcacactcagtt

SEQ ID NO: 348632 - DNA, 75 bp, Artificial Sequence
  Synthetic
acaggtgacccttacacacctggattcccttccttcaatcacactcagtttccaccatctcggtcatcaggattg

SEQ ID NO: 348633 - DNA, 75 bp, Artificial Sequence
  Synthetic
caatcacatcggttatccaattaataactaaattgtagtgtatatatagaccatatatgtttctatttttttgac

SEQ ID NO: 348634 - DNA, 75 bp, Artificial Sequence
  Synthetic
tgggaatatggaaggagactgtccctctgactggaaaacagactctacatgtaggatggtaacctcagaaagcaa

SEQ ID NO: 348635 - DNA, 75 bp, Artificial Sequence
  Synthetic
tctgactggaaaacagactctacatgtaggatggtaacctcagaaagcaagaatgtgaagctcactgtgagcaat

SEQ ID NO: 348636 - DNA, 75 bp, Artificial Sequence
  Synthetic
acacaagttgataaaatgttgatagctgaatctgataaatatacaatagatgcaaggtataacctaaaacccatg

SEQ ID NO: 348637 - DNA, 75 bp, Artificial Sequence
  Synthetic
aaattgattagccaaatgtggatttatttttgtgatattgatataatatttcggataatgcatactgttagtctt

SEQ ID NO: 348638 - DNA, 75 bp, Artificial Sequence
  Synthetic
tgtagaaccagatcactatgttgtagttggggcccagagagatgcatggggccctggagctgcaaaatccggtgt

SEQ ID NO: 348639 - DNA, 75 bp, Artificial Sequence
  Synthetic
gttggggcccagagagatgcatggggccctggagctgcaaaatccggtgtaggcacagctctcctattgaaactt

SEQ ID NO: 348640 - DNA, 75 bp, Artificial Sequence
  Synthetic
ataacacaaaatgtgaacgctgcccacctcatacatataccgcaatccccaattactctaatggatgtcatcaat

SEQ ID NO: 348641 - DNA, 75 bp, Artificial Sequence
  Synthetic
gtaatattgttacatgatctatagatgatatattgattttggcaggatcgaattccatatccgcgactaaacagt

SEQ ID NO: 348642 - DNA, 75 bp, Artificial Sequence
  Synthetic
gtagaaaatgcccaaccggatcatttgataaggtaaagtgtaccggaacacagaacagtaaatgttcgtgtcttc

SEQ ID NO: 348643 - DNA, 75 bp, Artificial Sequence
  Synthetic
gaaaaaaatgtaaatactttttaaattttaaattagtaaaacttttttttattttttatgattccaaaaatactg

SEQ ID NO: 348644 - DNA, 75 bp, Artificial Sequence
  Synthetic
aagcattatctttgccagttggagtgctggagactttggatcggttggtgccactgaatggctagagggatacct

SEQ ID NO: 348645 - DNA, 75 bp, Artificial Sequence
  Synthetic
gctggagactttggatcggttggtgccactgaatggctagagggatacctttcgtccctgcatttaaaggctttc

SEQ ID NO: 348646 - DNA, 75 bp, Artificial Sequence
  Synthetic
ttctgccagcccactgttgtatacgcttattgagaaaacaatgcaaaatgtgaagcatccggttactgggcaatt

SEQ ID NO: 348647 - DNA, 75 bp, Artificial Sequence
  Synthetic
cttattgagaaaacaatgcaaaatgtgaagcatccggttactgggcaatttctatatcaggacagcaactgggcc

SEQ ID NO: 348648 - DNA, 75 bp, Artificial Sequence
  Synthetic
cacctttctcctgtaaagaaacctgaagttgctaccttattaaggacggagaagtattcctcacgaaagacggga

SEQ ID NO: 348649 - DNA, 75 bp, Artificial Sequence
  Synthetic
aatgttaccatacattatatcgctacttggttagtgtattattcagtatgaagacctattaataattacttatct

SEQ ID NO: 348650 - DNA, 75 bp, Artificial Sequence
  Synthetic
cttggttagtgtattattcagtatgaagacctattaataattacttatcttttgacgatcttgttataattataa

SEQ ID NO: 348651 - DNA, 75 bp, Artificial Sequence
  Synthetic
atattctggaatcccagcagtttctttctgtttttgcgaggacacagattatccttatttgggtaccaccatgga

SEQ ID NO: 348652 - DNA, 75 bp, Artificial Sequence
  Synthetic
ttctgtttttgcgaggacacagattatccttatttgggtaccaccatggacacctataaggaactgattgagagg

SEQ ID NO: 348653 - DNA, 75 bp, Artificial Sequence
  Synthetic
ttgatgtatgatgttaatgtgtcctctttcctcttataacatcgtaatcaaaaacttttttataatatataccta

SEQ ID NO: 348654 - DNA, 75 bp, Artificial Sequence
  Synthetic
gccaatactattacagaagttttaaaagactcagaagaggattatcaagatgtgtatatttgtgaaaattgtgga

SEQ ID NO: 348655 - DNA, 75 bp, Artificial Sequence
  Synthetic
gttcgtgattaaactaacccatgatgttgaattgaacctggactatgagaggtacaacagccaactgctttcatt

SEQ ID NO: 348656 - DNA, 75 bp, Artificial Sequence
  Synthetic
gttgaattgaacctggactatgagaggtacaacagccaactgctttcatttgtgagggatctgaaccaatacaga

SEQ ID NO: 348657 - DNA, 75 bp, Artificial Sequence
  Synthetic
tgattgctgttattaatggatttagaaatagtggacgattttgtgatattaatatagttattaatgatgaaagga

SEQ ID NO: 348658 - DNA, 75 bp, Artificial Sequence
  Synthetic
tggagcctccgaatatttttccattctgttttccaataattttatcgattctaatgaatacgaagttaatctaag

SEQ ID NO: 348659 - DNA, 75 bp, Artificial Sequence
  Synthetic
tggagacttcttccgtgctacttccagactaacaacagatttcgggaatgctgagaaaacagacagatttgtcat

SEQ ID NO: 348660 - DNA, 75 bp, Artificial Sequence
  Synthetic
agactaacaacagatttcgggaatgctgagaaaacagacagatttgtcatgaagaaactcaatgatcgtgtcatg

SEQ ID NO: 348661 - DNA, 75 bp, Artificial Sequence
  Synthetic
gatttgatcgattacatttatgggatacctttgagcctaactaacgataacgtgaaatatattctttcaaccgct

SEQ ID NO: 348662 - DNA, 75 bp, Artificial Sequence
  Synthetic
aaacatcaagtagaaattccgttggaaaactttaataacaaagaaagagataggtctaacgcctattcaaaatta

SEQ ID NO: 348663 - DNA, 75 bp, Artificial Sequence
  Synthetic
tttccgacatgtcttctggggctccggctctcacacgctgccagctttactggagaacttgaaactgcgtaaaca

SEQ ID NO: 348664 - DNA, 75 bp, Artificial Sequence
  Synthetic
ggctctcacacgctgccagctttactggagaacttgaaactgcgtaaacaaaataacggtgcttttaatgaaacg

SEQ ID NO: 348665 - DNA, 75 bp, Artificial Sequence
  Synthetic
taaaaatctttgttctagaaactgtatcgatttctacatatacgctgataaatataataacaagaaaatagaatc

SEQ ID NO: 348666 - DNA, 75 bp, Artificial Sequence
  Synthetic
aaatgccctctctggtgacgtttgggacattgacaatgagttttaaatgtgatacccatagcttccatgagaaca

SEQ ID NO: 348667 - DNA, 75 bp, Artificial Sequence
  Synthetic
gacattgacaatgagttttaaatgtgatacccatagcttccatgagaacagcagggtagtctggtttctagactt

SEQ ID NO: 348668 - DNA, 75 bp, Artificial Sequence
  Synthetic
aaaactttaaatacttaacagaggaatcaatgataaaaattttaagcgatgatatgttaaatataaaaaatgagg

SEQ ID NO: 348669 - DNA, 75 bp, Artificial Sequence
  Synthetic
ttttgaattcacagctggatgtacaaccgtttcctccgtttccattaccgccatctctaagtttcttttctagat

SEQ ID NO: 348670 - DNA, 75 bp, Artificial Sequence
  Synthetic
aaaaaaagcaatgtgtccgctgtttccgttaataatactattttcgtaactggcggattattcataaataactct

SEQ ID NO: 348671 - DNA, 75 bp, Artificial Sequence
  Synthetic
ttccatcccatcatcttggtactactagatgtctttaggcagcagcttttaatacagggtagataacctgtactt

SEQ ID NO: 348672 - DNA, 75 bp, Artificial Sequence
  Synthetic
tgcaccgtcgagttacttaaatgcctcagaatatcattgctttccccacaagttataaaatcactttatagtcat

SEQ ID NO: 348673 - DNA, 75 bp, Artificial Sequence
  Synthetic
tgttgttttatatatatcgctacgaatttaaagagaaattagtttaggaagaaaaaaattatctatctacatcat

SEQ ID NO: 348674 - DNA, 75 bp, Artificial Sequence
  Synthetic
agcacgttgtctctcaagctctcttttgtagtaactatcatttttatctgattccctggcacgtttaagatcttc

SEQ ID NO: 348675 - DNA, 75 bp, Artificial Sequence
  Synthetic
tcggttttttattcatggtatcatagaagataccattatcaacaaattttttgaggtaattttctttgtcggaag

SEQ ID NO: 348676 - DNA, 75 bp, Artificial Sequence
  Synthetic
gtataacattcttaaacaatatagcattcttggatgaatcatttcctagataccatagcatcgagttgatatcta

SEQ ID NO: 348677 - DNA, 75 bp, Artificial Sequence
  Synthetic
gtaatgggaactgcctctttcctgttgttgttaatgaaaatgtcagaaaccagttatgtgaatgatctctctgaa

SEQ ID NO: 348678 - DNA, 75 bp, Artificial Sequence
  Synthetic
ttaatatctacgacaatagacagcagtcccatggttccataaacagtgagtttatctttctttgaagcgatattt

SEQ ID NO: 348679 - DNA, 75 bp, Artificial Sequence
  Synthetic
tagatgtctttaggcagcagcttttaatacagggtagataacctgtacttcaagttaaagtgaataaccacttaa

SEQ ID NO: 348680 - DNA, 75 bp, Artificial Sequence
  Synthetic
aatttccataaactgctacaatcataaaaaaaatacatgggaaatgatatcttcacgtagatataggtgtagttt

SEQ ID NO: 348681 - DNA, 75 bp, Artificial Sequence
  Synthetic
aaaaaaaatacatgggaaatgatatcttcacgtagatataggtgtagtttcgcagtggccgtcctggataatatt

SEQ ID NO: 348682 - DNA, 75 bp, Artificial Sequence
  Synthetic
tgttgttaatgaaaatgtcagaaaccagttatgtgaatgatctctctgaatcctaagggctggtctctgctgaag

SEQ ID NO: 348683 - DNA, 75 bp, Artificial Sequence
  Synthetic
aaataggagataccaggttgaaagaccttctccaaatgagatctaagcctttccataaggaatgtagctggtttc

SEQ ID NO: 348684 - DNA, 75 bp, Artificial Sequence
  Synthetic
ccttctccaaatgagatctaagcctttccataaggaatgtagctggtttcctcattcctgaaagaaacagttaac

SEQ ID NO: 348685 - DNA, 75 bp, Artificial Sequence
  Synthetic
tatagcgtacaatacatgtacaaattcttggatatatgatataccagagctaaaatatcctcgttctaattgtgg

SEQ ID NO: 348686 - DNA, 75 bp, Artificial Sequence
  Synthetic
tcttggatatatgatataccagagctaaaatatcctcgttctaattgtgggggactggctgatgacgaatacatt

SEQ ID NO: 348687 - DNA, 75 bp, Artificial Sequence
  Synthetic
tccttctgctggataaaatgaggttcaactgttgattgcaggaataaggccttaatatgttaacctcagtgtcat

SEQ ID NO: 348688 - DNA, 75 bp, Artificial Sequence
  Synthetic
ttcttccaattgcaattggtaagatgacggccaactttagtacccacgtcttttcaccacagcactgtggatgtg

SEQ ID NO: 348689 - DNA, 75 bp, Artificial Sequence
  Synthetic
caactgttgattgcaggaataaggccttaatatgttaacctcagtgtcatttatgaaaagaggggaccagaagcc

SEQ ID NO: 348690 - DNA, 75 bp, Artificial Sequence
  Synthetic
tgatagatggaagccatcaaaaccatattggcagaagtatgctaaaatgcgcgaaccaaaatgtgatatgggggt

SEQ ID NO: 348691 - DNA, 75 bp, Artificial Sequence
  Synthetic
tattggcagaagtatgctaaaatgcgcgaaccaaaatgtgatatgggggttgcgatgttaaacggattaatatat

SEQ ID NO: 348692 - DNA, 75 bp, Artificial Sequence
  Synthetic
tacgttatgataaccgcataaaataaaaatccatttttatttttagctactattcataattgagattgatgtaat

SEQ ID NO: 348693 - DNA, 75 bp, Artificial Sequence
  Synthetic
atttagttctttgttatttttgtttcttccaaagcacattgaaagagaaccagtttcaggtgtttagttgcagac

SEQ ID NO: 348694 - DNA, 75 bp, Artificial Sequence
  Synthetic
cttccaaagcacattgaaagagaaccagtttcaggtgtttagttgcagactcagtttgtcagactttaaagaata

SEQ ID NO: 348695 - DNA, 75 bp, Artificial Sequence
  Synthetic
tttatcagaagatggatggatgaagcatcaacgtcttccaataaaaatgtccaatatgtcgacgattgttcatga

SEQ ID NO: 348696 - DNA, 75 bp, Artificial Sequence
  Synthetic
tggcaagatttatatatctggaggttacaacaatagtagtgtagttaatgtaatatcgaatctagtccttagcta

SEQ ID NO: 348697 - DNA, 75 bp, Artificial Sequence
  Synthetic
gtccttttggcactgagatatttattgtttatttatcagtgacagagttcactataaatggtgtttttttaatag

SEQ ID NO: 348698 - DNA, 75 bp, Artificial Sequence
  Synthetic
tgtttatttatcagtgacagagttcactataaatggtgtttttttaatagaatataattatcggaagcagtgcct

SEQ ID NO: 348699 - DNA, 75 bp, Artificial Sequence
  Synthetic
gaattaatcccgctctatggtcagcgcataataaattatatgtaggaggaggaatatctgatgatgttcgaacta

SEQ ID NO: 348700 - DNA, 75 bp, Artificial Sequence
  Synthetic
tctgctaataaaacccaacagatactggaagttttgcatttatggtcaacacttaagggttttagaaaacagccg

SEQ ID NO: 348701 - DNA, 75 bp, Artificial Sequence
  Synthetic
atttctggcaatgtcgtttcgatagcgttaccactatcggcgaatgatctgattatcatagcagcgaacaacaac

SEQ ID NO: 348702 - DNA, 75 bp, Artificial Sequence
  Synthetic
tggaagttttgcatttatggtcaacacttaagggttttagaaaacagccgtcagccaaatgtaattgaataaagt

SEQ ID NO: 348703 - DNA, 75 bp, Artificial Sequence
  Synthetic
aaaagattgttggacattggataatggtcacgtgttaccacgcaattatataatgtataaatgcgaaccgattaa

SEQ ID NO: 348704 - DNA, 75 bp, Artificial Sequence
  Synthetic
gcgagcactgaccagataagaatgctggttttcctaaatgcagtgaattgtgaccaagttataaatcaatgtcac

SEQ ID NO: 348705 - DNA, 75 bp, Artificial Sequence
  Synthetic
tggttttcctaaatgcagtgaattgtgaccaagttataaatcaatgtcacttaaaggctgtggtagtactcctgc

SEQ ID NO: 348706 - DNA, 75 bp, Artificial Sequence
  Synthetic
atttggaaagttttataggtagttgatagaacaaaatacataattttgtaaaaataaatcactttttatactaat

SEQ ID NO: 348707 - DNA, 75 bp, Artificial Sequence
  Synthetic
ttgtgtaaataatataaaaataacaatacaatattgaatgtgttgctgttaaaaatgtatgtgttaatataatag

SEQ ID NO: 348708 - DNA, 75 bp, Artificial Sequence
  Synthetic
atagaacaaaatacataattttgtaaaaataaatcactttttatactaatatgacacgattaccaatacttttgt

SEQ ID NO: 348709 - DNA, 75 bp, Artificial Sequence
  Synthetic
caaaatttccagtacctttgtcacaatcctaacacattatcgggagcagtatcttccataatgtataaagaacaa

SEQ ID NO: 348710 - DNA, 75 bp, Artificial Sequence
  Synthetic
atcctaacacattatcgggagcagtatcttccataatgtataaagaacaaggtagtttttacctaccacagtgtc

SEQ ID NO: 348711 - DNA, 75 bp, Artificial Sequence
  Synthetic
ataggtgatgatgcaactctatcatgtaatcgaaataatacaaatgactacgttgttatgagtgcttggtataag

SEQ ID NO: 348712 - DNA, 75 bp, Artificial Sequence
  Synthetic
gtaatcgaaataatacaaatgactacgttgttatgagtgcttggtataaggagcccaattccattattcttttag

SEQ ID NO: 348713 - DNA, 75 bp, Artificial Sequence
  Synthetic
atcgggaacagtgtttcccataattttcttcatgcaatgacatcttcaaagcttgaagatcgttagtatctaaca

SEQ ID NO: 348714 - DNA, 75 bp, Artificial Sequence
  Synthetic
ttcttcatgcaatgacatcttcaaagcttgaagatcgttagtatctaacatgtatcccaactcctataattccct

SEQ ID NO: 348715 - DNA, 75 bp, Artificial Sequence
  Synthetic
tcttacgactctccatacgatgatctagttacaactatcacaattaaatcattgactgctagagatgccggtact

SEQ ID NO: 348716 - DNA, 75 bp, Artificial Sequence
  Synthetic
tagttacaactatcacaattaaatcattgactgctagagatgccggtacttatgtatgtgcattctttatgacat

SEQ ID NO: 348717 - DNA, 75 bp, Artificial Sequence
  Synthetic
gggtaaattcaaccactgtaaaatgaaattactacaaaatttgaaatttagcttgggtttttgttacctttatgg

SEQ ID NO: 348718 - DNA, 75 bp, Artificial Sequence
  Synthetic
aaattactacaaaatttgaaatttagcttgggtttttgttacctttatggtttctccaggtcctctacttaatga

SEQ ID NO: 348719 - DNA, 75 bp, Artificial Sequence
  Synthetic
tctaaatcatggagcagctggttctacagctgaacaactatcaaaatatatagagaatatgaatgagaatacacc

SEQ ID NO: 348720 - DNA, 75 bp, Artificial Sequence
  Synthetic
aagcattttaactttagaagacgtggatagttttttaactacgttatcatccgtaactaaagaattgcatcaaat

SEQ ID NO: 348721 - DNA, 75 bp, Artificial Sequence
  Synthetic
gatattccgtattgtgcgacactagctaccgcaaataaaatatacggtagcgatagtatcgagttccatgcctcc

SEQ ID NO: 348722 - DNA, 75 bp, Artificial Sequence
  Synthetic
tatcacattatttgcatgttacctcctataaacttagtgcggacaagttttaatccagaattgaccttttgactt

SEQ ID NO: 348723 - DNA, 75 bp, Artificial Sequence
  Synthetic
ctataaacttagtgcggacaagttttaatccagaattgaccttttgacttaaagcagagggactttgtatagaag

SEQ ID NO: 348724 - DNA, 75 bp, Artificial Sequence
  Synthetic
ccgtcacatacactagtgatagcattaatacagtaagtgcatcatctggagaatccacaacagacgagactccgg

SEQ ID NO: 348725 - DNA, 75 bp, Artificial Sequence
  Synthetic
ttcaaactgtaaactttaataatgctaaccaaacaaaggaactaatcaacgaatgggttaagacaatgacaaatg

SEQ ID NO: 348726 - DNA, 75 bp, Artificial Sequence
  Synthetic
ctacccattcgtggtgatcaattaaatgtaggtatgaataagttcgaagctccgtgagtgaaccatcattataaa

SEQ ID NO: 348727 - DNA, 75 bp, Artificial Sequence
  Synthetic
gtaaaattaattcattattgactagtccgctatccattaatactcgtatgacagttgttagcgccgtccatttta

SEQ ID NO: 348728 - DNA, 75 bp, Artificial Sequence
  Synthetic
atgtaggtatgaataagttcgaagctccgtgagtgaaccatcattataaacgtgatgatcagctgtttgtcatag

SEQ ID NO: 348729 - DNA, 75 bp, Artificial Sequence
  Synthetic
aagcaatgtggaaatatccattttctaaacatcttacatatacagacaagttttatatttctaagaatatagtta

SEQ ID NO: 348730 - DNA, 75 bp, Artificial Sequence
  Synthetic
tcttagtgtcacttacctagatttacagcctcacttgaatgtgtcactactcacagtctctttaatcttcagttt

SEQ ID NO: 348731 - DNA, 75 bp, Artificial Sequence
  Synthetic
ctctattagcaattataaaaccaaggactttgtagaaatatttggtattaccgcattaattatattgtcggccgt

SEQ ID NO: 348732 - DNA, 75 bp, Artificial Sequence
  Synthetic
cagcctcacttgaatgtgtcactactcacagtctctttaatcttcagttttatctttaatctcctcttttatctt

SEQ ID NO: 348733 - DNA, 75 bp, Artificial Sequence
  Synthetic
aaactctagtatggtgattatactaccggacgacatagaaggtatatataacatagaaaaaaatataacagatga

SEQ ID NO: 348734 - DNA, 75 bp, Artificial Sequence
  Synthetic
acaaaacagagaacaaagtctagatttttgacttacataaatgtctgggatagtaaaatctatcatattgagcgg

SEQ ID NO: 348735 - DNA, 75 bp, Artificial Sequence
  Synthetic
acatagaaaaaaatataacagatgaaaaatttaaaaaatggtgtggtatgttatctactaaaagtatagacttgt

SEQ ID NO: 348736 - DNA, 75 bp, Artificial Sequence
  Synthetic
gttcgggtgttacgcacacgtacttaaatgaaagcatgtggcatgttcatcgtataacacaatatgaatacaggg

SEQ ID NO: 348737 - DNA, 75 bp, Artificial Sequence
  Synthetic
aaatgaaagcatgtggcatgttcatcgtataacacaatatgaatacagggcatgcattttgcagcagtgagtctc

SEQ ID NO: 348738 - DNA, 75 bp, Artificial Sequence
  Synthetic
aagatattttcgtgttttagtttatcgagatctgatctgttcatatacgtatccatgattgtacggtacgttatg

SEQ ID NO: 348739 - DNA, 75 bp, Artificial Sequence; identical to SEQ ID NO: 48591
  Synthetic

SEQ ID NO: 348740 - DNA, 75 bp, Artificial Sequence
  Synthetic
attttagaaaatttaggacttactaatatattcggatattatgcagattttagcaagatgtgtaatgaaactatc

SEQ ID NO: 348741 - DNA, 75 bp, Artificial Sequence
  Synthetic
agtacgtgctaacaggctcaatattcctgaatgaaatatcagactagtgacaagctcctggtcttgagatgtctt

SEQ ID NO: 348742 - DNA, 75 bp, Artificial Sequence
  Synthetic
tagcaagatgtgtaatgaaactatcactgtagaaaaatttctacatacgacgtttatagatgttaatgaggagta

SEQ ID NO: 348743 - DNA, 75 bp, Artificial Sequence
  Synthetic
cctgaatgaaatatcagactagtgacaagctcctggtcttgagatgtcttctcgttaaggagatgggccttttgg

SEQ ID NO: 348744 - DNA, 75 bp, Artificial Sequence; identical to SEQ ID NO: 48593
  Synthetic

SEQ ID NO: 348745 - DNA, 75 bp, Artificial Sequence
  Synthetic
cgtttatagatgttaatgaggagtatacagaagcatcggccgttacaggagtatttatgactaacttttcgatgg

SEQ ID NO: 348746 - DNA, 75 bp, Artificial Sequence
  Synthetic
ttgcatgacctttactgtgttagctctttgaatgttcttgaaattttagactttctttgtaaacaaatgatatgt

SEQ ID NO: 348747 - DNA, 75 bp, Artificial Sequence
  Synthetic
ctttgaatgttcttgaaattttagactttctttgtaaacaaatgatatgtccttatcattgtataaaagctgtta

SEQ ID NO: 348748 - DNA, 75 bp, Artificial Sequence
  Synthetic
ccatccattcatgtacatgattaaagacaacacaggacgtatactttttatagggaaatactgctatccgcaata

SEQ ID NO: 348749 - DNA, 75 bp, Artificial Sequence
  Synthetic
ctgaaaaaaaaaaaaaaaaaaaaaaaaaaaaaaaaaaaaaaaaaaaaaaaaaaaaaaaaaaaaaaaaaaaaaaaa

SEQ ID NO: 348750 - DNA, 75 bp, Artificial Sequence
  Synthetic
aaaaaaaaaaaaaaaaaaaaaaaaaaaaaaaaaagtaccttctgaggcggaaagaaccagccggatctcgacttc

SEQ ID NO: 348751 - DNA, 75 bp, Artificial Sequence
  Synthetic
tcgacactattatcattgaagatgatgtgaatttagcatatagtaagttaattcagatactacaggaccgtatta

SEQ ID NO: 348752 - DNA, 75 bp, Artificial Sequence
  Synthetic
attcagatactacaggaccgtattagaatgtattttaacactaattagagacttaagacttaaaacttgataatt

SEQ ID NO: 348753 - DNA, 75 bp, Artificial Sequence
  Synthetic
gttaaatattaaaacttaccacgtaaaacttaaaatttaaaatgatatttcattgacagatagatcacacattat

SEQ ID NO: 348754 - DNA, 75 bp, Artificial Sequence
  Synthetic
aaacttaaaatttaaaatgatatttcattgacagatagatcacacattatgaactttcaaggacttgtgttaact

SEQ ID NO: 348755 - DNA, 75 bp, Artificial Sequence
  Synthetic
gatgaccaaaaagactatacggtaacttctcagttcaataactacactatcgataccaaagactggactatcggc

SEQ ID NO: 348756 - DNA, 75 bp, Artificial Sequence; identical to SEQ ID NO: 154621
  Synthetic

SEQ ID NO: 348757 - DNA, 75 bp, Artificial Sequence
  Synthetic
aaaaccctggcgttacccaacttaatcgccttgcagcacatccccctttcgccagctggcgtaatagcgaagagg

SEQ ID NO: 348758 - DNA, 75 bp, Artificial Sequence
  Synthetic
atttggtagtatttatactactaatgacaataattatgtagtaaaaatagagcccaaagctaacggatcattatt

SEQ ID NO: 348759 - DNA, 75 bp, Artificial Sequence
  Synthetic
ttggtcacggtttactataggtcgtgcattgttcaaatcagagtctgaggatattttccaaaagaaaatgagtat

SEQ ID NO: 348760 - DNA, 75 bp, Artificial Sequence
  Synthetic
gacaataattatgtagtaaaaatagagcccaaagctaacggatcattatttaccgaacaggcattttatactaga

SEQ ID NO: 348761 - DNA, 75 bp, Artificial Sequence
  Synthetic
tacattttttgacgacgatgattgatcgctattgcacaattttgtttttgtactttctaatatagtgtttaggtt

SEQ ID NO: 348762 - DNA, 75 bp, Artificial Sequence
  Synthetic
tattattaattttagaagctatatgcaatggataatttccatcatcatccgtctcatttggagagtatcctctat

SEQ ID NO: 348763 - DNA, 75 bp, Artificial Sequence
  Synthetic
cgctttgcctggtttccggcaccagaagcggtgccggaaagctggctggagtgcgatcttcctgaggccgatact

SEQ ID NO: 348764 - DNA, 75 bp, Artificial Sequence
  Synthetic
atttaataaatttccagatatggcttattatcgaggagactgtttaaaagccgtttatgtaacaatgacttataa

SEQ ID NO: 348765 - DNA, 75 bp, Artificial Sequence
  Synthetic
aagcggtgccggaaagctggctggagtgcgatcttcctgaggccgatactgtcgtcgtcccctcaaactggcaga

SEQ ID NO: 348766 - DNA, 75 bp, Artificial Sequence
  Synthetic
ccgtttatgtaacaatgacttataaaaatactaaaactggagagactgattacacgtacctctctaatggggggt

SEQ ID NO: 348767 - DNA, 75 bp, Artificial Sequence
  Synthetic
gtcaatccgccgtttgttcccacggagaatccgacgggttgttactcgctcacatttaatgttgatgaaagctgg

SEQ ID NO: 348768 - DNA, 75 bp, Artificial Sequence
  Synthetic
agaatccgacgggttgttactcgctcacatttaatgttgatgaaagctggctacaggaaggccagacgcgaatta

SEQ ID NO: 348769 - DNA, 75 bp, Artificial Sequence
  Synthetic
aaatactaaaactggagagactgattacacgtacctctctaatggggggttgcctgcatactatcgtaatggggt

SEQ ID NO: 348770 - DNA, 75 bp, Artificial Sequence
  Synthetic
gatcggaatcgaaatcttaaataccatacaatttatgcacgagcaaggatattctcacggagatattaaagcgag

SEQ ID NO: 348771 - DNA, 75 bp, Artificial Sequence
  Synthetic
atacaatttatgcacgagcaaggatattctcacggagatattaaagcgagtaatatagtcttggatcaaatagat

SEQ ID NO: 348772 - DNA, 75 bp, Artificial Sequence
  Synthetic
gtcggttacggccaggacagtcgtttgccgtctgaatttgacctgagcgcatttttacgcgccggagaaaaccgc

SEQ ID NO: 348773 - DNA, 75 bp, Artificial Sequence; identical to SEQ ID NO: 154629
  Synthetic

SEQ ID NO: 348774 - DNA, 75 bp, Artificial Sequence
  Synthetic
taatggcgaacatgttccatttataagaaatccaaataaaatggataacggtactctagaatttacacctataga

SEQ ID NO: 348775 - DNA, 75 bp, Artificial Sequence
  Synthetic
attaagcgctattgtgcttaattattttgctctataaactgaatatatagccacaattattgacgggcttgttta

SEQ ID NO: 348776 - DNA, 75 bp, Artificial Sequence
  Synthetic
agaaatccaaataaaatggataacggtactctagaatttacacctatagattctcataaaggatacgttgtatct

SEQ ID NO: 348777 - DNA, 75 bp, Artificial Sequence
  Synthetic
tttgctctataaactgaatatatagccacaattattgacgggcttgtttatgaccggcaatcatgaatttacaga

SEQ ID NO: 348778 - DNA, 75 bp, Artificial Sequence; identical to SEQ ID NO: 154632
  Synthetic

SEQ ID NO: 348779 - DNA, 75 bp, Artificial Sequence
  Synthetic
ccgtatagtctttttggtcatcaggaaacaaggaaactaatacctctacactattgaacgatttatcttccgtaa

SEQ ID NO: 348780 - DNA, 75 bp, Artificial Sequence
  Synthetic
aggtatcttaccatggactaagatatctgaaacaaagaattgtgcattagtaagtgccacaaaacagaaatatgt

SEQ ID NO: 348781 - DNA, 75 bp, Artificial Sequence
  Synthetic
acatgcataagaaaaactgcgttgtatcatgacattcaattggagcatgtagaagacaataaagatagtgtagcg

SEQ ID NO: 348782 - DNA, 75 bp, Artificial Sequence
  Synthetic
tagaatatatatacggtggcaaaacatataacgtaaccagaattgtaaaattagaggtacgggatagaataatac

SEQ ID NO: 348783 - DNA, 75 bp, Artificial Sequence
  Synthetic
tctgaaacaaagaattgtgcattagtaagtgccacaaaacagaaatatgttaacaatactgcgactttgttaatg

SEQ ID NO: 348784 - DNA, 75 bp, Artificial Sequence; identical to SEQ ID NO: 154636
  Synthetic

SEQ ID NO: 348785 - DNA, 75 bp, Artificial Sequence; identical to SEQ ID NO: 154633
  Synthetic

SEQ ID NO: 348786 - DNA, 75 bp, Artificial Sequence
  Synthetic
aaactctttgacatattttgaggaacccaattacgacgagtttcggcacatattaatgcagggtgtatattatta

SEQ ID NO: 348787 - DNA, 75 bp, Artificial Sequence
  Synthetic
acatttaattggacagatatagctgagggtgttagaaatgagttcattaaaatatgtgatatcaacggaacatat

SEQ ID NO: 348788 - DNA, 75 bp, Artificial Sequence
  Synthetic
aatatgtgatatcaacggaacatatttatataattatactattgctgttagtataattattgattccacggaaga

SEQ ID NO: 348789 - DNA, 75 bp, Artificial Sequence
  Synthetic
tatcgtgcggtggttgaactgcacaccgccgacggcacgctgattgaagcagaagcctgcgatgtcggtttccgc

SEQ ID NO: 348790 - DNA, 75 bp, Artificial Sequence
  Synthetic
tcgccagcggcaccgcgcctttcggcggtgaaattatcgatgagcgtggtggttatgccgatcgcgtcacactac

SEQ ID NO: 348791 - DNA, 75 bp, Artificial Sequence
  Synthetic
aacttaatttattattgatctcgtgtgtacaaccgaaatcatggcgatgttttacgcacacgctctcggtgggta

SEQ ID NO: 348792 - DNA, 75 bp, Artificial Sequence
  Synthetic
ccgccgacggcacgctgattgaagcagaagcctgcgatgtcggtttccgcgaggtgcggattgaaaatggtctgc

SEQ ID NO: 348793 - DNA, 75 bp, Artificial Sequence
  Synthetic
tttacgcacacgctctcggtgggtacgacgagaatcttcatgcctttcctggaatatcatcgactgttgccaatg

SEQ ID NO: 348794 - DNA, 75 bp, Artificial Sequence
  Synthetic
catcatcctctgcatggtcaggtcatggatgagcagacgatggtgcaggatatcctgctgatgaagcagaacaac

SEQ ID NO: 348795 - DNA, 75 bp, Artificial Sequence
  Synthetic
tggatgagcagacgatggtgcaggatatcctgctgatgaagcagaacaactttaacgccgtgcgctgttcgcatt

SEQ ID NO: 348796 - DNA, 75 bp, Artificial Sequence
  Synthetic
agtttataataacaagtatgacattgtaaaagacaaatatatgtggtgttacagtcaggtgaacaagagatatat

SEQ ID NO: 348797 - DNA, 75 bp, Artificial Sequence
  Synthetic
tcagtggagtagtaaacgcgtacataactcctggataacgtttagcagctgccgttcctattctagaccaaaaat

SEQ ID NO: 348798 - DNA, 75 bp, Artificial Sequence
  Synthetic
tggagcactgctgcctatgtttgagtgcaatgaatatctacaaattggagatccgatccatgatcaagaaggaaa

SEQ ID NO: 348799 - DNA, 75 bp, Artificial Sequence
  Synthetic
cgatactagattttatctctagcgagagatgtcgttagaatcatttatcataactacgtttaataataattcatc

SEQ ID NO: 348800 - DNA, 75 bp, Artificial Sequence
  Synthetic
gtggtggatgaagccaatattgaaacccacggcatggtgccaatgaatcgtctgaccgatgatccgcgctggcta

SEQ ID NO: 348801 - DNA, 75 bp, Artificial Sequence
  Synthetic
tgcaatgaatatctacaaattggagatccgatccatgatcaagaaggaaatcaaatctctatcatcacatatcgc

SEQ ID NO: 348802 - DNA, 75 bp, Artificial Sequence; identical to SEQ ID NO: 154645
  Synthetic

SEQ ID NO: 348803 - DNA, 75 bp, Artificial Sequence
  Synthetic
gtgtttggaaggagtagggattcatcatcacacacttgaagcaggaaacgctgtatatggaaaagttcaacatga

SEQ ID NO: 348804 - DNA, 75 bp, Artificial Sequence; identical to SEQ ID NO: 154647
  Synthetic

SEQ ID NO: 348805 - DNA, 75 bp, Artificial Sequence; identical to SEQ ID NO: 154648
  Synthetic

SEQ ID NO: 348806 - DNA, 75 bp, Artificial Sequence
  Synthetic
catcacacacttgaagcaggaaacgctgtatatggaaaagttcaacatgattattctactatcaaagagaaggcc

SEQ ID NO: 348807 - DNA, 75 bp, Artificial Sequence; identical to SEQ ID NO: 154650
  Synthetic

SEQ ID NO: 348808 - DNA, 75 bp, Artificial Sequence
  Synthetic
aatggtccatcaaaaaatggctttcgctacctggagagacgcgcccgctgatcctttgcgaatacgcccacgcga

SEQ ID NO: 348809 - DNA, 75 bp, Artificial Sequence
  Synthetic
tatccccgtttacagggcggcttcgtctgggactgggtggatcagtcgctgattaaatatgatgaaaacggcaac

SEQ ID NO: 348810 - DNA, 75 bp, Artificial Sequence
  Synthetic
tctgggactgggtggatcagtcgctgattaaatatgatgaaaacggcaacccgtggtcggcttacggcggtgatt

SEQ ID NO: 348811 - DNA, 75 bp, Artificial Sequence
  Synthetic
actatacgccatatgtggtctgttgtatatgatcattttgatattgtgaatggtaaagaatgctgttatgtgcat

SEQ ID NO: 348812 - DNA, 75 bp, Artificial Sequence
  Synthetic
tggtaaagaatgctgttatgtgcatacgcatttgtctaatcaaaatcttataccgagtactgtaaaaacaaattt

SEQ ID NO: 348813 - DNA, 75 bp, Artificial Sequence
  Synthetic
gccgaccgcacgccgcatccagcgctgacggaagcaaaacaccagcagcagtttttccagttccgtttatccggg

SEQ ID NO: 348814 - DNA, 75 bp, Artificial Sequence
  Synthetic
catccttgactaccacaacatttcttttttctggcataacttcgttgtcctttacatcatcgaacttctgatcat

SEQ ID NO: 348815 - DNA, 75 bp, Artificial Sequence
  Synthetic
tgacggaagcaaaacaccagcagcagtttttccagttccgtttatccgggcaaaccatcgaagtgaccagcgaat

SEQ ID NO: 348816 - DNA, 75 bp, Artificial Sequence
  Synthetic
gatggtaagccgctggcaagcggtgaagtgcctctggatgtcgctccacaaggtaaacagttgattgaactgcct

SEQ ID NO: 348817 - DNA, 75 bp, Artificial Sequence
  Synthetic
tgagagattggtagaggagttcttcaatagatcagaacttcaggctggtaaattagtcaaatttggtaattctat

SEQ ID NO: 348818 - DNA, 75 bp, Artificial Sequence; identical to SEQ ID NO: 154657
  Synthetic

SEQ ID NO: 348819 - DNA, 75 bp, Artificial Sequence
  Synthetic
tgtctgactgaatacatcctgtgggtttctcatagatggacccatagagaaagcgcagggtctctctacaggctt

SEQ ID NO: 348820 - DNA, 75 bp, Artificial Sequence; identical to SEQ ID NO: 154659
  Synthetic

SEQ ID NO: 348821 - DNA, 75 bp, Artificial Sequence; identical to SEQ ID NO: 154660
  Synthetic

SEQ ID NO: 348822 - DNA, 75 bp, Artificial Sequence
  Synthetic
agacactgtctcatacactacagtaagtacatcatctggaattgtcactactaaatcaaccaccgatgatgcgta

SEQ ID NO: 348823 - DNA, 75 bp, Artificial Sequence; identical to SEQ ID NO: 154662
  Synthetic

SEQ ID NO: 348824 - DNA, 75 bp, Artificial Sequence
  Synthetic
agatgtggattggcgataaaaaacaactgctgacgccgctgcgcgatcagttcacccgtgcaccgctggataacg

SEQ ID NO: 348825 - DNA, 75 bp, Artificial Sequence
  Synthetic
cgacatacgtgtgcgctatcaaagtggaaagatgctgttgtgctgtgtttgcagattggccagaatcatggtata

SEQ ID NO: 348826 - DNA, 75 bp, Artificial Sequence
  Synthetic
agccggtctattcgacactattattattgaagatgatgtgaatttagcatatagtaagttaattcagatactaca

SEQ ID NO: 348827 - DNA, 75 bp, Artificial Sequence
  Synthetic
cgctggaaggcggcgggccattaccaggccgaagcagcgttgttgcagtgcacggcagatacacttgctgatgcg

SEQ ID NO: 348828 - DNA, 75 bp, Artificial Sequence
  Synthetic
aattagcaccagaatagctatggattgcacatgtattctatgtcgtctactggatgaagatgtgacgtacaaaaa

SEQ ID NO: 348829 - DNA, 75 bp, Artificial Sequence
  Synthetic
aggccgaagcagcgttgttgcagtgcacggcagatacacttgctgatgcggtgctgattacgaccgctcacgcgt

SEQ ID NO: 348830 - DNA, 75 bp, Artificial Sequence
  Synthetic
gatggtagtggtcaaatggcgattaccgttgatgttgaagtggcgagcgatacaccgcatccggcgcggattggc

SEQ ID NO: 348831 - DNA, 75 bp, Artificial Sequence
  Synthetic
ccgttgatgttgaagtggcgagcgatacaccgcatccggcgcggattggcctgaactgccagctggcgcaggtag

SEQ ID NO: 348832 - DNA, 75 bp, Artificial Sequence
  Synthetic
ttaattttttataaactaacattgttaattgaaaagggataacatgttacagaatataaattatatatggatttt

SEQ ID NO: 348833 - DNA, 75 bp, Artificial Sequence
  Synthetic
cgccttactgccgcctgttttgaccgctgggatctgccattgtcagacatgtataccccgtacgtcttcccgagc

SEQ ID NO: 348834 - DNA, 75 bp, Artificial Sequence; identical to SEQ ID NO: 154670
  Synthetic

SEQ ID NO: 348835 - DNA, 75 bp, Artificial Sequence
  Synthetic
acatcccatataatacaggattataatctcgttcgaacatacgagaaagtggataaaacaatagttgatttttta

SEQ ID NO: 348836 - DNA, 75 bp, Artificial Sequence
  Synthetic
atctcgttcgaacatacgagaaagtggataaaacaatagttgattttttatctaggttgccaaatttattccata

SEQ ID NO: 348837 - DNA, 75 bp, Artificial Sequence; identical to SEQ ID NO: 154673
  Synthetic

SEQ ID NO: 348838 - DNA, 75 bp, Artificial Sequence
  Synthetic
aatacgaatattataattttttttctagatagagtattaaatattaataagaacgggtcatttatacacaatctc

SEQ ID NO: 348839 - DNA, 75 bp, Artificial Sequence
  Synthetic
ggattggtggcgacgactcctggagcccgtcagtatcggcggaattccagctgagcgccggtcgctaccattacc

SEQ ID NO: 348840 - DNA, 75 bp, Artificial Sequence
  Synthetic
aagaatatgtatatcaattagttaataatgatcatccagataataggataagactaatgcttgaaaatggacgta

SEQ ID NO: 348841 - DNA, 75 bp, Artificial Sequence
  Synthetic
agactaatgcttgaaaatggacgtagaacaagacattttttgtcctatatatcagatacagttaatatctatata

SEQ ID NO: 348842 - DNA, 75 bp, Artificial Sequence
  Synthetic
attattaataaaggatgtggacacgtgtagagtatacgacgtcagccctatattagaggcggattatctaaacaa

SEQ ID NO: 348843 - DNA, 75 bp, Artificial Sequence
  Synthetic
atatagatgcagaagacagttacggttgtacattattacatagatgtatatatcactataagaaatcagaatcag

SEQ ID NO: 348844 - DNA, 75 bp, Artificial Sequence
  Synthetic
gcgatttagagtaaccccatataatgtagacatggaaatcgttaatcttcttattgagagacgtcatactcttgt

SEQ ID NO: 348845 - DNA, 75 bp, Artificial Sequence
  Synthetic
aatcatacaatgaattaattaagatattgttaaataatggatccgatgtagataaaaaagatacgtacggaaaca

SEQ ID NO: 348846 - DNA, 75 bp, Artificial Sequence
  Synthetic
taccacgtctggataggagattgtatctgtcaagttactgctgtggacgtacatggaaaggaaattatgagaatg

SEQ ID NO: 348847 - DNA, 75 bp, Artificial Sequence
  Synthetic
gagatatgtttagagaatgctaatatagactctgtagactttaatagatatacacctcttcattatgtctcatgt

SEQ ID NO: 348848 - DNA, 75 bp, Artificial Sequence
  Synthetic
tagactctgtagactttaatagatatacacctcttcattatgtctcatgtcgtaataaatatgattttgtaaagt

SEQ ID NO: 348849 - DNA, 75 bp, Artificial Sequence
  Synthetic
tacacctcttcattatgtctcatgtcgtaataaatatgattttgtaaagttattaatttctaaaggagcaaatgt

SEQ ID NO: 348850 - DNA, 75 bp, Artificial Sequence
  Synthetic
gagtccttagtagcgtggcaatgacagggtctgaacttggcacaaggagaggccattgtgaaggtagacctgtag

SEQ ID NO: 348851 - DNA, 75 bp, Artificial Sequence
  Synthetic
acggtatctcgcttataaaactatatttggaatcagacacagagttagaaatagataatgaacatatagttcgtc

SEQ ID NO: 348852 - DNA, 75 bp, Artificial Sequence
  Synthetic
atagataatgaacatatagttcgtcatttaataatttttgatgctgttgaatctttagattatctattatccaga

SEQ ID NO: 348853 - DNA, 75 bp, Artificial Sequence
  Synthetic
cgacgctgtcagttataatgcgtataatacgttggtctatctattaaacagaaatggtgattttgagacgattac

SEQ ID NO: 348854 - DNA, 75 bp, Artificial Sequence
  Synthetic
tactagtggatgtacatgtatttcggaagcagtcgcaaacaacaacaaaataataatggaagtactattgtctaa

SEQ ID NO: 348855 - DNA, 75 bp, Artificial Sequence
  Synthetic
atgacgatgacaagactcctactggtgtatataattattttaaacctaaagatgccattcctgttattatatcta

SEQ ID NO: 348856 - DNA, 75 bp, Artificial Sequence
  Synthetic
ataaacaacataatgcagatttattgaaaatgtgtataaaatatactgcgtgtatgaccgattatgatactctta

SEQ ID NO: 348857 - DNA, 75 bp, Artificial Sequence
  Synthetic
actaaagcgctatagagtagacattaatagaatgaagaatgcctacatatcaggcgtctccatgtttgatatatt

SEQ ID NO: 348858 - DNA, 75 bp, Artificial Sequence
  Synthetic
taaatggtatattttaagatgtttcgatgaaatagatatcatgaagagatgttatataaaaaataaaactgtatt

SEQ ID NO: 348859 - DNA, 75 bp, Artificial Sequence
  Synthetic
gttatataaaaaataaaactgtattccaattagttttttgtatcaaagacattaatactttaatgagatacggta

SEQ ID NO: 348860 - DNA, 75 bp, Artificial Sequence
  Synthetic
attagtaaattcaagattcctatctctgattatacgggatatgacgacttcaatcaaacaaaaaagctcaataag

SEQ ID NO: 348861 - DNA, 75 bp, Artificial Sequence
  Synthetic
cctagtgcttgcgccaatggatggatacaatacgataaacattgttatctagataccaacattaaaatgtccaca

SEQ ID NO: 348862 - DNA, 75 bp, Artificial Sequence
  Synthetic
tgattattttgaagacgatgattcgtctacatgttctgccgtaaccgacagggaaacggatgtataattttttta

SEQ ID NO: 348863 - DNA, 75 bp, Artificial Sequence; identical to SEQ ID NO: 48844
  Synthetic

SEQ ID NO: 348864 - DNA, 75 bp, Artificial Sequence
  Synthetic
tcctgtattctttttaagatcgaggaacgccataatatcagaatgccacggttccaagtatatggccataactcc

SEQ ID NO: 348865 - DNA, 75 bp, Artificial Sequence
  Synthetic
ttttaacgctcataaataaaaatgaaaacgatttccgttgttacgttgttatgcgtactacctgctgttgtttat

SEQ ID NO: 348866 - DNA, 75 bp, Artificial Sequence
  Synthetic
gaaatacacctctacataactacgtatctcaatatgatatcactctcattcctcatccacaacccattaaaaaaa

SEQ ID NO: 348867 - DNA, 75 bp, Artificial Sequence
  Synthetic
aattccaccatgacactaagttgcaacggcgaaacaaaatattttcgttgcgaagaaaaaaatggaaatacttct

SEQ ID NO: 348868 - DNA, 75 bp, Artificial Sequence
  Synthetic
ggccgccacagacacgaatatgactaaaccgatgaccatttaaaaacccctctctagctttcacttaaactgtat

SEQ ID NO: 348869 - DNA, 75 bp, Artificial Sequence
  Synthetic
acggcgaaacaaaatattttcgttgcgaagaaaaaaatggaaatacttcttggaatgatactgttacgtgtccta

SEQ ID NO: 348870 - DNA, 75 bp, Artificial Sequence
  Synthetic
aaagaaaaatactcatttggggaatatatgactatcaactgtgatgttggatatgaggttattggtgcttcgtac

SEQ ID NO: 348871 - DNA, 75 bp, Artificial Sequence
  Synthetic
atatgactatcaactgtgatgttggatatgaggttattggtgcttcgtacataagttgtacagctaattcttgga

SEQ ID NO: 348872 - DNA, 75 bp, Artificial Sequence
  Synthetic
ggattaatttccggatctacattttctatcggtggcgttatacatcttagttgtaaaagtggttttacactaacg

SEQ ID NO: 348873 - DNA, 75 bp, Artificial Sequence
  Synthetic
tttgatccagtggatgatggtcccgacgatgagacagatctgagcaaactctcgaaagacgttgtacaatatgaa

SEQ ID NO: 348874 - DNA, 75 bp, Artificial Sequence
  Synthetic
acgatgagacagatctgagcaaactctcgaaagacgttgtacaatatgaacaagaaatagaatcgttagaagcaa

SEQ ID NO: 348875 - DNA, 75 bp, Artificial Sequence
  Synthetic
aaaattatttaacttttcattaatagggatttgacgtatgtagcgtacaaaatgatcgttcctggtatatagata

SEQ ID NO: 348876 - DNA, 75 bp, Artificial Sequence
  Synthetic
atatccgcactgctaaatactaaatctccttcatgctctctcactacactttttatcatcttatgaggaataatt

SEQ ID NO: 348877 - DNA, 75 bp, Artificial Sequence
  Synthetic
ggcagtatatacattttcaaataataaactaaacaaaactggtttagctaatactaattatatcacaacatctat

SEQ ID NO: 348878 - DNA, 75 bp, Artificial Sequence
  Synthetic
agattaaagacttatagctagaatcaattgagatgtcttcttcagtggatgttgatatctacgatgccgttagag

SEQ ID NO: 348879 - DNA, 75 bp, Artificial Sequence
  Synthetic
aattgagatgtcttcttcagtggatgttgatatctacgatgccgttagagcatttttactcaggcactattataa

SEQ ID NO: 348880 - DNA, 75 bp, Artificial Sequence
  Synthetic
aattatgaaaaagtaaatcattatgagatggacgagattgtacgcatcgttcgcgacagtatgtggtttatacct

SEQ ID NO: 348881 - DNA, 75 bp, Artificial Sequence
  Synthetic
acaggctatttacaagatgcgccgttataccgttcgatgatatagtacgtactatgccaaatgaatcacgtgtta

SEQ ID NO: 348882 - DNA, 75 bp, Artificial Sequence
  Synthetic
tattcggtagttcaaatatatgatccatgcatagatcggtaaagctattgtagatgtgatttttcctaaatctaa

SEQ ID NO: 348883 - DNA, 75 bp, Artificial Sequence
  Synthetic
gagatatagaagcgcttttaacgacgatggtatatacatccgtagaaatatgattaacaagttgtacggatacgc

SEQ ID NO: 348884 - DNA, 75 bp, Artificial Sequence
  Synthetic
gatggtatatacatccgtagaaatatgattaacaagttgtacggatacgcatctctaactactattggcacgatc

SEQ ID NO: 348885 - DNA, 75 bp, Artificial Sequence
  Synthetic
catgaatgtggtaaaagaattactttctaacggtgcatctctaacaatcaaggatagcagtaataaggatccaat

SEQ ID NO: 348886 - DNA, 75 bp, Artificial Sequence
  Synthetic
ataattatttcaatatactagttaaaattttaagattttaaatgtataaaaaactaataacgtttttatttgtaa

SEQ ID NO: 348887 - DNA, 75 bp, Artificial Sequence
  Synthetic
aattttaagattttaaatgtataaaaaactaataacgtttttatttgtaataggtgcagtagcatcctattcgaa

SEQ ID NO: 348888 - DNA, 75 bp, Artificial Sequence
  Synthetic
acaactttgttaataataatctcgtcgatgtaaacgtcgtaaggtttatcgtggaaaatatggacacgcggctgt

SEQ ID NO: 348889 - DNA, 75 bp, Artificial Sequence
  Synthetic
gagtagataatatagaaaattcatatactgatgataataatgaattggtgttaaattttaaagagtacacaattt

SEQ ID NO: 348890 - DNA, 75 bp, Artificial Sequence
  Synthetic
ataaggtagcaacttcaggtttctttacaggagaaaggtgtgcactctgaatttcgagattaaatgcaataacaa

SEQ ID NO: 348891 - DNA, 75 bp, Artificial Sequence
  Synthetic
cggatttgattccatagatatagatgttataaacgactataaaattattgatatgtataccattgactcgtctac

SEQ ID NO: 348892 - DNA, 75 bp, Artificial Sequence
  Synthetic
tacgtaaactgtttatacaagattgaaattatattctttttttatagagtgtggtagtgttacggatatctaata

SEQ ID NO: 348893 - DNA, 75 bp, Artificial Sequence
  Synthetic
attatgataagtacccttatattcacaaatatgatggtgatgagcgacaatattctattactgcagagggaaaat

SEQ ID NO: 348894 - DNA, 75 bp, Artificial Sequence
  Synthetic
atgcccggtagttgcgatatacataaactgatcactaattccaaacccacccactttttatagtaagtttttcac

SEQ ID NO: 348895 - DNA, 75 bp, Artificial Sequence
  Synthetic
tattctattactgcagagggaaaatgctataaaggaataaaatatgaaataagtatgatcaacgatgatactcta

SEQ ID NO: 348896 - DNA, 75 bp, Artificial Sequence
  Synthetic
tggacatagtaatacatattattcaaaatatgatttttaaaaatttaaaatatattatcgcttcagtgacagtag

SEQ ID NO: 348897 - DNA, 75 bp, Artificial Sequence
  Synthetic
tgtatacggtatcacagctatcttaaagccatacattcggacagtcacatttcatttcccatgtacgacgatctc

SEQ ID NO: 348898 - DNA, 75 bp, Artificial Sequence
  Synthetic
tatattataattctcgcagttttgttcattaatagtatacatgctaaaataactagttataagtttgaatccgtc

SEQ ID NO: 348899 - DNA, 75 bp, Artificial Sequence
  Synthetic
aactagttataagtttgaatccgtcaattttgattccaaaattgaatggactggggatggtctatacaatatatc

SEQ ID NO: 348900 - DNA, 75 bp, Artificial Sequence
  Synthetic
aattttgattccaaaattgaatggactggggatggtctatacaatatatcccttaaaaattatggcatcaagacg

SEQ ID NO: 348901 - DNA, 75 bp, Artificial Sequence
  Synthetic
tctaatcaaaatcttataccgagtactgtaaaaacaaatttgtacatgaagactatgggatcatgcattcaaatg

SEQ ID NO: 348902 - DNA, 75 bp, Artificial Sequence
  Synthetic
atttccaaagaatgatttcgtatctttctgggttaaatttgaacaaggcgattataaagtggaagagtattgtac

SEQ ID NO: 348903 - DNA, 75 bp, Artificial Sequence
  Synthetic
ggtagcaaaaagattcctatttacaaacgcggtgacatgtgtgatatctacttgttgtatacggctaacttcaca

SEQ ID NO: 348904 - DNA, 75 bp, Artificial Sequence
  Synthetic
catatgatatcgatgactacgattgcacgtctacaggttgcagcatagactttgtcacaacagaaaaagtgtgcg

SEQ ID NO: 348905 - DNA, 75 bp, Artificial Sequence
  Synthetic
aggactgacagaggtgttcggttcaactggagattatagcaatatgtgtaattcagatgtgagtgtcgacgctat

SEQ ID NO: 348906 - DNA, 75 bp, Artificial Sequence
  Synthetic
cacgtctacaggttgcagcatagactttgtcacaacagaaaaagtgtgcgtgacagcacagggagccacagaagg

SEQ ID NO: 348907 - DNA, 75 bp, Artificial Sequence
  Synthetic
aaatgggcgtggattgttaactatagaatcggacgtctgatattcgaaaatctgtggagtttcaggttttggtgg

SEQ ID NO: 348908 - DNA, 75 bp, Artificial Sequence
  Synthetic
catcttatgaggaatgattgccttcatcatttttcgtgaaataggaataattagcaccagaatagctatggatta

SEQ ID NO: 348909 - DNA, 75 bp, Artificial Sequence
  Synthetic
ggtagcacatcaaatgatgttaccacttttcttagcatgcttaacttgactaaatattcataactaatttttatt

SEQ ID NO: 348910 - DNA, 75 bp, Artificial Sequence
  Synthetic
actatattccggtttgcaaaacaaaaatgttcttaactacattcacaaaaagttacctctcgttacttcttcttt

SEQ ID NO: 348911 - DNA, 75 bp, Artificial Sequence
  Synthetic
caagactacaaagaatgttctagcggctattcctaacagaacatttgcaaagattaatccgggtgaagttattcc

SEQ ID NO: 348912 - DNA, 75 bp, Artificial Sequence
  Synthetic
gcatattatacactggttaacgcccttataggctctaaccattttcaagatgaggtccctgattatagtccttct

SEQ ID NO: 348913 - DNA, 75 bp, Artificial Sequence
  Synthetic
aagaggaaacatggggattgaaaatagggttgtgtataattgccaaagatttctatcccgaaagaactgattgca

SEQ ID NO: 348914 - DNA, 75 bp, Artificial Sequence
  Synthetic
ttctatcccgaaagaactgattgcagtgttcatctcccaactgcaagtgaaggattgataactgaaggcaatgga

SEQ ID NO: 348915 - DNA, 75 bp, Artificial Sequence
  Synthetic
ttcagggatatacgaaacaccgataaattataaaaaaagcaatgtgtccgctgtttccgttaataatactatttt

SEQ ID NO: 348916 - DNA, 75 bp, Artificial Sequence
  Synthetic
caaaggatgtggaattatgttatgggaatttgtattttgataggatctataataatgtagtaaatataaaatata

SEQ ID NO: 348917 - DNA, 75 bp, Artificial Sequence
  Synthetic
aactctaatagcacgatcgtggttaacaatatggaaaaacttgacatttataaagacaaacaatggtcgattata

SEQ ID NO: 348918 - DNA, 75 bp, Artificial Sequence
  Synthetic
gaaatgcctatggctagggtatatcacggcatcgactcgacatttggaatgttatattttgccggaggtctatcc

SEQ ID NO: 348919 - DNA, 75 bp, Artificial Sequence
  Synthetic
acggcatcgactcgacatttggaatgttatattttgccggaggtctatccgttaccgaacaatatggtaatttag

SEQ ID NO: 348920 - DNA, 75 bp, Artificial Sequence
  Synthetic
gatatttcatatactatttataagatatccatatcatcattgtgtaaactaaataacgtcttctatgtatttagt

SEQ ID NO: 348921 - DNA, 75 bp, Artificial Sequence
  Synthetic
atatatatatactctattttggtggaggattatatgatataattcgtggataatcatttttaagacacatttctt

SEQ ID NO: 348922 - DNA, 75 bp, Artificial Sequence
  Synthetic
tgatcgtctccccgctataaaggcattatcaacttctccttattgattgaaaatgaaaatataaatagtttttat

SEQ ID NO: 348923 - DNA, 75 bp, Artificial Sequence
  Synthetic
aaatgaaaatataaatagtttttatgtatagcagtattaccctatagttttattgcttactactaacatggatac

SEQ ID NO: 348924 - DNA, 75 bp, Artificial Sequence
  Synthetic
aatatttttattctctttctctctttgatggtctcataaaaaatatttttattctctttctctctttgatggtct

SEQ ID NO: 348925 - DNA, 75 bp, Artificial Sequence
  Synthetic
ttactaatttgttccctagcacgtccgagtttagttttatatgccgaatagagttctgattcatcctttgagcag

SEQ ID NO: 348926 - DNA, 75 bp, Artificial Sequence
  Synthetic
gtcacgatgtaggaatatagatcatatctactaatttttataatcaatacaaaacataaaaaacaactcgttatt

SEQ ID NO: 348927 - DNA, 75 bp, Artificial Sequence
  Synthetic
atctactaatttttataatcaatacaaaacataaaaaacaactcgttattacatagcaggcatggaatccttcaa

SEQ ID NO: 348928 - DNA, 75 bp, Artificial Sequence
  Synthetic
attctggtaattcaatactatataaggtcagaaaaaatttcactagttcgttctacaattacgtaatgaagatag

SEQ ID NO: 348929 - DNA, 75 bp, Artificial Sequence
  Synthetic
ttctacaattacgtaatgaagatagatcacaaatcacacaagccattgttgtctgaaatacgattctatatatct

SEQ ID NO: 348930 - DNA, 75 bp, Artificial Sequence
  Synthetic
gtatttggctattccagatctgtatggaattggagaaaccgatgattatatgttcttcgttataaagaattcggg

SEQ ID NO: 348931 - DNA, 75 bp, Artificial Sequence
  Synthetic
ggaattggagaaaccgatgattatatgttcttcgttataaagaattcgggaagagtattcgccccaaaggatact

SEQ ID NO: 348932 - DNA, 75 bp, Artificial Sequence
  Synthetic
acactctcgaggatttacccatggaaaaatagaaccgaggaatatactgattagaaataaacgtctttcactaat

SEQ ID NO: 348933 - DNA, 75 bp, Artificial Sequence
  Synthetic
aaaatagaaccgaggaatatactgattagaaataaacgtctttcactaattgactattctagaactaacaaacta

SEQ ID NO: 348934 - DNA, 75 bp, Artificial Sequence
  Synthetic
cctattcctatttcctttcagggtatcacaaaaatattaaacctctttctgatggtctcataaaaaaagttttac

SEQ ID NO: 348935 - DNA, 75 bp, Artificial Sequence
  Synthetic
aaagagaataaaaatatttttgtaaaactttttttatgagaccatcaaagagagaaagagaataaaaatattttt

SEQ ID NO: 348936 - DNA, 75 bp, Artificial Sequence
  Synthetic
aggaaatatcaattatatgtgtgtagacaatcatcttggagcaacagtttcaagacgaggagatttagaaatgtt

SEQ ID NO: 348937 - DNA, 75 bp, Artificial Sequence
  Synthetic
gacaatcatcttggagcaacagtttcaagacgaggagatttagaaatgttgggatattgcatgatagaatggttc

SEQ ID NO: 348938 - DNA, 75 bp, Artificial Sequence
  Synthetic
aaaaaaagaatataaaaaatttatagctactttctttgaggactgttttcctgaaggaaatgaacctctggaatt

SEQ ID NO: 348939 - DNA, 75 bp, Artificial Sequence
  Synthetic
tgaacacacccatacatgaaagcgatgagaaataggattctcatcttgccaaaatatcactagaaaaaatttatt

SEQ ID NO: 348940 - DNA, 75 bp, Artificial Sequence
  Synthetic
ccattatttttttggaatcggatactatatcttcggtatcttgacgcagtctagtatacatagagttaagagaga

SEQ ID NO: 348941 - DNA, 75 bp, Artificial Sequence
  Synthetic
atctctatcgcgctacacgaccaatatcgattactatggatatcttctatgaaaggagagaatgtatttatttct

SEQ ID NO: 348942 - DNA, 75 bp, Artificial Sequence
  Synthetic
atccaaattccggaatagatgtatcacatgctcttgccacccagataaccaaaaagtcacacgctccaggatata

SEQ ID NO: 348943 - DNA, 75 bp, Artificial Sequence
  Synthetic
gaaaggagagaatgtatttatttctccagcgtcaatctcgtcagtattgacaatactgtattatggagctaatgg

SEQ ID NO: 348944 - DNA, 75 bp, Artificial Sequence
  Synthetic
ataaggttagcgctcaaaatatctcattcaaatccataaataaagtatatgggcgatattctgccgtgtttaaag

SEQ ID NO: 348945 - DNA, 75 bp, Artificial Sequence
  Synthetic
gtgtccacatcctttattaataataatttaacaatctctatatctatggttgagaaagaccagtagtattggatg

SEQ ID NO: 348946 - DNA, 75 bp, Artificial Sequence
  Synthetic
taagtttcaaactgttgacttcactgattgtcgcactatagatgcaatcaacaagtgtgtagatatctttactga

SEQ ID NO: 348947 - DNA, 75 bp, Artificial Sequence
  Synthetic
taagcgactatcatctaaacagtatgttgtacggaaagaaccattacaaatattatccatgatagaaagaaaata

SEQ ID NO: 348948 - DNA, 75 bp, Artificial Sequence
  Synthetic
gattgtcgcactatagatgcaatcaacaagtgtgtagatatctttactgaggggaaaatcaatccactattggat

SEQ ID NO: 348949 - DNA, 75 bp, Artificial Sequence
  Synthetic
gaaaaggaatttaccagtgattatcccttttacgtatctccgacggaaatggtagacgtaagtatgatgtctatg

SEQ ID NO: 348950 - DNA, 75 bp, Artificial Sequence
  Synthetic
ttcaatcatagaactgccatatgttggagatactagtatgatggtcattcttccagacaagattgatggattaga

SEQ ID NO: 348951 - DNA, 75 bp, Artificial Sequence
  Synthetic
ttccagacaagattgatggattagaatccatagaacaaaatctaacagatacaaattttaagaaatggtgtgact

SEQ ID NO: 348952 - DNA, 75 bp, Artificial Sequence
  Synthetic
atccatagaacaaaatctaacagatacaaattttaagaaatggtgtgactttatggatgctatgtttatagatgt

SEQ ID NO: 348953 - DNA, 75 bp, Artificial Sequence
  Synthetic
ataatcagccataattactcgagtgcaacatgttagatcgtctatatatgaataagccgtgttatctattccttt

SEQ ID NO: 348954 - DNA, 75 bp, Artificial Sequence
  Synthetic
tacaaatgagttctgtgtagatcatccgttcatctatgtgattaggcatgttgatggaaaaattcttttcgttgg

SEQ ID NO: 348955 - DNA, 75 bp, Artificial Sequence
  Synthetic
gtaagatgacggccaactttagtacccacgtcttttcaccacagcactgtggatgtgacagactgaccagtattg

SEQ ID NO: 348956 - DNA, 75 bp, Artificial Sequence
  Synthetic
ggatgtgacagactgaccagtattgatgacgtcaaacaatgtttgactgaatatatttattggtcgtcctatgca

SEQ ID NO: 348957 - DNA, 75 bp, Artificial Sequence
  Synthetic
tagagatgatgcggaattagtgttcatcgacattcgcgagctggtaaaaaatatgccgtgggatgatgtcaaaga

SEQ ID NO: 348958 - DNA, 75 bp, Artificial Sequence
  Synthetic
atttattaatgctttagtgaaattttaacttgtgttctaaatggatgcggctattagaggtaatgatgttatctt

SEQ ID NO: 348959 - DNA, 75 bp, Artificial Sequence
  Synthetic
ataccggatgagcaaaaaaccatcagagagatttcggccatcatcggactttgtgcatatgctgctacttactgg

SEQ ID NO: 348960 - DNA, 75 bp, Artificial Sequence
  Synthetic
acagtctgaacgcattgtttgtgatgcttgagatgctaaattacgtggattataacatcatattccggcgtatga

SEQ ID NO: 348961 - DNA, 75 bp, Artificial Sequence
  Synthetic
aaaagatggatataaagaatttgctgactgtatgtactattttttacattactacattggctacggcagatatac

SEQ ID NO: 348962 - DNA, 75 bp, Artificial Sequence
  Synthetic
tataacatcatattccggcgtatgaattgatgagttgtacatcttgacattttcttctttcttctcttctccctt

SEQ ID NO: 348963 - DNA, 75 bp, Artificial Sequence
  Synthetic
tttattcttcattcgttcagacttttaacgcgtctgaatgtatcgacaaagggcaatattttgcatcattcatgg

SEQ ID NO: 348964 - DNA, 75 bp, Artificial Sequence
  Synthetic
taacgcgtctgaatgtatcgacaaagggcaatattttgcatcattcatggagttagaaaacgagccagtaatctt

SEQ ID NO: 348965 - DNA, 75 bp, Artificial Sequence
  Synthetic
ttttatgggaaaaacgaggagcggataatgatagaattataccgatagataatggtagcaatatgctaattctga

SEQ ID NO: 348966 - DNA, 75 bp, Artificial Sequence
  Synthetic
taatgatagaattataccgatagataatggtagcaatatgctaattctgaacccgacacaatcagactctggtat

SEQ ID NO: 348967 - DNA, 75 bp, Artificial Sequence
  Synthetic
atttgacaatcgtgtctgtctcagaatcaaatatagatcttatctcgtatccacaaatagtaaatgagagatcta

SEQ ID NO: 348968 - DNA, 75 bp, Artificial Sequence
  Synthetic
atcaaatatagatcttatctcgtatccacaaatagtaaatgagagatctactggcgaaatggtatgtcccaatat

SEQ ID NO: 348969 - DNA, 75 bp, Artificial Sequence
  Synthetic
gaaattaaagccctctattagcataaacggctacaggtctaccttcacaatggcctttccttgtgcccagttcag

SEQ ID NO: 348970 - DNA, 75 bp, Artificial Sequence
  Synthetic
atcgacgccttagaaataagagacttaaacaacggacacctggaattattaccatagaagatgttagaaaaaatg

SEQ ID NO: 348971 - DNA, 75 bp, Artificial Sequence
  Synthetic
gtcttttggataagtaatggtatgtattacgaagaagatgatggggacggaaacggtagaataagtgtagcaaat

SEQ ID NO: 348972 - DNA, 75 bp, Artificial Sequence
  Synthetic
acaacgtttacgtgtatggcgtttactattcctagcatcagtaaaacagttactgttagtataacgtgaatgtat

SEQ ID NO: 348973 - DNA, 75 bp, Artificial Sequence
  Synthetic
ctattcctagcatcagtaaaacagttactgttagtataacgtgaatgtatgttgttacatttccatgtcaattga

SEQ ID NO: 348974 - DNA, 75 bp, Artificial Sequence
  Synthetic
atttgacttgagtgttaaatgtgaaaaccatcgttcagttatagaaaattatgtaatgacaatgatcctgttcat

SEQ ID NO: 348975 - DNA, 75 bp, Artificial Sequence
  Synthetic
attgctatgattaactcccacgatactatgcatattattaatcattaacttgcagactatacctagtgctatttt

SEQ ID NO: 348976 - DNA, 75 bp, Artificial Sequence
  Synthetic
ttgctccataatctattatcgcgtagatgaatcgcttctcggctcgcatcttagtgtgacttgacttgtaataat

SEQ ID NO: 348977 - DNA, 75 bp, Artificial Sequence
  Synthetic
gtttagtcgcggatatggaattcgatcctgccaaaatcaataaatcatgtaacaatattacaatacatagatgaa

SEQ ID NO: 348978 - DNA, 75 bp, Artificial Sequence
  Synthetic
caacaagagcagatatctataggaaagggtggaatgcgatacattgatctatgtagttttaaaacacacgcgaac

SEQ ID NO: 348979 - DNA, 75 bp, Artificial Sequence
  Synthetic
atggattaaatcgtgtattcatcgtatagcaatgtaatggagagttacctcgtttattcagatcgcagtgtttaa

SEQ ID NO: 348980 - DNA, 75 bp, Artificial Sequence
  Synthetic
ttacaaaatgtaaccaatacctttgcatgacttgttttgttcggcaacgttagtttaaacttgacgaatggatta

SEQ ID NO: 348981 - DNA, 75 bp, Artificial Sequence
  Synthetic
tattaagtttttttactttaacgcccttgtatgtttttacagagactttatctaaatttctagtacttgtatgtg

SEQ ID NO: 348982 - DNA, 75 bp, Artificial Sequence
  Synthetic
gtccataaatacgttaggtatgtaccacatactgtcgcgaacgatgctcacaatctcgtccatctcgcccatctc

SEQ ID NO: 348983 - DNA, 75 bp, Artificial Sequence
  Synthetic
gctattaatccgtatatcatcattttgatattacttataataacgatttgtttaatttttagtttatactattaa

SEQ ID NO: 348984 - DNA, 75 bp, Artificial Sequence
  Synthetic
atgaactcatcgagatattgctctctgtcatattcatacacctgcataaactttctagacatcttacaatccgtg

SEQ ID NO: 348985 - DNA, 75 bp, Artificial Sequence
  Synthetic
tgtcatattcatacacctgcataaactttctagacatcttacaatccgtgttattttaggatcatatttacatat

SEQ ID NO: 348986 - DNA, 75 bp, Artificial Sequence
  Synthetic
aatgaatattaaacaattatatgaggacttttaccacaaagcatcataaaaatgagtcgtcgtctgatttatgtt

SEQ ID NO: 348987 - DNA, 75 bp, Artificial Sequence
  Synthetic
gacttttaccacaaagcatcataaaaatgagtcgtcgtctgatttatgttttaaatatcaaccgcgaatcaactc

SEQ ID NO: 348988 - DNA, 75 bp, Artificial Sequence
  Synthetic
gaccatacttctacagaacttgattttgtagttaaaaactatgatctaaacagacgacaacctgtaactgggtat

SEQ ID NO: 348989 - DNA, 75 bp, Artificial Sequence
  Synthetic
cataacagtgatacccgcaattattaaatctcgataatatcagaccgtacatacatagacggccattgttagata

SEQ ID NO: 348990 - DNA, 75 bp, Artificial Sequence
  Synthetic
cagacgacaacctgtaactgggtatactgcactacactgctatttgtataataattactttacaaacgatgtact

SEQ ID NO: 348991 - DNA, 75 bp, Artificial Sequence
  Synthetic
gacgtatgcctgtttatatattgcttactagatgttgcaatatttcacatgatgtagtgatagatatgatagaca

SEQ ID NO: 348992 - DNA, 75 bp, Artificial Sequence
  Synthetic
gtcgtccggtagtataatcaccatactagagtttccctcgtatggaatatcgataatagagaatcctccgaataa

SEQ ID NO: 348993 - DNA, 75 bp, Artificial Sequence
  Synthetic
tttgccaaccaatacatgtagctaaaattaggcataaatttcacacatccagtgcaacgaaattctccagaagat

SEQ ID NO: 348994 - DNA, 75 bp, Artificial Sequence
  Synthetic
tgtaacacgactcacaatagaatctgtgaatgctctcccggatattattgtcttctcaaaggatcatccggatgc

SEQ ID NO: 348995 - DNA, 75 bp, Artificial Sequence
  Synthetic
catagtatcaactttattagataagggaatcgatcctaactttaaacaagacggatatacagcgttacattatta

SEQ ID NO: 348996 - DNA, 75 bp, Artificial Sequence
  Synthetic
agactattccaacctattactagagtatataaaatctcgttacatgttattgaaggaagaggatatcgatgagaa

SEQ ID NO: 348997 - DNA, 75 bp, Artificial Sequence
  Synthetic
aagtagccattcttcccatggatgtttccttttttaccaaaggaaatgcatcattgattattctcctgtttgatt

SEQ ID NO: 348998 - DNA, 75 bp, Artificial Sequence
  Synthetic
ttatttgtgtctcgcacacgtttataaaccaggtgagtgtagaaaaccgataacgataaaaaaggccaagcgaat

SEQ ID NO: 348999 - DNA, 75 bp, Artificial Sequence
  Synthetic
tatttctttgtttatacaacatggagctaatctaaacgcgttagataattgtggtaatacaccattccatttgta

SEQ ID NO: 349000 - DNA, 75 bp, Artificial Sequence
  Synthetic
gctaatctaaacgcgttagataattgtggtaatacaccattccatttgtatcttagtattgaaatgtgtaataat

SEQ ID NO: 349001 - DNA, 75 bp, Artificial Sequence
  Synthetic
gtcactctacagaaagtccttcatgtgactgatactaataaatttgctcattataggttcacttgtgtcctcgct

SEQ ID NO: 349002 - DNA, 75 bp, Artificial Sequence
  Synthetic
tctccagaggaaatatcctcacaacttaatgaagatctatttccagatgatgattcaccggccactattatcgaa

SEQ ID NO: 349003 - DNA, 75 bp, Artificial Sequence
  Synthetic
taataatcatggattaacgcctatactatgttatataacttccgactacatacaacacgatattcttgttatgtt

SEQ ID NO: 349004 - DNA, 75 bp, Artificial Sequence
  Synthetic
ttgtaggaaggaggcgtggaactcgatactatcgctaccgtatattttatttgcggtagctagtgtcgcacaata

SEQ ID NO: 349005 - DNA, 75 bp, Artificial Sequence
  Synthetic
tacaacacgatattcttgttatgttaatacatcactatgaaacaaatgttggagaaatgccgatagatgagcgtc

SEQ ID NO: 349006 - DNA, 75 bp, Artificial Sequence
  Synthetic
ttaagataaggtaggcaaatgtttatagtactaagaattgggcaagcataagacatgtcacaaagaccctttttg

SEQ ID NO: 349007 - DNA, 75 bp, Artificial Sequence
  Synthetic
tcgataacttatttgatgaataggtttaaaaatatagatatttatacccgctatgaaggaaagacattattacac

SEQ ID NO: 349008 - DNA, 75 bp, Artificial Sequence
  Synthetic
caaaagactatgggaatatatttggatttgtggtgtcccataccactagatttcctcgtcctatggaacgagaag

SEQ ID NO: 349009 - DNA, 75 bp, Artificial Sequence; identical to SEQ ID NO: 48936
  Synthetic

SEQ ID NO: 349010 - DNA, 75 bp, Artificial Sequence
  Synthetic
acttggatgtttgttcggaggatgaaatagatagaatctataaaacgattaaacaatatcacgaaagtagaaaac

SEQ ID NO: 349011 - DNA, 75 bp, Artificial Sequence
  Synthetic
agaatgtgataagatcgttggtggatcaacttccatctctacctatcttcgatataaaatcatttgagaaattca

SEQ ID NO: 349012 - DNA, 75 bp, Artificial Sequence
  Synthetic
tcacgaaagacgggatcgcagtctttatgattcatagtaatagttagttccgacgttgagatggattcgctgaga

SEQ ID NO: 349013 - DNA, 75 bp, Artificial Sequence
  Synthetic
tcaaactgtccactgttctagacactacactatatgcagttttaagatgtcataattcgagaaagttaagaagat

SEQ ID NO: 349014 - DNA, 75 bp, Artificial Sequence
  Synthetic
acctcaccgagttaaaaaaatataataacgataagtcctttaaaatatattctaatattatgaatgagagatacc

SEQ ID NO: 349015 - DNA, 75 bp, Artificial Sequence
  Synthetic
atacgtcattaactttattgggtattccgtatggatttggtcatgatagaatgtattgttttaaattggtagctg

SEQ ID NO: 349016 - DNA, 75 bp, Artificial Sequence
  Synthetic
taacgataagtcctttaaaatatattctaatattatgaatgagagataccttaatgtatattataaagatatgta

SEQ ID NO: 349017 - DNA, 75 bp, Artificial Sequence
  Synthetic
gtctactaacattactaccttcagaaattatatacgaaatattatacatgctgacaattaacgatctttataata

SEQ ID NO: 349018 - DNA, 75 bp, Artificial Sequence
  Synthetic
attatacatgagagaaacaatatatacgagtataatacggacttcataatttaataatgtagtaatcgttgtctt

SEQ ID NO: 349019 - DNA, 75 bp, Artificial Sequence
  Synthetic
gattgagattctctatgagacgatatatagtaatgaagagagttcttacacatatcactgttgtacatacaggta

SEQ ID NO: 349020 - DNA, 75 bp, Artificial Sequence
  Synthetic
tgttctacgtttaggagcaccagaagtatttttggagcccttggaggctgatgtagaagaagacgaggattttga

SEQ ID NO: 349021 - DNA, 75 bp, Artificial Sequence
  Synthetic
tcctcgagataaaagagcatacaccacacgaggactatgtttggtatactgttgaaggtaagtgtgtaacggcgt

SEQ ID NO: 349022 - DNA, 75 bp, Artificial Sequence
  Synthetic
attccacagttacgccatagacatcgaaaatgaaatcacagaattcttcaataaaatgagagatactctaccagc

SEQ ID NO: 349023 - DNA, 75 bp, Artificial Sequence
  Synthetic
gaaaatgaaatcacagaattcttcaataaaatgagagatactctaccagctaaagactctaaatggttgaatcca

SEQ ID NO: 349024 - DNA, 75 bp, Artificial Sequence
  Synthetic
gcgataaattcgtaataatctgttttgttcaaaggaatctacaggcataaaaataaaaatataatttataatata

SEQ ID NO: 349025 - DNA, 75 bp, Artificial Sequence
  Synthetic
attcagcgcaaagtgtcctcctattgaagacagtcttttatcgcacagatataaagactatgtggttaaatggga

SEQ ID NO: 349026 - DNA, 75 bp, Artificial Sequence
  Synthetic
caggtttctaataaacgtgttaaacatggtgatttatggatagccaactatacatctaaattcagtaaccgtagg

SEQ ID NO: 349027 - DNA, 75 bp, Artificial Sequence
  Synthetic
aacttggtattttttggttctggaggaggcgaatttaaattcggacttggattcggattttgtgagttcttgatc

SEQ ID NO: 349028 - DNA, 75 bp, Artificial Sequence
  Synthetic
tacatctaaattcagtaaccgtaggtatttgtgtaccgtaactacaaagaatggtgactgtgttcagggtatagt

SEQ ID NO: 349029 - DNA, 75 bp, Artificial Sequence
  Synthetic
atggtgactgtgttcagggtatagttagatctcatattaaaaaacctccttcatgcattccaaaaacatatgaac

SEQ ID NO: 349030 - DNA, 75 bp, Artificial Sequence
  Synthetic
agacttatactgtggaattctttacgcaaaacattataataatataacttggtataaagataataaggaaattaa

SEQ ID NO: 349031 - DNA, 75 bp, Artificial Sequence
  Synthetic
gacgttagaatcaagaatgatatcgtagtatcaagatgtaaaatacttacggttataccgtcgcaagaccacagg

SEQ ID NO: 349032 - DNA, 75 bp, Artificial Sequence
  Synthetic
ccatttccgtgttcgttcgaatgccacatcgacgtcaaagataggggagtagttgaaatctagttctgcattgtt

SEQ ID NO: 349033 - DNA, 75 bp, Artificial Sequence
  Synthetic
taaaacacgaagagaaaccggtgcgtcggataattgtcctatatgtcgtacccgttttagaaacataacaatgag

SEQ ID NO: 349034 - DNA, 75 bp, Artificial Sequence
  Synthetic
tttaaactaatactagatccgaaaatcaacgtaacgataggagaacctgccaatataacatgcactgctgtgtca

SEQ ID NO: 349035 - DNA, 75 bp, Artificial Sequence
  Synthetic
tgattgaatgggaaaatccatctggatggcttataggattcgattttgatgtatactctgttttaactagtagag

SEQ ID NO: 349036 - DNA, 75 bp, Artificial Sequence
  Synthetic
atggcttataggattcgattttgatgtatactctgttttaactagtagaggcggtatcaccgaggcgaccttgta

SEQ ID NO: 349037 - DNA, 75 bp, Artificial Sequence
  Synthetic
gacacaactattattttgaaaaaacccttacaactacagtagtattggagtaaatacacaatgcatttttatata

SEQ ID NO: 349038 - DNA, 75 bp, Artificial Sequence
  Synthetic
taaatacacaatgcatttttatatacattactgaataattattattattatttatatcgtatttgtgctatagaa

SEQ ID NO: 349039 - DNA, 75 bp, Artificial Sequence
  Synthetic
caatattcatcaatttagatagaaacttatactcatcatctgttttaggaatccatgtattattaccactttcca

SEQ ID NO: 349040 - DNA, 75 bp, Artificial Sequence
  Synthetic
gctttacatgagtacttttataattatagatcagtcaacggaaaatacaagtatagatacaacggttactatcaa

SEQ ID NO: 349041 - DNA, 75 bp, Artificial Sequence
  Synthetic
cacatatctccgataactaatgatgtatctacacaaacatgggaaaagaaatcagagttagatagatacatggaa

SEQ ID NO: 349042 - DNA, 75 bp, Artificial Sequence
  Synthetic
tgacaaagttagaaaaaatgatttagacatgaatgtggtaaaagaattactttctaacggtgcatctctaacaat

SEQ ID NO: 349043 - DNA, 75 bp, Artificial Sequence
  Synthetic
acgaaagtatatagtacactcctatctaaaaaattatagaaatttcgattatccatttttcaggaagttagtttt

SEQ ID NO: 349044 - DNA, 75 bp, Artificial Sequence
  Synthetic
ctaaaaaattatagaaatttcgattatccatttttcaggaagttagttttgactaataaacattgtctcaacaat

SEQ ID NO: 349045 - DNA, 75 bp, Artificial Sequence
  Synthetic
atgtataagtgtaaaaattataacattcatagttggatttacataggtgtccaatcgggatctctccatcatcga

SEQ ID NO: 349046 - DNA, 75 bp, Artificial Sequence
  Synthetic
gataattgatggcatctcccttccttttttagtagatatttcatcgtgtaagaatcaatattaatatttctaaag

SEQ ID NO: 349047 - DNA, 75 bp, Artificial Sequence
  Synthetic
gtctaataaaaaattaataactcctaattacatgaagttattagtgtataacggaaatgatataaacgcacgagg

SEQ ID NO: 349048 - DNA, 75 bp, Artificial Sequence
  Synthetic
aattacatgaagttattagtgtataacggaaatgatataaacgcacgaggtgaagatacacaaatgcgaactcca

SEQ ID NO: 349049 - DNA, 75 bp, Artificial Sequence
  Synthetic
ccgatactataatgaaaagattatagacgcatttatagagttaggagccgatctaactattccaaatgacgatgg

SEQ ID NO: 349050 - DNA, 75 bp, Artificial Sequence
  Synthetic
gacgcatttatagagttaggagccgatctaactattccaaatgacgatggaatgataccagtagtttactgtata

SEQ ID NO: 349051 - DNA, 75 bp, Artificial Sequence
  Synthetic
aggttgtaatatcatatagacaataactaacaattaattagtaactgttatctcttttttaattaaccaactaac

SEQ ID NO: 349052 - DNA, 75 bp, Artificial Sequence
  Synthetic
acgtaaactacttaatcttagtagacgtgcgtcacataatctatttagagatcgagtcatgcacgattatataag

SEQ ID NO: 349053 - DNA, 75 bp, Artificial Sequence
  Synthetic
cgtgcgtcacataatctatttagagatcgagtcatgcacgattatataagtaatacatatattgatcttgagtgt

SEQ ID NO: 349054 - DNA, 75 bp, Artificial Sequence
  Synthetic
aggacgtacaccacttcattgcgctatacaacataacttcactcagattgctaagtacttattagatcgaggagc

SEQ ID NO: 349055 - DNA, 75 bp, Artificial Sequence
  Synthetic
atacaacataacttcactcagattgctaagtacttattagatcgaggagctgatatatcattaaagacagacgat

SEQ ID NO: 349056 - DNA, 75 bp, Artificial Sequence
  Synthetic
gagaatgatatagaaaagcatatcaaaagactttgtgttgtgcatttctgtgagaagaaagaggacatcaagtac

SEQ ID NO: 349057 - DNA, 75 bp, Artificial Sequence
  Synthetic
gactagctttttgattagtcgtctaccgcctaaaagtgtcatatgctcactgactaaccatataatagattatgt

SEQ ID NO: 349058 - DNA, 75 bp, Artificial Sequence
  Synthetic
ccgcctaaaagtgtcatatgctcactgactaaccatataatagattatgttcttacgaacaatagacgtattatt

SEQ ID NO: 349059 - DNA, 75 bp, Artificial Sequence
  Synthetic
gattccaaaaatactgaatacaaagtcctaaattataaatatggagatcatactaccacaacttattattatgta

SEQ ID NO: 349060 - DNA, 75 bp, Artificial Sequence
  Synthetic
taccaacataccgtataatatgtaatatacaattccataacccattgacagttgttatacatcaaaattgcaatt

SEQ ID NO: 349061 - DNA, 75 bp, Artificial Sequence
  Synthetic
tgtgtcctctttcctcttataacatcgtaatcaaaaacttttttataatatatacctaataatgtgtcttaatag

SEQ ID NO: 349062 - DNA, 75 bp, Artificial Sequence
  Synthetic
taaaacacataaaaataagcgtaactaataagacaatggatatttacgacgataaaggtctacagactattaaac

SEQ ID NO: 349063 - DNA, 75 bp, Artificial Sequence
  Synthetic
aaaacattttcatcagggtgttttacgattagttctttaaagatatccatggtatagaccaaacaataacgataa

SEQ ID NO: 349064 - DNA, 75 bp, Artificial Sequence
  Synthetic
taataagacaatggatatttacgacgataaaggtctacagactattaaactgtttaataatgaatttgattgtat

SEQ ID NO: 349065 - DNA, 75 bp, Artificial Sequence
  Synthetic
tacaacttccgatggaagacaattctgatattatagaaaatatcagaaaaatactatatagacgattaaaaaatg

SEQ ID NO: 349066 - DNA, 75 bp, Artificial Sequence
  Synthetic
ataaatacgaggacgtgtatagagtaagtaaagaaaaagaatgtggaatttgctatgaagttgtttactcaaaac

SEQ ID NO: 349067 - DNA, 75 bp, Artificial Sequence
  Synthetic
aataacttttatgaaatacgatccaaatgatgataataagcgtacgtgttctaattgggtacccttaactaataa

SEQ ID NO: 349068 - DNA, 75 bp, Artificial Sequence
  Synthetic
ctaattgggtacccttaactaataactatatggaatattgtctagtaatatatttggaaacaccgatatgtggag

SEQ ID NO: 349069 - DNA, 75 bp, Artificial Sequence
  Synthetic
agtccgtattatactcgtatatattgtttctctcatgtataataataaacggaagagatatagcaccgcatgcac

SEQ ID NO: 349070 - DNA, 75 bp, Artificial Sequence
  Synthetic
attatgtttgcaaagactctagactttaaatcaacgaaagtgttaactggacgtaaaacaattgccgttctagac

SEQ ID NO: 349071 - DNA, 75 bp, Artificial Sequence
  Synthetic
cgttgatatagatatacatactgataaaaacggaaaagagttatgttattgttatataacaatagatgatcatta

SEQ ID NO: 349072 - DNA, 75 bp, Artificial Sequence
  Synthetic
aaaaacggaaaagagttatgttattgttatataacaatagatgatcattacttggttgatgtggaaactatagga

SEQ ID NO: 349073 - DNA, 75 bp, Artificial Sequence
  Synthetic
tataggtatcgttaaagataaacgtataagcgatagttttggagatgtatgtatggatacaatatttgacttttc

SEQ ID NO: 349074 - DNA, 75 bp, Artificial Sequence
  Synthetic
ataagcgatagttttggagatgtatgtatggatacaatatttgacttttctgaagcacgagagttattttcatta

SEQ ID NO: 349075 - DNA, 75 bp, Artificial Sequence
  Synthetic
aataccgcctttcaaaattgtaacaacaatgttgcctcatacatcggatacgacatcaaccttccgactaaagac

SEQ ID NO: 349076 - DNA, 75 bp, Artificial Sequence
  Synthetic
tgatacagatatatggactcccgtcacagaagatgattacaaatttctttctagactagtattgtatgcaaaatc

SEQ ID NO: 349077 - DNA, 75 bp, Artificial Sequence
  Synthetic
acagaagatgattacaaatttctttctagactagtattgtatgcaaaatctcaatcggatactgtattcgactat

SEQ ID NO: 349078 - DNA, 75 bp, Artificial Sequence
  Synthetic
aactagattttactttaatatgccgaaataaaaaatttttgtataatatctagaggtagaggtattgtttagata

SEQ ID NO: 349079 - DNA, 75 bp, Artificial Sequence
  Synthetic
attttttttatgagtatttttacaaaaatgtataaagtgtatgtcttatgtatatttataaaaatgctaaatatg

SEQ ID NO: 349080 - DNA, 75 bp, Artificial Sequence
  Synthetic
aatacaataattaatttctcgtaaaagtagaaaatatattctaatttattgcacggtaaggaagtagaatcataa

SEQ ID NO: 349081 - DNA, 75 bp, Artificial Sequence
  Synthetic
aactcacgcatagagaaggtagggaataatggcataatatttattaggttatcatcattgtcattatctacaact

SEQ ID NO: 349082 - DNA, 75 bp, Artificial Sequence
  Synthetic
atacgtttagccgcctttaatagaggaaatcccaccgcctttctggatctcaccaacgacgatagttctgaccag

SEQ ID NO: 349083 - DNA, 75 bp, Artificial Sequence
  Synthetic
ttttgtaaaaatactcataaaaaaatttataaaaattatggcacaaccatatcttgtagaggtagtttattagtt

SEQ ID NO: 349084 - DNA, 75 bp, Artificial Sequence
  Synthetic
ctaaaattgatggatgagatatacagctattaatttcgaaaatatattttaatctgataactttaaacatggatt

SEQ ID NO: 349085 - DNA, 75 bp, Artificial Sequence
  Synthetic
ataagaatgattgtttgacgaatcacgagaactattaagacatatattattagaggtatatattataaaaaagtt

SEQ ID NO: 349086 - DNA, 75 bp, Artificial Sequence
  Synthetic
ggagatgggatatatgacgttgtagtgtttgggttttctgaacgttgatagtctactaatactacatgctgacat

SEQ ID NO: 349087 - DNA, 75 bp, Artificial Sequence
  Synthetic
gtctactaatactacatgctgacatctaatgcctgtataaccatgagagcatctacaatacataccgtcgatatc

SEQ ID NO: 349088 - DNA, 75 bp, Artificial Sequence
  Synthetic
aaacaatatccatctccctctggaccgcataatctgatagctggaatatctgttgtagcgtttgtaatttctggc

SEQ ID NO: 349089 - DNA, 75 bp, Artificial Sequence
  Synthetic
attttggtcattaaatctttcatttcttcctggtatatttttatcacctcgtttggttggatttttgtctatatt

SEQ ID NO: 349090 - DNA, 75 bp, Artificial Sequence
  Synthetic
gtgtttatgacaagattgggaattttatattattaattcagtaatataaactaataatatattgttaattgtgta

SEQ ID NO: 349091 - DNA, 75 bp, Artificial Sequence
  Synthetic
tatggaaattattgataatcggtactaataaaatagtttaactcttttaaaaccagtttggtactggaatttcag

SEQ ID NO: 349092 - DNA, 75 bp, Artificial Sequence
  Synthetic
taataaaatagtttaactcttttaaaaccagtttggtactggaatttcagttcattactcgttgagaaattgatg

SEQ ID NO: 349093 - DNA, 75 bp, Artificial Sequence
  Synthetic
gatcccaaatctggtaaaagttaaacttggggagaatgatacagaaaatctttcttctactatatcggcggcacc

SEQ ID NO: 349094 - DNA, 75 bp, Artificial Sequence
  Synthetic
atttttttaaaatgatattacttttatatgcttgcatcgcagaatgatattcacaagtattattaaaaatgagta

SEQ ID NO: 349095 - DNA, 75 bp, Artificial Sequence
  Synthetic
cgtcaaggatcatcacctatcttgtgcattttcgaaactcgtaaaaagattaatatttataaagaaaatatggaa

SEQ ID NO: 349096 - DNA, 75 bp, Artificial Sequence
  Synthetic
atacgttaaagtctgtccgtcttctctattgtttagactgtttgtagaatgctgtgatataaacaaactagtaga

SEQ ID NO: 349097 - DNA, 75 bp, Artificial Sequence
  Synthetic
ctattgtttagactgtttgtagaatgctgtgatataaacaaactagtagaaggtacgactccgttacactgttat

SEQ ID NO: 349098 - DNA, 75 bp, Artificial Sequence
  Synthetic
tgtcaatgggttatggaattgtatattacatattatacggtatgttggtaacgacaaataccgatcggtaattgt

SEQ ID NO: 349099 - DNA, 75 bp, Artificial Sequence
  Synthetic
aacatctctcataagaaagtgagttacgaagatatcatcggttcaacgatcgtcgatacaaaatgcgtcaagaat

SEQ ID NO: 349100 - DNA, 75 bp, Artificial Sequence
  Synthetic
aaagtgtaccggacactatattccggtttgcaaaacaaaaatgttcttaactacattcacaaaaagttacctctc

SEQ ID NO: 349101 - DNA, 75 bp, Artificial Sequence
  Synthetic
gagcagaccctaattatgtagatgatagaggtaatacttttcttcattacttctgcatctatatgtccacttatg

SEQ ID NO: 349102 - DNA, 75 bp, Artificial Sequence
  Synthetic
ttctgcatctatatgtccacttatgagaaaacgtcatttaataagatgcatcgtgaaaagaaatttattaaagag

SEQ ID NO: 349103 - DNA, 75 bp, Artificial Sequence
  Synthetic
acttcagccaaatattcttttttgaaacgccatctatcgtagcgaggacacaagtgaacctataatgagcaaatt

SEQ ID NO: 349104 - DNA, 75 bp, Artificial Sequence
  Synthetic
tattagtatcggttacatgaaggactttctgtagagtgacgattctaccatctatggtacgaacggtttcatctt

SEQ ID NO: 349105 - DNA, 75 bp, Artificial Sequence
  Synthetic
tgtaagcgttggcaccggaatactattcatggaaatgtttttcgattacaataaaataattcaaaaaatagtatc

SEQ ID NO: 349106 - DNA, 75 bp, Artificial Sequence
  Synthetic
ctacctttacaatggcctttccttgtgcccagttcagaccctgtcattgccacgctactaaggactccctgaata

SEQ ID NO: 349107 - DNA, 75 bp, Artificial Sequence
  Synthetic
cacgctactaaggactccctgaataccgtggccgacgtcagacattgtctgactgaatacatcctgtgggtttct

SEQ ID NO: 349108 - DNA, 75 bp, Artificial Sequence
  Synthetic
gactgaatacatcctgtgggtttctcatagatggacccatagagaaactgcagggtctctctacaggcttctcat

SEQ ID NO: 349109 - DNA, 75 bp, Artificial Sequence
  Synthetic
cagggtctctctacaggcttctcatctctttcagaactgatgcaacggagctctttggtggtgagttgaaggatt

SEQ ID NO: 349110 - DNA, 75 bp, Artificial Sequence
  Synthetic
aaaatacatatgacagacattgttgacagaaacgtgaccttcattcttaccgtcgtccataaatacgttaggtat

SEQ ID NO: 349111 - DNA, 75 bp, Artificial Sequence
  Synthetic
ggactcataatctctatacgggattaacggatgttctatatacggggatgagtagttttcttctttaactttata

SEQ ID NO: 349112 - DNA, 75 bp, Artificial Sequence
  Synthetic
atatcgacatactacttatgctgcgaaagattctgaacgagaacgactatctcaccctcttggatcatatccgca

SEQ ID NO: 349113 - DNA, 75 bp, Artificial Sequence
  Synthetic
ttcacacatttttgataaatgggaactgctgcaacaattcagactcccaccaaattaatgaataaagaaaatgca

SEQ ID NO: 349114 - DNA, 75 bp, Artificial Sequence
  Synthetic
aaagattctgaacgagaacgactatctcaccctcttggatcatatccgcactgctaaatactaaatctccttcat

SEQ ID NO: 349115 - DNA, 75 bp, Artificial Sequence
  Synthetic
atttttcgtgaaataggaataattagcaccagaatagctatggattattgtggtagagagtgcacatgtattcta

SEQ ID NO: 349116 - DNA, 75 bp, Artificial Sequence
  Synthetic
aatcaattacagatttctccgtgataggtatcgatgaaggacagttctttccagacattgttgaattctgtgagc

SEQ ID NO: 349117 - DNA, 75 bp, Artificial Sequence
  Synthetic
acagtaagcatagatacgtcaaatctcaaattgtgcatctactgatatccagctattcgaattcctctaacgaac

SEQ ID NO: 349118 - DNA, 75 bp, Artificial Sequence
  Synthetic
ggattggtggatatatacgtaacgacgcctaatccgagaccagaagtattgctatggcttcttaaatcagaatgt

SEQ ID NO: 349119 - DNA, 75 bp, Artificial Sequence
  Synthetic
taagaactctcttcattactatatatcgtctcatagagaatctcaatctctatccaaggatgtaattaaatgttt

SEQ ID NO: 349120 - DNA, 75 bp, Artificial Sequence
  Synthetic
tatccaaggatgtaattaaatgtttgatcgataacaatgtttccatccatggcagagacgaaggaggatctttac

SEQ ID NO: 349121 - DNA, 75 bp, Artificial Sequence
  Synthetic
aagcgatttagagtaaccccatataatgtagacatggaaatcgttaattttcttattgagagacgtcatactctt

SEQ ID NO: 349122 - DNA, 75 bp, Artificial Sequence
  Synthetic
tgaaaaatatatcacttgctcacctctatatttcgtacatttttaaactgtttatataatatctctctgatatat

SEQ ID NO: 349123 - DNA, 75 bp, Artificial Sequence
  Synthetic
ttcatctatgtgattaggcatgttgatggaaaaattcttttcgttggtagatattgctctccaacaactaattgt

SEQ ID NO: 349124 - DNA, 75 bp, Artificial Sequence
  Synthetic
tatctaacaatggccgtctatgtatgtacggtctgatattatcgagatttaataattgcgggtatcactgttatg

SEQ ID NO: 349125 - DNA, 75 bp, Artificial Sequence
  Synthetic
gtacggtctgatattatcgagatttaataattgcgggtatcactgttatgaaaccatactgatagatgtatttga

SEQ ID NO: 349126 - DNA, 75 bp, Artificial Sequence
  Synthetic
taaactgaaactaacaaagagcgacgtacaactgttgtaaattattttatgcttcgtaaaatgtaggttttgaac

SEQ ID NO: 349127 - DNA, 75 bp, Artificial Sequence
  Synthetic
aaaatattcttcataaccggcaagaaagtgaaaagttcacattgaaactatgtcagtagtatacatcatgaaatg

SEQ ID NO: 349128 - DNA, 75 bp, Artificial Sequence
  Synthetic
tatcgccggtcgtcataaggaactaaagcgctatagagcagacattaatagaatgaagaatgcctacatatcagg

SEQ ID NO: 349129 - DNA, 75 bp, Artificial Sequence
  Synthetic
tgttttctcatcacttagaacagatttaacaatttctataaagtctgtcaaatcatcttccggagaccccataaa

SEQ ID NO: 349130 - DNA, 75 bp, Artificial Sequence
  Synthetic
ttattactccattaaataatttatcatggagcgataatgtcctgtttcatttgtttccatgacatattacaaaat

SEQ ID NO: 349131 - DNA, 75 bp, Artificial Sequence
  Synthetic
acatagattattacattcttgactgtcgctaatatctaaatatttattgttatcgtattggattctgcatataga

SEQ ID NO: 349132 - DNA, 75 bp, Artificial Sequence
  Synthetic
cccatacatgaaggcaatgagaaataggattctcatcttgccaaaatatcactagaaaaaatttatttatcaatt

SEQ ID NO: 349133 - DNA, 75 bp, Artificial Sequence
  Synthetic
gagtcgtaaaaaagttctccttcgatggtctcacaaaaatattaaacctctttctgatggagtcgtaaaaaagtt

SEQ ID NO: 349134 - DNA, 75 bp, Artificial Sequence
  Synthetic
aaataatatcccacattatcatctgttagagtagtatcattaaatctattatattttatgaaaaatatatcactg

SEQ ID NO: 349135 - DNA, 75 bp, Artificial Sequence
  Synthetic
aagatagattccatcatcgtgacataagtcgccttaaagagattcgaatctccgacaccgacctgtatacggtat

SEQ ID NO: 349136 - DNA, 75 bp, Artificial Sequence
  Synthetic
gtacgacgatctcatagaacagtgccatctatcgatggagcgtaaaagtaaactcgtcgacaaagcactcaataa

SEQ ID NO: 349137 - DNA, 75 bp, Artificial Sequence
  Synthetic
tatgccaaatgaatcacgtgttaaacaatgggtgatggatacacttaatggtataatgatgaatgaacgcgatgt

SEQ ID NO: 349138 - DNA, 75 bp, Artificial Sequence
  Synthetic
agtatgttgtacggaaagaaccattacaaatattatccatgatagaaagaaaatatctatatgattggagaagta

SEQ ID NO: 349139 - DNA, 75 bp, Artificial Sequence
  Synthetic
aattgtatattcagattatcatgcgatgtgtatacgctaacggtatcaataaacggagcacaccatttagtcata

SEQ ID NO: 349140 - DNA, 75 bp, Artificial Sequence
  Synthetic
ctcatgtataataataaacggaagagatatagcaccgcatgcaccatccgatggaaagtgtaaagacaacgaata

SEQ ID NO: 349141 - DNA, 75 bp, Artificial Sequence
  Synthetic
gatatagcaccgcatgcaccatccgatggaaagtgtaaagacaacgaatacaaacgccataatttgtgtccggga

SEQ ID NO: 349142 - DNA, 75 bp, Artificial Sequence
  Synthetic
actcacaatagaatctgtgaatgctctcccggatattattgtcttctcaaaggatcatccggatgcaaggcatgt

SEQ ID NO: 349143 - DNA, 75 bp, Artificial Sequence
  Synthetic
tgagccaacaaatgtaatcgtgtataatatctttgatagaatcagactctaaagaaaaggaatcggctttattat

SEQ ID NO: 349144 - DNA, 75 bp, Artificial Sequence
  Synthetic
acgcattcatgataaacttaatgaaaaatgtttttcgttggatgaatagtatgtcttaataattgttattatttt

SEQ ID NO: 349145 - DNA, 75 bp, Artificial Sequence
  Synthetic
tctcttatcatgtgggtaatgttctcgatgtcgatagccatatgcccggtagttgcgatatacataaactgatca

SEQ ID NO: 349146 - DNA, 75 bp, Artificial Sequence
  Synthetic
ctaattccaaacccacccgctttttatagtaagtttttcacccataaataataaatacaataattaatttctcgt

SEQ ID NO: 349147 - DNA, 75 bp, Artificial Sequence
  Synthetic
atagtaagtttttcacccataaataataaatacaataattaatttctcgtaaaagtagaaaatatattctaattt

SEQ ID NO: 349148 - DNA, 75 bp, Artificial Sequence
  Synthetic
ccacattcagattccaacagctgattaacttccacattaatacagcctattttcgctccaaatgtacattcgaaa

SEQ ID NO: 349149 - DNA, 75 bp, Artificial Sequence
  Synthetic
gcaatcatcctcatcctcctcctcgtgtacggaagaagaaaacaaacatcatatgggaatcgatgttattatcaa

SEQ ID NO: 349150 - DNA, 75 bp, Artificial Sequence
  Synthetic
tgtacggaagaagaaaacaaacatcatatgggaatcgatgttattatcaaagtcacaaagcaagaccaaacaccg

SEQ ID NO: 349151 - DNA, 75 bp, Artificial Sequence
  Synthetic
agtcacaaagcaagaccaaacaccgaccaatgataagatttgccaatccgtaacggaaattacagagtccgagtc

SEQ ID NO: 349152 - DNA, 75 bp, Artificial Sequence
  Synthetic
accaatgataagatttgccaatccgtaacggaaattacagagtccgagtcagatccagatcccgaggtggaatca

SEQ ID NO: 349153 - DNA, 75 bp, Artificial Sequence
  Synthetic
atgtagatcctcctaccacttattactccatcatcggtggaggtctgagaatgaactttggattcaccaaatgtc

SEQ ID NO: 349154 - DNA, 75 bp, Artificial Sequence
  Synthetic
gtatcatgaactctaatcaaaatcttaatatcttcgtcacacgttagttctttgaagtttttaagagatgcatca

SEQ ID NO: 349155 - DNA, 75 bp, Artificial Sequence
  Synthetic
ttatgcttcgtaaaatgtaggttttgaaccaaacattctttcaaagaatgagatgcataaaactttattatccaa

SEQ ID NO: 349156 - DNA, 75 bp, Artificial Sequence
  Synthetic
tcatgaagaagctcttgctatgatcaaagactgtgaggtgtctatcgacatcagatgtagcgaagaagagaaaga

SEQ ID NO: 349157 - DNA, 75 bp, Artificial Sequence
  Synthetic
ttcaagtatgtcgacggatcggcatctgaaggtgcaaccgatgatacttcactcatcgattcaacaaaactcaaa

SEQ ID NO: 349158 - DNA, 75 bp, Artificial Sequence
  Synthetic
gcgtgtgtctgaatcgataactctattcatctgaaattggatgagtagggttaatcgaacgattcaggcacacca

SEQ ID NO: 349159 - DNA, 75 bp, Artificial Sequence
  Synthetic
agcagagactcgagtattgggtagagtcttaccttactatcttccagactctaaggatccagaaggaagaggtta

SEQ ID NO: 349160 - DNA, 75 bp, Artificial Sequence
  Synthetic
cgaattaaaaaagtgtaccggacactatattccggtttgcaaaacaaaaatgttcttaactacattcacaaaaag

SEQ ID NO: 349161 - DNA, 75 bp, Artificial Sequence
  Synthetic
aacatagattattaccttcttaactgtcgctaatatctatatatttattgttatcgtattggattctgcatatag

SEQ ID NO: 349162 - DNA, 75 bp, Artificial Sequence
  Synthetic
atttcctttcagggtatcacaaaaatattaaacctctttctgatggtctcataaaaaaagttttacaaaaatatt

SEQ ID NO: 349163 - DNA, 75 bp, Artificial Sequence
  Synthetic
aaaatatttttattctctttctctctttgatggtctcataaaaaaagttttacaaaaatatttttattctctttc

SEQ ID NO: 349164 - DNA, 75 bp, Artificial Sequence
  Synthetic
tctctttgatggtctcataaaaaatattaaacctctttctgatggtgtcactaaaatatttttattctcattctc

SEQ ID NO: 349165 - DNA, 75 bp, Artificial Sequence
  Synthetic
attctctttctctcttcgatggtctcacaaaaatattaaacctctttctgatggtgtcactaaaatatttttatt

SEQ ID NO: 349166 - DNA, 75 bp, Artificial Sequence
  Synthetic
tcgtagtatcaagatgtaaaatacttacggttataccgtcacaagaccacaggtttaaactaaaaagaaattgcg

SEQ ID NO: 349167 - DNA, 75 bp, Artificial Sequence
  Synthetic
ctattttcagtaatggtaactgcgaaaccgttatttatagcagatatagggataggagtaggaatgccacaaatg

SEQ ID NO: 349168 - DNA, 75 bp, Artificial Sequence
  Synthetic
catgttaaataaacctacaaagaaacgatatgttaataatccgatatttacagattgggctaataagcaatataa

SEQ ID NO: 349169 - DNA, 75 bp, Artificial Sequence
  Synthetic
cgatatgttaataatccgatatttacagattgggctaataagcaatataagttttataatcaaataatatataat

SEQ ID NO: 349170 - DNA, 75 bp, Artificial Sequence
  Synthetic
taggttaccagacaattgtatatcataaaataatgtttataatttacacgttaaaatcatataataaaacgtaga

SEQ ID NO: 349171 - DNA, 75 bp, Artificial Sequence
  Synthetic
taaaataatgtttataatttacacgttaaaatcatataataaaacgtagatcgtataatattttttggtatataa

SEQ ID NO: 349172 - DNA, 75 bp, Artificial Sequence
  Synthetic
ggtatccattgacgataatcgtttatcaacactaccgttagaaattagacatttgattttctcgtacgcgttcct

SEQ ID NO: 349173 - DNA, 75 bp, Artificial Sequence
  Synthetic
atttactgtctacctaaatttcgttgaaccggaagaattgaatcttagtaagtttatgatggttcttccgggggc

SEQ ID NO: 349174 - DNA, 75 bp, Artificial Sequence
  Synthetic
tcaacactaccgttagaaattagacatttgattttctcgtacgcgttcctataaaaatagaaactataatcatat

SEQ ID NO: 349175 - DNA, 75 bp, Artificial Sequence
  Synthetic
acagacaaattcttgtccatatattttaaaacattgacttttgtactaagaaaaatatctagactaactatctct

SEQ ID NO: 349176 - DNA, 75 bp, Artificial Sequence
  Synthetic
gtactgtaaaaatagaaactataatcatataatagtgtaggttggtagtagggtactcgtgattaattttattgt

SEQ ID NO: 349177 - DNA, 75 bp, Artificial Sequence
  Synthetic
agtggcggcatgtggagtgtctttatccatggacatgatggtagtaataaaggatctaaaacttatacatctggt

SEQ ID NO: 349178 - DNA, 75 bp, Artificial Sequence
  Synthetic
tccatggacatgatggtagtaataaaggatctaaaacttatacatctggtggcggtggaatgtggggaggaggat

SEQ ID NO: 349179 - DNA, 75 bp, Artificial Sequence
  Synthetic
ggcggtggaatgtggggaggaggatcgtccagtggggttaacggaggtgtaaaatctggaactggtaaaatttaa

SEQ ID NO: 349180 - DNA, 75 bp, Artificial Sequence
  Synthetic
acttgatacgccgcgttctctgtagtcgacgctctcaaatgggaaacgatctccattatttttttggaatcggat

SEQ ID NO: 349181 - DNA, 75 bp, Artificial Sequence
  Synthetic
ctccattatttttttggaatcggatactatatcttcggtatcttgacgcaatctagtatacatagagttaagaga

SEQ ID NO: 349182 - DNA, 75 bp, Artificial Sequence
  Synthetic
gttgtgtgggtgtatagagttcacagtagctcattcagtcaaaatgtttgactatttggaaaatgaggaggtggc

SEQ ID NO: 349183 - DNA, 75 bp, Artificial Sequence
  Synthetic
gtagctcattcagtcaaaatgtttgactatttggaaaatgaggaggtggctctcgatgaacttaaacagatgttg

SEQ ID NO: 349184 - DNA, 75 bp, Artificial Sequence
  Synthetic
actggatgggtcttgatgtcgctgtctttctcttcttcgctacatctgatgtcgatagacacctcacagtctttg

SEQ ID NO: 349185 - DNA, 75 bp, Artificial Sequence
  Synthetic
acacgcatacctttttaatgagcattgtaataatgttgaggtcgtcaaactactactagacagtggcactaatcc

SEQ ID NO: 349186 - DNA, 75 bp, Artificial Sequence
  Synthetic
tgtaataatgttgaggtcgtcaaactactactagacagtggcactaatccattacgcaaaaattggagacagcta

SEQ ID NO: 349187 - DNA, 75 bp, Artificial Sequence
  Synthetic
agcgatggctctactagaagccactggatttagcaacataaatgactttaatatattcagctatatgaaatccaa

SEQ ID NO: 349188 - DNA, 75 bp, Artificial Sequence
  Synthetic
agacgaggggttagatggtaaaatacaaaataatagatatagatttgcatttctatacttgttggtgaaatggta

SEQ ID NO: 349189 - DNA, 75 bp, Artificial Sequence
  Synthetic
gtactgatacgcgtatgatgattatcaactacgaaattgcggtaccgtattgcatctgtattcaaagtcggatac

SEQ ID NO: 349190 - DNA, 75 bp, Artificial Sequence
  Synthetic
caactacgaaattgcggtaccgtattgcatctgtattcaaagtcggatacgagagcatatgtgcgtccggaagtt

SEQ ID NO: 349191 - DNA, 75 bp, Artificial Sequence
  Synthetic
taaaattacatcaagattataatattgaaatcgtaatttgagttgtttgataatcatggatatcaaaaatgatat

SEQ ID NO: 349192 - DNA, 75 bp, Artificial Sequence
  Synthetic
ctattgtacagctcttcaatattatattaagtcatctcatatagatatagacatcgttaaattgttaatgaaagg

SEQ ID NO: 349193 - DNA, 75 bp, Artificial Sequence
  Synthetic
ggtgaaaaacttactataaaaagtgggtgggtttggaattagtgatcagtttatgtatatcgcaactaccgggca

SEQ ID NO: 349194 - DNA, 75 bp, Artificial Sequence
  Synthetic
acccacatgataagagattgtatcagtttcgtagtcttgagtattggtattactatatagtatatagatgtcgcc

SEQ ID NO: 349195 - DNA, 75 bp, Artificial Sequence
  Synthetic
gtttcgtagtcttgagtattggtattactatatagtatatagatgtcgcccactagagttactgtctccgaatgc

SEQ ID NO: 349196 - DNA, 75 bp, Artificial Sequence
  Synthetic
acggaataatgtgtagtattgtaccactatggagaaatgataaggaaaccatctttttgatattgaaaacaatga

SEQ ID NO: 349197 - DNA, 75 bp, Artificial Sequence
  Synthetic
actatggagaaatgataaggaaaccatctttttgatattgaaaacaatgaactcggatgtcctccaacatatact

SEQ ID NO: 349198 - DNA, 75 bp, Artificial Sequence
  Synthetic
tagatattaatgtcgtatttgaacagagcctgtaacatctcaatgtctttattatctatagccaatttaatgtcg

SEQ ID NO: 349199 - DNA, 75 bp, Artificial Sequence
  Synthetic
tggtaaataaagaggctatacacggatactttagaaatattaatattgattcttacacgatgaaatatctactaa

SEQ ID NO: 349200 - DNA, 75 bp, Artificial Sequence
  Synthetic
tcttacacgatgaaatatctactaaaaaaggaagggagatgccatcaattatctcgattggacacctatgtaaat

SEQ ID NO: 349201 - DNA, 75 bp, Artificial Sequence
  Synthetic
acttataaaaatactaaaactggagagactgattacacgtacctctctaatgggggttgcctgcatactatcgta

SEQ ID NO: 349202 - DNA, 75 bp, Artificial Sequence
  Synthetic
ttgtgacatgtcttatgcttgcccaattcttagtactataaacatttgcctaccttatcttaaagacattaacat

SEQ ID NO: 349203 - DNA, 75 bp, Artificial Sequence
  Synthetic
attcttagtactataaacatttgcctaccttatcttaaagacattaacatgattgacaaacgaggagaaacactt

SEQ ID NO: 349204 - DNA, 75 bp, Artificial Sequence
  Synthetic
agaatccggttcagatgtcaacattagatcaaataacggatatacatgtatagccattgccatcaacgaatctaa

SEQ ID NO: 349205 - DNA, 75 bp, Artificial Sequence
  Synthetic
tggataatatccatattgacgatgtcaataatgccggtattggcatacagttcatcgatttttagatttcattca

SEQ ID NO: 349206 - DNA, 75 bp, Artificial Sequence
  Synthetic
agatcaaataacggatatacatgtatagccattgccatcaacgaatctaaaaacattgaactgctgaaaatgcta

SEQ ID NO: 349207 - DNA, 75 bp, Artificial Sequence
  Synthetic
atctaacatcgtagataactactatgctataaaacaatgtattaaatatgccatgattatagatgactgtacatc

SEQ ID NO: 349208 - DNA, 75 bp, Artificial Sequence
  Synthetic
gctataaaacaatgtattaaatatgccatgattatagatgactgtacatcgtctaagattccagagtccataagt

SEQ ID NO: 349209 - DNA, 75 bp, Artificial Sequence
  Synthetic
gaaaaaaataatggtaggtggtaatactatgttctcattaatatttactgatcatggagctaaaattattcatag

SEQ ID NO: 349210 - DNA, 75 bp, Artificial Sequence
  Synthetic
catggataatatttgtaatggttctttccgtacaacatactgtttagatgatagtcgcttagcttggttatgata

SEQ ID NO: 349211 - DNA, 75 bp, Artificial Sequence
  Synthetic
gagtattatgagttaaaacaaaataaaatatatgtggaagcatatgatattatttccaacgcaatagtgaaacat

SEQ ID NO: 349212 - DNA, 75 bp, Artificial Sequence
  Synthetic
catctcctggagtcagcgacattgtagaaagcgtggctgctgtagagctcgatgatagcgacggggatgatgaac

SEQ ID NO: 349213 - DNA, 75 bp, Artificial Sequence
  Synthetic
atcgatgatacatgtattaaaatactttccgaataagtcttttaaatattgtattaattatgaaaaactatgcta

SEQ ID NO: 349214 - DNA, 75 bp, Artificial Sequence
  Synthetic
tttttatacctttaaaattgataaataaattttttctagtgatattttggcaagatgaaaatcctatttctcatt

SEQ ID NO: 349215 - DNA, 75 bp, Artificial Sequence
  Synthetic
gccttcatgtatgggtgtgttcacccatatgttaatgccgacgaaatcaaatgtcctaacctaaacatcgtaaca

SEQ ID NO: 349216 - DNA, 75 bp, Artificial Sequence
  Synthetic
tcttctggagaatttcattgttcaggatgtgtggaacatatgcctgagtttagctacatgtattggttggcaaag

SEQ ID NO: 349217 - DNA, 75 bp, Artificial Sequence
  Synthetic
tagctacatgtattggttggcaaaggatatgagatcggacgaggatgctaaatttatagaacatttgggtgaggg

SEQ ID NO: 349218 - DNA, 75 bp, Artificial Sequence
  Synthetic
tatttatttatgatatatatcgttatcgttatcgttatcgttatcgttatcgttattgtttggtctataccatgg

SEQ ID NO: 349219 - DNA, 75 bp, Artificial Sequence
  Synthetic
tatgtcgtctactggatgaagatgtgacgtacaaaaaaataaaactagagattgaaacgtgtcacaacttatcaa

SEQ ID NO: 349220 - DNA, 75 bp, Artificial Sequence
  Synthetic
cgacatacgtcgtcaacaaattaaactttttatttattagttaactagcttatagaacttgctcattgttatgtt

SEQ ID NO: 349221 - DNA, 75 bp, Artificial Sequence
  Synthetic
ctttttatttattagttaactagcttatagaacttgctcattgttatgtttctaaaacgggtacgacatatagga

SEQ ID NO: 349222 - DNA, 75 bp, Artificial Sequence
  Synthetic
tttcactcatatgacactcaccaataatagtagaattaatgtcgtaatttacaccaatagtgagttcggcggcaa

SEQ ID NO: 349223 - DNA, 75 bp, Artificial Sequence
  Synthetic
tttatattcccgttattccacccattacggaagataaatcgttcaatagtgtagaggtattagtttccttgttta

SEQ ID NO: 349224 - DNA, 75 bp, Artificial Sequence
  Synthetic
taatatatcaaacatggagacgcctgatatgtaggcattcttcattctattaatgtctactctatagcgctttag

SEQ ID NO: 349225 - DNA, 75 bp, Artificial Sequence
  Synthetic
agatagcgtatatctctattaaatgcgtcaatcatagtctctagagtgggatggtagctcagtaataaatcaact

SEQ ID NO: 349226 - DNA, 75 bp, Artificial Sequence
  Synthetic
atgattactaacgcaactatatagtttaaattaagcattttggaaacataaaataactctgtagacgatacttga

SEQ ID NO: 349227 - DNA, 75 bp, Artificial Sequence
  Synthetic
acaattaccgatcggtatttgtcgttaccaacataccgtataatatgtaatatacaattccataacccattgaca

SEQ ID NO: 349228 - DNA, 75 bp, Artificial Sequence
  Synthetic
tgtgtcctctttcctcttataacatcgtaatcaaaaacttttttataatatatacctctaataatatatgtctta

SEQ ID NO: 349229 - DNA, 75 bp, Artificial Sequence
  Synthetic
atagatagtacataaatgcgtatagtagtctacctatctctttattatgaaaaccggcattacgatcatatatgt

SEQ ID NO: 349230 - DNA, 75 bp, Artificial Sequence
  Synthetic
ctatcgatgatagcactgttattactactgaagaactacaagtaactccatcaccaactccaacatatgcacatg

SEQ ID NO: 349231 - DNA, 75 bp, Artificial Sequence
  Synthetic
ctatatcatctacataatctacgatattattacacataaacatcgacaacatactattgtttattatctaagtcc

SEQ ID NO: 349232 - DNA, 75 bp, Artificial Sequence
  Synthetic
aacaatgtaagcactatatctattcaggtactgagtaaaatattgggagtcaatgaaacagaattaactaattat

SEQ ID NO: 349233 - DNA, 75 bp, Artificial Sequence
  Synthetic
agaggtggaggaatttatagatgctggaagacaagttagatggtgttctacatccaatcatatatctaaagatat

SEQ ID NO: 349234 - DNA, 75 bp, Artificial Sequence
  Synthetic
aggtactgagtaaaatattgggagtcaatgaaacagaattaactaattatcttattacgcataaaaatgccacgg

SEQ ID NO: 349235 - DNA, 75 bp, Artificial Sequence
  Synthetic
tttttttattcatcatcctctggtggttcgtcgttcctatcgaatgtggatctgattaacccgtcatctataggt

SEQ ID NO: 349236 - DNA, 75 bp, Artificial Sequence
  Synthetic
gacaagagtatgacgtctctcaataagaagattaacgatttccatgtctacattatatggggttactctaaatcg

SEQ ID NO: 349237 - DNA, 75 bp, Artificial Sequence
  Synthetic
catggtaatataggatttttggaaataaataattgttacaatgtttctgtatcagatgctagttttagaataaca

SEQ ID NO: 349238 - DNA, 75 bp, Artificial Sequence
  Synthetic
taaataattgttacaatgtttctgtatcagatgctagttttagaataacattagtaaacgatacttctgaagaaa

SEQ ID NO: 349239 - DNA, 75 bp, Artificial Sequence
  Synthetic
accaatatcactaaatgtttgaaaacattaatcaataatgcgtcaattaatgatgtacttataacacaaaatatg

SEQ ID NO: 349240 - DNA, 75 bp, Artificial Sequence
  Synthetic
cattaatcaataatgcgtcaattaatgatgtacttataacacaaaatatgaatgtaacatctaattgtgataaat

SEQ ID NO: 349241 - DNA, 75 bp, Artificial Sequence
  Synthetic
ctagagactatgattgacgcatttaatagagatatacgctatctatatcctgaaccattattcgcctgtatcaga

SEQ ID NO: 349242 - DNA, 75 bp, Artificial Sequence
  Synthetic
aatacgttgatgaaaattggtgtaaaaaatgatgaaaacaatacggtatataaatattataattgtaaactaact

SEQ ID NO: 349243 - DNA, 75 bp, Artificial Sequence
  Synthetic
aaaatgatgaaaacaatacggtatataaatattataattgtaaactaactacaaattctacgtgtgatgagttaa

SEQ ID NO: 349244 - DNA, 75 bp, Artificial Sequence
  Synthetic
gattgcataattcgtattcttggacggacgtatccgtttatccacaattaggtattttagcagacgtaagtcgat

SEQ ID NO: 349245 - DNA, 75 bp, Artificial Sequence
  Synthetic
acaaaaaagaactaacgtccatcattacagaaactgtaaagaacagtgagaggatcgactccatagtggacaaca

SEQ ID NO: 349246 - DNA, 75 bp, Artificial Sequence
  Synthetic
aatagtgtttcaataactaacagcaggaaaagacgagatttgaatggtgagtttgaattttccacttccaaggaa

SEQ ID NO: 349247 - DNA, 75 bp, Artificial Sequence
  Synthetic
ggaaaagacgagatttgaatggtgagtttgaattttccacttccaaggaattagattgtctttacaaatcatatg

SEQ ID NO: 349248 - DNA, 75 bp, Artificial Sequence
  Synthetic
tctgacgacaaaaaggagtacatggacatgaaattattcgaccacgcgaaaaaagatttaagaatagacagtgtt

SEQ ID NO: 349249 - DNA, 75 bp, Artificial Sequence
  Synthetic
acatgaaattattcgaccacgcgaaaaaagatttaagaatagacagtgttattcctaaaggtacaactcatttcc

SEQ ID NO: 349250 - DNA, 75 bp, Artificial Sequence
  Synthetic
ctgtatcgcatttattgaagacgtaacaatgtagcgcattgtttcctcgtctatctatatgttttgataagttgt

SEQ ID NO: 349251 - DNA, 75 bp, Artificial Sequence
  Synthetic
atatctagaggtagaggtattgtttagataaatacaaataacatcgcatatttagcatttttataaatatacata

SEQ ID NO: 349252 - DNA, 75 bp, Artificial Sequence
  Synthetic
tttcaaaatgttaaatcacgtgcaagtctattggcggaaaaaataatgcctagagtacctactactgctaccgaa

SEQ ID NO: 349253 - DNA, 75 bp, Artificial Sequence
  Synthetic
gtctattggcggaaaaaataatgcctagagtacctactactgctaccgaagagcagctatatgcaactgtaaata

SEQ ID NO: 349254 - DNA, 75 bp, Artificial Sequence
  Synthetic
aatccatagctattctggtgctaattattcctatttcacgaaaaatgatgaaggcaatcattcctcataagatga

SEQ ID NO: 349255 - DNA, 75 bp, Artificial Sequence
  Synthetic
cttgtgtctacgataaaccaaaagctttctagtgctaaagaggtaacttatgcttcgctcaatctgccaggatca

SEQ ID NO: 349256 - DNA, 75 bp, Artificial Sequence
  Synthetic
ataatgagtgaaagtcagtgtccgatgatcaatgacgatagctttactctgaaaagaaagtatcaaatcgatagt

SEQ ID NO: 349257 - DNA, 75 bp, Artificial Sequence
  Synthetic
tttctagtgctaaagaggtaacttatgcttcgctcaatctgccaggatcaagtggctatgttcatagaccatctg

SEQ ID NO: 349258 - DNA, 75 bp, Artificial Sequence
  Synthetic
gatagtgattatgaagatatacaaactgttgttaaggaatataatgaaagatatggtagaccagtcagtaaaaca

SEQ ID NO: 349259 - DNA, 75 bp, Artificial Sequence
  Synthetic
ctgttgttaaggaatataatgaaagatatggtagaccagtcagtaaaacacagttatcaagtagtgaaagtgatt

SEQ ID NO: 349260 - DNA, 75 bp, Artificial Sequence
  Synthetic
tttcatggagtcatttctgatgaaacatttaatgatctccacgcaattgtcgatattgtcccacggaagtgaatc

SEQ ID NO: 349261 - DNA, 75 bp, Artificial Sequence
  Synthetic
ggagctagccgtgttagaacatcatcaagtagtagtgattttgaagatatgaatactgttgttagggaatataga

SEQ ID NO: 349262 - DNA, 75 bp, Artificial Sequence
  Synthetic
caagtagtagtgattttgaagatatgaatactgttgttagggaatatagacaaaaatatggcaatgcaatggcaa

SEQ ID NO: 349263 - DNA, 75 bp, Artificial Sequence
  Synthetic
gttgcatcagttctgaaagagatgagaagcctgtagagagaccctgcgctttctctatgggtccatctatgagaa

SEQ ID NO: 349264 - DNA, 75 bp, Artificial Sequence
  Synthetic
tggatcgttctctggtagatatgtatcatatcttagaaagttttctgcccttccaacaaacgagtttattagttt

SEQ ID NO: 349265 - DNA, 75 bp, Artificial Sequence
  Synthetic
caacgattactacattattaaattatgaagtccgtattatactcgtatatattgtttctctcatgtataataata

SEQ ID NO: 349266 - DNA, 75 bp, Artificial Sequence
  Synthetic
aaaacaactaaaagtctatcaggtggtgtagacatagttacaaaacaatcagactattctctattacctgacgtt

SEQ ID NO: 349267 - DNA, 75 bp, Artificial Sequence
  Synthetic
gtgtagacatagttacaaaacaatcagactattctctattacctgacgttaatactggtagttctattgtgtcac

SEQ ID NO: 349268 - DNA, 75 bp, Artificial Sequence
  Synthetic
gtagccgtttatgctaatagagggctttaatttccatttttttaatgggttgtggatgaggaatgagagtgatat

SEQ ID NO: 349269 - DNA, 75 bp, Artificial Sequence
  Synthetic
agtccaaatcctcctccccgtaatccccgtcgaccacttcctcaacatgatgattattctcctccacaagttcct

SEQ ID NO: 349270 - DNA, 75 bp, Artificial Sequence
  Synthetic
cccgtcgaccacttcctcaacatgatgattattctcctccacaagttcctcagcgcgattattctcctccgcgca

SEQ ID NO: 349271 - DNA, 75 bp, Artificial Sequence
  Synthetic
agtggacatatagatgcagaagtaatgaagaaaagtattacctctatcatctacataattagggtctgctccttt

SEQ ID NO: 349272 - DNA, 75 bp, Artificial Sequence
  Synthetic
ttatcgttattgtttggtctataccatggatatctttaaagaactaatcgtaaaacaccctgatgaaaatgtttt

SEQ ID NO: 349273 - DNA, 75 bp, Artificial Sequence
  Synthetic
cctagaccagcaggtcaattacctcctatagatcaaccagataaaggatttagtaagtttgtatcacctagacgg

SEQ ID NO: 349274 - DNA, 75 bp, Artificial Sequence
  Synthetic
ctatagatcaaccagataaaggatttagtaagtttgtatcacctagacggtgtagaagagcaagctctggagtca

SEQ ID NO: 349275 - DNA, 75 bp, Artificial Sequence
  Synthetic
caacggccaaaacttgaaccagaatatgcggaggtcggtaatggtatacccaagaacaatgttcctgtaataggt

SEQ ID NO: 349276 - DNA, 75 bp, Artificial Sequence
  Synthetic
atgcggaggtcggtaatggtatacccaagaacaatgttcctgtaataggtaataaacatagtaaaaaatatacat

SEQ ID NO: 349277 - DNA, 75 bp, Artificial Sequence
  Synthetic
gcagcaatgttactaactggtcagcaggccattagccaacagactagatcaactgcgttaagtagaaaagatcag

SEQ ID NO: 349278 - DNA, 75 bp, Artificial Sequence
  Synthetic
aggccattagccaacagactagatcaactgcgttaagtagaaaagatcagatgagcaatgaagaaaagatattcg

SEQ ID NO: 349279 - DNA, 75 bp, Artificial Sequence
  Synthetic
aatgacacatgttatcgatattcgttgatgaattattattaaacgtagttatgataaatgattctaacgacatct

SEQ ID NO: 349280 - DNA, 75 bp, Artificial Sequence
  Synthetic
ggtatggcgggcggtccaaaactaatgattgcaggaatggctataacggctataactggtataatagatacgata

SEQ ID NO: 349281 - DNA, 75 bp, Artificial Sequence
  Synthetic
tgattgcaggaatggctataacggctataactggtataatagatacgataaaagatatatattacctgttttcag

SEQ ID NO: 349282 - DNA, 75 bp, Artificial Sequence
  Synthetic
tcggaaagtattttaatacatgtatcatcgatggagatccatatgaggagtcacttgtagttcttcagtagtaat

SEQ ID NO: 349283 - DNA, 75 bp, Artificial Sequence
  Synthetic
ctagattgtccagcgtgtccccaggacaaggtaaggactctcccgcgatcactcgtgaagaagctctggctatga

SEQ ID NO: 349284 - DNA, 75 bp, Artificial Sequence
  Synthetic
ggcttattatccgatagtaataaaatgggggtaagaaaatgtttgacgcccggtgacgacacacttatttatatt

SEQ ID NO: 349285 - DNA, 75 bp, Artificial Sequence
  Synthetic
ttgtaattggagtaactgttggtagttcttccgtggaatcaataattatactaacagcaatagtataattatata

SEQ ID NO: 349286 - DNA, 75 bp, Artificial Sequence
  Synthetic
tgggggtaagaaaatgtttgacgcccggtgacgacacacttatttatattgcatacagaaacgatagcagtttta

SEQ ID NO: 349287 - DNA, 75 bp, Artificial Sequence
  Synthetic
ctaacagcaatagtataattatataaatatgttccgttgatatcacatattttaatgaactcatttctaacaccc

SEQ ID NO: 349288 - DNA, 75 bp, Artificial Sequence
  Synthetic
gagatcctatatctaaacacatcaaatttagttctagagtatcaactaaaggtggcttgtcccataggaacatta

SEQ ID NO: 349289 - DNA, 75 bp, Artificial Sequence
  Synthetic
atttagttctagagtatcaactaaaggtggcttgtcccataggaacattaagatctgtagatgtggacataactg

SEQ ID NO: 349290 - DNA, 75 bp, Artificial Sequence
  Synthetic
ttgattgactacttgtacggtagcgacgctacactatctttattgtcttctacatgctccaattgaatgtcatga

SEQ ID NO: 349291 - DNA, 75 bp, Artificial Sequence
  Synthetic
acgctacactatctttattgtcttctacatgctccaattgaatgtcatgatacaacgcagtttttcttatgcatg

SEQ ID NO: 349292 - DNA, 75 bp, Artificial Sequence
  Synthetic
atcagaatggcaacgctactatccaaacatccagttattagattgacatgtggtttagcagcaacattggtaatt

SEQ ID NO: 349293 - DNA, 75 bp, Artificial Sequence
  Synthetic
aacatccagttattagattgacatgtggtttagcagcaacattggtaattaaaccgtacgaggtacccattagtg

SEQ ID NO: 349294 - DNA, 75 bp, Artificial Sequence
  Synthetic
ttctgtaaattcatgattgccggtcataaacaagcccgtcaataattgtggctatatattcagtttatagagcaa

SEQ ID NO: 349295 - DNA, 75 bp, Artificial Sequence
  Synthetic
ataaacaagcccgtcaataattgtggctatatattcagtttatagagcaaaataattaagcacaatagcgcttaa

SEQ ID NO: 349296 - DNA, 75 bp, Artificial Sequence
  Synthetic
tctataccatctgatgtctgtgataggtatcctctaaagaaattctatcttttggctggtggttgtccctatgat

SEQ ID NO: 349297 - DNA, 75 bp, Artificial Sequence
  Synthetic
ggtatcctctaaagaaattctatcttttggctggtggttgtccctatgatacatctcaaacttttattgtacata

SEQ ID NO: 349298 - DNA, 75 bp, Artificial Sequence
  Synthetic
ttctctttctctcttcaatggagtcataaaatatttttattctctttctctcttcgatggtctcacaaaaatatt

SEQ ID NO: 349299 - DNA, 75 bp, Artificial Sequence
  Synthetic
atcctctaaaggctgatcttcatctataaatcaagatcataattacatttagacagtggtttcatgtttataaaa

SEQ ID NO: 349300 - DNA, 75 bp, Artificial Sequence
  Synthetic
aaaatatcgatgtttaacttttgttctatgacgtccttatcagcggtatcggtacatatacgtaattcaccttca

SEQ ID NO: 349301 - DNA, 75 bp, Artificial Sequence
  Synthetic
agatgggtgttacaaaatccatttagacaagaaggggaatataagcaactgtttacctttagcaaatacgatttt

SEQ ID NO: 349302 - DNA, 75 bp, Artificial Sequence
  Synthetic
gacaagaaggggaatataagcaactgtttacctttagcaaatacgattttaacgacaccataatcgatcctaatg

SEQ ID NO: 349303 - DNA, 75 bp, Artificial Sequence
  Synthetic
accccattacgatagtatgcaggcaaccccccattagagaggtacgtgtaatcagtctctccagttttagtattt

SEQ ID NO: 349304 - DNA, 75 bp, Artificial Sequence
  Synthetic
ttcccagcattaactgattcgatacctagaagatcgtgattgatctctccgaccattccacgaacttctaattgg

SEQ ID NO: 349305 - DNA, 75 bp, Artificial Sequence
  Synthetic
agccatatctggaaatttattaaatactcgagtcattttacgcacggtcaaaaaagtaagtaatgtcgacgactt

SEQ ID NO: 349306 - DNA, 75 bp, Artificial Sequence
  Synthetic
actcgagtcattttacgcacggtcaaaaaagtaagtaatgtcgacgacttcttacattctatagaaacacctaga

SEQ ID NO: 349307 - DNA, 75 bp, Artificial Sequence
  Synthetic
ttctggtccgaacctatgatattggaagatgtatcatcgtgtagttctagaactagaaaaatatacgtaaaactg

SEQ ID NO: 349308 - DNA, 75 bp, Artificial Sequence
  Synthetic
aagatgtatcatcgtgtagttctagaactagaaaaatatacgtaaaactgggaatatttaatgctgaaggtttta

SEQ ID NO: 349309 - DNA, 75 bp, Artificial Sequence
  Synthetic
cataaaaatgcggacagtgacaatgttatcatagagctacctgtaggtgattacggcacagccaaattgtattca

SEQ ID NO: 349310 - DNA, 75 bp, Artificial Sequence
  Synthetic
acgacctatagtaaaccgtgaccaataagttatattagtcaatggtatatccaaaccatcaggtgtggatagtac

SEQ ID NO: 349311 - DNA, 75 bp, Artificial Sequence
  Synthetic
ttatcatagagctacctgtaggtgattacggcacagccaaattgtattcagcaacaaaaccgtcgaggatagctg

SEQ ID NO: 349312 - DNA, 75 bp, Artificial Sequence
  Synthetic
ttattcacacaaaaagaacatttttataaacatgaaaccactgtctaaatgtaattatgatcttgatttatagat

SEQ ID NO: 349313 - DNA, 75 bp, Artificial Sequence
  Synthetic
ctaatgtttaataaaatcagcggtgttccattttggagcatgtacacaggaagtgtaactagtagaaatagaatg

SEQ ID NO: 349314 - DNA, 75 bp, Artificial Sequence
  Synthetic
ttccattttggagcatgtacacaggaagtgtaactagtagaaatagaatgtttaccacattgtctagaggaatgc

SEQ ID NO: 349315 - DNA, 75 bp, Artificial Sequence
  Synthetic
acactattgaacgatttatcttccgtaatgggtggaataacgggaatataaagtggactagcgatggatgaagtc

SEQ ID NO: 349316 - DNA, 75 bp, Artificial Sequence
  Synthetic
gcaggaataccatttcatgaagatagtgtagaagcagatctacattatggaccaaaaataatgttaaaggaaaca

SEQ ID NO: 349317 - DNA, 75 bp, Artificial Sequence
  Synthetic
gtgtagaagcagatctacattatggaccaaaaataatgttaaaggaaacatatgacacaaacagtattgacccac

SEQ ID NO: 349318 - DNA, 75 bp, Artificial Sequence
  Synthetic
tctctttctctcttcgatggtctcacaaaaatattaaacctctttctgatggagtcgtaaaaaagttttatctct

SEQ ID NO: 349319 - DNA, 75 bp, Artificial Sequence
  Synthetic
ttcatggctgacaatttaggaaatggatatgacaaccctaattcattttgggaagatgctaaaactaagaaacgg

SEQ ID NO: 349320 - DNA, 75 bp, Artificial Sequence
  Synthetic
gatatgacaaccctaattcattttgggaagatgctaaaactaagaaacggacatatagtgcaatgacgataaaag

SEQ ID NO: 349321 - DNA, 75 bp, Artificial Sequence
  Synthetic
taaaaagtatacgtcctgtgttgtctttaatcatgtacatgaatggatggtttatgtagaccttcgtacgatata

SEQ ID NO: 349322 - DNA, 75 bp, Artificial Sequence
  Synthetic
tttatgtagaccttcgtacgatataccatcgaaaagttagtcataaatactcctgtaacggccgatgcttctgta

SEQ ID NO: 349323 - DNA, 75 bp, Artificial Sequence
  Synthetic
tcctgtaacggccgatgcttctgtatactcctcattaacatctataaacgtcgtatgtagaaatttttctacagt

SEQ ID NO: 349324 - DNA, 75 bp, Artificial Sequence
  Synthetic
ggagatattatttctaatatggtttatctacaatctactagtcaggattatggagatggtaccaaatatacattt

SEQ ID NO: 349325 - DNA, 75 bp, Artificial Sequence
  Synthetic
atctacaatctactagtcaggattatggagatggtaccaaatatacatttaaatccgtaactagatcagatcatg

SEQ ID NO: 349326 - DNA, 75 bp, Artificial Sequence
  Synthetic
gatagtttcattacacatcttgctaaaatctgcataatatccgaatatattagtaagtcctaaattttctaaaat

SEQ ID NO: 349327 - DNA, 75 bp, Artificial Sequence
  Synthetic
atatgaaccttctacatataattatactatcgatgatagcactgttattactactgaagaactacaagtgactcc

SEQ ID NO: 349328 - DNA, 75 bp, Artificial Sequence
  Synthetic
cggtaccagattatacggttctgtcatttccactttaaactttggcatatacaagtctatacttttagtagataa

SEQ ID NO: 349329 - DNA, 75 bp, Artificial Sequence
  Synthetic
cctgcgtttagtataccaagaaatatatcaacgtatgaaggtctatgctttagtgttactacatctaaagatcat

SEQ ID NO: 349330 - DNA, 75 bp, Artificial Sequence
  Synthetic
tatcaacgtatgaaggtctatgctttagtgttactacatctaaagatcattgtgctacaagtaataatgggttaa

SEQ ID NO: 349331 - DNA, 75 bp, Artificial Sequence
  Synthetic
cataccacaccattttttaaatttttcatctgttatatttttttctatgttatatataccttctatgtcgtccgg

SEQ ID NO: 349332 - DNA, 75 bp, Artificial Sequence
  Synthetic
catcattggaattattacacactgtcgttggattattactgttcatacgaagatatttggagaagcaactggcct

SEQ ID NO: 349333 - DNA, 75 bp, Artificial Sequence
  Synthetic
cgttggattattactgttcatacgaagatatttggagaagcaactggcctgactatgatccatgtaagtcatata

SEQ ID NO: 349334 - DNA, 75 bp, Artificial Sequence
  Synthetic
taactatattcttagaaatataaaacttgtctgtatatgtaagatgtttagaaaatggatatttccacattgctt

SEQ ID NO: 349335 - DNA, 75 bp, Artificial Sequence
  Synthetic
cttgtctgtatatgtaagatgtttagaaaatggatatttccacattgctttaaaatggacggcgctaacaactgt

SEQ ID NO: 349336 - DNA, 75 bp, Artificial Sequence
  Synthetic
cctccttacacatttgaattcactcatgacaattctaacgaatatgtggataaagaaattagtaacaaattaaat

SEQ ID NO: 349337 - DNA, 75 bp, Artificial Sequence
  Synthetic
atgacaattctaacgaatatgtggataaagaaattagtaacaaattaaatgatctgtacaatgcatacaagaaga

SEQ ID NO: 349338 - DNA, 75 bp, Artificial Sequence
  Synthetic
tctctataaagcgattgatttttcttaccctctagagtttcctacggtcgttggtcacacatttttttctagaca

SEQ ID NO: 349339 - DNA, 75 bp, Artificial Sequence
  Synthetic
gtgttaaaaaaaattatcctatcatgtatttgagagtcttatatgtagcaaacatgataactgcaatacccataa

SEQ ID NO: 349340 - DNA, 75 bp, Artificial Sequence
  Synthetic
catttgtcattgtcttaacccattcgttgattagttcctttgtttggttagcattattaaagtttacagtttgaa

SEQ ID NO: 349341 - DNA, 75 bp, Artificial Sequence
  Synthetic
gtatttgagagtcttatatgtagcaaacatgataactgcaatacccataagctttagatattcacgcgtgctagt

SEQ ID NO: 349342 - DNA, 75 bp, Artificial Sequence
  Synthetic
aaagcattgacttcagagggtagagaaatagcaagtgttaatatagatggtaatctgttagatatcgcatatcaa

SEQ ID NO: 349343 - DNA, 75 bp, Artificial Sequence
  Synthetic
aaatagcaagtgttaatatagatggtaatctgttagatatcgcatatcaagcagataaggaaaagatggccgaca

SEQ ID NO: 349344 - DNA, 75 bp, Artificial Sequence
  Synthetic
agacacctcacagtctttgatcatagccagagcttcttcatgagtgatcgcgggagagtccttaccttgtcctgg

SEQ ID NO: 349345 - DNA, 75 bp, Artificial Sequence
  Synthetic
gaaatgtccgttatataatctacaaaacaatcatcgcatatagtatgcgatagtagagtaaacatttttatagtt

SEQ ID NO: 349346 - DNA, 75 bp, Artificial Sequence
  Synthetic
tcagacaaagatataaaagacattatagaatccgaagaaggtaagagatgttgtataatagatgttaagaacaat

SEQ ID NO: 349347 - DNA, 75 bp, Artificial Sequence
  Synthetic
tagaatccgaagaaggtaagagatgttgtataatagatgttaagaacaatcgtgttgaaaagtactatcctattg

SEQ ID NO: 349348 - DNA, 75 bp, Artificial Sequence
  Synthetic
agaaccagctgctccatgatttagaatagataaagtagataaaatggaaactggagaaatcaaaacattttcatc

SEQ ID NO: 349349 - DNA, 75 bp, Artificial Sequence
  Synthetic
tataacaaatcctatgtgttagtaaacgatacttatatgagctacgactatcttgaatcatcaggtatagttgtt

SEQ ID NO: 349350 - DNA, 75 bp, Artificial Sequence
  Synthetic
acgatacttatatgagctacgactatcttgaatcatcaggtatagttgttctatcatgttatgaaatgactataa

SEQ ID NO: 349351 - DNA, 75 bp, Artificial Sequence
  Synthetic
atgatattcatgtccctattataatcattactaactttatcacaatatatgttgataatatctatatatgatcta

SEQ ID NO: 349352 - DNA, 75 bp, Artificial Sequence
  Synthetic
acgttagcattctatatccgtgttaaaaaaaattatcctatcatgtatttgagagttttatatgtagcaaacatg

SEQ ID NO: 349353 - DNA, 75 bp, Artificial Sequence
  Synthetic
gcaagtgcggtagccgaagcattgaatgacatgtttaaggaatttgataaaaacgtaagtgctattataataaaa

SEQ ID NO: 349354 - DNA, 75 bp, Artificial Sequence
  Synthetic
atgacatgtttaaggaatttgataaaaacgtaagtgctattataataaaagaagaagataattatctaaacagtt

SEQ ID NO: 349355 - DNA, 75 bp, Artificial Sequence
  Synthetic
aatgataaaatcaatcgttatctaaaatgatcatactcatttattttattctattatattaacacatacattttt

SEQ ID NO: 349356 - DNA, 75 bp, Artificial Sequence
  Synthetic
ctgttagtcattattttaatattggcaatttatatagcgcgcaataaatacaaaaccaggaaatataaaataatg

SEQ ID NO: 349357 - DNA, 75 bp, Artificial Sequence
  Synthetic
gttgttgttcgctgctatgataatcagatcattcgccgatagtggtaacgctatcgaaacgacattgccagaaat

SEQ ID NO: 349358 - DNA, 75 bp, Artificial Sequence
  Synthetic
tatttctagacgttgccagaaaatcctgtaatatttttagttttttgggctgtgaataaagtatcgccctaatat

SEQ ID NO: 349359 - DNA, 75 bp, Artificial Sequence
  Synthetic
tcatctgttttaaaaaacctattaaaggagtatgtcatgaatacgtttaatgttcatgacagtgatggtcacatt

SEQ ID NO: 349360 - DNA, 75 bp, Artificial Sequence
  Synthetic
tgacttgtaataattgcttttgtagaacgtggatatgtgtttacagtagtaatgaagagaagtgagttcatcctc

SEQ ID NO: 349361 - DNA, 75 bp, Artificial Sequence
  Synthetic
agttacgcatgccgtggtgtaacaatatctttaatacagatggattaaatcgtgtattcatcgtatagcaatgta

SEQ ID NO: 349362 - DNA, 75 bp, Artificial Sequence
  Synthetic
caacccattaaaaaaatggaaattaaagccctctattagcatagacggctacaggtctaccatcaggttaacctt

SEQ ID NO: 349363 - DNA, 75 bp, Artificial Sequence
  Synthetic
aagccctctattagcatagacggctacaggtctaccatcaggttaaccttcgtctacctttacaatggcctttcc

SEQ ID NO: 349364 - DNA, 75 bp, Artificial Sequence
  Synthetic
ttttttacccactataaaataaaatgagtatactacctgttatatttcttcctatatttttttattcttcattcg

SEQ ID NO: 349365 - DNA, 75 bp, Artificial Sequence
  Synthetic
ttcaggaactataaaactactacaatgatctatcgacataccatctatcaaacaaaatttgggtttaatttctcc

SEQ ID NO: 349366 - DNA, 75 bp, Artificial Sequence
  Synthetic
aaaatattctaacctttcccattgatcatgctgtaatcatatccccactgagtaaatgtgtcgtagttagcaagg

SEQ ID NO: 349367 - DNA, 75 bp, Artificial Sequence
  Synthetic
ttctacatccaatcatatatctaaagatatacccgaagatatgcacactgataaatttgtcatttatgatattta

SEQ ID NO: 349368 - DNA, 75 bp, Artificial Sequence
  Synthetic
catccttataaagaatgaatggagtaccagtttcaatctgagattctataatcgctttccagacgactcgagcct

SEQ ID NO: 349369 - DNA, 75 bp, Artificial Sequence
  Synthetic
tcactacactttttatcacacccaccttactttttatcatcttatgaggaatgattgccttcatcatttttcgtg

SEQ ID NO: 349370 - DNA, 75 bp, Artificial Sequence
  Synthetic
taattatttgccgttgtctgtattcattattagacgagtcaccgactatttggatagacacatatgcgatcagat

SEQ ID NO: 349371 - DNA, 75 bp, Artificial Sequence
  Synthetic
atcctattccatcaaattgtataggtatgtcttctgccaagtacataaattctagcatcgagcaagatactttaa

SEQ ID NO: 349372 - DNA, 75 bp, Artificial Sequence
  Synthetic
cacccacacgtttttcgaaaaaattagtttttccttccaatgatatattttccatgaaatcaaacggattggtaa

SEQ ID NO: 349373 - DNA, 75 bp, Artificial Sequence
  Synthetic
atttaaaatataatattaatgtactaaaacttatatattattaatttatctaactaaagttagtaaattatatat

SEQ ID NO: 349374 - DNA, 75 bp, Artificial Sequence
  Synthetic
taactaaagttagtaaattatatatataattttataattaatttaattttactaattttatttagtgtctagaaa

SEQ ID NO: 349375 - DNA, 75 bp, Artificial Sequence
  Synthetic
ttaaagtacgtaaatctagctatagttttattatttaattttagataatataccgtctccttatttttaaaaatt

SEQ ID NO: 349376 - DNA, 75 bp, Artificial Sequence
  Synthetic
aaactctagagtgtaagaaagatcgatcgctttatagagaccatcagaaagaggtttaatatttttgtgagacca

SEQ ID NO: 349377 - DNA, 75 bp, Artificial Sequence
  Synthetic
tacaagccatgttgataaactacttacattacggcgatatggtaagtatacctatcgttcgatgcatgttagata

SEQ ID NO: 349378 - DNA, 75 bp, Artificial Sequence
  Synthetic
gtcaaaaaaatagaaacatatatggtctatatatacactacaatttagttattaattggataaccgatgtgattg

SEQ ID NO: 349379 - DNA, 75 bp, Artificial Sequence
  Synthetic
gagtttattttatatgtctcgcataaacattactaaaaaaatatattgttctgtttttctttttctttttctttc

SEQ ID NO: 349380 - DNA, 75 bp, Artificial Sequence
  Synthetic
atgcccgtaaagataaacatcaacattgtttggtaatcattaaaccaattagtatgacgttgaactaatttcaca

SEQ ID NO: 349381 - DNA, 75 bp, Artificial Sequence
  Synthetic
caaagcggttattggaatatggagcgagtgttacaacatcacgctcgataatcaatacggccatccagaaaagca

SEQ ID NO: 349382 - DNA, 75 bp, Artificial Sequence
  Synthetic
tccagataataaacaaattttgtcgccctaactaattctatattgttatatattttacaattggttattgatact

SEQ ID NO: 349383 - DNA, 75 bp, Artificial Sequence
  Synthetic
acgggtgttaatggggcggtatacacattttcaaataataaactaaacaaaactggtttaactaataataattat

SEQ ID NO: 349384 - DNA, 75 bp, Artificial Sequence
  Synthetic
cgtacatttttaaactgtttatataatatctctctgatataatcagatatatttattgtgtcggtagatgatacc

SEQ ID NO: 349385 - DNA, 75 bp, Artificial Sequence
  Synthetic
tcataaacacggagtttattttatatgtctcgcataaacattactaaaaaatatattgttcggttttctttttct

SEQ ID NO: 349386 - DNA, 75 bp, Artificial Sequence
  Synthetic
tactatctgacataaacatatcaaaagaaggaattaaacgatggagaagatttgacggaccatgtggttatgatt

SEQ ID NO: 349387 - DNA, 75 bp, Artificial Sequence
  Synthetic
tatcggctcaaagagaattgttaaaattccgtatatagcacaaatgtgcctaaacgacgaaggtggtccatcatc

SEQ ID NO: 349388 - DNA, 75 bp, Artificial Sequence
  Synthetic
gaaacgatatcatgaacaatcacaagaacagaggcacttacgcggtaaacattcatgtactaacaactcctggac

SEQ ID NO: 349389 - DNA, 75 bp, Artificial Sequence
  Synthetic
cagaatatgccctataacacgatcgtgcaaaacctggtatatcgtctctatctttatcacaatatagtgtatcga

SEQ ID NO: 349390 - DNA, 75 bp, Artificial Sequence
  Synthetic
aagatctatataatcattatagcgttgacttatggactctggaatcttagacgatgtacagtcatctataatcat

SEQ ID NO: 349391 - DNA, 75 bp, Artificial Sequence
  Synthetic
cagcttgcatgcctgcagcaattcccgaggctgtagccgacgatggtgcgccaggagagttgttgattcattgtt

SEQ ID NO: 349392 - DNA, 75 bp, Artificial Sequence
  Synthetic
cgaggctgtagccgacgatggtgcgccaggagagttgttgattcattgtttgcctccctgctgcggtttttcacc

SEQ ID NO: 349393 - DNA, 75 bp, Artificial Sequence
  Synthetic
gtttgcggtcgcgagtgaagatccctttcttgttaccgccaacgcgcaatatgccttgcgaggtcgcaaaatcgg

SEQ ID NO: 349394 - DNA, 75 bp, Artificial Sequence
  Synthetic
attctcataatgttactcaattggcacgaacaaaaatacgggaaattacaaaaggaagaaggacaacatctactt

SEQ ID NO: 349395 - DNA, 75 bp, Artificial Sequence
  Synthetic
tttcttgttaccgccaacgcgcaatatgccttgcgaggtcgcaaaatcggcgaaattccatacctgttcaccgac

SEQ ID NO: 349396 - DNA, 75 bp, Artificial Sequence
  Synthetic
acgaacaaaaatacgggaaattacaaaaggaagaaggacaacatctactttatctattcataaaacataatcaag

SEQ ID NO: 349397 - DNA, 75 bp, Artificial Sequence
  Synthetic
actgatactcttcactccacatgtcggtgtacattgagtgcagcccggctaacgtatccacgccgtattcggtga

SEQ ID NO: 349398 - DNA, 75 bp, Artificial Sequence
  Synthetic
gacattcagaaagacgaatactataataccatgactcctcttcataccgcctttcaaaattgtaacaacaatgtt

SEQ ID NO: 349399 - DNA, 75 bp, Artificial Sequence
  Synthetic
ggtgtacattgagtgcagcccggctaacgtatccacgccgtattcggtgatgataatcggctgatgcagtttctc

SEQ ID NO: 349400 - DNA, 75 bp, Artificial Sequence
  Synthetic
cgccgctttggacataccatccgtaataacggttcaggcacagcacatcaaagagatcgctgatggtatcggtgt

SEQ ID NO: 349401 - DNA, 75 bp, Artificial Sequence
  Synthetic
ataacggttcaggcacagcacatcaaagagatcgctgatggtatcggtgtgagcgtcgcagaacattacattgac

SEQ ID NO: 349402 - DNA, 75 bp, Artificial Sequence
  Synthetic
gcgcgaaatattcccgtgcaccttgcggacgggtatccggttcgttggcaatactccacatcaccacgcttgggt

SEQ ID NO: 349403 - DNA, 75 bp, Artificial Sequence
  Synthetic
cggacgggtatccggttcgttggcaatactccacatcaccacgcttgggtggtttttgtcacgcgctatcagctc

SEQ ID NO: 349404 - DNA, 75 bp, Artificial Sequence
  Synthetic
aaagagattcgaatctccgacaccgacctgtatacggtattaagaacagaagacatacggtatcacagctatctt

SEQ ID NO: 349405 - DNA, 75 bp, Artificial Sequence
  Synthetic
cgctgtacagttctttcggcttgttgcccgcttcgaaaccaatgcctaaagagaggttaaagccgacagcagcag

SEQ ID NO: 349406 - DNA, 75 bp, Artificial Sequence
  Synthetic
gcccgcttcgaaaccaatgcctaaagagaggttaaagccgacagcagcagtttcatcaatcaccacgatgccatg

SEQ ID NO: 349407 - DNA, 75 bp, Artificial Sequence
  Synthetic
gtgtctagaaaaaaatgtgtgacccacgactgtaggaaactctagagggtaaaaaaatcaatcgctttatagaga

SEQ ID NO: 349408 - DNA, 75 bp, Artificial Sequence
  Synthetic
tgtgagaccatcgaagagagaaagagataaaactttttacgactccatcagaaagaggtttaatatttttgtgag

SEQ ID NO: 349409 - DNA, 75 bp, Artificial Sequence
  Synthetic
gaaagaggtttaatatttttgtgagaccatcgaagagagaaagagatagttagtctatatatttttcttagtgca

SEQ ID NO: 349410 - DNA, 75 bp, Artificial Sequence
  Synthetic
tagtctatatatttttcttagtgcaaaagtcaatgttttaaaatatatggacaagaatttgtctgtataaaaact

SEQ ID NO: 349411 - DNA, 75 bp, Artificial Sequence
  Synthetic
aaagtcaatgttttaaaatatatggacaagaatttgtctgtataaaaacttgtgagaaattttgtaccaaaaaaa

SEQ ID NO: 349412 - DNA, 75 bp, Artificial Sequence
  Synthetic
tgtgagaaattttgtaccaaaaaaacgtgaacagtatcccctacatggattttactagatcatttatataccaaa

SEQ ID NO: 349413 - DNA, 75 bp, Artificial Sequence
  Synthetic
aaatattatacgatctacgttttattatatgattttaacgtgtaaattataaacattattttatgatatacaatt

SEQ ID NO: 349414 - DNA, 75 bp, Artificial Sequence
  Synthetic
atgttgttgaacgttattgtttaagaaatagttgatgcatcagaatggtttgcatttattggagacgtaacaatg

SEQ ID NO: 349415 - DNA, 75 bp, Artificial Sequence
  Synthetic
cactacattgtttcctcgtctatctatatgttttgataagttataacacgtttcaatctctagttttattttttt

SEQ ID NO: 349416 - DNA, 75 bp, Artificial Sequence
  Synthetic
gtacgtcacatcttcatccagtagacgacatagaatacatgtgcaatctttgccacaatccatagctattttggt

SEQ ID NO: 349417 - DNA, 75 bp, Artificial Sequence
  Synthetic
tgagagtgagtgagcatgaaaaagatttagtatttagcagtgcggatatgatccaagagggtgaaatagtcgttc

SEQ ID NO: 349418 - DNA, 75 bp, Artificial Sequence
  Synthetic
atccaagagggtgaaatagtcgttctcgttcagaatcttttgcagcataagtagtatgtcgatatacttatcgtt

SEQ ID NO: 349419 - DNA, 75 bp, Artificial Sequence
  Synthetic
gaagactcttccagagacgatagctaattgagtacaaagtccaatgattgcacaaagttctttggcggttttcat

SEQ ID NO: 349420 - DNA, 75 bp, Artificial Sequence
  Synthetic
ggagtcatttctgatgaaacatttaatgatctccacgcaattgtctatattgtcccacggaagtgaatccgagaa

SEQ ID NO: 349421 - DNA, 75 bp, Artificial Sequence
  Synthetic
ctccttcaactcgctaccaaagagctccgttgcatcagttctgaaagagatgagaagcctgtaaagagaccctgc

SEQ ID NO: 349422 - DNA, 75 bp, Artificial Sequence
  Synthetic
gctttctctatgggtccatctatgagaaacccacaggatgtattcagtcagacaatgtctgacgtctgccacggt

SEQ ID NO: 349423 - DNA, 75 bp, Artificial Sequence
  Synthetic
attcagggagtccttagtagcatggcaatgacagggactgaactgggcacaagaagaggccattgtgaaggtaga

SEQ ID NO: 349424 - DNA, 75 bp, Artificial Sequence
  Synthetic
aagaagaggccattgtgaaggtagacgaaggttaacctgatggttaacctgtagccgtctgtgctaatagagggc

SEQ ID NO: 349425 - DNA, 75 bp, Artificial Sequence
  Synthetic
tttaatttccattttttaatggggttgtggatgaggaatgagagtgtcttatctcgtccttggtttacatggatc

SEQ ID NO: 349426 - DNA, 75 bp, Artificial Sequence
  Synthetic
tgtggatgaggaatgagagtgtcttatctcgtccttggtttacatggatcagtgtgagaaaaaatatcttgtata

SEQ ID NO: 349427 - DNA, 75 bp, Artificial Sequence
  Synthetic
agtgtgagaaaaaatatcttgtatattattaactaaactaacaaccttggtttccaatccatgtttaaaaatgac

SEQ ID NO: 349428 - DNA, 75 bp, Artificial Sequence
  Synthetic
ctatatgtttttattaattttatttatatcgttaaaatgtatcgtatataatagttttctaacgtggagtacaga

SEQ ID NO: 349429 - DNA, 75 bp, Artificial Sequence
  Synthetic
attttcggttaatgagttcatggtaaagggcgaatgaatgcctgcctgtattataatatacataagttaatagtt

SEQ ID NO: 349430 - DNA, 75 bp, Artificial Sequence
  Synthetic
tttatcatatttttctaatactatataaaaatatcattatgtataatcattactgtcgctatcattattgtgttt

SEQ ID NO: 349431 - DNA, 75 bp, Artificial Sequence
  Synthetic
gtgtagttctgttctatcatctacatcactgtcactgtcactctccctatatcttctaaaattacaaacaactgg

SEQ ID NO: 349432 - DNA, 75 bp, Artificial Sequence
  Synthetic
atattcgataacagcatttgtgtagtttttgtcttttatagtatatacgttattgtcaaaatctaaacaaatatt

SEQ ID NO: 349433 - DNA, 75 bp, Artificial Sequence
  Synthetic
ggcataatacctatctataagattaggatccatgttcgagcatactagcatatttgtaacttcgtcgtaaagcgt

SEQ ID NO: 349434 - DNA, 75 bp, Artificial Sequence
  Synthetic
taaatcaatagaataaaccattttgtggtgcaactttttacgaactagttgtatgagtttatcgtttacataagc

SEQ ID NO: 349435 - DNA, 75 bp, Artificial Sequence
  Synthetic
taacctcttaggaagatcgcgttaatcatgtactcataaaacgattggaatcatctatacgccatatgtggtctg

SEQ ID NO: 349436 - DNA, 75 bp, Artificial Sequence
  Synthetic
gtatgagtttatcgtttacataagccattaacagctttaacagatgatctgagtaatatcctctattatacattt

SEQ ID NO: 349437 - DNA, 75 bp, Artificial Sequence
  Synthetic
aatgttcacggtcttagtatttttagatatcaattgtaatttacacccatattctactcccttgtgtaacgttag

SEQ ID NO: 349438 - DNA, 75 bp, Artificial Sequence
  Synthetic
acattctaaatctatagtattatctattacagcgtaaaacacattcaatattgtattgttatattattagtttat

SEQ ID NO: 349439 - DNA, 75 bp, Artificial Sequence
  Synthetic
aatactaatactaatactaatactaatactaatactactacttgtaagaatgagactgactacacaccaatggac

SEQ ID NO: 349440 - DNA, 75 bp, Artificial Sequence
  Synthetic
attactgaattaataatataaaattcccaatcttgttataaacacacactgagaaacagcataaacacaaaatcc

SEQ ID NO: 349441 - DNA, 75 bp, Artificial Sequence
  Synthetic
atcaaaaatgtcgatgaaatatctgatgttgttgttcgctgctatgataattagatcattcgccaatagtggtaa

SEQ ID NO: 349442 - DNA, 75 bp, Artificial Sequence
  Synthetic
cgctatcgaaacgacattgtcagaaattacaaacactacaacagatattccagctatcagattatgcggtccaga

SEQ ID NO: 349443 - DNA, 75 bp, Artificial Sequence
  Synthetic
attacaaacactacaacagatattccagctatcagattatgcggtccagagggaaatggatattgttttcacggt

SEQ ID NO: 349444 - DNA, 75 bp, Artificial Sequence
  Synthetic
atctgtatccacgctagagatattgacggtatgtattgtagatgctctcatggttatacaggcattagatgtcag

SEQ ID NO: 349445 - DNA, 75 bp, Artificial Sequence
  Synthetic
tgtaatggatagacaattatcaaaaactccaacgagataaaagagatccactgagatgactggaaatcacttctg

SEQ ID NO: 349446 - DNA, 75 bp, Artificial Sequence
  Synthetic
catgtagtattagtagactatcaacgttcagaaaaaccaaacactacaacgtcatatatcccatctcccggtatt

SEQ ID NO: 349447 - DNA, 75 bp, Artificial Sequence
  Synthetic
gtgcttgtattattagtaagcattattatgtgttgtctattatttgtttataggttcactcgaagaactaataaa

SEQ ID NO: 349448 - DNA, 75 bp, Artificial Sequence
  Synthetic
tctaaacaatacctctacctctagatattatacaaaaattttttatttcagtatattaaagtaaaatctagttac

SEQ ID NO: 349449 - DNA, 75 bp, Artificial Sequence
  Synthetic
cttgaaaataaatacagtgggtggttctgtatcaccagtaagaacataatagtcgaatacagtatccgattgaga

SEQ ID NO: 349450 - DNA, 75 bp, Artificial Sequence
  Synthetic
ctatatcatctatatcatctatatcatctatatcatctatatcatctacgatattattacacataaacatcggca

SEQ ID NO: 349451 - DNA, 75 bp, Artificial Sequence
  Synthetic
ttttgcatacaatactagtctagaaagaaatttgtaatcatcttctgtgacgggagtccatatatctgtatcatc

SEQ ID NO: 349452 - DNA, 75 bp, Artificial Sequence
  Synthetic
gtctagtttatcagtgtcccatgctatattcctgttatcatcattagttaatgaaaataactctcgtgcttcaga

SEQ ID NO: 349453 - DNA, 75 bp, Artificial Sequence
  Synthetic
aaagtcaaatattgtatccatacatacatctccaaaactatcacttatacgtttatctttaacgatacctatacc

SEQ ID NO: 349454 - DNA, 75 bp, Artificial Sequence
  Synthetic
tattattctgaatagtgaaaaccttcacagatagatcattttgaacacacaacgcatctagactttcggcggttg

SEQ ID NO: 349455 - DNA, 75 bp, Artificial Sequence
  Synthetic
tagatggttatttactaacagacattttccagatctattgactataactcctatagtttccacatcaaccaagta

SEQ ID NO: 349456 - DNA, 75 bp, Artificial Sequence
  Synthetic
atgatcatctattgttatataacaataacataactcttttccatttttatcagtatgtatatctatatcaacgtc

SEQ ID NO: 349457 - DNA, 75 bp, Artificial Sequence
  Synthetic
cagagtccgagtcagatcccgaggtggaatcagaagatgattccacatcagtcgaggatgtagatcctcctacca

SEQ ID NO: 349458 - DNA, 75 bp, Artificial Sequence
  Synthetic
gccgtagtgaatagtagtcattgatctattatatgaaacggatatgtctagaacggcaattgtcttacgtccagt

SEQ ID NO: 349459 - DNA, 75 bp, Artificial Sequence
  Synthetic
taacactttcgttgatttaaagtctagagtctttgcaaacataatatccttatccgactttatatttcctgtagg

SEQ ID NO: 349460 - DNA, 75 bp, Artificial Sequence
  Synthetic
gtggtataattttattttgcctccacatatcggtgtttccaaatatattactagacaatattccatatagttatt

SEQ ID NO: 349461 - DNA, 75 bp, Artificial Sequence
  Synthetic
agttaagggtacccaattagaacacgtatgcttattatcatcattcggatcgtatttcataaaagttattgtact

SEQ ID NO: 349462 - DNA, 75 bp, Artificial Sequence
  Synthetic
atcgatgtcaacacattctacattttttaatcgtctatatagtatttttctgatattttctataatatcagaatt

SEQ ID NO: 349463 - DNA, 75 bp, Artificial Sequence
  Synthetic
gtcttccatcggaagttgtatactatcggaatcagttacatgtttaaataattctctgatgtcattccttataca

SEQ ID NO: 349464 - DNA, 75 bp, Artificial Sequence
  Synthetic
atcaaattcattattaaacagtttaatagtctgtagacctttatcgttgtaaatatccattgtcttattagttac

SEQ ID NO: 349465 - DNA, 75 bp, Artificial Sequence
  Synthetic
gcttatttttatgtgttttatgttgatttattatatttataagaatgattgtttgacaaatcacgagaactatta

SEQ ID NO: 349466 - DNA, 75 bp, Artificial Sequence
  Synthetic
agacatatattattagaggtatatattataaaaaagtttttgattacgatgttataagaggaaaaaggacacatt

SEQ ID NO: 349467 - DNA, 75 bp, Artificial Sequence
  Synthetic
aacaaaaatgttcttaactacattaacaaaaagttatctctcgcgacttcttctttttctgtctcagtagtgtgt

SEQ ID NO: 349468 - DNA, 75 bp, Artificial Sequence
  Synthetic
aacatcatacatcaattaactattcttataacatcgtaatcaaaagaattgcaattttgatgtataacaactgtc

SEQ ID NO: 349469 - DNA, 75 bp, Artificial Sequence
  Synthetic
aatgaattatggaattgtatattacacattatacggtatgttggtaacgacaaataccgattggtaattgtttac

SEQ ID NO: 349470 - DNA, 75 bp, Artificial Sequence
  Synthetic
acattatacggtatgttggtaacgacaaataccgattggtaattgtttaccggtgtaatagaatttatatatcta

SEQ ID NO: 349471 - DNA, 75 bp, Artificial Sequence
  Synthetic
cggtgtaatagaatttatatatctattacaccggccaagtatgcataataataagttgtgggagtatcatccaca

SEQ ID NO: 349472 - DNA, 75 bp, Artificial Sequence
  Synthetic
tatttataatttaggactttgtattcagtatttttggaatcataaaaaaaagttttaccattttaaaatttaaaa

SEQ ID NO: 349473 - DNA, 75 bp, Artificial Sequence
  Synthetic
gtcgcggatatggaatttgatcctaccaaaatcaatatatcatctatagatcatgtaacaatattacaatacata

SEQ ID NO: 349474 - DNA, 75 bp, Artificial Sequence
  Synthetic
gatgaaccaaatgatataagactaacagtatgcattatccaaaatattaataacattacatattatatcaatatc

SEQ ID NO: 349475 - DNA, 75 bp, Artificial Sequence
  Synthetic
tatcgctggaagggactatatgactaacttatctagagatacaggaatacaacaatcaaaccttactgaaactat

SEQ ID NO: 349476 - DNA, 75 bp, Artificial Sequence
  Synthetic
aacttatctagagatacaggaatacaacaatcaaaccttactgaaactatacgtaactgtcaaaaaaatagaaac

SEQ ID NO: 349477 - DNA, 75 bp, Artificial Sequence
  Synthetic
tttggtacaaaatttctcacaagtttttatacagacaaattcttgtccatatattttaaaacattgacttttgca

SEQ ID NO: 349478 - DNA, 75 bp, Artificial Sequence
  Synthetic
atatatggtctatatatacactacaatttagttattaatgtggttattgattggataaccgatgtgattgttcaa

SEQ ID NO: 349479 - DNA, 75 bp, Artificial Sequence
  Synthetic
tcaatattaagagggttggtaaattggtacatagataataatacctatactccaaatacacccaataatacaaca

SEQ ID NO: 349480 - DNA, 75 bp, Artificial Sequence
  Synthetic
taacgtaaccagaattgtaaaattagaggtatgggataaaataataccttctactatgcaaaaggccttgtaact

SEQ ID NO: 349481 - DNA, 75 bp, Artificial Sequence
  Synthetic
gacatcaacgccttagaaataagagacttaaacaacggacacctggaattattaccatagaagatgttagaaaaa

SEQ ID NO: 349482 - DNA, 75 bp, Artificial Sequence
  Synthetic
accatttctgagttggatatcatcaaaatactggataaatacgaggacgtatataaagtaagtaaagaaaaagaa

SEQ ID NO: 349483 - DNA, 75 bp, Artificial Sequence
  Synthetic
tgtggaatttgctatgaagttgtctactcaaaacgattagaaaacgatagatactttggtttattggattcgtgt

SEQ ID NO: 349484 - DNA, 75 bp, Artificial Sequence
  Synthetic
aatcatatattttgcataacatgtatcaatatatggcatagaacacgaagagaaactggtgcgtcggataattgt

SEQ ID NO: 349485 - DNA, 75 bp, Artificial Sequence
  Synthetic
cctatatgtcgtacccgttttagaaacataacaatgagtaagttctataagctagttaactaataaataaaaagt

SEQ ID NO: 349486 - DNA, 75 bp, Artificial Sequence
  Synthetic
ttaatttgttgacgacatatatcgttatttttctcgtatgaaagattaatttgattctaatataatcttcagtat

SEQ ID NO: 349487 - DNA, 75 bp, Artificial Sequence
  Synthetic
tatttttctcgtatgaaagattaatttgattctaatataatcttcagtattagatgaatcttaattcaaattaat

SEQ ID NO: 349488 - DNA, 75 bp, Artificial Sequence
  Synthetic
taacttattagatagagatgagatgtctactattctagaggaatattttatgtacagaggtggaggagttgctga

SEQ ID NO: 349489 - DNA, 75 bp, Artificial Sequence
  Synthetic
tccattagattatatcataaataaaaatagtagcacgtgctactttagccaaatattcttttttgaaacgccatt

SEQ ID NO: 349490 - DNA, 75 bp, Artificial Sequence
  Synthetic
tagcgtagtgaggacacaagtgaacctataatgagcaaatttattagtatcggttacatgaaggactttacgtag

SEQ ID NO: 349491 - DNA, 75 bp, Artificial Sequence
  Synthetic
agtggtgattccaccatctgtggtacgaatggtttcatcttctttgatgccatcacccagatgttctataaactt

SEQ ID NO: 349492 - DNA, 75 bp, Artificial Sequence
  Synthetic
ggtatactcgtccgatttcatatcctttgccaaccaatacatatagctaaacttaggcatatgttccacacatcc

SEQ ID NO: 349493 - DNA, 75 bp, Artificial Sequence
  Synthetic
tgaacaataaaattctccagatgatgttacaatgtctagatttggacatttggtttcaaccgcgttaacatatga

SEQ ID NO: 349494 - DNA, 75 bp, Artificial Sequence
  Synthetic
gtggtgtcccataccactagatttcctcgtcctatggaacgagaaggtgttgattaccattacgttaacagagag

SEQ ID NO: 349495 - DNA, 75 bp, Artificial Sequence
  Synthetic
gtgaacacagccatacatgaaagcgatgagaaataggattctcatctcgccaaaatatcactagaaaaaatttat

SEQ ID NO: 349496 - DNA, 75 bp, Artificial Sequence
  Synthetic
cttaaaaatacttacctaatgccttactcggtgtatataaaacctacctctcttaaaatggttgagaccaagctt

SEQ ID NO: 349497 - DNA, 75 bp, Artificial Sequence
  Synthetic
caaaatatcactagaaaaaatttatttatcaattttaaaggtataaaatacttattgttgtcctcgtttgtcaat

SEQ ID NO: 349498 - DNA, 75 bp, Artificial Sequence
  Synthetic
ttatcaattttaaaggtataaaatacttattgttgtcctcgtttgtcaatcatgttaatgtctttaagataaggt

SEQ ID NO: 349499 - DNA, 75 bp, Artificial Sequence
  Synthetic
ttgggcaagcataagacatgacacaaagaccctttttgtatatataagtgtagaaattataacatccatagttgg

SEQ ID NO: 349500 - DNA, 75 bp, Artificial Sequence
  Synthetic
gatggatatcgatatcgtcgaatgtcatatactcaattagtatatgttggaggacattcgagttcattgttttca

SEQ ID NO: 349501 - DNA, 75 bp, Artificial Sequence
  Synthetic
catatactcaattagtatatgttggaggacattcgagttcattgttttcaatatcaaagagatggtttccttatc

SEQ ID NO: 349502 - DNA, 75 bp, Artificial Sequence
  Synthetic
gaacgtcactctctccaccttcatatttatttatccgtaaaaatgttatcctggacattgtgccaataataaaaa

SEQ ID NO: 349503 - DNA, 75 bp, Artificial Sequence
  Synthetic
tttccaaaaacaatttgaccaaatctaaatttacatctttattgtatctataatcactatttagataatcagcca

SEQ ID NO: 349504 - DNA, 75 bp, Artificial Sequence
  Synthetic
cgttacactttggagtctcatctttagtaaacatatcataatattcgatattacgagttgacacattgaacaaat

SEQ ID NO: 349505 - DNA, 75 bp, Artificial Sequence
  Synthetic
taattcctcgagtgcaacgtgttagatcgtctatatatgaataagcagtgttatctattcctttcattaacaatt

SEQ ID NO: 349506 - DNA, 75 bp, Artificial Sequence
  Synthetic
taacgatgtctatatctatatgagatgacttaatataatattgaagagctgtacaatagtttttatctatagaag

SEQ ID NO: 349507 - DNA, 75 bp, Artificial Sequence
  Synthetic
acggcttgattccgtgattaattagacatttaacaacttccggacgcacatatgctctcgtatccgactctgaat

SEQ ID NO: 349508 - DNA, 75 bp, Artificial Sequence
  Synthetic
acagatgagagataatatacaaatgcaatacggtaccgcaattttgtggttgataatcatcatacgtgtatccat

SEQ ID NO: 349509 - DNA, 75 bp, Artificial Sequence
  Synthetic
actcgtcatcctcataaagaacattgcagccattttctatgaacaaatcaataatttcaggaacaggatcatctg

SEQ ID NO: 349510 - DNA, 75 bp, Artificial Sequence
  Synthetic
tcattacataattttctataactgaacgatggttttcacatttaacactcaagtcaaatccatgttctaccaaca

SEQ ID NO: 349511 - DNA, 75 bp, Artificial Sequence
  Synthetic
cctttattaagtcaacgtttacatttttggatttcatatagttgaatatattaaagttatttatgttgctaaatc

SEQ ID NO: 349512 - DNA, 75 bp, Artificial Sequence
  Synthetic
cagtggcttctagtagagccatcgctatatccttattaactttaacatgtctactatttgtgtattcttctaatg

SEQ ID NO: 349513 - DNA, 75 bp, Artificial Sequence
  Synthetic
ctactatttgtgtattcttctaatggggtaaaatgtctccaatttttgtgcaatggattagtgccactgtctagt

SEQ ID NO: 349514 - DNA, 75 bp, Artificial Sequence
  Synthetic
agtagtttgacgacctcgacattattacaatgctcattaaaaaggtatgcatgtaaagcattattcttgaattgg

SEQ ID NO: 349515 - DNA, 75 bp, Artificial Sequence
  Synthetic
ttcctggtatcattaggatctctgtctttcaacatctgtttaagttcatcgagagctacctcctcattttccaga

SEQ ID NO: 349516 - DNA, 75 bp, Artificial Sequence
  Synthetic
tagttaaacattttgactgaatagaagtgaatgagctactgtgaactctgtacacccacacaactaatgttatta

SEQ ID NO: 349517 - DNA, 75 bp, Artificial Sequence
  Synthetic
aatatcattttttgaatatatttataccatgtcaaaacttgttcaattattaataaaaataatttagtgtttaaa

SEQ ID NO: 349518 - DNA, 75 bp, Artificial Sequence
  Synthetic
ttttaccagttccagatttcacacctccattaaccccactttttacaccacaggacgatcctccccacatttcac

SEQ ID NO: 349519 - DNA, 75 bp, Artificial Sequence
  Synthetic
cgccaccagatgtataagttttagatcctttattactaccatcatgtccatggataaagacactccacatgccgc

SEQ ID NO: 349520 - DNA, 75 bp, Artificial Sequence
  Synthetic
cactacctcctttagaagacatattaataagacttaagacaagtttaacaataaaattaatcacgagtaccctac

SEQ ID NO: 349521 - DNA, 75 bp, Artificial Sequence
  Synthetic
taccaacctacactattatatgattatagtttctatttttacagtaccttgactaaagtctttagtcacacaata

SEQ ID NO: 349522 - DNA, 75 bp, Artificial Sequence
  Synthetic
atagtttctatttttacagtaccttgactaaagtctttagtcacacaatactaccaacctacactattatatgat

SEQ ID NO: 349523 - DNA, 75 bp, Artificial Sequence
  Synthetic
ctaattagtaacgactattaaaataaatattcttcataaccggtaagaatagtaaaaagactaaatcttcacatt

SEQ ID NO: 349524 - DNA, 75 bp, Artificial Sequence
  Synthetic
tatagtttctatttttataggaacacgtacgagaaaatcaaatgtctaagttctaacggtagtgttgataaacga

SEQ ID NO: 349525 - DNA, 75 bp, Artificial Sequence
  Synthetic
ttgttatccacggatacctcatttatcatgttgtctattttcttactttgttctattaacttattagcgttgtat

SEQ ID NO: 349526 - DNA, 75 bp, Artificial Sequence
  Synthetic
attatttgattataaaacttatattgctgtttagtccactctataaatatcggattattcacatatcgtttcttt

SEQ ID NO: 349527 - DNA, 75 bp, Artificial Sequence
  Synthetic
gtaggtttatttaacttgtacatcactgtaagcatgtccgtaccatttattttaatttgacacatatcagcaatt

SEQ ID NO: 349528 - DNA, 75 bp, Artificial Sequence
  Synthetic
tcttttttgcattcggttctaccaacgtaataatgaagtgtggtatatgatctataagtataatatagtatctct

SEQ ID NO: 349529 - DNA, 75 bp, Artificial Sequence
  Synthetic
tttttcgtaagatattaaacagtttatcacatctagagataatttatctcgtgataatataataatagagtgcgg

SEQ ID NO: 349530 - DNA, 75 bp, Artificial Sequence
  Synthetic
atcataacactactttggttagatgttttagaaaaaaaatatcgccgtaccgttcttgtttttataaaaataaca

SEQ ID NO: 349531 - DNA, 75 bp, Artificial Sequence
  Synthetic
ataataatataatactaatagtaatcgttatcattgtacccacttgagaagttagtaactttttttctattataa

SEQ ID NO: 349532 - DNA, 75 bp, Artificial Sequence
  Synthetic
tcttgtatccgtaagatacattactacacataggaattccctgatcgagcaatagtttaaatacatctacatttg

SEQ ID NO: 349533 - DNA, 75 bp, Artificial Sequence
  Synthetic
gatttgatgtagttgcgtatttctctacaatattaataccatttttgcaactatttatttctagaccttttgtga

SEQ ID NO: 349534 - DNA, 75 bp, Artificial Sequence
  Synthetic
agtctccaatttttcttaaaacagttttaccgtttgcatgttaccactatcaaccacatatacaatacagtgttc

SEQ ID NO: 349535 - DNA, 75 bp, Artificial Sequence
  Synthetic
ttagtaatctcaataattctacgtcaatattatcagattctatatattcgaatatatcaaagtcattgatatttt

SEQ ID NO: 349536 - DNA, 75 bp, Artificial Sequence
  Synthetic
tataattggtagaagacaataatgacaccacaacatcagttttgatattcttatttttcttggtaacgtatacat

SEQ ID NO: 349537 - DNA, 75 bp, Artificial Sequence
  Synthetic
ttatttttcttggtaacgtatacatttaatgaattttcattacgttctaccaatgattgtgcactgcaggcatca

SEQ ID NO: 349538 - DNA, 75 bp, Artificial Sequence
  Synthetic
ttaatgaattttcattacgttctaccaatgattgtgcactgcaggcatcaaaagttttacaactatcataaagca

SEQ ID NO: 349539 - DNA, 75 bp, Artificial Sequence
  Synthetic
tactatcctatccaaccattatggtattgatgctatagtatattttaattcatttcatttatgtgtatttggtac

SEQ ID NO: 349540 - DNA, 75 bp, Artificial Sequence
  Synthetic
attgatgctatagtatattttaattcatttcatttatgtgtatttggtacgagcagacagcatgagatcgtatga

SEQ ID NO: 349541 - DNA, 75 bp, Artificial Sequence
  Synthetic
tttcagtaccgtagtgacaatactattagtttcaataagatcaatctctagatctatagaatcaaaacatgatag

SEQ ID NO: 349542 - DNA, 75 bp, Artificial Sequence
  Synthetic
gttagaagataatgaatatctgtaggcttcttgttgcactgtaacttctcgttttgttagatgtttgtatcatgc

SEQ ID NO: 349543 - DNA, 75 bp, Artificial Sequence
  Synthetic
gcttcttgttgcactgtaacttctcgttttgttagatgtttgtatcatgctttaacattaatggtacaaatttta

SEQ ID NO: 349544 - DNA, 75 bp, Artificial Sequence
  Synthetic
ccctactataaaattgtatattcagattatcatgagatgtgtttacactaactgtatcgataaacggcacaccat

SEQ ID NO: 349545 - DNA, 75 bp, Artificial Sequence
  Synthetic
ttagtcataaccgtaatccaaaaatttttaaagtatatcttaacgaaagaagttgtatcatcgttaggatttggt

SEQ ID NO: 349546 - DNA, 75 bp, Artificial Sequence
  Synthetic
aaattattatctacagtgtatggtactaaatcctcataagtgtatatatctagagtaatgtttaatttatcaaat

SEQ ID NO: 349547 - DNA, 75 bp, Artificial Sequence
  Synthetic
ggttcataatatggatcctcatgacaatttccgaagacgaaaatgagatatagacatggttactccttaaaaaaa

SEQ ID NO: 349548 - DNA, 75 bp, Artificial Sequence
  Synthetic
tacgaataatcgccttggctatttagtaagtgtcatttaacactatacttatattaatccatggactcataatct

SEQ ID NO: 349549 - DNA, 75 bp, Artificial Sequence
  Synthetic
gtaagtgtcatttaacactatacttatattaatccatggactcataatctctatacgggattaacggatgttcta

SEQ ID NO: 349550 - DNA, 75 bp, Artificial Sequence
  Synthetic
tatacggggatgagtagttctcttctttaactttatactttttactaatcatatttagactgatgtatgggtaat

SEQ ID NO: 349551 - DNA, 75 bp, Artificial Sequence
  Synthetic
ctttccatcattaacacacgtactaacttttgattttaacgacgacatattagtaactgttttccattttttttt

SEQ ID NO: 349552 - DNA, 75 bp, Artificial Sequence
  Synthetic
agtgtttgaagagctcgttctcatcatcagaataaatcaatatctctgtttttttgttatacagatgtattacag

SEQ ID NO: 349553 - DNA, 75 bp, Artificial Sequence
  Synthetic
cctcatatattacgtaatagaacgtgtcatctaccttattaactttcaccgcatagttgtttgcaaatacggtta

SEQ ID NO: 349554 - DNA, 75 bp, Artificial Sequence
  Synthetic
atcctttgacctcgtcgatttccgaccaatctgggcgtataatgaatctgaactttaatttcttgtaatcattcg

SEQ ID NO: 349555 - DNA, 75 bp, Artificial Sequence
  Synthetic
aaataatttttagtttgcatccgtagttatctcctctatgcaactgtaaatttctcaacgcgatatctccattaa

SEQ ID NO: 349556 - DNA, 75 bp, Artificial Sequence
  Synthetic
taatgatgtcaaattcgtgttgtatacccatactgaattgatgaacgaacgaataccgacggcgttaatagtaat

SEQ ID NO: 349557 - DNA, 75 bp, Artificial Sequence
  Synthetic
ttactttttcatctttacatactcggtactagttttactatcataagtttataaattccacaagctactatggaa

SEQ ID NO: 349558 - DNA, 75 bp, Artificial Sequence
  Synthetic
tataccaaccatcttagtatagaacacatgtcttaaagttattaattaattacatattgttttatatatcgctac

SEQ ID NO: 349559 - DNA, 75 bp, Artificial Sequence
  Synthetic
gaatttaaacagagaaatcagttaggaagaaaaaattatctgtcttcttcatcatcgtctattggataacgtctc

SEQ ID NO: 349560 - DNA, 75 bp, Artificial Sequence
  Synthetic
tgtattctacgatagagtgctactttaagatgagacatatccgtgttatcaaaaatatactccattaaaatgatt

SEQ ID NO: 349561 - DNA, 75 bp, Artificial Sequence
  Synthetic
attccggcagcgaacttgatattggatatatcacaacctttgttaatatctacgacaatagacagcagtcccatg

SEQ ID NO: 349562 - DNA, 75 bp, Artificial Sequence
  Synthetic
cgtactcccaatatgtatacgatctaacgaagaatttgatccagtggaggatggtcccgatgatgagacagatct

SEQ ID NO: 349563 - DNA, 75 bp, Artificial Sequence
  Synthetic
gttccataaacagtgagtttatctttctttgaagagatattttgtagagatcttataaaactgtcaaatgacatc

SEQ ID NO: 349564 - DNA, 75 bp, Artificial Sequence
  Synthetic
gagcaaactctcaaaagacgttgtacaatatgaacaagaaatagaatcgttagaagcaacttatcatataatcat

SEQ ID NO: 349565 - DNA, 75 bp, Artificial Sequence
  Synthetic
gcatttatatctttagctaaatcgtatatgttaccatcgtaatatctaaccgcgtctatcttaaacgtttccatc

SEQ ID NO: 349566 - DNA, 75 bp, Artificial Sequence
  Synthetic
gctttaaagacgtttccgatagatggtctcatttcatcagtcatactaagccaacaaatataatcgtgtataaca

SEQ ID NO: 349567 - DNA, 75 bp, Artificial Sequence
  Synthetic
tctttgatagaatcagactctaaagaaaacgaatcggctttattatacacattcatgataaacttaatgaaaaat

SEQ ID NO: 349568 - DNA, 75 bp, Artificial Sequence
  Synthetic
gttttcgttgtttaagttggatgaatagtatgtcttaataattgttattatttcactaattaatatttagtaatt

SEQ ID NO: 349569 - DNA, 75 bp, Artificial Sequence
  Synthetic
agtacactctataaaaacgagaatgacataactaatcataactagttatcaaagtgtctaggatgcgtaattttt

SEQ ID NO: 349570 - DNA, 75 bp, Artificial Sequence
  Synthetic
tatatggtatagatcctgtaagcgttgtctgtattctggagctattttctctatcgcattagtgagttcagaata

SEQ ID NO: 349571 - DNA, 75 bp, Artificial Sequence
  Synthetic
gatagttttagtttccaacaatagctttaacagtggacccttgatgactgtactcgctttatacccgaataccat

SEQ ID NO: 349572 - DNA, 75 bp, Artificial Sequence
  Synthetic
tgttataaatttaaatcgaataacgaacataactttagtaaagttgtctatattaactcttttattttccagcca

SEQ ID NO: 349573 - DNA, 75 bp, Artificial Sequence
  Synthetic
tcgtaatacccatgtttaagatagtatattctctagttacactatggtctcatcgttgtttagaatatcacatac

SEQ ID NO: 349574 - DNA, 75 bp, Artificial Sequence
  Synthetic
cgaatctacatcaaattttagaaattggtctgtgttacgtatctcttctatattattgttgatgtattgtcgtag

SEQ ID NO: 349575 - DNA, 75 bp, Artificial Sequence
  Synthetic
aaaactattacgtagaccattttctttataaaacgaatatatagtataccaattatcttttccgataatatattt

SEQ ID NO: 349576 - DNA, 75 bp, Artificial Sequence
  Synthetic
gccacaatatattctatgatggtattgaagaagataacaaccttggcatattgatcatttgatacggacatggta

SEQ ID NO: 349577 - DNA, 75 bp, Artificial Sequence
  Synthetic
acacacataatccattctctcaatcactacatctttaagtttttcgttgttaagatatttggctaaattatataa

SEQ ID NO: 349578 - DNA, 75 bp, Artificial Sequence
  Synthetic
tcaacagatagcttgaatgaaagagactcagtaatcggaataagtgttttctcaatggagtgtccgtataccaac

SEQ ID NO: 349579 - DNA, 75 bp, Artificial Sequence
  Synthetic
ctcaatggagtgtccgtataccaacatgtctgatattttgatgtacaccatcaaattgtttagttttctcttttt

SEQ ID NO: 349580 - DNA, 75 bp, Artificial Sequence
  Synthetic
ttctattagatcattaacagaatcagtatatatttttctagatccaaagacgaactctttggcgtcctctataat

SEQ ID NO: 349581 - DNA, 75 bp, Artificial Sequence
  Synthetic
attcccagaaaagatattttcgtgttttagtttatcgagatctaatctgttcatatacgtatccatgattgcgcg

SEQ ID NO: 349582 - DNA, 75 bp, Artificial Sequence
  Synthetic
tttagtttatcgagatctaatctgttcatatacgtatccatgattgcgcggtacgttatgatagccgcataaaat

SEQ ID NO: 349583 - DNA, 75 bp, Artificial Sequence
  Synthetic
ctacatttggtcccgataccattaaagaattcttatgatataaggaaacagcttttaggtactcatctactctac

SEQ ID NO: 349584 - DNA, 75 bp, Artificial Sequence
  Synthetic
aagaattttggagagccttaacgatatcagtgacgtttattatttcaggaggaaaaaacctaacattgagaatgt

SEQ ID NO: 349585 - DNA, 75 bp, Artificial Sequence
  Synthetic
aaaatccattttcatttttaaccaatactatctcctctattcataattgagattgatgtaatactttgttacttt

SEQ ID NO: 349586 - DNA, 75 bp, Artificial Sequence
  Synthetic
gaacgtaaaaacagtacacggatccgtatctccaacaagcatgtagtaatcaaatttggtgttgttaaacttcgc

SEQ ID NO: 349587 - DNA, 75 bp, Artificial Sequence
  Synthetic
ggtcaacctttgttgtacaaattcctcggccattttaatatttaagtgatataaaacattctcgacttatttaac

SEQ ID NO: 349588 - DNA, 75 bp, Artificial Sequence
  Synthetic
aatattcattaatttagatagaaatttatactcatcatctgttttaggaatccatgtattattaccactttccaa

SEQ ID NO: 349589 - DNA, 75 bp, Artificial Sequence
  Synthetic
cttatcattatcccaggctatgtttcgtccatcatcattgcgcagagtgaataattcttctgtatccggcagttc

SEQ ID NO: 349590 - DNA, 75 bp, Artificial Sequence
  Synthetic
caaccactctcgatacatcaactctctcattttcttcaacaaattctgcaatatcttcgtaaaaagattcttgaa

SEQ ID NO: 349591 - DNA, 75 bp, Artificial Sequence
  Synthetic
aaatatatgatccatgcatagatcggcaaagctatcgtagatgtgatttttcctaaatcgagtataaaactcgtt

SEQ ID NO: 349592 - DNA, 75 bp, Artificial Sequence
  Synthetic
atatcttcgtaaaaagattcttgaaacttttcagaatatctatcgacttcagatgaaatagcgttcgtcaacata

SEQ ID NO: 349593 - DNA, 75 bp, Artificial Sequence
  Synthetic
tactagcaaacactttcctgatttattgaccaagacacatatggtttctaagtctatcaagtggtggggatccat

SEQ ID NO: 349594 - DNA, 75 bp, Artificial Sequence
  Synthetic
agttatgacgcagtaacatagattattaccttcttgactgtcgctaatatctatatatttattgttatcgtattg

SEQ ID NO: 349595 - DNA, 75 bp, Artificial Sequence
  Synthetic
gattctgcatatagatggcttgtatgtcaaagatatagaacacataaccaatttatagtcgcgctttacattctc

SEQ ID NO: 349596 - DNA, 75 bp, Artificial Sequence
  Synthetic
gaatctaaagttaagagatttagaaaacattatatcctcggatgatgttatcactgtttctggagtaggatatat

SEQ ID NO: 349597 - DNA, 75 bp, Artificial Sequence
  Synthetic
taaagtctttacagatttcatccgattcaaataaatcactaaataatatcccacattgtcatctgttagagtagt

SEQ ID NO: 349598 - DNA, 75 bp, Artificial Sequence
  Synthetic
atcattaaatctattatattttatgaaagatatattactgctcacctctatatttcgtacatttttaaactgttt

SEQ ID NO: 349599 - DNA, 75 bp, Artificial Sequence
  Synthetic
gtataatatctctctgatacaattagatatatctattgtgtcggtagacgataccgttacatttgaattaatggt

SEQ ID NO: 349600 - DNA, 75 bp, Artificial Sequence
  Synthetic
gttccattttacaacttttaacaagttgaccaatttatttctaatagtatcaaactctccatgattaaatatttt

SEQ ID NO: 349601 - DNA, 75 bp, Artificial Sequence
  Synthetic
aatagtatccattttatatcaacggacacaaagtagctaacataaaccattgtataatttttatgttttatgttt

SEQ ID NO: 349602 - DNA, 75 bp, Artificial Sequence
  Synthetic
attagcgtacacattttggaagttccggttgccatgtatttcctggagagcaagtagatgatgaggaaccagata

SEQ ID NO: 349603 - DNA, 75 bp, Artificial Sequence
  Synthetic
gtttatatccgtacttgcacgtaaagtctacattgtcattatacgaatatgatcttttaaacccgctagacaagt

SEQ ID NO: 349604 - DNA, 75 bp, Artificial Sequence
  Synthetic
atccgtttaatattgtaggatgtggacatttaacaatctgacacgtgggtggattagaccattctcctcctgaac

SEQ ID NO: 349605 - DNA, 75 bp, Artificial Sequence
  Synthetic
acaggacaccagagttaccaatcaacgaatatccactattgcaactataagttacaacgcttccatcggtataaa

SEQ ID NO: 349606 - DNA, 75 bp, Artificial Sequence
  Synthetic
aatcattatatccgttatgtcttccgttggatatagatggaggtaattggcatttaacagattcgcaaataggtg

SEQ ID NO: 349607 - DNA, 75 bp, Artificial Sequence
  Synthetic
ccttgggattccataccatagatccagtagatcctaatttacaatacgatttatattcaccaatcaaataatatc

SEQ ID NO: 349608 - DNA, 75 bp, Artificial Sequence
  Synthetic
cgctattacaagagtacgttatactagagccaaagtctactccgccaatatcaagatggccattatcgatatctc

SEQ ID NO: 349609 - DNA, 75 bp, Artificial Sequence
  Synthetic
gaggcgacgggcatctccgtttaatacattgattaaagagtgtccatccagtacctgtacatttagcatatatag

SEQ ID NO: 349610 - DNA, 75 bp, Artificial Sequence
  Synthetic
gtcccattttttgctttctgtatccaggtagacatagatattctatagtgtctcctatgttgtaattagcattag

SEQ ID NO: 349611 - DNA, 75 bp, Artificial Sequence
  Synthetic
catcagtctccacactattcttaaatttcatattaatgggtcgtgacggaatagtacagcatgatagaacgcatc

SEQ ID NO: 349612 - DNA, 75 bp, Artificial Sequence
  Synthetic
gtttaatactaatactaatactaatactaatactaatactaatactaatactaatactaatactaatactaatac

SEQ ID NO: 349613 - DNA, 75 bp, Artificial Sequence
  Synthetic
ctattcccaacaatgtcaggaacgtcactctctccaccttcatatttatttatccgtaaaaatgttatcctggac

SEQ ID NO: 349614 - DNA, 75 bp, Artificial Sequence
  Synthetic
ttctatacgtctttattttctattttttaatttttttaaatttttaacgatttactgtggctagatacccaatct

SEQ ID NO: 349615 - DNA, 75 bp, Artificial Sequence
  Synthetic
ccagcggctactaaacgatcaaccaaaaaggataaagaaaaggaggaagtggaagaagaagaagtagttatagag

SEQ ID NO: 349616 - DNA, 75 bp, Artificial Sequence
  Synthetic
attgtgccaataataaaaaagcccatatatgttcgctattgtagaaattgtttttcatagttgctcaaaaacgat

SEQ ID NO: 349617 - DNA, 75 bp, Artificial Sequence
  Synthetic
tatatgttcgctattgtagaaattgtttttcatagttgctcaaaaacgatggcggtgacttatgagtcacgttac

SEQ ID NO: 349618 - DNA, 75 bp, Artificial Sequence
  Synthetic
atttgattttggataatattcgtattttgcatctgctataattaagatataatcgccacaaaaacacgcgaacat

SEQ ID NO: 349619 - DNA, 75 bp, Artificial Sequence
  Synthetic
ctttcctacatggttaaagtacatgtacaattctatccatttgtcttccttaactatatatttgtatagataatt

SEQ ID NO: 349620 - DNA, 75 bp, Artificial Sequence
  Synthetic
acgagtctcgtgtgtaattccagtaattgcatagatgttaccatcgtactctacagcataaactatactatgatg

SEQ ID NO: 349621 - DNA, 75 bp, Artificial Sequence
  Synthetic
agataacatagtttgggaaaagaaatcattagtgacggaaaatcgtcttcataaagcatgcttgttgagactatc

SEQ ID NO: 349622 - DNA, 75 bp, Artificial Sequence
  Synthetic
tctaggcatgggagacttttttatccaacaatttttagtgaaacattccacattgtttaatattacatatttttc

SEQ ID NO: 349623 - DNA, 75 bp, Artificial Sequence
  Synthetic
acagaatcgaccacagcaggatcccatgacgagcgtcatattaaactaattcattttcaataatatactaattag

SEQ ID NO: 349624 - DNA, 75 bp, Artificial Sequence
  Synthetic
atacgtggtataaactccacccattacatatatatcatcatttacgaataccgacgcgtctgaatatctaggagt

SEQ ID NO: 349625 - DNA, 75 bp, Artificial Sequence
  Synthetic
ttcgaagtgtagcgttttaaatattttgctacacctgttgaaatagaaaattttaatcctcctattacatataac

SEQ ID NO: 349626 - DNA, 75 bp, Artificial Sequence
  Synthetic
ctgggataagatttctaagttactgctgcatcatataactaaacacgttaggtttctttattgtttgggtaaaac

SEQ ID NO: 349627 - DNA, 75 bp, Artificial Sequence
  Synthetic
taaacatgtctattgttaatcatgccaccaataatgtatagacaattatataaaacatttgcattatagaattgt

SEQ ID NO: 349628 - DNA, 75 bp, Artificial Sequence
  Synthetic
caacatttcatccccatacattttacattcctcgagtctaccatcgtcaaaatatctttccaactcctttttcga

SEQ ID NO: 349629 - DNA, 75 bp, Artificial Sequence
  Synthetic
ctatctatctgtattaccgacgattgtccaatattctgttctaggagagtaatgggttattgtggatatataatc

SEQ ID NO: 349630 - DNA, 75 bp, Artificial Sequence
  Synthetic
agagtttttaatgactactatattatgttttataccatttcgtgtcacaggctttgtagatttggatatagcatt

SEQ ID NO: 349631 - DNA, 75 bp, Artificial Sequence
  Synthetic
aacaggaaagaagtatactatcgtcatttttttctctagatccagctacgattgataatgatagaatagacgcta

SEQ ID NO: 349632 - DNA, 75 bp, Artificial Sequence
  Synthetic
gcacatagtattagtcataaacttgggatgtaaactgttgatgatatctacatcgtttggatttttatgtatcca

SEQ ID NO: 349633 - DNA, 75 bp, Artificial Sequence
  Synthetic
catcgtttggatttttatgtatccactttaataatatcatagctgtaacatcctcgtgatttacgttgacgtttt

SEQ ID NO: 349634 - DNA, 75 bp, Artificial Sequence
  Synthetic
cgtgggataagatagttgttcatcctttgataattttccaaattctggattggatgtcactgcagtaatattgtt

SEQ ID NO: 349635 - DNA, 75 bp, Artificial Sequence
  Synthetic
aattatttctaacattgacgcattatatagtttttacacatagatctacaacaggtggaatatcaattaatacgg

SEQ ID NO: 349636 - DNA, 75 bp, Artificial Sequence
  Synthetic
tatagtttttacacatagatctacaacaggtggaatatcaattaatacggcagcaactagtattatctctacatt

SEQ ID NO: 349637 - DNA, 75 bp, Artificial Sequence
  Synthetic
taattgactgattattgagttaaaatcagtactaatttccaacccttcagaatatactttgtgtttcatggtaat

SEQ ID NO: 349638 - DNA, 75 bp, Artificial Sequence
  Synthetic
cagcaactagtattatctctacattgtttacggtgatgtttatcttcttccagcgcatatagtctaatagcgatt

SEQ ID NO: 349639 - DNA, 75 bp, Artificial Sequence
  Synthetic
gtttacggtgatgtttatcttcttccagcgcatatagtctaatagcgattcaaacgcgtgatagtttataccatt

SEQ ID NO: 349640 - DNA, 75 bp, Artificial Sequence
  Synthetic
caatataatcgcttcatcatttatatggtgtttctaaattcgtttaaaaaattatacggagacgccgtaataatt

SEQ ID NO: 349641 - DNA, 75 bp, Artificial Sequence
  Synthetic
tccccattgatagaaaatatcacgctttccattcttgaagtactataagtaattatagtataatgtaacgtttat

SEQ ID NO: 349642 - DNA, 75 bp, Artificial Sequence
  Synthetic
tttccattcttgaagtactataagtaattatagtataatgtaacgtttatatattcaatattttttataaaaaaa

SEQ ID NO: 349643 - DNA, 75 bp, Artificial Sequence
  Synthetic
tcatttcgacattaattcctttttaaatttccgtctatcatctatagaaacatattctatgaatttataaaatgc

SEQ ID NO: 349644 - DNA, 75 bp, Artificial Sequence
  Synthetic
catattctatgaatttataaaatgcttttacgtgtcctatcgtaggcgatagaaccgctaaaaagcctatcgaat

SEQ ID NO: 349645 - DNA, 75 bp, Artificial Sequence
  Synthetic
gttcacaaaaatacataaagaaatgtctacataaatctatggcgccattggcatcttgaaatagcgccagtcctc

SEQ ID NO: 349646 - DNA, 75 bp, Artificial Sequence
  Synthetic
ttctacaaaagaatctattatatggtatagggagagtataaaacattaaatgtccgtacttattaaagtattcag

SEQ ID NO: 349647 - DNA, 75 bp, Artificial Sequence
  Synthetic
tagccaatcctaactctttcgaatacttattaatggctcttattctgtacgaatctatttttttgaacaacggac

SEQ ID NO: 349648 - DNA, 75 bp, Artificial Sequence
  Synthetic
ctagtggtatatcttgttctatgtatctaaaataatgtctgacaagatccgttagtttaatatccttagtcatct

SEQ ID NO: 349649 - DNA, 75 bp, Artificial Sequence
  Synthetic
tatccaacactaaaaatataatagctaatattttattacaatcatccggatattcttctacgatctcactaacta

SEQ ID NO: 349650 - DNA, 75 bp, Artificial Sequence
  Synthetic
atgtttctttggttatactagtatagtcacgatcagacaaataaagaaaatcagatgattgatgaataatacatt

SEQ ID NO: 349651 - DNA, 75 bp, Artificial Sequence
  Synthetic
taaatttatcatctgtaagatttttgagatatctcattaaaatattattagggtcagtactcattatcatatatt

SEQ ID NO: 349652 - DNA, 75 bp, Artificial Sequence
  Synthetic
tttcaccatatagatcaatcattagatcatcaaaatatgtttcaatcatcctaaagagtatggtaaatgactctt

SEQ ID NO: 349653 - DNA, 75 bp, Artificial Sequence
  Synthetic
cccatctaatttctggacgttcaccaatgtctctagccactttggcactaatagcgatcattcgcttaacatctt

SEQ ID NO: 349654 - DNA, 75 bp, Artificial Sequence
  Synthetic
ctacattattaactggttgatttaatctatctagcaatggaccgtcggacagtgtcattctcatgttcttaatca

SEQ ID NO: 349655 - DNA, 75 bp, Artificial Sequence
  Synthetic
atgtacatacatcactgtcatctaccaattcatccaacaacataagctttttaaaatcatcattataatatgatg

SEQ ID NO: 349656 - DNA, 75 bp, Artificial Sequence
  Synthetic
gatcgccatcatttctccaaagaatatatctaataagtagagtcctcatgcttagtaatttaactattttagtta

SEQ ID NO: 349657 - DNA, 75 bp, Artificial Sequence
  Synthetic
atatctaataagtagagtcctcatgcttagtaatttaactattttagttaacaactattttttatgttaaatcaa

SEQ ID NO: 349658 - DNA, 75 bp, Artificial Sequence
  Synthetic
gtagaaccactatgttaatacttattcatattttagtttttaggattgataatcaacataaaaattaatacatca

SEQ ID NO: 349659 - DNA, 75 bp, Artificial Sequence
  Synthetic
gtttacccataggagagataactataaatggagatctagatacaaaatccggattcatgatagttttaacattat

SEQ ID NO: 349660 - DNA, 75 bp, Artificial Sequence
  Synthetic
tcaattttgaaaatacttagtttccacgtagtcaatgaaacatttgagctcatcgtacagaacgttctcgtacag

SEQ ID NO: 349661 - DNA, 75 bp, Artificial Sequence
  Synthetic
gacgtaactataaactggtttatatttgttcaagatagatacaaatccgataacttttttgacaaattctacggg

SEQ ID NO: 349662 - DNA, 75 bp, Artificial Sequence
  Synthetic
caatggtgtgatgttgattaggtcttttacgaatttgatataaaatagcgttcacatatcctccataatggtcaa

SEQ ID NO: 349663 - DNA, 75 bp, Artificial Sequence
  Synthetic
tcgccatttgttcgtatgtcataaattctttaattatatggcactgtgtattatttagttcatccttgttcatca

SEQ ID NO: 349664 - DNA, 75 bp, Artificial Sequence
  Synthetic
ttaggaatctatccaatatggcaattatactagaactataagtgtgttgtaaacacatattgatgtgtctgttta

SEQ ID NO: 349665 - DNA, 75 bp, Artificial Sequence
  Synthetic
tacaattaatgatatttggatccatgctactaccttcgggtaaaattggagaatcgtataccatttctagtactt

SEQ ID NO: 349666 - DNA, 75 bp, Artificial Sequence
  Synthetic
taggttcattgttatccattgtagaggatgacatgctcgaatcatacaaaaatatattatttttatgttattttg

SEQ ID NO: 349667 - DNA, 75 bp, Artificial Sequence
  Synthetic
actaggtagtaatttgactattgcgtgtaaagtatcgttgagacctccacaacggatgcagatgtcttttggata

SEQ ID NO: 349668 - DNA, 75 bp, Artificial Sequence
  Synthetic
aaagtatctacgatttttacaaaagtccggatgcataagtacaaagtacgcgataaacggaataataatagattt

SEQ ID NO: 349669 - DNA, 75 bp, Artificial Sequence
  Synthetic
atctagtttatctttttctatcgctttcatagttagatacatagtctcggaagtcggattatgtaacatcaactt

SEQ ID NO: 349670 - DNA, 75 bp, Artificial Sequence
  Synthetic
agttatctgatgaaagataaactagatatataaataatcccattctaatactttaacatgatgtattacatgcat

SEQ ID NO: 349671 - DNA, 75 bp, Artificial Sequence
  Synthetic
cgataaaattactgggttatttagtcttacgcattcactcatacatgtattaccgttaactacagagtctacact

SEQ ID NO: 349672 - DNA, 75 bp, Artificial Sequence
  Synthetic
aaaatgattaaacaatagatagtctaccattgtttcgtattcagatagtacagcgtagtacatggcatcttcaca

SEQ ID NO: 349673 - DNA, 75 bp, Artificial Sequence
  Synthetic
atggaagtagttgaaatctagttctgcattgttggcgcgcctcaaatgtagtgttggatatcttcacgtatagtt

SEQ ID NO: 349674 - DNA, 75 bp, Artificial Sequence
  Synthetic
aatgtttctgatggaggtctatcaataactggcacaacaataacaggagttttattcaccgccgccatttagtta

SEQ ID NO: 349675 - DNA, 75 bp, Artificial Sequence
  Synthetic
aattatatcattgtctaatagatatttgatgcatcttatggatcccacttcgacagccatcttaaaatcggtaga

SEQ ID NO: 349676 - DNA, 75 bp, Artificial Sequence
  Synthetic
atcatattgctttcctttatcattaataatttctagaatatcatctctatcataaaagatacaaatattaactgt

SEQ ID NO: 349677 - DNA, 75 bp, Artificial Sequence
  Synthetic
catgttacactatataacaattacactacatttttatcataacactactttggttagatgttttagaaaaaaaat

SEQ ID NO: 349678 - DNA, 75 bp, Artificial Sequence
  Synthetic
ttgatccgtaataacattactagttgataacaatttgttaataagatgtgctgggctcaatgtcttaataagaag

SEQ ID NO: 349679 - DNA, 75 bp, Artificial Sequence
  Synthetic
tgtaagaggactatctccaaatttgttttgtttattaacatccgttgatggaagtaaaagatttataatgtctac

SEQ ID NO: 349680 - DNA, 75 bp, Artificial Sequence
  Synthetic
attcttgactgttttagagcatacaatatggagaggtgtatttccatcatgatctggttttgaggggctaattcc

SEQ ID NO: 349681 - DNA, 75 bp, Artificial Sequence
  Synthetic
aagtatataaatactttttatttacggtactcttgtagtggtaatacccctactcgattattttttttaaaaaaa

SEQ ID NO: 349682 - DNA, 75 bp, Artificial Sequence
  Synthetic
accgcgtcatcatcgactgtacgatacataatgttaccgtgttgcgtacattgctcgtaaaagactttcgttaat

SEQ ID NO: 349683 - DNA, 75 bp, Artificial Sequence
  Synthetic
aaatttatctactatcctggcttcaaatccaatggacattatttttttaaacactctttctgaaggatcggtaga

SEQ ID NO: 349684 - DNA, 75 bp, Artificial Sequence
  Synthetic
cgccaacaacggaccacatccttcttcatcaaccgagttgttaatcttggctccatactgtaccaataaatttat

SEQ ID NO: 349685 - DNA, 75 bp, Artificial Sequence
  Synthetic
tctctctatgacttcatcatctgttcccgaaagataatatagaggcgttttatgctgtttatcgcacgcgtttgg

SEQ ID NO: 349686 - DNA, 75 bp, Artificial Sequence
  Synthetic
aatgatacacactatactgtcgaatttgatagggacaaagtagttgacacgtttatttcgtataatagacataat

SEQ ID NO: 349687 - DNA, 75 bp, Artificial Sequence
  Synthetic
gcaactattctattattattaattttagaagctatatgtaatggataatttccatcatcatccgtctcatttgga

SEQ ID NO: 349688 - DNA, 75 bp, Artificial Sequence
  Synthetic
gagtatcctctatgaagaagttcttcgacaaatcgttcatctagtcctttaattccacaatacgcatgtagaatg

SEQ ID NO: 349689 - DNA, 75 bp, Artificial Sequence
  Synthetic
tgataatttccagaaggttcaatagcttgtagcatattcctaaatacatctaaatttttactattatatttggta

SEQ ID NO: 349690 - DNA, 75 bp, Artificial Sequence
  Synthetic
ggatatctatgataggattgtgtgcgtgtgtggtagatgtttggagaaaggagaaactgttttctagatggaaat

SEQ ID NO: 349691 - DNA, 75 bp, Artificial Sequence
  Synthetic
ctactataatttactctctataacaaatgtcataacttagttcttttatgtcaagaaggcactggtttagttcat

SEQ ID NO: 349692 - DNA, 75 bp, Artificial Sequence
  Synthetic
ctatgaatgtcacaccataactaccacgcataccatacttagagttatgataaagatatttatccttagggtgca

SEQ ID NO: 349693 - DNA, 75 bp, Artificial Sequence
  Synthetic
ggtaatggggattaatctttgttggatcagtctctaagttaacacatgtcacacaggatccatttatagttatat

SEQ ID NO: 349694 - DNA, 75 bp, Artificial Sequence
  Synthetic
cacatgatgatttatggtgaattgattccggaagatcgctattgtattttgtggttccacaattcatttccatac

SEQ ID NO: 349695 - DNA, 75 bp, Artificial Sequence
  Synthetic
atgttattatcacactgatattatgatgaactttatccagccgctgggttgtaaacaacataacagatagtttat

SEQ ID NO: 349696 - DNA, 75 bp, Artificial Sequence
  Synthetic
tatctttaccaactccctctgccgccgcaacgaatctctgatccgtatccatgatggtcatgtttatttctagcc

SEQ ID NO: 349697 - DNA, 75 bp, Artificial Sequence
  Synthetic
tcatcttttgccaacacagagggtggatatttgttcattggataataatacacacaaagtaattggattcatggc

SEQ ID NO: 349698 - DNA, 75 bp, Artificial Sequence
  Synthetic
cgtatccagtcaacactatgttagcatttctatcgatatagctttcactcatataacactcaccaataatagtag

SEQ ID NO: 349699 - DNA, 75 bp, Artificial Sequence
  Synthetic
tgagaataaaaatgtttttgtttaaccgctgcatgatgtacagatttcggaatcacaaaccaccagtggttttat

SEQ ID NO: 349700 - DNA, 75 bp, Artificial Sequence
  Synthetic
aattaatgtcgtaatttacaccaatagtaagttcggcggcaaagtaccaatacctgtaatcttgtcgaggaggac

SEQ ID NO: 349701 - DNA, 75 bp, Artificial Sequence
  Synthetic
atatagtattcttgtattctaccgaatacccaagagatgcaatacaaaagagtaagactaatttgtaaaccatct

SEQ ID NO: 349702 - DNA, 75 bp, Artificial Sequence
  Synthetic
agtaagactaatttgtaaaccatcttacttaaaatatgtaacaatagtacgatgaatgagtaataagaaatatga

SEQ ID NO: 349703 - DNA, 75 bp, Artificial Sequence
  Synthetic
aatctatcttatatacacataattattctatcaattttaccaattagttagtgtttaataaaaatatgggaatct

SEQ ID NO: 349704 - DNA, 75 bp, Artificial Sequence
  Synthetic
aattaatttttccttacacaatcgacgtacatgagtctgagttccttgtttttgctaattatttcatccaattta

SEQ ID NO: 349705 - DNA, 75 bp, Artificial Sequence
  Synthetic
ttttaatatttcgataatatacggtaatctctcttttggacttatatagcttattccacaatacgagtcattata

SEQ ID NO: 349706 - DNA, 75 bp, Artificial Sequence
  Synthetic
tttgctaattatttcatccaatttattatttttgacgatgtcaagatcttttgtataggagtcagacttgtattc

SEQ ID NO: 349707 - DNA, 75 bp, Artificial Sequence
  Synthetic
aacatgcttttctataatcatttttagctatttcggcatcatccaatagtacattttccagattagcagaataga

SEQ ID NO: 349708 - DNA, 75 bp, Artificial Sequence
  Synthetic
tattaatgtcgtatttgaacagagcctgtaacacctcaatgtctttattatctatagccaatttaatgtccggaa

SEQ ID NO: 349709 - DNA, 75 bp, Artificial Sequence
  Synthetic
tgaagagaaggaaattattggtgtttgacggcgtcatatagtcgagcaaaagaatcatcatatccacgtgtccat

SEQ ID NO: 349710 - DNA, 75 bp, Artificial Sequence
  Synthetic
tgacggcgtcatatagtcgagcaaaagaatcatcatatccacgtgtccatttttatagtggtgtgaatacaacta

SEQ ID NO: 349711 - DNA, 75 bp, Artificial Sequence
  Synthetic
ttttatagtggtgtgaatacaactaaggagaatagccagatcaaaagtagatggtatttctgaaagaaagtatga

SEQ ID NO: 349712 - DNA, 75 bp, Artificial Sequence
  Synthetic
tataatacttacatcattaagcatgacggtatgataaaatgaagttttccatccagttttcccatagaacataag

SEQ ID NO: 349713 - DNA, 75 bp, Artificial Sequence
  Synthetic
tctccaatttttcttaaaacagttttaccgtttgtatgttaccactatcaaccacataatacaatacagtgttcc

SEQ ID NO: 349714 - DNA, 75 bp, Artificial Sequence
  Synthetic
cttgtcattaaattgtgaatcatccagtccactgaatagcaaaatttttactattttggtatcttccaatgtggc

SEQ ID NO: 349715 - DNA, 75 bp, Artificial Sequence
  Synthetic
ctattttggtatcttccaatgtggctgcctaatgtaatggaaattcattctctagaagatttttttaatgctcca

SEQ ID NO: 349716 - DNA, 75 bp, Artificial Sequence
  Synthetic
gcgttcaacaacgtacatactagacgcatgttattatcagctattgcataatacaaggcactatgtccatggaca

SEQ ID NO: 349717 - DNA, 75 bp, Artificial Sequence
  Synthetic
tccgccttaaatgtatctttactagagagaaagcttttcagctgcttagacttccgagtattaattcgtgacaga

SEQ ID NO: 349718 - DNA, 75 bp, Artificial Sequence
  Synthetic
tccatgtctgaaacgagacgctaattagtgtataattttgtcatactgctccagaattaataatatctctaatag

SEQ ID NO: 349719 - DNA, 75 bp, Artificial Sequence
  Synthetic
cgcaaaacaacatatacacatttaataaaaataatattcattaaggagattcagattccgccgtatccataaaca

SEQ ID NO: 349720 - DNA, 75 bp, Artificial Sequence
  Synthetic
atattaaggagattctaccttacccataaacaatataaatccagtaatatcatgtctaatgatgaacacaaatgg

SEQ ID NO: 349721 - DNA, 75 bp, Artificial Sequence
  Synthetic
tgtattaaattccagttcttcaggagatgatctcaccgtagctaccatgatagtagatgcctccgctacagttcc

SEQ ID NO: 349722 - DNA, 75 bp, Artificial Sequence
  Synthetic
ttgttcgttgacatctatctttgcattctgaaacattttataaatatataatgggtccctagtcatatgtttaaa

SEQ ID NO: 349723 - DNA, 75 bp, Artificial Sequence
  Synthetic
cgacgcattatctggattaaacatactaggagccatcatttcggctatcgacttaatatccctcttattttcgat

SEQ ID NO: 349724 - DNA, 75 bp, Artificial Sequence
  Synthetic
agaaaatctagggagtttaagattgtacactttattccctaattgagacgaccaatagtctaattttgcagccat

SEQ ID NO: 349725 - DNA, 75 bp, Artificial Sequence
  Synthetic
gatagaatctgtgaaatgggtcatattatcacctattgccagatacatactaatattagcatccttatacggaag

SEQ ID NO: 349726 - DNA, 75 bp, Artificial Sequence
  Synthetic
gcgcaccatatcatattcttcgtcatcgattgtgattgtatttccttgtaatttagtaactacgctcatcatggg

SEQ ID NO: 349727 - DNA, 75 bp, Artificial Sequence
  Synthetic
aaccgttttcgtgccgtacttattagtaaaactagtattgtgtgttttagtgatatcaaatggatattgccacgt

SEQ ID NO: 349728 - DNA, 75 bp, Artificial Sequence
  Synthetic
tgatatcaaatggatattgccacgtacctttaaaatatatagtattaatgattgcccatagagtattattgtcaa

SEQ ID NO: 349729 - DNA, 75 bp, Artificial Sequence
  Synthetic
gcatagtagaatctactacattagacatacctgatctacgttctactatggaattaattttattaaccgcatctc

SEQ ID NO: 349730 - DNA, 75 bp, Artificial Sequence
  Synthetic
ttatgatcctctctcattgatttttcgcgggatacatcatctattatggcgtcagccatagtcatagccatagca

SEQ ID NO: 349731 - DNA, 75 bp, Artificial Sequence
  Synthetic
gtctaaagtttaatctatataggccgaatctatgatattgttgataatacgacggtttaatacacacagtattat

SEQ ID NO: 349732 - DNA, 75 bp, Artificial Sequence
  Synthetic
ctacgaaactttgataagttagatcagtgtacgtatatttagatgtttttagcttagctaatcctgatattaatt

SEQ ID NO: 349733 - DNA, 75 bp, Artificial Sequence
  Synthetic
ctgtaaatgctggacccagatctatttttctcaaatccatagtcttcaataattctactttagtattacctgatg

SEQ ID NO: 349734 - DNA, 75 bp, Artificial Sequence
  Synthetic
aaacgaatagccaaacggcgagaagacaatattatcatcctcattcccatcttgaatatttttatacgctaatat

SEQ ID NO: 349735 - DNA, 75 bp, Artificial Sequence
  Synthetic
atctagagaatccacaacagtcaagacgtcgggaccaattactaataaagaagatcatacagtcacagacactgt

SEQ ID NO: 349736 - DNA, 75 bp, Artificial Sequence
  Synthetic
accggcattggtaaatccttgcaggcgataggtgaacgctgtacacgctaacgatagtatcaataacacaatcat

SEQ ID NO: 349737 - DNA, 75 bp, Artificial Sequence
  Synthetic
ctctgattaacccatcatctataggtgatgctggttctggagattctggaggagatggattattatctggaagaa

SEQ ID NO: 349738 - DNA, 75 bp, Artificial Sequence
  Synthetic
gattttatggtattaatattttaccttattttttatatttggtataaaaattattgatgtctacacatccttttg

SEQ ID NO: 349739 - DNA, 75 bp, Artificial Sequence
  Synthetic
taattgacatctatatatccttttgtataatcaattctaatcactttaacttttacagttttccctaccagttta

SEQ ID NO: 349740 - DNA, 75 bp, Artificial Sequence
  Synthetic
tccctatatttaaaatatctattcatatgcatctgagtactctctaccaagatagcttcagagtgaggatagtca

SEQ ID NO: 349741 - DNA, 75 bp, Artificial Sequence
  Synthetic
aaaagatcaacatatagaacataaccattctcgtatactttgccctttaatacatcacccacattgggcaacgaa

SEQ ID NO: 349742 - DNA, 75 bp, Artificial Sequence
  Synthetic
cgggctcgtaaattgggataaaaattatgtttttattattttatatctatttaatatctattcaatatttacaat

SEQ ID NO: 349743 - DNA, 75 bp, Artificial Sequence
  Synthetic
cgttatataactattaatattaacagttcgtttaacgatcatattatttttatgttttattaataattgtaaaac

SEQ ID NO: 349744 - DNA, 75 bp, Artificial Sequence
  Synthetic
atacaattaaatcaatatagaggaagggacggatactgtcttttgtgagatatagttatggcgactaaatcagat

SEQ ID NO: 349745 - DNA, 75 bp, Artificial Sequence
  Synthetic
tatgaggatgctgttttttactttgtggatgatgatgaaatatgtagtcgtgactccatcatcgatctaatagat

SEQ ID NO: 349746 - DNA, 75 bp, Artificial Sequence
  Synthetic
gaatatatcacgtggagaaatcatgttatagtgtttaacaaagatattaccagttgtggaagactctacaaggaa

SEQ ID NO: 349747 - DNA, 75 bp, Artificial Sequence
  Synthetic
ttgatgaagttcgatgatgctgctatacgatactatggtattgataaaattaatgagattgtcgaggctatgagt

SEQ ID NO: 349748 - DNA, 75 bp, Artificial Sequence
  Synthetic
gaaggagaccactacatcaatcttacagaagttcatgatcaggaaagtctattcgctaccataggaatatgtgct

SEQ ID NO: 349749 - DNA, 75 bp, Artificial Sequence
  Synthetic
aaaatcactgaacattggggatacaaaaagatttcagaatctagattccaatcattgggaaacattacagatcta

SEQ ID NO: 349750 - DNA, 75 bp, Artificial Sequence
  Synthetic
gaattgatgatatagggttctttataatgcattcgtattctatatccggtgttaaaaaaattatcctatcatgta

SEQ ID NO: 349751 - DNA, 75 bp, Artificial Sequence
  Synthetic
gaaacaggaaacgctgtatatggaaaagttcaacatgattattctactatcaaagagaaggccaaagaaatgagt

SEQ ID NO: 349752 - DNA, 75 bp, Artificial Sequence
  Synthetic
tttgagagtcttatatgtagcaaacatgatagctgtgataccaataagttttagatattcacgcgtgctaatgtt

SEQ ID NO: 349753 - DNA, 75 bp, Artificial Sequence
  Synthetic
ttagatattcacgcgtgctaatgttggggatggtattatctggcggtgaaatgtccgttatataatctataaaac

SEQ ID NO: 349754 - DNA, 75 bp, Artificial Sequence
  Synthetic
ggggatggtattatctggcggtgaaatgtccgttatataatctataaaacaatcatcgcatatagtatgcgatag

SEQ ID NO: 349755 - DNA, 75 bp, Artificial Sequence
  Synthetic
tataacgtaaccagaattgtaaaattagaggtatgggataaaataataccttctactatgcaattaccaaaaggc

SEQ ID NO: 349756 - DNA, 75 bp, Artificial Sequence
  Synthetic
tagagtaaacatttttatagtttctactggattcatacatcgtttacccaattcggttatgaatgaaattgtcgc

SEQ ID NO: 349757 - DNA, 75 bp, Artificial Sequence
  Synthetic
aaaaagcccatatatgttcgctattgtagaaattgtttttcatagttgctcaaaaacgatggcggtgacttatga

SEQ ID NO: 349758 - DNA, 75 bp, Artificial Sequence
  Synthetic
caatcttacacccaaccccttgttatccattagtatagtattaacttcgttatttatgtcataaactgtaaatga

SEQ ID NO: 349759 - DNA, 75 bp, Artificial Sequence
  Synthetic
tccattagtatagtattaacttcgttatttatgtcataaactgtaaatgattctgtagatgccatatcatacatg

SEQ ID NO: 349760 - DNA, 75 bp, Artificial Sequence
  Synthetic
atattcatgtccctattataatcattattaactttatcacaatacatgttgataatatctatatatgatctagtt

SEQ ID NO: 349761 - DNA, 75 bp, Artificial Sequence
  Synthetic
tttgtgggcaattgtctatacaagtcgtctaaacgttgtttactcatatagtattgaacagccatcattacatgg

SEQ ID NO: 349762 - DNA, 75 bp, Artificial Sequence
  Synthetic
tcccgttccgttgatagataatcgagtatgttagtggacttgttaaatctatataccatattttctggaagtgga

SEQ ID NO: 349763 - DNA, 75 bp, Artificial Sequence
  Synthetic
ataaacatcggcaacatactattgtacattatctaagtccggttgatccaaacccttgatctcctctatctgtac

SEQ ID NO: 349764 - DNA, 75 bp, Artificial Sequence
  Synthetic
tatctagagattgtacttctttcagttttggataatatatacgttgatagattagctgagctattctatcccccg

SEQ ID NO: 349765 - DNA, 75 bp, Artificial Sequence
  Synthetic
tatttacattaaatgtatattttccattattaataagaatgactcctatatttcccctataatcttcgtctatta

SEQ ID NO: 349766 - DNA, 75 bp, Artificial Sequence
  Synthetic
tcacaacatctataaaagtgaggatgtgatacattagtatgcggaaccaataacggaaatcccaaatgttggaaa

SEQ ID NO: 349767 - DNA, 75 bp, Artificial Sequence
  Synthetic
caccgcctcctatatcaatgccttttagggacagaccagacctaggagctattctaccatagcagaacttaggca

SEQ ID NO: 349768 - DNA, 75 bp, Artificial Sequence
  Synthetic
tggacatactaatatctgtcttaattaattgtctttctcctggagggatagtataatcataagcgctatataaat

SEQ ID NO: 349769 - DNA, 75 bp, Artificial Sequence
  Synthetic
catatccggcggcgtacggtgattgtctagtaggagatttagctctgttagtttccttaacaaatctaactggtg

SEQ ID NO: 349770 - DNA, 75 bp, Artificial Sequence
  Synthetic
agttaatattcatgttgaacataaaactaatattttatttcaaaattatttaccatcccatatattccatgaata

SEQ ID NO: 349771 - DNA, 75 bp, Artificial Sequence
  Synthetic
ctttggttagatgttttagaaaaaaaatatcgccgtaccgttcttgttttataaaaataacaattaacaattatc

SEQ ID NO: 349772 - DNA, 75 bp, Artificial Sequence
  Synthetic
agtgcgatgattgtacacttctatagtatctattacgaaccacgataaaatcctcctatcaatagcagtttatta

SEQ ID NO: 349773 - DNA, 75 bp, Artificial Sequence
  Synthetic
gtatctattacgaaccacgataaaatcctcctatcaatagcagtttattatccactattatcaattctggattat

SEQ ID NO: 349774 - DNA, 75 bp, Artificial Sequence
  Synthetic
tccactattatcaattctggattatcccttgataaatagtatcatctatcagagaccatgtattgctgtatttgt

SEQ ID NO: 349775 - DNA, 75 bp, Artificial Sequence
  Synthetic
aataaaatttagcatttctaccaaccaagaataaccttctaccgaacactaacgcgcatgatttataatgaggat

SEQ ID NO: 349776 - DNA, 75 bp, Artificial Sequence
  Synthetic
aataagttgacggtccaaactgccactgatcatgattgggtagcaaatattctgtagttgtatccgtttcagaat

SEQ ID NO: 349777 - DNA, 75 bp, Artificial Sequence
  Synthetic
gtcctcctattacgtacataacattgtttatggatgccattgctggattacatctaggtttcaaaagacttggca

SEQ ID NO: 349778 - DNA, 75 bp, Artificial Sequence
  Synthetic
tattaacccaagcagcattcccgtggaaccaacgctcaacagatgtgggatttggtagacctcctactacgtata

SEQ ID NO: 349779 - DNA, 75 bp, Artificial Sequence
  Synthetic
tttggtagacctcctactacgtataatttattgttagcgggtatcccgctagcatacagtttggggctattcatc

SEQ ID NO: 349780 - DNA, 75 bp, Artificial Sequence
  Synthetic
ggaggaattggaatccaattgtttgatatataatttaccgctatagcattgttatgtatttcattgttcatccat

SEQ ID NO: 349781 - DNA, 75 bp, Artificial Sequence
  Synthetic
caccgatgagatatactacttctccaacatgtgtacttgtacacatatggaatatatctataatttgatccatgt

SEQ ID NO: 349782 - DNA, 75 bp, Artificial Sequence
  Synthetic
tcataggatactttatgaatggatacctgtattatttgcgtggttgtttatcacaatgaaatattttggtacagt

SEQ ID NO: 349783 - DNA, 75 bp, Artificial Sequence
  Synthetic
ctaatatccattttacattatttatacctctgggtgaaagataatttgacctgattacatttttgataaggagta

SEQ ID NO: 349784 - DNA, 75 bp, Artificial Sequence
  Synthetic
ctgattacatttttgataaggagtagcaaatttcctaatttatttcttctcttcgtataccacttaatgacaaaa

SEQ ID NO: 349785 - DNA, 75 bp, Artificial Sequence
  Synthetic
tcaactacataatcttcgtctggaacatttaactcattgctttctagaataagtttcaagataaataatcaaaat

SEQ ID NO: 349786 - DNA, 75 bp, Artificial Sequence
  Synthetic
ggagatataggtgtagttttgcagtgaccgtcataatattatctatatgatgggtggatatgatcagtacccgta

SEQ ID NO: 349787 - DNA, 75 bp, Artificial Sequence
  Synthetic
tgtctatgatatcctcttccagttccaaaaagtgtttggcaataaagtctttagtatgacataagagattggata

SEQ ID NO: 349788 - DNA, 75 bp, Artificial Sequence
  Synthetic
ctgaagagggagccgataactttatagattatataaaggtacaaacaggatatcgtcaaacttacgggtacgatt

SEQ ID NO: 349789 - DNA, 75 bp, Artificial Sequence
  Synthetic
gtccgtattctatacccattatgtaacactcgacacaatattcctttctaaaatctcgtagtataaagtttatac

SEQ ID NO: 349790 - DNA, 75 bp, Artificial Sequence
  Synthetic
aagtgtagatgataaattctacagacgttaatatagacacgcgtaataaattgatgacgtcatgtctattatgta

SEQ ID NO: 349791 - DNA, 75 bp, Artificial Sequence
  Synthetic
ttgatctttattttttgtgtatttttgacgtaaatgtgtgcgaaaatacggagataactttttcaatattgtaga

SEQ ID NO: 349792 - DNA, 75 bp, Artificial Sequence
  Synthetic
attgactattatattgcctccatagcattaataattgttttgaatttcttagtcatagacaatgctaatatattc

SEQ ID NO: 349793 - DNA, 75 bp, Artificial Sequence
  Synthetic
ttacagtacatagtattgacaaatatcggcatttatgtttctttaaaagtcaacatctaaagaaaaatgattgtc

SEQ ID NO: 349794 - DNA, 75 bp, Artificial Sequence
  Synthetic
ttcttgagacataactcccattttttggtattcacccacacgtttttcgaaaaaattagttttaccttctaatga

SEQ ID NO: 349795 - DNA, 75 bp, Artificial Sequence
  Synthetic
tggtattcacccacacgtttttcgaaaaaattagttttaccttctaatgatatattttccatgaaatcgaatgga

SEQ ID NO: 349796 - DNA, 75 bp, Artificial Sequence
  Synthetic
tatattttccatgaaatcgaatggattggtaacattataaatttttttaaatcccaattcagaaatcaatctatc

SEQ ID NO: 349797 - DNA, 75 bp, Artificial Sequence
  Synthetic
ttggtaacattataaatttttttaaatcccaattcagaaatcaatctatctgcgacaaattttatatatgttttc

SEQ ID NO: 349798 - DNA, 75 bp, Artificial Sequence
  Synthetic
tcaacgtcttccaataaaaatgtccaatatgtcgacgattgttcataccgcaaaatttatatatcaggaggctac

SEQ ID NO: 349799 - DNA, 75 bp, Artificial Sequence
  Synthetic
atcatttcgcaattcattcctataagtttaactggaagagccacagtaagaaattcttgttcaatagagaccgcg

SEQ ID NO: 349800 - DNA, 75 bp, Artificial Sequence
  Synthetic
tctgttataatagatcttactgtttcttcactcggtggatacaataaatgtttaaacatcaaacatgcgaaatcg

SEQ ID NO: 349801 - DNA, 75 bp, Artificial Sequence
  Synthetic
cagtgtagaccctcgtctctactaattaattcgttggaaaacgtgagtccgggcattaggccacgctttttaagc

SEQ ID NO: 349802 - DNA, 75 bp, Artificial Sequence
  Synthetic
caaaatatggacgcaaatgatccagaaaagaaaattccttctactgccgcaaaggcaataagtctttctccataa

SEQ ID NO: 349803 - DNA, 75 bp, Artificial Sequence
  Synthetic
ccggcgctgtcatgtatccacttttgagcccaatcggccttcttttttacacaaggcattgtctctatagcatta

SEQ ID NO: 349804 - DNA, 75 bp, Artificial Sequence
  Synthetic
gtgtattacatgcatcttattagaatattaacctaactaaaagacataatataaaaacttattacatagttgata

SEQ ID NO: 349805 - DNA, 75 bp, Artificial Sequence
  Synthetic
aagagatagtttttttcattactatctttaacatatgtatcaatcaaaagactatacatttccgaatgaatgttt

SEQ ID NO: 349806 - DNA, 75 bp, Artificial Sequence
  Synthetic
tcaatggccatttgaaatccgtagaaacatctagcctcggtaatctgtacttctatacaaaatcgttctgctaaa

SEQ ID NO: 349807 - DNA, 75 bp, Artificial Sequence
  Synthetic
ttttcattcactattccgtcactggctgcaaaaaacgccaatacatgttttataaaatatttttcgtctggtgtt

SEQ ID NO: 349808 - DNA, 75 bp, Artificial Sequence
  Synthetic
agtttattccaatcattgatatctttagatatatccacttcttccactgtccaaaatgatgcctctgccttttta

SEQ ID NO: 349809 - DNA, 75 bp, Artificial Sequence
  Synthetic
tacatattccagatgtcatgatattgaattggaaaaataacaaatctatttggattttttgcaaggattggttcc

SEQ ID NO: 349810 - DNA, 75 bp, Artificial Sequence
  Synthetic
tctaggatctgatttggaagcgtatttcatgtgtaagttacaggaacttaattgtgacgcgagtattctcttgaa

SEQ ID NO: 349811 - DNA, 75 bp, Artificial Sequence
  Synthetic
ttttttttcagttatcatctatatgactgtatttggatcttttgtacatcgctattatcgcaatcactacaataa

SEQ ID NO: 349812 - DNA, 75 bp, Artificial Sequence
  Synthetic
ttataattattattgatagcattgttattagcactatcataattaaattattgatattcatgggtgcggaataat

SEQ ID NO: 349813 - DNA, 75 bp, Artificial Sequence
  Synthetic
cgttattatcatcattatcattttgtaattgtgacatcatactagataaatcgtttgcgcgattgttgtgggaag

SEQ ID NO: 349814 - DNA, 75 bp, Artificial Sequence
  Synthetic
cgggcatggaggatgaattatcgttattattatttaaagcctcccattcggattcacaaatatgacgcgcgttca

SEQ ID NO: 349815 - DNA, 75 bp, Artificial Sequence
  Synthetic
acattttatggaaactataattttgtgaaaacaggtaacaagaaaactcgtcatcgttatttttaacgatagtaa

SEQ ID NO: 349816 - DNA, 75 bp, Artificial Sequence
  Synthetic
tgaaaacaggtaacaagaaaactcgtcatcgttatttttaacgatagtaaaccgattaaacgtcgcgctaatttc

SEQ ID NO: 349817 - DNA, 75 bp, Artificial Sequence
  Synthetic
taacgctagcgactctattggatatggatttccagatatatatcttttcagctcccctacgtatctataatcatc

SEQ ID NO: 349818 - DNA, 75 bp, Artificial Sequence
  Synthetic
ttattagaggtaatgatgttatctttgttcttaagactataggtgtcccgtcaacatgcagacaaaatgaagatc

SEQ ID NO: 349819 - DNA, 75 bp, Artificial Sequence
  Synthetic
tgtgggaaatggaaggtatttccatctatctagtgttcctaatatcatatgtagtggtgtaatagaaccattaag

SEQ ID NO: 349820 - DNA, 75 bp, Artificial Sequence
  Synthetic
cgcgaaagattttatttcacatcgtattttaacttcgcaataatttctggttagataacacactctaccagttaa

SEQ ID NO: 349821 - DNA, 75 bp, Artificial Sequence
  Synthetic
gagatcgacgtttggcaatggcaatgtattaagattaactccataatgtctagcagcatccgcgatggcataagt

SEQ ID NO: 349822 - DNA, 75 bp, Artificial Sequence
  Synthetic
gtcaataatattagcctttacagatatattcatagtagttgtgacaatgactccatcttttagatgcgatactcc

SEQ ID NO: 349823 - DNA, 75 bp, Artificial Sequence
  Synthetic
tttatatgagccagaatcttcgtacctcaaactcgatatattcaaacaagttaatgagatattaacgcgttttat

SEQ ID NO: 349824 - DNA, 75 bp, Artificial Sequence
  Synthetic
gaacgatgatatgtatccagaagttctatcctccgtggctaacgctataaccttattattatagtaccaaagagt

SEQ ID NO: 349825 - DNA, 75 bp, Artificial Sequence
  Synthetic
gtgattaatgtgtgacacattagcgcatgtacatatttgtacattattgtctacgtcgtattcgacacatccaca

SEQ ID NO: 349826 - DNA, 75 bp, Artificial Sequence
  Synthetic
tacagccaacaaatataaaatgataaatgctctaatggtgttcgtacccatcttaatgcggcttaataaatgttt

SEQ ID NO: 349827 - DNA, 75 bp, Artificial Sequence
  Synthetic
cgatttcaatttattgtaaaaaagaatcggttttatactgttcgagattctcattgattatattctcatctatca

SEQ ID NO: 349828 - DNA, 75 bp, Artificial Sequence
  Synthetic
tcattgattatattctcatctatcatctccacacagtcaaatccgtggttagcatatacctcattaaccgataat

SEQ ID NO: 349829 - DNA, 75 bp, Artificial Sequence
  Synthetic
agactatcagactcttctatcgttataactcgagaatatttaatttggtcattcttaatcaagtcaattatctta

SEQ ID NO: 349830 - DNA, 75 bp, Artificial Sequence
  Synthetic
attcttaatcaagtcaattatcttatttttaacaaatgtgagtattttactcattttttataaaaaacttttaga

SEQ ID NO: 349831 - DNA, 75 bp, Artificial Sequence
  Synthetic
aatatacagactctatcgcgtgtctatatcttctttttatatccaatgtatttatatctgatttttcttcattta

SEQ ID NO: 349832 - DNA, 75 bp, Artificial Sequence
  Synthetic
ttatatataatggtccaaattctatacgtgttgcttcatccagatcattaaggttcttataatcgcaatatcctt

SEQ ID NO: 349833 - DNA, 75 bp, Artificial Sequence
  Synthetic
ctccttcctcttctatatcgtccttcttaaacttattcttagcgtcacagaatcgaccacagcaggatcccatga

SEQ ID NO: 349834 - DNA, 75 bp, Artificial Sequence
  Synthetic
gactattaaaataaatattcttcataaccggtaagaatagtaaaaagactaaatcttcacattgtaactattcag

SEQ ID NO: 349835 - DNA, 75 bp, Artificial Sequence
  Synthetic
taaaaaatagaaaaaacatgtggtattagtgcaggtcgttatttctcccattgcaattggtaagatgacggccaa

SEQ ID NO: 349836 - DNA, 75 bp, Artificial Sequence
  Synthetic
tagtgtttacataaatgagatgagaagatattctctattttggtggaggattatatgatataattcgtggataat

SEQ ID NO: 349837 - DNA, 75 bp, Artificial Sequence
  Synthetic
ggtgtgtactttaaattttgagattaaatgtaataacaaaggttcttccttcaaacagctaacgaaagaaaagaa

SEQ ID NO: 349838 - DNA, 75 bp, Artificial Sequence
  Synthetic
cattcttaagacacatttcttcattcgtaaatcttttcacgttaaatgagtgtccatattttgcaatttcttcat

SEQ ID NO: 349839 - DNA, 75 bp, Artificial Sequence
  Synthetic
aggatggcggtgtacgtggacggtgctgttcctgttcttgttgtggtctccgactttcgtgtttgcgtttagatc

SEQ ID NO: 349840 - DNA, 75 bp, Artificial Sequence
  Synthetic
cctccattatcgcgattgtatagatgaggtactattttataccttgtaattaaatttttttattaattaattaat

SEQ ID NO: 349841 - DNA, 75 bp, Artificial Sequence
  Synthetic
tagttagataaattaataatacataagttttaatacattaatattatattatactattttatttagtgtctagaa

SEQ ID NO: 349842 - DNA, 75 bp, Artificial Sequence
  Synthetic
tgtatttaagagctagatttcgtctaatagaacaaatagctacagtaaaaataactagaataatcgctacaccca

SEQ ID NO: 349843 - DNA, 75 bp, Artificial Sequence
  Synthetic
ctagaaaccacggttcgtaatacggcaatcggttttcgataataggtggaacgtatattttatttaaggacttaa

SEQ ID NO: 349844 - DNA, 75 bp, Artificial Sequence
  Synthetic
gaattgtctgtaaaccacaatttgctcccgccgatcctgtattaactatctgtaaaagcatatgttggccgggcg

SEQ ID NO: 349845 - DNA, 75 bp, Artificial Sequence
  Synthetic
gagccgaacattctccgatattcaatttttgtatatctataatgttattaacctccgcatacgcattacagtttt

SEQ ID NO: 349846 - DNA, 75 bp, Artificial Sequence
  Synthetic
agagaaagagataaaactttttacgactccatcagaaagaggtttaatatttttgtgagaccatcgaagagagaa

SEQ ID NO: 349847 - DNA, 75 bp, Artificial Sequence
  Synthetic
tttctagcttggatacggcactaggtacatcatttagatctattcctatttcctcagcgatagctcttctatcct

SEQ ID NO: 349848 - DNA, 75 bp, Artificial Sequence
  Synthetic
tttccggaagcaatgaaatcacttcaataaatgattcaaccatgagtgtgaaactaagtctagtattactcatgc

SEQ ID NO: 349849 - DNA, 75 bp, Artificial Sequence
  Synthetic
atttgttagttattcggagcgcgcaatttttaaactgtcctataacctctcctatatgaatagcacaagtgacat

SEQ ID NO: 349850 - DNA, 75 bp, Artificial Sequence
  Synthetic
tagtagggatagaatgttgagctaatttttgtaaataactatctataaaaagattatacaaagttttaaactctt

SEQ ID NO: 349851 - DNA, 75 bp, Artificial Sequence
  Synthetic
tattatatgattttaacgtgtaaattataaacattattttatgatatacaattgtttggtaacctagttgggaca

SEQ ID NO: 349852 - DNA, 75 bp, Artificial Sequence
  Synthetic
tagtttctgccatttatccagtctgagaaaatgtccctcataataaatttttccaagaaactaattgggtgaaga

SEQ ID NO: 349853 - DNA, 75 bp, Artificial Sequence
  Synthetic
atggaaacctttaatctatatttatcacagtctgttttggtacacatgatgaattcttctaatgctgtactaaat

SEQ ID NO: 349854 - DNA, 75 bp, Artificial Sequence
  Synthetic
ctttgccacaatccatagctattttggtgctaattattcctatattatattcacaaaaatgatgaaggcaatcat

SEQ ID NO: 349855 - DNA, 75 bp, Artificial Sequence
  Synthetic
tcaatatctttttcgatttctggatatgtttttaataaagtatgaacaaagaaatggaaatcgtaataccagtta

SEQ ID NO: 349856 - DNA, 75 bp, Artificial Sequence
  Synthetic
gatggagtcgtaaaaagttttatctctttctctcttcgatggtctcacaaaaatattaaacctctttctgatgga

SEQ ID NO: 349857 - DNA, 75 bp, Artificial Sequence
  Synthetic
tatatatatatatatatatatgggagtaaagcatataacgtaaccagaattgtaaaattagaggtatgggataaa

SEQ ID NO: 349858 - DNA, 75 bp, Artificial Sequence
  Synthetic
tgttcaactttgaaattgttttttattttcttgttaatgattccagccacttgggaaaagtcaaagtcgtttaat

SEQ ID NO: 349859 - DNA, 75 bp, Artificial Sequence
  Synthetic
tgtaaaattagaggtatgggataaaataataccttctactatgcaattaccaaaaggccttgtaacttcactagg

SEQ ID NO: 349860 - DNA, 75 bp, Artificial Sequence
  Synthetic
tcgttcagaatcttttgcagcataagtagtatgtcgatatacttatcgttgaagactcttccagagaccggttga

SEQ ID NO: 349861 - DNA, 75 bp, Artificial Sequence
  Synthetic
gccgatttaatacgttcattaaaaacaaactttttatcctttagatgaattattattggttcattggaatcaaaa

SEQ ID NO: 349862 - DNA, 75 bp, Artificial Sequence
  Synthetic
ggacatcaacgccttagaaataagagacttaaacaacggacacctggaattattaccatagaagatgttagaaaa

SEQ ID NO: 349863 - DNA, 75 bp, Artificial Sequence
  Synthetic
atatatatatatatatatatgggagtaaagcatataacgtaaccagaattgtaaaattagaggtatgggataaaa

SEQ ID NO: 349864 - DNA, 75 bp, Artificial Sequence
  Synthetic
agtaagatattatcgggtttaagatctgcgtgtaaaaagttgtcgcaacagggtagttcgtagattttaatgtat

SEQ ID NO: 349865 - DNA, 75 bp, Artificial Sequence
  Synthetic
gtatctactttatctgccgaatacagtgctaggggaaaaattataatatttcctctttcgtattcgtagttagtt

SEQ ID NO: 349866 - DNA, 75 bp, Artificial Sequence
  Synthetic
cgcttttcatgttcgaaaaagtgaaacatgcggttaaaatagtttataacattaatattactgttaataactgcc

SEQ ID NO: 349867 - DNA, 75 bp, Artificial Sequence
  Synthetic
ggataaaagtgggatagtaatttcacgaatttgatactgtcctttctctcgttaaacgcctttagaaaaacttta

SEQ ID NO: 349868 - DNA, 75 bp, Artificial Sequence
  Synthetic
gaagaatatctcaatgagagttcctgaccgtccatagtttgtatcaataatagtaacatattaagaacccgttta

SEQ ID NO: 349869 - DNA, 75 bp, Artificial Sequence
  Synthetic
tacagtgtatgtaaaaatgttaatttatagtttaatcccatggccaatgcacacacgattaattttttttcgtct

SEQ ID NO: 349870 - DNA, 75 bp, Artificial Sequence
  Synthetic
ccctttagattgttgtatagaaattttggtaccgtgaactccgccgtagtttccatgggactatataattttgtg

SEQ ID NO: 349871 - DNA, 75 bp, Artificial Sequence
  Synthetic
gcctcgaatacaaattttactacatagttatctatcttaaagactataccatatcctcctgtagatatgtgataa

SEQ ID NO: 349872 - DNA, 75 bp, Artificial Sequence
  Synthetic
aaatcgtcgtttataggataaaatcgtttatctttttgttggaaaaatgatgaattaatgtaatcattctcttct

SEQ ID NO: 349873 - DNA, 75 bp, Artificial Sequence
  Synthetic
atctttagtagtgtttccctattaaaattcttaaaataatttaacaatctaactgacggagcccaattttggtgt

SEQ ID NO: 349874 - DNA, 75 bp, Artificial Sequence
  Synthetic
aaatctaattgtgacattatgttgttaaaatataaacagtctcctaatataacagtatcagataatctatgtgga

SEQ ID NO: 349875 - DNA, 75 bp, Artificial Sequence
  Synthetic
gacatccattgatattcaggggatgaatcattggcaacacccatttattgtacaaaaagccccaatttacaaata

SEQ ID NO: 349876 - DNA, 75 bp, Artificial Sequence
  Synthetic
ttgtgatgcttaaaatgctcaattacgtggattataacatcatattccggcgtatgaattgacatttctcccttt

SEQ ID NO: 349877 - DNA, 75 bp, Artificial Sequence
  Synthetic
aaagtccaggtttgatagagacaaactattaactatcgtgtctctgtttttaacacctccacagtttttaatttc

SEQ ID NO: 349878 - DNA, 75 bp, Artificial Sequence
  Synthetic
tttggtaataaaattattcactatatcagtatcttctttatctaccagagattttactaacttgataaccttggc

SEQ ID NO: 349879 - DNA, 75 bp, Artificial Sequence
  Synthetic
tgtctcattcaatagggtagtgatatttgtatgagtgatattgatatctttttgaattgtttcttttagaagtga

SEQ ID NO: 349880 - DNA, 75 bp, Artificial Sequence
  Synthetic
ttctttgatggtgttagcatacaaattacaataatgcagaaactcagttaacatacaggaattatagtaagccaa

SEQ ID NO: 349881 - DNA, 75 bp, Artificial Sequence
  Synthetic
tcaatacaaccaaattcttggacgatctattagaaaattctcttacgccgatatttctgaacccgttaatgtata

SEQ ID NO: 349882 - DNA, 75 bp, Artificial Sequence
  Synthetic
ttccaattgctgtccgtattgtattagagtatcgatatgagtaatggtgtccttgcgtttttctgatagaatgcg

SEQ ID NO: 349883 - DNA, 75 bp, Artificial Sequence
  Synthetic
agcagcgattttggcgttatcatttgatgatatgtttggaatgacgaatcctgtttctactaactttttggtagg

SEQ ID NO: 349884 - DNA, 75 bp, Artificial Sequence
  Synthetic
acaaagtgaaacaatcaagaagatagcttctcctcctatttgtagaagaaattgaactcctctagatgatctact

SEQ ID NO: 349885 - DNA, 75 bp, Artificial Sequence
  Synthetic
gacgatagtatctccttgacagatattggtccgaattacagaagtacctggaatgtaaagccctgaaaccccctc

SEQ ID NO: 349886 - DNA, 75 bp, Artificial Sequence
  Synthetic
acgtaaccagaattgtaaaattagaggtatgggataaaataataccttctactatgcaattaccaaaaggccttg

SEQ ID NO: 349887 - DNA, 75 bp, Artificial Sequence
  Synthetic
attttttaagcagattgttgccgtaaatcctgcactatgtccaagatagagagctcctttggtgaatccatctct

SEQ ID NO: 349888 - DNA, 75 bp, Artificial Sequence
  Synthetic
atgtttcagtttaaccaagaaacagtcagctggtctaaaatttccatctctatctaatacagcatccaacttgat

SEQ ID NO: 349889 - DNA, 75 bp, Artificial Sequence
  Synthetic
gtcaggaactatgaccggtttaatgttatatgtaacattgagtaaatccttaagttcataatcatcactgtcatc

SEQ ID NO: 349890 - DNA, 75 bp, Artificial Sequence
  Synthetic
tatttttatgagtatttttacaaaaaatgtataaagtgtatgtcttatgtatatttataaaaatgctaaatgtga

SEQ ID NO: 349891 - DNA, 75 bp, Artificial Sequence
  Synthetic
agttatgtacgatccaaacaatgtttctaccgacatagtggatacgaagatactatccatcagaatgtttccctg

SEQ ID NO: 349892 - DNA, 75 bp, Artificial Sequence
  Synthetic
attagtattttctatatagctattcttctttaaacgattttccaaattagtaactatgttcatttttttaggagt

SEQ ID NO: 349893 - DNA, 75 bp, Artificial Sequence
  Synthetic
atgacgcctagccagcatggaagagaattttctagatcctctcttcaacatctttaatctcaatgggatgcaaaa

SEQ ID NO: 349894 - DNA, 75 bp, Artificial Sequence
  Synthetic
ccccatggtgtaacaactaacgataaaaataatattgtttttcactttttataattttaccatttgactcatgac

SEQ ID NO: 349895 - DNA, 75 bp, Artificial Sequence
  Synthetic
ttcattgatatctttatacgagctacgaatatataattctttataactgaactgagatatatacactggatctat

SEQ ID NO: 349896 - DNA, 75 bp, Artificial Sequence
  Synthetic
cattacgacgtttatcgatttcagctcggagatcgtcatcgcgttgttttagccacatacgactaagttcaagtt

SEQ ID NO: 349897 - DNA, 75 bp, Artificial Sequence
  Synthetic
ggtttccataattgagtaaataaatgctctgcaataactaatggcaaatgtataaaacaacaaaattatactaga

SEQ ID NO: 349898 - DNA, 75 bp, Artificial Sequence
  Synthetic
ctccttgacaagatccatctacttttccatccctaatagtatccagttccttttctagttctgaacgcatttctc

SEQ ID NO: 349899 - DNA, 75 bp, Artificial Sequence
  Synthetic
gttgttaaagttaatattttctattagttgttccaataaattatttgttgtgactgtgttcaagtcataaatcat

SEQ ID NO: 349900 - DNA, 75 bp, Artificial Sequence
  Synthetic
tttgatactatccaataaacagtctttaagttctggaatattatcatcccattgtaaagcccctaattcgactat

SEQ ID NO: 349901 - DNA, 75 bp, Artificial Sequence
  Synthetic
cgaataccctgctctggtagccgtttcaatatcgacggacgtcaatactgtaataaaggtggtagtattgtcatc

SEQ ID NO: 349902 - DNA, 75 bp, Artificial Sequence
  Synthetic
atcatgatacacaacaggaatatggtcgttagtaggtacggtgactttacacaacgcgatatataactttccttt

SEQ ID NO: 349903 - DNA, 75 bp, Artificial Sequence
  Synthetic
tgtgccatttttaacgtagttgggacgtcctgcagggtattgttttgaagaaatgatatcgagaacagatttgat

SEQ ID NO: 349904 - DNA, 75 bp, Artificial Sequence
  Synthetic
acgatatttgttggatttctgattattcactataatataatctagacagatagatgattcgataaataaagaaga

SEQ ID NO: 349905 - DNA, 75 bp, Artificial Sequence
  Synthetic
tatatcgttggtaggataatacatccccattccagtattcttggatactctattgatgacactagttaagaacat

SEQ ID NO: 349906 - DNA, 75 bp, Artificial Sequence
  Synthetic
gtcttcaattctagaaaacgaaaacatcctacacggactcattaaaacttctagcgctcctgattgtgtctcaaa

SEQ ID NO: 349907 - DNA, 75 bp, Artificial Sequence
  Synthetic
tgcctcatacaatgatttcaaggatgtcatagattctttaacccacgatttaatattgcgtttagcatctatttt

SEQ ID NO: 349908 - DNA, 75 bp, Artificial Sequence
  Synthetic
ttgattacattctcattaattaaccattccaagtcactatgtgtaagaagattatattctatcataagcttgact

SEQ ID NO: 349909 - DNA, 75 bp, Artificial Sequence
  Synthetic
ttttattaaatcgaatggtcggctctctggtttgctaccccaatgataacaatagtcttgtaaagataaaccgca

SEQ ID NO: 349910 - DNA, 75 bp, Artificial Sequence
  Synthetic
agaaaatttatacgcatccatccaaataactcttgcaccatcagatgatatcagtatattattatagattttcca

SEQ ID NO: 349911 - DNA, 75 bp, Artificial Sequence
  Synthetic
tccacaattattgggccagtatactgttagcaacggtatatcgaatagattactcatgtaacctactagaatgat

SEQ ID NO: 349912 - DNA, 75 bp, Artificial Sequence
  Synthetic
agttcgtgtactagtcataatatctttaatccaatctaagaaatttaaaattagatcttttacactgttaaagtt

SEQ ID NO: 349913 - DNA, 75 bp, Artificial Sequence
  Synthetic
aacaaaggtattacccgggtacgtggatatcatatatggcattggtccattatcagtaatagctccataaactga

SEQ ID NO: 349914 - DNA, 75 bp, Artificial Sequence
  Synthetic
tgatctaacgaggaagaaattcgcgcccataattcatctctagatatgtatttaatatcaaacggtaacacatca

SEQ ID NO: 349915 - DNA, 75 bp, Artificial Sequence
  Synthetic
atttcgggacgcgtatatgtttctaaatttttaatccaaatataatgatgacctatatgccctattatcatactg

SEQ ID NO: 349916 - DNA, 75 bp, Artificial Sequence
  Synthetic
tcaactatagtacacttagagaacttacgatacatctgtttcctataatcgttaaattttacaaatctataacat

SEQ ID NO: 349917 - DNA, 75 bp, Artificial Sequence
  Synthetic
gctaaaccttttgacgacaaccattcattaatttctgatatggaatctgtattctcgatacagtatcgttttaaa

SEQ ID NO: 349918 - DNA, 75 bp, Artificial Sequence
  Synthetic
gccagtgctatatctccctgttcgtgagaacgctttcgtataatatcaatcaacggataatctgaggtttttgga

SEQ ID NO: 349919 - DNA, 75 bp, Artificial Sequence
  Synthetic
gaataatatgactcatgatctatttcgtccataaacaatctagacataggaattggaggcgatgatcttaatttt

SEQ ID NO: 349920 - DNA, 75 bp, Artificial Sequence
  Synthetic
gtgcaatgagtagttaatcctataacttctaatcttgtaatattcatcatcgacataatactatctatgttatca

SEQ ID NO: 349921 - DNA, 75 bp, Artificial Sequence
  Synthetic
tcgtatattagtataccatgaccttcttcatttcgtgccaaaatgatatacagtcttaaatagttacgcaatatc

SEQ ID NO: 349922 - DNA, 75 bp, Artificial Sequence
  Synthetic
tatcttcgtaaaaagattcttgaaactttttagaatatctatcgactttagatgaaatagcgttcgtcaacatac

SEQ ID NO: 349923 - DNA, 75 bp, Artificial Sequence
  Synthetic
aaaatattttacttaggagttagaatttatagacgaccatttagtttattactattactagcattattggtattc

SEQ ID NO: 349924 - DNA, 75 bp, Artificial Sequence
  Synthetic
tcaatagtttcataattgttagctgttttcattaagatttgtaccctgtttaacatgatggcgttctatacgtct

SEQ ID NO: 349925 - DNA, 75 bp, Artificial Sequence
  Synthetic
ggtgtaatagaatttatatatctattacaccggccaagtatgcataataataagttgtgggtagtatcatccaca

SEQ ID NO: 349926 - DNA, 75 bp, Artificial Sequence
  Synthetic
cttcatttcgtgccaaaatgatatacagtcttaaatagttacgcaatatctcaatagtttcataattgttagctg

SEQ ID NO: 349927 - DNA, 75 bp, Artificial Sequence
  Synthetic
ggatacgcatctctaactactattggcacgatcgctggaggtgtttgtttgttattatctgttgatgcatctagt

SEQ ID NO: 349928 - DNA, 75 bp, Artificial Sequence
  Synthetic
aatttttaacgatttactgtggctagatacccaatctctctcaaatatttttttagcctcgcttacaagctgttt

SEQ ID NO: 349929 - DNA, 75 bp, Artificial Sequence
  Synthetic
atctatactattaaaactaacaaatccgtgattttggtaatgggttccgtcaaaatttgccgacgtgatatgaac

SEQ ID NO: 349930 - DNA, 75 bp, Artificial Sequence
  Synthetic
atattcatcgtcgactatcaacaattttgtattattctgaatagtgaaaaccttcacagatagatcattttgaac

SEQ ID NO: 349931 - DNA, 75 bp, Artificial Sequence
  Synthetic
tttgtattattctgaatagtgaaaaccttcacagatagatcattttgaacacacaacgcatctagacttctggcg

SEQ ID NO: 349932 - DNA, 75 bp, Artificial Sequence
  Synthetic
gttgccatagaatatacgtcgttcttatcccaattaccaactaaaagtctgatcttaactcctctattaatggct

SEQ ID NO: 349933 - DNA, 75 bp, Artificial Sequence
  Synthetic
gcttctataatggagttgtaaatgtcgggccaatagtagctattaccatcgacacgtgtagtgggaactattgcc

SEQ ID NO: 349934 - DNA, 75 bp, Artificial Sequence
  Synthetic
aaatgttcaatatctatactagttttagctgacctaagtttatcaataactacatcggtatctagatctctagaa

SEQ ID NO: 349935 - DNA, 75 bp, Artificial Sequence
  Synthetic
tatcccaataggtgttccggagaatcagtaaagaacactccacctataggattcttaatatgatacgcagtgcta

SEQ ID NO: 349936 - DNA, 75 bp, Artificial Sequence
  Synthetic
actggcagacaacaagccgaagagtataaattcaaccatgaattttttacgctattaaaggctttaaaagtatca

SEQ ID NO: 349937 - DNA, 75 bp, Artificial Sequence
  Synthetic
aatcttctacgaagatctgtggccagtggtggataatcagaatatacacctaacgttttaattgtatgtatagat

SEQ ID NO: 349938 - DNA, 75 bp, Artificial Sequence
  Synthetic
cctccagtaaatgacgcgtttcctacataacatctttcatcatctgatacccaaaaacatccaagtagtagtcct

SEQ ID NO: 349939 - DNA, 75 bp, Artificial Sequence
  Synthetic
acgttattttttttatcaatattaacggttataaaatttatatccgggcagtgactttgtagctctcccagattt

SEQ ID NO: 349940 - DNA, 75 bp, Artificial Sequence
  Synthetic
cttttccctcgttcatctagcaaaactattattttaatccctttttcagatgcctcttttagtttatcaaaaata

SEQ ID NO: 349941 - DNA, 75 bp, Artificial Sequence
  Synthetic
agcgctcccctagtcgtactcagaggattacaacaaaaagatgctatgtatatatatttcttagctagagtgata

SEQ ID NO: 349942 - DNA, 75 bp, Artificial Sequence
  Synthetic
atttcgttaaaacattcaaatgttgtcaaatgatcggatctaaaatccatattttctggtagtgtttctaccagt

SEQ ID NO: 349943 - DNA, 75 bp, Artificial Sequence
  Synthetic
ctacattttgctcccgcaggtgctgatgtaaatggccacatttagttaacaaaaaaaatttacatatcctgttcc

SEQ ID NO: 349944 - DNA, 75 bp, Artificial Sequence
  Synthetic
atcaacgattctagaacgtcatcggttatatcgctaaaatcttcatcaaagtcgacatcacaacctagctcagtc

SEQ ID NO: 349945 - DNA, 75 bp, Artificial Sequence
  Synthetic
aatatattaagaagttccgtgatattatcttcatcgatttctatatccatatcggatgtagataattgactgatt

SEQ ID NO: 349946 - DNA, 75 bp, Artificial Sequence
  Synthetic
tttcatggtaatatcggtagcgtatttaagttggtagatttttcaattatgcatcaatatagcaacagtagttct

SEQ ID NO: 349947 - DNA, 75 bp, Artificial Sequence
  Synthetic
tgctcctccttaattctagcatcttcttcattattttcttctacatacataagcatctccaatacgttagacagc

SEQ ID NO: 349948 - DNA, 75 bp, Artificial Sequence
  Synthetic
acaccgatgatggcggccgccacagacacgaatatgactagactgatgaccatttaaaaaaacactctagctttc

SEQ ID NO: 349949 - DNA, 75 bp, Artificial Sequence
  Synthetic
acttaaactgtatcgatcattcttttagcacatgtataatataaaaacattattctatttcgaatttaggcttcc

SEQ ID NO: 349950 - DNA, 75 bp, Artificial Sequence
  Synthetic
gcgtattcacccggatcacgattttgtctttcaggaaagctatcgaatgtaaacgtagtagccatacgtcgcaga

SEQ ID NO: 349951 - DNA, 75 bp, Artificial Sequence
  Synthetic
aaaaatttttcatccgtaaaccgataataatatatatagacttgttaatagttggaataaatagattaatgctta

SEQ ID NO: 349952 - DNA, 75 bp, Artificial Sequence
  Synthetic
aactatcatcatctccacgattagagatacaatatttacattctttttgctgtttcgaaactttatcaatacacg

SEQ ID NO: 349953 - DNA, 75 bp, Artificial Sequence
  Synthetic
ttaatacaaacccaggaaggagatattgaaactgaggctgttgaaaatgaaacggtgaatacaatagttcagata

SEQ ID NO: 349954 - DNA, 75 bp, Artificial Sequence
  Synthetic
atgtaaaatcatgattccgtattctgatgatattagaactactaatggatgtcaatggtatgtatctaggagtat

SEQ ID NO: 349955 - DNA, 75 bp, Artificial Sequence
  Synthetic
ctattttaacaaagcatctatttgctaatatacaattatccttttgattaattgttattttattcatattcttaa

SEQ ID NO: 349956 - DNA, 75 bp, Artificial Sequence
  Synthetic
aaggtttcatatttatcaattcttctacattaaaaatttccatttttaatttatgtagcccgcaatactcctcat

SEQ ID NO: 349957 - DNA, 75 bp, Artificial Sequence
  Synthetic
tacgtttcattttttgtctataatatccattttgtttatctcagtacatagattatccaattgagaagcacattt

SEQ ID NO: 349958 - DNA, 75 bp, Artificial Sequence
  Synthetic
agtagttttgtacattttaagtttattgacgaatcgtcgaaaactagttatagttaacattttattatttgatac

SEQ ID NO: 349959 - DNA, 75 bp, Artificial Sequence
  Synthetic
cctgatattaatacccctaccgttactattatttataactgatgtaacccacgtaacattagaattaattatcga

SEQ ID NO: 349960 - DNA, 75 bp, Artificial Sequence
  Synthetic
tagtaatgcattcacgcttccaaaattgtctattataaactcaccaataatttttttattgcatgttttcatatt

SEQ ID NO: 349961 - DNA, 75 bp, Artificial Sequence
  Synthetic
cattaggattatcaaatctttaatcttattacgattgtatgcgttaatattacaagacgtcattctaaaagacgg

SEQ ID NO: 349962 - DNA, 75 bp, Artificial Sequence
  Synthetic
gttttgttctattgcgcatcatagattcatatagaacacccgtagaaatactaatttgttttactttataaaata

SEQ ID NO: 349963 - DNA, 75 bp, Artificial Sequence
  Synthetic
ctaatgcatctatttcatcgttttgtataacgtctttccaagtggcaaattccaaatttttttcattgatagtac

SEQ ID NO: 349964 - DNA, 75 bp, Artificial Sequence
  Synthetic
caaattcttctatctctttaactatttgcatagataggtaattacagtgatgtctacatgccgttttttgaaact

SEQ ID NO: 349965 - DNA, 75 bp, Artificial Sequence
  Synthetic
gaatagatgcatctaaaagcgatgctacgctagtcacgatcaccactttcatatttagaatatatgtatgtaaaa

SEQ ID NO: 349966 - DNA, 75 bp, Artificial Sequence
  Synthetic
tacgctagtcacgatcaccactttcatatttagaatatatgtatgtaaaaatatagtagaatttcattttgtttt

SEQ ID NO: 349967 - DNA, 75 bp, Artificial Sequence
  Synthetic
tttctatgctataaatgaattctcattttgcatctgcccatactccgttttatatcaataccaaagaaggaagat

SEQ ID NO: 349968 - DNA, 75 bp, Artificial Sequence
  Synthetic
atctggttctaaaagctgttaaagtatgcgatgttagaactgtagaattcgaaggaagtaaagcttcctgcgtac

SEQ ID NO: 349969 - DNA, 75 bp, Artificial Sequence
  Synthetic
tcaaagtagataaaccctcatcgcccgcgagcgagagaagaccttcgtcaccgtccagatgcgagagaatgaata

SEQ ID NO: 349970 - DNA, 75 bp, Artificial Sequence
  Synthetic
acccaggaaaacaagttccgtttatgaggacggacatgctacaaaatatgttcgcggctaatcgcgataatgtag

SEQ ID NO: 349971 - DNA, 75 bp, Artificial Sequence
  Synthetic
cttctagacttttgtcctaaaatactattatatctttttcgatattaataaatccgtgtcgcccatgttttttat

SEQ ID NO: 349972 - DNA, 75 bp, Artificial Sequence
  Synthetic
cataatatcagaatgccacggttccaagtatatggtcataactccaggccgtttgtttcctccctgatctatgta

SEQ ID NO: 349973 - DNA, 75 bp, Artificial Sequence
  Synthetic
ctctttcagtatgtgaatagataggtattttatctctattcatcatcgaatttaagagatccgataaacattgtt

SEQ ID NO: 349974 - DNA, 75 bp, Artificial Sequence
  Synthetic
tgtatgctccagatgtcagcatctgatacaacaatatatgtgcacataaacctctggcacttatttcgtgtacct

SEQ ID NO: 349975 - DNA, 75 bp, Artificial Sequence
  Synthetic
caaaagaacagcttttgtatatactgtcctgtatagatatacaatctagatagaagtatagactactactctatt

SEQ ID NO: 349976 - DNA, 75 bp, Artificial Sequence
  Synthetic
attcatgttacactatataacaattacactacatttttatcataacactactttggttagattttagaaaaaaaa

SEQ ID NO: 349977 - DNA, 75 bp, Artificial Sequence
  Synthetic
tccccttatcactaaggagaatagtatttgagaaatatgtatacataatattatcatgaattagatatacagaat

SEQ ID NO: 349978 - DNA, 75 bp, Artificial Sequence
  Synthetic
tagagattaatgcgcatcgttttaacgtatcatagatgccctctatactatcatccatcatgttaagtagaaaac

SEQ ID NO: 349979 - DNA, 75 bp, Artificial Sequence
  Synthetic
ttgtaacactctcgaaatcacacgatgtgtctgcgttaagatctaatatatcactcgataacacattttcatcta

SEQ ID NO: 349980 - DNA, 75 bp, Artificial Sequence
  Synthetic
gatacactagacattttttaaagctaaaatagtctttagtagtaacagtaactacgcgattattttcatcgatga

SEQ ID NO: 349981 - DNA, 75 bp, Artificial Sequence
  Synthetic
tgcatttcatcggcatattattacgcttaccatcaaagactataccatgtgtatatctaacgtattctagcatag

SEQ ID NO: 349982 - DNA, 75 bp, Artificial Sequence
  Synthetic
ttgccatacgcgcattaaacttttcaggatctttggatagatcttccaatctatctatttgagaaaacattttta

SEQ ID NO: 349983 - DNA, 75 bp, Artificial Sequence
  Synthetic
tcatgttcaatagttgaaacgtcgggtccactatatagatattatctataaagattttaggaactacgttcatgg

SEQ ID NO: 349984 - DNA, 75 bp, Artificial Sequence
  Synthetic
tatcctggcgaatattaaaactatcaatgatatgattatcgttttcatcttttatcaccatatagtttctaagat

SEQ ID NO: 349985 - DNA, 75 bp, Artificial Sequence
  Synthetic
atgggattttacttaatataatattatttcccgtaataaattttattagaaatgccaaatctataagaaaagtcc

SEQ ID NO: 349986 - DNA, 75 bp, Artificial Sequence
  Synthetic
tagaattagtctgaagaatatctatatcaccgtaccgtatatttggattaattagatatagagaatatgatccgt

SEQ ID NO: 349987 - DNA, 75 bp, Artificial Sequence
  Synthetic
aacatatacaacttttattatggcgtctaagatattcttccatcaacttattaacatttttgactagggaagata

SEQ ID NO: 349988 - DNA, 75 bp, Artificial Sequence
  Synthetic
cattatgacgtcccatcacttttgccttgtctattactgcaacgttcatagaatttagcatatctcttgccaatt

SEQ ID NO: 349989 - DNA, 75 bp, Artificial Sequence
  Synthetic
cttccattgatgttacattataagaaattttagatgaaattacatttggagctttaatagtaagaactcctaata

SEQ ID NO: 349990 - DNA, 75 bp, Artificial Sequence
  Synthetic
tgtccgtgtatgtggtcactaatacagattgtagttctataatcgtaaataatttacctatattatatgtttgag

SEQ ID NO: 349991 - DNA, 75 bp, Artificial Sequence
  Synthetic
tctgtttagaaaagtagctaagtatacgatcttttatttctgatgcagatgtatcaacatcggaaaaaaatcttt

SEQ ID NO: 349992 - DNA, 75 bp, Artificial Sequence
  Synthetic
ttttattcttttttactaaagatacaaatatgtctttgttaaaaacagttattttctgaatatttctagtttgta

SEQ ID NO: 349993 - DNA, 75 bp, Artificial Sequence
  Synthetic
attttaacatatgatattcattcacactaggtaatctacctaaataggtttctataatctttaatgtaatattag

SEQ ID NO: 349994 - DNA, 75 bp, Artificial Sequence
  Synthetic
gaagagtattatgatcaggattcctattcattttgaggatttaaaactctgattattgtctaatatggtctcaac

SEQ ID NO: 349995 - DNA, 75 bp, Artificial Sequence
  Synthetic
gcaaactttttcacagagcgatagagtttttgataactcgtttttcttaagaaatataaaactactgtctccaga

SEQ ID NO: 349996 - DNA, 75 bp, Artificial Sequence
  Synthetic
gcttgctctatcttttattttatctaattcgatacaaactcctgatactggttcagaaagtaattcattaatttt

SEQ ID NO: 349997 - DNA, 75 bp, Artificial Sequence
  Synthetic
cagtcctttatagaagatatttaatatagataatacaaaattttcagtttttgatatcgatctgattgatcctag

SEQ ID NO: 349998 - DNA, 75 bp, Artificial Sequence
  Synthetic
aactagatatattaataacgtgctcattaggcagtttatggcagcttgataattagatatagtatattccagttc

SEQ ID NO: 349999 - DNA, 75 bp, Artificial Sequence
  Synthetic
atatttattagataccgcattgcccagattttgatattctatgaattcctctgaaaataaatccaaaataactag

SEQ ID NO: 350000 - DNA, 75 bp, Artificial Sequence
  Synthetic
acattctattttttgtggattagtgtactctcttccctctatcatgttcacaactggtgtccacgatgataaata

SEQ ID NO: 350001 - DNA, 75 bp, Artificial Sequence
  Synthetic
tctagagggaatataatatagtccataggatgccaatctagcaatgtcgaataactgtaattttattcttcgctc

SEQ ID NO: 350002 - DNA, 75 bp, Artificial Sequence
  Synthetic
ttcattatgaattgattcttgaggtataaacctaacacaaattatattattagacttttcgtatgtaatgtcttt

SEQ ID NO: 350003 - DNA, 75 bp, Artificial Sequence
  Synthetic
catgttataagtttttaatcctggaatagaatctattttaatgaggcttttaaacgcagagttctccaacaagtc

SEQ ID NO: 350004 - DNA, 75 bp, Artificial Sequence
  Synthetic
aaaacataatactctgttggttttcttatatacaatattacgattttcttctttgaatggaataggtttttgaat

SEQ ID NO: 350005 - DNA, 75 bp, Artificial Sequence
  Synthetic
tagtttataattacaacataataaataaggaagtgtgcaaatagtacgcggaaaaaacataatagctcccctgtt

SEQ ID NO: 350006 - DNA, 75 bp, Artificial Sequence
  Synthetic
ttcatccatggttttaagtaaatgatcactggcttctttagtcaatggatattcgaacattaaccgtttcatcat

SEQ ID NO: 350007 - DNA, 75 bp, Artificial Sequence
  Synthetic
cattggacaaaatccatatttcttaatgtaaagagtgatcaaatcattatgtttattgtaccatcttgttgtaaa

SEQ ID NO: 350008 - DNA, 75 bp, Artificial Sequence
  Synthetic
tgtgtattcggttatcggatctgctcctttttctattaaagtatcgatgtcgatctcgtctaagaattcaactat

SEQ ID NO: 350009 - DNA, 75 bp, Artificial Sequence
  Synthetic
atcgacatatttcatttgtatacacataaccattactaacgtagaatgtataggaagagatgtaacgggaacagg

SEQ ID NO: 350010 - DNA, 75 bp, Artificial Sequence
  Synthetic
gacatgttcgtggtgttatgaaacatgtatgagaaaaactgcgttgtttcatgacaatcaattggggcatgcgga

SEQ ID NO: 350011 - DNA, 75 bp, Artificial Sequence
  Synthetic
gtttgttgattcgcaaactattctaatacataattcttctgttaatacgtcttgcacgtaatctattatagatgc

SEQ ID NO: 350012 - DNA, 75 bp, Artificial Sequence
  Synthetic
caagatatctatataattattttgtaagatgatgttaactatgtgatctatataagtagtgtaataatttatgta

SEQ ID NO: 350013 - DNA, 75 bp, Artificial Sequence
  Synthetic
tttcgatatatgttccaactctgtctttgtgatgtctagttttgtaatatctatagcatcctcaaaaaatatatt

SEQ ID NO: 350014 - DNA, 75 bp, Artificial Sequence
  Synthetic
cgcatatattcccaagtcttcagttctatcttctaaaaaatcttcaacgtatggaatataataatctattttacc

SEQ ID NO: 350015 - DNA, 75 bp, Artificial Sequence
  Synthetic
tcttctgatatcattaatgatatagtttttgacactatcttctgtcaattgattcttattcactatatctaagaa

SEQ ID NO: 350016 - DNA, 75 bp, Artificial Sequence
  Synthetic
acggatagcgtccctaggacgaactactgccattaatatctctattatagcttctggatataattcatctattat

SEQ ID NO: 350017 - DNA, 75 bp, Artificial Sequence
  Synthetic
accagaattaataggaactattccgtatttatctaacatagttttaagaaagtcagaatctaagacctgatgttc

SEQ ID NO: 350018 - DNA, 75 bp, Artificial Sequence
  Synthetic
atatattggttcatacatgaaatgatctctattgatgatagtgactatttcgttctctgaaaattggtaactcat

SEQ ID NO: 350019 - DNA, 75 bp, Artificial Sequence
  Synthetic
tctatatatgctttccttgttgatgaaggataggatatactcaatagaatttgtaccaacaaactgttctcttat

SEQ ID NO: 350020 - DNA, 75 bp, Artificial Sequence
  Synthetic
gaatcgtatatcatcatctgaaataatcatgtaaggcatacatttaacaataagagacttgtctcctgttatcaa

SEQ ID NO: 350021 - DNA, 75 bp, Artificial Sequence
  Synthetic
tatactattcttgtgataatttatgtgtgaggcaaatttgtccacgttctttaattttgttatagtagatatcaa

SEQ ID NO: 350022 - DNA, 75 bp, Artificial Sequence
  Synthetic
atccaatggagctacagttcttggcttaaacagatatagtttttctggaacgaattctacaacattattataaag

SEQ ID NO: 350023 - DNA, 75 bp, Artificial Sequence
  Synthetic
attcagaaagctgtggatgtttgggttcaacatccactgatggtgttacaccaatggttcagtgacgtctgtgga

SEQ ID NO: 350024 - DNA, 75 bp, Artificial Sequence
  Synthetic
gactttgggtagataagtgggatgaaatcctattttaattaatgcaatagccttgtcctcgtgcagatatccaaa

SEQ ID NO: 350025 - DNA, 75 bp, Artificial Sequence
  Synthetic
cgcttttgtgatagtatggcattcattgtctaaaaacgctctacgaatatctgtgacagatatcatctttagaga

SEQ ID NO: 350026 - DNA, 75 bp, Artificial Sequence
  Synthetic
atactagtcgcgttaatagtactaaaatttgtatttttaatctatctcaataaaaaattaatatttatgatttaa

SEQ ID NO: 350027 - DNA, 75 bp, Artificial Sequence
  Synthetic
taaaaaattaatatttatgatttaatgtataactttactaactgttattgataactagaatcagaatctaatgat

SEQ ID NO: 350028 - DNA, 75 bp, Artificial Sequence
  Synthetic
gacgtaaccaagaagtttatctacagccaatttagctgcattatttttagcatctcgtttagattttccatcggc

SEQ ID NO: 350029 - DNA, 75 bp, Artificial Sequence
  Synthetic
gccaatttagctgcattatttttagcatctcgtttagattttccatcggccttatcgaatactctcccgtcgatg

SEQ ID NO: 350030 - DNA, 75 bp, Artificial Sequence
  Synthetic
atccatagttggatttacataggtgtccaattgggatctcaccatcatcgagataattgatgacatctccccctt

SEQ ID NO: 350031 - DNA, 75 bp, Artificial Sequence
  Synthetic
tctacacaggcataaaatgtaggagagttactaggccccactgattcaatacgaaaagaccaatctctcttagtt

SEQ ID NO: 350032 - DNA, 75 bp, Artificial Sequence
  Synthetic
tcatctcctggagtcggcgacattgtagaaagcgtgaccgctgtagagcttgatgatagcaacggggatgatgat

SEQ ID NO: 350033 - DNA, 75 bp, Artificial Sequence
  Synthetic
atttggcagtactcattaataatggtgacagggttagcatttttccaatcaataatttttttagccggaataaca

SEQ ID NO: 350034 - DNA, 75 bp, Artificial Sequence
  Synthetic
tgacagggttagcatttttccaatcaataatttttttagccggaataacatcatcaaaagacttatgatcctctc

SEQ ID NO: 350035 - DNA, 75 bp, Artificial Sequence
  Synthetic
atagcatccggcttatccgcctcagttgtcataaaccaacgaggaggaatatcgtcggagctgtacaccatagca

SEQ ID NO: 350036 - DNA, 75 bp, Artificial Sequence
  Synthetic
tatcatcttattccccatagactatcgatgattatactctgtattagttctattggaagatgtgttatctctata

SEQ ID NO: 350037 - DNA, 75 bp, Artificial Sequence
  Synthetic
ctacgttgaagatcgtacagagctttattaacttctcgcttctccatattaagttgtctagttagttgtacagca

SEQ ID NO: 350038 - DNA, 75 bp, Artificial Sequence
  Synthetic
gtaactccttcaagtccaatgtttttaatagcctcacatacaatctctgcgtcagaacgctcgtcaatatagatc

SEQ ID NO: 350039 - DNA, 75 bp, Artificial Sequence
  Synthetic
ttagacatttttagagagaactaccgcaactagtaataaaactaatctattttatcatttttttattcatcatct

SEQ ID NO: 350040 - DNA, 75 bp, Artificial Sequence
  Synthetic
tctggtggttcatcgttcctatcgaatgtgactctgattaacccatcatctataggtgatgctggttctggagat

SEQ ID NO: 350041 - DNA, 75 bp, Artificial Sequence
  Synthetic
gaagaatctctgttatttccttgtttttatgtatcgattgcgttgtaacattaagattgcgaaatgctctaaatt

SEQ ID NO: 350042 - DNA, 75 bp, Artificial Sequence
  Synthetic
tgggaggcttgaagtgttgtttgcaatctctacacgcgtgtctaactaatggaggttcatcagcggctctagttt

SEQ ID NO: 350043 - DNA, 75 bp, Artificial Sequence
  Synthetic
tctacacctccacgcgaagatctaccaccgcttcctctaaatcctccttatcgacaactttctcgtggtggtgat

SEQ ID NO: 350044 - DNA, 75 bp, Artificial Sequence
  Synthetic
gaatcatcatcggtgtagtattcctacttttacagttaggacacggtgtattgtatttctcgttgagaacgttaa

SEQ ID NO: 350045 - DNA, 75 bp, Artificial Sequence
  Synthetic
tatagattcatcaaggtatataaacctggggaggagactacctcgacatacgtgtgcgctatcaaagtggaaaga

SEQ ID NO: 350046 - DNA, 75 bp, Artificial Sequence
  Synthetic
agtaatcattgtaactcacatcctttattttatctatattgtattctactcctttcttaatgcattttataccga

SEQ ID NO: 350047 - DNA, 75 bp, Artificial Sequence
  Synthetic
ataagagatagcgaaggaattctttttcggtaccgctagtacccttaatcatgtcacatagtgttttatattcca

SEQ ID NO: 350048 - DNA, 75 bp, Artificial Sequence
  Synthetic
aatttgtggcaatggacggtttatttctatacgatagtttgtttctagaatcctttgagtattctataccaatat

SEQ ID NO: 350049 - DNA, 75 bp, Artificial Sequence
  Synthetic
tattctttgattcgaatttagtttcttcgatattggattttgtattacctatattcttgatgtagtactttgatg

SEQ ID NO: 350050 - DNA, 75 bp, Artificial Sequence
  Synthetic
atttttccatggcccattctattaagtcttccaagttggcatcatccacatattgtgatagtaattctcggatat

SEQ ID NO: 350051 - DNA, 75 bp, Artificial Sequence
  Synthetic
tagtagcggctaccgccattgatgtttgttcattggatgagtaactactaatgtatacattttccatttataaca

SEQ ID NO: 350052 - DNA, 75 bp, Artificial Sequence
  Synthetic
cgtatgtattaactttgttcatttatattttttcattattatgttgatattaacaaaagtgaatatatatatgtt

SEQ ID NO: 350053 - DNA, 75 bp, Artificial Sequence
  Synthetic
aataattgtattgtggttatatggctacaatttcataatgagcggaagtcagtgtccgatgattaatgacgatag

SEQ ID NO: 350054 - DNA, 75 bp, Artificial Sequence
  Synthetic
atttactctgaaaagaaagtatcaaatcgatagtgtagagtcgacaatgaaaatggataagaagaggacaaagtt

SEQ ID NO: 350055 - DNA, 75 bp, Artificial Sequence
  Synthetic
tcaaaatagagccaaaatggtaaaagaaataaatcagacaataagagcagcacaaactcattacgagacattgaa

SEQ ID NO: 350056 - DNA, 75 bp, Artificial Sequence
  Synthetic
actaggatacataaaatttaagaaaatgattaggactactactttagaagatataacaacatctattccaaatat

SEQ ID NO: 350057 - DNA, 75 bp, Artificial Sequence
  Synthetic
tagtattgtacaagaagccattttatctctaaatttacgaattaagattttaaattttaaacataaagataatga

SEQ ID NO: 350058 - DNA, 75 bp, Artificial Sequence
  Synthetic
tcagaaaatttataaactattctcggacatttcagccattggcaaagtatcacagaatccgagtaaaatggcata

SEQ ID NO: 350059 - DNA, 75 bp, Artificial Sequence
  Synthetic
tgctttactgctttacatgttccccaatttgtttggagatgaccatagattcattctttatagaatgtttccaat

SEQ ID NO: 350060 - DNA, 75 bp, Artificial Sequence
  Synthetic
gagtaaaatcaaacacaagatcttctctcctttcaaacttaatcttattagaatattagtggaagaaagattcta

SEQ ID NO: 350061 - DNA, 75 bp, Artificial Sequence
  Synthetic
taataatgaatgcagatctaataaatggagaataattggaacacaagttgataaaatgttgatagctgaatctga

SEQ ID NO: 350062 - DNA, 75 bp, Artificial Sequence
  Synthetic
taaatatacaatagatgcaaggtatcgcctaagacctatatatagaatcaagggaaaatctgaagaagataccct

SEQ ID NO: 350063 - DNA, 75 bp, Artificial Sequence
  Synthetic
cttcatcaaacagatggtagaccaatgtgtgacatcccaggaattggtggaaaaagtgttgaagatactgtttag

SEQ ID NO: 350064 - DNA, 75 bp, Artificial Sequence
  Synthetic
agatttgttcaagagtggagaatacaaagcgtacagatacgatgatgacgtagaaaatggattcattggattgga

SEQ ID NO: 350065 - DNA, 75 bp, Artificial Sequence
  Synthetic
taaactaaaattaaacattgttcatgatatagttgaaccatgtatgcctgttcgtaggccagtggctaagatact

SEQ ID NO: 350066 - DNA, 75 bp, Artificial Sequence
  Synthetic
gtgtaaagaaatggtaaataaatactttgagaatccgctgcatattattggtaagaatcttcaagagtgcattga

SEQ ID NO: 350067 - DNA, 75 bp, Artificial Sequence
  Synthetic
ctttgttagtgaataggcatttcatctttctccaatactaattcaaattgttaaattaataatggatatagtata

SEQ ID NO: 350068 - DNA, 75 bp, Artificial Sequence
  Synthetic
aatagttattagaataagagtgtagtatcatagataagtatttactttcttctataaaatggattttattcgtag

SEQ ID NO: 350069 - DNA, 75 bp, Artificial Sequence
  Synthetic
aaagtatcttatatacacagtagaaaataatatagattttttaaaggatgatacattaagtaaagtaaacaattt

SEQ ID NO: 350070 - DNA, 75 bp, Artificial Sequence
  Synthetic
taccctcaatcatgtactagctctcaagtatctagttagcaattttcctcaacacgttattactaaggatgtatt

SEQ ID NO: 350071 - DNA, 75 bp, Artificial Sequence
  Synthetic
agctaataccaatttttttgttttcatacatatggtacgatgttgtaaagtgtacgaagcggttttacgacacgc

SEQ ID NO: 350072 - DNA, 75 bp, Artificial Sequence
  Synthetic
atttgatgcacccacgttgtacgttaaagcattgactaagaattatttatcgtttagtaacgcaatacaatcgta

SEQ ID NO: 350073 - DNA, 75 bp, Artificial Sequence
  Synthetic
caaggaaacagtgcataaactaacacaagatgaaaaatttttagaggtagccgaatacatggaagaattaggaga

SEQ ID NO: 350074 - DNA, 75 bp, Artificial Sequence
  Synthetic
acttataggggtaaattatgacttagttcttaatccattatttcacgaaggggaacccatcaaagatatggaaat

SEQ ID NO: 350075 - DNA, 75 bp, Artificial Sequence
  Synthetic
catttttttaaaactgtttaagaaaacagactttaaagttgttaaaaaattaagtgttataagattacttatttg

SEQ ID NO: 350076 - DNA, 75 bp, Artificial Sequence
  Synthetic
ggcttacctaagcaagaaagatacaggtatagagtttgcggataatgatagacaagatatatatactctatttca

SEQ ID NO: 350077 - DNA, 75 bp, Artificial Sequence
  Synthetic
acacactggtagaatagtccatagcaatctaacagaaacgtttagagattatatctttcccggagataagactag

SEQ ID NO: 350078 - DNA, 75 bp, Artificial Sequence
  Synthetic
ctattgggtgtggttaaacgaaagtatagctaatgatgcagatatcgttcttaatagacccgccattaccatgta

SEQ ID NO: 350079 - DNA, 75 bp, Artificial Sequence
  Synthetic
tgataaaattcttagttatatatactctgagataaaacagggacgtgttaataaaaacatgcttaagttagttta

SEQ ID NO: 350080 - DNA, 75 bp, Artificial Sequence
  Synthetic
tatctttgagcctgaaaaagatatcagagaacttctgctagaaatcatatatgatattcctggagatatcctatc

SEQ ID NO: 350081 - DNA, 75 bp, Artificial Sequence
  Synthetic
tattattgatgcaaaaaacgacgattggaaaaaatattttattagtttttacaaagctaattttattaacggtaa

SEQ ID NO: 350082 - DNA, 75 bp, Artificial Sequence
  Synthetic
tacatttattagcgatagaacgtttaacgaggatttattcagagttgttgttcaaatagatcctgaatattttga

SEQ ID NO: 350083 - DNA, 75 bp, Artificial Sequence
  Synthetic
taatgaacgaattatgtctttattctctacgagtgctgtggaaattaaacgatttgatgagttagatattaataa

SEQ ID NO: 350084 - DNA, 75 bp, Artificial Sequence
  Synthetic
cagttatatatctaatataatttatgaggtgaacgatatcacattagatacaatggatgatatgaagaagtgcca

SEQ ID NO: 350085 - DNA, 75 bp, Artificial Sequence
  Synthetic
aatctttaacgaggatacatcgtattatgttaaggaatacaatacatacctgtttttgaacgagacggatcccat

SEQ ID NO: 350086 - DNA, 75 bp, Artificial Sequence
  Synthetic
ggtcatagagaacggaatactaaagaaactgtcatctataaaatccaagagtagacgactgaacttgtttagcaa

SEQ ID NO: 350087 - DNA, 75 bp, Artificial Sequence
  Synthetic
aaacattttaaaatattatttagacggacaattggctcgtctaggtcttgtgttagatgattataaaggagactt

SEQ ID NO: 350088 - DNA, 75 bp, Artificial Sequence
  Synthetic
gttagttaaaatgataaaccatctcaagtttgtggaggatgtatcagcattcgttagattttctacagataaaaa

SEQ ID NO: 350089 - DNA, 75 bp, Artificial Sequence
  Synthetic
gcttcctacattaggaggaacagttttaaagtctcttggttttaatctattaccgttagtttttatgaaatcctt

SEQ ID NO: 350090 - DNA, 75 bp, Artificial Sequence
  Synthetic
ccctagtgttcttccatcgctaatcaacactattttagctagttataatatttccatcattgtcctatttcaaaa

SEQ ID NO: 350091 - DNA, 75 bp, Artificial Sequence
  Synthetic
gtttttaagagataatctatatcatgtagaaaaattcttggataaaagcatccatctaaccaagacggataagaa

SEQ ID NO: 350092 - DNA, 75 bp, Artificial Sequence
  Synthetic
atatatacttcaattgataaggcacggcagatcatagaacaaaccaaatatattattaataatttgtatatacat

SEQ ID NO: 350093 - DNA, 75 bp, Artificial Sequence
  Synthetic
tctcccccctttcttttttagtagatatttcatcgtgtaagaatcaatattaatatttctaaagtatccgtgtat

SEQ ID NO: 350094 - DNA, 75 bp, Artificial Sequence
  Synthetic
agatataattatcacatattaaaattcacacatttttgataaatgggaactactgcaacaatttagactcccacc

SEQ ID NO: 350095 - DNA, 75 bp, Artificial Sequence
  Synthetic
aaattaatgaataaagagaatgcagaaatgattttggaaaaattgttgatcatatagttatgtatattagtgacg

SEQ ID NO: 350096 - DNA, 75 bp, Artificial Sequence
  Synthetic
aaatgattttggaaaaattgttgatcatatagttatgtatattagtgacgaatcaagagatgaaaataatcctga

SEQ ID NO: 350097 - DNA, 75 bp, Artificial Sequence
  Synthetic
aaaaataatcatcgaatactttgtaagatactccttcatgaacataatcagttacaaaacgtttatatgaagtaa

SEQ ID NO: 350098 - DNA, 75 bp, Artificial Sequence
  Synthetic
atatattgattttcgtaacagatacggagactatagatctttcattataaaaagtgatcacgggtttgtaaagat

SEQ ID NO: 350099 - DNA, 75 bp, Artificial Sequence
  Synthetic
cacaacaaatgataatcaaacacatctacgaacaatatcttatttcggtatctgaagtacttattaaaacctatg

SEQ ID NO: 350100 - DNA, 75 bp, Artificial Sequence
  Synthetic
atatccatgggtgacataattacatataacggatgtaaagacaataaatggatgctagaacaactctctacccta

SEQ ID NO: 350101 - DNA, 75 bp, Artificial Sequence
  Synthetic
attaatacaaacgataacttgatttcaaaattatcaatggagatacaacgtgaaatactttattactccattaaa

SEQ ID NO: 350102 - DNA, 75 bp, Artificial Sequence
  Synthetic
tatctgatgaaagataaactagatatataaataatcccattctaatactttaacatgtgtattacatgcatctta

SEQ ID NO: 350103 - DNA, 75 bp, Artificial Sequence
  Synthetic
ttagaatattaacctaactaaaagacataatataaaaacttattacatagttgataaaaagcggtaggctataaa

SEQ ID NO: 350104 - DNA, 75 bp, Artificial Sequence
  Synthetic
tattatggcagcagtcgttccgcgttttgatgacgtgtacaaaaatgcacagcgaagaattctagatcaagaaac

SEQ ID NO: 350105 - DNA, 75 bp, Artificial Sequence
  Synthetic
attttttagtagaggtctaggtagaccgttaatgaagaacacatatttgtttgataattacgcgtatggatggat

SEQ ID NO: 350106 - DNA, 75 bp, Artificial Sequence
  Synthetic
accagaaacggcaatttggagtagtcgatacgcaaacctagatgcaagtgactattatcccatttcgttgggatt

SEQ ID NO: 350107 - DNA, 75 bp, Artificial Sequence
  Synthetic
acttaaaaagtttaagtttctcatgtctctatataaaggtcctattccagtatacgaagaaaaagtaaatactga

SEQ ID NO: 350108 - DNA, 75 bp, Artificial Sequence
  Synthetic
attcatagccaatggatcgttctctggtagatacgtatcatatcttcgaaagttttctgctcttccaacaaacga

SEQ ID NO: 350109 - DNA, 75 bp, Artificial Sequence
  Synthetic
gtttattagttttttgttactgacttccattccaatctataatatcttgttctggtttaaaaatactcagtttga

SEQ ID NO: 350110 - DNA, 75 bp, Artificial Sequence
  Synthetic
tattactaaacacacattattcagatacgtctatacagataatgccaaacacctggcattggctaggtatatgca

SEQ ID NO: 350111 - DNA, 75 bp, Artificial Sequence
  Synthetic
tcaaacaggagactataagcctttgtttagtcgtctcaaagagaattatatatttaccggtcccgttccaatagg

SEQ ID NO: 350112 - DNA, 75 bp, Artificial Sequence
  Synthetic
tatcaaagatatagatcaccctaatcttagtagagcaagaagtccatccgactatgagacattagctaatattag

SEQ ID NO: 350113 - DNA, 75 bp, Artificial Sequence
  Synthetic
tactatattgtactttaccaagtatgatccggtattaatgtttttattgttttacgtacctgggtattcaattac

SEQ ID NO: 350114 - DNA, 75 bp, Artificial Sequence
  Synthetic
tacaaaaattactccagcagtagagtatctaatggataaactgaaactaacaaagaacgatgtacaactgttgtg

SEQ ID NO: 350115 - DNA, 75 bp, Artificial Sequence
  Synthetic
ctcaaatgaacgccagaggcgtaaaagtcaaattagattttgaacgaagacctccttcgttttataaaccattag

SEQ ID NO: 350116 - DNA, 75 bp, Artificial Sequence
  Synthetic
aatattttatgcttcgtaaaatgtaggtcttgaaccaaacattctttcaaagaatgagatacataaaactttatt

SEQ ID NO: 350117 - DNA, 75 bp, Artificial Sequence
  Synthetic
atccaatagattgactatttcggacgtcaatcgtttaaagtaaacttcgtaaaatattctttgatcactaccgag

SEQ ID NO: 350118 - DNA, 75 bp, Artificial Sequence
  Synthetic
tttaaaacttctatcgataattgtttcatatgttttaatatttacaagttttttggtccatggtacattagccgg

SEQ ID NO: 350119 - DNA, 75 bp, Artificial Sequence
  Synthetic
acaaatatatgcaaaataatatcgttctccaagttctatagtctctggattatttttattatattcagtaaccaa

SEQ ID NO: 350120 - DNA, 75 bp, Artificial Sequence
  Synthetic
aaacagaatagaaacattataccccaaccagttatgtttagcgtgtcatgatactaagtataatgtatgtaaccc

SEQ ID NO: 350121 - DNA, 75 bp, Artificial Sequence
  Synthetic
atacatattagggttatctgcggatttataatttaagtgatgcattcgactcaacataaataattctagaggaga

SEQ ID NO: 350122 - DNA, 75 bp, Artificial Sequence
  Synthetic
aggaaatgtataatttggtaatggtttctcatgtggatctaaagaagaggtaagatatctactagaaagataccg

SEQ ID NO: 350123 - DNA, 75 bp, Artificial Sequence
  Synthetic
cgatctactatcaaattcggatcgtaaatctgtttctaaagaacggagaatatctatacatacctgattagaatt

SEQ ID NO: 350124 - DNA, 75 bp, Artificial Sequence
  Synthetic
catccgtccttcagacaacatctcagacagtctggtcttgtatatcttaatcatattcttatgaaacttggaaac

SEQ ID NO: 350125 - DNA, 75 bp, Artificial Sequence
  Synthetic
atctcttctagtttcactagtacctttattaattctctcaggtacagattttgaattcgatgatgccgagtattt

SEQ ID NO: 350126 - DNA, 75 bp, Artificial Sequence
  Synthetic
catcgttgtatatttcttcttcgattgcataatcagattcttatataccgcctcaaactctattttaaaattatt

SEQ ID NO: 350127 - DNA, 75 bp, Artificial Sequence
  Synthetic
aaacaatactctactattaatcagtcgttctaattcctttgctatttctatggacttatctacatcttgactgtc

SEQ ID NO: 350128 - DNA, 75 bp, Artificial Sequence
  Synthetic
tatctctgtaaacacggagtcggtatctccgtacacgctacgaaaacgaaatctgtaatctataggcaacgatgt

SEQ ID NO: 350129 - DNA, 75 bp, Artificial Sequence
  Synthetic
acgccttagaaataagagacttaaacaacggacacctggaattattaccatagaagatgttagaaaaatgatgct

SEQ ID NO: 350130 - DNA, 75 bp, Artificial Sequence
  Synthetic
tttcacaatcggattaatatctctatcgtccatataaaatggattacttaatggattggcaaaccgtaacatacc

SEQ ID NO: 350131 - DNA, 75 bp, Artificial Sequence
  Synthetic
gttagataactctgctccatttagtaccgattctagatacaagatcattctacgtcctatggatgtgcaactctt

SEQ ID NO: 350132 - DNA, 75 bp, Artificial Sequence
  Synthetic
agccgaagcgtatgagtatagagcactatttctaaatcccatcagaccatatactgagttggctatgatcttgta

SEQ ID NO: 350133 - DNA, 75 bp, Artificial Sequence
  Synthetic
tagtacacgaatgattttctaaagtacttggaaagttttataggtagttgatagaacaaaatacataatttttgt

SEQ ID NO: 350134 - DNA, 75 bp, Artificial Sequence
  Synthetic
cgtatactgcatggaatcatagatggccttttcagttgaactggtagcctgttttagcatctttttatatctggc

SEQ ID NO: 350135 - DNA, 75 bp, Artificial Sequence
  Synthetic
tctctctgccaaaaatgttcttaatagtctaggaatggttccttctattgatctatcgaaaattgctatttcaga

SEQ ID NO: 350136 - DNA, 75 bp, Artificial Sequence
  Synthetic
gatgaggttaggtagtctaggttcacaatgaaccgtaatatatctaggcggtggatatttctgaagcaagagctg

SEQ ID NO: 350137 - DNA, 75 bp, Artificial Sequence
  Synthetic
attatttatttcttcttccaatctattgctactaacaacgacaccgactaatgtttccggagatagatttccaaa

SEQ ID NO: 350138 - DNA, 75 bp, Artificial Sequence
  Synthetic
gatacacacattaggatacagactgttataatcaaagattaatacattattactaaacattttttgttttggagc

SEQ ID NO: 350139 - DNA, 75 bp, Artificial Sequence
  Synthetic
gacggatcggtatctgaaggtgtaaccgatgatacttcactcatcgattcaacaaaactcaaatcgtgtgtctga

SEQ ID NO: 350140 - DNA, 75 bp, Artificial Sequence
  Synthetic
aaataccttaccgccttcataaggaaacttttgttttgtttctgatctaactaagatagttttagtttccaacaa

SEQ ID NO: 350141 - DNA, 75 bp, Artificial Sequence
  Synthetic
ccttagaaataagagacttaaacaacggacacctggaattattaccatagaagatgttagaaaaatgatgctggt

SEQ ID NO: 350142 - DNA, 75 bp, Artificial Sequence
  Synthetic
ctaagatagttttagtttccaacaatagctttaacagtggacccttgatgactgtactcgctttatattcgaata

SEQ ID NO: 350143 - DNA, 75 bp, Artificial Sequence
  Synthetic
ccatggattgaggaagcacatatgttgacgcacccgcgtctgtttttgtttctactccataatactcccacaaat

SEQ ID NO: 350144 - DNA, 75 bp, Artificial Sequence
  Synthetic
actgacacaagcaagcatcatgaatacagtatctagccatatctaaagctatgtttagattataatccttataca

SEQ ID NO: 350145 - DNA, 75 bp, Artificial Sequence
  Synthetic
tctgtgctagatcaacgtcatcctttccgaacgataatttatacgtatcatttgttaaagtgggacatgatagta

SEQ ID NO: 350146 - DNA, 75 bp, Artificial Sequence
  Synthetic
caactttgaatccattttcccaaatatctttatgaattactttacatataatatcatcaaccgtcacataattac

SEQ ID NO: 350147 - DNA, 75 bp, Artificial Sequence
  Synthetic
ttcaagttctccttgacaagatccatctacttttccatccctagtatccagttccttttctagttctgaacgcat

SEQ ID NO: 350148 - DNA, 75 bp, Artificial Sequence
  Synthetic
ctgtggttaaaacctttgcaaatacagcggctttgcctttagcgtccgtagtatcgtcaccgatgaacgtcattt

SEQ ID NO: 350149 - DNA, 75 bp, Artificial Sequence
  Synthetic
aaaaaatattaaacctctttctgatggagtcgtaaaaagttttatctctttctctcttcgatggtctcacaaaaa

SEQ ID NO: 350150 - DNA, 75 bp, Artificial Sequence
  Synthetic
ctctaactcctctatttaatactttacccatgcaactaaacgcgttcttggatatagaatccaatttgtacgaat

SEQ ID NO: 350151 - DNA, 75 bp, Artificial Sequence
  Synthetic
ccaatttttcagatttttgaatgaatgaatacagatcaaaaaatatagttccattattgttattaacgtgaaacg

SEQ ID NO: 350152 - DNA, 75 bp, Artificial Sequence
  Synthetic
acacgtactaacttttgattttaacgacgacatattagtaactgttttccatttttttttttttttttttttttt

SEQ ID NO: 350153 - DNA, 75 bp, Artificial Sequence
  Synthetic
taaaatatttttattctcattctgatgcatcaactatttcttaaacaataacgttcaacaacatatactctcgag

SEQ ID NO: 350154 - DNA, 75 bp, Artificial Sequence
  Synthetic
tagtattggccatgccacctacccccttgtgactagactgatttctctcataaatacagagatgtacagcttcct

SEQ ID NO: 350155 - DNA, 75 bp, Artificial Sequence
  Synthetic
aagagatagttagtctatatatttttcttagtgcaaaagtcaatgttttaaaatatatggacaagaatttgtctg

SEQ ID NO: 350156 - DNA, 75 bp, Artificial Sequence
  Synthetic
ttttgtctggagatctaaagataatcttctctccggttaataattctagacgattagtaatatatctcagatcaa

SEQ ID NO: 350157 - DNA, 75 bp, Artificial Sequence
  Synthetic
atagatagactttctctaaataggactattgttacaaaagttaataacaattataacaattattataattgttat

SEQ ID NO: 350158 - DNA, 75 bp, Artificial Sequence
  Synthetic
agttatgtccgttaaaggtaacaatatagtcgaacgttagttccaacaattgtttagctatttgtagcaaaacta

SEQ ID NO: 350159 - DNA, 75 bp, Artificial Sequence
  Synthetic
tctatatcatctatatcatctatatcatctatatcatctatatcatctatatcatctatatcatctatatcatct

SEQ ID NO: 350160 - DNA, 75 bp, Artificial Sequence
  Synthetic
tttcagaacacagaactagttctctctcataatccatttccatcagtgactgtatcctcaaacatcctctatcga

SEQ ID NO: 350161 - DNA, 75 bp, Artificial Sequence
  Synthetic
cggcttcttgtatttcctgttccgttaacatctcttcattaataagcgtaaacaataatcgtttaccacttaaat

SEQ ID NO: 350162 - DNA, 75 bp, Artificial Sequence
  Synthetic
cgatataacagtaacttgtatgagagattgggttaataaatacagaaggaaacttcttatcgaagtgacactcta

SEQ ID NO: 350163 - DNA, 75 bp, Artificial Sequence
  Synthetic
tatctagaaataagtacgatcttgggatatcgaatctaggtatttctttagcgaaacagttacgtggatcgccac

SEQ ID NO: 350164 - DNA, 75 bp, Artificial Sequence
  Synthetic
aatgataacatccattgttaatctttgttaaatattgatcgtccaacgaataacatccgtctggagatatcccgt

SEQ ID NO: 350165 - DNA, 75 bp, Artificial Sequence
  Synthetic
tagaaatataaaaccaactaatattgagaaattcatccatagtggcgttttgtatgttgcgtttctttggctctt

SEQ ID NO: 350166 - DNA, 75 bp, Artificial Sequence
  Synthetic
ctattaaccacatatctgcgacggagcattttctatctttaatatctagattataacttattgtctcgtcaatgt

SEQ ID NO: 350167 - DNA, 75 bp, Artificial Sequence
  Synthetic
ctatagttctcatctttcccattggcctcgcattaaatggaggaggagccaatgactgatatatttcgtctgtca

SEQ ID NO: 350168 - DNA, 75 bp, Artificial Sequence
  Synthetic
gtgcccccaggacaaggtaaggactctcccgctatcactcgtgcagaagctctggctatgatcaaagactgtgag

SEQ ID NO: 350169 - DNA, 75 bp, Artificial Sequence
  Synthetic
gaaactctcgtatagtcatagatgaaatactctttaaagtttctgaaataagattagtaacagtcttacctccga

SEQ ID NO: 350170 - DNA, 75 bp, Artificial Sequence
  Synthetic
ctacgtaataaaagtaatgaggaaatcgtataaatactgtctcgccatttcgacatctggatttcagatataaaa

SEQ ID NO: 350171 - DNA, 75 bp, Artificial Sequence
  Synthetic
atctgttttcaccatgactttcgaaccaattaatacaccgaacatccatttctagaatttagaaatatattttca

SEQ ID NO: 350172 - DNA, 75 bp, Artificial Sequence
  Synthetic
tttaaatgaatcccaaacattggggaagagccgcttggaccattatttttatagtactttcacaagcgggtttag

SEQ ID NO: 350173 - DNA, 75 bp, Artificial Sequence
  Synthetic
acggcaacatagaagcgtgtaaacgaaaactatatactatagtcagcactcttccatgtcctgcctgcagacgac

SEQ ID NO: 350174 - DNA, 75 bp, Artificial Sequence
  Synthetic
acgcaactatcgctatagaggacaataatattatgtctagcaatgatctaaattatatttattattttttcatca

SEQ ID NO: 350175 - DNA, 75 bp, Artificial Sequence
  Synthetic
gattatttaacaatttggcatctgatcccaaatacgcaatcgatgtgtcaaaggttaaacctttataaacttaac

SEQ ID NO: 350176 - DNA, 75 bp, Artificial Sequence
  Synthetic
ccattataaaacttatgattagttacgactgaaataaccgcatgattattttttggtataattctacacggcata

SEQ ID NO: 350177 - DNA, 75 bp, Artificial Sequence
  Synthetic
gtttctgtaactatgaattctacccccgttacatttgtataatctttaacaaacagtaagggctcgtcaaatacg

SEQ ID NO: 350178 - DNA, 75 bp, Artificial Sequence
  Synthetic
taaaactcattacttacgatagaaatagatcccttatcacacttaaaataaaaaatatccttatcctttaccacc

SEQ ID NO: 350179 - DNA, 75 bp, Artificial Sequence
  Synthetic
aaataaaattctgattggtcgatgtgaatgtattcacttaacaattccacaaatttatttattaactccgaggca

SEQ ID NO: 350180 - DNA, 75 bp, Artificial Sequence
  Synthetic
catacatcgtcggtattttttatgacaaactttactcttccagcatccgtttctaaaaaaatattaacgagttcc

SEQ ID NO: 350181 - DNA, 75 bp, Artificial Sequence
  Synthetic
atttatatcatccaatattattgaaatgacgttgatggacagatgatgcaaataagaaggtacaatacctttgtc

SEQ ID NO: 350182 - DNA, 75 bp, Artificial Sequence
  Synthetic
taccatctcctccaattcatgctctattttgtcattaactttaatgtgtgaaaacagtacgccacatgcttccat

SEQ ID NO: 350183 - DNA, 75 bp, Artificial Sequence
  Synthetic
aacagtgtgtaacacttttaatacgaaatgtctgatggcgacataattgtccaaaactgccaatctataatagat

SEQ ID NO: 350184 - DNA, 75 bp, Artificial Sequence
  Synthetic
catattgatcatttagtacggacatggtatcaacagatagcttgaatgaaagagactcagtaatcggaataagtg

SEQ ID NO: 350185 - DNA, 75 bp, Artificial Sequence
  Synthetic
ttttctcgatagagtgtccgtataccaacatgtctgatattttgatgtatttcatcaaattgtttagttttctct

SEQ ID NO: 350186 - DNA, 75 bp, Artificial Sequence
  Synthetic
ttttatcctcattaaacagcatttctgtcaatggaccccaacatctttgaccgattaagttttgattgattcttc

SEQ ID NO: 350187 - DNA, 75 bp, Artificial Sequence
  Synthetic
catgtaaggcgtatctagtcagatcgtataatctagccaacaatccatcgtcggtgtttaggtcacatcgtatac

SEQ ID NO: 350188 - DNA, 75 bp, Artificial Sequence
  Synthetic
tttttaattctctatagaagagagacacacacctggaacaattacagacagtaatttctttattatctacagatg

SEQ ID NO: 350189 - DNA, 75 bp, Artificial Sequence
  Synthetic
taagatacttgaagacattcctatgatgatgtagaatttttgataacactgtattgatggtatctgttaccataa

SEQ ID NO: 350190 - DNA, 75 bp, Artificial Sequence
  Synthetic
taccttttatggcggacagtgtcagagcacaggatttccaatcttttgcaattttcagtaccattatctttgttt

SEQ ID NO: 350191 - DNA, 75 bp, Artificial Sequence
  Synthetic
tgatatctatattagatagcatggtgcgtctgacaacacagggattaagacgaaaagatgaaatgattctatcta

SEQ ID NO: 350192 - DNA, 75 bp, Artificial Sequence
  Synthetic
catcttcaatagataccttgctattttttctggcattatctatatgtgagagaatatcctctagagaatcagtat

SEQ ID NO: 350193 - DNA, 75 bp, Artificial Sequence
  Synthetic
ttagaaatggataaaatcaaaattacggttgattcaaaattggtaatgttgttaccatatcgtataacttggaaa

SEQ ID NO: 350194 - DNA, 75 bp, Artificial Sequence
  Synthetic
cctttttgataatagtggatctcaatgacatgggacgtctaaaccttcttattttatcacctgtttgcatggtga

SEQ ID NO: 350195 - DNA, 75 bp, Artificial Sequence
  Synthetic
tttgtctgctttcttttaacatgatgtaatctctaaattcattggcaaattgtctatatctaaaatcataatatg

SEQ ID NO: 350196 - DNA, 75 bp, Artificial Sequence
  Synthetic
agatgtttacctctacaaatatctgttcgtccaatgttagagtatctacatcagtcttgtattccaaattaaaca

SEQ ID NO: 350197 - DNA, 75 bp, Artificial Sequence
  Synthetic
acagagtgcagataatcatttaatccgtcgtacatggttggaagatgtgcattaacaaaatctttaattgtcttg

SEQ ID NO: 350198 - DNA, 75 bp, Artificial Sequence
  Synthetic
atgaaggtgggactatatctaacatcttgattaataaaatttataacattttccataggatactttgtaactagc

SEQ ID NO: 350199 - DNA, 75 bp, Artificial Sequence
  Synthetic
tttatacacatctcttcatctgtaagtttagacagaatatcgtgaacaggtggtatattatattcatcagatata

SEQ ID NO: 350200 - DNA, 75 bp, Artificial Sequence
  Synthetic
gctgtagcatcaaaactaggaatcggcaacagtccggttcttaatattgtattgtttatactcaagatattcgtt

SEQ ID NO: 350201 - DNA, 75 bp, Artificial Sequence
  Synthetic
cgaagaataatgttcaaatctagattgtttaatatattatatagatgtagtgtagctcctacaggaatatcttta

SEQ ID NO: 350202 - DNA, 75 bp, Artificial Sequence
  Synthetic
actaagtcaattatttcatcaaccgttagatctattttaaagttaatcatataggcattgatttttaaaaggtat

SEQ ID NO: 350203 - DNA, 75 bp, Artificial Sequence
  Synthetic
gtagccttgattacattctcattaattaaccattccaagtcactatgtgtaagaagattatattctatcataagc

SEQ ID NO: 350204 - DNA, 75 bp, Artificial Sequence
  Synthetic
ttgactacatttagtcccgacaccatcaaagaatttttatgatataaggaaacagcttttaggtactcatctact

SEQ ID NO: 350205 - DNA, 75 bp, Artificial Sequence
  Synthetic
ctacaagaattctgtagagccttaatgatatcggcgacgtttattattttaggaggaaagaacctaacattaaga

SEQ ID NO: 350206 - DNA, 75 bp, Artificial Sequence
  Synthetic
aggaggaaagaacctaacattaagaatatcggaattaatagcttccagatacagtgattttggcaatagtccgtg

SEQ ID NO: 350207 - DNA, 75 bp, Artificial Sequence
  Synthetic
catttttttctagacactaaataaaattagtaaaattaaattaattataaaattatatatataatttactgactt

SEQ ID NO: 350208 - DNA, 75 bp, Artificial Sequence
  Synthetic
acagtgattttggcaatagtccgtgtaatccataatccagtaacacgagctggtgcttgctagacaccttttcaa

SEQ ID NO: 350209 - DNA, 75 bp, Artificial Sequence
  Synthetic
tgtttaatttttttgaaataagctttgataaagccttccttgcaaattccggatacatgaacatgtcgccgacat

SEQ ID NO: 350210 - DNA, 75 bp, Artificial Sequence
  Synthetic
gaatgagtattttttttcagtattttatatttttcttaacaagttctcaatacaccaatagatgatagaatatca

SEQ ID NO: 350211 - DNA, 75 bp, Artificial Sequence
  Synthetic
cccaatgcgtccatgttgtctatttccaacaggtcgctatatccaccaatagaagttttcccaaaaaatattcta

SEQ ID NO: 350212 - DNA, 75 bp, Artificial Sequence
  Synthetic
ggaacagttctaccaccagtaatttgttcaaaatagtcgtgcaatttattttcgggtttaaattctttaatatcg

SEQ ID NO: 350213 - DNA, 75 bp, Artificial Sequence
  Synthetic
acaatttcatacgctcctcttttgaaactaaacttatttagaatatccagtgcgtttctacaaaaaggacatgta

SEQ ID NO: 350214 - DNA, 75 bp, Artificial Sequence
  Synthetic
aacttgacaaaaattgtgactttgttattggtcaacctttgttgtacaaattcctcggccattttaatatttaag

SEQ ID NO: 350215 - DNA, 75 bp, Artificial Sequence
  Synthetic
tattggtcaacctttgttgtacaaattcctcggccattttaatatttaagtgatataaaaactatctcgacttat

SEQ ID NO: 350216 - DNA, 75 bp, Artificial Sequence
  Synthetic
ttaactctttagtcgagatatatggacgcagatagctatatgataaccaactacagaaggcgaacgctataaaaa

SEQ ID NO: 350217 - DNA, 75 bp, Artificial Sequence
  Synthetic
acataattacgacgagcatatttataaatatttttattcagcattacttgatatagtaatattaggcacagtcaa

SEQ ID NO: 350218 - DNA, 75 bp, Artificial Sequence
  Synthetic
aaatatttttattcagcattacttgatatagtaatattaggcacagtcaaacattcaaccactctcgatacatta

SEQ ID NO: 350219 - DNA, 75 bp, Artificial Sequence
  Synthetic
acattcaaccactctcgatacattaactctctcattttctttaacaaattctgcaatatcttcgtaaaaagattc

SEQ ID NO: 350220 - DNA, 75 bp, Artificial Sequence
  Synthetic
acatactatgttttgtatacataaaggcgcccattttaacagtttctagtgacaaaatgctagcgatcctaggat

SEQ ID NO: 350221 - DNA, 75 bp, Artificial Sequence
  Synthetic
gacaaaatgctagcgatcctaggatcctttagaatcacatagattgacgattcgtctctcttagtaactctagta

SEQ ID NO: 350222 - DNA, 75 bp, Artificial Sequence
  Synthetic
ttcgtctctcttagtaactctagtaaaataatcatacaatctagtacgcgaaataatattatccttgacttgagg

SEQ ID NO: 350223 - DNA, 75 bp, Artificial Sequence
  Synthetic
cattcttaatcaagtcaattatcttatttttaacaaatgtgagtattttactcatttttataaaaaacttttaga

SEQ ID NO: 350224 - DNA, 75 bp, Artificial Sequence
  Synthetic
agatctaaacaatctagttttgagaacatcgataagttcatcgggaatgacatacatactatctttaatagaact

SEQ ID NO: 350225 - DNA, 75 bp, Artificial Sequence
  Synthetic
catacatactatctttaatagaactcttttcatccagttgaatggactcgtccttaaccaactgattaataagat

SEQ ID NO: 350226 - DNA, 75 bp, Artificial Sequence
  Synthetic
cttctattttatcattttccagatgatatgtatgtccattaaagttaaattgtgtagcgcttctttttagtctag

SEQ ID NO: 350227 - DNA, 75 bp, Artificial Sequence
  Synthetic
cagccaatactttaacatcactaatatcaatatacaaaggagatgatttatcgacggtattaagaattcgttttt

SEQ ID NO: 350228 - DNA, 75 bp, Artificial Sequence
  Synthetic
caacatccgtcaaaaccaattcctttttgcctgtatcatccagtttgccattctttgtaaagaaattattttcta

SEQ ID NO: 350229 - DNA, 75 bp, Artificial Sequence
  Synthetic
ataggtgcaatagcattctattcgaataatgagtatactccgtttaataaacttagtgtaaaactatatatagat

SEQ ID NO: 350230 - DNA, 75 bp, Artificial Sequence
  Synthetic
ctagactattaataagactgataaggattcctccataattgcacaatccaaacttttttacaaaactagacttta

SEQ ID NO: 350231 - DNA, 75 bp, Artificial Sequence
  Synthetic
cgagatctacaggaatgcgtacttcaggtttcttagcttgtgattttttcttttgtggacattttctagtgacca

SEQ ID NO: 350232 - DNA, 75 bp, Artificial Sequence
  Synthetic
actcatctaccatttcattgattttagcagtgaaataagctttcaatgcacgggcactgatactattaaaaacga

SEQ ID NO: 350233 - DNA, 75 bp, Artificial Sequence
  Synthetic
gttgatcttcaaattccaccatttaagttcaccaaacaacttttaaatacaaatatatcaatagtagtagaataa

SEQ ID NO: 350234 - DNA, 75 bp, Artificial Sequence
  Synthetic
gaactataaaaaaaataataattaaccaataccaaccccaacaaccggtattattagttgatgtgacagttttct

SEQ ID NO: 350235 - DNA, 75 bp, Artificial Sequence
  Synthetic
catcacttagaacagatttaacaatttctataaagtctgtcaaatcatcttccggagaacccataaatacaccaa

SEQ ID NO: 350236 - DNA, 75 bp, Artificial Sequence
  Synthetic
atatagcggcgtacaacttatccatttatacattgaatattggcttttctttatcactatcttcatcatattcat

SEQ ID NO: 350237 - DNA, 75 bp, Artificial Sequence
  Synthetic
catcgatatcaacaagtcccaaattacgagccaaatcttcttctacattttcagtcattgatacacgttcactat

SEQ ID NO: 350238 - DNA, 75 bp, Artificial Sequence
  Synthetic
ctccagagagtccgataacgttagccaccacttctctatcaatgattagtttcttaagtgcaaatgtaatttttg

SEQ ID NO: 350239 - DNA, 75 bp, Artificial Sequence
  Synthetic
tttcagttccggatctatagaaaactacaggtgtgataattgccttggctaattgtctttctcttttactgagtg

SEQ ID NO: 350240 - DNA, 75 bp, Artificial Sequence
  Synthetic
attctagttcaccttctatagatctgagaatggataattctccagtcgaaacatattctaccatggctccgttta

SEQ ID NO: 350241 - DNA, 75 bp, Artificial Sequence
  Synthetic
atttgttaatgaagatggattcatccttaaatgttttctctgtaatagtttccaccaaaagactatgcaaagaat

SEQ ID NO: 350242 - DNA, 75 bp, Artificial Sequence
  Synthetic
ttggaatgcgttccttgtgcttaatgtttccatagacagcttctagaagttgatacaacataggactagccgcgg

SEQ ID NO: 350243 - DNA, 75 bp, Artificial Sequence
  Synthetic
taacttttatttttagaaagtatccatcacttctatcttgtttagatttatttttataaagtttagtctctcctt

SEQ ID NO: 350244 - DNA, 75 bp, Artificial Sequence
  Synthetic
ccaacataataaaagtggaagtcatttgactagataaactatcagtaagttttatagagatagatgaacaattag

SEQ ID NO: 350245 - DNA, 75 bp, Artificial Sequence
  Synthetic
cgtattgagaagcatttagtgtgacgtattcgatacattttgcattagatttactaatcgattttgcatactcta

SEQ ID NO: 350246 - DNA, 75 bp, Artificial Sequence
  Synthetic
taacacccgcacaagtctgtagagaatcgctagatgctgtaggtcttggtgaagtttcaactctctttttgatta

SEQ ID NO: 350247 - DNA, 75 bp, Artificial Sequence
  Synthetic
aataaaaatgtttttgtttaaccgctgcatgatgtacagatttcggaatcacaaaccaccagtggttttatttta

SEQ ID NO: 350248 - DNA, 75 bp, Artificial Sequence
  Synthetic
tccttgtccaatgtgaattgaatgggagcggatgcgggtttcgtacgtagatagtacattcccgtttttagaccg

SEQ ID NO: 350249 - DNA, 75 bp, Artificial Sequence
  Synthetic
agactccatccgtaaaaatgcatacttgttagtttggaataactcggatctgctatatggatattcatagattga

SEQ ID NO: 350250 - DNA, 75 bp, Artificial Sequence
  Synthetic
ctttgatcgatgaaggctcccctgtctgcagccatttttatgatcgtcttttgtggaatttcccaaatagtttta

SEQ ID NO: 350251 - DNA, 75 bp, Artificial Sequence
  Synthetic
taaactcgcttaatatcttctggaaggtttgtattctgaatagatccaccatctaccataatcctattcttgatc

SEQ ID NO: 350252 - DNA, 75 bp, Artificial Sequence
  Synthetic
agaaagccaggtcatatggaagatgttcaagctgttaatatcaatctcgataaacgtgaacaggctgtcggagcc

SEQ ID NO: 350253 - DNA, 75 bp, Artificial Sequence
  Synthetic
tcatcattccataattttctctcggttaaaactctaaggagatgcggattaactacttgaaattctccagacaat

SEQ ID NO: 350254 - DNA, 75 bp, Artificial Sequence
  Synthetic
ttaacgaagacggggatttcgtagaagttgaaccgggatcatcatttaagtttctgatacctaagggattttact

SEQ ID NO: 350255 - DNA, 75 bp, Artificial Sequence
  Synthetic
actctccgagtgtaaatattactggtatacggttccacagactcattatttcccaaaatttgagcagttgatgca

SEQ ID NO: 350256 - DNA, 75 bp, Artificial Sequence
  Synthetic
gtcggcataggtgccaccaataaactatttctaagaccgtatgttctgattttatcttttagaggttcccaattc

SEQ ID NO: 350257 - DNA, 75 bp, Artificial Sequence
  Synthetic
tgtctaatgatatccgcgaacgatatttgtgaaaatattaaaaaaaaaatactttttttattaaatgacgtctct

SEQ ID NO: 350258 - DNA, 75 bp, Artificial Sequence
  Synthetic
caaagatccgacggtacaacattccaaagatcatattgtagaataccgttactggcgtacgatcctacatatgta

SEQ ID NO: 350259 - DNA, 75 bp, Artificial Sequence
  Synthetic
tcgtatggtccttccttctcagctagttcacaactcgcctctaatgcaccgtaataaatggtttcgaagatcttc

SEQ ID NO: 350260 - DNA, 75 bp, Artificial Sequence
  Synthetic
tatatgtcaaccattactaaaaaatatattgttctgtttttgttttcttttttctttttcttacacacatcgcta

SEQ ID NO: 350261 - DNA, 75 bp, Artificial Sequence
  Synthetic
ttatttagatcttgtgcttccaggctatcaaatggataatttaagagaataaacgcgtctgctaatccttgaaca

SEQ ID NO: 350262 - DNA, 75 bp, Artificial Sequence
  Synthetic
ccaataccgataggtctatgtctcttattagagatttcagcttctggaataggataataattaatatctataatt

SEQ ID NO: 350263 - DNA, 75 bp, Artificial Sequence
  Synthetic
ttattgaggtttctgacaattactttgaccacatccttcagtttgagaaaatcaaattgtccatctattacaaac

SEQ ID NO: 350264 - DNA, 75 bp, Artificial Sequence
  Synthetic
atgttcaatgcaatagatgccagattacaaacggctacctcattagcatccgcatattgtattatctcagtgcaa

SEQ ID NO: 350265 - DNA, 75 bp, Artificial Sequence
  Synthetic
agattactacacttgatggttcctaaattttgttgattactctttttgttacacgcatccttataaagaatgaat

SEQ ID NO: 350266 - DNA, 75 bp, Artificial Sequence
  Synthetic
ggcgtaccagtttcaatctgggattctataatcgctttccagacgacacgagcctttattatagatttgtatctc

SEQ ID NO: 350267 - DNA, 75 bp, Artificial Sequence
  Synthetic
ttttctctttcgtatagtgtatacaatcgttcaaactcgtctccccaaacattgtccaatccaggacattcatcc

SEQ ID NO: 350268 - DNA, 75 bp, Artificial Sequence
  Synthetic
ggacacatcaacgaccactctccgtcatccttcactcgtttcataaagagatcaggaatccaaagagctataaat

SEQ ID NO: 350269 - DNA, 75 bp, Artificial Sequence
  Synthetic
agatctctggttctatgttcctcgtttcctgtattctttttaagatcgaggaacgccataatatcagaatgccac

SEQ ID NO: 350270 - DNA, 75 bp, Artificial Sequence
  Synthetic
ggttccaagtatatggtcataactccaggccgtttgtttcctccctgatctatgtatctagcggtgttattataa

SEQ ID NO: 350271 - DNA, 75 bp, Artificial Sequence
  Synthetic
actctcaacattggaataataccattggatgcaccattggtcccggagatatagcttccactggcacgaatatta

SEQ ID NO: 350272 - DNA, 75 bp, Artificial Sequence
  Synthetic
ctaattgatagacctatcccccctgccattttagagattaatgcgcatcgttttaacgtatcatagatgccctct

SEQ ID NO: 350273 - DNA, 75 bp, Artificial Sequence
  Synthetic
gaaaacagctagacatttggtgacgactagttcccgcattaaataaggtaggagaagcgtgcgtaaaccattttt

SEQ ID NO: 350274 - DNA, 75 bp, Artificial Sequence
  Synthetic
cagaaagtagattgtacgtctcgatagctgagtctatatcccattgatgaattcctactgcgacacgcattaaca

SEQ ID NO: 350275 - DNA, 75 bp, Artificial Sequence
  Synthetic
tgtgctgaggtctttcaacgatcttgttgtttattttcagcaagtaggatttttccaaagttttaaaaccaaaat

SEQ ID NO: 350276 - DNA, 75 bp, Artificial Sequence
  Synthetic
agttgtatgaaaagtctcgttcgtaaataataactgagttgagtttatccttatatttgttaactacatccatgg

SEQ ID NO: 350277 - DNA, 75 bp, Artificial Sequence
  Synthetic
taatacttgaaataatcggagaatgtttcccatttttaggattgacatagttaaataaatccttcatcacttcac

SEQ ID NO: 350278 - DNA, 75 bp, Artificial Sequence
  Synthetic
taaatagtttttttgtttctttgtgtagatttgatacggctattctagcggctagaatggcataatccggatgtt

SEQ ID NO: 350279 - DNA, 75 bp, Artificial Sequence
  Synthetic
gtgtagtacaagtggctgctatttcggctgtcagagtgtccaattctaccgttgttactccattatatattcctt

SEQ ID NO: 350280 - DNA, 75 bp, Artificial Sequence
  Synthetic
ggataaccttcatagctattttaataggatctatatgatcagtgtttaagccataacataattttctaatacgag

SEQ ID NO: 350281 - DNA, 75 bp, Artificial Sequence
  Synthetic
atgtgattttatcaaacatgacattttccttgtatccatttcgtttaatgacaaacatttttgttggtgtaataa

SEQ ID NO: 350282 - DNA, 75 bp, Artificial Sequence
  Synthetic
atcaacgccttagaaataagagacttaaacaacggacacctggaattattaccatagaagatgttagaaaaatga

SEQ ID NO: 350283 - DNA, 75 bp, Artificial Sequence
  Synthetic
atcaacgccttagaaataagagacttaaacaacggacacctggaattattaccatagaagatgttagaaaaatgt

SEQ ID NO: 350284 - DNA, 75 bp, Artificial Sequence
  Synthetic
atcaacgccttagaaataagagacttaaacaacggacacctggaattattaccatagaagatgttagaaaaatgc

SEQ ID NO: 350285 - DNA, 75 bp, Artificial Sequence
  Synthetic
atcaacgccttagaaataagagacttaaacaacggacacctggaattattaccatagaagatgttagaaaaatgg

SEQ ID NO: 350286 - DNA, 75 bp, Artificial Sequence
  Synthetic
aaaaaattatttaacttttcattaatagggatttgatgtacgtagcgtacaaaattatcgttcctggtatataga

SEQ ID NO: 350287 - DNA, 75 bp, Artificial Sequence
  Synthetic
tagggatttgatgtacgtagcgtacaaaattatcgttcctggtatatagataaagagtcctatatatttgaaaat

SEQ ID NO: 350288 - DNA, 75 bp, Artificial Sequence
  Synthetic
gattgcattgtgaatatatcattaggatttaactccttgactatcatggcggtgccagaaattaccatcaaaagc

SEQ ID NO: 350289 - DNA, 75 bp, Artificial Sequence
  Synthetic
attaatacagttataccgatcgcagttagaacggttatagcatccgccatttatatctaaaaattagatcaaaga

SEQ ID NO: 350290 - DNA, 75 bp, Artificial Sequence
  Synthetic
atatgtgacaaagtcctagttgtatactgagaattaacgaaacaatgtttcttacatatttttttcttattagta

SEQ ID NO: 350291 - DNA, 75 bp, Artificial Sequence
  Synthetic
actgacttaatagtaggaactggaaagctagacttgattattctataagtataaatacccttccaaataatattc

SEQ ID NO: 350292 - DNA, 75 bp, Artificial Sequence
  Synthetic
tctttgataaaagttccagaaaatgtagaattttttaaaaagttatcttttgctattaccaagattgtgtttaga

SEQ ID NO: 350293 - DNA, 75 bp, Artificial Sequence
  Synthetic
cgcttattattaatatgagtgataaaatccacaccgcctctagatatagcttttatttccacattagatggtaaa

SEQ ID NO: 350294 - DNA, 75 bp, Artificial Sequence
  Synthetic
tccaatagtgaaactatctttttaggaatgtatggactcgcgtttagaggagtgaacgtcttaggcgtcggaaag

SEQ ID NO: 350295 - DNA, 75 bp, Artificial Sequence
  Synthetic
gatgattcatcaaacgaataaacaatttcacaaatggatgttaatgtattagtaggaaattttttgacgctagtg

SEQ ID NO: 350296 - DNA, 75 bp, Artificial Sequence
  Synthetic
gaattgaaaattctaatggatgatgttctacctatttcatcagataacatgttaatttccgacatcaacggtttt

SEQ ID NO: 350297 - DNA, 75 bp, Artificial Sequence
  Synthetic
tagatccctccattatcgcgattgcatagatgaggtactattttataccttgtaattaaatttttttattaatta

SEQ ID NO: 350298 - DNA, 75 bp, Artificial Sequence
  Synthetic
tccacaatacgagtcattatatactccaaaaaacaaaataactagtataaaatctgtatcgaatgggaaaaacga

SEQ ID NO: 350299 - DNA, 75 bp, Artificial Sequence
  Synthetic
attaattaaacgtataaaaacgttccgtatctgtatttaagagccagatttcgtctaatagaacaaatagctaca

SEQ ID NO: 350300 - DNA, 75 bp, Artificial Sequence
  Synthetic
aattatcgacataggtatagaatccggaacattgaacgtattaatacttaattctttttcagtggtaagaaccga

SEQ ID NO: 350301 - DNA, 75 bp, Artificial Sequence
  Synthetic
taggttattgacattgtatggttttaaatattctataacttgagacttgatagatattaatgacgaattgaaaat

SEQ ID NO: 350302 - DNA, 75 bp, Artificial Sequence
  Synthetic
tatttttatcaccacgtgtgtttcaggatcgtcatcgatacccgtcaaccaaccaaacggagtaaaataaatatc

SEQ ID NO: 350303 - DNA, 75 bp, Artificial Sequence
  Synthetic
attaatatatgctctagatattagtatttttattaatcctttgattatcatcttctcgtacgcgaatgattccat

SEQ ID NO: 350304 - DNA, 75 bp, Artificial Sequence
  Synthetic
aatgtattagttaaatattaaacttaccacgtaaaacttaaaatttaaaatggtatttcattgacggatagatca

SEQ ID NO: 350305 - DNA, 75 bp, Artificial Sequence
  Synthetic
gatcaagagtgatttgagaacatcctccggagtattaatgggcttagtaaacagtccatcgttgcaataataaaa

SEQ ID NO: 350306 - DNA, 75 bp, Artificial Sequence
  Synthetic
gttatccaagttaaaggatattatgcattcgtttaaagatattacctcatctgacggagacaattttttggtagg

SEQ ID NO: 350307 - DNA, 75 bp, Artificial Sequence
  Synthetic
ttttagagactttgaagctacttgtttaacaaagttattcatcgtcgtctactattctatttaattttgtagtta

SEQ ID NO: 350308 - DNA, 75 bp, Artificial Sequence
  Synthetic
atttatcacatatcacattaattgactttttggtccacttttccatacgtttatattcttttaatcctgcgttat

SEQ ID NO: 350309 - DNA, 75 bp, Artificial Sequence
  Synthetic
ccgtttccgttatatccagggatagatcttgcaagttaaatagaatgctcttaaataatgtcatttttttatccg

SEQ ID NO: 350310 - DNA, 75 bp, Artificial Sequence
  Synthetic
ctaaaaatttaaagaatgtataaaccttttttagagatttgaaactcttaggtggtgtcctagtacacaatatca

SEQ ID NO: 350311 - DNA, 75 bp, Artificial Sequence
  Synthetic
taaacaaactaataaacattccacattcagattccaacagttgattaacttccacattaatacagcctattttcg

SEQ ID NO: 350312 - DNA, 75 bp, Artificial Sequence
  Synthetic
ttcagattccaacagttgattaacttccacattaatacagcctattttcgctccaaatatacattcgaaaaatct

SEQ ID NO: 350313 - DNA, 75 bp, Artificial Sequence
  Synthetic
aaataaaacatcaatgtcgcaatttgtattatccaatacagaatgtctgtgattcgtgttaaaaccatcggagaa

SEQ ID NO: 350314 - DNA, 75 bp, Artificial Sequence
  Synthetic
ggaatagaaataaaaattattatagtggtggaattcagttggaatattgcctccggagtcataaaaggatactaa

SEQ ID NO: 350315 - DNA, 75 bp, Artificial Sequence
  Synthetic
acattgttttttatcataaattacacatttccaatgagacaaataacaaaatccaaacattacaaatctagaggt

SEQ ID NO: 350316 - DNA, 75 bp, Artificial Sequence
  Synthetic
agaacttttaattttgtctttaagtatatacgataagatatgtttattcataaacgcgtcaaatttttcatgaat

SEQ ID NO: 350317 - DNA, 75 bp, Artificial Sequence
  Synthetic
cgctaaggagtttaagaatctcatgtcaaattgtcctatataatccacttcggatccataagcaaactgagagac

SEQ ID NO: 350318 - DNA, 75 bp, Artificial Sequence
  Synthetic
accacgtttgttattactccaatgggtatgctgactataacagatacattatatgatgatctcgatatctcaata

SEQ ID NO: 350319 - DNA, 75 bp, Artificial Sequence
  Synthetic
taagttcttaatacttcgattgctcatccaggctcctctctcaggctctattttcatcttgacgacctttggatt

SEQ ID NO: 350320 - DNA, 75 bp, Artificial Sequence
  Synthetic
ttcaccagtatgtattcctttacgtgataaatcatcgattttcaaatccatttgtgagaagtctattgccttaga

SEQ ID NO: 350321 - DNA, 75 bp, Artificial Sequence
  Synthetic
tactttttcccgtagtcgaggtttaaagaaatacgctaacggtatactagtaggtaactcaaagacatcatatat

SEQ ID NO: 350322 - DNA, 75 bp, Artificial Sequence
  Synthetic
agaatgataacgcgtctttaactcatcggttaactctttcttttgatcgagttcgtcgctactattgggtctgct

SEQ ID NO: 350323 - DNA, 75 bp, Artificial Sequence
  Synthetic
caggtgcctcgactctactagttccaacatcataccaataggaatacaagacactttgccagcggttgtagattt

SEQ ID NO: 350324 - DNA, 75 bp, Artificial Sequence
  Synthetic
atcatatttctccactacatatccgttacaatttgttaagaatttagatacatctatattgctacataatccagc

SEQ ID NO: 350325 - DNA, 75 bp, Artificial Sequence
  Synthetic
tagtgaatatatatgacataataaattggtaaatcctagttctggtattttactaattactaaatctgtatatct

SEQ ID NO: 350326 - DNA, 75 bp, Artificial Sequence
  Synthetic
ttccatttatcatggaaaagaatttaccagatatcttcttttttccaaactgcgttaatgtattctcttacaaat

SEQ ID NO: 350327 - DNA, 75 bp, Artificial Sequence
  Synthetic
tgcgttaatgtattctcttacaaatattcacaagatgaatttagtaatatgagtaacatggaacgtgatagtttc

SEQ ID NO: 350328 - DNA, 75 bp, Artificial Sequence
  Synthetic
tctttggcggtgtttccagttataaaacatagatggcataacgcacacgttgtaaaacataaaggaatatacaaa

SEQ ID NO: 350329 - DNA, 75 bp, Artificial Sequence
  Synthetic
gttagtacagaagcacatggaaaaaaagtatctcctccatcactaggaaaaccctcacacataaacctaaccgcg

SEQ ID NO: 350330 - DNA, 75 bp, Artificial Sequence
  Synthetic
aagcaatatatatacagtgaacacacaataagctttgaatgttatagttttctaaaatgtataacaaatgcagaa

SEQ ID NO: 350331 - DNA, 75 bp, Artificial Sequence
  Synthetic
attaattcgttcgatgagtatatattaagaggactattagaagctggtaatagtttacagatattttccaattcc

SEQ ID NO: 350332 - DNA, 75 bp, Artificial Sequence
  Synthetic
gtaggtaaacgaacagatactataggtgtactagggaataagtatccatttagcaaaattccattggcctcatta

SEQ ID NO: 350333 - DNA, 75 bp, Artificial Sequence
  Synthetic
tagcaaaattccattggcctcattaactcctaaagcacaacgagagatattttcagcatggatttctcatagacc

SEQ ID NO: 350334 - DNA, 75 bp, Artificial Sequence
  Synthetic
cgtagttttaactggaggaaccggagtgggtaagacgtcacaggtacccaagttattgctttggtttaattattt

SEQ ID NO: 350335 - DNA, 75 bp, Artificial Sequence
  Synthetic
atttggtggattctctactctagataaaatcactgactttcacgaaagaccagtcattctatctcttcctaggat

SEQ ID NO: 350336 - DNA, 75 bp, Artificial Sequence
  Synthetic
agctttagttagattgcatagcaataccattttaaaatcattgggatttaaggtactagatggatctcctatttc

SEQ ID NO: 350337 - DNA, 75 bp, Artificial Sequence
  Synthetic
tttacggtacggatctataccggaagaattaataaacaaacaaccaaaaaaatatggaattgtattttctaccca

SEQ ID NO: 350338 - DNA, 75 bp, Artificial Sequence
  Synthetic
taagttatctctaacaaaactatttagttatggcactcttattatagacgaagttcatgagcatgatcaaatagg

SEQ ID NO: 350339 - DNA, 75 bp, Artificial Sequence
  Synthetic
agatattattatagcagtagcgagaaagcatcatacgaaaatagattctatgtttttaatgactgccacgttaga

SEQ ID NO: 350340 - DNA, 75 bp, Artificial Sequence
  Synthetic
ggatgacagggaacggctaaaagtatttttacctaatcccgcatttatacatattcctggagatacactgtttaa

SEQ ID NO: 350341 - DNA, 75 bp, Artificial Sequence
  Synthetic
aattagcgaggtatttattcataataagataaatccatcttccagaatggcatacatagaagaagaaaagagaaa

SEQ ID NO: 350342 - DNA, 75 bp, Artificial Sequence
  Synthetic
tttagttactgctatacagatgtatactcctcctgatggatcatctggtatagtctttgtggcatccgttgcaca

SEQ ID NO: 350343 - DNA, 75 bp, Artificial Sequence
  Synthetic
gtgtcacgaatataaatcatatttagaaaaaagattaccgtatgatatgtatattattcatggtaaggtcttaga

SEQ ID NO: 350344 - DNA, 75 bp, Artificial Sequence
  Synthetic
aatagacaaaatattagaaaaagtgtattcatcgcctaatgtatcgataattatttctactccttatttggaatc

SEQ ID NO: 350345 - DNA, 75 bp, Artificial Sequence
  Synthetic
cagcgttactatacacaatgttactcacatttatgatatgggtagagtttttgttcccgctccttttggaggatc

SEQ ID NO: 350346 - DNA, 75 bp, Artificial Sequence
  Synthetic
acaacaatttatttctaaatctatgagagatcaacgaaaaggaagagtaggaagagttaatcctggtacatacgt

SEQ ID NO: 350347 - DNA, 75 bp, Artificial Sequence
  Synthetic
ctttccattcttgaagtactataagtaattatagtataatgtaacgtttatatattcaatattttttataaaaaa

SEQ ID NO: 350348 - DNA, 75 bp, Artificial Sequence
  Synthetic
ctatttctatgatctgtcttatatgaagtctatacagcgaataaattcagaatttctacataattatatattgta

SEQ ID NO: 350349 - DNA, 75 bp, Artificial Sequence
  Synthetic
cgctaataagtttaatttaacacttcccgaagatttgtttataatccctacaaatttggatattctatggcgtac

SEQ ID NO: 350350 - DNA, 75 bp, Artificial Sequence
  Synthetic
aaaggaatatatagactcgttcgatattagtacagaaacatggaataaattattatccaattattatatgaagat

SEQ ID NO: 350351 - DNA, 75 bp, Artificial Sequence
  Synthetic
gatagagtatgctaaactttatgtactaagtcctattctcgctgaggagttggataactttgagaggacgggaga

SEQ ID NO: 350352 - DNA, 75 bp, Artificial Sequence
  Synthetic
attaactagtattgtacaagaagccattttatctctaaatttacgaattaagattttaaattttaaacataaaga

SEQ ID NO: 350353 - DNA, 75 bp, Artificial Sequence
  Synthetic
taatgatacgtatatacacttttgtaaaatattatttggtgtctataacggaacaaacgctactatatattatca

SEQ ID NO: 350354 - DNA, 75 bp, Artificial Sequence
  Synthetic
tagacctctaacgggatatatgaatatgatttcagatactatatttgttcctgtagataataactaaaaatcaaa

SEQ ID NO: 350355 - DNA, 75 bp, Artificial Sequence
  Synthetic
ctctaatgaccacatctttttttagagatgaaaaattttccacatctccttttgtagatatgactaaacattttg

SEQ ID NO: 350356 - DNA, 75 bp, Artificial Sequence
  Synthetic
cagaaaaaagtttattagtgtttagataatcgtatacttcatcagtgtagatagtaaatgtgaacagataaaagg

SEQ ID NO: 350357 - DNA, 75 bp, Artificial Sequence
  Synthetic
tattcttgctcaatagattggtaaattccatagaatatattaatccttttttcttgagatcccacatcatttcaa

SEQ ID NO: 350358 - DNA, 75 bp, Artificial Sequence
  Synthetic
ccagagaagttttatccaataatttacctcgtactataccacatacaaaactagattttgtagtgacgtcgtacc

SEQ ID NO: 350359 - DNA, 75 bp, Artificial Sequence
  Synthetic
tggcattcctaccaaacaaaattttacttttagtttttttagaaaattctaaggtagaatctctatttgtcaata

SEQ ID NO: 350360 - DNA, 75 bp, Artificial Sequence
  Synthetic
tgtcatctatggaattaccactagcaaaaaatgatagaaatatatattgatacatcgcagctggttttgatctac

SEQ ID NO: 350361 - DNA, 75 bp, Artificial Sequence
  Synthetic
tatattttaaaaacgaatcagattccataattgcctgtatatcatcagctgaaaaactatgttttacacgtattc

SEQ ID NO: 350362 - DNA, 75 bp, Artificial Sequence
  Synthetic
cttcggcatttctttttaatgatatatcttgtttagacaatgataaagttatcatgtccatgagagacgcgtctc

SEQ ID NO: 350363 - DNA, 75 bp, Artificial Sequence
  Synthetic
cgtatcgtataaatatttcattagatgttagacgcttcattaggggtatacttctataaggtttcttgattagcc

SEQ ID NO: 350364 - DNA, 75 bp, Artificial Sequence
  Synthetic
catcatttgttgcgtcaagaactactatcggatgttgttgggtatctctagtgttacacatggccttactaaagt

SEQ ID NO: 350365 - DNA, 75 bp, Artificial Sequence
  Synthetic
ttgggtaaataactatgatatctctattaattatagatgtatatatttcattcgtcaaggatattagtatcgact

SEQ ID NO: 350366 - DNA, 75 bp, Artificial Sequence
  Synthetic
tgctatcgtcattaatacgtgtaatgtaatcatataaatcatgcgatagccaaggaaaattcaaatagatgttca

SEQ ID NO: 350367 - DNA, 75 bp, Artificial Sequence
  Synthetic
tcatataatcatcgctataattcatattaatacgttgacattgactaatttgtaatatagcctcgccacgaagaa

SEQ ID NO: 350368 - DNA, 75 bp, Artificial Sequence
  Synthetic
agctctcgtattcagtttcatcaataaaggataccgttaaatataactggttgccgattgtctcatagtctatta

SEQ ID NO: 350369 - DNA, 75 bp, Artificial Sequence
  Synthetic
agtggtaagtttcgtacaaatacagaatccctaaaatattatctaatgttggattaatctttaccataactgtat

SEQ ID NO: 350370 - DNA, 75 bp, Artificial Sequence
  Synthetic
aaaatggagacggagtcataactattttaccgtttgtacttactggaatagatgaaggaataatctccggacatg

SEQ ID NO: 350371 - DNA, 75 bp, Artificial Sequence
  Synthetic
atatgcaattcgctaaacaatgttatgagcattcaaatccgaaattgaccgagaaagaattatcggataaaatct

SEQ ID NO: 350372 - DNA, 75 bp, Artificial Sequence
  Synthetic
ctggtaaagacccaaatgtctggttgaagaaatccaatgttccgggtcctaatctcttgacaaaaattacgatat

SEQ ID NO: 350373 - DNA, 75 bp, Artificial Sequence
  Synthetic
tcgatcccgatatcctttgcattctatttaccagcatatcacgaactatattaagattatctatcatgtctattc

SEQ ID NO: 350374 - DNA, 75 bp, Artificial Sequence
  Synthetic
tcccaccgttatataaatcgcctccgctaagaaacgttagtatatccatacaatggaatacttcatttctaaaat

SEQ ID NO: 350375 - DNA, 75 bp, Artificial Sequence
  Synthetic
agtattcgttttctaattctttaatgtgaaatcgtatactagaaagggaaaaattatctttaagttttccgttag

SEQ ID NO: 350376 - DNA, 75 bp, Artificial Sequence
  Synthetic
aaaagaaccacgaaactaatgttctgattgcgtctgactccgtcgctgaattaatggatttacaccaaaaactca

SEQ ID NO: 350377 - DNA, 75 bp, Artificial Sequence
  Synthetic
tataacttctagatgtagaagcattagctaaaaaaatagtagaatcaaaggatataagtagatgttccaacaagt

SEQ ID NO: 350378 - DNA, 75 bp, Artificial Sequence
  Synthetic
gagcaattcccaaaatttcatctatatcattctcaaatccgaaattagaaattcccaagtagatatcttttttca

SEQ ID NO: 350379 - DNA, 75 bp, Artificial Sequence
  Synthetic
tccgatcattaataaaaatacgaactttattcggtaagacgatcatttactaaggagtaaaataggaagtaatgt

SEQ ID NO: 350380 - DNA, 75 bp, Artificial Sequence
  Synthetic
tcgtatatcgttatcatcgtataaattaaaggtgtgttttttaccattaagtgacattataattttaccaatatt

SEQ ID NO: 350381 - DNA, 75 bp, Artificial Sequence
  Synthetic
ggaattataatataggtatatttgcgcacttgcgacagttgatgcatcggtaaatatagctgtatctaatgttct

SEQ ID NO: 350382 - DNA, 75 bp, Artificial Sequence
  Synthetic
tgatattcagaaagctgtggatgtttgggtcgacatccactgatggtgttacaccaatcggttcagtgacgtctg

SEQ ID NO: 350383 - DNA, 75 bp, Artificial Sequence
  Synthetic
agtcggtatttcatcatttcgctgtataataatagcgttttctctatctgtttccattacagctgcctgaagttt

SEQ ID NO: 350384 - DNA, 75 bp, Artificial Sequence
  Synthetic
attggtcggataatatgtaaaataataagaaatacatacgaataacaaaaataaaataaaatataataaagatgc

SEQ ID NO: 350385 - DNA, 75 bp, Artificial Sequence
  Synthetic
catttagagatctaattttgttcaacttgtccaaattcctacttacagaagataaggaatcgttggagatagtgt

SEQ ID NO: 350386 - DNA, 75 bp, Artificial Sequence
  Synthetic
cttccttatgtagaggatttgaaatatcttatgatgacttgataacttactttccagatagaaaatatcataaat

SEQ ID NO: 350387 - DNA, 75 bp, Artificial Sequence
  Synthetic
atatttataaagtatttgaacatgtagatttatcggaggaattaagtatggaattccatgatacaactctgcgag

SEQ ID NO: 350388 - DNA, 75 bp, Artificial Sequence
  Synthetic
gcgatttcacgttccagattacgtttagccttcatgcgtctctccctctctctatcgagtttatcagagcagtct

SEQ ID NO: 350389 - DNA, 75 bp, Artificial Sequence
  Synthetic
atttagtctatcttaaattgtataagtattccaagtgtatacgaccgtgttataaattaggagataatctaaaag

SEQ ID NO: 350390 - DNA, 75 bp, Artificial Sequence
  Synthetic
aaaaaaatatcgccgtaccgttcttgtttttataaaaataacaattaacaattatcaaattttttctttaatatt

SEQ ID NO: 350391 - DNA, 75 bp, Artificial Sequence
  Synthetic
gcatagttgttataagggacagaaatatatatattagagaagcaaatgatgacttgatagaatatctcctcaagg

SEQ ID NO: 350392 - DNA, 75 bp, Artificial Sequence
  Synthetic
aatacactcctcagatttatacatattctaatgagcacgttcccatagctggttcaaaattaattctttgcggat

SEQ ID NO: 350393 - DNA, 75 bp, Artificial Sequence
  Synthetic
tttctcaagttacatttatggcgtatacaacgtctcatataacaacaaataaaaaggtagatgttctcgtttcca

SEQ ID NO: 350394 - DNA, 75 bp, Artificial Sequence
  Synthetic
aaaaatgtatagataaactagtcgatccaataaattatcaaatacttcaaaatttatttgataaaggaagcggaa

SEQ ID NO: 350395 - DNA, 75 bp, Artificial Sequence
  Synthetic
aaattaatatttctatttctatttctatttctactataatttactctctataacaaatgtcataacttagttctt

SEQ ID NO: 350396 - DNA, 75 bp, Artificial Sequence
  Synthetic
agtcagctcttaacgcaatctcttgcttcttcgtcatagtacgcgcaatcactgtgagatccattgctaccacgt

SEQ ID NO: 350397 - DNA, 75 bp, Artificial Sequence
  Synthetic
caataaacaaaatactcaggaagatattttattcggtaaccggtggccaaactccataatttgctttttctattt

SEQ ID NO: 350398 - DNA, 75 bp, Artificial Sequence
  Synthetic
cggattttagaatttccaaattcaccagcgatttatctgttttggtgaaatccaaggatttattaatgtccacaa

SEQ ID NO: 350399 - DNA, 75 bp, Artificial Sequence
  Synthetic
atgccatttgttttgtctgtggattgtatttgaaaatggaaacgatgtagttagatagatgcgctgcaaagtttc

SEQ ID NO: 350400 - DNA, 75 bp, Artificial Sequence
  Synthetic
ctattagggttccgcgctttacgtcacctagcatacttgaatcaccatcctttaaaaaaaatgataagatatcaa

SEQ ID NO: 350401 - DNA, 75 bp, Artificial Sequence
  Synthetic
catggagtatatcatactctgattttaattcttctactgcctcactgacattttcacaaatactacaatacggtt

SEQ ID NO: 350402 - DNA, 75 bp, Artificial Sequence
  Synthetic
taccgaaaataatcagtacgttcttcatttatgggtatcaaaaacttaaaatcgttactgctggaaaataaatca

SEQ ID NO: 350403 - DNA, 75 bp, Artificial Sequence
  Synthetic
gaaaattagtgttcgggtgagttggattatgtgagtactggattgcatattatattttatattttatattttata

SEQ ID NO: 350404 - DNA, 75 bp, Artificial Sequence
  Synthetic
ctgacgatattagatgataatttatacaaagtatacaatggaatatttgtggatacaatgagtatttatatagcc

SEQ ID NO: 350405 - DNA, 75 bp, Artificial Sequence
  Synthetic
gtcgccaattgtgtccgaaacttagaagagttaactacggtattcataaaatacgtaaacggatgggtaaaaaag

SEQ ID NO: 350406 - DNA, 75 bp, Artificial Sequence
  Synthetic
aagagttaactacggtattcataaaatacgtaaacggatgggtaaaaaagggagggcatgtaaccctttttatcg

SEQ ID NO: 350407 - DNA, 75 bp, Artificial Sequence
  Synthetic
atagaggaagtataaaaattaaacaaaacgttagagacaaaagacgtaaatattctaaatcaaccaaggacagaa

SEQ ID NO: 350408 - DNA, 75 bp, Artificial Sequence
  Synthetic
aaatgttagaattagaaaagtgtacatccaaaatacaaaatgttaccggatttatggaagaagaaataaaggcag

SEQ ID NO: 350409 - DNA, 75 bp, Artificial Sequence
  Synthetic
aaatacaattaaaaatcgataaactcacatttcaaatatatttatctgattctgataacataaaaatatcattga

SEQ ID NO: 350410 - DNA, 75 bp, Artificial Sequence
  Synthetic
atttattatttttgacgatgtcagatcttttgtataggagtcagacttgtattcaacatgcttttctataatcat

SEQ ID NO: 350411 - DNA, 75 bp, Artificial Sequence
  Synthetic
atgagatactaacacatttcaacaataatgagaatgttacattattttattgtgatgaacgagatgcagaatttg

SEQ ID NO: 350412 - DNA, 75 bp, Artificial Sequence
  Synthetic
ttatgtgtctagaggctaaaacatatttctttaccacaggagaatggccgttgataataagtaccgatcaggata

SEQ ID NO: 350413 - DNA, 75 bp, Artificial Sequence
  Synthetic
ctatgctatttgcgtctgttgataatcatcctaagatgataaaaaacttaactcaactgtttaaatttgttccat

SEQ ID NO: 350414 - DNA, 75 bp, Artificial Sequence
  Synthetic
ctgcagaggataactatttagcaaaattaacggcgttagtgaatggatgtgatttctttcctggactctatgggg

SEQ ID NO: 350415 - DNA, 75 bp, Artificial Sequence
  Synthetic
catctataacacccaccaacttaaacaaaatacaattgtttagtgattttacaatcaataatatagtcactagtt

SEQ ID NO: 350416 - DNA, 75 bp, Artificial Sequence
  Synthetic
tggcaattaaaaattattatagaaagactaactctaccgtagacgtgcgtaatattgttacgtttataaacgatt

SEQ ID NO: 350417 - DNA, 75 bp, Artificial Sequence
  Synthetic
acgctaatttagacgatgtctactcgtatattcctccttgtcaatgcactgttcaagaatttatattttccgcat

SEQ ID NO: 350418 - DNA, 75 bp, Artificial Sequence
  Synthetic
tagatgaaaaatggaacgattttaaatcatcttatttagagaccgttccgttaccctgtcaattaatgtacgcgt

SEQ ID NO: 350419 - DNA, 75 bp, Artificial Sequence
  Synthetic
tagaaccacgtaaggagattgatgtttcagaagttaaaactttatcatcttatatagatttcgaaaatactaaat

SEQ ID NO: 350420 - DNA, 75 bp, Artificial Sequence
  Synthetic
cagatatcgatgttataaaatctatatcctcgatctttggatattctaacgaaaactgtaacacgatagtgtttg

SEQ ID NO: 350421 - DNA, 75 bp, Artificial Sequence
  Synthetic
gcatctataaggataatttactactgagtataaatagttcattttactttaacaatagtctgttaataaccaata

SEQ ID NO: 350422 - DNA, 75 bp, Artificial Sequence
  Synthetic
ctaaaagtgataatataataaatataggttactagattaaaaatggttttccaagtagtgtgctctacatgcggt

SEQ ID NO: 350423 - DNA, 75 bp, Artificial Sequence
  Synthetic
aaagatatttctcacgaacgatataaattgattatacgaaaaaaatcattaaaggatgtactcgttagtgtaaag

SEQ ID NO: 350424 - DNA, 75 bp, Artificial Sequence
  Synthetic
taaaaaataagtatataaatactttttatttacggtactcttgtagtggtaatacccctactcgattattttttt

SEQ ID NO: 350425 - DNA, 75 bp, Artificial Sequence
  Synthetic
aacaaatgttgtaggttaaaattatctacacaaatagaacctcaacgtaacttaacagtgcaacctctattggat

SEQ ID NO: 350426 - DNA, 75 bp, Artificial Sequence
  Synthetic
ataaactaatatggatccggttaattttatcaagacatatgcacctagaggttctattatttttattaattatac

SEQ ID NO: 350427 - DNA, 75 bp, Artificial Sequence
  Synthetic
tatgtcattaacaagtcatttgaatccatcgatagaaaaacatgtgggtatttattatggtacgttattatcgga

SEQ ID NO: 350428 - DNA, 75 bp, Artificial Sequence
  Synthetic
acacttggtagttgaatcaacatatagaaaaggagttcaaatagtcccattggatagtttttttgaaggatatct

SEQ ID NO: 350429 - DNA, 75 bp, Artificial Sequence
  Synthetic
tagtgcaaaagtatacatgttagagaatattcaagttatgaaaatagcagctgatacgtcattaactttactggg

SEQ ID NO: 350430 - DNA, 75 bp, Artificial Sequence
  Synthetic
tattccatatggatttggtcataatagaatgtattgttttaaattggtagctgaatgttataaaaatgccggtat

SEQ ID NO: 350431 - DNA, 75 bp, Artificial Sequence
  Synthetic
taatacatcatctaaacgaatattgggcaaagatatttttctaagccaaaacttcacagatgataatagatggat

SEQ ID NO: 350432 - DNA, 75 bp, Artificial Sequence
  Synthetic
aaagatatatgattctaataatttaacattttggcaaattgattaccttaaagggtgagttaatatgcataacta

SEQ ID NO: 350433 - DNA, 75 bp, Artificial Sequence
  Synthetic
ctcctccgttgttttttccctcgttctttttcttaacgttgtttgccatcactctcataatgtaaagatattcta

SEQ ID NO: 350434 - DNA, 75 bp, Artificial Sequence
  Synthetic
aaatggtaaacttttgcatatcggacgcagaaattggtataaatgttgtaattgtattatttcccgtcaatggac

SEQ ID NO: 350435 - DNA, 75 bp, Artificial Sequence
  Synthetic
tagtcacagctccatcagttttatatcctttagagtatttctcactagtgtctagcattttagagcattccatga

SEQ ID NO: 350436 - DNA, 75 bp, Artificial Sequence
  Synthetic
tctgtttatcattgatattggccggaaagatagattttttattttttattatattactattggcaattgtagata

SEQ ID NO: 350437 - DNA, 75 bp, Artificial Sequence
  Synthetic
taacttctggtaaatatttttctaccttttcaatctcttctattttcaagccggctatatattctgctatattat

SEQ ID NO: 350438 - DNA, 75 bp, Artificial Sequence
  Synthetic
tgctagtatcaataccttttctggctaagaagtcatatgtggtattaactatatcagttttaactggtagttcca

SEQ ID NO: 350439 - DNA, 75 bp, Artificial Sequence
  Synthetic
ttagcctttccacttctgcagaataattagaaattggttctttaccagaaaatccagctactataataggctcac

SEQ ID NO: 350440 - DNA, 75 bp, Artificial Sequence
  Synthetic
cgatgatcattggcaaaatcctatattgtaccaaattaatgagagcatatttcatttccaataattctgctagtt

SEQ ID NO: 350441 - DNA, 75 bp, Artificial Sequence
  Synthetic
cttgagacattgatttatttgatgaatctagttggttctctagatactctaccatttctgccgcatacaataact

SEQ ID NO: 350442 - DNA, 75 bp, Artificial Sequence
  Synthetic
tgttagataaaatcagggttatcaaagtgtttagcgtggctagaatagtgggcttacatgtattaaagaatgcgg

SEQ ID NO: 350443 - DNA, 75 bp, Artificial Sequence
  Synthetic
tagtatgagtaaaccgttttaacgaattatatagtctccagaaatctgtggcgttgcatacatgagctgaatgac

SEQ ID NO: 350444 - DNA, 75 bp, Artificial Sequence
  Synthetic
gaataacaaaatacaagcatcttgttaacgggctcgtaaattgggataaaaattatgtttttattattttatatc

SEQ ID NO: 350445 - DNA, 75 bp, Artificial Sequence
  Synthetic
atcgaagattgtccaatatttttaatagctgctctttgtccattatttctatatttgactcgcaacaattgtaaa

SEQ ID NO: 350446 - DNA, 75 bp, Artificial Sequence
  Synthetic
tatttaatatttacaatatatgtaatcattatccagattgaacatacagtttgcacttgccatgattcgttatat

SEQ ID NO: 350447 - DNA, 75 bp, Artificial Sequence
  Synthetic
taccattaatcactgattccttttttgatgccggacaatagcacaattgtttagctttggactctatgtattcag

SEQ ID NO: 350448 - DNA, 75 bp, Artificial Sequence
  Synthetic
aattaatagatatatctctcaatacagattgtactatacattttgaaactatgtcaaaaattgtagaacgacgct

SEQ ID NO: 350449 - DNA, 75 bp, Artificial Sequence
  Synthetic
gttctgcagccatttaactttaaataatttacaaaaatttaaaatgagtatccgtataaaaatcgataaactgcg

SEQ ID NO: 350450 - DNA, 75 bp, Artificial Sequence
  Synthetic
ccaaattgtggcatatttttcagagttcagtgaagaagtgtctataaatgtagactcaacggatgagttaatgta

SEQ ID NO: 350451 - DNA, 75 bp, Artificial Sequence
  Synthetic
tatttttgccgccttgggcggatctgtaaacatttgggccattatacctcttagtgcatcagtgttctaccgcgg

SEQ ID NO: 350452 - DNA, 75 bp, Artificial Sequence
  Synthetic
agccgaaaatattgtgtttaatcttccggtgtccaaggtaaaatcgtgtttgtgtagttttcacaatgatgccat

SEQ ID NO: 350453 - DNA, 75 bp, Artificial Sequence
  Synthetic
catagatatagaacctgatctggaaaataatctagtaaaactttctagttatcatgtagtaagtgtcgattgtaa

SEQ ID NO: 350454 - DNA, 75 bp, Artificial Sequence
  Synthetic
caaggaactgatgcctattaggacagatactactatttgtctaagtatagatcaaaagaaatcttacgtgtttaa

SEQ ID NO: 350455 - DNA, 75 bp, Artificial Sequence
  Synthetic
ttttcacaagtatgaagaaaaatgttgtggtagaaccgtcattcatctagaatggttgttgggctttattaagtg

SEQ ID NO: 350456 - DNA, 75 bp, Artificial Sequence
  Synthetic
tattagtcagcatcagcatttgactattatgtttaaagatgacaatattattatgaagactcctggtaatactga

SEQ ID NO: 350457 - DNA, 75 bp, Artificial Sequence
  Synthetic
tgctttttccagggaatattctatgactgaatgttctcaagaactacaaaagttttctttcaaaatagctatctc

SEQ ID NO: 350458 - DNA, 75 bp, Artificial Sequence
  Synthetic
actgaatgttctcaagaactacaaaagttttctttcaaaatagctatctcgtctctcaacaaactacgaggattt

SEQ ID NO: 350459 - DNA, 75 bp, Artificial Sequence
  Synthetic
aaaaagagagtcaatgtttttgaaaccagaattgtaatggataatgacgataacattctaggaatgttgttttcg

SEQ ID NO: 350460 - DNA, 75 bp, Artificial Sequence
  Synthetic
gatagagttcaatcctttaagatcaacatctttatggcgtttttagattaatactttcaatgagataaatatggg

SEQ ID NO: 350461 - DNA, 75 bp, Artificial Sequence
  Synthetic
tggcggagtaagtgttgagctccctaaacgggatccgcctccgggagtacccactgatgagatgttattaaatgt

SEQ ID NO: 350462 - DNA, 75 bp, Artificial Sequence
  Synthetic
tgataaaatgcatgacgtgatagctcccgctaagcttttagaatatgtgcatataggaccactagcaaaagataa

SEQ ID NO: 350463 - DNA, 75 bp, Artificial Sequence
  Synthetic
agaggataaagtaaagaaaagatatccagagtttagattagttaatacaggacccggtggtctttcggcattatt

SEQ ID NO: 350464 - DNA, 75 bp, Artificial Sequence
  Synthetic
aagacaatcgtataatggaaccgcacccaactgctgtcacacttttaatcgtactcattattggaagaaggatgg

SEQ ID NO: 350465 - DNA, 75 bp, Artificial Sequence
  Synthetic
aacgccttagaaataagagacttaaacaacggacacctggaattattaccatagaagatgttagaaaaatgatgc

SEQ ID NO: 350466 - DNA, 75 bp, Artificial Sequence
  Synthetic
aaagatatcagataagtatgaagagggtgcagtattagaatcgtgttggccagacgttcacgataccggaaaatg

SEQ ID NO: 350467 - DNA, 75 bp, Artificial Sequence
  Synthetic
cgatgttaatttatttgactggtgtcagggggatacgttcgatagaaacatatgccatcagtggatcggttcagc

SEQ ID NO: 350468 - DNA, 75 bp, Artificial Sequence
  Synthetic
atttaataggagtgatagaactgtagagggtcaacaatcgttaataaatctgtataataagatgcaaacattatg

SEQ ID NO: 350469 - DNA, 75 bp, Artificial Sequence
  Synthetic
tagtaaagatgctagtgtaccaatatgcgaatcatttttgcatcatttacgcgcacacaatacagaagatagcaa

SEQ ID NO: 350470 - DNA, 75 bp, Artificial Sequence
  Synthetic
atactatatgtaaataatctgtcactgattaattatttgccgttgtctgtattcattattagacgagttacaaac

SEQ ID NO: 350471 - DNA, 75 bp, Artificial Sequence
  Synthetic
agagatgatcgattatattctaagacaacagtctgcgaactttaaacagaaatatatgagatgtagttatcccac

SEQ ID NO: 350472 - DNA, 75 bp, Artificial Sequence
  Synthetic
tagagataagttagaagagtcattaaaatatgcggaacctcgagaatgttgggatccagagtgttcgaatgccaa

SEQ ID NO: 350473 - DNA, 75 bp, Artificial Sequence
  Synthetic
tgttaatttcttactaacacgtaattataataatttaggactttgtaatattgtacgatgtaataccagcgtgaa

SEQ ID NO: 350474 - DNA, 75 bp, Artificial Sequence
  Synthetic
caacttacagatggataaaacttcctcattaagattgtcatgtggattaagcaatagtgatagattttctactgt

SEQ ID NO: 350475 - DNA, 75 bp, Artificial Sequence
  Synthetic
tcccgtcaatagagcaaaagtagttcaacataatattaaacactcgttcgatctaaaattgcatttgattagttt

SEQ ID NO: 350476 - DNA, 75 bp, Artificial Sequence
  Synthetic
taagtgttgtcaaagcggggttgatcttgtgctgttatatattgtctaacacctataagattatcaaaatcttgt

SEQ ID NO: 350477 - DNA, 75 bp, Artificial Sequence
  Synthetic
attatctctcttggtaatatggatactaattgtagctatttaaatgggtgccgcggcaagcatacagacgacggt

SEQ ID NO: 350478 - DNA, 75 bp, Artificial Sequence
  Synthetic
gaatacactcagcgaacgtatctcgtctaaattagaacaagaagcgaatgctagtgctcaaacaaaatgtgatat

SEQ ID NO: 350479 - DNA, 75 bp, Artificial Sequence
  Synthetic
agaaatcggaaatttttatatccgacaaaaccatggatgtaacctcactgttaaaaatatgtgctctgcagatgc

SEQ ID NO: 350480 - DNA, 75 bp, Artificial Sequence
  Synthetic
ggatgctcagttggatgctgtgttatcagccgctacagaaacatatagtggattaacaccggaacaaaaagcata

SEQ ID NO: 350481 - DNA, 75 bp, Artificial Sequence
  Synthetic
cgtaccagctatgtttactgctgcgttaaacattcagacgagtgtaaacactgttgttagagattttgaaaatta

SEQ ID NO: 350482 - DNA, 75 bp, Artificial Sequence
  Synthetic
tgtgaaacagacttgtaattctagcgcggtcgtcgataacaaattaaagatacaaaacgtaattatagatgaatg

SEQ ID NO: 350483 - DNA, 75 bp, Artificial Sequence
  Synthetic
ttacggagccccaggatctccaacaaatttggaatttattaatacaggatctagcaaaggaaattgtgccattaa

SEQ ID NO: 350484 - DNA, 75 bp, Artificial Sequence
  Synthetic
ggcgttgatgcaattgacgactaaggccactactcaaatagcacctagacaagttgctggtacaggagttcagtt

SEQ ID NO: 350485 - DNA, 75 bp, Artificial Sequence
  Synthetic
ttatatgattgttatcggtgttataatattggcagcgttgtttatgtactatgccaagcgtatgctgttcacgtc

SEQ ID NO: 350486 - DNA, 75 bp, Artificial Sequence
  Synthetic
caccaatgataaaatcaaacttattttagccaataaggaaaacgtccattggactacttacatggacacattctt

SEQ ID NO: 350487 - DNA, 75 bp, Artificial Sequence
  Synthetic
taacgtaaccagaattgtaaaattagaggtatgggataaaataataccttctactatgcaattaccaaaaggcct

SEQ ID NO: 350488 - DNA, 75 bp, Artificial Sequence
  Synthetic
tagaacttctccaatggttattgctaccacggatatacaaaactgaaaatatattgataatattttaatagatta

SEQ ID NO: 350489 - DNA, 75 bp, Artificial Sequence
  Synthetic
acatggaagttatcgctgatcgtctagatgatatagtgaaacaaaatatagcggatgaaaaatttgtagattttg

SEQ ID NO: 350490 - DNA, 75 bp, Artificial Sequence
  Synthetic
ttatacacggtctagagcatcaatgtcctgctatacttcggccattaattaggttgtttattgatatactattat

SEQ ID NO: 350491 - DNA, 75 bp, Artificial Sequence
  Synthetic
ttgttatagtaatttatatttttacggtacgtctagtaagtagaaattatcaaatgttgttggcgttattggcgc

SEQ ID NO: 350492 - DNA, 75 bp, Artificial Sequence
  Synthetic
tagtcatctcattaactattttttattactttatactataatagtactagactgacttctaacaaacatctcacc

SEQ ID NO: 350493 - DNA, 75 bp, Artificial Sequence
  Synthetic
tgccataaataaatgcttgatattaaagtcttctatttctaacactattccatctgtggaaaataatactctgac

SEQ ID NO: 350494 - DNA, 75 bp, Artificial Sequence
  Synthetic
attatcgctaattgacacatcggtgagtgatatgcctataaagtaataatcttctttgggcacatataccagtgt

SEQ ID NO: 350495 - DNA, 75 bp, Artificial Sequence
  Synthetic
accaggttctaacaacctatttactggtgctcctgtagcatactttttctttaccttaagaatatccatcgtttg

SEQ ID NO: 350496 - DNA, 75 bp, Artificial Sequence
  Synthetic
cttggtcaatagcgacaggtgattttttatcaaccattcaaaaaagtaattggagtgttcatatcctctacaggc

SEQ ID NO: 350497 - DNA, 75 bp, Artificial Sequence
  Synthetic
tattgtctcatgaccgtgtatgaaatttaagtaacacgactgtggtagatttgttctatagagccggttgccgca

SEQ ID NO: 350498 - DNA, 75 bp, Artificial Sequence
  Synthetic
aatagatagaactaccaatatgtctgtacaaatgttaaacattaattgattaacagaaaaaacaatgttcgttct

SEQ ID NO: 350499 - DNA, 75 bp, Artificial Sequence
  Synthetic
ttgttaaacgaattaaaattatttaatttaatacattcccatatccagacaacaatcgtctggattaatctgttc

SEQ ID NO: 350500 - DNA, 75 bp, Artificial Sequence
  Synthetic
gggaatagaaaccaaatcaaaacaaaattcattagaatatatgtcacgtttatacatcgaatataaaataactac

SEQ ID NO: 350501 - DNA, 75 bp, Artificial Sequence
  Synthetic
agtttgaaaaataacagtatcatttaaacatttaacttgcggggttaatctcacaactttactgtttttgaactg

SEQ ID NO: 350502 - DNA, 75 bp, Artificial Sequence
  Synthetic
ttcaaaatatagcatagatccgtgagaaatacgtttagccgcctttaatagaggaaatcccaccgcctttttgga

SEQ ID NO: 350503 - DNA, 75 bp, Artificial Sequence
  Synthetic
tcttaccaacgacgatagttctgaccagcaactcatttcttcatcatccacctgttttaacatataataggcagg

SEQ ID NO: 350504 - DNA, 75 bp, Artificial Sequence
  Synthetic
agatagatatccgtcattgcaatattccttctcgtaggcacacaatcgaatattgataaaatctccattctcttc

SEQ ID NO: 350505 - DNA, 75 bp, Artificial Sequence
  Synthetic
tctgcatttattatcttgtcttggtggtgggctaggctgtagtcttggtctattattaccatcgttgttgaatct

SEQ ID NO: 350506 - DNA, 75 bp, Artificial Sequence
  Synthetic
atttctgtcattaaatctttcatttcttcctggtatatttttattacctcgcttggttggatttttgtctatatt

SEQ ID NO: 350507 - DNA, 75 bp, Artificial Sequence
  Synthetic
atcgtttgtaacatcggtacgggtattcatttatcacaaaaaaaacttctctaaatgagtctactgctagaaaac

SEQ ID NO: 350508 - DNA, 75 bp, Artificial Sequence
  Synthetic
ctcatcgaagaagataccatattttttgcaggaagtatatctgagtatgatgatttacaaatggttattgccggt

SEQ ID NO: 350509 - DNA, 75 bp, Artificial Sequence
  Synthetic
gcagacaaaatgaagatccaagatttgtagaagcatttaaatgcgacgagttagaaagatatattaagaataatc

SEQ ID NO: 350510 - DNA, 75 bp, Artificial Sequence
  Synthetic
gcaaaatccaaatttccaagatctatgctttctatttttaatatagtacctagaacaatgtcaaaatatgagttg

SEQ ID NO: 350511 - DNA, 75 bp, Artificial Sequence
  Synthetic
gagttaattcataacgagaatatcacaggggcaatgtttaccacaatgtataatataagaaacaatttgggttta

SEQ ID NO: 350512 - DNA, 75 bp, Artificial Sequence
  Synthetic
ggtgatgataaactaactattgaagccattgaaaactatttcttggatcctaacaatgaggttatgcctcttatt

SEQ ID NO: 350513 - DNA, 75 bp, Artificial Sequence
  Synthetic
attaataatacggatatgacggccgtcattcctaaaaaaagtggtaggagaaagaataagaacatggttatcttc

SEQ ID NO: 350514 - DNA, 75 bp, Artificial Sequence
  Synthetic
cgtcaaggatcatcacctatcttgtgtattttcgaaactcgtaaaaagattaatatttataaagaaaatatggaa

SEQ ID NO: 350515 - DNA, 75 bp, Artificial Sequence
  Synthetic
tccgcatcgactgagtatacacctatcggagacaacaaggctttaatatctaaatatgcgggaattaatgtcctg

SEQ ID NO: 350516 - DNA, 75 bp, Artificial Sequence
  Synthetic
aatgtgtattctccttccacatccatgagattgaatgccatttacggattcaccaataaaaataaactagaaaaa

SEQ ID NO: 350517 - DNA, 75 bp, Artificial Sequence
  Synthetic
cttagtactaataaggaactagaattgtatagttctagccctcttcaagaacccattaggttaaatgattttctg

SEQ ID NO: 350518 - DNA, 75 bp, Artificial Sequence
  Synthetic
ggactattggaatgtgttaaaaagaatattcctctaacagatattccgacaaaggattgattactataaatggag

SEQ ID NO: 350519 - DNA, 75 bp, Artificial Sequence
  Synthetic
aatgttcctaatgtatactttaatcctgtgtttatagagcccacgtttaaacattctttattaagtgtttataaa

SEQ ID NO: 350520 - DNA, 75 bp, Artificial Sequence
  Synthetic
cacagattaatagttttatttgaagtatttgttgtattcattctaatatatgtattttttagatctgaattaaat

SEQ ID NO: 350521 - DNA, 75 bp, Artificial Sequence
  Synthetic
atgttcttcatgcataaacgaaaaatacccgatcctattgatagattacgacgtgctaatctagcgtgtgaagac

SEQ ID NO: 350522 - DNA, 75 bp, Artificial Sequence
  Synthetic
tttatgctataggtggtcaaaaactgaagtttaacattatttatttatgatatatatattatatatcggtatcgt

SEQ ID NO: 350523 - DNA, 75 bp, Artificial Sequence
  Synthetic
gataaattaatgatctatggattaccatggataacaactcaaacatctgcattatcaataaatagtaaaccgata

SEQ ID NO: 350524 - DNA, 75 bp, Artificial Sequence
  Synthetic
gtgtataaagattgtgcaaagcttttgcgatcaataaatggatcacaaccagtatctcttaacgatgttcttcgc

SEQ ID NO: 350525 - DNA, 75 bp, Artificial Sequence
  Synthetic
agatgatgattcattttttaagtatttggctagtcaagatgatgaatcttcattatctgatatattgcaaatcac

SEQ ID NO: 350526 - DNA, 75 bp, Artificial Sequence
  Synthetic
tcaatatctagactttctgttattattattgatccaatcaaaaaataaattagaagctgttggtcattgttatga

SEQ ID NO: 350527 - DNA, 75 bp, Artificial Sequence
  Synthetic
atctctttcagaggaatacagacaattgacaaaattcacagactctcaagattttaaaaaactgtttaacaaggt

SEQ ID NO: 350528 - DNA, 75 bp, Artificial Sequence
  Synthetic
ccctattgttacagatggaagggtcaaacttaataaaggatatttgtccgactttgtgattagtttgatgcgatt

SEQ ID NO: 350529 - DNA, 75 bp, Artificial Sequence
  Synthetic
caaaaaagaatcagctctagctaccaccgcaatagatcctgttagatacatagatcctcgtcgcgatatcgcatt

SEQ ID NO: 350530 - DNA, 75 bp, Artificial Sequence
  Synthetic
ttctaacgtgatggatatattaaagtcaaataaagtgaaaaataattattctttattgtcatcatgaacggcggg

SEQ ID NO: 350531 - DNA, 75 bp, Artificial Sequence
  Synthetic
catattcagttgataatcggccccatgttttcaggtaaaagtacagaattaattagacgagttagacgttatcaa

SEQ ID NO: 350532 - DNA, 75 bp, Artificial Sequence
  Synthetic
atagctcaatataaatgcgtgactataaaatattctaacgataatagatacggaacgggactatggacgcatgat

SEQ ID NO: 350533 - DNA, 75 bp, Artificial Sequence
  Synthetic
aagaataattttgaagcattggaagcaactaaactatgcgatgtcttggaagcaattacagatttctccgtgata

SEQ ID NO: 350534 - DNA, 75 bp, Artificial Sequence
  Synthetic
ggtattgatgaaggacagttctttccagacattgttgaattctgtgagcgtatggcaaacgaaggaaaaatagtt

SEQ ID NO: 350535 - DNA, 75 bp, Artificial Sequence
  Synthetic
atagtagccgcactcgatgggacatttcaacgtaaaccgtttaataatatcttggatcttattccattatctgaa

SEQ ID NO: 350536 - DNA, 75 bp, Artificial Sequence
  Synthetic
atggtggtaaaactaactgcagtgtgtatgaaatgctttaaggaggcgtccttttctaaacgattaggtacagaa

SEQ ID NO: 350537 - DNA, 75 bp, Artificial Sequence
  Synthetic
accaagatagaaataataggaggaattgatatgtatcaatcggtgtgtagaaagtgttacatcgactcataatat

SEQ ID NO: 350538 - DNA, 75 bp, Artificial Sequence
  Synthetic
tatattttttatctaaaaaactaaaaataaacattgattaaattttaatataatacttaaaaatggatgttgtgt

SEQ ID NO: 350539 - DNA, 75 bp, Artificial Sequence
  Synthetic
cgttagataaaccgtttatgtattttgaggaaattgataatgagttagattacgaaccagaaagtgcaaatgagg

SEQ ID NO: 350540 - DNA, 75 bp, Artificial Sequence
  Synthetic
aaagaggcaaaagatgtcaaggtggaagaaaaaaatatcgatattgaagatgacaatgatatggatgtagaaagc

SEQ ID NO: 350541 - DNA, 75 bp, Artificial Sequence
  Synthetic
tagcaaaaaaactgccgtatcaaggacagttaaaactattactaggagaattattttttcttagtaagttacagc

SEQ ID NO: 350542 - DNA, 75 bp, Artificial Sequence
  Synthetic
gacacggtatattagatggtgccaccgtagtgtatataggatctgctcccggtacacatatacgttatttgagag

SEQ ID NO: 350543 - DNA, 75 bp, Artificial Sequence
  Synthetic
atcatttctataatttaggagtgatcatcaaatggatgctaattgacggccgtcatcatgatcctattctaaatg

SEQ ID NO: 350544 - DNA, 75 bp, Artificial Sequence
  Synthetic
gattacgtgatgtgactctagtaactcggttcgttgatgaggaatatctacgatccatcaaaaaacaactgcatc

SEQ ID NO: 350545 - DNA, 75 bp, Artificial Sequence
  Synthetic
cttctaagattattttaatttctgatgtgcgatccaaacgaggaggaaatgaacctagtactgaggatttactaa

SEQ ID NO: 350546 - DNA, 75 bp, Artificial Sequence
  Synthetic
aaaaaaacgtgaacagtatcccctacatggattttactagatcatttatataccaaaaaatattatacgatctac

SEQ ID NO: 350547 - DNA, 75 bp, Artificial Sequence
  Synthetic
cccggatactggatatattttacagccaacacatgcatccatgcaacatttcctacatatacccggttatgcacc

SEQ ID NO: 350548 - DNA, 75 bp, Artificial Sequence
  Synthetic
gtaattacgctctacaaaatgtcatgattagtattttaaaccccgtagcgtctagtcttaaatggagatgcccgt

SEQ ID NO: 350549 - DNA, 75 bp, Artificial Sequence
  Synthetic
ttccagatcaatggattaaggacttttatatcccacacggtaataaaatgttacaaccttttgctccttcatatt

SEQ ID NO: 350550 - DNA, 75 bp, Artificial Sequence
  Synthetic
ctcgtaaaagactttcgttaatttgtctccttctccgtaaattccagtgggtcttggcaacaagtatacaatttt

SEQ ID NO: 350551 - DNA, 75 bp, Artificial Sequence
  Synthetic
cagctgaaatgagattattaagtatttataccggtgagaacatgagacttactcgagttaccaaatcagatgctg

SEQ ID NO: 350552 - DNA, 75 bp, Artificial Sequence
  Synthetic
taaattatgaaaaaaagatgtattaccttaataagatagttcgcaacaaagtagttgttaactttgattatccta

SEQ ID NO: 350553 - DNA, 75 bp, Artificial Sequence
  Synthetic
tgtccgggtgatatatcgtacagggtatgctcatgaccaatgaatggatcaccgtgtttatttggtcctattgct

SEQ ID NO: 350554 - DNA, 75 bp, Artificial Sequence
  Synthetic
atcaggaatatgactattttcacatgtactttatgttgaggaccgtatactgcaataaaacatttcctactacta

SEQ ID NO: 350555 - DNA, 75 bp, Artificial Sequence
  Synthetic
aagcaaaggtactatttctacaacaatctatatttcgtttcttaaatattccaacaacatcaactgaaaaagtta

SEQ ID NO: 350556 - DNA, 75 bp, Artificial Sequence
  Synthetic
gtcatgaaccaatacaatgtaaagtatctagcaaagattctgtgtataaaaacagaaatagcaagagatccgtac

SEQ ID NO: 350557 - DNA, 75 bp, Artificial Sequence
  Synthetic
ggatatgatccaagagggtgaaatagtcgttctcgttcagaatcttttgcagcataagtagtatgtcgatatact

SEQ ID NO: 350558 - DNA, 75 bp, Artificial Sequence
  Synthetic
gcggtaataaatagaaatgtgctactaagatatactaccgatatacagtataatgatttagttactttaataacc

SEQ ID NO: 350559 - DNA, 75 bp, Artificial Sequence
  Synthetic
gttagacataaaattgattctatgaaaactgtgtttcaggtatttaacgaatcatccataaattatactccggtc

SEQ ID NO: 350560 - DNA, 75 bp, Artificial Sequence
  Synthetic
gatgatgattacggagaaccaatcattataacatcgtatcttcaaaaaggtcataacaagtttcctgtaaatttt

SEQ ID NO: 350561 - DNA, 75 bp, Artificial Sequence
  Synthetic
ctatacatagatgtagtaatatctgatttatttcctagctttgttagactagatactacagaaactaatatagtt

SEQ ID NO: 350562 - DNA, 75 bp, Artificial Sequence
  Synthetic
aatagtgtactacaaacaggcgatggtaaaaagactcttcgtcttcccaaaatgttagagacggaaatagttgtc

SEQ ID NO: 350563 - DNA, 75 bp, Artificial Sequence
  Synthetic
aagattctctatcgtcctaatataccattaaaaattgttagatttttccgcaataacatgataactggtgtagag

SEQ ID NO: 350564 - DNA, 75 bp, Artificial Sequence
  Synthetic
atagccgatagatctgttatttcagtcgctgattaatcaattagtagagatgagataagaacataataatatatc

SEQ ID NO: 350565 - DNA, 75 bp, Artificial Sequence
  Synthetic
ttatatctcgtttagaaaaatgctaatattaaaatagctaacgctagtaatccaatcggaagccatttgatatct

SEQ ID NO: 350566 - DNA, 75 bp, Artificial Sequence
  Synthetic
ataatagggtatctaatttcctgattcagatagcggacagctatattctctgtagctactcgtttggaatcacaa

SEQ ID NO: 350567 - DNA, 75 bp, Artificial Sequence
  Synthetic
acattatttacatctaatttactatctgtaatggaaacgtttcccaatgaaatggtacaatcagatacattacat

SEQ ID NO: 350568 - DNA, 75 bp, Artificial Sequence
  Synthetic
cttgatatatttttttttaaagaggctggtaacaacgcatcgcttcgtttacatggctcgtaccaacagtaatag

SEQ ID NO: 350569 - DNA, 75 bp, Artificial Sequence
  Synthetic
ggtaatcttgtatctattcctatccgtactatgcttttatcaggataaatacatttacatcgtatatcgtctttg

SEQ ID NO: 350570 - DNA, 75 bp, Artificial Sequence
  Synthetic
ttagcatcacagaatgcataaatttgttcgtctgtcatgataaaaatttaaagtgtaaatataactattattttt

SEQ ID NO: 350571 - DNA, 75 bp, Artificial Sequence
  Synthetic
atagttgtaataaaaagggaaatttaattgtatacctttggttctttaaaagaaactgacttgataaaaatggct

SEQ ID NO: 350572 - DNA, 75 bp, Artificial Sequence
  Synthetic
gtagccaatcctaactctttcgaatacttattaatggctcttattctgtacgaatctattttttgaacaacggac

SEQ ID NO: 350573 - DNA, 75 bp, Artificial Sequence; identical to SEQ ID NO: 47220
  Synthetic

SEQ ID NO: 350574 - DNA, 75 bp, Artificial Sequence
  Synthetic
aaaaatgacgacgatatcggtaccgttaaagatggtagactaggtgctatggatggggcattatgtaagacttgt

SEQ ID NO: 350575 - DNA, 75 bp, Artificial Sequence
  Synthetic
gggaaaacggaattggaatgttttggtcactggggtaaagtaagtatctataaaactcatatagttaagcctgaa

SEQ ID NO: 350576 - DNA, 75 bp, Artificial Sequence; identical to SEQ ID NO: 47225
  Synthetic

SEQ ID NO: 350577 - DNA, 75 bp, Artificial Sequence
  Synthetic
tccaacgatattaacctaaaagagttatcgggacacgctcttagaagattaaaggataaaatattatccaagaaa

SEQ ID NO: 350578 - DNA, 75 bp, Artificial Sequence
  Synthetic
aagtcatgttggaatagcgaatgtatgcaaccgtatcaaaaaatttctttttcaaagaaaaaggtttgtttcgtc

SEQ ID NO: 350579 - DNA, 75 bp, Artificial Sequence
  Synthetic
aacaagttggatgatattaacgttcctaattctctcatttatcaaaagttaatttctattcatgaaaagttttgg

SEQ ID NO: 350580 - DNA, 75 bp, Artificial Sequence
  Synthetic
ccattattagaaattcatcaatatccagctaacttattttatacagactactttcctatccctccgttgattatt

SEQ ID NO: 350581 - DNA, 75 bp, Artificial Sequence
  Synthetic
agaccggctattagtttttggatagatagtatacccaaagagaccaatgaattaacttacttattaggtatgatc

SEQ ID NO: 350582 - DNA, 75 bp, Artificial Sequence
  Synthetic
atgtctctctcaaatcagacaaccatctcataaaatagttctcgcgtgctggagaggtagttgctgctcgtataa

SEQ ID NO: 350583 - DNA, 75 bp, Artificial Sequence
  Synthetic
gttaagaattgtaacttgaatgctgatgaacaggttatccaaaaggcggtaatagaatacgatgatattaaaatt

SEQ ID NO: 350584 - DNA, 75 bp, Artificial Sequence
  Synthetic
atttctaataacactaccagtatcaatttatcatatatcacatccggcaaaaataatatgattagaagttatatc

SEQ ID NO: 350585 - DNA, 75 bp, Artificial Sequence
  Synthetic
taataaattacctttacaagatatggttgtgccataatttttataaatttttttatgagtatttttatgagtatt

SEQ ID NO: 350586 - DNA, 75 bp, Artificial Sequence
  Synthetic
ttattatgatgaggtaaaaaataaaccgtttaatattgatccggggtattatattttcttaccggtatattttgg

SEQ ID NO: 350587 - DNA, 75 bp, Artificial Sequence
  Synthetic
gtcgcccggcgaaaagatcagaccgctagatctgtaattggtcccagtacatctatcacagttaatgaggtagga

SEQ ID NO: 350588 - DNA, 75 bp, Artificial Sequence
  Synthetic
tttacaaaaaatgtataaagtgtatgtcttatgtatatttataaaaatgctaaatgtgatgtatctatgttattt

SEQ ID NO: 350589 - DNA, 75 bp, Artificial Sequence
  Synthetic
atttttttaaatttttaacgatttactgtggctagatacccaatctctctcaaatatttttttagcctcgcttac

SEQ ID NO: 350590 - DNA, 75 bp, Artificial Sequence
  Synthetic
atgcccgcatatattagaaatacacttacagaaaagatatttgttaatgcctttacagtgaataaagttaaacaa

SEQ ID NO: 350591 - DNA, 75 bp, Artificial Sequence
  Synthetic
ctattagcgtcaaaccaagttaaattttactttaataaacgattaaaccaattaacaagaatacgtcaaggaaag

SEQ ID NO: 350592 - DNA, 75 bp, Artificial Sequence; identical to SEQ ID NO: 47242
  Synthetic

SEQ ID NO: 350593 - DNA, 75 bp, Artificial Sequence
  Synthetic
tttggaagacagccgtcgctacatagatacaacgtcatcgcttcatctatcagagctaccgaaggagatactatc

SEQ ID NO: 350594 - DNA, 75 bp, Artificial Sequence; identical to SEQ ID NO: 47244
  Synthetic

SEQ ID NO: 350595 - DNA, 75 bp, Artificial Sequence
  Synthetic
aatcctaaagccgtagttgaacagagtattcttatgtatccgacaacgttactcaaacacgatattcatggagcc

SEQ ID NO: 350596 - DNA, 75 bp, Artificial Sequence
  Synthetic
cccgtttatggatctattcaagatgaaatcgtagcagcatattcattgtttaggatacaagatctttgtttagat

SEQ ID NO: 350597 - DNA, 75 bp, Artificial Sequence
  Synthetic
gaagtattgaacatcttggggaaatatggaagagagttcgatcctaaaggtaaatgtaaattcagtggtaaagat

SEQ ID NO: 350598 - DNA, 75 bp, Artificial Sequence
  Synthetic
atctatacttacttaataggtgaaaagattaattatccgggtctcttaaaggatggcgaaattattgcaaacgat

SEQ ID NO: 350599 - DNA, 75 bp, Artificial Sequence
  Synthetic
gtagatagtaattttgttgtggctatgaggcatctgtcattggctggactcttatccgatcataagtcgaacgtg

SEQ ID NO: 350600 - DNA, 75 bp, Artificial Sequence
  Synthetic
gaaggtatcaactttattatcaagtcatcttatgtttttaagagatatctatctatttacggttttggggtgaca

SEQ ID NO: 350601 - DNA, 75 bp, Artificial Sequence
  Synthetic
catcttatgtttttaagagatatctatctatttacggttttggggtgacattcaaagatttgagaccaaattcga

SEQ ID NO: 350602 - DNA, 75 bp, Artificial Sequence
  Synthetic
cattcactaataaattggaggccatcaacgtagaaaaaatagaacttatcaaagaagcatacgccaaatatctca

SEQ ID NO: 350603 - DNA, 75 bp, Artificial Sequence
  Synthetic
aagatgtaagagacggaaaaatagttccattatctaaagctttagaggcggactatgtggaatccatgttatcca

SEQ ID NO: 350604 - DNA, 75 bp, Artificial Sequence
  Synthetic
acttaacaaatcttaatatcagagagatagaagaacatatgagacaaacgctgatagataatccagataataacc

SEQ ID NO: 350605 - DNA, 75 bp, Artificial Sequence
  Synthetic
gatagaagaacatatgagacaaacgctgatagataatccagataataacctcctgaaaatggccaaagcgggtta

SEQ ID NO: 350606 - DNA, 75 bp, Artificial Sequence
  Synthetic
actattatatttggtataaagagatagataatactcggccgacataatgttgttgtccattgtagtataaaaatt

SEQ ID NO: 350607 - DNA, 75 bp, Artificial Sequence
  Synthetic
taaagtaaatcccacagaactaatgtatattttaggtacttatggacaacagaggatagatggcgaaccagcaga

SEQ ID NO: 350608 - DNA, 75 bp, Artificial Sequence
  Synthetic
gactcgagtattgggtagagtcttaccttactatcttccagactctaaggatccagaaggaagaggttatattct

SEQ ID NO: 350609 - DNA, 75 bp, Artificial Sequence
  Synthetic
taattctttaacaaaaggattaacgggttctcaatattacttttcaatgctggttgcaagatctcaatctactga

SEQ ID NO: 350610 - DNA, 75 bp, Artificial Sequence
  Synthetic
tattgtctgtgaaacatcgcgtaccggaacactggctagaaaaatcattaaaaagatggaggatatggtggtcga

SEQ ID NO: 350611 - DNA, 75 bp, Artificial Sequence
  Synthetic
cggatacggacaagtagttataggtaatacgctcatcaagtacgccgccaattataccaaaattctaggctcagt

SEQ ID NO: 350612 - DNA, 75 bp, Artificial Sequence
  Synthetic
cataataataagttgtgggtagtatcatccacatatttataatttaggactttgtattcagtatttttggaatca

SEQ ID NO: 350613 - DNA, 75 bp, Artificial Sequence
  Synthetic
atgtaaacctgtagatcttatctatccagatgagtccatgacttggtatttggaaattagtgctctgtggaataa

SEQ ID NO: 350614 - DNA, 75 bp, Artificial Sequence
  Synthetic
aataaaacaaggattcgtttactctcagaaacagaaacttgcaaagaagacattggcgccgtttaatttcctagt

SEQ ID NO: 350615 - DNA, 75 bp, Artificial Sequence
  Synthetic
atttgtcaaacccaccactgaggataatgctattaaggttaaggatctgtacgatatgattcataacgtcattga

SEQ ID NO: 350616 - DNA, 75 bp, Artificial Sequence
  Synthetic
aatgctattaaggttaaggatctgtacgatatgattcataacgtcattgatgatgtgagagagaaatacttcttt

SEQ ID NO: 350617 - DNA, 75 bp, Artificial Sequence
  Synthetic
acggtatctaatatagattttatggagtatatattcttgacgcatcttaatccttctagaattagaattacaaaa

SEQ ID NO: 350618 - DNA, 75 bp, Artificial Sequence
  Synthetic
aaaaaacgtatcgctggaagggactatatgactaacttatctagagatacaggaatacaacaatcaaaccttact

SEQ ID NO: 350619 - DNA, 75 bp, Artificial Sequence
  Synthetic
gaaacggctatcactatctttgaaaagttctatgaaaaactcaattatactctaggtggtggaactcctattgga

SEQ ID NO: 350620 - DNA, 75 bp, Artificial Sequence
  Synthetic
attatttctgcacaggtattgtctgagaagtttacacaacaagccctgtccagttttcacactactgaaaaaagc

SEQ ID NO: 350621 - DNA, 75 bp, Artificial Sequence
  Synthetic
ggtgctgtcaaacaaaaacttggtttcaatgagtttaataacttgactaatttgagtaagaataagaccgaaatt

SEQ ID NO: 350622 - DNA, 75 bp, Artificial Sequence
  Synthetic
atcactctggtatccgatgatatctctaaacttcaatctgttaagattaattttgaatttgtatgtttgggagaa

SEQ ID NO: 350623 - DNA, 75 bp, Artificial Sequence
  Synthetic
ttaaatccaaacatcactcttcgaaaagaaacagatagatatgtagtagacataatagtcaatagattatacatc

SEQ ID NO: 350624 - DNA, 75 bp, Artificial Sequence
  Synthetic
aagagagcagaaataaccgaattagtcgtcgaatatatgattgaacgatttatctcctttagcgtcattgtaaag

SEQ ID NO: 350625 - DNA, 75 bp, Artificial Sequence
  Synthetic
gaatggggtatggagacattcattgaggacgaggataatattagatttactgtttatctaaatttcgttgaacca

SEQ ID NO: 350626 - DNA, 75 bp, Artificial Sequence
  Synthetic
gaggaattgaatcttagtaagtttatgatggttcttccgggtgccgccaacaagggcaagattagtaaattcaag

SEQ ID NO: 350627 - DNA, 75 bp, Artificial Sequence
  Synthetic
attcctatctctgattatacaggttatgacgatttcaatcaaacaaaaaagctcaataagatgactgtagaactc

SEQ ID NO: 350628 - DNA, 75 bp, Artificial Sequence
  Synthetic
atgaatctaaaagaattgggttctttcgatttggagaacgttaacgtgtatcctggagtatggaatacatacgat

SEQ ID NO: 350629 - DNA, 75 bp, Artificial Sequence
  Synthetic
atcttcggtatcgaggccgctcgtggatacttatgcgaagccatgttaaacacctatggagaaggtttcgattat

SEQ ID NO: 350630 - DNA, 75 bp, Artificial Sequence
  Synthetic
ctgtatcagccttgtgatcttctcgctagtttactatgtgctagttacgaaccagaatcagttaataaattcaag

SEQ ID NO: 350631 - DNA, 75 bp, Artificial Sequence
  Synthetic
ttcggcgcagctagtactcttaagagagctacgtttggagacaataaagcattgttaaacgcggctcttcataaa

SEQ ID NO: 350632 - DNA, 75 bp, Artificial Sequence
  Synthetic
aagtcagaacctattaacgataatagtagctgccacttttttagcaaggtccctaatataggaactggatattac

SEQ ID NO: 350633 - DNA, 75 bp, Artificial Sequence
  Synthetic
aaatactttatcgacttgggtcttctcatgagaatggaaaggaaactatctgataagatatcttctcaaaagatt

SEQ ID NO: 350634 - DNA, 75 bp, Artificial Sequence
  Synthetic
aaggagatggaagaaacagaagacttttaattcttatcaataacatatttttctatgatctgtcttttaaacgat

SEQ ID NO: 350635 - DNA, 75 bp, Artificial Sequence
  Synthetic
ggattttccacaaatgcgcctctcaagtccctcatagaatgatacacgtataaaaaatataacataggtgatgac

SEQ ID NO: 350636 - DNA, 75 bp, Artificial Sequence
  Synthetic
tccttatttttagacattagatatgccaaaatcatagccccgcttctatttactcccgcaacacaatgaaccaac

SEQ ID NO: 350637 - DNA, 75 bp, Artificial Sequence
  Synthetic
acgggctcgtttcgttgatcacatttagataagaaggcggttacgtcgtcaaaatatttactaatatcggtagtt

SEQ ID NO: 350638 - DNA, 75 bp, Artificial Sequence
  Synthetic
gtatcatctaccaacggtatatgaataatattaatattagagttaggtaatgtatatttatccatcgtcaaattt

SEQ ID NO: 350639 - DNA, 75 bp, Artificial Sequence
  Synthetic
aaaacatatttgaacttaacttcagatgatggtgcattcatagcatttttataatttcccaaatacacattattg

SEQ ID NO: 350640 - DNA, 75 bp, Artificial Sequence
  Synthetic
gttactcttgtcattatagtgggagatttggctctgcgcatatctccagttgaacgtagtagtaagtatttatat

SEQ ID NO: 350641 - DNA, 75 bp, Artificial Sequence
  Synthetic
aaacttttcttatccatttataacgtacaaatggataaaactactttatcagtaaacgcgtgtaatttagaatac

SEQ ID NO: 350642 - DNA, 75 bp, Artificial Sequence
  Synthetic
gttagagaaaaggctatagtaggcgtacaagcagccaagacatcaacacttatattctttgttattatattggca

SEQ ID NO: 350643 - DNA, 75 bp, Artificial Sequence
  Synthetic
cagtgagaggatcgactccatagtggacaacattaatacagacgataacttgatttcaaaattatcaatggagat

SEQ ID NO: 350644 - DNA, 75 bp, Artificial Sequence
  Synthetic
attagtgcgctattactctggtttcagacgtctgataatccagtctttaatgaattaacgagatatatgcgaatt

SEQ ID NO: 350645 - DNA, 75 bp, Artificial Sequence
  Synthetic
aaaaatacggttaacgattggaaatcattaacggatagtaaaacaaaattagaaagtgatagaggtagacttcta

SEQ ID NO: 350646 - DNA, 75 bp, Artificial Sequence
  Synthetic
cctcaataactttaacacgttgtctttcaagctctcttttgtagcaactatcattttatctgattccctggcgcg

SEQ ID NO: 350647 - DNA, 75 bp, Artificial Sequence
  Synthetic
gccgctggtaaggatgatatattcgaattcaaatgtgtggattttggtgcctattttatagctatgcgattggat

SEQ ID NO: 350648 - DNA, 75 bp, Artificial Sequence
  Synthetic
aagaaaacatatctaccgcaagctattaggcgaggtactggagacgcgtggatggttaaaaaggcggcaaaggtt

SEQ ID NO: 350649 - DNA, 75 bp, Artificial Sequence
  Synthetic
gatccatctgctcaacaattttgtcagtatttgataaaacacaagtctaataatgttattacttgtggtaatgag

SEQ ID NO: 350650 - DNA, 75 bp, Artificial Sequence
  Synthetic
atgttaaatgaattaggttatagcggttattttatgtcgccgcattggtgttccgatcttagtaatatggaatag

SEQ ID NO: 350651 - DNA, 75 bp, Artificial Sequence
  Synthetic
tgttagataaatgcggtaacaaatgttcctgtaaggaaccataacagcttagatttaacgttaaagatgagcata

SEQ ID NO: 350652 - DNA, 75 bp, Artificial Sequence
  Synthetic
aacataataaacaaaattacaatcaaacctataacattaatatcaaacaatccaaaaaatgaaatcagtggagta

SEQ ID NO: 350653 - DNA, 75 bp, Artificial Sequence
  Synthetic
cgcggctatagctactacgtttacggtatagcctctagataattttttaagcacaaaataaaaacataattttaa

SEQ ID NO: 350654 - DNA, 75 bp, Artificial Sequence
  Synthetic
gtaaatgcgtacataactcctggataacgtttaacagctgccgttcctattctagaccaaaaatttggtttcatg

SEQ ID NO: 350655 - DNA, 75 bp, Artificial Sequence
  Synthetic
tacggtgactactaggagggaaaatgaagaaagaaaaatatctacctctccaaaaagaaaaatttactactgatg

SEQ ID NO: 350656 - DNA, 75 bp, Artificial Sequence
  Synthetic
ttttcaaagcggtgttctgcaacaagacgaggatcgtgttctacgtatttggcagagttatccattatttgcctg

SEQ ID NO: 350657 - DNA, 75 bp, Artificial Sequence
  Synthetic
ttaatcttcatttcgttttcgattctggctatttcaaaataaaatcccgatgatagacctccagactttataatt

SEQ ID NO: 350658 - DNA, 75 bp, Artificial Sequence
  Synthetic
tcatctacaatgttcagcgccgtagtaactctaataatataggctgacaagctaacatcataccctcctgtatat

SEQ ID NO: 350659 - DNA, 75 bp, Artificial Sequence
  Synthetic
gtgaatatgacatgatttttgtccattactagctcggttttaactttattgcctgtaataatttctctcatctgt

SEQ ID NO: 350660 - DNA, 75 bp, Artificial Sequence
  Synthetic
aggatatctattttcttgtcatgcattgcctttaagactggacgaagaaacgtaatatcctcaataacgttatca

SEQ ID NO: 350661 - DNA, 75 bp, Artificial Sequence
  Synthetic
ttttctacaataactacatattctacctttttattttctaactcggtaaaaaatttagaatcccatagggctaaa

SEQ ID NO: 350662 - DNA, 75 bp, Artificial Sequence
  Synthetic
tgtctagcgatatttcttttcgtttcctctgtacacatggtgttacaaaaccctgaaaagaagtgagtatacttg

SEQ ID NO: 350663 - DNA, 75 bp, Artificial Sequence
  Synthetic
tcatcatttctaatgtttcctccagtccagtgtataaacgcataatccttgtaatgatctggatcatccttgact

SEQ ID NO: 350664 - DNA, 75 bp, Artificial Sequence
  Synthetic
atataggtgtagttttgcagtggccgtcctggataatattatctatatgatgggtggatatgatcagtacccgta

SEQ ID NO: 350665 - DNA, 75 bp, Artificial Sequence
  Synthetic
tgaagaggcaaaagatgtcaaggtggaagaaaaaaaatatcgatattgaagatgacaatgacgatgatatggatg

SEQ ID NO: 350666 - DNA, 75 bp, Artificial Sequence
  Synthetic
atcacaacatttcttttttctggcataacttcgttgtccttcacatcatcgaacttctgatcattaatatgctca

SEQ ID NO: 350667 - DNA, 75 bp, Artificial Sequence
  Synthetic
gccatttagttattgaaattaatcatatacaactctctaatacgagttatattttcgtctatccattgtttcaca

SEQ ID NO: 350668 - DNA, 75 bp, Artificial Sequence
  Synthetic
ttgacatatttcgacaaaaagatataaaatgcgtattccaatgcttctctgtttaatgaattactaaaatataca

SEQ ID NO: 350669 - DNA, 75 bp, Artificial Sequence
  Synthetic
aacacgtcactgtctggcaataaatgatatcttagaatattgtaacaatttattttgtattgcgcatgttcgtga

SEQ ID NO: 350670 - DNA, 75 bp, Artificial Sequence
  Synthetic
tctatgagttcttcttcgaatggcataggatctccgaatctgaaaatgtataaataggagttagaataataatat

SEQ ID NO: 350671 - DNA, 75 bp, Artificial Sequence
  Synthetic
aaatgtccaatatgtcgacgattgttcataccggcaaaatttatatatcaggaggctacacaatagtagtgtagt

SEQ ID NO: 350672 - DNA, 75 bp, Artificial Sequence
  Synthetic
ttgagagtattggtaatgtacaaactctttagcggtataattagtttttttctctcgatttctatttttagatgt

SEQ ID NO: 350673 - DNA, 75 bp, Artificial Sequence
  Synthetic
gatggaaaaatgactaattttgtagcattagtatcatgaactctaatcaaaatcttaatatcttcgtcacacgtt

SEQ ID NO: 350674 - DNA, 75 bp, Artificial Sequence
  Synthetic
agctctttgaactgtttaagagatgcatcagttggttccacggatggagtaggtgcaacaattttttgttcgaca

SEQ ID NO: 350675 - DNA, 75 bp, Artificial Sequence
  Synthetic
tatgtatgtactggagccattgtcttaactataatggtgcttgtatcgaaaaactttaatgtagatagcggaagc

SEQ ID NO: 350676 - DNA, 75 bp, Artificial Sequence
  Synthetic
tcttcgccgcgactttctacgtcgtaattaggttctaatgccgatctttgaatggatactagttttctaagttct

SEQ ID NO: 350677 - DNA, 75 bp, Artificial Sequence
  Synthetic
aatgtgattctctgaaaatgtaaatccaattcctccggcattatagatgtgtatacatcggtaaataaaactata

SEQ ID NO: 350678 - DNA, 75 bp, Artificial Sequence
  Synthetic
gtatccaacgatcccttctcgcaaattctagtcttaaccaagaaatcgtatataactacggaaatggcgtattta

SEQ ID NO: 350679 - DNA, 75 bp, Artificial Sequence
  Synthetic
agagtggattcttctaccgttttgttcttggatttcatataagaaactataaagtccgcactactgttaagaatg

SEQ ID NO: 350680 - DNA, 75 bp, Artificial Sequence
  Synthetic
attactaacgcaactatatagtttaaattaagcatcttggaaacataaaataactctgtagatgatacttgactt

SEQ ID NO: 350681 - DNA, 75 bp, Artificial Sequence
  Synthetic
tcgaataagtttgcagacaaacgaagaaagaacagacctctcttaatttcagaagaaaactttttttcgtattcc

SEQ ID NO: 350682 - DNA, 75 bp, Artificial Sequence
  Synthetic
tgacgtctagagtttatatcaataaaaaagttaagaattagtcggttaatgttgtatttcattacccaagtttga

SEQ ID NO: 350683 - DNA, 75 bp, Artificial Sequence
  Synthetic
aatatattcgatagttatggacatagtaatacatattattcaaaatatggtctttaaaaatttaaaatatattat

SEQ ID NO: 350684 - DNA, 75 bp, Artificial Sequence
  Synthetic
gatttcataatattatcaaaagacatgataatattaaagataaagcgctgactatgcacgaaatagctatatggt

SEQ ID NO: 350685 - DNA, 75 bp, Artificial Sequence
  Synthetic
tcgctcaagaatatagtcttgttaaacgtggaaacgataactgtatttttaattacgtcagctgcatctaaatta

SEQ ID NO: 350686 - DNA, 75 bp, Artificial Sequence
  Synthetic
aatataggtatatttattccacacactctacaatatgccacaccatcttcataataaataaattcattagcaaag

SEQ ID NO: 350687 - DNA, 75 bp, Artificial Sequence
  Synthetic
catctggagaatccacaacagacaagacttcgggaccaattactaataaagaagatcatacagtcacagacactg

SEQ ID NO: 350688 - DNA, 75 bp, Artificial Sequence
  Synthetic
ttattaattttagtgaaatagttagcgtcaactttcatagcttccttcaatctaatttgatgctcacacggtgcg

SEQ ID NO: 350689 - DNA, 75 bp, Artificial Sequence
  Synthetic
accgccaatgatgcggatctttatgatacgcacaatgataatgaaccatctactgtgtcaccaacaactgtaaaa

SEQ ID NO: 350690 - DNA, 75 bp, Artificial Sequence
  Synthetic
aattccactttaacatctcttttccatgcctcaggttcatcgatctctataatatctagtttcttgcgtttaata

SEQ ID NO: 350691 - DNA, 75 bp, Artificial Sequence
  Synthetic
aacacgggttcgtctttcgcaatgaggtctgtatagtaactatgtaaatgataactagatagaaagatgtagcta

SEQ ID NO: 350692 - DNA, 75 bp, Artificial Sequence
  Synthetic
tatagatgacgatcctttaagagaggtatgataactttaccccaatcagataaactattgttatggtcttcggaa

SEQ ID NO: 350693 - DNA, 75 bp, Artificial Sequence
  Synthetic
aaagaatttttataaatttttccagtattttccaaatatacgtacttgacatctaaaaaatccttaatgataata

SEQ ID NO: 350694 - DNA, 75 bp, Artificial Sequence
  Synthetic
ggaatggataatccgtctattttataaagaaatacatatcgcacattatacttttttttggaaatgggaataccg

SEQ ID NO: 350695 - DNA, 75 bp, Artificial Sequence
  Synthetic
atgtgtctacataaatatgcaaagtctaaatattttttagagaatcttaattggtccaaattcttttccaagtac

SEQ ID NO: 350696 - DNA, 75 bp, Artificial Sequence
  Synthetic
ggtaatagatttttcatattgaacggtatcttcttgatttctggttctaattccgcattaaatgatgaaactaag

SEQ ID NO: 350697 - DNA, 75 bp, Artificial Sequence
  Synthetic
tcgctatttttataactaacgattacatcacctctaacatcatcatttaccaggatactgatcttcttttgtcgt

SEQ ID NO: 350698 - DNA, 75 bp, Artificial Sequence
  Synthetic
aaatacatgtctaatgtgttaaaaaaaagatcatacaagttatacgtcatttcatctgtagtattcttgtcattg

SEQ ID NO: 350699 - DNA, 75 bp, Artificial Sequence
  Synthetic
agtgataaacttgtgctaatctcttctttaacagtctgttcaaatttatatcctatatacgaaaaaatagcaacc

SEQ ID NO: 350700 - DNA, 75 bp, Artificial Sequence
  Synthetic
aatgtttgatcattcgcgtcaatattctgttctattgtagtgtataacaatcttatatcttcttccgtgatagct

SEQ ID NO: 350701 - DNA, 75 bp, Artificial Sequence
  Synthetic
aagtgcttaaatatttctactacttcattaatcttttcggtactcagattcagtttctcatcttttacttgattg

SEQ ID NO: 350702 - DNA, 75 bp, Artificial Sequence
  Synthetic
gatacgttataaaggttgataacgaaaatatttttatttcgtgagataaagtcatcgtaggattttggacttata

SEQ ID NO: 350703 - DNA, 75 bp, Artificial Sequence
  Synthetic
ttcgcgtctagtagatatgcttttatttttggaataatctcaattagaatagtctctttagagtccatttaaagt

SEQ ID NO: 350704 - DNA, 75 bp, Artificial Sequence
  Synthetic
tacaaacaactaggaaattggtttataatgtataatttttttagtttttatagattctttattctatacttaaaa

SEQ ID NO: 350705 - DNA, 75 bp, Artificial Sequence
  Synthetic
aatgaaaataaatacaaaggttcttgagggttgtgttaaattgaaagcgagaaataatcataaattatttcatta

SEQ ID NO: 350706 - DNA, 75 bp, Artificial Sequence
  Synthetic
tcgcgatatccgttaagtttgtattgtaatggcgtggtcaattacgaataaagcggatactagtagtttcacaaa

SEQ ID NO: 350707 - DNA, 75 bp, Artificial Sequence
  Synthetic
gatggctgaaattagagctcatctaagaaatagcgctgaaaataaagataaaaacgatgatattttcccggaaga

SEQ ID NO: 350708 - DNA, 75 bp, Artificial Sequence
  Synthetic
tgtaataattccatctactaagcccaaaaccaaacgagccactactcctcgtaaaccagcggctactaaacgatc

SEQ ID NO: 350709 - DNA, 75 bp, Artificial Sequence
  Synthetic
gtaaaccagcggctactaaacgatcaaccaaaaaggataaagaaaaggaggaagtggaagaagaagtagttatag

SEQ ID NO: 350710 - DNA, 75 bp, Artificial Sequence
  Synthetic
aggaatatcatcaaacaactgaagaaaattctccacctccgtcatcatctcctggagtcggcgacattgtagaaa

SEQ ID NO: 350711 - DNA, 75 bp, Artificial Sequence
  Synthetic
aacctatggtacaagttgaagctggtaaagtaaatcatagtgttagaagcgatctctctgacctaaaggtggcta

SEQ ID NO: 350712 - DNA, 75 bp, Artificial Sequence
  Synthetic
ccgacaatattgttaaagatcttaagaaaattattactagaatctctgcagtatcgactgttctagaggatgttc

SEQ ID NO: 350713 - DNA, 75 bp, Artificial Sequence
  Synthetic
taatattcccagaaaagatattttcgtgttttagtttatcgagatctaatctgttcatatacgtatccatgattg

SEQ ID NO: 350714 - DNA, 75 bp, Artificial Sequence
  Synthetic
aagcagctggtatctctagacaatttacttctatgactaaatctattacaacactatctgatctagtcaccgagg

SEQ ID NO: 350715 - DNA, 75 bp, Artificial Sequence
  Synthetic
gaaaatctaaagttgttcgtaaaaaagttaaaacttgtaagaagtaaatgcgtgcacttttttataaagatggta

SEQ ID NO: 350716 - DNA, 75 bp, Artificial Sequence
  Synthetic
aactgtttaccgataataattttttaaatcctgtatcagacaataatccagcgtatgaggttttgcaacatgtta

SEQ ID NO: 350717 - DNA, 75 bp, Artificial Sequence
  Synthetic
cagggtgcatattattaagtgtgaggttttggtttgatgtaaaatttttgttgataaaaattaaaaaaataactt

SEQ ID NO: 350718 - DNA, 75 bp, Artificial Sequence
  Synthetic
aaattcctactcatttaacagatgtagtagtatatgaacaaacgtgggaggaggcgttaactagattaatttttg

SEQ ID NO: 350719 - DNA, 75 bp, Artificial Sequence
  Synthetic
tgggaagtgattcaaaaggacgtagacaatacttttacggaaaaatgcatgtacagaatcgcaacgctaaaagag

SEQ ID NO: 350720 - DNA, 75 bp, Artificial Sequence
  Synthetic
aatctttatatctttcctggaatatcattaactgttgccaatgatgttaggaaatattctgttgtgtcagtttat

SEQ ID NO: 350721 - DNA, 75 bp, Artificial Sequence
  Synthetic
atcgtatttttgttagagtatataacgttatgaaacgaattaattgttttataaacaaaaatataaagaaatcat

SEQ ID NO: 350722 - DNA, 75 bp, Artificial Sequence
  Synthetic
ccacagattccaattatcagttggcagtttttatgttaatggaaactatgttttttattagatttggtaaaatga

SEQ ID NO: 350723 - DNA, 75 bp, Artificial Sequence
  Synthetic
aatatcttaaggagaatgaaacagtagggttattaacactaaaaaataaacacatagaaataagtcccgataaaa

SEQ ID NO: 350724 - DNA, 75 bp, Artificial Sequence
  Synthetic
tagttatcaagtttgtaggaaaggacaaagtttcacatgaatttgttgttcataagtctaatagactatataaac

SEQ ID NO: 350725 - DNA, 75 bp, Artificial Sequence
  Synthetic
cgctattgaaactgacggatgattctagtcccgaagaatttctgttcaacaaactaagtgaacgaaaggtatacg

SEQ ID NO: 350726 - DNA, 75 bp, Artificial Sequence
  Synthetic
aatgtatcaaacagtttggtattagaatcaaggatctccgaacgtatggagtcaattatacgtttttatataatt

SEQ ID NO: 350727 - DNA, 75 bp, Artificial Sequence
  Synthetic
tttggacaaatgtaaagtccatatctcctcttccatcaccaaaaaagttaatagcgttaactatcaaacaaactg

SEQ ID NO: 350728 - DNA, 75 bp, Artificial Sequence
  Synthetic
ctgaagtggtaggtcatactccatcaatttcaaaaagagcttatatggcaacgactattttagaaatggtaaagg

SEQ ID NO: 350729 - DNA, 75 bp, Artificial Sequence
  Synthetic
ataaaaattttttagatgtagtatctaaaactacgttcgatgaattcctatctatagtcgtagatcacgttaaat

SEQ ID NO: 350730 - DNA, 75 bp, Artificial Sequence
  Synthetic
catctacggatggatgatatagatccttacacaaataattacaaaaccgataaatggaaatggataagcgtatga

SEQ ID NO: 350731 - DNA, 75 bp, Artificial Sequence
  Synthetic
aatctctcgcaatgaccgctttctttggagagctaaccacattagatattatggcattaataatgtctatattta

SEQ ID NO: 350732 - DNA, 75 bp, Artificial Sequence
  Synthetic
aacgccatccaaacaataccattttttcagtggataaggatggtcagtttatgattgatttcgaatacgatactt

SEQ ID NO: 350733 - DNA, 75 bp, Artificial Sequence
  Synthetic
ataaggcttctcaatatttggatttgccccttactccgatatctggagatgaatgcaagactcacgcatcgagta

SEQ ID NO: 350734 - DNA, 75 bp, Artificial Sequence
  Synthetic
tagccaaacaattggcgtgtgtggacattattaaagaggatattagcgaatatatcaaaactacaccccgtctta

SEQ ID NO: 350735 - DNA, 75 bp, Artificial Sequence
  Synthetic
tagttcgtcatttaataatttttgatgctgttgaatctttagattatctattatttagaggagttattgatatta

SEQ ID NO: 350736 - DNA, 75 bp, Artificial Sequence
  Synthetic
aacgatttataaaaaaataccgcaatagatcagatactcgtatcagtcaagatacagaaaagcttaaaatagctc

SEQ ID NO: 350737 - DNA, 75 bp, Artificial Sequence
  Synthetic
tagctaaaggcatagattacgaatatataaaagacgcttgttaataagtaaatgaaaaaaaactagtcgtttata

SEQ ID NO: 350738 - DNA, 75 bp, Artificial Sequence
  Synthetic
ataaaacacgatatggatgccaacgtagtatcatcttccactatcgcgacatatatagacgctttagcaaagaat

SEQ ID NO: 350739 - DNA, 75 bp, Artificial Sequence
  Synthetic
gcttcggaattagaacagggttctaccgcatacgaaataaataatgaattggaactagtatttattaagccgcca

SEQ ID NO: 350740 - DNA, 75 bp, Artificial Sequence
  Synthetic
tagatattgctctccaacaactaattaagcatattcttaatattagaatattatatagttaagatttttttaaaa

SEQ ID NO: 350741 - DNA, 75 bp, Artificial Sequence
  Synthetic
ttgattactttgacaaatgtagtaaatatctccacgattcaggaatcgtttattcgatttaccgttactaataag

SEQ ID NO: 350742 - DNA, 75 bp, Artificial Sequence
  Synthetic
gaaggcgtcaaaattagaactaagattccattatctaaggtacatggtctagatgtaaaaaatgtacagttagta

SEQ ID NO: 350743 - DNA, 75 bp, Artificial Sequence
  Synthetic
ttccattatctaaggtacatggtctagatgtaaaaaatgtacagttagtagatgctatagataacatagtttggg

SEQ ID NO: 350744 - DNA, 75 bp, Artificial Sequence
  Synthetic
gatgctatagataacatagtttgggaaaagaaatcattagtgacggaaaatcgtcttcacaaagaatgcttgttg

SEQ ID NO: 350745 - DNA, 75 bp, Artificial Sequence
  Synthetic
agactatcaacagaggaacgccatatatttttggattacaagaaatatggatcctctatccgactagaattagtt

SEQ ID NO: 350746 - DNA, 75 bp, Artificial Sequence
  Synthetic
aatcttattcaagcaaaaacaaaaaactttacgatagactttaagctaaaatattttctaggatccggtgcgcag

SEQ ID NO: 350747 - DNA, 75 bp, Artificial Sequence
  Synthetic
tctaaaagttctttattgcacgctattaatcatccaaagtcaaggcctaatacatctctggaaatagaattcaca

SEQ ID NO: 350748 - DNA, 75 bp, Artificial Sequence
  Synthetic
cctagagacaatgaaacagttccatatgatgaactaataaaggaattgacgactttctcgcgtcatatatttatg

SEQ ID NO: 350749 - DNA, 75 bp, Artificial Sequence
  Synthetic
gactttctcgcgtcatatatttatggcttctccagagaatgtaattctttctccacttattaacgcacctataaa

SEQ ID NO: 350750 - DNA, 75 bp, Artificial Sequence
  Synthetic
gacttttatgttgcctaaacaagatatagtaggtatggatctggaaaatctatatgccgtaactaagactgacgg

SEQ ID NO: 350751 - DNA, 75 bp, Artificial Sequence
  Synthetic
actgttcgttctccaaaccaatcaattatgtaaatatctttaatacagagtttaatactaatactaatactacta

SEQ ID NO: 350752 - DNA, 75 bp, Artificial Sequence
  Synthetic
cattcctataactatcagagttacatcaaaggggttgtattgttattttacacatcttggttatattattagata

SEQ ID NO: 350753 - DNA, 75 bp, Artificial Sequence
  Synthetic
tccagttaagagaataatagattctgaagtagtagtctttggtgaggcagttaaggataagaactggactgtata

SEQ ID NO: 350754 - DNA, 75 bp, Artificial Sequence
  Synthetic
ttaaggataagaactggactgtatatctcattaagctaatagagcccgtaaatgcaatcagtgatagactagaag

SEQ ID NO: 350755 - DNA, 75 bp, Artificial Sequence
  Synthetic
aaagtaagtatgtcgaatctaaactagtggatatttgtgatcggatagtattcaagtcaaagaaatacgaaggtc

SEQ ID NO: 350756 - DNA, 75 bp, Artificial Sequence
  Synthetic
gaaatcacttctgtctacataagaattatgaaatggatacaatagatgattgtaattcgtatgtggataatcgtg

SEQ ID NO: 350757 - DNA, 75 bp, Artificial Sequence
  Synthetic
ttatgaaatggatacaatagatgattgtaattcgtatgtggataatcgtgttgtaaaaaagattactagagcaag

SEQ ID NO: 350758 - DNA, 75 bp, Artificial Sequence
  Synthetic
cttttactacaactagtgaagtcgttgatatgttatctacatatttaccaaagcaaccagaaggtgttattttgt

SEQ ID NO: 350759 - DNA, 75 bp, Artificial Sequence
  Synthetic
aagatctcctaaaacggctccaaaaattatcaaatcaaacctatagatcctaagatgtcttggtatttagatcta

SEQ ID NO: 350760 - DNA, 75 bp, Artificial Sequence
  Synthetic
tttattcaaagggacctaaatctaacattgattttaaaatcaaaaaggagaatactatagaccaaactgtaaatg

SEQ ID NO: 350761 - DNA, 75 bp, Artificial Sequence
  Synthetic
tggatgaattaggagcaagacctagaatacctagatctacgacagatattcaagttgattatcgtggaactgatg

SEQ ID NO: 350762 - DNA, 75 bp, Artificial Sequence
  Synthetic
tagtatttaggtacatgtccagtgaaccaattatctttggagaatcatctatctttatagagtataagaaattta

SEQ ID NO: 350763 - DNA, 75 bp, Artificial Sequence
  Synthetic
gacgcgtaatgggttatgagaatatatatgaaacaatacgcgataatatatattcgcaagtcagagacagagtag

SEQ ID NO: 350764 - DNA, 75 bp, Artificial Sequence
  Synthetic
ccaacgataaaggctttcctaaagaatatggttctggtaaaattgtgttatacaacggcgttaattatctaaata

SEQ ID NO: 350765 - DNA, 75 bp, Artificial Sequence
  Synthetic
tattaaatggtatgttagatagtagacgactacctccgctactagaactattatcggaaacgcgattgaatcaaa

SEQ ID NO: 350766 - DNA, 75 bp, Artificial Sequence
  Synthetic
atatctattgtttggaatatattaatacacataatgaagtgggtattaagtccgtggttgtacctattaagttta

SEQ ID NO: 350767 - DNA, 75 bp, Artificial Sequence
  Synthetic
gatgacaactgcaaatgctgttagacaaattgtcaaaaatgttaaaacagtcgatgataatccatatagcattat

SEQ ID NO: 350768 - DNA, 75 bp, Artificial Sequence
  Synthetic
tagcagaattcttagtcaatggagaaatacttaaacctagaatcgataaaaccatgaaatatattaactcagaag

SEQ ID NO: 350769 - DNA, 75 bp, Artificial Sequence
  Synthetic
caaattgtcaaaaatgttaaaacagtcgatgataatccatatagcattatttatgaaaagcttggaatgcctacc

SEQ ID NO: 350770 - DNA, 75 bp, Artificial Sequence
  Synthetic
ttatgaaaagcttggaatgcctaccaatagaagaagtgaactagtcattgattcagaaaatccagtcgctggaat

SEQ ID NO: 350771 - DNA, 75 bp, Artificial Sequence
  Synthetic
actattatggaaatcaacataatgtcatagttgaacatttaagagatcaaagcatcaaaataggagatgtcttta

SEQ ID NO: 350772 - DNA, 75 bp, Artificial Sequence
  Synthetic
attaaacatttctactccaactggattatattcagaaccttataccaaacctagtaaagataaacgcgactattc

SEQ ID NO: 350773 - DNA, 75 bp, Artificial Sequence
  Synthetic
acgaggacaaactatctgatgtaggacatcaatatgccaataatgataaatttagattaaatccagaagttagtt

SEQ ID NO: 350774 - DNA, 75 bp, Artificial Sequence
  Synthetic
gctaaccgcgtatagtactcccaagaatcaagctaggctggaaactatttacgaaactatcaaaatgcagggtac

SEQ ID NO: 350775 - DNA, 75 bp, Artificial Sequence
  Synthetic
attttacgaataaaagaactagaggaccgttgggaattttatcgaactacgtcaagactcttcttatttctatgt

SEQ ID NO: 350776 - DNA, 75 bp, Artificial Sequence
  Synthetic
attgttccaaaacatttttagacgattccaacaaacgaaaggtattggcgattgattttggaaacggtgctgacc

SEQ ID NO: 350777 - DNA, 75 bp, Artificial Sequence
  Synthetic
tggaaaaatacttttatggagagattgcgttattggtagcgacggatccagatgctgatgctatagctagaggaa

SEQ ID NO: 350778 - DNA, 75 bp, Artificial Sequence
  Synthetic
atgaaagatacaacaaattaaattctggaattaaaaccaagtactacaaatttgactacattcaggaaactattc

SEQ ID NO: 350779 - DNA, 75 bp, Artificial Sequence
  Synthetic
gatccaatacatttgtatctagtgtcagagaagtattttattttggaaagtttaatatcatcgactggcagtttg

SEQ ID NO: 350780 - DNA, 75 bp, Artificial Sequence
  Synthetic
ttacgtggattataacatcatattccggcgtatgaattgacatttctccctcttctccctttcccaaaaataaac

SEQ ID NO: 350781 - DNA, 75 bp, Artificial Sequence
  Synthetic
ctatccattattctttccatccgagacattatgctaccatcatgaataacttatccgaactaactgcttctggag

SEQ ID NO: 350782 - DNA, 75 bp, Artificial Sequence
  Synthetic
gcaaggtattaattactaccatggacggagacaaattatcaaaattaaccgataaaaagacttttataattcata

SEQ ID NO: 350783 - DNA, 75 bp, Artificial Sequence
  Synthetic
agaatctacctagtagcgaaaactatatgtctgtagaaaaaatagctgatgatagaatagtggtatataatccat

SEQ ID NO: 350784 - DNA, 75 bp, Artificial Sequence
  Synthetic
atatatcatcttttcactaaataagtagtaataatgattcaacaatgtcagatatatgaacgataataacttagt

SEQ ID NO: 350785 - DNA, 75 bp, Artificial Sequence
  Synthetic
caacaatgtctactccaatgactgaatacattatcaaaaagaacgatatagttagagtgtttaacgaatacggat

SEQ ID NO: 350786 - DNA, 75 bp, Artificial Sequence
  Synthetic
ttgttcttgtagataatgttgatttcgctacaattatagaacgaagtaaaaagtttattaatggtgcatctacaa

SEQ ID NO: 350787 - DNA, 75 bp, Artificial Sequence
  Synthetic
tggaagatagaccgtctacaagaaactttttcgaactaaatagaggagccattaaatgtgaaggtttagatgtcg

SEQ ID NO: 350788 - DNA, 75 bp, Artificial Sequence
  Synthetic
ttagtatccacaaatagtaaatgagagatctactggtgaaatgtgtcccagtattaatgcatttattgctagtaa

SEQ ID NO: 350789 - DNA, 75 bp, Artificial Sequence
  Synthetic
aagacttacttagttactatgttgtttatgtcttttctaagcggtaaataataatatggtatgggttctgatatc

SEQ ID NO: 350790 - DNA, 75 bp, Artificial Sequence
  Synthetic
cccgttttaaatgcattaaataattccaatagagcgatttttgttcctataggaccttccaactgtggatactct

SEQ ID NO: 350791 - DNA, 75 bp, Artificial Sequence
  Synthetic
gtattgttaatagatatattaatacttttgtcgggtaacaaaggttctacgtcttctaaaaataaaagtttgata

SEQ ID NO: 350792 - DNA, 75 bp, Artificial Sequence
  Synthetic
acatctggcctgttcataaataaaaacttggcgattctatatatactcttattatcaaatctagccattgtctta

SEQ ID NO: 350793 - DNA, 75 bp, Artificial Sequence
  Synthetic
tagatgtgagctactgtaggtgtaccatttgattttctttctaatactatatatttctctcgaagaagttcttgc

SEQ ID NO: 350794 - DNA, 75 bp, Artificial Sequence
  Synthetic
tgattaaacattaatcctgtcaaggaagaagatgctacagcgtttacgtgtatggcgtttactattcctagcatc

SEQ ID NO: 350795 - DNA, 75 bp, Artificial Sequence
  Synthetic
acatcatctgggaataaaatactactgttgagtaaatcagttattttttttatatcgatattgatggacattttt

SEQ ID NO: 350796 - DNA, 75 bp, Artificial Sequence
  Synthetic
atagttaaggataataagtatcccaaagtagataacgacgataacgaagtatttatacttttaggaaatcacaat

SEQ ID NO: 350797 - DNA, 75 bp, Artificial Sequence
  Synthetic
gactttatcagatcaaaattaacaaaattaaaggagcatgtatttttttctaaatatattgtaactccagataca

SEQ ID NO: 350798 - DNA, 75 bp, Artificial Sequence
  Synthetic
tatggatctttatgtgtagaattaaatggatctagttttcagcacggtggtagatatatagaggtggaggaattt

SEQ ID NO: 350799 - DNA, 75 bp, Artificial Sequence
  Synthetic
atagatgatggaagacaagttagatggtgttctacatccaatcatatatctgaagatatacccgaagatatacac

SEQ ID NO: 350800 - DNA, 75 bp, Artificial Sequence
  Synthetic
actaataaatttattatttatgatatttatacgtttgattcgttcaaaaataaacgattggtatttgtacaggta

SEQ ID NO: 350801 - DNA, 75 bp, Artificial Sequence
  Synthetic
cctacatcattaggagatgatagctatttaactaacccgttattgtcaccgtattattgtaattcagtagctaga

SEQ ID NO: 350802 - DNA, 75 bp, Artificial Sequence
  Synthetic
caaatggtcaatgatatgatttttaatcaagattcatttttaaaatatttattagaacatctgattagaagccac

SEQ ID NO: 350803 - DNA, 75 bp, Artificial Sequence
  Synthetic
tatagagtttctaaacatataacaatagttagatacaaagataccgaagaattaaatctaacgagaatatgttat

SEQ ID NO: 350804 - DNA, 75 bp, Artificial Sequence
  Synthetic
aatagagataagtttaaggcgtttgcattcgcttggtttaacggcgttttggaaaatgaaaaagtactagatacg

SEQ ID NO: 350805 - DNA, 75 bp, Artificial Sequence
  Synthetic
tataaaaaggtatctgatttgatataatgaattcagtgactgtatcacacgcaccatatactattacttatcacg

SEQ ID NO: 350806 - DNA, 75 bp, Artificial Sequence
  Synthetic
atgattgggaaccagtcatgaatcaattagtagagttttataacgaagtagccagttggctgctacgcgacgaga

SEQ ID NO: 350807 - DNA, 75 bp, Artificial Sequence
  Synthetic
cgtcgcctattcctgataagttctttatacagttgaaacaaccgcttagaaataagcgagtatgtgtgtgtggta

SEQ ID NO: 350808 - DNA, 75 bp, Artificial Sequence
  Synthetic
taaaatatgaaataagtacaatgaacgataatattctattgagacaacatactcttctactaatatatttgatag

SEQ ID NO: 350809 - DNA, 75 bp, Artificial Sequence
  Synthetic
tagatccgtatccgaaagatggaactggtgtaccgttcgagtcaccaaattttacaaaaaaatcaattaaggaga

SEQ ID NO: 350810 - DNA, 75 bp, Artificial Sequence
  Synthetic
tagcatcttctatatctagattaaccggagtaattgattataaaggttataaccttaatataatagacggggtta

SEQ ID NO: 350811 - DNA, 75 bp, Artificial Sequence
  Synthetic
taccctggaattattacttaagttgtaaattaggagaaacaaaaagtcacgcgatttactgggataagatttcta

SEQ ID NO: 350812 - DNA, 75 bp, Artificial Sequence
  Synthetic
acacatataataatgaatattaaacactagtatagcaggagtttatactcacaaaacatcataaaatgagtcgtc

SEQ ID NO: 350813 - DNA, 75 bp, Artificial Sequence
  Synthetic
gcgatttactgggataagatttctaagttactgctgcatcatataactaaacacgttagtgttctttattgtttg

SEQ ID NO: 350814 - DNA, 75 bp, Artificial Sequence
  Synthetic
ggtaaaacagatttctcgaatatacgggccaagttagaatctccagtaactaccatagtgggatatcatccagca

SEQ ID NO: 350815 - DNA, 75 bp, Artificial Sequence
  Synthetic
ctccaacgagataaaagagatccactgagatgactggaaatcacttctgtctacataagaatcaagctaggctgg

SEQ ID NO: 350816 - DNA, 75 bp, Artificial Sequence
  Synthetic
gctagagaccgtcaattcgagaaagatagatcatttgaaattatcaacgttttactggaattagacaacaaggca

SEQ ID NO: 350817 - DNA, 75 bp, Artificial Sequence
  Synthetic
cctataaattgggctcaagggtttatttattaatgctttagtgaaattttaacttgtgttctaaatggatgcggt

SEQ ID NO: 350818 - DNA, 75 bp, Artificial Sequence
  Synthetic
tattagaggtaatgatgttatctttgttcttaagactataggtgtcccgtcagtatgcagacaaaatgaagatcc

SEQ ID NO: 350819 - DNA, 75 bp, Artificial Sequence
  Synthetic
ggagttgttaaaggtgacacatgtaccgacacacttgagagtttatcagaagatggatggatggatgatgcatca

SEQ ID NO: 350820 - DNA, 75 bp, Artificial Sequence
  Synthetic
aagatttgtagaagcatttaaatgcgacgagttagaaagatatattaagaataatccagaatgtacactattcga

SEQ ID NO: 350821 - DNA, 75 bp, Artificial Sequence
  Synthetic
tacatgttaacaatttacgatctttataatatatcgtatccacctaccaaagtatagttgtatttgtaatttttc

SEQ ID NO: 350822 - DNA, 75 bp, Artificial Sequence
  Synthetic
aagtcttagggatgaggaagcatattctatagtcagaattttcatggatgtagatttagacgcgtgtctagacga

SEQ ID NO: 350823 - DNA, 75 bp, Artificial Sequence
  Synthetic
aatagattatttaacagctattcaagattttattatcgaggtgtcaaactgtgtagctagattcgcgtttacaga

SEQ ID NO: 350824 - DNA, 75 bp, Artificial Sequence
  Synthetic
atgcggtgccattcatgaaaatgtaataaaatccatgagatctaatttttcattaactaagtctacaaatagaga

SEQ ID NO: 350825 - DNA, 75 bp, Artificial Sequence
  Synthetic
taaaacaagttttcatatcatctttttagatacgtataccactatggataccttgatagccatgaaacgaacact

SEQ ID NO: 350826 - DNA, 75 bp, Artificial Sequence
  Synthetic
attagaattaagtagatcatctgaaaatccactaacaagatcgatagacactgccgtatataggaaaaaaacaac

SEQ ID NO: 350827 - DNA, 75 bp, Artificial Sequence
  Synthetic
tcttcgggttgtaggtactaggaaaaatccaaattgcgacactattcatgtaatgcaaccaccgcatgataatat

SEQ ID NO: 350828 - DNA, 75 bp, Artificial Sequence
  Synthetic
agaagattacctattcacttacgtggatatgaacaacaatagttattacttttctctacaacgacgattggagga

SEQ ID NO: 350829 - DNA, 75 bp, Artificial Sequence
  Synthetic
tttagttcctgataagttatgggaaccagggtttatttcattcgaagacgctataaaaagagtttcaaaaatatt

SEQ ID NO: 350830 - DNA, 75 bp, Artificial Sequence
  Synthetic
tctggtatttatatgtgcattaccaagaacgagacctacagtgatatgatgtcgttaaatttgacaaattgtgtc

SEQ ID NO: 350831 - DNA, 75 bp, Artificial Sequence
  Synthetic
cattaattctataataaactttaatgatctcgatgaaaataattttacaacggtaccactggtcatagattacgt

SEQ ID NO: 350832 - DNA, 75 bp, Artificial Sequence
  Synthetic
aacaccttgtgcattatgtaaaaaacgatcgcataaacatccgcatcaactatcgttggaaaatgatgctattag

SEQ ID NO: 350833 - DNA, 75 bp, Artificial Sequence
  Synthetic
aatttacaaaactggtaatccacatagttgtaaagttaaaattgttccgttggatggtaataaactgtttaatat

SEQ ID NO: 350834 - DNA, 75 bp, Artificial Sequence
  Synthetic
cgcacaaagaattttagacactaactctgttttattaaccgaacgaggagaccatatagtttggattaataattc

SEQ ID NO: 350835 - DNA, 75 bp, Artificial Sequence
  Synthetic
atggaaatttaacagcgaagaacccttaataacaaaactaattctgtcaataagacatcaactacctaaggaata

SEQ ID NO: 350836 - DNA, 75 bp, Artificial Sequence
  Synthetic
ttcaagcgaattactctgtccgaggaaacgaaagactgtagaagctaacatacgagacatgttagtagattcagt

SEQ ID NO: 350837 - DNA, 75 bp, Artificial Sequence
  Synthetic
agagaccgatacctatccggataaacttccgtttaaaaatggtgtattggacctggtagacggaatgttttactc

SEQ ID NO: 350838 - DNA, 75 bp, Artificial Sequence
  Synthetic
tggagatgatgctaaaaaatatacgtgtactgtatcaaccggatttaaatttgacgatacaaagttcgtcgaaga

SEQ ID NO: 350839 - DNA, 75 bp, Artificial Sequence
  Synthetic
tagtccagaaatggaagagttaataaatatcattaacgatatccaaccattaacggatgaaaataagaaaaatag

SEQ ID NO: 350840 - DNA, 75 bp, Artificial Sequence
  Synthetic
agagttgtacgaaaaaactttatctagttgtttatgcggtgctaccaaaggatgtttaacattcttttttggaga

SEQ ID NO: 350841 - DNA, 75 bp, Artificial Sequence
  Synthetic
aacggcaactggaaagtcgacaaccaaacgtttgttaaagtctgctatcagtgatctgtttgttgagacgggtca

SEQ ID NO: 350842 - DNA, 75 bp, Artificial Sequence
  Synthetic
tgtcgtatgatgaagatgacgatgaaaatgatggtacatatatatttttttgtatcattattgttattgctattc

SEQ ID NO: 350843 - DNA, 75 bp, Artificial Sequence
  Synthetic
aacaattttaacagatgtattggataaaggacctaatccatttatcgctaacatgcatttgaaaagatctgtgtt

SEQ ID NO: 350844 - DNA, 75 bp, Artificial Sequence
  Synthetic
ctgtagcgaactacctgattttgcatgtagtgggacaaagaaaatcagatctgataatattaaaaagttgacaga

SEQ ID NO: 350845 - DNA, 75 bp, Artificial Sequence
  Synthetic
accttgtgtcattggaagaccgtgtttctccaataaaattaataatagaaaccatgctacaatcattatcgatac

SEQ ID NO: 350846 - DNA, 75 bp, Artificial Sequence
  Synthetic
taattacaaacctgtctttgataggatagataacgcattaatgagaagaatcgccgttgtgcgattcagaacaca

SEQ ID NO: 350847 - DNA, 75 bp, Artificial Sequence
  Synthetic
cttttctcaaccttctggtagagaggctgctgaaaataatgacgcgtacgataaagtcaaactattagacgaggg

SEQ ID NO: 350848 - DNA, 75 bp, Artificial Sequence
  Synthetic
gttagatggtaaaatacaaaataatagatatagattcgcatttctatacttgttggtgaaatggtacagaaaata

SEQ ID NO: 350849 - DNA, 75 bp, Artificial Sequence
  Synthetic
tcatgttcctattatgaaactatatcctacaccggaagagattcctgactttgcattctatctcaaaataggtac

SEQ ID NO: 350850 - DNA, 75 bp, Artificial Sequence
  Synthetic
tctgttagtatctagctctgtaaagcatattccattaatgacggacctctccaaaaagggatatatattgcacga

SEQ ID NO: 350851 - DNA, 75 bp, Artificial Sequence
  Synthetic
taatgtggttactcttccgttgactactttccaacagaaaatatccaagtattttaattctagactatttggaca

SEQ ID NO: 350852 - DNA, 75 bp, Artificial Sequence
  Synthetic
cgacatagagagcttcatcaatagacataagaaatttgccaatgttagtgatgaatatctacaatatatattcat

SEQ ID NO: 350853 - DNA, 75 bp, Artificial Sequence
  Synthetic
agaggatatttcatctccgtaaatatatgctcatatatttatagaagatattacatatctaaatgaataccggaa

SEQ ID NO: 350854 - DNA, 75 bp, Artificial Sequence
  Synthetic
tcatagatttatttgataatcatgttgatagtataccaactatattacctcatcagttagctactctagattatc

SEQ ID NO: 350855 - DNA, 75 bp, Artificial Sequence
  Synthetic
tagtcagaactatcatagatgagaacagaagcgtgttattgttccatattatgggatcaggtaaaacaataatcg

SEQ ID NO: 350856 - DNA, 75 bp, Artificial Sequence
  Synthetic
ctttgttgttcgccttgatagcttccagatttaaaaaggttcacattctagtgccgaacattaacattttgaaaa

SEQ ID NO: 350857 - DNA, 75 bp, Artificial Sequence
  Synthetic
tttttaattataatatgggtgtagctatgaacttgtttaatgatgaattcatagctgagaatatctttattcatt

SEQ ID NO: 350858 - DNA, 75 bp, Artificial Sequence
  Synthetic
caacaacaagtttttattctcttaattataacgataacgtcattaattataacggattatctcgctacaataact

SEQ ID NO: 350859 - DNA, 75 bp, Artificial Sequence
  Synthetic
ctatttttatcgttgatgaggcacataatatctttgggaataatactggagaacttatgaccgtaataaaaaata

SEQ ID NO: 350860 - DNA, 75 bp, Artificial Sequence
  Synthetic
aaaacaagattccttttctactattgtctggatctcccattactaacacacctaatactctgggtcatattatag

SEQ ID NO: 350861 - DNA, 75 bp, Artificial Sequence
  Synthetic
atttaatgtccgaagagacgatagattttggtgagattattagtcgtggtaagaaagtaattcagacacttctta

SEQ ID NO: 350862 - DNA, 75 bp, Artificial Sequence
  Synthetic
taacagtcttacctccgactactctgggtaacaaacatactctaataggtgttttctctgcggagataatatcag

SEQ ID NO: 350863 - DNA, 75 bp, Artificial Sequence
  Synthetic
acgaacgcggtgtgaatgtactcaaggatttgcttaaaggaagaatatcatattacgaaatgcctgataaagatt

SEQ ID NO: 350864 - DNA, 75 bp, Artificial Sequence
  Synthetic
taccaacgataagatatcacggacgtaagtttctagatactagagtagtatattgtcacatgtctaaacttcaag

SEQ ID NO: 350865 - DNA, 75 bp, Artificial Sequence
  Synthetic
agagagattatatgattactagacgacagctatgttatcatgaaatgtttgataaaaatatgtataacgtgtcaa

SEQ ID NO: 350866 - DNA, 75 bp, Artificial Sequence
  Synthetic
tggcagtattgggacaacttaatctgatgaataatttagatactttatttcaggaacaggataaggaattgtacc

SEQ ID NO: 350867 - DNA, 75 bp, Artificial Sequence
  Synthetic
caaatctgaaaataaataatggtgtgttatacggagaagaattggtaacgttaaacattagttccaaatttaaat

SEQ ID NO: 350868 - DNA, 75 bp, Artificial Sequence
  Synthetic
actttatcaatcggatacagacactcaacggaaaacattttatatacttttctaattctacatatggtggattag

SEQ ID NO: 350869 - DNA, 75 bp, Artificial Sequence
  Synthetic
taattaaatatatcatgctcagtaatggatattctgaatataatggttctcagggaactaatccacatatgataa

SEQ ID NO: 350870 - DNA, 75 bp, Artificial Sequence
  Synthetic
acggcaaaccaaaaacatttgctatcgttactagtaaaatgaaatcgtctttagaggatctattagatgtgtata

SEQ ID NO: 350871 - DNA, 75 bp, Artificial Sequence
  Synthetic
attctcctgaaaacgatgatggtagtcaattgatgtttttgttttcgtcaaacattatgtccgaatcctatactc

SEQ ID NO: 350872 - DNA, 75 bp, Artificial Sequence
  Synthetic
tgaaagaggtaaggcatatttggtttatgactatcccggatactttttctcaatacaaccaaattcttggacgat

SEQ ID NO: 350873 - DNA, 75 bp, Artificial Sequence
  Synthetic
tatttctgaacccgttaatgtatatcttttagcagccgtatattccgatttcaatgacgaagtgacgtcattaaa

SEQ ID NO: 350874 - DNA, 75 bp, Artificial Sequence
  Synthetic
cgattacacgcaggatgaattgattaatgttttaccctttgacattaaaaagctgttgtatctaaaatttaagac

SEQ ID NO: 350875 - DNA, 75 bp, Artificial Sequence
  Synthetic
taaagaaacgaatagaatatactctattcttcaagagatgtctgaaacgtattctcttccaccacatccatcaat

SEQ ID NO: 350876 - DNA, 75 bp, Artificial Sequence
  Synthetic
tgtaaaagttttattgggagaattggtcagacaatttttttataataattctcgtattaagtataacgatgccaa

SEQ ID NO: 350877 - DNA, 75 bp, Artificial Sequence
  Synthetic
gttacttaaaatggttacatcagttataaaaaataaagaagacgctaggaattacatagatgatattgtaaacgg

SEQ ID NO: 350878 - DNA, 75 bp, Artificial Sequence
  Synthetic
gacattgtagaaagcgtgaccgctgtagagcttgatgatagcaacggggatgatgataatgataatgataatgac

SEQ ID NO: 350879 - DNA, 75 bp, Artificial Sequence
  Synthetic
tcacttctttgtatcgaataaagtatttgataaatctcttttatacaaatacgaaaacgatattattacagtacc

SEQ ID NO: 350880 - DNA, 75 bp, Artificial Sequence
  Synthetic
gaataagaataagaataagatcaaggattatatggaacacgattattataaaataacaatagttcctggttcctc

SEQ ID NO: 350881 - DNA, 75 bp, Artificial Sequence
  Synthetic
gtttagactttcctacgaaccgtttgtttggggagttaactttcgtaaggaatataacgtggtatcttctccata

SEQ ID NO: 350882 - DNA, 75 bp, Artificial Sequence
  Synthetic
aaactgataaaatatataaagaaataaatgtcgagctttgttaccaatggataccttccagttacattggaacca

SEQ ID NO: 350883 - DNA, 75 bp, Artificial Sequence
  Synthetic
catgagctgacgttagacataaaaactaatattaggaatgccgtatataagacgtatctccataaagaaattagt

SEQ ID NO: 350884 - DNA, 75 bp, Artificial Sequence
  Synthetic
ggtaaaatggccaagaaaatagaaatttgtaaagacgtggaattacctctcggcgaaatagttaataattctgta

SEQ ID NO: 350885 - DNA, 75 bp, Artificial Sequence
  Synthetic
gttataaacgttccgtgtgtaataacctacgcgtattatcacgttggggatatagttagaggaacattaaacatc

SEQ ID NO: 350886 - DNA, 75 bp, Artificial Sequence
  Synthetic
gaagatgaatcaaatgtaactattcaatgcggagatttaatctgtaaactaagtagagattcgggtactgtatca

SEQ ID NO: 350887 - DNA, 75 bp, Artificial Sequence
  Synthetic
tttagcgattcaaagtactgcttttttcgaaatggtaatgcgtatgataacggcagcgaagtctccgccgttcta

SEQ ID NO: 350888 - DNA, 75 bp, Artificial Sequence
  Synthetic
atggaggctcaacaaggtaccgaatctagttttgtttttctcgcgaatatcgtcgactcataagaaagagaatag

SEQ ID NO: 350889 - DNA, 75 bp, Artificial Sequence
  Synthetic
cggtaagtatatatacgaatactatggcaataattgcgaatgttttattcccttcgatatatttttgataatatg

SEQ ID NO: 350890 - DNA, 75 bp, Artificial Sequence
  Synthetic
gtataatctccccagaataatatacttctgtgtcatcgttcaatttatacggatttctatagttctctgttatat

SEQ ID NO: 350891 - DNA, 75 bp, Artificial Sequence
  Synthetic
aatgcggtttgccctcatgattagacaacgacaatagtgttctgaatttagatagttgatcagaatgaatgttta

SEQ ID NO: 350892 - DNA, 75 bp, Artificial Sequence
  Synthetic
ttggcgttggaaaaattatccatacagcgtctgcagagtggttgatagttgttcctagatatttaaaataatcca

SEQ ID NO: 350893 - DNA, 75 bp, Artificial Sequence
  Synthetic
ataatcgagtatgttagtggacttgttaaatctatataccatattttctggaagtggatatacatagttgtgatc

SEQ ID NO: 350894 - DNA, 75 bp, Artificial Sequence
  Synthetic
acttactaggcagcaaattgtctagataaaatactgaatcaaacggtgcagacgtattggcggttctaatggaat

SEQ ID NO: 350895 - DNA, 75 bp, Artificial Sequence
  Synthetic
atcattattgctagccttatcatctatatcatctatatcatctatatcatctatatcatctatatcatctatatc

SEQ ID NO: 350896 - DNA, 75 bp, Artificial Sequence
  Synthetic
ccaattgattgactatcttttgaaaatatacatttttatgatccgatacttgtaagaatatagaaataatgataa

SEQ ID NO: 350897 - DNA, 75 bp, Artificial Sequence
  Synthetic
atctagtaactagagtaaaaatctacagatgttcaataaagattccgtcaaaaatattgtacagtacttatacaa

SEQ ID NO: 350898 - DNA, 75 bp, Artificial Sequence
  Synthetic
gtccatcatcgtgtttttttgcctcttcataagaactatattttttcttattccaatgaacaagattaatctctc

SEQ ID NO: 350899 - DNA, 75 bp, Artificial Sequence
  Synthetic
aaaatattgtacagtacttatacaataggcatataagttctatgaatataatagatgtattaaaatgcgccaact

SEQ ID NO: 350900 - DNA, 75 bp, Artificial Sequence
  Synthetic
cagagtatttgtacacatctatcaagtgattggatccataatcgtcttcctttccccaatatatatgtagtgatg

SEQ ID NO: 350901 - DNA, 75 bp, Artificial Sequence
  Synthetic
ataacacatattcattgggaagaaaccctccacttaaatatcctcctttaaaattaatccttactagttttccag

SEQ ID NO: 350902 - DNA, 75 bp, Artificial Sequence
  Synthetic
ccctccacttaaatatcctcctttaaaattaatccttactagttttccagtattctggatagtggttggtttcga

SEQ ID NO: 350903 - DNA, 75 bp, Artificial Sequence
  Synthetic
ctcattataatgtatgtttaacggctttaatcgcgcgttagaaattgcttttttagtttctatattaataggaga

SEQ ID NO: 350904 - DNA, 75 bp, Artificial Sequence
  Synthetic
tagttgttgtgacatagtaaaaatgaaatgataactgtttagaaatagctcttagtatgggaattacaatggatg

SEQ ID NO: 350905 - DNA, 75 bp, Artificial Sequence
  Synthetic
aggaagtgatatttgaaactcctagagaattaatatctattaaacgaataaaagatattccaagatcaaaagaca

SEQ ID NO: 350906 - DNA, 75 bp, Artificial Sequence
  Synthetic
cgcacgtgtttgctgcgtgtataacaagtgacggatatccgctaataggagctagaagaacttcattcgcattcc

SEQ ID NO: 350907 - DNA, 75 bp, Artificial Sequence
  Synthetic
aggcgatattatctcaacaaaattcagattctatctttagagtatccactaaactattacggtttatgtattaca

SEQ ID NO: 350908 - DNA, 75 bp, Artificial Sequence
  Synthetic
tcatgatactaagtataatgtatgtaacccgtgcatattagtatataacattaatactatggaatatagtgttat

SEQ ID NO: 350909 - DNA, 75 bp, Artificial Sequence
  Synthetic
atgaactaagagaaatctttagacggttgagaaaaggttctatcaacaatatcgatcctcacttcgaagagttaa

SEQ ID NO: 350910 - DNA, 75 bp, Artificial Sequence
  Synthetic
ttccaccattcctaatcacataattaattacacatccgcgattgtagataatgaaataataatagctggaggata

SEQ ID NO: 350911 - DNA, 75 bp, Artificial Sequence
  Synthetic
tattattgggtggtaaactagataaaaaggaatctattaaagattgtttaagaagagaattaaaagaggaaagtg

SEQ ID NO: 350912 - DNA, 75 bp, Artificial Sequence
  Synthetic
atgaacgtataacagtaaaagaattcggaaatgtaattctaaaacttacaacacaggataaattatttaataaag

SEQ ID NO: 350913 - DNA, 75 bp, Artificial Sequence
  Synthetic
tataaactataaactaaaaattaaacaatatcgttattatataagtaataccaaaatgatgatatacgattaata

SEQ ID NO: 350914 - DNA, 75 bp, Artificial Sequence
  Synthetic
cggaattaatagcttccagatacagtgattttggcaatagtccgtgtaatccataatccagtaacacgagctggt

SEQ ID NO: 350915 - DNA, 75 bp, Artificial Sequence
  Synthetic
tgtatataggttattgcatgtcgtgttttattaatcaatcattagaggatttatcacatactagtatttacaatg

SEQ ID NO: 350916 - DNA, 75 bp, Artificial Sequence
  Synthetic
tagaaattagaaagattaaatcattaaatgattgtattaacgatgataaatacgaatatctgtcttatatttata

SEQ ID NO: 350917 - DNA, 75 bp, Artificial Sequence
  Synthetic
atatgctagttaatagtaaatgaacttttacagatctagtataattagtcagattattaagtataatagacgact

SEQ ID NO: 350918 - DNA, 75 bp, Artificial Sequence
  Synthetic
agctaagtctattatttgcgaggatgactctcaaattattacacttacggcattcgttaaccaatgcctatggtg

SEQ ID NO: 350919 - DNA, 75 bp, Artificial Sequence
  Synthetic
tcataaacgagtatccgtgtccgctattttattaactacggataacaaaatattagtatgtaacagacgagatag

SEQ ID NO: 350920 - DNA, 75 bp, Artificial Sequence
  Synthetic
ttttctctattctgaaataattagaactagaaacatgtctagaaagaaacgattatttctaaattattccaatta

SEQ ID NO: 350921 - DNA, 75 bp, Artificial Sequence
  Synthetic
actagaaacatgtctagaaagaaacgattatttctaaattattccaattatttgaacaaacaggaaagaagtata

SEQ ID NO: 350922 - DNA, 75 bp, Artificial Sequence
  Synthetic
tttgaacaaacaggaaagaagtatactatcgtcatttttttctctagatccagctactgctgataatgatagaat

SEQ ID NO: 350923 - DNA, 75 bp, Artificial Sequence
  Synthetic
agacgctatttatccgggcggtatacccaaaaggggtgagaacgttccagagtgtctatccagggaaatcaaaga

SEQ ID NO: 350924 - DNA, 75 bp, Artificial Sequence
  Synthetic
agaagttaatatagacaattcttttgtattcatagacactcgtttttttattcatggtatcatagaagataccat

SEQ ID NO: 350925 - DNA, 75 bp, Artificial Sequence
  Synthetic
taattatgatcttgatttatagatgaaaatcagctgctttagatgattttggttagtatgtataatataaaaaaa

SEQ ID NO: 350926 - DNA, 75 bp, Artificial Sequence
  Synthetic
tattaacaaattttttgaggtaattttctttgttggaagaatatctctaacgagtgatcaaattattgatacctt

SEQ ID NO: 350927 - DNA, 75 bp, Artificial Sequence
  Synthetic
taaaagtaatcatgaaattaaggatctaatatttttagatccgaattcaggtaatggactccaatacgaaattgc

SEQ ID NO: 350928 - DNA, 75 bp, Artificial Sequence
  Synthetic
aaaatatgctctagatactgcaaaacttaaatgttatggccatagaggatgttattatgaatcattaaaaaaatt

SEQ ID NO: 350929 - DNA, 75 bp, Artificial Sequence
  Synthetic
aactgaggatgattgattagaaaatataaattaatttaccatcgtgtatttttataacgggattgtctggcatat

SEQ ID NO: 350930 - DNA, 75 bp, Artificial Sequence
  Synthetic
catgtagatagttaccatctacatcgtatactcgaccatctacgcctttaaatcctctatttattgacattaatc

SEQ ID NO: 350931 - DNA, 75 bp, Artificial Sequence
  Synthetic
tattagaattggaataccaaatattagtaccctcaattagtttattggtaatattttttttagacgatagatcga

SEQ ID NO: 350932 - DNA, 75 bp, Artificial Sequence
  Synthetic
tggctcttgaaaccaaggttttccaaccggactcgttatcgatcggtgaaaagtctttttcattagcatgaatcc

SEQ ID NO: 350933 - DNA, 75 bp, Artificial Sequence
  Synthetic
attctaatgatgtatgtttaaacactctaaacaattggacaaattcttttgatttgctttgaataatttcaaata

SEQ ID NO: 350934 - DNA, 75 bp, Artificial Sequence
  Synthetic
ggtcttcgtctacagtaggcataccattagataatctagccattataaagtgcacgtttacatatctacgttctg

SEQ ID NO: 350935 - DNA, 75 bp, Artificial Sequence
  Synthetic
gaggagtaagaacgtgactattaagacgaatggctcttcctactatttgacgaagagatgcctcgttccaagtca

SEQ ID NO: 350936 - DNA, 75 bp, Artificial Sequence
  Synthetic
ccgtctaagatgataaaaaacacgtttattttatatgtcaaccattactaaaaaatatattgttctgttttttgt

SEQ ID NO: 350937 - DNA, 75 bp, Artificial Sequence
  Synthetic
tatctagaatgaagatatcattaattgagaaaaaactaataccctcgcctccactagaagagaatacacatgttt

SEQ ID NO: 350938 - DNA, 75 bp, Artificial Sequence
  Synthetic
taatgcattctccgttagtgtttgattcttggttaaactcagccaccgccttgattctagtatcttttgttctag

SEQ ID NO: 350939 - DNA, 75 bp, Artificial Sequence
  Synthetic
aaaaacatatataataaataacaatggctgaatggcataaaattatcgaggatatttcaaaaaataataattttg

SEQ ID NO: 350940 - DNA, 75 bp, Artificial Sequence
  Synthetic
atgagaactctatattagagataccaaagactttgaaatatagtaataaaatttctattcctgactgattaacaa

SEQ ID NO: 350941 - DNA, 75 bp, Artificial Sequence
  Synthetic
taagaaaaatatatagactaactatctctttctctcttcgatggtctcacaaaaatattaaacctctttctgatg

SEQ ID NO: 350942 - DNA, 75 bp, Artificial Sequence
  Synthetic
atggttcaaagactagacatttaccatgtgatgctaatattcccaaacatacatctatgaatttggcgcttttct

SEQ ID NO: 350943 - DNA, 75 bp, Artificial Sequence
  Synthetic
cttttaattcagtaaatagagagatatcagccgcactagcgtcccctcccaatagttctccctttttaaaggtat

SEQ ID NO: 350944 - DNA, 75 bp, Artificial Sequence
  Synthetic
ctaatgcggatttagaaaactctctatctcttaatgagcgtttaaagtcattatatagggttgctatctcttgcg

SEQ ID NO: 350945 - DNA, 75 bp, Artificial Sequence
  Synthetic
ttatatagggttgctatctcttgcgcgtattcacccggatcacgattttgtctttcaggaaagctatcgaacgta

SEQ ID NO: 350946 - DNA, 75 bp, Artificial Sequence
  Synthetic
aacgtagtagccatacgtcgcagaattctaaatgatgatatacctgtttttatttcagtaagtttagccttttga

SEQ ID NO: 350947 - DNA, 75 bp, Artificial Sequence
  Synthetic
taaatctcttcttgcttttttgacatattaacgtatcgcattaatactgttttcttagcgaatgatgcagaccct

SEQ ID NO: 350948 - DNA, 75 bp, Artificial Sequence
  Synthetic
tagaaaaatgatgctggttattacacatgtgttttaatatatatatatatatatatatatatatatatatatata

SEQ ID NO: 350949 - DNA, 75 bp, Artificial Sequence
  Synthetic
tctacgtcatcaaaaatagaaaactcgttattaactatgtacgaacataggcctcctagtttggagactaattct

SEQ ID NO: 350950 - DNA, 75 bp, Artificial Sequence
  Synthetic
ggtttatttatgaccggcgaccatgaatttacagagattatctctggctatatatcttactgcgacatgttcgtg

SEQ ID NO: 350951 - DNA, 75 bp, Artificial Sequence
  Synthetic
ttttcattaactagacgtttattctcaaatagcgattggtgttgtaaggatcctggtcgtagtaagttaaccaac

SEQ ID NO: 350952 - DNA, 75 bp, Artificial Sequence
  Synthetic
atggtgaattcttgcacactattgacgataggtgtagccgataaacaaatcatcttatggttttttaacgcaatg

SEQ ID NO: 350953 - DNA, 75 bp, Artificial Sequence
  Synthetic
gtcttagataaaaaattatatactgaacgagtaggacggatcttaccatcttctttgattaatgatttagaaatg

SEQ ID NO: 350954 - DNA, 75 bp, Artificial Sequence
  Synthetic
aagttatgacattcatcaatgatgacgcatattctactcttggaattaatagttttgatattagtaaaaaattta

SEQ ID NO: 350955 - DNA, 75 bp, Artificial Sequence
  Synthetic
tttctaaaattttgatcatcgtaattaataaaaatacaatccttcgttatctctggagcgtatctgagtatagtg

SEQ ID NO: 350956 - DNA, 75 bp, Artificial Sequence
  Synthetic
ttcatccaaggatcttctatcaaagcttttttcactaataagataatagcccaattcgtataaatatccttaaga

SEQ ID NO: 350957 - DNA, 75 bp, Artificial Sequence
  Synthetic
tgtttgagaatatatacagtagtcattgttttaccgacacctgtttcatggaacaataaaagagaatgcatactg

SEQ ID NO: 350958 - DNA, 75 bp, Artificial Sequence
  Synthetic
tctaatcctaagaaaactcttgctacaaaatgttgataatccttgaggcgtactacgtctgttcccatcatttca

SEQ ID NO: 350959 - DNA, 75 bp, Artificial Sequence
  Synthetic
acaggcatattagtagttctgcgcaaggcataatcgatataggccgcatgtgatttactcatttatagtgataag

SEQ ID NO: 350960 - DNA, 75 bp, Artificial Sequence
  Synthetic
taataactatgttttaaaaatcataacagtagtttaactagtcttctctgatgtttgttttcgatacttttcgaa

SEQ ID NO: 350961 - DNA, 75 bp, Artificial Sequence
  Synthetic
ccagctattccacctagtagagatagtcaaccaaataataaaggatttagtaagtttgtatctcctagacggtgt

SEQ ID NO: 350962 - DNA, 75 bp, Artificial Sequence
  Synthetic
aaaatacttattctgattattctagccatttccgtgttcgttcaaatgccacatcaaagatatgggagtagttga

SEQ ID NO: 350963 - DNA, 75 bp, Artificial Sequence
  Synthetic
tcagaagtcatactagaataaagcaacgagtgaacgtaatagagagcttcgtatactctattcgaaaactctaag

SEQ ID NO: 350964 - DNA, 75 bp, Artificial Sequence
  Synthetic
aacttattaatgaattccgtatccactggatcgtttagaatactaaattgaacactgttcacatccttccaagaa

SEQ ID NO: 350965 - DNA, 75 bp, Artificial Sequence
  Synthetic
gaagatttagtaacggacttaacatgagacataaataaatccaaattttttttacaaacattactagccaccata

SEQ ID NO: 350966 - DNA, 75 bp, Artificial Sequence
  Synthetic
atggcgctatcttttaaccagctatcgcttacacatttcagcaatctaacatttttaaagagactacaatatatt

SEQ ID NO: 350967 - DNA, 75 bp, Artificial Sequence
  Synthetic
ctcatggtatcgattacacctctaccgaatagagtaggaagtttaataatacaatatttttcgtttacaaaatca

SEQ ID NO: 350968 - DNA, 75 bp, Artificial Sequence
  Synthetic
aataatggtcgaaacacgtcaaaggttaacatcttataatcgctaatgtatagattgttttcagtaagatgatta

SEQ ID NO: 350969 - DNA, 75 bp, Artificial Sequence
  Synthetic
ttagatttaatagcatctcgttcgcgtttaaacagtttattgcgtgcgctaagatcggcaactactgcgtccgct

SEQ ID NO: 350970 - DNA, 75 bp, Artificial Sequence
  Synthetic
ttagtacttctcccataatactttacgctattaatctttaaaatttcatagactttatctagatcgctttctggt

SEQ ID NO: 350971 - DNA, 75 bp, Artificial Sequence
  Synthetic
aacatgatatcatgtgtaaaaagttttaacatgtcggttggcattctatttagatcattaactctagaaatctga

SEQ ID NO: 350972 - DNA, 75 bp, Artificial Sequence
  Synthetic
agaaagtaattagctccgtattccaaactaggtaatgggcttttacctagagacagattaagttctggcaatgtt

SEQ ID NO: 350973 - DNA, 75 bp, Artificial Sequence
  Synthetic
tcataaaatggaagaaggacatgcgtcccctcccggatattttttacaatttcatccatttacaactctatagtt

SEQ ID NO: 350974 - DNA, 75 bp, Artificial Sequence
  Synthetic
tgttttcattattattagttattatctcccattatcttggtaatacttaccccttgatcgtaagataccttatac

SEQ ID NO: 350975 - DNA, 75 bp, Artificial Sequence
  Synthetic
aggtcattacatacaactaccaattgtttttgtacataatagattggatggttgacatccatggtggaataaact

SEQ ID NO: 350976 - DNA, 75 bp, Artificial Sequence
  Synthetic
actcgaacagatagtttatctttccccctagatacattggccgtaatagttgtcggtctaaagaatatctttggt

SEQ ID NO: 350977 - DNA, 75 bp, Artificial Sequence
  Synthetic
gtaaagttaaaagttagggttcttgttccattattgctttttgtcagtagttcattataaattctcgagatgggc

SEQ ID NO: 350978 - DNA, 75 bp, Artificial Sequence
  Synthetic
ccgttctctgaatatagaacatcatttccaaatctaacttctagtctagaaataatatcggtcttattcttaaaa

SEQ ID NO: 350979 - DNA, 75 bp, Artificial Sequence
  Synthetic
tctattcccttgatgaagggatcgttaatgaacaaatccttggcctttgattcggctgatctattatctccgtta

SEQ ID NO: 350980 - DNA, 75 bp, Artificial Sequence
  Synthetic
tagacgttacgttgactagtccaaagacttacaggaatagatgtatcgatgatgttgatactatgtgatatgtgt

SEQ ID NO: 350981 - DNA, 75 bp, Artificial Sequence
  Synthetic
gcaaagactgttctcttggtggcgtcgctatatgttccagtaatggcggaaaactttttagaaatgttatatata

SEQ ID NO: 350982 - DNA, 75 bp, Artificial Sequence
  Synthetic
aaagaattttttcgggttccaaacattaacagattagtatgaagataaacactcatattatcaggaacattatca

SEQ ID NO: 350983 - DNA, 75 bp, Artificial Sequence
  Synthetic
atttttacatacacatcagcatcttgaatagaaacgataccatcttctggaacctcaacaatctcggcagactcc

SEQ ID NO: 350984 - DNA, 75 bp, Artificial Sequence
  Synthetic
tcctagtttcatcatccatgagattgtagaagctttgggattgtctgacataagatgtctatgaatatgattttt

SEQ ID NO: 350985 - DNA, 75 bp, Artificial Sequence
  Synthetic
ggataaccagttggtgggccatcactaacaataactagatcatccaacaatctactcacatatgcatctatataa

SEQ ID NO: 350986 - DNA, 75 bp, Artificial Sequence
  Synthetic
acgtttatttcatataatagacataatgactccatagagataagaggggtgcttccagaggaaactaatatcggt

SEQ ID NO: 350987 - DNA, 75 bp, Artificial Sequence
  Synthetic
tctttttcatcttgtgagtaccctggatacgaaataaatttattatccgtatttccataataaggtttagtataa

SEQ ID NO: 350988 - DNA, 75 bp, Artificial Sequence
  Synthetic
acagagagcgatgttgccgcatgaacttcagttacagtcgccgttggttggtttatttgacctattactctccta

SEQ ID NO: 350989 - DNA, 75 bp, Artificial Sequence
  Synthetic
ggtttctctataaacgatggtttaatttgtacattcttaaccatatatccaataaagctcaattcaggaacataa

SEQ ID NO: 350990 - DNA, 75 bp, Artificial Sequence
  Synthetic
acaaattctttgttgaacgtttcaaagtcgaacgaagagtcgcgaataacgatatcggatactggattgaaggtc

SEQ ID NO: 350991 - DNA, 75 bp, Artificial Sequence
  Synthetic
accgttacggtaatttttgaatcggatagtttaagactgctaaatgtatcttccacatcaaacggagttttaata

SEQ ID NO: 350992 - DNA, 75 bp, Artificial Sequence
  Synthetic
taaacgtatactgtagatggttctttaatagtgtcattaggagttaagccaatagaaatatcattaagttcacta

SEQ ID NO: 350993 - DNA, 75 bp, Artificial Sequence
  Synthetic
gaagacacattatttgacgacgagttatactctattatagaacgctctttcgatgataattttccaaaaatatcc

SEQ ID NO: 350994 - DNA, 75 bp, Artificial Sequence
  Synthetic
gaatatccagaatgtttcaaagcaattgtattattgatacaattattatataattcttcgccctcaatttcccaa

SEQ ID NO: 350995 - DNA, 75 bp, Artificial Sequence
  Synthetic
ataacaccattacacgaagagaccgatacatgattaatacatttatatccaacatatggtacgtaaccgaatctt

SEQ ID NO: 350996 - DNA, 75 bp, Artificial Sequence
  Synthetic
cccatacctttaacttctggaagttccaaactcagaaccaaatgattaagcgcagtaatatactgatccctaatt

SEQ ID NO: 350997 - DNA, 75 bp, Artificial Sequence
  Synthetic
tcgaagctagcgatagtctgattgtcgggaccattgtttgtcataactccggatagagaaatatattgcggcata

SEQ ID NO: 350998 - DNA, 75 bp, Artificial Sequence
  Synthetic
tataaagttggaatttgactatcgactgcgaagacattagaccgtttaatagagtcatccccaccaatcaacgaa

SEQ ID NO: 350999 - DNA, 75 bp, Artificial Sequence
  Synthetic
ttaatgatagtattattcattttctatttaaaatggaaaaagcttacaataaactccgtagagaaatatctataa

SEQ ID NO: 351000 - DNA, 75 bp, Artificial Sequence
  Synthetic
tttgtgagttttccttaaagtaacaacttccgtaaacgccgtctttatctcttagtaagtttattgtatttatga

SEQ ID NO: 351001 - DNA, 75 bp, Artificial Sequence
  Synthetic
ccttttccttatcttcataaaatactaaaggcaacaaagaaatttttggttcttctctaagagctacgtgagact

SEQ ID NO: 351002 - DNA, 75 bp, Artificial Sequence
  Synthetic
taaccatagacgccaacgaatccctacatattttagaacagaaatacccaacttcgccacccttgaatgtctcaa

SEQ ID NO: 351003 - DNA, 75 bp, Artificial Sequence
  Synthetic
tactaataggtctaaaaaccaaatcttgattacaaaaccaacacttatcaattacactatttgtcttaatagaca

SEQ ID NO: 351004 - DNA, 75 bp, Artificial Sequence
  Synthetic
tatctgccatagatttataatactttggtagtatacaagcgagtgcttcttctttagcgggcttaaagactgctt

SEQ ID NO: 351005 - DNA, 75 bp, Artificial Sequence
  Synthetic
taggtgctgaaataaccacatctggaaggcttactcgcttagccatttaattacggaactatttttttatacttc

SEQ ID NO: 351006 - DNA, 75 bp, Artificial Sequence
  Synthetic
taatgagcaagtagaaaacctctcatctacaaaaacatactcgtgtccataatcctctaccatagtaacacgttt

SEQ ID NO: 351007 - DNA, 75 bp, Artificial Sequence
  Synthetic
tttagatctcatatgtgctaaaaagttttcccatactaactgattactattatttttcgtataatttttaactgt

SEQ ID NO: 351008 - DNA, 75 bp, Artificial Sequence
  Synthetic
ttgaggttttagatttttagttacagaagtaatatcgaatattttatccaaaaagaatgagtaattaattgtttt

SEQ ID NO: 351009 - DNA, 75 bp, Artificial Sequence
  Synthetic
agaaggagtgttttcttggcaaaagaataccaagtgcttaaatatttctactacttcattaatcttttcggtact

SEQ ID NO: 351010 - DNA, 75 bp, Artificial Sequence
  Synthetic
tgattgattatttcaaagactaacttataatcctttttatttatcctctcgttagccttaagaaaactagataca

SEQ ID NO: 351011 - DNA, 75 bp, Artificial Sequence
  Synthetic
aaatttgcatctacatcatccgtggatatttgatttttttccatgatatccaaaagttccgagataatttctcca

SEQ ID NO: 351012 - DNA, 75 bp, Artificial Sequence
  Synthetic
ataacttgatttcaaaattatcaatggagatacaacgtaaaatactttattactccattaaaataatgtatcact

SEQ ID NO: 351013 - DNA, 75 bp, Artificial Sequence
  Synthetic
gaacattgatgagacaataatctccgcaatacatttctcaaatgaataagtttattagacacgtggaagtttgac

SEQ ID NO: 351014 - DNA, 75 bp, Artificial Sequence
  Synthetic
atgagcattaaatctgagcatcataatagtcttgaaacagtatctatggaaattatggataatcggtactaataa

SEQ ID NO: 351015 - DNA, 75 bp, Artificial Sequence
  Synthetic
tttttttgtacctttgtacatttttgaaatacagactcgcaaaaaatacaatattcatatccttgttcagatact

SEQ ID NO: 351016 - DNA, 75 bp, Artificial Sequence
  Synthetic
aaaatagtttaactctttttagaaccagtttggtactggaatttcagttcattcgttgagaatattgatgatttt

SEQ ID NO: 351017 - DNA, 75 bp, Artificial Sequence
  Synthetic
ataccgttgtgtctacaaccgctacataatcgtagattcatgttaacactctacgtatctcgtcgtccaatattt

SEQ ID NO: 351018 - DNA, 75 bp, Artificial Sequence
  Synthetic
tatataaaaacattttatttctagacgttgccaaaaaatcctgtaatacttttagtttttggggttgtgaataaa

SEQ ID NO: 351019 - DNA, 75 bp, Artificial Sequence
  Synthetic
gtatcgccctaatattattaccatcttccgccaatatagtagttagattatcagcacatgaagaaaaacacctct

SEQ ID NO: 351020 - DNA, 75 bp, Artificial Sequence
  Synthetic
taggtggattcagtacaatgttatatttttcgtaccaactcatttaaatatcataatctaaaatagttctgtaat

SEQ ID NO: 351021 - DNA, 75 bp, Artificial Sequence
  Synthetic
atgtctagcgctaatatattgatcataatcctgtgcataaattaaaatacaacaatgtctcgaaatcattgacat

SEQ ID NO: 351022 - DNA, 75 bp, Artificial Sequence
  Synthetic
ggcttcttccatagttagaagatcgtcgtcaaagttagcaacgtgattcatcaacatttgctgttttgaggcagc

SEQ ID NO: 351023 - DNA, 75 bp, Artificial Sequence
  Synthetic
aaatactgaaccgtcaccattcaaccattcataaaaaccatcgtctgaatccattgataatttcttgtactggtt

SEQ ID NO: 351024 - DNA, 75 bp, Artificial Sequence
  Synthetic
tttgagagctcgcatcaatctagcatttctagctcccggattgaaaacagaaagaggatcgtacatccagggtcc

SEQ ID NO: 351025 - DNA, 75 bp, Artificial Sequence
  Synthetic
attttctgtaaatagaatagtataatgtccctttaagaagatatcagacgatccacaatcaaaaaattggtctcc

SEQ ID NO: 351026 - DNA, 75 bp, Artificial Sequence
  Synthetic
gagtttgtaacagactgcggactttaacctatacatgataccgtttagcatgatttctggtgatacgtcaattgg

SEQ ID NO: 351027 - DNA, 75 bp, Artificial Sequence
  Synthetic
agtatcatctattagagatctaaagccggtgtaacattctccaccaaacatattcttattctgacgtcgttctac

SEQ ID NO: 351028 - DNA, 75 bp, Artificial Sequence
  Synthetic
ataaaacatcattgctccattaacgataacaggggaatgaacagcactacccatcacattagttcccaatgaatc

SEQ ID NO: 351029 - DNA, 75 bp, Artificial Sequence
  Synthetic
aatgtgtgtaactccagaacatcttccatagcctatgttaggaggagcgaacactactcttccactattgccatc

SEQ ID NO: 351030 - DNA, 75 bp, Artificial Sequence
  Synthetic
gaatgccatagaataaatatccttggaattgatagaaatcggactgtcggatgttgtgatcatcttcataggatt

SEQ ID NO: 351031 - DNA, 75 bp, Artificial Sequence
  Synthetic
aacaacaatgtatggtgccgcctgaagtttcatatcgtaactgatgccgtttataggtctagccacagaaaccaa

SEQ ID NO: 351032 - DNA, 75 bp, Artificial Sequence
  Synthetic
tgtaggtctaaatccaactatagacaaaatagaagccaatatctgttcctcatctgtcataacttgagagcatcc

SEQ ID NO: 351033 - DNA, 75 bp, Artificial Sequence
  Synthetic
agtatgaataatcttcattagatggggatctaccgcatcatcatcgttacaataaaaaattcccattctaatgtt

SEQ ID NO: 351034 - DNA, 75 bp, Artificial Sequence
  Synthetic
cataattgcttttctaatcatggtatgcatgtttgccctttgaatctctgtggaaattagatctgatacacctgt

SEQ ID NO: 351035 - DNA, 75 bp, Artificial Sequence
  Synthetic
aatcactatcggattatcctccgtaagacgattaaccaacaacatataattataagactttactcttctaaattc

SEQ ID NO: 351036 - DNA, 75 bp, Artificial Sequence
  Synthetic
ataaagttgctggattagactatatgtgtctccatgtacatacgcgttctcaagcgcgggaagtttaatgccaaa

SEQ ID NO: 351037 - DNA, 75 bp, Artificial Sequence
  Synthetic
tttatgaaaaatatatcattcgataagatagattccatcatcgaaaaatgcagctgtgagataagtcgcctcaaa

SEQ ID NO: 351038 - DNA, 75 bp, Artificial Sequence
  Synthetic
ttataacatccatagttggatttacataggtgtccaattgggatctcaccatcatcgagatgattgatggcatct

SEQ ID NO: 351039 - DNA, 75 bp, Artificial Sequence
  Synthetic
tagtgccatcagaataggatgaatgtagtaattagtttctggttttctataaataaaagacaaatcttgcgagct

SEQ ID NO: 351040 - DNA, 75 bp, Artificial Sequence
  Synthetic
cccccctttcttttttagtagatatttcatcgtgtaagaatcaatattaatatttctaaagtatccgtgtatagc

SEQ ID NO: 351041 - DNA, 75 bp, Artificial Sequence
  Synthetic
agacatatcggtaaaatgcatggattggaatcgtgtagtcgacagaagaatatgatgattagacggagagtatat

SEQ ID NO: 351042 - DNA, 75 bp, Artificial Sequence
  Synthetic
tttatctaactctttgagttggtcaccaattctaggactagctcgagaatgaataagtactaaaggatgagtaca

SEQ ID NO: 351043 - DNA, 75 bp, Artificial Sequence
  Synthetic
taattaagtttggatgtcttatccatttcgaagtgtagcgttttaaatattctgctacacctgttgaaatagaaa

SEQ ID NO: 351044 - DNA, 75 bp, Artificial Sequence
  Synthetic
tttcacagaaacactggcgttgttcaatgtgctctttacatgggtaaggagttgaaatagctcgtttctatttgt

SEQ ID NO: 351045 - DNA, 75 bp, Artificial Sequence
  Synthetic
tctgctacacctgttgaaatagaaaattttaatcctcctattacatataactttccatcattaacacacgtacta

SEQ ID NO: 351046 - DNA, 75 bp, Artificial Sequence
  Synthetic
tctgacaatatttagtttattcataatgttaagcatatcctgaatagtaaaattagatgtgtcatacttgttagt

SEQ ID NO: 351047 - DNA, 75 bp, Artificial Sequence
  Synthetic
agttagatatttagcaattgcattcccatcatttctcaatctcgtactccaatcatgtgtggatgctacttcatc

SEQ ID NO: 351048 - DNA, 75 bp, Artificial Sequence
  Synthetic
tatagaaaccatacaatcctttttggtagtctgttgagcttgatcatttcctgcacgtttaggtttggtacgttg

SEQ ID NO: 351049 - DNA, 75 bp, Artificial Sequence
  Synthetic
atttctagcccctgcggatataaagtcatcgtctacaatttgggacaatgaattgcatacactacatgacaaaga

SEQ ID NO: 351050 - DNA, 75 bp, Artificial Sequence
  Synthetic
tttatcagaagtgtgaatatgatcttcatctaccaaagaaagagtttgattagtataactagattttagtcctgt

SEQ ID NO: 351051 - DNA, 75 bp, Artificial Sequence
  Synthetic
gttagatgttaaaaaaacatcgctattgaccacggcttccattatttatattcgtagtttttactcgaaagcgtg

SEQ ID NO: 351052 - DNA, 75 bp, Artificial Sequence
  Synthetic
attttaatatccaatcttattacttttggaatcgttcaaaacctttgactagttgtagaatttgatctattgccc

SEQ ID NO: 351053 - DNA, 75 bp, Artificial Sequence
  Synthetic
tacgcgtatactcccttgcatcatatacgttcgtcaccagatcgtttgtttcggcctgaagttggcgcatatctt

SEQ ID NO: 351054 - DNA, 75 bp, Artificial Sequence
  Synthetic
tcggcctgaagttggcgcatatctttttcaacactcgacatgagatccttaagggccatattgtctagattttgt

SEQ ID NO: 351055 - DNA, 75 bp, Artificial Sequence
  Synthetic
tttcaacactcgacatgagatccttaagggccatattgtctagattttgttgagatgttgctcctggatttggat

SEQ ID NO: 351056 - DNA, 75 bp, Artificial Sequence
  Synthetic
attctctcttcgatggtctcacaaaaaagttttacaaaaatatttttattctctttctctcttcgatggtctcac

SEQ ID NO: 351057 - DNA, 75 bp, Artificial Sequence
  Synthetic
tttgttgtgctgttgtacatactgtaccaccagtaggtgtaggagtacatacagtggccacaataggaggttgag

SEQ ID NO: 351058 - DNA, 75 bp, Artificial Sequence
  Synthetic
gaggtgtaactgtcggagtagtacaagaaatacttccatccgattgttgtgtacatgtagttgttggtaacgtct

SEQ ID NO: 351059 - DNA, 75 bp, Artificial Sequence
  Synthetic
gagaaggttgggtagatggcgtcgtcgtcgtcttttgatctttattaaatttagagataatatcctgaacagcat

SEQ ID NO: 351060 - DNA, 75 bp, Artificial Sequence
  Synthetic
tgatcggcgtcaacgctggaaggagtgaactcggttgtgtattatcatctgccgacaaccaatcaaaaagattag

SEQ ID NO: 351061 - DNA, 75 bp, Artificial Sequence
  Synthetic
tatttcttaaacaataacgttcaacaacatatactctcgagcttatcaacatcccctagtcccaactaggttacc

SEQ ID NO: 351062 - DNA, 75 bp, Artificial Sequence
  Synthetic
acatatccgatgatgtattagtttgttgttgtcgtggttttggtgtaggagccggtgtaggtacctgcagtggag

SEQ ID NO: 351063 - DNA, 75 bp, Artificial Sequence
  Synthetic
atttttggtatataaatgatctagtaaaatccatgtagggatactgttcacgttttttggtacaaaatttctcac

SEQ ID NO: 351064 - DNA, 75 bp, Artificial Sequence
  Synthetic
ttatatgaatagttggttgtagcggttggataggctgtctgctggcggccatcatattatctctagctagttgtt

SEQ ID NO: 351065 - DNA, 75 bp, Artificial Sequence
  Synthetic
acatcaacgccttagaaataagagacttaaacaacggacacctggaattattaccatagaagatgttagaaaaat

SEQ ID NO: 351066 - DNA, 75 bp, Artificial Sequence
  Synthetic
ctcgcaactgtctttgataatacgactcttgagactttagtcctatttcaatcgcttcatccttttttatatcca

SEQ ID NO: 351067 - DNA, 75 bp, Artificial Sequence
  Synthetic
ctcttgagactttagtcctatttcaatcgcttcatccttttttatatccagatccttttcttcagaataatagat

SEQ ID NO: 351068 - DNA, 75 bp, Artificial Sequence
  Synthetic
tgacgactttggtgtagaggattctgccaacccctgtgagaacttgttaaagaagtccatttaaggctttaaaat

SEQ ID NO: 351069 - DNA, 75 bp, Artificial Sequence
  Synthetic
tgaattgcgattataagattaaatggcagacacagacgatattatcgactatgaatccgatgatctcactgaata

SEQ ID NO: 351070 - DNA, 75 bp, Artificial Sequence
  Synthetic
cgaggatgatgatgaagaggaagaagatggagagtcactagaaactagtgatatagatcccaaatcttcttataa

SEQ ID NO: 351071 - DNA, 75 bp, Artificial Sequence
  Synthetic
ataacattacatattatatcaatatcacaaaaataaatccacatttggctaatcaatttcgggcttggaaaaaac

SEQ ID NO: 351072 - DNA, 75 bp, Artificial Sequence
  Synthetic
gattgtagaatcagcatccactcatatagaagatgcacattccaatcttaaacatatagggaatcatatatctgc

SEQ ID NO: 351073 - DNA, 75 bp, Artificial Sequence
  Synthetic
tcttaaacgacgctatactagacgtataagtctatttgaaatagcgggtataatagcagaaagctataacttgct

SEQ ID NO: 351074 - DNA, 75 bp, Artificial Sequence
  Synthetic
tcaacgaggaagattacctctagtttcagaattttctgacgaaacgatgaagcaaaatatgctacatgtaattat

SEQ ID NO: 351075 - DNA, 75 bp, Artificial Sequence
  Synthetic
acaagagatagaggagggttcttgtcctatagtcatcgaaaagaacggagaattgttgtcggtaaacgattttga

SEQ ID NO: 351076 - DNA, 75 bp, Artificial Sequence
  Synthetic
caaagatggtctaaaattccatctagactatattatcaaaatttggaaacttcaaaaacgatattagaatttata

SEQ ID NO: 351077 - DNA, 75 bp, Artificial Sequence
  Synthetic
cgaatatcgttctctaaatgtcacaatcaagtctctcatatttagcaggttattgtcgtactttatatcgtgttc

SEQ ID NO: 351078 - DNA, 75 bp, Artificial Sequence
  Synthetic
atcaagtctctcatatttagcaggttattgtcgtactttatatcgtgttcattaacgatattttgcaaaatagta

SEQ ID NO: 351079 - DNA, 75 bp, Artificial Sequence
  Synthetic
atgattctatcttccttcgatagatattcttcagagattattgtcttatattctttcttgttatccgatataaat

SEQ ID NO: 351080 - DNA, 75 bp, Artificial Sequence
  Synthetic
agccgataactttatagattatataaaggtacaaacaggatatcgtcaaacttacggtgtacgattgcatatcta

SEQ ID NO: 351081 - DNA, 75 bp, Artificial Sequence
  Synthetic
ttaataagactttgaacattattaatacccgtttgtttaaatttttctacagatattttagttttggtagattct

SEQ ID NO: 351082 - DNA, 75 bp, Artificial Sequence
  Synthetic
tacccgtttgtttaaatttttctacagatattttagttttggtagattctattgtgtctgttaatagacacccaa

SEQ ID NO: 351083 - DNA, 75 bp, Artificial Sequence
  Synthetic
tgataggattgtgtgcgtgtgtggtagatgtttggagaaaggagaaactgttttctagatggaaatattgtttac

SEQ ID NO: 351084 - DNA, 75 bp, Artificial Sequence
  Synthetic
catcgacattcgacgttaattgtctataaattagagtataaattttagaaataacattagcaaattgttgtgcgt

SEQ ID NO: 351085 - DNA, 75 bp, Artificial Sequence
  Synthetic
tgatgtcgttattctgaaacagtatgattttaggtagcattttcttaacaaagagaacgtatttattgttactca

SEQ ID NO: 351086 - DNA, 75 bp, Artificial Sequence
  Synthetic
gttgaacagatgatatatccagattactaacgcatctgattccatataccaaactttcagaagaaatggtgtaca

SEQ ID NO: 351087 - DNA, 75 bp, Artificial Sequence
  Synthetic
attgtttgtattcattcaatgtctccttttcagaaattagtttagagtcaaatactgcaataattttcaaaagat

SEQ ID NO: 351088 - DNA, 75 bp, Artificial Sequence
  Synthetic
agttttcatcagataagattttatttagtgtagatatgataaaactattgttttgttggagaacttgatacgccg

SEQ ID NO: 351089 - DNA, 75 bp, Artificial Sequence
  Synthetic
agttgctgatgatgaatacatttattgcataggcgatcaggattcatcgttgatatcctagtattgatagatgga

SEQ ID NO: 351090 - DNA, 75 bp, Artificial Sequence
  Synthetic
cattctctgtagtcgacgctctcaaatgggaaacaatctccattatttttttggaatcggatactatatcttcgg

SEQ ID NO: 351091 - DNA, 75 bp, Artificial Sequence
  Synthetic
tatcttgacgcagtctagtatacatagagttaagagaaattagagtttgtacattaagcaacatgtctttaaatg

SEQ ID NO: 351092 - DNA, 75 bp, Artificial Sequence
  Synthetic
tggctacaaacttttccttttccgcatcatctagtttattatataccgattttacaacggcgccagatttaagaa

SEQ ID NO: 351093 - DNA, 75 bp, Artificial Sequence
  Synthetic
accagaatgaaaaactctgataactacaatatttcatcatagttacgattttatcatcttctatagttggtgtga

SEQ ID NO: 351094 - DNA, 75 bp, Artificial Sequence
  Synthetic
taacacatacctttttctccaagactggaaccaacgtcataaaaatgtttaaatcaaaatccatatcaacatctg

SEQ ID NO: 351095 - DNA, 75 bp, Artificial Sequence
  Synthetic
tatcatctatatcatctatatcatctacgatattattacacataaacatcggcaacatactattgtacattatct

SEQ ID NO: 351096 - DNA, 75 bp, Artificial Sequence
  Synthetic
atgcgctaagaccagtctcgcgttcaagattatctttactaatggtgacgaactcatcgtatagaactctaagtt

SEQ ID NO: 351097 - DNA, 75 bp, Artificial Sequence
  Synthetic
tgtccattatttatttacagatttagttgtttaatttatttgtactcttccaaagttgggatagtatttttctaa

SEQ ID NO: 351098 - DNA, 75 bp, Artificial Sequence
  Synthetic
cgttggtattatattattaggatctacgttcatatgtatcataatattaatcatccacgttttgataaatctatc

SEQ ID NO: 351099 - DNA, 75 bp, Artificial Sequence
  Synthetic
tttagcttctgaaataacgtatttaaacaaaggagaaaaatatttagctacggcatcagacgtaataacattttt

SEQ ID NO: 351100 - DNA, 75 bp, Artificial Sequence
  Synthetic
tttttgtaaaaataaatcactttttatactaatatgacacgattgtcaatacttttgttactaatatcattagta

SEQ ID NO: 351101 - DNA, 75 bp, Artificial Sequence
  Synthetic
tgtaaatgtaacgtatttagacgagagatcttcgttaaaaagttttccatctatgtagaatccatcggttgttaa

SEQ ID NO: 351102 - DNA, 75 bp, Artificial Sequence
  Synthetic
caccattcccgcgtcagattgaataggagtttgaatagtttgttttggaaatagatccttcaataacttatagtt

SEQ ID NO: 351103 - DNA, 75 bp, Artificial Sequence
  Synthetic
gggtgggaaaaaatcgattttatcactagactctttcttttttactatcattacctcatgaactatttcttgaat

SEQ ID NO: 351104 - DNA, 75 bp, Artificial Sequence
  Synthetic
gagtatatgtattttctttcctatatcggacgcgttcattggaaaatataccatgtcgttaactataagaatatt

SEQ ID NO: 351105 - DNA, 75 bp, Artificial Sequence
  Synthetic
tcccaaactgcattcatgttacactatataacaattacactacatttttatcataacactactttggttagattt

SEQ ID NO: 351106 - DNA, 75 bp, Artificial Sequence
  Synthetic
tttatcctcgtttacaaactgaataatattagacgtagttcgtaaacgaactatatcattaccagtacaacatct

SEQ ID NO: 351107 - DNA, 75 bp, Artificial Sequence
  Synthetic
aactatatgatatccactagtttcctttagccgtttattatcttgttccatattagcagtcattccatcatttaa

SEQ ID NO: 351108 - DNA, 75 bp, Artificial Sequence
  Synthetic
gaaggcgtcaaagataatagggagaaatgacattttggattctgttactactttaccaaaattaaggatatacgg

SEQ ID NO: 351109 - DNA, 75 bp, Artificial Sequence
  Synthetic
acttattatctttttctcaacgtcgatttgatgaacacacgatgaaaatgtgcttctatgagattgatcatgtag

SEQ ID NO: 351110 - DNA, 75 bp, Artificial Sequence
  Synthetic
ttttaagatctacccacggatacgaaataaacatgtctattgttaatcatgccgccaataatgtatagacaatta

SEQ ID NO: 351111 - DNA, 75 bp, Artificial Sequence
  Synthetic
aaaacaacaagggatacaatatttccgcatatcatgaaatatattaagaaatcccaccttattatatttccccaa

SEQ ID NO: 351112 - DNA, 75 bp, Artificial Sequence
  Synthetic
aggatccatgcacgtaaacattatatcgttatcattaataaagacttctttctcatcggatctgtaaaagttgtt

SEQ ID NO: 351113 - DNA, 75 bp, Artificial Sequence
  Synthetic
actgatttttttcattccaggatctagataattaataatgacgggttttctatttttattctttgtattttggca

SEQ ID NO: 351114 - DNA, 75 bp, Artificial Sequence
  Synthetic
tatcctagaccagtaaacagtttccactttggtaaaatcagcagacttttgaacgctattaaacatggcattaat

SEQ ID NO: 351115 - DNA, 75 bp, Artificial Sequence
  Synthetic
ggcaataactaaaaatgtaaaatatttttctatgttaggaatatggtttttcactttaatagatatatggttttt

SEQ ID NO: 351116 - DNA, 75 bp, Artificial Sequence
  Synthetic
ggccaaaatgatagatatttttttatccgaggatagtaaaatattattagtcgccgtctctataaaaatgaagct

SEQ ID NO: 351117 - DNA, 75 bp, Artificial Sequence
  Synthetic
agtctcgatatccaattttattctagaattgataggagtcgccaaatgtaccttatacgttatatctcccttgat

SEQ ID NO: 351118 - DNA, 75 bp, Artificial Sequence
  Synthetic
gcgttccatttgtgtatctatatctgacacaagatcggtaaatagttttacgttattaatcatcacggtatcacc

SEQ ID NO: 351119 - DNA, 75 bp, Artificial Sequence
  Synthetic
gtcgctagataatgctaatgttccatccaagtcccaaatggagagatttaactgttcatcgtttagaataaaatg

SEQ ID NO: 351120 - DNA, 75 bp, Artificial Sequence
  Synthetic
attaccggtcatattaataaagtgttcatcgtatctagataacaacgacttataattaatgtccaagtcttgaac

SEQ ID NO: 351121 - DNA, 75 bp, Artificial Sequence
  Synthetic
tcgctgaatgatcttttttaacccagttagttttagattggtacgaaatatattgttaaactttgattctacagt

SEQ ID NO: 351122 - DNA, 75 bp, Artificial Sequence
  Synthetic
aatgtccaaatctagttgtggaaatacgtccatcagcattgtttcaaacttgataatattattatccacatcttc

SEQ ID NO: 351123 - DNA, 75 bp, Artificial Sequence
  Synthetic
acgtccatcagcattgtttcaaacttgataatattattatccacatcttcatatgatccaaattctggaatagat

SEQ ID NO: 351124 - DNA, 75 bp, Artificial Sequence
  Synthetic
gtatcacacgctctggctacccagataaccaaaaagtcgcacgctccaggatatacattgtataaaaagctatcg

SEQ ID NO: 351125 - DNA, 75 bp, Artificial Sequence
  Synthetic
atataatacttgactgacttaaaactcgataattaataatataattcgtttttatatgtgactattttaacgtct

SEQ ID NO: 351126 - DNA, 75 bp, Artificial Sequence
  Synthetic
tttttaagtagtgtttttttttgcgtatatacgaagggattgaaaatagtattatcgacgtaactatattccaaa

SEQ ID NO: 351127 - DNA, 75 bp, Artificial Sequence
  Synthetic
ttattcttatgcgaatagataataatatcgtccttaatatctaacaaatttcctaaatatccctttaattgagtc

SEQ ID NO: 351128 - DNA, 75 bp, Artificial Sequence
  Synthetic
tacattatgaactttcaaggacttgtcttaactgacaattgcaaaaatcaatgggtcgttggaccattaatagga

SEQ ID NO: 351129 - DNA, 75 bp, Artificial Sequence
  Synthetic
attcgaagcgtcaatagaatatgtctcttaactatttccggctgttgtatatttaaatgacttcgtaagaaataa

SEQ ID NO: 351130 - DNA, 75 bp, Artificial Sequence
  Synthetic
tatatgggcgacttttcatctatgtaatcatatggagtgagatatagggctcgttctacctcctgccctttaccc

SEQ ID NO: 351131 - DNA, 75 bp, Artificial Sequence
  Synthetic
acctgtaataccaattgtggactcactatatatcgcatatttatatcgtggggtaaagtgaaaatctactaccga

SEQ ID NO: 351132 - DNA, 75 bp, Artificial Sequence
  Synthetic
tgatgtaagtcttacaatgtttgaaccagtaccagatcttaatttggaggcctccgtagaactaggggaggtaaa

SEQ ID NO: 351133 - DNA, 75 bp, Artificial Sequence
  Synthetic
tatagatcaaacaacacctatgataaaggagaatatcggttttatatcccgcagtagacgtctattcgcccatag

SEQ ID NO: 351134 - DNA, 75 bp, Artificial Sequence
  Synthetic
atctaaggatgatgagagaaaactagcactacgattctttttacaaagactttattttttagatcatagagagat

SEQ ID NO: 351135 - DNA, 75 bp, Artificial Sequence
  Synthetic
tcattatttgttcagatgcgttgacgctgtaaaagacgtcactattaccaaaaaaaataacattattgtggcgcc

SEQ ID NO: 351136 - DNA, 75 bp, Artificial Sequence
  Synthetic
ttatatagcacttttaactattgcatcaaaaggatgcaaacttacagaaacaatgattgaagcattctttccaga

SEQ ID NO: 351137 - DNA, 75 bp, Artificial Sequence
  Synthetic
actatataatgaacatagtaagaaattcaaattcaactctcaagtatccatcatccaagaaaaacttggatatca

SEQ ID NO: 351138 - DNA, 75 bp, Artificial Sequence
  Synthetic
gtctggaaactatcacgtttatgattttgaaccgtattactctacagtagctttggctattcgagatgaacattc

SEQ ID NO: 351139 - DNA, 75 bp, Artificial Sequence
  Synthetic
atctggcatttttaatatccgtcaagagagttatctggtaagttcattatctgaaataacatatagattttatct

SEQ ID NO: 351140 - DNA, 75 bp, Artificial Sequence
  Synthetic
aattaatctaaaatctgatcttgttcaatggagtgctagtacgggcgctgtaattaatcaaatggtaaatactgt

SEQ ID NO: 351141 - DNA, 75 bp, Artificial Sequence
  Synthetic
attgattacagtgtatgaaaagttacaactggtcatagaaaatgattcacaatttatatgttcattggctgtgga

SEQ ID NO: 351142 - DNA, 75 bp, Artificial Sequence
  Synthetic
atcagaacttccaataaaattacttaaagatagaaatgaattatttacaaaattcatcaacgagttaaaaaagac

SEQ ID NO: 351143 - DNA, 75 bp, Artificial Sequence
  Synthetic
cagttcattcaagataagcaaacgtgataaggatacgttactaaaatattttacttaggagttagaatttataga

SEQ ID NO: 351144 - DNA, 75 bp, Artificial Sequence
  Synthetic
gataaggatacgttactaaaatattttacttaggagttagaatttatagacgactcatttagtttattactatta

SEQ ID NO: 351145 - DNA, 75 bp, Artificial Sequence
  Synthetic
ctagcattattggtattcttcttgtcatcttgttcagaaatatataacaatgctatacctaatactaaatacatt

SEQ ID NO: 351146 - DNA, 75 bp, Artificial Sequence
  Synthetic
atcatgcttgcaatggctctaacaacgacgaaccaaaatgaatttggtcgtagcttttgttcacaaaaatacata

SEQ ID NO: 351147 - DNA, 75 bp, Artificial Sequence
  Synthetic
tagcttttgttcacaaaaatacataaagaaatgtctacataaatctatggcgccattggctacttgaaatagcgc

SEQ ID NO: 351148 - DNA, 75 bp, Artificial Sequence
  Synthetic
cagtcctcctacagattttaatatagctgtataacatgacatttattcatcatcaaaagagacagagtcaccatc

SEQ ID NO: 351149 - DNA, 75 bp, Artificial Sequence
  Synthetic
tgtcatatttagattttttttcatgtgttcaaagtatcctctactcatttcattataatagtttatcatacttag

SEQ ID NO: 351150 - DNA, 75 bp, Artificial Sequence
  Synthetic
aattttaggacggatcaatgagtaagacttgactaaatcgtcagtagtaatttgcgcatcgtctattctacatcc

SEQ ID NO: 351151 - DNA, 75 bp, Artificial Sequence
  Synthetic
gcttcgtcgaataatgtatagcattgctttgagattctccatagctatcaagtctttatacaatgacatggaaat

SEQ ID NO: 351152 - DNA, 75 bp, Artificial Sequence
  Synthetic
atctgtgaacactttatacttctccaacatcgatgccttaacatcatcacctactttagcattgaaaatacgttc

SEQ ID NO: 351153 - DNA, 75 bp, Artificial Sequence
  Synthetic
tattgtgtagatggatgtagcaagatttttaaacaacaatgccatcttacatgatgattgccttaagtctccaat

SEQ ID NO: 351154 - DNA, 75 bp, Artificial Sequence
  Synthetic
cttttgtttagaatgattagctacagagtccaacgcttggctgactagcatattattatctttagaaattgtatt

SEQ ID NO: 351155 - DNA, 75 bp, Artificial Sequence
  Synthetic
cttcaatgaggcgtttatcatatctgtaatttcgttagtcatattacagtctgactgggttgtaatgttatccaa

SEQ ID NO: 351156 - DNA, 75 bp, Artificial Sequence
  Synthetic
tttgcagaagagttcttcaatagatcagaacttcaggcgggtgaatcagtcaaattcggtaattccgttaatatt

SEQ ID NO: 351157 - DNA, 75 bp, Artificial Sequence
  Synthetic
catatcacctatggatacggtacacgtaccagcatttgtaataatcctatctaagatgttgtatggcattgcgca

SEQ ID NO: 351158 - DNA, 75 bp, Artificial Sequence
  Synthetic
gaaaatatcttctcctgtaatatctccactctcgataaatctacttagattattcttaaatgccttattctctgg

SEQ ID NO: 351159 - DNA, 75 bp, Artificial Sequence
  Synthetic
agaaaagatatcagtgtccatcatttcattaatagtatacgcagaaaagataccacgagtatcaattctatccaa

SEQ ID NO: 351160 - DNA, 75 bp, Artificial Sequence
  Synthetic
tcattggattggataataatacacacaaagtaattggattcatggcgggacacgactgcattaaactgatagaga

SEQ ID NO: 351161 - DNA, 75 bp, Artificial Sequence
  Synthetic
gatacttattggttccgagtcacaaataatggtttcctctccttcaggagatcctgcatagaaatatctaggaca

SEQ ID NO: 351162 - DNA, 75 bp, Artificial Sequence
  Synthetic
atagtttctatactgtctgtaactctgataatctctaaagtcactaactgataccatgaaattgagaagatcaaa

SEQ ID NO: 351163 - DNA, 75 bp, Artificial Sequence
  Synthetic
cgctgaagtaatcaatttttctgcctcgtttttactacaactagttttcatcaatgtagtgacgatgtattgttt

SEQ ID NO: 351164 - DNA, 75 bp, Artificial Sequence
  Synthetic
agttactcttggtctaatactgatgatagagatattattacttcccataatggatcttctagtagtcaccttaaa

SEQ ID NO: 351165 - DNA, 75 bp, Artificial Sequence
  Synthetic
gcccattgatgcgaatagcagatagataaagtcttggtatgactcctttctaatatagtacggactacctttgtc

SEQ ID NO: 351166 - DNA, 75 bp, Artificial Sequence
  Synthetic
acccaactttatacccacataagccataacaacctctttaatagccgtttcatgaggtttatcagccatgagcct

SEQ ID NO: 351167 - DNA, 75 bp, Artificial Sequence
  Synthetic
aagtagttggaagaatctcatgaatcccgtctcagaaagtcctatatgcatgatagaagatttatctttcttggg

SEQ ID NO: 351168 - DNA, 75 bp, Artificial Sequence
  Synthetic
tactctgggtaacaaacatactctaataggtgttttctctgcggagataatatcagaaaggatagagcaataagt

SEQ ID NO: 351169 - DNA, 75 bp, Artificial Sequence
  Synthetic
agtattattgtgattataaagaccgaatacataacaggtagaatttataaacatcatgtcctgaaggtttttaga

SEQ ID NO: 351170 - DNA, 75 bp, Artificial Sequence
  Synthetic
acgtattaaatattaataagaacgggtcatttatacacaatctcgggttatcatccattaatataaaagaatatg

SEQ ID NO: 351171 - DNA, 75 bp, Artificial Sequence
  Synthetic
cttgtattcctcgtaatccataccgtcccaaaacatggatttggtaactttgatagccgtagatctttgttcctt

SEQ ID NO: 351172 - DNA, 75 bp, Artificial Sequence
  Synthetic
cgccaacaggttaaagaaattaataaagaatttgttgtttctatttatgtccacaaattgcatatttggaagtcc

SEQ ID NO: 351173 - DNA, 75 bp, Artificial Sequence
  Synthetic
aagaatttgttgtttctatttatgtccacaaattgcatatttggaagtcccaccgttacgttcactgcagcattt

SEQ ID NO: 351174 - DNA, 75 bp, Artificial Sequence
  Synthetic
tgaggatctcgagtatgaagtacaatgttattgtttactggtatatctggaaagaattctaccagtctaggaata

SEQ ID NO: 351175 - DNA, 75 bp, Artificial Sequence
  Synthetic
agagattgatatcgcatagaaatacaaaagttaataatctcatcatcgaagattactcggttaccattgtaataa

SEQ ID NO: 351176 - DNA, 75 bp, Artificial Sequence
  Synthetic
attggtactctatcataatcgtcgacaaagtactgttcatacatgatgagatgtttatatgttggcatagtagtg

SEQ ID NO: 351177 - DNA, 75 bp, Artificial Sequence
  Synthetic
ttgtcaaagcggggttgatcttgtgctgttatatattgtctaacacctataagattatcaaaatcttgtctgctt

SEQ ID NO: 351178 - DNA, 75 bp, Artificial Sequence
  Synthetic
aatacaccgttaacaattttcgccttgaattcttttattggtgcattaataacatccttatagaggatgttaaac

SEQ ID NO: 351179 - DNA, 75 bp, Artificial Sequence
  Synthetic
aaataagtattatcaaagttaagatctgggtatttcttttctgctagaacatccattgagtcggagccatctggt

SEQ ID NO: 351180 - DNA, 75 bp, Artificial Sequence
  Synthetic
ttaatataaccaccgataaatctagctctgtattctgtatccgtcaatctaatattaagaaggtgttgagtgaaa

SEQ ID NO: 351181 - DNA, 75 bp, Artificial Sequence
  Synthetic
ggtggaagatcgtaaaagctgtgagtattaatgatagggttagtttccgaactaatgttaattggggtattaata

SEQ ID NO: 351182 - DNA, 75 bp, Artificial Sequence
  Synthetic
atatcgatatttccagcgttaagtgtaacattaaacagttttaattcacgtgacgtggtatcaattaaataatta

SEQ ID NO: 351183 - DNA, 75 bp, Artificial Sequence
  Synthetic
atgcccaatttggatatagcagcctgaagctcatcttgtttagttacggatcctaatgagttattaagaaataca

SEQ ID NO: 351184 - DNA, 75 bp, Artificial Sequence
  Synthetic
tcaaacggatgaacgaaggttgttttaagttggtcacatactttgtaatctagacatagatgcggaagaacggta

SEQ ID NO: 351185 - DNA, 75 bp, Artificial Sequence
  Synthetic
gaaactatacgaaatagatattcagagtcctctaattgatcaagagtaactattgacttaataggcatcatttat

SEQ ID NO: 351186 - DNA, 75 bp, Artificial Sequence
  Synthetic
ttagtattaaatgacgaccgtaccagtgacagatatacaaaacgacttaattacagagttttcagaagataatta

SEQ ID NO: 351187 - DNA, 75 bp, Artificial Sequence
  Synthetic
tccatctaacaaaaattatgaaataactcttcgtcaaatgtctattctaactcacgttaataacgtggtagatag

SEQ ID NO: 351188 - DNA, 75 bp, Artificial Sequence
  Synthetic
agaacataatgccgccgtagtgtcatctccagaggaaatatcatcacaacttaatgaagatttatttccagacga

SEQ ID NO: 351189 - DNA, 75 bp, Artificial Sequence
  Synthetic
ttaatgaagatttatttccagacgatgattctccggccactattattgaaagagtacaacaaccgcatactacta

SEQ ID NO: 351190 - DNA, 75 bp, Artificial Sequence
  Synthetic
ttattgacgatacgccacctcctacgtttcgtagagagttattgatatcggaacaacgtcagcaacgagaaaaaa

SEQ ID NO: 351191 - DNA, 75 bp, Artificial Sequence
  Synthetic
gatttaatattacggtatcaaaaaatgccgaagcgataatggaatctagatcgatgataacttctatgccaacac

SEQ ID NO: 351192 - DNA, 75 bp, Artificial Sequence
  Synthetic
aaacaccatccttgggagtagtttatgataaagataaaagaattcagatgctagaggatgaagtggttaatctta

SEQ ID NO: 351193 - DNA, 75 bp, Artificial Sequence
  Synthetic
gaaatcaacaatctaatacaaaatcatctaataatttggataattttaccagaatactatttggtaagactccgt

SEQ ID NO: 351194 - DNA, 75 bp, Artificial Sequence
  Synthetic
ataaatcaacagaagttaataagcgtatagccatcgttaattatgcaaatttgaatgggtcccccttatcagtag

SEQ ID NO: 351195 - DNA, 75 bp, Artificial Sequence
  Synthetic
aggacttggatgtttgttcagaggatgaaatagatagaatctataaaacgattaaacaatatcacgaaagtagaa

SEQ ID NO: 351196 - DNA, 75 bp, Artificial Sequence
  Synthetic
taacaatctccacgtatggaactcatgtagcataggtaatgtaacgcgtatattttatacattttttagttatct

SEQ ID NO: 351197 - DNA, 75 bp, Artificial Sequence
  Synthetic
aacgaaaaattatcgttactaacgtgattattattgtcataaacattattgaacaggcattgctaaaacttggat

SEQ ID NO: 351198 - DNA, 75 bp, Artificial Sequence
  Synthetic
ttgacgaaatcaaaggactgagtaccgacatcacttcagaaattatcgatgtggagatcggagatgactgtgatg

SEQ ID NO: 351199 - DNA, 75 bp, Artificial Sequence
  Synthetic
gttggggatggtattatctggcggtgaaatgtccgttatataatctataaaacaatcatcgcatatagtatgcga

SEQ ID NO: 351200 - DNA, 75 bp, Artificial Sequence
  Synthetic
aacgaattaaaattatttaatttaatacattcccatatccagacaacaatcgtttggattaatctgttcctgtcg

SEQ ID NO: 351201 - DNA, 75 bp, Artificial Sequence
  Synthetic
tctcataccggacgacatattaatctttttattagtgggcatctttttagatggtttctttttcccagcattaac

SEQ ID NO: 351202 - DNA, 75 bp, Artificial Sequence
  Synthetic
tgattcgatacctagaagatcgtgattgatctctccgaccattccacgaacttctaattgaccgtctctaacggt

SEQ ID NO: 351203 - DNA, 75 bp, Artificial Sequence
  Synthetic
accataaactattttaccagcattagtaacagcttggacaatctgaccatccattgcgttgaatgatgtagttgc

SEQ ID NO: 351204 - DNA, 75 bp, Artificial Sequence
  Synthetic
tgttgttttacgtctaggagcaccagaagtatttttagagctcttggatgttgatgtagaagaagacgaggattt

SEQ ID NO: 351205 - DNA, 75 bp, Artificial Sequence
  Synthetic
tgatttacatgtgatacattttgaactctttgattttgtgtcacatgcgccggcagtcacatctgtttgagaatt

SEQ ID NO: 351206 - DNA, 75 bp, Artificial Sequence
  Synthetic
aagattattgttgcctcctttgacggctgcatctccaccgatctgtgctagtagatttttaagctgtggtgtaat

SEQ ID NO: 351207 - DNA, 75 bp, Artificial Sequence
  Synthetic
cttattaactgtttcgatataatcatcgtaactgcttctaacggctaaattttttttatccgccatttagaagct

SEQ ID NO: 351208 - DNA, 75 bp, Artificial Sequence
  Synthetic
aaaaatatttttatttatacagaagatttaactagattatacaatgaactaatatgatccttttccagattattt

SEQ ID NO: 351209 - DNA, 75 bp, Artificial Sequence
  Synthetic
acaaacctggtatttcttgtttctggaggaggcaagtttacattcggacttggattttgtgagttcttgatctta

SEQ ID NO: 351210 - DNA, 75 bp, Artificial Sequence
  Synthetic
ttatacatcgcgtataggatggcgacggtaactgctacacaaataccaatcaaaagaagaataccaatcatttat

SEQ ID NO: 351211 - DNA, 75 bp, Artificial Sequence
  Synthetic
tgataataacttcactattgatcaagtatacaatatatcatcttttcactaaataagtagtaataatgattcaac

SEQ ID NO: 351212 - DNA, 75 bp, Artificial Sequence
  Synthetic
aacttagtttacggaaatatcgctatgattggtatgaatgactccactaactctgtggggtgcgcagtgctttcc

SEQ ID NO: 351213 - DNA, 75 bp, Artificial Sequence
  Synthetic
atctagagataatttatctcgtgataatataataatagagtgcggttttacctattttatcatctatataataat

SEQ ID NO: 351214 - DNA, 75 bp, Artificial Sequence
  Synthetic
ccacatagaataaattagcattccgactgtgataataataccaagtataaacgacataatactcaatactttcca

SEQ ID NO: 351215 - DNA, 75 bp, Artificial Sequence
  Synthetic
tgtacgagtgggactggtagacttactaaagtcaataaaggcaaagatacacgaaagaatcaaaagaatgattcc

SEQ ID NO: 351216 - DNA, 75 bp, Artificial Sequence
  Synthetic
actttctctaaataggactattgttacaaaagttaataacaattataacaattataacaattataacaattataa

SEQ ID NO: 351217 - DNA, 75 bp, Artificial Sequence
  Synthetic
agcaattaacactccggaaaaataatttccaatcataagcatcatgtccatttaactaataaaaattttaaatcg

SEQ ID NO: 351218 - DNA, 75 bp, Artificial Sequence
  Synthetic
ccgaatgaacaaagtggaatataaaccatataaaaacaatagtttgtactgcaaaaataatatctatttttgttt

SEQ ID NO: 351219 - DNA, 75 bp, Artificial Sequence
  Synthetic
tcgaagatatggtaaaattaaatagtagtacacaacatgttataactaacagcagcaacggttcgtaattactta

SEQ ID NO: 351220 - DNA, 75 bp, Artificial Sequence
  Synthetic
tcatttactagacgaaaaggtggcgggatattttcttgctcaaataatacgaatatattacccatccattttatg

SEQ ID NO: 351221 - DNA, 75 bp, Artificial Sequence
  Synthetic
cgatgtttatatactctaatctttaatagatctatagacgacgggtttaccaacaatatagattttatcgattca

SEQ ID NO: 351222 - DNA, 75 bp, Artificial Sequence
  Synthetic
acagaaacttagattaaatgctgaagagggagccgataactttatagattatataaaggtacaaacaggatatcg

SEQ ID NO: 351223 - DNA, 75 bp, Artificial Sequence
  Synthetic
tctaatttaaacccttccttaaacgtgaatgatctattatctggcataacgatgaccctacctgatgaatcagac

SEQ ID NO: 351224 - DNA, 75 bp, Artificial Sequence
  Synthetic
atgacaatataacattcattagtaatatcacatcaagtacaaaatatatcaactcatgtgtaaattcgtcactga

SEQ ID NO: 351225 - DNA, 75 bp, Artificial Sequence
  Synthetic
aatgtactgggccatgtagaataaattatcaacgaatcatcgtctacgaacatttatatcatttgttttaatttt

SEQ ID NO: 351226 - DNA, 75 bp, Artificial Sequence
  Synthetic
aggacgcgaataaatagatataaaatagaaaataacagatattacaaccagtgttatggccgcacccaaccaggt

SEQ ID NO: 351227 - DNA, 75 bp, Artificial Sequence
  Synthetic
atggaagccatcaaaaccatattgataaacgtatgctaaaatgcgagagccaaaatgtgatattggtgtagcgat

SEQ ID NO: 351228 - DNA, 75 bp, Artificial Sequence
  Synthetic
aggcagttttattttatcttttactacaggttctcctggatgtatgtcaccaactgtagacgtagttctagtaca

SEQ ID NO: 351229 - DNA, 75 bp, Artificial Sequence
  Synthetic
aatttacggtgactactaggagggaaaatgaagaaagaaaaatttactactgatgttatcaaacctaattatctt

SEQ ID NO: 351230 - DNA, 75 bp, Artificial Sequence
  Synthetic
attagacgtaagttccgcttgggaattttttaacgctaaagagttaacgttaatcgtacacccaacgtatttaca

SEQ ID NO: 351231 - DNA, 75 bp, Artificial Sequence
  Synthetic
tctagttctttgaacatcttgattataatataaccattttctatctctagattcgtcagtgcactcatgtaacca

SEQ ID NO: 351232 - DNA, 75 bp, Artificial Sequence
  Synthetic
acataccctaggtcctaaatatttatctccggaattagattttggataattcgcacaccaacaatttctatttcc

SEQ ID NO: 351233 - DNA, 75 bp, Artificial Sequence
  Synthetic
tttatgatcgttacaaaagacgtataatgccgtatccccaaaagtaaaataatcaggacgaataattctaataaa

SEQ ID NO: 351234 - DNA, 75 bp, Artificial Sequence
  Synthetic
ctcagaacaatatctcgcatccatatgtttggagcaaatatcggaataagtagacatagccggtttccgttttgc

SEQ ID NO: 351235 - DNA, 75 bp, Artificial Sequence
  Synthetic
acgtaaccattctaaacaattggggtttccaggatcgtttctacaaaatccagtcataaaatcgtcacaatgttc

SEQ ID NO: 351236 - DNA, 75 bp, Artificial Sequence
  Synthetic
tgtcttgtaattattattaaatatttttggacagtgtttggtatttgtctttgaacaacattttgctacgctatc

SEQ ID NO: 351237 - DNA, 75 bp, Artificial Sequence
  Synthetic
actatctcccaggagataatccttttttataaaatgacatcgttgcccggatgctatataatcagtagcgtgttt

SEQ ID NO: 351238 - DNA, 75 bp, Artificial Sequence
  Synthetic
taaatccttaatatattcaggagttacctcgttctgataatagattaatgttccaggacgaaatttgaaagaact

SEQ ID NO: 351239 - DNA, 75 bp, Artificial Sequence
  Synthetic
acatggttctccatgaattaatacatattgtttagcaaactcaggaactataaaactactacaatgatctatcga

SEQ ID NO: 351240 - DNA, 75 bp, Artificial Sequence
  Synthetic
gatatctcaataatggactttataggaccatacattataggtaacataaaaactgtccaaatagatgtacgggat

SEQ ID NO: 351241 - DNA, 75 bp, Artificial Sequence
  Synthetic
cataccatctatcaaacaaaatttgggtttaatttctcctggagacgtttcataataatacatataactttcttc

SEQ ID NO: 351242 - DNA, 75 bp, Artificial Sequence
  Synthetic
ggcaaacttaacagttctattatatttaggataattaaaacctaattccatatatttgtctcgtatatctgctat

SEQ ID NO: 351243 - DNA, 75 bp, Artificial Sequence
  Synthetic
tcctgatgctatgttgattctattaagagtaacggctgcccccattcttaataatcgtcagtatttaaactgtta

SEQ ID NO: 351244 - DNA, 75 bp, Artificial Sequence
  Synthetic
aatgttggtatatcaacatctaccttatttcccgcagtataaggtttgttgcaggtatactgttcaggaatggtt

SEQ ID NO: 351245 - DNA, 75 bp, Artificial Sequence
  Synthetic
acatttatactttttctatagtcctgtctttcgatgttcatcacatatgcaaagaacaaaataaacaaaataatg

SEQ ID NO: 351246 - DNA, 75 bp, Artificial Sequence
  Synthetic
taagaaataatattaaatatctgtgaattcgtaaatacattaattgccataataattacagcagctacaatacac

SEQ ID NO: 351247 - DNA, 75 bp, Artificial Sequence
  Synthetic
ttgtacaactgttcgttctccaaaccaatcaattatgtaaatatctttaatacagagtttaatactaatactaat

SEQ ID NO: 351248 - DNA, 75 bp, Artificial Sequence
  Synthetic
acaatagacattcccacagtgttgccattacctccacgatacatttgagttactaagcaataggtaataactaag

SEQ ID NO: 351249 - DNA, 75 bp, Artificial Sequence
  Synthetic
ctagtaagaggcaatagaaaagatgagataaatatcatcaatatagagattagaggagggctatatagagccaag

SEQ ID NO: 351250 - DNA, 75 bp, Artificial Sequence
  Synthetic
acgaacaaaatcaaaccgagtaacgttctaacatcattatttttgaagattcccaaataatcattcattcctcca

SEQ ID NO: 351251 - DNA, 75 bp, Artificial Sequence
  Synthetic
gagactatagatctttcattataaaaagtgatcacgggtttgtaaagatcatgcagagaaaagttctccaaaaac

SEQ ID NO: 351252 - DNA, 75 bp, Artificial Sequence
  Synthetic
taatcgttttgcatcatacctccatctttaggcataaacgattgctgctgttcctctgtaaataaatctttatca

SEQ ID NO: 351253 - DNA, 75 bp, Artificial Sequence
  Synthetic
agcactccagcacccgcagagaagtcgtcaagcatattgtaatatcttaaataactcatttatatattaaaaaat

SEQ ID NO: 351254 - DNA, 75 bp, Artificial Sequence
  Synthetic
gtcactattaaagatggagtataatctttatgccgaactaaaaaaaataacttgtggtcaatccctaagtctttt

SEQ ID NO: 351255 - DNA, 75 bp, Artificial Sequence
  Synthetic
taacgaagacggggatttcgtagaagttgaaccgggatcattatttaagtttttgatacctaagggattttactc

SEQ ID NO: 351256 - DNA, 75 bp, Artificial Sequence
  Synthetic
gtattcgagacattaacaacgaccgataataaaattactagtatcaatccaacaaatgcaccaaagttatatcct

SEQ ID NO: 351257 - DNA, 75 bp, Artificial Sequence
  Synthetic
cttcaacacaaagtcgtatctgaagtagtttctaatatgaggaaaatgattaaattaaaacgtcctctatacatc

SEQ ID NO: 351258 - DNA, 75 bp, Artificial Sequence
  Synthetic
ttgagcacgataacttattagatagagatgagatgtctactattctagaggaatattttatgtacagaggtctat

SEQ ID NO: 351259 - DNA, 75 bp, Artificial Sequence
  Synthetic
actcttcacttggcgtgtggatttggtaagactattaccacgtgttatcttatggctacacacggaagaaaaacc

SEQ ID NO: 351260 - DNA, 75 bp, Artificial Sequence
  Synthetic
gtcatttgtgtacccaataaaatgttaatacatcaatggaagacacaggtagaggcagtcggattggaacataag

SEQ ID NO: 351261 - DNA, 75 bp, Artificial Sequence
  Synthetic
atatctatagatggagtaagtagtttattaaaggaactaaagactcaaagtccggatgtattaatagtagttagt

SEQ ID NO: 351262 - DNA, 75 bp, Artificial Sequence
  Synthetic
gatcaatagacagatggatgaaatggtacttcttaccaacatcttaagcgtagaagttgtaaataacaatgagat

SEQ ID NO: 351263 - DNA, 75 bp, Artificial Sequence
  Synthetic
agacatctgacaaacgatgccttttgtaaatatatcaataagcattatgatttgttcatcttggatgaatcacat

SEQ ID NO: 351264 - DNA, 75 bp, Artificial Sequence
  Synthetic
acgtataatctgatgaacaatacagcagttacaagatttttagcgtattatcctccgatgatgtgttatttttta

SEQ ID NO: 351265 - DNA, 75 bp, Artificial Sequence
  Synthetic
actgctacacctagaccatctaacagaatttattgtaacagtattattaatattgccaagttatccgatctaaaa

SEQ ID NO: 351266 - DNA, 75 bp, Artificial Sequence
  Synthetic
aaaactatctatgctgtagatagtttttttgagccatattccacagataatattagacatatgataaaacgacta

SEQ ID NO: 351267 - DNA, 75 bp, Artificial Sequence
  Synthetic
ttagacgagttacaaactatttggatagacacatatgcgatcagatatttgctaataataagtggtattccatta

SEQ ID NO: 351268 - DNA, 75 bp, Artificial Sequence
  Synthetic
gatggaccatctaataaatatcatatatatactgaaaagttattatctgtagacgagcctagaaatcaacttatt

SEQ ID NO: 351269 - DNA, 75 bp, Artificial Sequence
  Synthetic
cttaataccctggtagaagaattcaagtcaggaactattaatcgcgttttagttattactaaactacgtgaacat

SEQ ID NO: 351270 - DNA, 75 bp, Artificial Sequence
  Synthetic
atggtattattctacaaacgattattagatcttttcggaccagaggttgtatttataggagacgctcaaaataga

SEQ ID NO: 351271 - DNA, 75 bp, Artificial Sequence
  Synthetic
cgtactccagatatggttaaatcaatcaaggaactaaatagatttatattcgtatccaccttattttattccggt

SEQ ID NO: 351272 - DNA, 75 bp, Artificial Sequence
  Synthetic
actggtttagatattcctagtttggattcgttgttcatttgctcggcagtaatcaacaatatgcaaatagagcaa

SEQ ID NO: 351273 - DNA, 75 bp, Artificial Sequence
  Synthetic
ttactagggagggtatgtcgagaaacagaactattagataggacggtatatgtatttcctaacacatccgtcaaa

SEQ ID NO: 351274 - DNA, 75 bp, Artificial Sequence
  Synthetic
gaaataaagtacatgataggaaattttgtgcaacgaattattagtctgtctgtagataaactaggatttaaacaa

SEQ ID NO: 351275 - DNA, 75 bp, Artificial Sequence
  Synthetic
gaaagttatcggaaacatcaagaatccgatcccacttctgtatgtacagcatcctccagagaagaacgtgtatta

SEQ ID NO: 351276 - DNA, 75 bp, Artificial Sequence
  Synthetic
aatagaatatttaactcgcaaaatcgttaagaagtttaagcgacgatccacatgctgtacaggccagtgtattac

SEQ ID NO: 351277 - DNA, 75 bp, Artificial Sequence
  Synthetic
ccctcatagtattaatataatccaatgatacttttgtgatgtcggaaatcttaaccaatttagactgacagacag

SEQ ID NO: 351278 - DNA, 75 bp, Artificial Sequence
  Synthetic
tgatacttttgtgatgtcggaaatcttaaccaatttagactgacagacagaacacgtcatgcaatcatcctcatc

SEQ ID NO: 351279 - DNA, 75 bp, Artificial Sequence
  Synthetic
gataactgtagtcttaggcttctttttgcgactcttcattccggaacgcgcattggtgctatccatttaggtagt

SEQ ID NO: 351280 - DNA, 75 bp, Artificial Sequence
  Synthetic
aaaaaataagtcagaatatgccctatagcacgatcgtgtaaaacctggtatatcgtctctatctttatcacagta

SEQ ID NO: 351281 - DNA, 75 bp, Artificial Sequence
  Synthetic
tagtgtatcgacatctttattattattgacctcgtttatctcggaacatggaatgggaacatttttgttatcaac

SEQ ID NO: 351282 - DNA, 75 bp, Artificial Sequence
  Synthetic
ggccacctttgccttaattccagatgttgtaaaattataactaaacagtctatcatcgacacaaatgaaattttt

SEQ ID NO: 351283 - DNA, 75 bp, Artificial Sequence
  Synthetic
gacacaatcagactctggtatttatatgtgcattaccaagaacgagacctacagtgatatgatgtcgttaaattt

SEQ ID NO: 351284 - DNA, 75 bp, Artificial Sequence
  Synthetic
aacgtaaccagaattgtaaaattagaggtatgggataaaataataccttctactatgcaattaccaaaaggcctt

SEQ ID NO: 351285 - DNA, 75 bp, Artificial Sequence
  Synthetic
gtttaaacgtttgtagtttacgtatgcggctcgttctcgtctcattttttcagatattgcaggtactataatatt

SEQ ID NO: 351286 - DNA, 75 bp, Artificial Sequence
  Synthetic
aaaaataagaatgaaataacataggattaaaaataaagttatcatgacttctagcgctgatttaactaacttaaa

SEQ ID NO: 351287 - DNA, 75 bp, Artificial Sequence
  Synthetic
agaattacttagtctgtacaaaagtttgagattttcagattctgcggctatagagaagtataattctttggtaga

SEQ ID NO: 351288 - DNA, 75 bp, Artificial Sequence
  Synthetic
atggggaacatctacttactggaaaataggcgtacaaaaggtagctaatgtcgagacgtccatatctgattatta

SEQ ID NO: 351289 - DNA, 75 bp, Artificial Sequence
  Synthetic
tcttaccggtatattttggaagcgtctttatttattcgaagggtaaaaatatggtagaacttggatctggaaact

SEQ ID NO: 351290 - DNA, 75 bp, Artificial Sequence
  Synthetic
cttttcaaataccagatgatatgcgaagtgtgtgtaacaaagtattagacggcgataacggaatagactttctga

SEQ ID NO: 351291 - DNA, 75 bp, Artificial Sequence
  Synthetic
atttagcatatagtaagttaattcagatactacaggaccgtattagaatgtattttaacactaattaagatataa

SEQ ID NO: 351292 - DNA, 75 bp, Artificial Sequence
  Synthetic
gatttgttttgttaaacaatagatggataatggaagacgctatatcaaaatatcagtcaccagttaatatattta

SEQ ID NO: 351293 - DNA, 75 bp, Artificial Sequence
  Synthetic
aactagcgagtgagtacggattaaacatacccaactatttagaaattgaaatagaggaagacacattatttgacg

SEQ ID NO: 351294 - DNA, 75 bp, Artificial Sequence
  Synthetic
atatccatatcgtatattaagttgggagaacttaggcggcaagttgtagactttttcaaattctcattcatgtat

SEQ ID NO: 351295 - DNA, 75 bp, Artificial Sequence
  Synthetic
ggagtctcatctttagtaaacatatcataatattcgatattacgagttgacacattgaacaaatccaagtatttg

SEQ ID NO: 351296 - DNA, 75 bp, Artificial Sequence
  Synthetic
attgagtccatcaaggtagatcgtataggggataatatttttattcctagcgttataacaaaatcaggaaaaaag

SEQ ID NO: 351297 - DNA, 75 bp, Artificial Sequence
  Synthetic
atattagtaaaagatgtagaccatttaatacgatccaaggttagagaacatacatttgtaaaagtaaaaaagaaa

SEQ ID NO: 351298 - DNA, 75 bp, Artificial Sequence
  Synthetic
aacacattttccattttatacgactatgatgggaacggaacagaaactagaggagaagtaataaaacgaattata

SEQ ID NO: 351299 - DNA, 75 bp, Artificial Sequence
  Synthetic
gacactataggacgagactattatgttaacggaaagtatttctctaaggttggtagtgcgggcttaaagcaattg

SEQ ID NO: 351300 - DNA, 75 bp, Artificial Sequence
  Synthetic
actaataaattaaatattaatgagtgcacaactgtcgatgagttagttgatgagattaataaatccggaactgta

SEQ ID NO: 351301 - DNA, 75 bp, Artificial Sequence
  Synthetic
aaacgaaaaataaaaacccaatcagcatttgatttaagtagagaatgtttgggatatccagaagcggattttata

SEQ ID NO: 351302 - DNA, 75 bp, Artificial Sequence
  Synthetic
acgttagttaataacatgcggttcaaaatagaaaattgtaaggttgtaaattttaatattgaaaatactaattgt

SEQ ID NO: 351303 - DNA, 75 bp, Artificial Sequence
  Synthetic
ttaaataacccaagtattgaaactatatatggaaactttaaccagttcgtctcaatctttaatatcgtcaccgat

SEQ ID NO: 351304 - DNA, 75 bp, Artificial Sequence
  Synthetic
gtcaaaaaaagattattcgagtgaaataatatgtgcctttgatataggtgcaaaaaatcctgccagaactgtttt

SEQ ID NO: 351305 - DNA, 75 bp, Artificial Sequence
  Synthetic
agaagtcaaggataactccgttagggtattggatatatcaaaattagactggagttctgattgggaaaggcgcat

SEQ ID NO: 351306 - DNA, 75 bp, Artificial Sequence
  Synthetic
tatagcagatatagggatagaagtaggaatgccacgaataaaaaatacttaaaatgtaatcttaatcgagtacgc

SEQ ID NO: 351307 - DNA, 75 bp, Artificial Sequence
  Synthetic
agctaaagatttgtcacaatatgaatacactacagttcttctagaacgtcagcctagaaggtcgccatacgtcaa

SEQ ID NO: 351308 - DNA, 75 bp, Artificial Sequence
  Synthetic
atttatctattttattaaaggctttttatatcatacatcggctaccaaagttatttgtgtctcgcctgtcatgtc

SEQ ID NO: 351309 - DNA, 75 bp, Artificial Sequence
  Synthetic
tggtaattcatatagagatcgaaaaaagagatctgtcgaagcattttttgattggatggacatattcggattgcg

SEQ ID NO: 351310 - DNA, 75 bp, Artificial Sequence
  Synthetic
tgaaataagtacaatgaacgataatataatattctattgagacaacatactcttaaaattggatctactaatata

SEQ ID NO: 351311 - DNA, 75 bp, Artificial Sequence
  Synthetic
agactccgttccagatagacgcaaattagacgatgtagcggatagtttcaatttggctatgagatacgtattaga

SEQ ID NO: 351312 - DNA, 75 bp, Artificial Sequence
  Synthetic
taaatggaatactaattatacacattataataggtgtaaatctagaaattacataaaaaaaatgtaataacgtta

SEQ ID NO: 351313 - DNA, 75 bp, Artificial Sequence
  Synthetic
gtaacgccattatggataatctatttacctttctacatgaaatagaagatagatataccagaactatttttaact

SEQ ID NO: 351314 - DNA, 75 bp, Artificial Sequence
  Synthetic
ttcatctaataagttgcgatgaaataggagatatatatggtcttatgaaagaacgcatttcctcagaggatatgt

SEQ ID NO: 351315 - DNA, 75 bp, Artificial Sequence
  Synthetic
aaacgaaatatatttgtagtacaacgaatactcccaaactgcattcatgttacactatataacaattacactaca

SEQ ID NO: 351316 - DNA, 75 bp, Artificial Sequence
  Synthetic
ttgataatatagtatataataaagatatacatcctgccattaagaaactagtttattgtgacattcaacttacta

SEQ ID NO: 351317 - DNA, 75 bp, Artificial Sequence
  Synthetic
aacacattattaatcagaatacgtatccggtatttaacgattcttcacaagtgaaatgttgtcattatttcgata

SEQ ID NO: 351318 - DNA, 75 bp, Artificial Sequence
  Synthetic
taaactcagataatagcaatattagctctcgtacagtagagatatttgagagggaaaagtcatctcttgtatcat

SEQ ID NO: 351319 - DNA, 75 bp, Artificial Sequence
  Synthetic
atattaaaactaccaataagaagagaaaagtcaattatggggaaataaagaaaactgtacatggaggcactaatg

SEQ ID NO: 351320 - DNA, 75 bp, Artificial Sequence
  Synthetic
caaattacttttccggtaaaaaatctgatgagtatctgagcactacagtcaggtccaatattaatcaaccttgga

SEQ ID NO: 351321 - DNA, 75 bp, Artificial Sequence
  Synthetic
tcaaaaccatctctaagaggatgagagtcaatatcattaatcactctatagtaacgcgtggaaaaagctccatat

SEQ ID NO: 351322 - DNA, 75 bp, Artificial Sequence
  Synthetic
tacaaactatagaaattatttttactaatagaacatgtgtgaaaatattcaaggattctactatgcacattattc

SEQ ID NO: 351323 - DNA, 75 bp, Artificial Sequence
  Synthetic
gttgtacatttctgtgagaaaaagaggatatcaaatacgcatatagattcatcaaggtatataaacctggggagg

SEQ ID NO: 351324 - DNA, 75 bp, Artificial Sequence
  Synthetic
tccttagtcatcttgtctagaatggcgtatctaactgcgggtttaggctttagtttagtttctatatctatatct

SEQ ID NO: 351325 - DNA, 75 bp, Artificial Sequence
  Synthetic
tatccaaggacaaggatgaaaaggggtgtatacacatgattgacaaattattctatgtctattataatttatttc

SEQ ID NO: 351326 - DNA, 75 bp, Artificial Sequence
  Synthetic
tgacatcatgcatccaaatggatctcataactgctctagattatcttagtgaacttaaggaatcaagtggataaa

SEQ ID NO: 351327 - DNA, 75 bp, Artificial Sequence
  Synthetic
tgttgttcgaggatatcatccaaaacgagtactttaaagaagtagctaatgttgtgaaccatgtactcacggcta

SEQ ID NO: 351328 - DNA, 75 bp, Artificial Sequence
  Synthetic
taatataacttattggtcacggtttactataggtcgcgtgtattgttcaaatcagagtctgaggatattttccaa

SEQ ID NO: 351329 - DNA, 75 bp, Artificial Sequence
  Synthetic
cggcattagatgagaaattattcctaattaagaaaatggctaaacacgatgtttatggagttagcaatttcaaaa

SEQ ID NO: 351330 - DNA, 75 bp, Artificial Sequence
  Synthetic
tagggatgtttaacttgacatttattaagtcattggatcataccgttttcccctctctgttagatgaggatagta

SEQ ID NO: 351331 - DNA, 75 bp, Artificial Sequence
  Synthetic
aaataaagttttttaaggggaaaaagctcaatattgtagcattacgctctctggaggattgtataaattacgtga

SEQ ID NO: 351332 - DNA, 75 bp, Artificial Sequence
  Synthetic
ctaaatccgagaatatgatagaaatgatgaaggaaagatcgactattttaaatagcatagatatagaaacggaat

SEQ ID NO: 351333 - DNA, 75 bp, Artificial Sequence
  Synthetic
ttataggtaacataaaaactgtccaaatagatgtacgggatataaaatattccgacatgcaaaaatgctacttta

SEQ ID NO: 351334 - DNA, 75 bp, Artificial Sequence
  Synthetic
gactacctcgacatacgtgtgcgctatcaaagtggaaagatgttgctgtgctgtgtttacagattggccagaatc

SEQ ID NO: 351335 - DNA, 75 bp, Artificial Sequence
  Synthetic
cggtagatcgtctaaaagatttgcttctaaaatgaaaaaaaacactgattcagaaatggatcaacgactcgggta

SEQ ID NO: 351336 - DNA, 75 bp, Artificial Sequence
  Synthetic
taagtttttggtacctgatcctaaagccggagttttttatagaccgttacatttccaatatgtatcgtattctaa

SEQ ID NO: 351337 - DNA, 75 bp, Artificial Sequence
  Synthetic
ttttatattgcatcgattgcatgaaatcttgaccgtcaagcggccacttttatcgtttaagaataatacagaacg

SEQ ID NO: 351338 - DNA, 75 bp, Artificial Sequence
  Synthetic
aattatgatagaaattagcaatgttaaagtgactcctccagattactcacctataatcgcgagtattaaaggtaa

SEQ ID NO: 351339 - DNA, 75 bp, Artificial Sequence
  Synthetic
gagttatgacgcattagccacgttcactgtaaatatctttaaagaggtaatggccaaagagggtatatccatcac

SEQ ID NO: 351340 - DNA, 75 bp, Artificial Sequence
  Synthetic
taaaataagtagctatgagggaaaagattctcatttgataaaaattccgctactaataggatacgggaataaaaa

SEQ ID NO: 351341 - DNA, 75 bp, Artificial Sequence
  Synthetic
tccacttgatacagccaagtatcttgtccctaacgtcataggtggggtatttatcaataaacaatctgtcgaaaa

SEQ ID NO: 351342 - DNA, 75 bp, Artificial Sequence
  Synthetic
agtaggaattaatctagtagaaaagattacaacatggccaaaatttagggttgttaagccaaactcattcacgtt

SEQ ID NO: 351343 - DNA, 75 bp, Artificial Sequence
  Synthetic
ctcgttttcctccgtatcccctcctaatatattaccgacaagatatcgccattacaagatatctctggatatatc

SEQ ID NO: 351344 - DNA, 75 bp, Artificial Sequence
  Synthetic
acaattggaagcgtcgaatatatcatcgacaaagacatttataacggtcaatattgttttactgtctcaatattt

SEQ ID NO: 351345 - DNA, 75 bp, Artificial Sequence
  Synthetic
atctagagtgagtttaggattcattagacgtagtttatcatacgatatgcctccagaagttgtctatttagtaaa

SEQ ID NO: 351346 - DNA, 75 bp, Artificial Sequence
  Synthetic
cgcgataatagatagtgctaaacgacttaccgaatctattactgactttaatattgatacgtatattaatgacct

SEQ ID NO: 351347 - DNA, 75 bp, Artificial Sequence
  Synthetic
ggtggaagccgaacacgttaaacaaaaatctcagttaacgattaacgagttcaaatatgaaatgctacataactt

SEQ ID NO: 351348 - DNA, 75 bp, Artificial Sequence
  Synthetic
tttacctcatatgaactatacacccgatcaactaaagggattttatatgatatctttactaagaaagtttcttta

SEQ ID NO: 351349 - DNA, 75 bp, Artificial Sequence
  Synthetic
ctgtatctactacacttctagatatccagatagagattcaatggtttgtcatcgcatcctaacatacggcaaata

SEQ ID NO: 351350 - DNA, 75 bp, Artificial Sequence
  Synthetic
aaaaataactattaacgacacaccaaaaaagaaaaggatgtattattagcgcaatcagttgctgttgaagaggca

SEQ ID NO: 351351 - DNA, 75 bp, Artificial Sequence
  Synthetic
ttttgagacgttggcacatgatgaattagagaattacataggcaacatcagaaacgacatcatgaacaatcacaa

SEQ ID NO: 351352 - DNA, 75 bp, Artificial Sequence
  Synthetic
acaattattgacgggtttatttatgaccggcaaccatgaatttacagagattatctctggctatatatcttactg

SEQ ID NO: 351353 - DNA, 75 bp, Artificial Sequence
  Synthetic
gaatagaggcacttacgcggtaaacattcatgtactaacaactcccggacttaatcacgcgttttctagcttatt

SEQ ID NO: 351354 - DNA, 75 bp, Artificial Sequence
  Synthetic
gagtggaaagttcaaaaagtcagacggtagttatcgaacacatcctcactattcatggatgcagaatatttctat

SEQ ID NO: 351355 - DNA, 75 bp, Artificial Sequence
  Synthetic
tcctagaagtgttggattttatccggatcaagtaaagatttcaaagatgttttctgtcagaaaataccatccaag

SEQ ID NO: 351356 - DNA, 75 bp, Artificial Sequence
  Synthetic
tcaatatctttacttttgttcatcagatgttccggaaagaggtcctcaggtaggtttagtatctcaattgtctgt

SEQ ID NO: 351357 - DNA, 75 bp, Artificial Sequence
  Synthetic
cttaagttccattacaaatatactaacgtctgagtatttggatttggaaaagaaaatttgtgagtatatcagatc

SEQ ID NO: 351358 - DNA, 75 bp, Artificial Sequence
  Synthetic
atattatgaagatgatataagttactttgaaacaggatttccaatcactatagaaaatgctctagtcgcatctct

SEQ ID NO: 351359 - DNA, 75 bp, Artificial Sequence
  Synthetic
taatccaaatatgatatgtgattttgtaactgactttagacgtagaaaacggatgggattcttcggtaacttgga

SEQ ID NO: 351360 - DNA, 75 bp, Artificial Sequence
  Synthetic
ggtaggtattactttagttagggatcacatgaatgaaattcgtattaatattggagcaggaagattagtcagacc

SEQ ID NO: 351361 - DNA, 75 bp, Artificial Sequence
  Synthetic
cataatcaaggatacggaagtcacgctttcaatatattacggtatttactagataggttcaacattcagaaagac

SEQ ID NO: 351362 - DNA, 75 bp, Artificial Sequence
  Synthetic
attcttggtggtggataacggagagctcatgatggatgtgtgtccggagttagaaagcagattagatgacatgac

SEQ ID NO: 351363 - DNA, 75 bp, Artificial Sequence
  Synthetic
attctctgacattcagaaagagttcccacatgtcatcgaaatggtagatatagaacaatttacttttagtaacgt

SEQ ID NO: 351364 - DNA, 75 bp, Artificial Sequence
  Synthetic
atgtgaatctgttcaaaaatttagaatgatgtcaaaggatgaaagaaagcaatacgatttatgtgactttcctgc

SEQ ID NO: 351365 - DNA, 75 bp, Artificial Sequence
  Synthetic
cgaatttagagatggatatgtagcatcttcactagtgggaatcaatcacaattctggtccaagagctattcttgg

SEQ ID NO: 351366 - DNA, 75 bp, Artificial Sequence
  Synthetic
ttctctttttatgaaactctgttgtatatctactgataaaactggaagcaaaaaatctgatagaaagaataagaa

SEQ ID NO: 351367 - DNA, 75 bp, Artificial Sequence
  Synthetic
atgtgctcaagctaaacaagctatctcttgtctgagttcggatatacgaaataaaatagacaatggaattcattt

SEQ ID NO: 351368 - DNA, 75 bp, Artificial Sequence
  Synthetic
gatgtatccagagaggccaattgtcattagtaaggctttagaaacttcaaagattgcggctaattgcttcggaca

SEQ ID NO: 351369 - DNA, 75 bp, Artificial Sequence
  Synthetic
acatgttactatagcattaatgtcgtacaaaggtatcaatcaagaggatggaattatcatcaaaaaacaatttat

SEQ ID NO: 351370 - DNA, 75 bp, Artificial Sequence
  Synthetic
tcagagaggcggtcttgatattgttacagccaagaaacaccaagtagaaattccattggaaaactttaataacaa

SEQ ID NO: 351371 - DNA, 75 bp, Artificial Sequence
  Synthetic
agaaagagataggtctaacgcctattcgaaattagaaagtaatggattagttagactgaatgctttcttggaatc

SEQ ID NO: 351372 - DNA, 75 bp, Artificial Sequence
  Synthetic
cggagacgctatggcacgaaatatctcatcaagaactcttgaagatgattttgctagagataatcagattagctt

SEQ ID NO: 351373 - DNA, 75 bp, Artificial Sequence
  Synthetic
tgatgtttccgagaaatataccgatatgtacaaatctcgcgttgaacgagtgcaagtagaacttactgacaaagt

SEQ ID NO: 351374 - DNA, 75 bp, Artificial Sequence
  Synthetic
taaggtgcgagtattaaccatgaaagaaagaagacccattctaggagataaatttaccactagaacgagtcaaaa

SEQ ID NO: 351375 - DNA, 75 bp, Artificial Sequence
  Synthetic
gggaacagtcgcgtatatcgcagatgaaacggaacttccatacgacgaaaatggtatcacaccagatgtcattat

SEQ ID NO: 351376 - DNA, 75 bp, Artificial Sequence
  Synthetic
taattctacatccatcttctctagaaaaactatatctatgttgatagaagttattttaacagccgcatattctgc

SEQ ID NO: 351377 - DNA, 75 bp, Artificial Sequence
  Synthetic
taagccgtacaacaataagggagaaaaccgacctgtctgttttcctagtagtaacgaaacatccatcgatacata

SEQ ID NO: 351378 - DNA, 75 bp, Artificial Sequence
  Synthetic
agaaagaattatcggataaaatcttttgtgaaaagattctttatgatcctgaaacggataagccttatgcatcca

SEQ ID NO: 351379 - DNA, 75 bp, Artificial Sequence
  Synthetic
aagtattttttggaccaatttattacttgcgtctgagacatttaactcaggacaaggcaaccgttagatgtagag

SEQ ID NO: 351380 - DNA, 75 bp, Artificial Sequence
  Synthetic
gtaaaaagacgaagctaattagacaagcgaatgagggacgaaaacgtggaggaggtatcaagtttggagaaatgg

SEQ ID NO: 351381 - DNA, 75 bp, Artificial Sequence
  Synthetic
gtttaacgacaatggaatatacatccgtagaactatgattgacaagttgtacggatacgcatctctaactactat

SEQ ID NO: 351382 - DNA, 75 bp, Artificial Sequence
  Synthetic
agagagactgtttaatagcgcatggcgcagccaatactattacagaagttttaaaagactcagaagaggattatc

SEQ ID NO: 351383 - DNA, 75 bp, Artificial Sequence
  Synthetic
aagatgtgtatatttgtgaaaattgtggagacatagcagcacaaatcaaaagtattaatacatgtcttagatgtt

SEQ ID NO: 351384 - DNA, 75 bp, Artificial Sequence
  Synthetic
agccgaacatatagctgatagtattccaatatctgagctatctagactacgatataatctatgtaagtatttacg

SEQ ID NO: 351385 - DNA, 75 bp, Artificial Sequence
  Synthetic
caaaacttaatctctctcctctcttaacaaaaattgataccacgcacgtatctaaagtatttcttactcaaatga

SEQ ID NO: 351386 - DNA, 75 bp, Artificial Sequence
  Synthetic
ttttataaaccattagataaagttgatctcaagccgtcttttctgaagtaggtttcttatttagtagttgttgta

SEQ ID NO: 351387 - DNA, 75 bp, Artificial Sequence
  Synthetic
gataatcgttaatattatcaagataatccaaatttaattcttcaaatgaagtaggatcttctataactactttat

SEQ ID NO: 351388 - DNA, 75 bp, Artificial Sequence
  Synthetic
ggcacgatcgctggaggtgtttgttattatctgttgatgcatctagttagtttgtataaataattatttcaatat

SEQ ID NO: 351389 - DNA, 75 bp, Artificial Sequence
  Synthetic
catagtctaaagatgactgatattcaggttttgttggtggttgaggtgtaacagctacttgagataccaaagtct

SEQ ID NO: 351390 - DNA, 75 bp, Artificial Sequence
  Synthetic
aggttttgttggtggttgaggtgtaacagctacttgagataccaaagtctgatattcagaaagctgtggatgttt

SEQ ID NO: 351391 - DNA, 75 bp, Artificial Sequence
  Synthetic
gatattcagaaagctgtggatgtttgggttcaacatccactgatggtgttacaccaatcggttcagtgacgtctg

SEQ ID NO: 351392 - DNA, 75 bp, Artificial Sequence
  Synthetic
tggatggaggtgctacttttacagaacctgtagccttagttgtcgacggagatacatcttcaatgcgaggaaatg

SEQ ID NO: 351393 - DNA, 75 bp, Artificial Sequence
  Synthetic
gatacatcttcaatgcgaggaaatgtataatttggtaatgtttcttatgtggatctgaagaagaggtaagatatc

SEQ ID NO: 351394 - DNA, 75 bp, Artificial Sequence
  Synthetic
tactagaaagataccgatcacgttctagttctcttttgtagaacttaactttttctttctcagcatctagttgat

SEQ ID NO: 351395 - DNA, 75 bp, Artificial Sequence
  Synthetic
attccaacctcttcacgttactacgttcatattccaattcacgttcgcatgggttaccttcgcagtttttacgag

SEQ ID NO: 351396 - DNA, 75 bp, Artificial Sequence
  Synthetic
gggttaccttcgcagtttttacgagcgatttcacgttccagattacgtttagccttcatgtgtctctcactctct

SEQ ID NO: 351397 - DNA, 75 bp, Artificial Sequence
  Synthetic
ctatcgagtttatcagagcagtctttctaaaggcgatcgaactccataaatttctccaacgatttgattgtttcc

SEQ ID NO: 351398 - DNA, 75 bp, Artificial Sequence
  Synthetic
atagatttccgaagttcagcttctaggacggcgattctttttctttcgaattcacagctggatgtacaaccgttt

SEQ ID NO: 351399 - DNA, 75 bp, Artificial Sequence
  Synthetic
cctccgtttccattaccatctctaagtttctttcctagatcggcaatctttctcaacatttcatccccatacatt

SEQ ID NO: 351400 - DNA, 75 bp, Artificial Sequence
  Synthetic
ttacattcctcgagtctaccgtcgtcgaaatatctttccaactccttttcgacctcaataactttaacacgttgt

SEQ ID NO: 351401 - DNA, 75 bp, Artificial Sequence
  Synthetic
tatcattttatctgattccctggcgcgtttaagatcttcatgcaattgagtcagctcttaacgcaatctcttgct

SEQ ID NO: 351402 - DNA, 75 bp, Artificial Sequence
  Synthetic
cgtttaagatcttcatgcaattgagtcagctcttaacgcaatctcttgcttcttcgtcatagtactcacaatcac

SEQ ID NO: 351403 - DNA, 75 bp, Artificial Sequence
  Synthetic
tgtgagatccattgctaccacgtctacacttggtgagctcgcgtttaagagattcaatttcccgtttgtattggt

SEQ ID NO: 351404 - DNA, 75 bp, Artificial Sequence
  Synthetic
ccatgtctccattgccgcaaccattagatttacaggctgttagctgtcgttcaagatcagaaatacggtttttct

SEQ ID NO: 351405 - DNA, 75 bp, Artificial Sequence
  Synthetic
tggaattgatttcgtcaatgtacttaacatgattaacatcgaaacacttattaagttctttttccaattctacga

SEQ ID NO: 351406 - DNA, 75 bp, Artificial Sequence
  Synthetic
ttttatttctttcgcgagtcaattccctcctgtagtagctatcggttttgtcagattcacgctctctacgtagac

SEQ ID NO: 351407 - DNA, 75 bp, Artificial Sequence
  Synthetic
tttcttgcaagttactaatttgttccctgacacgtccaagttcagttttatatgccgaatagagttctgatttat

SEQ ID NO: 351408 - DNA, 75 bp, Artificial Sequence
  Synthetic
cctttgagcagatctctagcgattgtttaagatcactaattctagtctttagcctatttacctcctcagaagatg

SEQ ID NO: 351409 - DNA, 75 bp, Artificial Sequence
  Synthetic
tttaagatcactaattctagtctttagcctatttacctcctcagaagatgttccgttaccgttgcgtttacactc

SEQ ID NO: 351410 - DNA, 75 bp, Artificial Sequence
  Synthetic
gttaagctgtctatcaagatccatgattctatctctaagacgttgtatctctttttccatatcagcattgctttc

SEQ ID NO: 351411 - DNA, 75 bp, Artificial Sequence
  Synthetic
ctttttccatatcagcattgctttcattattacgtctgtagtcacttaaatctttcaagatttgaaattctatct

SEQ ID NO: 351412 - DNA, 75 bp, Artificial Sequence
  Synthetic
ctaagacgtctcatttctatctgtttcggtattggtcttattattatgtctacagtcgttcaactgtctttcaag

SEQ ID NO: 351413 - DNA, 75 bp, Artificial Sequence
  Synthetic
atctaatattctagattggagtctactaatctctgtaagatttcctcctccgctctcaatgcagtcggtcaactt

SEQ ID NO: 351414 - DNA, 75 bp, Artificial Sequence
  Synthetic
attctctagttcgctaatacgcgaacgcagtgcatcaacttcttgcgtgtctttctggttgtgtgtacattcatc

SEQ ID NO: 351415 - DNA, 75 bp, Artificial Sequence
  Synthetic
gagtctagattcgagatctctaacgcgtcgtcgttcttcctcaagttctccgcgtactgcagaaagcgtgtccct

SEQ ID NO: 351416 - DNA, 75 bp, Artificial Sequence
  Synthetic
atcttgttgatatttagcaatttctgattctagagtactgattctgctcacgtagttactaatagttgtcttagc

SEQ ID NO: 351417 - DNA, 75 bp, Artificial Sequence
  Synthetic
cttatcaagttcctccttgtatttgtcgcattccttgatatccctacgaagtttggacagttcccattcgacatt

SEQ ID NO: 351418 - DNA, 75 bp, Artificial Sequence
  Synthetic
acgacgtttatcgatttcagctcggagatcgtcatcgcgttgttttagccacatacgactaagttcaagttctcc

SEQ ID NO: 351419 - DNA, 75 bp, Artificial Sequence
  Synthetic
ctagttctgaacgcatttctcgttccctatcaagcgattctttcaattctcggatagtcttcttatcaatttctg

SEQ ID NO: 351420 - DNA, 75 bp, Artificial Sequence
  Synthetic
atgaatctgaaccatcatctgtcccattttgaatatccctaagttctttgatctcttttgtaagtcggtcgattc

SEQ ID NO: 351421 - DNA, 75 bp, Artificial Sequence
  Synthetic
tttcggttttataaacagaatccctttccaaagtcctaatcttactgagtttatcactaagttctgcattcaatt

SEQ ID NO: 351422 - DNA, 75 bp, Artificial Sequence
  Synthetic
tacctttccagtatatgagtaaataactatagaagttaaactgtgaatgtcaaggtctaggcaaaccctcgtaac

SEQ ID NO: 351423 - DNA, 75 bp, Artificial Sequence
  Synthetic
cggtgagttttctcttggcttcttccaactctgttttaaactctccaccatttccgcattcttcctcgcatttat

SEQ ID NO: 351424 - DNA, 75 bp, Artificial Sequence
  Synthetic
ctaaccattcaattagtttattaataactagttggtaatcagcgattcctatagccgttcttgtaattgtgggaa

SEQ ID NO: 351425 - DNA, 75 bp, Artificial Sequence
  Synthetic
cataattaggatcttctaatggattgtatgacttaatagcatcatctttatcattattagggggatggacaacct

SEQ ID NO: 351426 - DNA, 75 bp, Artificial Sequence
  Synthetic
taattggttggtcctccttatctcctccagtagcatgtggttcttcaataccagtgttagtaataggcttaggca

SEQ ID NO: 351427 - DNA, 75 bp, Artificial Sequence
  Synthetic
aacagagccatctgtaaaaagataaactttatgtattgtaccaaagatttaaatcctaatttaatagctaactcg

SEQ ID NO: 351428 - DNA, 75 bp, Artificial Sequence
  Synthetic
aatgcttgtcgtacgcgggcacttcctcatccattaagtatttataatcgggttctgcttcagaatattcttttc

SEQ ID NO: 351429 - DNA, 75 bp, Artificial Sequence
  Synthetic
aaaaaaaattgaattgatgatatagggttctttataatgcattcgtattctatatccggtgttaaaaaaattatc

SEQ ID NO: 351430 - DNA, 75 bp, Artificial Sequence
  Synthetic
taagagacgcgacttcaggagttagtagaagaactctgtttctgtatctatcaacgctggaatcaatactcaagt

SEQ ID NO: 351431 - DNA, 75 bp, Artificial Sequence
  Synthetic
taaggatagcgaatacctcatcgtcatcatccgtatcttctgaaacaccatcatatgacatttcatgaagtctaa

SEQ ID NO: 351432 - DNA, 75 bp, Artificial Sequence
  Synthetic
cgtattgataaatagaatcagatttagtattaaacagatccttaacctttttagtaaatgcatatatatatatta

SEQ ID NO: 351433 - DNA, 75 bp, Artificial Sequence
  Synthetic
gatctccagatttcataatatgatcacatgccttaaatgtcagtgcttccataatatagtctggaacactaatgg

SEQ ID NO: 351434 - DNA, 75 bp, Artificial Sequence
  Synthetic
gtgacgaaaaagataccgcaccatatgctacgttaataaataaatctgaaccactaagtagataatgattaatat

SEQ ID NO: 351435 - DNA, 75 bp, Artificial Sequence
  Synthetic
taaggaagaggaaatattcagtatatagatatgccttagcatcatatcttgtactaaacacactaaacagtttat

SEQ ID NO: 351436 - DNA, 75 bp, Artificial Sequence
  Synthetic
tgatgtgatcaatttccaacaaaacaattagagcagcaggaataccaacaaacatattaccacagccgtattttt

SEQ ID NO: 351437 - DNA, 75 bp, Artificial Sequence
  Synthetic
tatgaatatcacatatcatgttaaaaaatcttgatagaagagcaaatatctcatctgacttaatgagacgtagtt

SEQ ID NO: 351438 - DNA, 75 bp, Artificial Sequence
  Synthetic
cagcagcagcataagtcataactgtaaatagaacatactttcctgtagtattgattctagactccgcatcaacac

SEQ ID NO: 351439 - DNA, 75 bp, Artificial Sequence
  Synthetic
cattattaaaaatagttttatatacatctttaatctgctcaccgttaatcgtcgaacgttctagtatacggaaac

SEQ ID NO: 351440 - DNA, 75 bp, Artificial Sequence
  Synthetic
actttgatttcttatctgtagttaatgacttagtgatatcacgaagaatattacgaattacatttcttgtttttc

SEQ ID NO: 351441 - DNA, 75 bp, Artificial Sequence
  Synthetic
ttgagagacatgattcagaactcaactcatcgttccatagtttttctacctcagtggcgaaatctttggagtgct

SEQ ID NO: 351442 - DNA, 75 bp, Artificial Sequence
  Synthetic
tggtacatttttcaataaggttcgtgacctccatttattataaaaaattttattcaaaacttaactacaatcggg

SEQ ID NO: 351443 - DNA, 75 bp, Artificial Sequence
  Synthetic
taattataagatcgtagatctcccatgtggtggaatactaccatctatcgcatgtggatggacagtgggtaatgg

SEQ ID NO: 351444 - DNA, 75 bp, Artificial Sequence
  Synthetic
ccatgggaacagtaatgattgcatatttatctttcttgctagtattactgcatattgtcccaatgtttcgatgtg

SEQ ID NO: 351445 - DNA, 75 bp, Artificial Sequence
  Synthetic
gtgttctaacctatcaactgccgctgtatcacaacaatagtgtccgatggaattaagattatgatccaatgtgtt

SEQ ID NO: 351446 - DNA, 75 bp, Artificial Sequence
  Synthetic
taatatatgattatcaagtcttatacgatccgcgtcttttttgacaggatcaggttcttctacatgaagaagttt

SEQ ID NO: 351447 - DNA, 75 bp, Artificial Sequence
  Synthetic
cggcctcttataatattcatgtctgggaaacggtggtctagggtaaggctccggtatcggagtgggttttggatt

SEQ ID NO: 351448 - DNA, 75 bp, Artificial Sequence
  Synthetic
ataatcatcatcgtctacatcatcatctttgatatttattttgctatcttgatgatgtcctgtatcagttgcatt

SEQ ID NO: 351449 - DNA, 75 bp, Artificial Sequence
  Synthetic
ttcaacactcgactgaatattagcacattcattgtctattattaccatatttctaaacccaaaatgtatgtgttg

SEQ ID NO: 351450 - DNA, 75 bp, Artificial Sequence
  Synthetic
aacatcagtactattgttgatgagtcttatagcatgaattcgcttatcgttatcgggtttagtttctgtaacctt

SEQ ID NO: 351451 - DNA, 75 bp, Artificial Sequence
  Synthetic
aacaattccttttttattaaactctacataatcataaccatttctattgtttgttttaatataaacgagtatagc

SEQ ID NO: 351452 - DNA, 75 bp, Artificial Sequence
  Synthetic
atcattgctaaatttttcaatagtatcgaaaacagaatatcccaaaccatataatatatattcagggacactcaa

SEQ ID NO: 351453 - DNA, 75 bp, Artificial Sequence
  Synthetic
actaaatgtccaggattctcctaaatacgtaaactttaatagtgcgaaatcattcaaaaatctatcacttataga

SEQ ID NO: 351454 - DNA, 75 bp, Artificial Sequence
  Synthetic
tagatagtacatgaatgcgtatagtagtctaccgatctctttattatgaaaaccgacattaccatcatatatttc

SEQ ID NO: 351455 - DNA, 75 bp, Artificial Sequence
  Synthetic
gtgatatacatgtgatccgtttacgttaaaccataaatacatgggtgaccctataaacatgaatttatttctaat

SEQ ID NO: 351456 - DNA, 75 bp, Artificial Sequence
  Synthetic
cctcagagccatagttaattgaccgtgtaatatttgcttacatgcatacttgatacgatcattaataagattttt

SEQ ID NO: 351457 - DNA, 75 bp, Artificial Sequence
  Synthetic
attattgctcgttatttcagaatcgtatatataaggagtaccattgtgattcttaccagatattatacaaaatac

SEQ ID NO: 351458 - DNA, 75 bp, Artificial Sequence
  Synthetic
tatatataaaatatattgacccacgttagtaatcatgtaaatgtttaatgttttaaattttgtatttaatgattc

SEQ ID NO: 351459 - DNA, 75 bp, Artificial Sequence
  Synthetic
tgcttccatgctacctaatataaatcaaatacttgattccaggtctacagaagctgccaatatagtctgtgttac

SEQ ID NO: 351460 - DNA, 75 bp, Artificial Sequence
  Synthetic
attatcatacgctagcatggtcttgtaatattcattctttaaaatataatattgtgttagccattgcattggagc

SEQ ID NO: 351461 - DNA, 75 bp, Artificial Sequence
  Synthetic
tcctaatggagattttctattctcgtccattttaggatatgctttcataaagtccctaataacttcgtgaataat

SEQ ID NO: 351462 - DNA, 75 bp, Artificial Sequence
  Synthetic
gtttctatgttttctactgatgcatgtatttgcttcgatttttttatcccatgtttcatctatcatagatttaaa

SEQ ID NO: 351463 - DNA, 75 bp, Artificial Sequence
  Synthetic
cgcagtaatgcttgcaacattaacatcttgaaccattggtacaattccgttccataaatttataatgttcgccat

SEQ ID NO: 351464 - DNA, 75 bp, Artificial Sequence
  Synthetic
tccataaatttataatgttcgccatttatataactcattttttgaatatacttttaattgaacaaaagagttaag

SEQ ID NO: 351465 - DNA, 75 bp, Artificial Sequence
  Synthetic
ttactcatatgggcgccgaccagtctgaacatcaatctttttagccagagatatcatagccgctcttagagtttc

SEQ ID NO: 351466 - DNA, 75 bp, Artificial Sequence
  Synthetic
agcgtgattttccaacctaaatagaacgtcatcattgcgtttacaacacttttctatttgttcaaactttgttgt

SEQ ID NO: 351467 - DNA, 75 bp, Artificial Sequence
  Synthetic
tacattagtaatttttttttccaaattagttagccgttgtttgagagtttcctcattatcgtctccatcggcttt

SEQ ID NO: 351468 - DNA, 75 bp, Artificial Sequence
  Synthetic
aacaattgcttcgcgtttagcctctggctttttagcagcctttgtagagaaaaattcagttgctggaattgcaag

SEQ ID NO: 351469 - DNA, 75 bp, Artificial Sequence
  Synthetic
atataacgtaaccagaattgtaaaattagaggtatgggataaaataataccttctactatgcaattaccaaaagg

SEQ ID NO: 351470 - DNA, 75 bp, Artificial Sequence
  Synthetic
atcatcatctccagggaaaagagttccgtccatttaaagtacagattttaaaaactgacactctacgttatttat

SEQ ID NO: 351471 - DNA, 75 bp, Artificial Sequence
  Synthetic
atttggtgcaacacatggattataaatatcgatgttaataacatcagaaaatgtaaagtctatacattgcgccat

SEQ ID NO: 351472 - DNA, 75 bp, Artificial Sequence
  Synthetic
cgtgttaaattttctaatggatctagtattattgggtccaacttcagcctgaaatccaaatatggaagcggatac

SEQ ID NO: 351473 - DNA, 75 bp, Artificial Sequence
  Synthetic
aaaaccgtttcctggataagccacacatctccacttttgctttacatcagaaattgtgtcattgacatcttgaac

SEQ ID NO: 351474 - DNA, 75 bp, Artificial Sequence
  Synthetic
tctcctatctaatgctggtgtaccacctatagattttgaatattcgaatgctgcatgagtagcattaaattcctt

SEQ ID NO: 351475 - DNA, 75 bp, Artificial Sequence
  Synthetic
aatattgccataattctcatatattgagtaaccctggataaaaagtaaacacactgcagccgtcgctaccacaat

SEQ ID NO: 351476 - DNA, 75 bp, Artificial Sequence
  Synthetic
aaaaaaaattgatagagagttcatttataatctattagaagctaacaaaatttttttacacgcatcagacaatgc

SEQ ID NO: 351477 - DNA, 75 bp, Artificial Sequence
  Synthetic
tttaataaatagttcaacatctacttttgttatatcgaaccgatgatatgattctaacctagaattacatccgaa

SEQ ID NO: 351478 - DNA, 75 bp, Artificial Sequence
  Synthetic
aaagttgactatgttcattgtcattaagtcattaacgaacaatatgccagactctggattataagacgatactgt

SEQ ID NO: 351479 - DNA, 75 bp, Artificial Sequence
  Synthetic
ctaatgccgtcctcgagtatatgatcgcatctcgatctcaatcatcttatttgagtcgtattcctaatgagatat

SEQ ID NO: 351480 - DNA, 75 bp, Artificial Sequence
  Synthetic
ttcatcacaatcacctaccttaatcatgtgattatgaatattggctattagagcaccttctaagaaatctataat

SEQ ID NO: 351481 - DNA, 75 bp, Artificial Sequence
  Synthetic
tcaaggtaacctcttaggaagatcgcgttaatcatgtactcataaaacgattggaatctatacgccatatgtggt

SEQ ID NO: 351482 - DNA, 75 bp, Artificial Sequence
  Synthetic
atctttgaaacacgatttaaaatcaaaccacgaatatacttctacgaagaaagttagtttacccataggagagat

SEQ ID NO: 351483 - DNA, 75 bp, Artificial Sequence
  Synthetic
aagttagtttacccataggagagataactataaatggagatctagatacaaaatccggatctatgatagttttaa

SEQ ID NO: 351484 - DNA, 75 bp, Artificial Sequence
  Synthetic
cattattatattctctattaaatacctccacatctaaaaatgttaattttgaaactatgtcttcgtttattaccg

SEQ ID NO: 351485 - DNA, 75 bp, Artificial Sequence
  Synthetic
tacctgaactaaacgctataagctctattgtttgtgaactctttaaacgatattcttgaaatacatgtaacaaag

SEQ ID NO: 351486 - DNA, 75 bp, Artificial Sequence
  Synthetic
gaaaaacatgtctctctcaaatcagacaaccatctcataaaatagttctcgcgtgctggagaggtagttgctgct

SEQ ID NO: 351487 - DNA, 75 bp, Artificial Sequence
  Synthetic
tttcctttaactcggtcggtttatctaccatagttacagaatttgtatccttatctataatataataatcaaaat

SEQ ID NO: 351488 - DNA, 75 bp, Artificial Sequence
  Synthetic
cgtataaagttatataattatcgcgttcagattgtgatcttttcaaatagactaaaaaccccatttctctagtaa

SEQ ID NO: 351489 - DNA, 75 bp, Artificial Sequence
  Synthetic
gtatcttatgtatatgtttgtaaaatatcttcatggtgggaatatgctctaccacagttagccattcctcattga

SEQ ID NO: 351490 - DNA, 75 bp, Artificial Sequence
  Synthetic
tagcggtagatgtattagacaaaactattccaatgtttaacaagggccattttacaagattattaaatccttgtt

SEQ ID NO: 351491 - DNA, 75 bp, Artificial Sequence
  Synthetic
attaatacagtaagtacatcatctggagaatccacaacagacaagacgtcgggaccaattactaataaagaagat

SEQ ID NO: 351492 - DNA, 75 bp, Artificial Sequence
  Synthetic
tgataaatgtagctaatgagggttcgagttcaacgacgattgaattctcttcccgcggatgccgcatgatgaacg

SEQ ID NO: 351493 - DNA, 75 bp, Artificial Sequence
  Synthetic
actggatgttgttcgattgatttggaattctttttcgactttttgtttatattaaatattttaaaatttatagct

SEQ ID NO: 351494 - DNA, 75 bp, Artificial Sequence
  Synthetic
gatagcaattcatgtactacggataatgtagacgcgtattgtgcatcgatatctttattattagataaatttatc

SEQ ID NO: 351495 - DNA, 75 bp, Artificial Sequence
  Synthetic
atgtgacttttctctaaatgatgatgttgcccaagatcctctcttaaatgaatccatcctatccttcaagatgga

SEQ ID NO: 351496 - DNA, 75 bp, Artificial Sequence
  Synthetic
aataaatgtgagaagtttgcctcgttaaggtcttccatttaaatattatataaacatttgtgtttgtatcttatt

SEQ ID NO: 351497 - DNA, 75 bp, Artificial Sequence
  Synthetic
atgacctatatgtttttattaattttatttatatcgttaaaatgtatcgtatataagttttctaacgtggagtac

SEQ ID NO: 351498 - DNA, 75 bp, Artificial Sequence
  Synthetic
cgtcttttatggaatagtttttaactagtaaagctgtaattacatactttgtccgtaaaacataaatataaacac

SEQ ID NO: 351499 - DNA, 75 bp, Artificial Sequence
  Synthetic
ccgcttttatcaaacgttccaaaaagtcgttagtagacatttttaacatgatatctattttaaatacacttaggt

SEQ ID NO: 351500 - DNA, 75 bp, Artificial Sequence
  Synthetic
ttttagaaaaaacatcattttataattgtaacgattcaataactaaagaaaagattaagattaaacataagggaa

SEQ ID NO: 351501 - DNA, 75 bp, Artificial Sequence
  Synthetic
tgtcatttgtattttataagccaaagcattctaccgttgttaaatacttatctggaggatgtatatatcatgatg

SEQ ID NO: 351502 - DNA, 75 bp, Artificial Sequence
  Synthetic
atttggttgtattggggaaggtaacaattaatgatctaaagatgatgctattttacatggatttatcatatcatg

SEQ ID NO: 351503 - DNA, 75 bp, Artificial Sequence
  Synthetic
gagtgacaagtagtggagtaatttacaaattgggatcatccatagatagactttctctaaataggactattgtta

SEQ ID NO: 351504 - DNA, 75 bp, Artificial Sequence
  Synthetic
caaattgggatcatccatagatagactttctctaaataggactattgttacaaaagttaataacaattataacaa

SEQ ID NO: 351505 - DNA, 75 bp, Artificial Sequence
  Synthetic
ttataacaattataacaattataacaattattataattgttataattatgatgatacattttttgacgatgatga

SEQ ID NO: 351506 - DNA, 75 bp, Artificial Sequence
  Synthetic
aattattataattgttataattatgatgatacattttttgacgatgatgattgatcgctattacacaattttgtt

SEQ ID NO: 351507 - DNA, 75 bp, Artificial Sequence
  Synthetic
tttgtactttctaatatagtgtttaggttctttttcatatgagaatattgatttactaaaatatctatgtttaac

SEQ ID NO: 351508 - DNA, 75 bp, Artificial Sequence
  Synthetic
agcgtcacagaatcgaccacagcaggatcccatgacaagcgtcatattaaactaattcattttcaataatatact

SEQ ID NO: 351509 - DNA, 75 bp, Artificial Sequence
  Synthetic
ttttgttctataacgtccttatcggcggtatcggtacatatacgtaattcaccttcacaaaatacggagtcttcg

SEQ ID NO: 351510 - DNA, 75 bp, Artificial Sequence
  Synthetic
agaattcaaaatattaaaccagacaaccacgtataattttatagctaaaaatgtcacgaagaatggaactaaaaa

SEQ ID NO: 351511 - DNA, 75 bp, Artificial Sequence
  Synthetic
ctctataaagcgattgattttttttaccctctagagtttcctacagtcgtgggtcacacatttttttctagacac

SEQ ID NO: 351512 - DNA, 75 bp, Artificial Sequence
  Synthetic
ataataatagccaatcgattattggatctaaccgtctgtatcatattcaacatgtttaatatatcctttcgttta

SEQ ID NO: 351513 - DNA, 75 bp, Artificial Sequence
  Synthetic
ataacgtaaccagaattgtaaaattagaggtatgggataaaataataccttctactatgcaattaccaaaaggcc

SEQ ID NO: 351514 - DNA, 75 bp, Artificial Sequence
  Synthetic
gccttagaaataagagacttaaacaacggacacctggaattattaccatagaagatgttagaaaaatgatgctgg

SEQ ID NO: 351515 - DNA, 75 bp, Artificial Sequence
  Synthetic
ccctttacaggcatcgatcgtagcatattttccgcgtctgagatggaaatgttaaaactacaaaaatgcgtaatg

SEQ ID NO: 351516 - DNA, 75 bp, Artificial Sequence
  Synthetic
ttagcccgtcctaatattggtacatgcctataagtttggcatagtagaataatagacgtgttcaaatgccttcca

SEQ ID NO: 351517 - DNA, 75 bp, Artificial Sequence
  Synthetic
aagtttaagaattctattagagtattgcattttgatagtttatcacctacatcatcaaaaataagtaaaaagtgt

SEQ ID NO: 351518 - DNA, 75 bp, Artificial Sequence
  Synthetic
gctgattttttatgattttgtgcgacagtaatacatttttctatgttacttttagttcgtattagattatattct

SEQ ID NO: 351519 - DNA, 75 bp, Artificial Sequence
  Synthetic
agagattcctgactactaacgaaattaatatgatttggccaaatgtacccatcataatctgggttataaacgggt

SEQ ID NO: 351520 - DNA, 75 bp, Artificial Sequence
  Synthetic
gtaaacaagaatatatgtttatattttttaactagtgtagaaaacagagatagtaaatagatagtttttccagat

SEQ ID NO: 351521 - DNA, 75 bp, Artificial Sequence
  Synthetic
ccagatcctcccgttaaaaccattctaaacggcatttttaataaattttctcttaaaaattgtttttcttggaaa

SEQ ID NO: 351522 - DNA, 75 bp, Artificial Sequence
  Synthetic
agacgtaacaatgcactacattgtttcctcgtctatctatatgttttgataagttataacacgtttcaatctcta

SEQ ID NO: 351523 - DNA, 75 bp, Artificial Sequence
  Synthetic
caattcataattatatttacagttactaaattaatttgataataaatcaaaatatggaaaactaaggtcgttagt

SEQ ID NO: 351524 - DNA, 75 bp, Artificial Sequence
  Synthetic
agggaggagaacaaagaaggcacatcgtgatataaataatatttgttatcatgatgacaccagaaaacgacgaag

SEQ ID NO: 351525 - DNA, 75 bp, Artificial Sequence
  Synthetic
agcaaacatctgtgttctccgccactgtttacggagacaaaattcagggaaaaaataaacgcaaacgcgtaattg

SEQ ID NO: 351526 - DNA, 75 bp, Artificial Sequence
  Synthetic
gtatatgtattagaatatctatggttatttcactactatctatgattaccatgtccgcgtttctcatagtgcgtc

SEQ ID NO: 351527 - DNA, 75 bp, Artificial Sequence
  Synthetic
taaatcaatgcatgtctgctaacgaggctgctattactgacgccactgcagttgctgctgcattatctactcata

SEQ ID NO: 351528 - DNA, 75 bp, Artificial Sequence
  Synthetic
gaaaggttgcgtctagcactacacaatataaacaccaagaaagctgtaatggtttatattaccagggttcttgtt

SEQ ID NO: 351529 - DNA, 75 bp, Artificial Sequence
  Synthetic
atatattccattcagactaccagttattctcggatgctaaagcaaattgcgccacagaatcatcaacactaccca

SEQ ID NO: 351530 - DNA, 75 bp, Artificial Sequence
  Synthetic
ataaatctgatgtcttgactacctggctcattgattatgttgaggatacatggggatctgatggtaatccaatta

SEQ ID NO: 351531 - DNA, 75 bp, Artificial Sequence
  Synthetic
tatcattaactgttgccaatgatgttaggaaatattctgttgtgtcagtttataataacaagtatgacattgtaa

SEQ ID NO: 351532 - DNA, 75 bp, Artificial Sequence
  Synthetic
caaaaactacaaccgattatcaagattccgatgtatcacaagaagttagaaagtatttttgtgttaaaacaatga

SEQ ID NO: 351533 - DNA, 75 bp, Artificial Sequence
  Synthetic
actaatatttatttttgtacattaataaatgaaatcgcttaatagacaaactgtaagtaggtttaagaagttgtc

SEQ ID NO: 351534 - DNA, 75 bp, Artificial Sequence
  Synthetic
ggtgccggccgctataatgatgatactctcaaccattattagcggcataggaacatttctgcattacaaagaaga

SEQ ID NO: 351535 - DNA, 75 bp, Artificial Sequence
  Synthetic
attaacatcatacatcaattaactattcttataacatcgtaatcaaaagaattgcaattttgattataacaactg

SEQ ID NO: 351536 - DNA, 75 bp, Artificial Sequence
  Synthetic
actgatgcctagtgcttgcgccaatggatggatacaatacgataaacattgttatttagatactaacattaaaat

SEQ ID NO: 351537 - DNA, 75 bp, Artificial Sequence
  Synthetic
gtctacagataatgcggtttatcagtgtcgtaaattacgagccagattgcctagaccggatactagacatctaag

SEQ ID NO: 351538 - DNA, 75 bp, Artificial Sequence
  Synthetic
tgagtgcacttagtccaggacctataattgattaccacgtctggataggagattgtattggtaaagttactgctg

SEQ ID NO: 351539 - DNA, 75 bp, Artificial Sequence
  Synthetic
agtattgtttagtattttttataaagattattgggtaagtttaaaaaagaccaataataaatggttagatattaa

SEQ ID NO: 351540 - DNA, 75 bp, Artificial Sequence
  Synthetic
taatgataaagatatagatattagtaaattaacaaattttaaacaactaaacagtacaacggatgctgaagcgtg

SEQ ID NO: 351541 - DNA, 75 bp, Artificial Sequence
  Synthetic
ttatatatacaagtctggaaaactggttaaaacagtatgtaaaagtactcaatctgtactatgtgttaaaagatt

SEQ ID NO: 351542 - DNA, 75 bp, Artificial Sequence
  Synthetic
gttaaaacagtatgtaaaagtactcaatctgtactatgtgttaaaagattctacaagtaacaacaaaaaataaaa

SEQ ID NO: 351543 - DNA, 75 bp, Artificial Sequence
  Synthetic
taataataagtccttaacgaacgttgatggacaccacgtttgttattactccaatgggtatgctgactataacag

SEQ ID NO: 351544 - DNA, 75 bp, Artificial Sequence
  Synthetic
ctcaataatggactttataggaccatacattataggtaacataaaaactgtccaaatagatgtacgggatataaa

SEQ ID NO: 351545 - DNA, 75 bp, Artificial Sequence
  Synthetic
tctattattacagagtcatacgacgtcggatttgattccatagatatagatgttataaacgactataaaattatt

SEQ ID NO: 351546 - DNA, 75 bp, Artificial Sequence
  Synthetic
atctaaatattttagaacactgtttacaacacctatgataataagagatctagtaactagagtaaaaatctacag

SEQ ID NO: 351547 - DNA, 75 bp, Artificial Sequence
  Synthetic
tttagctaagggtaaaatagttccttaggattctaatgatttggttagattcaacatttatagcatttgtaccgc

SEQ ID NO: 351548 - DNA, 75 bp, Artificial Sequence
  Synthetic
taggattctaatgatttggttagattcaacatttatagcatttgtaccgcatacagatcaaaaataccatcatca

SEQ ID NO: 351549 - DNA, 75 bp, Artificial Sequence
  Synthetic
tagcatgcgactatgataccatgttagatatagaaggtaaacatcagccattttatctatttacatctattgatg

SEQ ID NO: 351550 - DNA, 75 bp, Artificial Sequence
  Synthetic
tttttaacgctacaatcatagaagcgtataacctgtatacagctggagattatcatctgatcatcaatccttcag

SEQ ID NO: 351551 - DNA, 75 bp, Artificial Sequence
  Synthetic
ataatctgaaaatgaaattgtagtttaattcttcattctgcatatcaaacggcaatggatggatcataattgatg

SEQ ID NO: 351552 - DNA, 75 bp, Artificial Sequence
  Synthetic
ggaaatgcaatagtaattttttatcataaaagttgtaaagtaaataataaaacaataaatattgaactagtagta

SEQ ID NO: 351553 - DNA, 75 bp, Artificial Sequence
  Synthetic
ttggaagcgtatttcatgtgtaagttacaggatctaattgtgacgtgagtattctcttgaacaaggcatcaaaaa

SEQ ID NO: 351554 - DNA, 75 bp, Artificial Sequence
  Synthetic
cgtatattgagcaatcagaaatgatactggtacctcttatcacagtgaccgtagttgcgggaacaatattagtat

SEQ ID NO: 351555 - DNA, 75 bp, Artificial Sequence
  Synthetic
gttatatattatatatttgtaggaaaaagatacgtactgtctataatgacaataaaattattatgacaaaattaa

SEQ ID NO: 351556 - DNA, 75 bp, Artificial Sequence
  Synthetic
aaaagataaagagttctaattccagcaaatctagtaaatcaactgataacgaatcagactgggaggatcactgta

SEQ ID NO: 351557 - DNA, 75 bp, Artificial Sequence
  Synthetic
gtgctatggaacaaaataatgacgtggataatatttctaggaatgagatattggatgatgatagcttcgctggta

SEQ ID NO: 351558 - DNA, 75 bp, Artificial Sequence
  Synthetic
gtttaatatgggataacgaatccaatgtcatagcgcctagcacagaacacatttacgatagtgttgctggaagca

SEQ ID NO: 351559 - DNA, 75 bp, Artificial Sequence
  Synthetic
tgcattggcatcaaaagaagatagatgaactgacatatagcgaatataaggagatccaacactattaggagaaag

SEQ ID NO: 351560 - DNA, 75 bp, Artificial Sequence
  Synthetic
cgcggctaataaataatgattgtaatgaacaaactatttatcagaacactacagtaattaatgagacagagacta

SEQ ID NO: 351561 - DNA, 75 bp, Artificial Sequence
  Synthetic
ccaggtcatatggaagatgttcaagctgttaatatcaatctcgataaacgtgaacaggctgtcggagccacagtt

SEQ ID NO: 351562 - DNA, 75 bp, Artificial Sequence
  Synthetic
ttgaagtacttaatgaagataccaaacagaatcctagctattcgtccaatcctttcgtaaattataataaaacca

SEQ ID NO: 351563 - DNA, 75 bp, Artificial Sequence
  Synthetic
gtatttgtagcaagtcaaatccgttcattacagaactcaacaataaatttagtgagaataatccgtttaggagag

SEQ ID NO: 351564 - DNA, 75 bp, Artificial Sequence
  Synthetic
cacatagcgatgattacctaaataagcaagaacatgatgatatagaatcatctgttgtatcattagtctgattag

SEQ ID NO: 351565 - DNA, 75 bp, Artificial Sequence
  Synthetic
aatcatgttaatgtctttaagataaggtaggcaaatgtttatagtattaagaattgggcaagcataagacatgac

SEQ ID NO: 351566 - DNA, 75 bp, Artificial Sequence
  Synthetic
tttcctttttataaaattgaagtaatatttagtattaattgctaccgttacattgtacaaatggagatattccct

SEQ ID NO: 351567 - DNA, 75 bp, Artificial Sequence
  Synthetic
actagactgtttatacaagattgaaattatattcttttttatagagcgtgtgatgttacggatatctaataatat

SEQ ID NO: 351568 - DNA, 75 bp, Artificial Sequence
  Synthetic
gtatttggcatttctaaaattagcaattttattgctaataatgactgtagatattatatagatacagaacatcat

SEQ ID NO: 351569 - DNA, 75 bp, Artificial Sequence
  Synthetic
taaaaaattatacctaatgagatcaatagacagatggatgaaatggtacttcttaccaacatcttaagcgtaaaa

SEQ ID NO: 351570 - DNA, 75 bp, Artificial Sequence
  Synthetic
gattatactctgtattagttctattggaagatgtgttatctctatagataatgacgttaataacaaaaatattct

SEQ ID NO: 351571 - DNA, 75 bp, Artificial Sequence
  Synthetic
aacctttcccattgatcatgctgtaatcatatcccactaagtaaatgtgtcgtagttagtaagggtcctacaacc

SEQ ID NO: 351572 - DNA, 75 bp, Artificial Sequence
  Synthetic
atattggttgttaaagcggatatacccagcaaacgacatactatatgtaaataatctgtcactgattaattattt

SEQ ID NO: 351573 - DNA, 75 bp, Artificial Sequence
  Synthetic
cgagttacaaactatttggatagacacatatgcgatcagatatttgctaataataagtggtattccattataacc

SEQ ID NO: 351574 - DNA, 75 bp, Artificial Sequence
  Synthetic
atcgacgataagcagtttcctattccatcaaactgtataggtatgtcctctaccaagtacataaattctagcatc

SEQ ID NO: 351575 - DNA, 75 bp, Artificial Sequence
  Synthetic
gagcaagatactttaatccatgtttgtaacctcgagcatccattcgactcagtatacaaaaatgcagtcgtacaa

SEQ ID NO: 351576 - DNA, 75 bp, Artificial Sequence
  Synthetic
attctgtacctatcaaggaacaaatattgtacggtagaattgataatataaatatgagcattagtatttctgtgg

SEQ ID NO: 351577 - DNA, 75 bp, Artificial Sequence
  Synthetic
attaatagatttctagtatgggatcattaatcatttctaatctctaaatacctcataaaacaaaaaagctattat

SEQ ID NO: 351578 - DNA, 75 bp, Artificial Sequence; identical to SEQ ID NO: 348420
  Synthetic

SEQ ID NO: 351579 - DNA, 75 bp, Artificial Sequence
  Synthetic
agaataagatcaaggattatatggaacacgattattataaaataacaatagttcctggttcctcttccacgtcta

SEQ ID NO: 351580 - DNA, 75 bp, Artificial Sequence
  Synthetic
ctagctcgtggtattatacgcatgcctagtaatagtctctttgcgttgatggaaagcagactagaaataacaggc

SEQ ID NO: 351581 - DNA, 75 bp, Artificial Sequence
  Synthetic
taaaatgttcagacaccataatagttcccaacccagataataacagagttccatcaacacattcctttagactca

SEQ ID NO: 351582 - DNA, 75 bp, Artificial Sequence
  Synthetic
atcccaatcccaaaaccgttaaaatgtatccagccaattgatagtaaataatgaggtgtacagcacatgataatt

SEQ ID NO: 351583 - DNA, 75 bp, Artificial Sequence
  Synthetic
tcgaataatgagtatactccgtttaataaacttagtgtaaaactatatatatatatatatatatagatggagtag

SEQ ID NO: 351584 - DNA, 75 bp, Artificial Sequence
  Synthetic
tacacagtaaccaaaatgaaaacactttagtaattataagaaatatagacggtaatgtcatcattaacaatccaa

SEQ ID NO: 351585 - DNA, 75 bp, Artificial Sequence
  Synthetic
taatatgcctgagagtaaacattgacggataaaacaaaaatgccccgcataactctatcatggcaataatacaac

SEQ ID NO: 351586 - DNA, 75 bp, Artificial Sequence
  Synthetic
caaacacttgtaaaattcctaaattagtagaaaatacaactgatatcgatgtataagcgatttcgaggaataata

SEQ ID NO: 351587 - DNA, 75 bp, Artificial Sequence
  Synthetic
agaacaaagtaatgcctgtaaaaataaacatcaacattgtatgatggtcattaaaccaattagtatgacgttgaa

SEQ ID NO: 351588 - DNA, 75 bp, Artificial Sequence
  Synthetic
acgaccgataagagacgtgttattacattgtgattaaacattaatcctgtcaaggaagaagatgctacagcgttt

SEQ ID NO: 351589 - DNA, 75 bp, Artificial Sequence
  Synthetic
ctaatttcacagtagattttattccggtgttatcctcgcatgtataagtaccgggtaatatatctttatacttta

SEQ ID NO: 351590 - DNA, 75 bp, Artificial Sequence
  Synthetic
taattaatgaaacatcgttatcagataacgaatggagtttggcactagtatgccatttacttaatatgatcgtct

SEQ ID NO: 351591 - DNA, 75 bp, Artificial Sequence
  Synthetic
tggaagttttattataagttaaaatattatggttgtccaatttccatctaatatactttgttggattatctatag

SEQ ID NO: 351592 - DNA, 75 bp, Artificial Sequence
  Synthetic
tacacggaataatgatggtatcattgcacgccgtatactctatagtctttgtagatgttataaccacaaaagtgc

SEQ ID NO: 351593 - DNA, 75 bp, Artificial Sequence
  Synthetic
agaggtatatcaacaatattctaactcttaacatttttatttatttaaaatgatacctttgttatttattttatt

SEQ ID NO: 351594 - DNA, 75 bp, Artificial Sequence
  Synthetic
ctattttgcgaacggtatcgaatggcataagtttgaaacgagtgaaaaaataatttctacttacttaatagatga

SEQ ID NO: 351595 - DNA, 75 bp, Artificial Sequence
  Synthetic
cgtattatacacgggtgttaatggggcagtatatacattttcaaataataaactaaacaaaactggtttagctaa

SEQ ID NO: 351596 - DNA, 75 bp, Artificial Sequence
  Synthetic
gcagtatatacattttcaaataataaactaaacaaaactggtttagctaatactaattatatcacaacatctata

SEQ ID NO: 351597 - DNA, 75 bp, Artificial Sequence
  Synthetic
gtctgtctcagaatcaaatatagatcttatttagtatccacaaatagtaaatgagagatctactggtgaaatgtg

SEQ ID NO: 351598 - DNA, 75 bp, Artificial Sequence
  Synthetic
tactaattatatcacaacatctataaaagtagaggatgtgatacattagtatgcggaaccaataacggaaatccc

SEQ ID NO: 351599 - DNA, 75 bp, Artificial Sequence
  Synthetic
ttgttagctgttttcattaagatttgtaccctgtttaacatgatggcgttctatacgtctttattttctattttt

SEQ ID NO: 351600 - DNA, 75 bp, Artificial Sequence
  Synthetic
aaatgttggaaaatagacggttccaaagatccaaaacatagaggtagaggatacgctccttatcaaaatagtaaa

SEQ ID NO: 351601 - DNA, 75 bp, Artificial Sequence
  Synthetic
gtaacgataatcagtcataacaaatgtatactatctaacataaacatatcaaaagaaggaattaaacgatggaga

SEQ ID NO: 351602 - DNA, 75 bp, Artificial Sequence
  Synthetic
agatttgacggaccatgtggttatgatttatttatacacggcggataacgtaattccaaaagatggtttacaagg

SEQ ID NO: 351603 - DNA, 75 bp, Artificial Sequence
  Synthetic
taactgctacacaaataccaatcaaaagaagaataccaatcatttattgataataacttcactattgatcaagta

SEQ ID NO: 351604 - DNA, 75 bp, Artificial Sequence
  Synthetic
agcattcgtcgataaagacggtacttatgacaaagtttacattcttttcactgttactatcggctcaaagagaat

SEQ ID NO: 351605 - DNA, 75 bp, Artificial Sequence
  Synthetic
tgttaaaattccgtatatagcacaaatgtgcttaaacgacgaatgtggtccatcatcattgtctagtcatagatg

SEQ ID NO: 351606 - DNA, 75 bp, Artificial Sequence
  Synthetic
agtcattgatatttttataattggtagaagacaataatgacaccacaacatcagttttgatattcttatttttct

SEQ ID NO: 351607 - DNA, 75 bp, Artificial Sequence
  Synthetic
gtcgacgttgctcaaagtcgaattagaatgtgacatcgacggaagaagttatagtcaaattaatcattctaaaac

SEQ ID NO: 351608 - DNA, 75 bp, Artificial Sequence
  Synthetic
tataaaacagataatgatacgatactatatgtattctttgatagtccttttccaagtccgcattatgtacctatt

SEQ ID NO: 351609 - DNA, 75 bp, Artificial Sequence
  Synthetic
ctatgaataccattaaacaatctttttctacgtcaaattgggaggatatacaaagcaattactgtctccagcttt

SEQ ID NO: 351610 - DNA, 75 bp, Artificial Sequence
  Synthetic
tggtatatgtctaccagctggaaaaagttgttccacataacacgtttgacgttatagaacaatataatgtactag

SEQ ID NO: 351611 - DNA, 75 bp, Artificial Sequence
  Synthetic
ataatattataaagcctttatctaaccaacctatcttcaaaggaccgtctgatgttaaatggttcgatataaagg

SEQ ID NO: 351612 - DNA, 75 bp, Artificial Sequence
  Synthetic
agaaggaaaatgaacatcggaaatatagaatatacttcataaaagaaaatactatatattcgttcaatacaaaat

SEQ ID NO: 351613 - DNA, 75 bp, Artificial Sequence
  Synthetic
ctaaacaaactcgtagctcgcaagtcgatgcgcaactattttcagtaatggtaacttcgaaaccgttatttatag

SEQ ID NO: 351614 - DNA, 75 bp, Artificial Sequence
  Synthetic
gtaacttcgaaaccgttatttatagcagatatagggatagaagtaggaatgccacgaataaaaaaatacttaaaa

SEQ ID NO: 351615 - DNA, 75 bp, Artificial Sequence
  Synthetic
tgtaatcttaatcgagtacgccatatgacaatgaacaaacctaagacaaattatgctggttatgcttgctgcgta

SEQ ID NO: 351616 - DNA, 75 bp, Artificial Sequence
  Synthetic
tgacaatgaacaaacctaagacaaattatgctggttatgcttgctgcgtaatatgcggtctaattgttggaatta

SEQ ID NO: 351617 - DNA, 75 bp, Artificial Sequence
  Synthetic
tttttacagcgacactattaaaagctgtagaacgtaaattaattcatacaccattaatagataaaacgataaaag

SEQ ID NO: 351618 - DNA, 75 bp, Artificial Sequence
  Synthetic
atgcatatattagagaagattgtcctactgactgaataagctatataataaatgtatacatttatcgactaatca

SEQ ID NO: 351619 - DNA, 75 bp, Artificial Sequence
  Synthetic
aaaaacctgggaggaaggacgtaatgcatgcaaagctctaaatccaaattcggatctaattaatatagagactct

SEQ ID NO: 351620 - DNA, 75 bp, Artificial Sequence
  Synthetic
ggaacaattaggtattactccaggatctgatttggaagcgtatttcatgtgtaagttacaggatctaattgtgac

SEQ ID NO: 351621 - DNA, 75 bp, Artificial Sequence
  Synthetic
aaacgagttaagttttttaagaagccttagaagaggctattgggtaggagaattcaaaatattaaaccagacaac

SEQ ID NO: 351622 - DNA, 75 bp, Artificial Sequence
  Synthetic
aaatatatttgtagtacaacgaatactcccaaactgcattcatgttacactatataacaattacactacattttt

SEQ ID NO: 351623 - DNA, 75 bp, Artificial Sequence
  Synthetic
attaacaattatcaaattttttctttaatattttacgtggttgaccattcgtggtggtaaaataatctcttagtg

SEQ ID NO: 351624 - DNA, 75 bp, Artificial Sequence
  Synthetic
ttggaatggaatgctgtttaatgtttccacactcatcgtatattttgacgtatgcagttacatcgtttacgcaat

SEQ ID NO: 351625 - DNA, 75 bp, Artificial Sequence
  Synthetic
agtcagactgtagttctattatgcttcctacattaggaggaacagttttaaagtctcttggttttaatctattac

SEQ ID NO: 351626 - DNA, 75 bp, Artificial Sequence
  Synthetic
tcctacattaggaggaacagttttaaagtctcttggttttaatctattaccgttagtttttatgaaatccttatc

SEQ ID NO: 351627 - DNA, 75 bp, Artificial Sequence
  Synthetic
ctttgttttatccacttcacattttaaataaatgtccactatacattcttctgttaattttactagatcgtcata

SEQ ID NO: 351628 - DNA, 75 bp, Artificial Sequence
  Synthetic
tgtcatagaatttataggttccatagtccatggatccaaactagcaaacttcgcgtatacagtatcgcgattagt

SEQ ID NO: 351629 - DNA, 75 bp, Artificial Sequence
  Synthetic
gttgtttatcgtgtcctccgggaacatacgcttccagattatgtgatagcaagactaacacacaatgtacaccgt

SEQ ID NO: 351630 - DNA, 75 bp, Artificial Sequence
  Synthetic
gtatacaccaactgtatgaaaattaagaaaacagtttaatagatcaacagaaatatttaatcctccgtttgatac

SEQ ID NO: 351631 - DNA, 75 bp, Artificial Sequence
  Synthetic
tactataagtaattatagtataatgtaacgtttatatattcaatatttttataaaaaaatcatttcgacattaat

SEQ ID NO: 351632 - DNA, 75 bp, Artificial Sequence
  Synthetic
agatgcaccatatttatggatttcggattcacacgttgtttgtctgaggggttcgtctagcgttgcttctacata

SEQ ID NO: 351633 - DNA, 75 bp, Artificial Sequence
  Synthetic
aacttctattcccatatattctttattatcagaatcgcataccgatttatcatcatacactgtttgaaaactaaa

SEQ ID NO: 351634 - DNA, 75 bp, Artificial Sequence
  Synthetic
tggtatacacatcaaaataacaaatactaacgagtacattctgcaatattgttatcgtaattggaaaattagtgt

SEQ ID NO: 351635 - DNA, 75 bp, Artificial Sequence
  Synthetic
tttatattttatattttgtaataagaatagaatgctaatgtcaagtttattccaataaatgacttattaaaaaac

SEQ ID NO: 351636 - DNA, 75 bp, Artificial Sequence
  Synthetic
atatataataaataacaatggctgaatggcataaaattatcgaggatatttcaaaaaataataatttcgaggatg

SEQ ID NO: 351637 - DNA, 75 bp, Artificial Sequence
  Synthetic
ccgccatcgttgattacaagactacaaagaatgttctagcggctattcctaacagaacatttgcaaagattaatc

SEQ ID NO: 351638 - DNA, 75 bp, Artificial Sequence
  Synthetic
cgggcgaagttattccgctcatcactaatcataatattctaaaacctcttattggtcagaagttttgtattgtat

SEQ ID NO: 351639 - DNA, 75 bp, Artificial Sequence
  Synthetic
atactaactctctaatggatgagaacacgtatgctatggagttgcttactgggtacgcccctgtatctccgatcg

SEQ ID NO: 351640 - DNA, 75 bp, Artificial Sequence
  Synthetic
ttatagcgagaactcataccgcacttatatttttgatgggtaagccaacaacatctagacgtgatgtgtatagaa

SEQ ID NO: 351641 - DNA, 75 bp, Artificial Sequence
  Synthetic
tattatttttcaccatatagatcaatcattagatcatcaaaatatgtttcaatcatcctaaagagtatggtaaat

SEQ ID NO: 351642 - DNA, 75 bp, Artificial Sequence
  Synthetic
cgtgtagagatcacgctacccgtgtacgtgcaactggtaattaaaataaaaagtaatattcatatgtagtgttaa

SEQ ID NO: 351643 - DNA, 75 bp, Artificial Sequence
  Synthetic
ttttaaatgatgataaaatggataatatccatattgacgatgtcaataatgccggtattggtatacagctcatcg

SEQ ID NO: 351644 - DNA, 75 bp, Artificial Sequence
  Synthetic
atttttagatttcgttcagaggatgtggaattatgttatgggaatttgtattttgataggatctataataatgta

SEQ ID NO: 351645 - DNA, 75 bp, Artificial Sequence
  Synthetic
gtaaatataaaatatattcctgagcatattccatataaatataattttattaatcgtacgttctccgtagatgaa

SEQ ID NO: 351646 - DNA, 75 bp, Artificial Sequence
  Synthetic
ctagacaataatgtcttttttacacatggttattttttaaaacacaaatatggttcacttaatcctagtttgatt

SEQ ID NO: 351647 - DNA, 75 bp, Artificial Sequence
  Synthetic
gtctcattatcaggaaacttaaaatataatgatatacaatgctcagtaaatgtatcgtgcctcattaaaaatttg

SEQ ID NO: 351648 - DNA, 75 bp, Artificial Sequence
  Synthetic
gcaacgagtatatctactatattaacatctaaacataagacgtattctctacatcggtccaagtgtattactata

SEQ ID NO: 351649 - DNA, 75 bp, Artificial Sequence
  Synthetic
gaatgatgacggtatgatgtcgcattcggagacggtaactctagcgggtgactgtctatctagcgtcgacatcta

SEQ ID NO: 351650 - DNA, 75 bp, Artificial Sequence
  Synthetic
ataggatatgattctattatatggtataaagatataaatgacaagtataatgatatctatgattttaccgcaata

SEQ ID NO: 351651 - DNA, 75 bp, Artificial Sequence
  Synthetic
tgtatgctaatagcgtctacattgatagtgaccatatacgtgtttaaaaaaataaaaatgaactcttaattatgc

SEQ ID NO: 351652 - DNA, 75 bp, Artificial Sequence
  Synthetic
tagtgaccatatacgtgtttaaaaaaataaaaatgaactcttaattatgctattagaaatggataaaatcaaaat

SEQ ID NO: 351653 - DNA, 75 bp, Artificial Sequence
  Synthetic
tattagaaatggataaaatcaaaattacggttgattcaaaaattggtaatgttgttaccatatcgtataacttgg

SEQ ID NO: 351654 - DNA, 75 bp, Artificial Sequence
  Synthetic
tacggttgattcaaaaattggtaatgttgttaccatatcgtataacttggaaaaaataactattaacgacacacc

SEQ ID NO: 351655 - DNA, 75 bp, Artificial Sequence
  Synthetic
cgcaatcagttgctgttgaagaggcaaaagatgtcaaggtggaagaaaaaaatatcgatattgaagatgacaatg

SEQ ID NO: 351656 - DNA, 75 bp, Artificial Sequence
  Synthetic
acgatgatatggatgtagaaagcgtgtaatacgatctataaaaaataagtatataaatactttttatttacggta

SEQ ID NO: 351657 - DNA, 75 bp, Artificial Sequence
  Synthetic
atataaatactttttatttacggtactcttgtagtggaatacccctactcgattattttttttttaaaaaaaaat

SEQ ID NO: 351658 - DNA, 75 bp, Artificial Sequence
  Synthetic
acttattctgattattctagccatttccgtgttcgttcaaatgccacatcaaagatatgggagtagttgaaatct

SEQ ID NO: 351659 - DNA, 75 bp, Artificial Sequence
  Synthetic
aaagatatgggagtagttgaaatctagttctgcattgttggcgcgcctcaaatgtagtgttggatatcttcaacg

SEQ ID NO: 351660 - DNA, 75 bp, Artificial Sequence
  Synthetic
tatagttgttgagtagtgatggttttctaaatagaattctcttcatatcattcttgcacgtgtacatttttagca

SEQ ID NO: 351661 - DNA, 75 bp, Artificial Sequence
  Synthetic
catttatataactcattttttgaatatacttttaattgaacaagagttaagttactcatatgggcaccgaccagt

SEQ ID NO: 351662 - DNA, 75 bp, Artificial Sequence
  Synthetic
tccatcttggaatcctagatccttgttctattcccaatggtttcatcaatagaagattaaacatatcgtacgaac

SEQ ID NO: 351663 - DNA, 75 bp, Artificial Sequence
  Synthetic
acgatggagagtaaccgtagcaaaagtaagcatttcctttaatctcagatcccggatactggatatattttacag

SEQ ID NO: 351664 - DNA, 75 bp, Artificial Sequence
  Synthetic
ccaacacatgcatccatgcaacatttcctacatatacccggctatgtaccgcgtcatcatcgactgtacgataca

SEQ ID NO: 351665 - DNA, 75 bp, Artificial Sequence
  Synthetic
taatgttaccgtgttgcgtacattgctcgtaaaagactttcgttaatttgtctcctcctccgtaaattccagtgg

SEQ ID NO: 351666 - DNA, 75 bp, Artificial Sequence
  Synthetic
ctcgtaaaagactttcgttaatttgtctcctcctccgtaaattccagtgggtcttaggcaacaagtatacaattt

SEQ ID NO: 351667 - DNA, 75 bp, Artificial Sequence
  Synthetic
tgcaccattcataattacagaattattggctttcatgaccagttgctcgaccatacgtttactttttgcgtatac

SEQ ID NO: 351668 - DNA, 75 bp, Artificial Sequence
  Synthetic
agacaaattcttgtccatatattttaaaacattgacttttgcactaagaaaaatatatagactaactatctcttt

SEQ ID NO: 351669 - DNA, 75 bp, Artificial Sequence
  Synthetic
ttggctttcatgaccagttgctcgaccatacgtttactttttgcgtatacatgtccgggtgatatatcgtacagg

SEQ ID NO: 351670 - DNA, 75 bp, Artificial Sequence
  Synthetic
tctgtaggcttcttgttgcactgtaacttctcgttttgttagatgtttgtatcatgctttaatggtacaaatttt

SEQ ID NO: 351671 - DNA, 75 bp, Artificial Sequence
  Synthetic
taccgtgtttatttggtcctattgcttccatgctacctaatataaatcaaatacttgattcctaggtctacagaa

SEQ ID NO: 351672 - DNA, 75 bp, Artificial Sequence
  Synthetic
aatatataggtaatacatataaatgtcgtggacacaactattattttgaaaaacccttacaactacagtagtatt

SEQ ID NO: 351673 - DNA, 75 bp, Artificial Sequence
  Synthetic
caacgccttagaaataagagacttaaacaacggacacctggaattattaccatagaagatgttagaaaaatgatg

SEQ ID NO: 351674 - DNA, 75 bp, Artificial Sequence
  Synthetic
gctgccaatatagtctgtgttacataatagtttactttcatgatttcattatcggtgtattttccaaatacatcc

SEQ ID NO: 351675 - DNA, 75 bp, Artificial Sequence
  Synthetic
actagagcaaccgtatgaataatcagatttaccccatctagtgcttctttcaccttattaagtcgtttatatcac

SEQ ID NO: 351676 - DNA, 75 bp, Artificial Sequence
  Synthetic
tttttgccaaatttatctactatcctggcttcaaatccaatggacattatttttttaaacactctttctgaagga

SEQ ID NO: 351677 - DNA, 75 bp, Artificial Sequence
  Synthetic
attgtatatagtttataactttaaccttcgatacgagaggttgtggatcttctacgacattgataactctgattt

SEQ ID NO: 351678 - DNA, 75 bp, Artificial Sequence
  Synthetic
cttgaacatcatctgcgctaattaaaagttttactatatacctgcctagaaattcggcaccaccagtaaccgcgt

SEQ ID NO: 351679 - DNA, 75 bp, Artificial Sequence
  Synthetic
acacggtcattgctgctgtcactcataaatatcggactacttattctattttacaaataatggctgtttgtataa

SEQ ID NO: 351680 - DNA, 75 bp, Artificial Sequence
  Synthetic
tagaccacgataatatcagaggagttatttactttgaaccagtccatggaaaagataaagttttaggatcagtta

SEQ ID NO: 351681 - DNA, 75 bp, Artificial Sequence
  Synthetic
ttggattaaaatccggaacgtataatttgataattcatcgttacggggatattagtcgaggatgtaattccatag

SEQ ID NO: 351682 - DNA, 75 bp, Artificial Sequence
  Synthetic
gcagtccagaaatatttatcggtaacatctttgtaaacagatatggtgtagcatatgtttatttagatacagatg

SEQ ID NO: 351683 - DNA, 75 bp, Artificial Sequence
  Synthetic
taaatatatctacaattattggaaaggcgttatctatttcaaaaaatgatcagagattagcgtgtggagttattg

SEQ ID NO: 351684 - DNA, 75 bp, Artificial Sequence
  Synthetic
gtatttcttacataaatgaaaagataatacattttcttacaattaacgagaatggcgtttgatatatcagttaat

SEQ ID NO: 351685 - DNA, 75 bp, Artificial Sequence
  Synthetic
gcatctaaaacaataaatgcattagtttacttttctactcagcaaaataaattagtcatacgtaatgaagttaat

SEQ ID NO: 351686 - DNA, 75 bp, Artificial Sequence
  Synthetic
tccatagagataagaggggtgcttccagaggaaactaatatcggttgcacggttaatacgccggttagtatgact

SEQ ID NO: 351687 - DNA, 75 bp, Artificial Sequence
  Synthetic
tacttgtataataagtatagttttaaactgattttagcagaatatataagacacagaaatactgtatccggcaat

SEQ ID NO: 351688 - DNA, 75 bp, Artificial Sequence
  Synthetic
atttattcggcattgatgacactagatgatttggttattaaacagtatggcgacattgatctattatttaatgag

SEQ ID NO: 351689 - DNA, 75 bp, Artificial Sequence
  Synthetic
aaacttaaagtggactccgattcgggattatttgactttgtcaactttgtaaaggatattatatgttgtgattct

SEQ ID NO: 351690 - DNA, 75 bp, Artificial Sequence
  Synthetic
atcattcctcataagataataaaaagtgtattgagagtgagtgagcatgaaaaagatttagtatttagcagtgcg

SEQ ID NO: 351691 - DNA, 75 bp, Artificial Sequence
  Synthetic
agaatagtagtagctctatctagtctagtatctaaacattgggaattgacaaataaaaagtataggtgtatggca

SEQ ID NO: 351692 - DNA, 75 bp, Artificial Sequence
  Synthetic
tagtatctaaacattgggaattgacaaataaaaagtataggtgtatggcattagccgaacatatagctgatagta

SEQ ID NO: 351693 - DNA, 75 bp, Artificial Sequence
  Synthetic
aaatacacaaatgcaaactccattacacaaatatttgtgtaaatttgtatatcataatattgaatatggtatccg

SEQ ID NO: 351694 - DNA, 75 bp, Artificial Sequence
  Synthetic
ttagccgaacatatagctgatagtattccaatatctgagctatctagactacgatacaatctatgtaagtattta

SEQ ID NO: 351695 - DNA, 75 bp, Artificial Sequence
  Synthetic
tttatagtggtgtgaatacaactaaggagaatagccagatcaaaagtagatggtatttctgaaaagaaagtatga

SEQ ID NO: 351696 - DNA, 75 bp, Artificial Sequence
  Synthetic
agagtaagactaatttgtaaaccatcttacttaaaatatgtaacaatagtacgatgaatgagtaataagaaatat

SEQ ID NO: 351697 - DNA, 75 bp, Artificial Sequence
  Synthetic
cgaggacacactgagagcatagaggatgaatttgattattttgaagacgatgattcgtcgacatgttctgtcgta

SEQ ID NO: 351698 - DNA, 75 bp, Artificial Sequence
  Synthetic
accgacagggaaacggatgtataattttttatagtgtgcaggatatgataaaaatataattgttgtatccattcc

SEQ ID NO: 351699 - DNA, 75 bp, Artificial Sequence
  Synthetic
cattctaatcacattatatgattctgtaaaaaattatactgtaacacaatgaagtagttgcatagatgtatatag

SEQ ID NO: 351700 - DNA, 75 bp, Artificial Sequence
  Synthetic
gtcagatactggtttgataaactttttattccacatgagtatgtttgactttatggttagacccgcatactttaa

SEQ ID NO: 351701 - DNA, 75 bp, Artificial Sequence
  Synthetic
caaatcactgaaaattggagttaggtattgacatctcagaatcagttgccgttctggaacattaaatgtattttt

SEQ ID NO: 351702 - DNA, 75 bp, Artificial Sequence
  Synthetic
tatgatatattccaacgcatttatgtgggtatacaacaagtcattactaatagagtattccaagagttttaattg

SEQ ID NO: 351703 - DNA, 75 bp, Artificial Sequence
  Synthetic
gctagtatttaacaagagaagagatttcaacagactgtttatgaactcgaatgccgccttattgtcgcttatatt

SEQ ID NO: 351704 - DNA, 75 bp, Artificial Sequence
  Synthetic
gatgatgtcgaattctcccaatatcatcactgatgagtagctcatcttgttatcaggatccaagctttctaaaga

SEQ ID NO: 351705 - DNA, 75 bp, Artificial Sequence
  Synthetic
atcactgatgagtagctcatcttgttatcaggatccaagctttctaaagacgtcattaaaccctcgatcatgaat

SEQ ID NO: 351706 - DNA, 75 bp, Artificial Sequence
  Synthetic
ggatttatcatcatcgtttttatgttggacataagcttagtccgtttgtccacatctatagacgatgatttctga

SEQ ID NO: 351707 - DNA, 75 bp, Artificial Sequence
  Synthetic
attattgcatatatctctctctttaactccaggaacttgtcaggatggtccactttaacatgttctcgcctaaga

SEQ ID NO: 351708 - DNA, 75 bp, Artificial Sequence
  Synthetic
gataaaaatctttggatggttgcatgtgacttttctctaaatgatgatgttgcccaagatcctctcttaaatgaa

SEQ ID NO: 351709 - DNA, 75 bp, Artificial Sequence
  Synthetic
gtgacttttctctaaatgatgatgttgcccaagatcctctcttaaatgaatccatcctatccttgtacaagatgg

SEQ ID NO: 351710 - DNA, 75 bp, Artificial Sequence
  Synthetic
acagtctattttccttagatggtttaatatttttgttacccatgatctataaaggtagacctaatcgtcttggat

SEQ ID NO: 351711 - DNA, 75 bp, Artificial Sequence
  Synthetic
gaccatatatttatttccagttttattatacgcataaattgtaaaaatatgttaggtttactaaaatgtctcgcg

SEQ ID NO: 351712 - DNA, 75 bp, Artificial Sequence
  Synthetic
gggcattaatcgtttttgaaggattggacaaatctggaaaaacaacacaatgtatgaacatcatggaatctatac

SEQ ID NO: 351713 - DNA, 75 bp, Artificial Sequence
  Synthetic
acatcatacatcaattaactacattcttataacatcgtaatcaaaagaattgcaattttgatgtataacaactgt

SEQ ID NO: 351714 - DNA, 75 bp, Artificial Sequence
  Synthetic
cgacaaacacgataaaatatcttaactttccgcagagatccactgtcactggaaagatgatagatgactatctaa

SEQ ID NO: 351715 - DNA, 75 bp, Artificial Sequence
  Synthetic
ctcgtaaaaaaacctataatgatcatatagttaatctattattttgtgcaaatagatgggagtttgcatctttta

SEQ ID NO: 351716 - DNA, 75 bp, Artificial Sequence
  Synthetic
tacaagaacaattagaacagggaattactttaatagttgatagatacgcgttctctggagtagcatatgccaccg

SEQ ID NO: 351717 - DNA, 75 bp, Artificial Sequence
  Synthetic
ctaaaggcgcgtcaatgactctcagtaagagttatgaatctggattgcctaaacccgacttagttatattcttgg

SEQ ID NO: 351718 - DNA, 75 bp, Artificial Sequence
  Synthetic
aaagttttaccattttaaaatttaaaaagtatttacatttttcactgtttagtcgcggatatggaatttgatcct

SEQ ID NO: 351719 - DNA, 75 bp, Artificial Sequence
  Synthetic
aatctggtagcaaagaaattaatagaaacgtcggcgaggaaatttatgaagatgtagcattccaacaaaaggtat

SEQ ID NO: 351720 - DNA, 75 bp, Artificial Sequence
  Synthetic
tacaagaatataaaaaaatgattgaagaaggagaagatattcattggcaaattatttcttctgaattcgaggaag

SEQ ID NO: 351721 - DNA, 75 bp, Artificial Sequence
  Synthetic
atgtaaagaaggagttgattaagaatatagttatagaggctatacatacggttactggaccagtggggcaactgt

SEQ ID NO: 351722 - DNA, 75 bp, Artificial Sequence
  Synthetic
tcatgtatacaatttctattagataataaacagaatagaaacattataccccaaccagttatgtttagcgtgtca

SEQ ID NO: 351723 - DNA, 75 bp, Artificial Sequence
  Synthetic
caaatatattaaacgtatgctgatgagtaatatatcaacattgataactacggacgcatttaaaaaaacagtatt

SEQ ID NO: 351724 - DNA, 75 bp, Artificial Sequence
  Synthetic
ggatgtaataaagtgaaattacatttttataaatagatgttagtgcagtgttaaaaaatggatgaaggatattac

SEQ ID NO: 351725 - DNA, 75 bp, Artificial Sequence
  Synthetic
tctggcaacttggaatcagttctcggatacgtatctgatatgcatactaaactcgcatcaataactcaattagtt

SEQ ID NO: 351726 - DNA, 75 bp, Artificial Sequence
  Synthetic
attgccaagatagaaactatagataatgatatattaaacaacgacattgtaaatttcattatgtgtagatcaaac

SEQ ID NO: 351727 - DNA, 75 bp, Artificial Sequence
  Synthetic
ttaaataatccatttatctctttcctagatactgtatatactattatagatcaagagatctatcagaacgagttg

SEQ ID NO: 351728 - DNA, 75 bp, Artificial Sequence
  Synthetic
tattaatatttctaaagtatccgtgtatagcctctttatttaccacagctccatataccaacatgcattccacta

SEQ ID NO: 351729 - DNA, 75 bp, Artificial Sequence
  Synthetic
attaattcattagacgacaataaaattatcgattgtatagttaataagtttatgagcttttataaggataaccta

SEQ ID NO: 351730 - DNA, 75 bp, Artificial Sequence
  Synthetic
gaaaatatagtagatgctatcattactctaaaatatataatgaataatccagattttaaaactacgtatgcagaa

SEQ ID NO: 351731 - DNA, 75 bp, Artificial Sequence
  Synthetic
gtactcggttccagaatagcggatatagatattaaacaagtaatacgtgagaatatactacaattgtctaatgat

SEQ ID NO: 351732 - DNA, 75 bp, Artificial Sequence
  Synthetic
gaatatactacaattgtctaatgatatccgcgaacgatatttgtgaaaatattaaaaaaaaatactttttttatt

SEQ ID NO: 351733 - DNA, 75 bp, Artificial Sequence
  Synthetic
aaatgacgtctcttcgtgaatttagaaaattatgctgtgctatatatcacgcatcaggatataaagaaaaatcta

SEQ ID NO: 351734 - DNA, 75 bp, Artificial Sequence
  Synthetic
aattaattagagactttataacagatagggatgataaatatttaatcattaagctattgcttcccggattagacg

SEQ ID NO: 351735 - DNA, 75 bp, Artificial Sequence
  Synthetic
atagaatttataacatgaacgataaacaaattataaaaatatatagtataatatttaaacaatctcagaaagata

SEQ ID NO: 351736 - DNA, 75 bp, Artificial Sequence
  Synthetic
tgctacaagatttaggatacggatatataggagacactattagtacattcttcaaagagaacacagaaatccgtc

SEQ ID NO: 351737 - DNA, 75 bp, Artificial Sequence
  Synthetic
caagaaataaaagcattttaactttagaagacgtggatagtttcttaactacattatcatccataactaaagaat

SEQ ID NO: 351738 - DNA, 75 bp, Artificial Sequence
  Synthetic
cgcatcaaataaaattattgactgacatcgcatccgtttgtacatgtaatgatttaaaatgtgtagtcatgctta

SEQ ID NO: 351739 - DNA, 75 bp, Artificial Sequence
  Synthetic
ttgataaagatctaaaaattaaagcgggtcctcggtacgtacttaacgctatcagtcctcatgcctatgatgttt

SEQ ID NO: 351740 - DNA, 75 bp, Artificial Sequence
  Synthetic
ttagaaaatctaataacttgaaagagataatagaaaatgaatctaaacaaaatctagactctatatctgtttctg

SEQ ID NO: 351741 - DNA, 75 bp, Artificial Sequence
  Synthetic
ttatgactccaattaatcccatgttagcggaatcgtgtgattctgtcaataaggcatttaaaaaatttccatcag

SEQ ID NO: 351742 - DNA, 75 bp, Artificial Sequence
  Synthetic
gaatgtttgctgaagtcaaatacgatggcgagagagtacaagttcataaaaataataacgagtttgcctttttta

SEQ ID NO: 351743 - DNA, 75 bp, Artificial Sequence
  Synthetic
aagcgcgaaagattttatttcacatcgtattttaacttcgcaataatttctggttagataacacactctaccagt

SEQ ID NO: 351744 - DNA, 75 bp, Artificial Sequence
  Synthetic
gtagaaacatgaaaccagtactctcttataaagtggattatctcaaagaatacataccgaaagcatttaaaaaag

SEQ ID NO: 351745 - DNA, 75 bp, Artificial Sequence
  Synthetic
ctacgtctatcgtattggattctgaaattgttcttgtagacgaacataatgtacagctcccgtttggaagtttag

SEQ ID NO: 351746 - DNA, 75 bp, Artificial Sequence
  Synthetic
gtatacacaaaaagaaagaatataaaaactctaacatgtgtttgtttgtgtttgactgtttgtactttgatggat

SEQ ID NO: 351747 - DNA, 75 bp, Artificial Sequence
  Synthetic
tcgatatgacggacattccattgtacaaacgaagatcttttctcaaagatgttatggtcgagatacccaatagaa

SEQ ID NO: 351748 - DNA, 75 bp, Artificial Sequence
  Synthetic
caaacgaagatcttttctcaaagatgttatggtcgagatacccaatagaatagtattctcagagttgacgaatat

SEQ ID NO: 351749 - DNA, 75 bp, Artificial Sequence
  Synthetic
aatcattgggaaacattacagatctaatgaccgacgataatataaacatcttgatactttttctagaaaaaaaat

SEQ ID NO: 351750 - DNA, 75 bp, Artificial Sequence
  Synthetic
tagtaacgagtctcagttaactgacgtattggatgatgcactaacaagaaaattagaaggattggtcttaaaaga

SEQ ID NO: 351751 - DNA, 75 bp, Artificial Sequence
  Synthetic
tattaatggagtatacgagccgggaaagagaagatggttaaaaataaagcgagactatttgaacgagggttccat

SEQ ID NO: 351752 - DNA, 75 bp, Artificial Sequence
  Synthetic
aaaaaaaagttttaccattttaaaatttaaaaagtatttacattttttcactgtttagtcgcggatatggaattt

SEQ ID NO: 351753 - DNA, 75 bp, Artificial Sequence
  Synthetic
ggcagattctgccgatttagtagtactaggtgcttactatggtaaaggagcaaagggtggtattatggcagtctt

SEQ ID NO: 351754 - DNA, 75 bp, Artificial Sequence
  Synthetic
aacgagacctacagtgatatgatgtcgttaaatttgacaattgtgtctgtctcagaatcaaatatagatcttatt

SEQ ID NO: 351755 - DNA, 75 bp, Artificial Sequence
  Synthetic
agtataactaaagttaatactacattaaaacttaaaaaaaataataatatcactattacaattaataagtataaa

SEQ ID NO: 351756 - DNA, 75 bp, Artificial Sequence
  Synthetic
tctaatgggttgttacgatgatgaatccggtaaatggaagacggtaactaaatgttcaggacatgatgataatac

SEQ ID NO: 351757 - DNA, 75 bp, Artificial Sequence
  Synthetic
gttaagggttttgcaagaccaattaacgatggttaaaattaacaaggatcccaaaaaaattccagagtggttggt

SEQ ID NO: 351758 - DNA, 75 bp, Artificial Sequence
  Synthetic
agttaataaaatctatattcccgattttgtagtagaggatccgaaacaatctcaaatatgggaaatttcaggagc

SEQ ID NO: 351759 - DNA, 75 bp, Artificial Sequence
  Synthetic
agagtttacatcttccaagtcacatacagcgaatggaatatcgattagatttcctagatttactaggattagaga

SEQ ID NO: 351760 - DNA, 75 bp, Artificial Sequence
  Synthetic
agataaaacgtggaaagaatctactcatctaaacgatttagtaaatttgactaaatcttaatagttacatacaaa

SEQ ID NO: 351761 - DNA, 75 bp, Artificial Sequence
  Synthetic
ctgaaaattaaaataacactatttagttggtgatcgccatggatggtgttattgtatactgtctaaacgcgttag

SEQ ID NO: 351762 - DNA, 75 bp, Artificial Sequence
  Synthetic
taaaacatggtgaggaaataaatcatataaaaaatgatttcatgattaaaccatgttgtgaaagagtttgtgaaa

SEQ ID NO: 351763 - DNA, 75 bp, Artificial Sequence
  Synthetic
aagtcaagaacgtacacatcgacggacaatctaaaaacaatacagtgattgcagatttgccatatctggataatg

SEQ ID NO: 351764 - DNA, 75 bp, Artificial Sequence
  Synthetic
ctgtattggatgtatgcaaatcagtatataaaaagaatgtatcaagaatatccagatttgctaatttgataaaga

SEQ ID NO: 351765 - DNA, 75 bp, Artificial Sequence
  Synthetic
tagatgatgatgacaagactcctaccggtgtatataattattttaaacctaaagatgctatttctgttattatat

SEQ ID NO: 351766 - DNA, 75 bp, Artificial Sequence
  Synthetic
ccataggaaaggataaagatgtctgtgaactattaatcgcatccgataaagcgtgtgcgtgtatagagttaaatt

SEQ ID NO: 351767 - DNA, 75 bp, Artificial Sequence
  Synthetic
taacttattttaagattaagtgctattgtacttaattttttgttctataaactgaatatatagctacaattattg

SEQ ID NO: 351768 - DNA, 75 bp, Artificial Sequence
  Synthetic
catataaagtagccattcttcccatgaatgtttccttctttaccaaaggaaatgcgtcattgattattctcctgt

SEQ ID NO: 351769 - DNA, 75 bp, Artificial Sequence
  Synthetic
acgggtttatttatgaccggcaaccatgaatttacagagattatctctggctatatatcttactgtgacatgttc

SEQ ID NO: 351770 - DNA, 75 bp, Artificial Sequence
  Synthetic
ttgacttctctatcaatgcggcacctctcttaagaagtgtaaccgataataatgttgttatatctagacacaaac

SEQ ID NO: 351771 - DNA, 75 bp, Artificial Sequence
  Synthetic
cttagaaataagagacttaaacaacggacacctggaattattaccatagaagatgttagaaaaatgatgctggtt

SEQ ID NO: 351772 - DNA, 75 bp, Artificial Sequence
  Synthetic
atatatatatatgggagtaaagcatataacgtaaccagaattgtaaaattagaggtatgggataaaataatacct

SEQ ID NO: 351773 - DNA, 75 bp, Artificial Sequence
  Synthetic
gtcttcatggcgagattccgagttccaattggttcaagttttatataagtataaagtccaactattgttctatat

SEQ ID NO: 351774 - DNA, 75 bp, Artificial Sequence
  Synthetic
tctactatgcaattaccaaaaggccttgtaacttcactaggtagtaatttgactattgcgtgtaaagtatcgttg

SEQ ID NO: 351775 - DNA, 75 bp, Artificial Sequence
  Synthetic
tatatatggtagttgatggatctgtgatgtatgcaatagctgataataaaactcacacaattattagcaaaaata

SEQ ID NO: 351776 - DNA, 75 bp, Artificial Sequence
  Synthetic
tattagacaatactacaattaacgatgagtgcagatgctgttattttgaaccacagattaagattctcgatagag

SEQ ID NO: 351777 - DNA, 75 bp, Artificial Sequence
  Synthetic
atgagatgcttaatggatcatcgtgtgatatgaacagacattgtattatgatgaatttaccagatataggagaat

SEQ ID NO: 351778 - DNA, 75 bp, Artificial Sequence
  Synthetic
tcggttccagtatattggggaaatatgaacctgacatgattaagattgctctttcagtggctggtaatttaataa

SEQ ID NO: 351779 - DNA, 75 bp, Artificial Sequence
  Synthetic
gaaatcaagactacattcccgggagacgcggctatagctactacgtttacggtatagcctctagataatttttta

SEQ ID NO: 351780 - DNA, 75 bp, Artificial Sequence
  Synthetic
aatatttacaatatatgtaatcattatccagattgaacatagagtttgcacttgccatgattcgttatataacta

SEQ ID NO: 351781 - DNA, 75 bp, Artificial Sequence
  Synthetic
acgcggctatagctactacgtttacggtatagcctctagataattttttaagcacaaaataaaaaacataatttt

SEQ ID NO: 351782 - DNA, 75 bp, Artificial Sequence
  Synthetic
aaactagtctatttcatactattttgtgtgatcaccatggacataaagatagatattagtatttttggtgataaa

SEQ ID NO: 351783 - DNA, 75 bp, Artificial Sequence
  Synthetic
gtgtgatcaccatggacataaagatagatattagtatttttggtgataaatttacggtgactactaggagggaaa

SEQ ID NO: 351784 - DNA, 75 bp, Artificial Sequence
  Synthetic
tttacggtgactactaggagggaaaatgaagaaagaaaaaatatctacctctccaaaaagaaaaatttactactg

SEQ ID NO: 351785 - DNA, 75 bp, Artificial Sequence
  Synthetic
atgttatcaaacctaattatcttgagcacgataacttattagatagagatgagatgtctactattctagaggaat

SEQ ID NO: 351786 - DNA, 75 bp, Artificial Sequence
  Synthetic
attttatgtacagaggtctattaggcctcagaataaaatatggacgactttttaacgaaattagaaaattcgaca

SEQ ID NO: 351787 - DNA, 75 bp, Artificial Sequence
  Synthetic
atgatgcggaagaacaattcggtactatagaagaactcaaacagaaacttagattaaatgctgaagagggagccg

SEQ ID NO: 351788 - DNA, 75 bp, Artificial Sequence
  Synthetic
tgtgtgcgtgtgtggtagatgtttggagaaaggagaaactgttttctagatggaaatattgtttacgagctatta

SEQ ID NO: 351789 - DNA, 75 bp, Artificial Sequence
  Synthetic
aactgtttattgatgatcccatacttgataagataaaatctatactgcagaatagactagtgtatgtggaaatgt

SEQ ID NO: 351790 - DNA, 75 bp, Artificial Sequence
  Synthetic
tatagaaaattaaaagttaatgagagcaaaatataatgttgtattctaatcccatatttattattttcacggaga

SEQ ID NO: 351791 - DNA, 75 bp, Artificial Sequence
  Synthetic
cccatatttattattttcacggagatataggtgtagttttgcagtgaccgtcctgataatattatctatatgatg

SEQ ID NO: 351792 - DNA, 75 bp, Artificial Sequence
  Synthetic
ggtggatatgatcagtacccgtatagaagttcaaaggttatagtgtacaatacatgtacaaattcttggatatat

SEQ ID NO: 351793 - DNA, 75 bp, Artificial Sequence
  Synthetic
gatataccagagctaaaatatcctcgttctaattgtggaggagttgctgatgatgaatacatttattgcataggc

SEQ ID NO: 351794 - DNA, 75 bp, Artificial Sequence
  Synthetic
tgatgaatacatttattgcataggcgatcaggattcatcgttgatatctagtattgatagatggaagccatcaaa

SEQ ID NO: 351795 - DNA, 75 bp, Artificial Sequence
  Synthetic
atgcgagagacaaaatgtgatattggtgtagcgatgttaaacggattaatatatgtcataggcggagttgttaaa

SEQ ID NO: 351796 - DNA, 75 bp, Artificial Sequence
  Synthetic
ggtgacacatgtaccgacacacttgagagtttatcagaagatggatggatgatgcatcaacgtcttccaataaat

SEQ ID NO: 351797 - DNA, 75 bp, Artificial Sequence
  Synthetic
gatgcatcaacgtcttccaataaatgtccaatatgtcgacgattgttcataccggcaaaatttatatatcaggag

SEQ ID NO: 351798 - DNA, 75 bp, Artificial Sequence
  Synthetic
gctacacaatagtagtgtagttaatggaatatcaaatctagtccttagctataatccgatatatgatgaatggac

SEQ ID NO: 351799 - DNA, 75 bp, Artificial Sequence
  Synthetic
tactaacttttgattttaacgacgacatattagtaactgttttccattttttttttttttttttttttttttttt

SEQ ID NO: 351800 - DNA, 75 bp, Artificial Sequence
  Synthetic
caaattatcatcattaaatattcctagaattaatcctgctctatggtcagtgcataataaagtatatgtaggagg

SEQ ID NO: 351801 - DNA, 75 bp, Artificial Sequence
  Synthetic
tttttttttttttttttttttttttttttttttttttttcgttttaagatctacccacggatacgaaataaacat

SEQ ID NO: 351802 - DNA, 75 bp, Artificial Sequence
  Synthetic
aatatctgatgatattcaaactaatacatctgaaacatacaacaaagaaaaagatcgttggacattggataatag

SEQ ID NO: 351803 - DNA, 75 bp, Artificial Sequence
  Synthetic
tcacgtgttaccacgcaattatataatgtataaatgcgaaccgattaaacataaatatccattggaaaaacacag

SEQ ID NO: 351804 - DNA, 75 bp, Artificial Sequence
  Synthetic
tacacgaatgattttctaaagtacttggaaagttttatatgtagttgatagaacaaaatacatattttttgtaaa

SEQ ID NO: 351805 - DNA, 75 bp, Artificial Sequence
  Synthetic
aataaatcactttttatactaatatgacacgattgtcaatacttttgttactaatatcattagtatactctacac

SEQ ID NO: 351806 - DNA, 75 bp, Artificial Sequence
  Synthetic
cttatcctcagacacagatatctaaaaaaataggtgatgatgcaactctatcatgtagtagaaataatataaatg

SEQ ID NO: 351807 - DNA, 75 bp, Artificial Sequence
  Synthetic
caacaagttcctcaacgtgattattctccaccacatagacctcctccaccacttcctcctaaaccagttccagct

SEQ ID NO: 351808 - DNA, 75 bp, Artificial Sequence
  Synthetic
attatgttgttatgagtgcttggtataaggagcccaattccattattcttttagctgccaaaagtgacgtcttgt

SEQ ID NO: 351809 - DNA, 75 bp, Artificial Sequence
  Synthetic
ttttctggaagtggatatacatagttgtgatcatcattattgctagccttatcttctatatcatctatatcatct

SEQ ID NO: 351810 - DNA, 75 bp, Artificial Sequence
  Synthetic
attttgataattataccaaggataaaatatcatacgattctccatacgatgatctagttacaactattacaatta

SEQ ID NO: 351811 - DNA, 75 bp, Artificial Sequence
  Synthetic
aatcattgactgctaaagatgccggtacttatgtatgtgcattctttatgacatcaactacaaatgatactgata

SEQ ID NO: 351812 - DNA, 75 bp, Artificial Sequence
  Synthetic
aagtagattatgaagaatactctacagagttgattgtaaacacagatagtgaatcgactatagacataatactat

SEQ ID NO: 351813 - DNA, 75 bp, Artificial Sequence
  Synthetic
gaaaaataacaaatctatttggattttttgcaaggattggttccataactaaattaacaatagtagtaatttttt

SEQ ID NO: 351814 - DNA, 75 bp, Artificial Sequence
  Synthetic
ctggatcttcacattcaccggaaactagttctgagaaacctgattatataaataattttaattgctcgttggtat

SEQ ID NO: 351815 - DNA, 75 bp, Artificial Sequence
  Synthetic
tagttctgagaaacctgattatataaataattttaattgctcgttggtatttgaaatcgcgactccgggaccaat

SEQ ID NO: 351816 - DNA, 75 bp, Artificial Sequence
  Synthetic
tttccatatcagcattgctttcattattacgtctgtagtcacttaactatctttcaagatttgaaattctatctc

SEQ ID NO: 351817 - DNA, 75 bp, Artificial Sequence
  Synthetic
tactgataatgtagaaaatcatacagacactgtcacatacactagtgatatcattaatacagtaagtacatcatc

SEQ ID NO: 351818 - DNA, 75 bp, Artificial Sequence
  Synthetic
atcatacagtcacagacactgtctcatacactacagtaagtacatcatctgaaattgtcactactaaatcaaccg

SEQ ID NO: 351819 - DNA, 75 bp, Artificial Sequence
  Synthetic
atacactacagtaagtacatcatctgaaattgtcactactaaatcaaccgccaatgatgcgcacaatgataatga

SEQ ID NO: 351820 - DNA, 75 bp, Artificial Sequence
  Synthetic
accatctactgtgtcaccaacaactgtaaaaaacatcacgaaatctataggtaagtatagtactaaagactatgt

SEQ ID NO: 351821 - DNA, 75 bp, Artificial Sequence
  Synthetic
caaagtatttggtattgcagcattaattatattgtcggccgtggcaattttctgtattacgtattatatatgtaa

SEQ ID NO: 351822 - DNA, 75 bp, Artificial Sequence
  Synthetic
taaacgttcacgtaaatacaaaacagaaaacaaagtctagattttgacttacataaatgtctggaatagtaaaat

SEQ ID NO: 351823 - DNA, 75 bp, Artificial Sequence
  Synthetic
ctatcattttgagcgggtcatctggtttaggaaagacagccatagccaaaagactatgggaatatatttggattt

SEQ ID NO: 351824 - DNA, 75 bp, Artificial Sequence
  Synthetic
gcaatctggaagggaatagccaccggaaactttctagaacatactgagtttttaggaaatatttacggaacttct

SEQ ID NO: 351825 - DNA, 75 bp, Artificial Sequence
  Synthetic
aaaacagctgtgaatacagcggctattaataatcgtatttgtgtgatggatttaaacatcgacggtgttagaagt

SEQ ID NO: 351826 - DNA, 75 bp, Artificial Sequence
  Synthetic
ttaataatcgtatttgtgtgatggatttaaacatcgacggtgttagaagtcttaaaaatacttacctaatgcctt

SEQ ID NO: 351827 - DNA, 75 bp, Artificial Sequence
  Synthetic
cgtcgtagaaacactgaagcggacgataagattcatcgtcgcgcgatgttggcaaaaacggatatggatgaggcc

SEQ ID NO: 351828 - DNA, 75 bp, Artificial Sequence
  Synthetic
aacgaagcaggtctattcaacactactattattgaagataatgtgaatttagcatatagtaagttaattcagata

SEQ ID NO: 351829 - DNA, 75 bp, Artificial Sequence
  Synthetic
tgactgacttaaaacttgataattaataatataattcgtttttatatgtgactattttaacgtctaaatgtatta

SEQ ID NO: 351830 - DNA, 75 bp, Artificial Sequence
  Synthetic
gttaaatattaaacttaccacgtaaaacttaaaatttaaaatggtatttcattgacggatgatcatacattatga

SEQ ID NO: 351831 - DNA, 75 bp, Artificial Sequence
  Synthetic
actttcaaggacttgtcttaactgacaattgcaaaaatcaatgggtcgttggaccattaataggaaaaggtggat

SEQ ID NO: 351832 - DNA, 75 bp, Artificial Sequence
  Synthetic
tcggtagtatttatactactaatgacaataattatgtagtaaaaatagagcccaaagctaacggatcattattta

SEQ ID NO: 351833 - DNA, 75 bp, Artificial Sequence
  Synthetic
ctgaacaggcattttatactagagtacttaaaccatccgttatcgaagaatggaaaaaatctcaccatataagcc

SEQ ID NO: 351834 - DNA, 75 bp, Artificial Sequence
  Synthetic
acgtaggagttatcacatgcaaggcatttggtctatacaaatccattaatacggaatatagattcttggtaatta

SEQ ID NO: 351835 - DNA, 75 bp, Artificial Sequence
  Synthetic
atttggtctatacaaatccattaatacggaatatagattcttggtaattaatagattgggtgtagatctagatgc

SEQ ID NO: 351836 - DNA, 75 bp, Artificial Sequence
  Synthetic
atagattgggtgtagatctagatgcggtgatcagggctaacaataatagactaccgaaaagatcggtgatgttag

SEQ ID NO: 351837 - DNA, 75 bp, Artificial Sequence
  Synthetic
taggaatagaaatcttgaataccatacaatttatgcacgagcaaggatattctcatggagatattaaagcgagca

SEQ ID NO: 351838 - DNA, 75 bp, Artificial Sequence
  Synthetic
atatagttttggatcaaatggataagaataaattatatctagtggattacggattggtttctaaattcatgtcta

SEQ ID NO: 351839 - DNA, 75 bp, Artificial Sequence
  Synthetic
acggcgaacatgttccatttataagaaatccaaataaaatggataatggtactctagaatttacacctatagatt

SEQ ID NO: 351840 - DNA, 75 bp, Artificial Sequence
  Synthetic
cacataaaggatacgttgtatcgagacgtggagatctagaaacacttggatattgtatgattagatggttgggag

SEQ ID NO: 351841 - DNA, 75 bp, Artificial Sequence
  Synthetic
gtatcttgccatggactaagatagctgaaacaaagaattgcgcattagtaagtgctacaaaacagaaatatgtga

SEQ ID NO: 351842 - DNA, 75 bp, Artificial Sequence
  Synthetic
acaatactacgactttgttaatgaccagtttgcaatatgcgcctagagaattgctgcaatatattaccatggtaa

SEQ ID NO: 351843 - DNA, 75 bp, Artificial Sequence
  Synthetic
actctttgacatattttgaggaacccaattacgataagtttcggcacatattaatgcagggtgcatattattaag

SEQ ID NO: 351844 - DNA, 75 bp, Artificial Sequence
  Synthetic
ttaatgcagggtgcatattattaagtgtgaggttttggtttgatgtaaaatttttgttgataaaaattaaaaaat

SEQ ID NO: 351845 - DNA, 75 bp, Artificial Sequence
  Synthetic
aacttaatttattattgatctcgtgtgtacaaccgaaatcatggcgatttttacacacacgtcttggcgggtacg

SEQ ID NO: 351846 - DNA, 75 bp, Artificial Sequence
  Synthetic
tgtacaaccgaaatcatggcgatttttacacacacgtcttggcgggtacgacgagaatctttatacctttcctgg

SEQ ID NO: 351847 - DNA, 75 bp, Artificial Sequence
  Synthetic
aatatcattaactgttgccaatgatgttaggaaatattctgttgtgtcagtttataataacaagtggacattgta

SEQ ID NO: 351848 - DNA, 75 bp, Artificial Sequence
  Synthetic
tgtatccactttaataatatcatagctgtaacatccttgtgattttacgttgacgttttcgtgggataagatagt

SEQ ID NO: 351849 - DNA, 75 bp, Artificial Sequence
  Synthetic
aaagaaatatatgtggtgttacagttaggtgaacaagagatatattggagcattgctgcatatgtttgagtgcaa

SEQ ID NO: 351850 - DNA, 75 bp, Artificial Sequence
  Synthetic
tgaatatctacaaattggagatccaatccatgatcaagaaggaaatcaaatctctatcgtcacatatcgctacaa

SEQ ID NO: 351851 - DNA, 75 bp, Artificial Sequence
  Synthetic
aactactatgctctaagcggaatcgggtacaaaagtctagacttgtgtttggaaggagtagggattcatcatcac

SEQ ID NO: 351852 - DNA, 75 bp, Artificial Sequence
  Synthetic
gtacttgaaacaggaaacgctgtatatggaaaagttcaacatgattattctactatcaaagagaaggccaaagaa

SEQ ID NO: 351853 - DNA, 75 bp, Artificial Sequence
  Synthetic
atcttcttccagcgcatatagtctaatagcgatttaaacgcgtgatagtttataccattcaatataatcgcttca

SEQ ID NO: 351854 - DNA, 75 bp, Artificial Sequence
  Synthetic
taattgattaccacgtctggataggagattgtattggtaaagttactgctgtagacgtacatggaaaggaaatta

SEQ ID NO: 351855 - DNA, 75 bp, Artificial Sequence
  Synthetic
tgagaatgtgattcaaaaagggtgcggtactacagataccaaatctggtaaaagttaaacttggggataatgata

SEQ ID NO: 351856 - DNA, 75 bp, Artificial Sequence
  Synthetic
cagaaaatctttccactaccatatcagctctcctgaattccggcggcggtaccatcaaggtaacctcttaggaag

SEQ ID NO: 351857 - DNA, 75 bp, Artificial Sequence
  Synthetic
ttgtgaatggtaaagaatgctgttatatacatcttcattcatctaatcagaatcttatgcctagtactgtaaaaa

SEQ ID NO: 351858 - DNA, 75 bp, Artificial Sequence
  Synthetic
acggatcggtatctgaaggtgtaaccgatgatacttcactcatcgattcaacaaaactcaaatcgtgtgtctgaa

SEQ ID NO: 351859 - DNA, 75 bp, Artificial Sequence
  Synthetic
ccaatttgtatatgtgatctatgacatcatgcatccaaatggatctcataactgctctagattatcttagtgaac

SEQ ID NO: 351860 - DNA, 75 bp, Artificial Sequence
  Synthetic
taacacctaattacatgaagttattagtgtataacggaaatgatataaacgcacgcggcgaaaatacacaaatgc

SEQ ID NO: 351861 - DNA, 75 bp, Artificial Sequence
  Synthetic
gttcttcaatagatcagaacttcaggcgggtgaatcagtcaaattcggtaattccgttaatattaaaaatacatc

SEQ ID NO: 351862 - DNA, 75 bp, Artificial Sequence
  Synthetic
ttagggtcagtactcattatcatatattggcagcagctattacttattttattttatttttctttattttattat

SEQ ID NO: 351863 - DNA, 75 bp, Artificial Sequence
  Synthetic
tgtttcagctaagcaactaagaacacgtatacggcaacagcttccctctatactctcatcttttgccaacacaga

SEQ ID NO: 351864 - DNA, 75 bp, Artificial Sequence
  Synthetic
gggtggatatttgttcattggattggataataatacacacaaagtaattggattcatggcgggacacgactgcat

SEQ ID NO: 351865 - DNA, 75 bp, Artificial Sequence
  Synthetic
tcctacattcctaaactttgtatctgacataagaacagtgagaggatcgactccatagtggacaacattaataca

SEQ ID NO: 351866 - DNA, 75 bp, Artificial Sequence
  Synthetic
aacgataacttgatttcaaaattatcaatggagatacaacgtgaaatactttattactccattaaataatgtatc

SEQ ID NO: 351867 - DNA, 75 bp, Artificial Sequence
  Synthetic
acctcgacatacgtgtgcgctatcaaagtggaaagatgttgctgtgctgtgtttacagattggccagaatcatgg

SEQ ID NO: 351868 - DNA, 75 bp, Artificial Sequence
  Synthetic
aatgtacatacatcactgtcatctaccaattcatccaacaacataagctttttaaaatcatcattataataggat

SEQ ID NO: 351869 - DNA, 75 bp, Artificial Sequence
  Synthetic
tatatggatactagtggtatcaagaagtattctccagatgaatgggtgtcatctataaaattttaattaagaact

SEQ ID NO: 351870 - DNA, 75 bp, Artificial Sequence
  Synthetic
atctataaaattttaattaagaactatagagaacaaataataggttgtaatacatatagacaataactaacaatt

SEQ ID NO: 351871 - DNA, 75 bp, Artificial Sequence
  Synthetic
ttgttttctttttcttacacacatcgctaattatgaaaaagtaaatgatgaaatgtatgagatggtgagatggac

SEQ ID NO: 351872 - DNA, 75 bp, Artificial Sequence
  Synthetic
aattagtaactgttatctctttttaactaactcttatatacctattaatacatcgtattatagttcttaatcatt

SEQ ID NO: 351873 - DNA, 75 bp, Artificial Sequence
  Synthetic
gattcacttattgttttaataaactaacattgttaattgaaaagggataacatgttatagaatataaattatata

SEQ ID NO: 351874 - DNA, 75 bp, Artificial Sequence
  Synthetic
ggtaacctagttgggactaggggatgttgataagctcgagagtatatgttgttgaacgttattgtttaagaaata

SEQ ID NO: 351875 - DNA, 75 bp, Artificial Sequence
  Synthetic
tggatttttttaaaaaggaaatacttgactggagtatatatttatctcttcattatatagcacatgcgtgttcca

SEQ ID NO: 351876 - DNA, 75 bp, Artificial Sequence
  Synthetic
ctagttattaaacactgcgatctgaataaacaactaaaatgtggtatgtctccattacattgctatgtgatgaat

SEQ ID NO: 351877 - DNA, 75 bp, Artificial Sequence
  Synthetic
gatccactttaaaagtgtcataccgggttctttttattcttttaaacagatcaatggtgtgatgttgattaggtc

SEQ ID NO: 351878 - DNA, 75 bp, Artificial Sequence
  Synthetic
attcttccacatcccatataatacaggaatataatcttattcgaacatacaaaaaagtggataaaacaatagttg

SEQ ID NO: 351879 - DNA, 75 bp, Artificial Sequence
  Synthetic
attttttatctaggtggccaaatttattccatattttagaatatggggaaaatattctacatatttattctatgg

SEQ ID NO: 351880 - DNA, 75 bp, Artificial Sequence
  Synthetic
atgatgctaatacgaatattataattttttttctagataacgtattaaatattaataagaacgggtcatttatac

SEQ ID NO: 351881 - DNA, 75 bp, Artificial Sequence
  Synthetic
tttttttctagataacgtattaaatattaataagaacgggtcatttatacacaatctcgggttatcatcatccat

SEQ ID NO: 351882 - DNA, 75 bp, Artificial Sequence
  Synthetic
taatataaaagaatatgtatatcaattagttaataatgatcatctagataatgggataagactaatgcttgaaaa

SEQ ID NO: 351883 - DNA, 75 bp, Artificial Sequence
  Synthetic
tggacgtagaacaagacattttttatcctatatattagatacagttaatatctatatatgtattttaataaatca

SEQ ID NO: 351884 - DNA, 75 bp, Artificial Sequence
  Synthetic
tggattttacatagatgctgtggacagttacggttgtacattattacatagatgtatatatcactataagaaatc

SEQ ID NO: 351885 - DNA, 75 bp, Artificial Sequence
  Synthetic
agaatcagaatcatacaatgaattaattaaaatattgttaaataatggatcagatgtagataaaaaagatacgca

SEQ ID NO: 351886 - DNA, 75 bp, Artificial Sequence
  Synthetic
tggaaacacgccatttatcctattatgtaaacacgatatagacaacgtagaattgtttgagatatgtttagagaa

SEQ ID NO: 351887 - DNA, 75 bp, Artificial Sequence
  Synthetic
tgctaatatagactctgtagactttaatggatatacacctcttcattatgtctcatgtcgcaataaatatgattt

SEQ ID NO: 351888 - DNA, 75 bp, Artificial Sequence
  Synthetic
tgtaaagtcattaatttctaaaggagcaaatgttaatacgcgtaatagattcggaactactccattttattgtgg

SEQ ID NO: 351889 - DNA, 75 bp, Artificial Sequence
  Synthetic
aattatacacggtatctcgcttataaaactatatttggaatcagacacagagttagaaatagataatgaacatat

SEQ ID NO: 351890 - DNA, 75 bp, Artificial Sequence
  Synthetic
tatttagaggagttattgatattaactatcgtactatatacaacgaaacatctatttacgacgctgttagttata

SEQ ID NO: 351891 - DNA, 75 bp, Artificial Sequence
  Synthetic
atgcgtataatatgttggtctatctattaaacagaaatggtgattttgagacgattactactagtggatgtacat

SEQ ID NO: 351892 - DNA, 75 bp, Artificial Sequence
  Synthetic
gtatttcgaaagcagttgcgaacaacaacaaaataataatggaagtactattgtctaaacaaccatctttgaaaa

SEQ ID NO: 351893 - DNA, 75 bp, Artificial Sequence
  Synthetic
ttatgatactgtctataatagcaattactaaacataaacaacataatacaaatttattaaaaatgtgtataaaat

SEQ ID NO: 351894 - DNA, 75 bp, Artificial Sequence
  Synthetic
atactgcgtgtatgacagattatgatactcttatagatgtacagtcgttacagcaatataaatggtatattttaa

SEQ ID NO: 351895 - DNA, 75 bp, Artificial Sequence
  Synthetic
aatgtttcgatgaaatagatatcatgaagagatgttatataaaaaataaaactgtattccaattagttttttgta

SEQ ID NO: 351896 - DNA, 75 bp, Artificial Sequence
  Synthetic
acggtgattactacattattaaatcatgaagtccgtattatacttgtatatattgtttctctcatgtataataat

SEQ ID NO: 351897 - DNA, 75 bp, Artificial Sequence
  Synthetic
ctaaagacattaatactttaatgagatacggcagacatccttctttcgttaaatatactagtctcgacgtatacg

SEQ ID NO: 351898 - DNA, 75 bp, Artificial Sequence
  Synthetic
ctaagggattttactcctctccttccgtaaagacgagtttagtatttgagacattaacaacgaccgataataaaa

SEQ ID NO: 351899 - DNA, 75 bp, Artificial Sequence
  Synthetic
gaagtcgtgtacgtaatatcatagcatctattagatatcgtcagagattaattagtctattatccaagaagctgg

SEQ ID NO: 351900 - DNA, 75 bp, Artificial Sequence
  Synthetic
atgtgggagataaatgggcatgttttcctaacgaaataaaatataaaatattggaaaactttaacgataacgaac

SEQ ID NO: 351901 - DNA, 75 bp, Artificial Sequence
  Synthetic
tatcgacatatctaaaaatcttataaacactattaaaatataaaacctaagtaggataaaacacattacatcatt

SEQ ID NO: 351902 - DNA, 75 bp, Artificial Sequence
  Synthetic
gtttccttttattgcttaacagtgtatactatttttaacactcataaataaaaatgaaaacgatttccgttgtta

SEQ ID NO: 351903 - DNA, 75 bp, Artificial Sequence
  Synthetic
ataataataaacggaagagatgcagcaccgtatacaccacccaatggaaagtgtaaagacaccgaatacaaacgc

SEQ ID NO: 351904 - DNA, 75 bp, Artificial Sequence
  Synthetic
tataaagagatagataatactcggccgacataatgttgtccattgtagtataaaaattaatatttctatttctat

SEQ ID NO: 351905 - DNA, 75 bp, Artificial Sequence
  Synthetic
cgttgttatgcgtactacctgcggttgtttattcaacatgtactgtacccactatgaataacgctaaattaacgt

SEQ ID NO: 351906 - DNA, 75 bp, Artificial Sequence
  Synthetic
ctccgggaacatacgcttccagattatgtgatagcaagactaacacacaatgtacaccgtgtggttcgggtacct

SEQ ID NO: 351907 - DNA, 75 bp, Artificial Sequence
  Synthetic
ctaccgaaacatcgtttaatgataaacaaaaagttacatttacatgtgattcgggatattattctttggatccaa

SEQ ID NO: 351908 - DNA, 75 bp, Artificial Sequence
  Synthetic
atgctgtctgtgaaacagataaatggaaatacgaaaatccatgtaaaaaaatgtgtacagtttctgattatgtct

SEQ ID NO: 351909 - DNA, 75 bp, Artificial Sequence
  Synthetic
ctgaactatataataaaccgctatacgaagtaaatgccatcataacactaatttgtaaagacgaaacaaaatatt

SEQ ID NO: 351910 - DNA, 75 bp, Artificial Sequence
  Synthetic
ttcgttgtgaagaaaaaaatggaaatacttcttggaatgatactgttacgtgtcctaatgcggaatgtcaatctc

SEQ ID NO: 351911 - DNA, 75 bp, Artificial Sequence
  Synthetic
ttcaattagatcacggatcgtgtcaaccagttaaagaaaaatactcatttggggaacatataactatcaactgtg

SEQ ID NO: 351912 - DNA, 75 bp, Artificial Sequence
  Synthetic
atgttggatatgaggttattggtgcttcgtacataacttgtacagctaattcttggaatgttattccatcatgtc

SEQ ID NO: 351913 - DNA, 75 bp, Artificial Sequence
  Synthetic
aacaaaaatgtgatataccgtctctatctaatggattaatttccggatctacattttctatcggtggcgttatac

SEQ ID NO: 351914 - DNA, 75 bp, Artificial Sequence
  Synthetic
atcttagttgtaaaagtggttttatactaacgggatctccatcatccacatgtatcgacggtaaatggaatcccg

SEQ ID NO: 351915 - DNA, 75 bp, Artificial Sequence
  Synthetic
tactcccaatatgtatacgatctaacgaagaatttgatccagtggaggatggtcccgatgatgagacagatctga

SEQ ID NO: 351916 - DNA, 75 bp, Artificial Sequence
  Synthetic
gcaaactctcaaaagacgttgtacaatatgaacaagaaatagaatcgttagaagcaacttatcatataatcatag

SEQ ID NO: 351917 - DNA, 75 bp, Artificial Sequence
  Synthetic
tagcgttgacaattatgggcgtcatatttttaatctccgttatagtattagtttgttcctgtaacaaaaataatg

SEQ ID NO: 351918 - DNA, 75 bp, Artificial Sequence
  Synthetic
accaatataagttccataaattgttgctgtgaatataaatccgttaaaataataaataattaataacgaacaagt

SEQ ID NO: 351919 - DNA, 75 bp, Artificial Sequence
  Synthetic
atcaaaagattaaagaattatagctagaattaattgagatgtcttcttcagtggatgttgatatctacgatgctg

SEQ ID NO: 351920 - DNA, 75 bp, Artificial Sequence
  Synthetic
ccagagtatttttacttaggcactattataacaagagatttattgtgtatggaagaagtaaccatattacataat

SEQ ID NO: 351921 - DNA, 75 bp, Artificial Sequence
  Synthetic
atatacaggctatttacaagatgcgccgtaccgttcgatgatatagtacgtactatgccaaatgaatcacgtgtt

SEQ ID NO: 351922 - DNA, 75 bp, Artificial Sequence
  Synthetic
agtattaattcgtgacagatccatgtctgaaacgagacgctaattagtgtataatttttgtcatactgctccaga

SEQ ID NO: 351923 - DNA, 75 bp, Artificial Sequence
  Synthetic
taacaatgggtgatagatacacttaatggcataatgatgaatgaacacaatgttgctgtgtaggtaccggactac

SEQ ID NO: 351924 - DNA, 75 bp, Artificial Sequence
  Synthetic
tgttcatggaaatgtttttcgattataataaaaataattccaaaaatagcatcatcaactaatgtatgacataat

SEQ ID NO: 351925 - DNA, 75 bp, Artificial Sequence
  Synthetic
taatagcgtatccataattctagctaatgagagatatagaagcgcgtttaacgacaatggaatatacatccgtag

SEQ ID NO: 351926 - DNA, 75 bp, Artificial Sequence
  Synthetic
cggagctacattaccatatcatcatccatgctcatgtggatggaaaatccatccattatataattaatgatacgt

SEQ ID NO: 351927 - DNA, 75 bp, Artificial Sequence
  Synthetic
caaatgtcctcagattaaatccatctcagaatccgctaatggaaacgcagtgaatgctagattgtccagtgtgcc

SEQ ID NO: 351928 - DNA, 75 bp, Artificial Sequence
  Synthetic
aactatgattgacaagttgtacggatacgcatctctaactactattggcacgatcgctggaggtgtttgttatta

SEQ ID NO: 351929 - DNA, 75 bp, Artificial Sequence
  Synthetic
acttattactccattattggcggaggtctgagaatgaactttggattcaccaaatgtcctcagattaaatccatc

SEQ ID NO: 351930 - DNA, 75 bp, Artificial Sequence
  Synthetic
tctgttgatgcatctagttagtttgtataaataattatttcaatatactagttaaaattttaagattttaaatgt

SEQ ID NO: 351931 - DNA, 75 bp, Artificial Sequence
  Synthetic
ataaaaactaataacgtttttatttgtaataggtgcaatagcattctattcgaataatgagtatactccgtttaa

SEQ ID NO: 351932 - DNA, 75 bp, Artificial Sequence
  Synthetic
gatggagtagataatatagaaaattcatatactgataataatgaattagtgttaatttttaaagagtacacagtt

SEQ ID NO: 351933 - DNA, 75 bp, Artificial Sequence
  Synthetic
tgttataaacgactataaaattattgatatgtatactattgactcgtctactatttaatgcaaaggacacacatg

SEQ ID NO: 351934 - DNA, 75 bp, Artificial Sequence
  Synthetic
ctatttaatgcaaaggacacacatgtagaatatctaccaaattatcatgccattatgataaacacccttatattc

SEQ ID NO: 351935 - DNA, 75 bp, Artificial Sequence
  Synthetic
acaaatatgagggtgataagcgacaatattctattactacaaagggaaaatgctataaaggaataaaatatgaaa

SEQ ID NO: 351936 - DNA, 75 bp, Artificial Sequence
  Synthetic
taagtacaatgaacgataatattctattgagacaacatactcttaaaattggatctactaatatattcgatagtt

SEQ ID NO: 351937 - DNA, 75 bp, Artificial Sequence
  Synthetic
tacgatatgatcactgttcatattcctattctctcttcgatggtctcacaaaaaagttttacaaaaatattttta

SEQ ID NO: 351938 - DNA, 75 bp, Artificial Sequence
  Synthetic
atggacatagtaatacatattattcaaaatatggtctttaaaaatttaaaatatattatcacttcaacgacaata

SEQ ID NO: 351939 - DNA, 75 bp, Artificial Sequence
  Synthetic
gtcaaataacagccaatatgagatctgtaatgctaacagttttgctaattaatagcataaatgctacgataacta

SEQ ID NO: 351940 - DNA, 75 bp, Artificial Sequence
  Synthetic
atggagtcgtaaaaagttttatctctttctctcttcgatggtctcacaaaaaatattaaacctctttctgatgga

SEQ ID NO: 351941 - DNA, 75 bp, Artificial Sequence
  Synthetic
gctataaattcgaatccgtcaattttgattccaaaattgaatggactggcgatggtctatacaatatatccctta

SEQ ID NO: 351942 - DNA, 75 bp, Artificial Sequence
  Synthetic
aaaattatgggataaagacgtggcaaacaatgtatacaaatgtaccagaaggaacatacgacatatccggatttc

SEQ ID NO: 351943 - DNA, 75 bp, Artificial Sequence
  Synthetic
caaagaatgatttcgtatctttctgggttaaatttgaacaaggtgactataaagtggaagagtattgtacaggac

SEQ ID NO: 351944 - DNA, 75 bp, Artificial Sequence
  Synthetic
aaagtggaagagtattgtacaggactatgcatcgaagtaaaaatcggaccaccaactgtaacattgactgaatac

SEQ ID NO: 351945 - DNA, 75 bp, Artificial Sequence
  Synthetic
ttaccaaacaattgtatatcataaaataatgtttataatttacacgttaaaatcatataataaaacgtagatcgt

SEQ ID NO: 351946 - DNA, 75 bp, Artificial Sequence
  Synthetic
gacgaccatatcaatttgtacatcgagcatccgtatgccactagaggtagcaagaagattcctatttacaaacgt

SEQ ID NO: 351947 - DNA, 75 bp, Artificial Sequence
  Synthetic
tgtgagaaattttgtaccaaaaaacgtgaacagtatccctacatggattttactagatcatttatataccaaaaa

SEQ ID NO: 351948 - DNA, 75 bp, Artificial Sequence
  Synthetic
caagaagattcctatttacaaacgtaatgacatgtgtgatatctacttgttgtatacggctaacttcacatttgg

SEQ ID NO: 351949 - DNA, 75 bp, Artificial Sequence
  Synthetic
agattctgaagaaccagtaacatataatattgatgactacgattgtacgtctacaggttgcagcatagactttgc

SEQ ID NO: 351950 - DNA, 75 bp, Artificial Sequence
  Synthetic
cacaacagaaaaagtgtgcgtgacggcgcagggagccacagaaggatttctagaaaaaattactccatggagttc

SEQ ID NO: 351951 - DNA, 75 bp, Artificial Sequence
  Synthetic
ggaagtatgtctgacacctaagaagaatgtatttacatgcgctattagatccaaggaagatgtatccaatttcaa

SEQ ID NO: 351952 - DNA, 75 bp, Artificial Sequence
  Synthetic
ggacaaaatgaccagagttatcaagagaaaatttaataaacagtctcaaaattatatgaccaaatttctcggtac

SEQ ID NO: 351953 - DNA, 75 bp, Artificial Sequence
  Synthetic
gtgtctagaaaaaaatgtgtgacccacgactgtaggaaactctagagggtaaaaaaaatcaatcgctttatagag

SEQ ID NO: 351954 - DNA, 75 bp, Artificial Sequence
  Synthetic
tacggctaatgatgttactaccgtgattagcatgctagattaaatattttgggcaaatctaaatattttttataa

SEQ ID NO: 351955 - DNA, 75 bp, Artificial Sequence
  Synthetic
aaaaaaaatcaatcgctttatagagaccatcagaaagaggtttaatatttttgtgagaccatcgaagagagaaag

SEQ ID NO: 351956 - DNA, 75 bp, Artificial Sequence
  Synthetic
aaattaaaaaatcactttcgttatcgataactcgagaacatgggttacatatcaacatattaatgttggtggcat

SEQ ID NO: 351957 - DNA, 75 bp, Artificial Sequence
  Synthetic
tgtctaaaacagtcacgatatctcttaaatgctacagaaaggtaggattttataatctttatggatctaatgata

SEQ ID NO: 351958 - DNA, 75 bp, Artificial Sequence
  Synthetic
gcgagcaggaaaattattctcctgtatctgttaaaactacgattatctattaaagacagagatactaaatataga

SEQ ID NO: 351959 - DNA, 75 bp, Artificial Sequence
  Synthetic
caataacataccatggaaaaatattacagattttattaaactcttttatagagaaatgtaataattgctcaaata

SEQ ID NO: 351960 - DNA, 75 bp, Artificial Sequence
  Synthetic
atactatatacaatatcactataaagtcttggactaattatactttggtaaatgttacaactgacaatagtgtct

SEQ ID NO: 351961 - DNA, 75 bp, Artificial Sequence
  Synthetic
acttaaatgtatctagtgatatcgtgatcaataaaacaggaaatattactacattcattaataatacagttaatg

SEQ ID NO: 351962 - DNA, 75 bp, Artificial Sequence
  Synthetic
gatcaataaaacaggaaatattactacattcattaataatacagttaatggtaatttatcgattagtcttaatga

SEQ ID NO: 351963 - DNA, 75 bp, Artificial Sequence
  Synthetic
tacactaagtatatacacagaatcagaacctgtgtttatagtggatccattcattactcttgataaattgtacaa

SEQ ID NO: 351964 - DNA, 75 bp, Artificial Sequence
  Synthetic
agaggccattgtgaatgtagacgaaggttaacctgtagccgtctgtgctaatagagggctttaatttccattttt

SEQ ID NO: 351965 - DNA, 75 bp, Artificial Sequence
  Synthetic
tatcatgtatttgagagtcttatatgtagcaaacatgatagctgtgataccaataagctttagatattcacgcgt

SEQ ID NO: 351966 - DNA, 75 bp, Artificial Sequence
  Synthetic
ttaatactaatactaatactaatactactacttgtaagaatgagactgactacacaccaatggacatttcttatg

SEQ ID NO: 351967 - DNA, 75 bp, Artificial Sequence
  Synthetic
tactacttgtaagaatgagactgactacacaccaatggacatttcttatgttattaatgacaatataacattcat

SEQ ID NO: 351968 - DNA, 75 bp, Artificial Sequence
  Synthetic
cactgagtttacagatagcggttgtcagaataccagtattgtttaataaaacaatggaacaattaggtattactc

SEQ ID NO: 351969 - DNA, 75 bp, Artificial Sequence
  Synthetic
gtgacgtgagtattctcttgaacaaggcatcaaaaaatgtaatggatagacaattatcaaaaactccaacgagat

SEQ ID NO: 351970 - DNA, 75 bp, Artificial Sequence
  Synthetic
aaaagagatccactgagatgactggaaatcacttctgtctacataagaatcaagctaggctggaaactatttacg

SEQ ID NO: 351971 - DNA, 75 bp, Artificial Sequence
  Synthetic
aaatcacttctgtctacataagaatcaagctaggctggaaactatttacgaaactatcaaaatgcagggtacaac

SEQ ID NO: 351972 - DNA, 75 bp, Artificial Sequence
  Synthetic
aaactatcaaaatgcagggtacaacaaacaataatgacggaagtaaacgaacgtctccaatatatgataacgttg

SEQ ID NO: 351973 - DNA, 75 bp, Artificial Sequence
  Synthetic
gcaatactaaggattcattgacatatgtaaatattaataaagtatatatgagatacacgttttgatagtcatcct

SEQ ID NO: 351974 - DNA, 75 bp, Artificial Sequence
  Synthetic
aatcgtatcggagtacggagatcatcaagttcatcatccgatattattgtaaccacaatgcattggcatcaaaag

SEQ ID NO: 351975 - DNA, 75 bp, Artificial Sequence
  Synthetic
tacataagccattaacagctttaacagatgatctgagtaatatacctctattatacatttaatgttcacgatctt

SEQ ID NO: 351976 - DNA, 75 bp, Artificial Sequence
  Synthetic
aagatagatgaactgacatatagcgaatataaggagatccaacactattaggagaaagccaggtcatatggaaga

SEQ ID NO: 351977 - DNA, 75 bp, Artificial Sequence
  Synthetic
tgttcaagctgttaatatcaatctcgataaacgtgaacaggctgtcggagccacagtttcgagacgaggagattt

SEQ ID NO: 351978 - DNA, 75 bp, Artificial Sequence
  Synthetic
agaaatgttgggattattgcatgatagaatggttcagtggcaaacttccatggaaaaacaaaagtagtatagcaa

SEQ ID NO: 351979 - DNA, 75 bp, Artificial Sequence
  Synthetic
tacaacagaaaagagaatataaaaaatttatagctactttctttgaggactgttttccggaaggaaataaacctt

SEQ ID NO: 351980 - DNA, 75 bp, Artificial Sequence
  Synthetic
tggaattagtatacacgttagattattctcaaactcctaattatgaaagactacgtagactagactgtttataca

SEQ ID NO: 351981 - DNA, 75 bp, Artificial Sequence
  Synthetic
aataatattagactatctctgacactacacgaccaaatcgattactatggatatcttcagggaaatcgcatcttc

SEQ ID NO: 351982 - DNA, 75 bp, Artificial Sequence
  Synthetic
tacgaaaggagagaatgtattcatttctccagcgacaatctcgtcagtattgacaatactgtattatggagctaa

SEQ ID NO: 351983 - DNA, 75 bp, Artificial Sequence
  Synthetic
tggatccactgctgaacagttatcaaaatatgtagaaaaggaggagaccatggataaagttagcgctcagaatat

SEQ ID NO: 351984 - DNA, 75 bp, Artificial Sequence
  Synthetic
ctcattcaaatccatgaataaagtatatgggcgatattctgccgtgtttaaaaattcctttttgggaaaaattgg

SEQ ID NO: 351985 - DNA, 75 bp, Artificial Sequence
  Synthetic
cgataatttccaaactgttgacttcactgattgtcgcactatagatgctatcaataagtgtgttgatgtctttac

SEQ ID NO: 351986 - DNA, 75 bp, Artificial Sequence
  Synthetic
gacattctaaatctatagtattatctattacagcgtaaaacacattcaatattgtattgttatattattagttta

SEQ ID NO: 351987 - DNA, 75 bp, Artificial Sequence
  Synthetic
tgaggggaaaatcaatccactattgactgaacaattgtctcccaatacctgtctcctagcaattagtgccgtata

SEQ ID NO: 351988 - DNA, 75 bp, Artificial Sequence
  Synthetic
ctttaaagcaaaatggttgataccattcaaaaaggaatttaccagtgattatccattttacgtatcaccaacgga

SEQ ID NO: 351989 - DNA, 75 bp, Artificial Sequence
  Synthetic
aatggtagacgtaagtatgatgtctatgtatggtgagtcatttaattacgcatctgtaaaagaatcattcggtaa

SEQ ID NO: 351990 - DNA, 75 bp, Artificial Sequence
  Synthetic
cctactacgtataatttattgttagcgggtatcccgctagcatacagtttgggctattcatcgaaggaattggaa

SEQ ID NO: 351991 - DNA, 75 bp, Artificial Sequence
  Synthetic
cttttcaatcatagaactgccatatgttggaaatactagtatgatggtcattcttccagacaagattgatggatt

SEQ ID NO: 351992 - DNA, 75 bp, Artificial Sequence
  Synthetic
agaatccataaaacaaaatctaacagatacaaattttaagaaatggtgtaactctctggaagctacgtttatcga

SEQ ID NO: 351993 - DNA, 75 bp, Artificial Sequence
  Synthetic
tgtacacattcccaagtttaaggtaacaggttcgtataatctggtggatactctagtaaagttgggactgacaga

SEQ ID NO: 351994 - DNA, 75 bp, Artificial Sequence
  Synthetic
tgtgttctattcaactggcgattatagcaatatgtgtaattcagatgtgagtgttgacgctatgattcacaaaac

SEQ ID NO: 351995 - DNA, 75 bp, Artificial Sequence
  Synthetic
gtatatagatgtcaatgaagagtacacagaagcagctgcagcaacttctgtactagtggcagactgtgcatcaac

SEQ ID NO: 351996 - DNA, 75 bp, Artificial Sequence
  Synthetic
agttacaaatgagttctgtgcagatcatccgttcatctatgtgattaggcatgtcgatggcaaaattcttttcgt

SEQ ID NO: 351997 - DNA, 75 bp, Artificial Sequence
  Synthetic
catccgttcatctatgtgattaggcatgtcgatggcaaaattcttttcgttggtagatattgctctccaacaact

SEQ ID NO: 351998 - DNA, 75 bp, Artificial Sequence
  Synthetic
aaaaaatagaaaaaacatgtggtattagtgcaggtcgttattcttcccattgcaattggtaagatgacggccaac

SEQ ID NO: 351999 - DNA, 75 bp, Artificial Sequence
  Synthetic
tgcaattggtaagatgacggccaactttagtacccacgtcttttcaccacagcactgtggatgtgacagactgac

SEQ ID NO: 352000 - DNA, 75 bp, Artificial Sequence
  Synthetic
cagtattgatgacgtcagacaatgtttgactgaatatatttattggtcgtcctatgcataccgcaacaggcaatg

SEQ ID NO: 352001 - DNA, 75 bp, Artificial Sequence
  Synthetic
cgctggacagttgtattccacactcctctcttttagagatgatgcggaatcagtgttcatcgatgttcgcgagct

SEQ ID NO: 352002 - DNA, 75 bp, Artificial Sequence
  Synthetic
ggtgaaaaatatgccgtgggatgatgtcaaagattgtgtagaaatcatccgttgttatataccggatgagcaaaa

SEQ ID NO: 352003 - DNA, 75 bp, Artificial Sequence
  Synthetic
aaccatcagagagatttcggccatcatcggactttgtgcatatgctgctacttactggggaggcgaagaccatcc

SEQ ID NO: 352004 - DNA, 75 bp, Artificial Sequence
  Synthetic
cactagtaacagtctgaacgcattgtttgtgatgcttaaaatgctcaattacgtggattataacatcatattccg

SEQ ID NO: 352005 - DNA, 75 bp, Artificial Sequence
  Synthetic
ctaaactttaacaatctccacgtatggaactcatgtagcataggtaatgtaacgcgtatattttatacatttttt

SEQ ID NO: 352006 - DNA, 75 bp, Artificial Sequence
  Synthetic
tcccagaaataaacttttttacccactataaaataaaagagtatactacctattatatttcttcctatatttttt

SEQ ID NO: 352007 - DNA, 75 bp, Artificial Sequence
  Synthetic
attcttcattagttacgacttttaacacacctaaatgtgtcgacaaagggcaatagtttgcgtcattcatggagt

SEQ ID NO: 352008 - DNA, 75 bp, Artificial Sequence
  Synthetic
tagaaaacgagccagtaatcttaccatgtcctcaaataaatactctatcgtttggatataatatattagatattt

SEQ ID NO: 352009 - DNA, 75 bp, Artificial Sequence
  Synthetic
tatgggaaaacgagaagcggataatgatagaattataccaatagataattgtaacaatatgctaattctgaaccc

SEQ ID NO: 352010 - DNA, 75 bp, Artificial Sequence
  Synthetic
tcgtttgtcaatcatgttaatgtctttaagataaggtaggcaaattttatagtattaagaattgggcaagcataa

SEQ ID NO: 352011 - DNA, 75 bp, Artificial Sequence
  Synthetic
aatatagatcttatttagtatccacaaatagtaaatgagagatctactggtgaaatgtgtcccagtaatgcattt

SEQ ID NO: 352012 - DNA, 75 bp, Artificial Sequence
  Synthetic
attgctagtaacataaacacagatattatatggagcggacatcaacgccttagaaataagagacttaaacaacgg

SEQ ID NO: 352013 - DNA, 75 bp, Artificial Sequence
  Synthetic
tactatgcaattaccaaaaggccttgtaacttcactaggtagtaatttgactattgcgtgtaaagtatcgttgag

SEQ ID NO: 352014 - DNA, 75 bp, Artificial Sequence
  Synthetic
gtaacttcactaggtagtaatttgactattgcgtgtaaagtatcgttgagacctcccacaacggatgcagatgtc

SEQ ID NO: 352015 - DNA, 75 bp, Artificial Sequence
  Synthetic
agtatccgtgtatagcctctttatttaccctccatatgccaacatgcattccactagatggatatcgatatcgtc

SEQ ID NO: 352016 - DNA, 75 bp, Artificial Sequence
  Synthetic
ttttggataagtaatggtatgtattacgaagaagacaatgaggacggagacggtagaataagtatagcaaataaa

SEQ ID NO: 352017 - DNA, 75 bp, Artificial Sequence
  Synthetic
acgaagaagacaatgaggacggagacggtagaataagtatagcaaataaaatctatacgaccgataagagacgtg

SEQ ID NO: 352018 - DNA, 75 bp, Artificial Sequence
  Synthetic
gcgtttactattcctagcatcagcaaaacagttactattagtataatgtgattgtatgttgttacatttccatgt

SEQ ID NO: 352019 - DNA, 75 bp, Artificial Sequence
  Synthetic
caaatagagtttataaaaattttttatacattatcttccaacaagcaattgacgaacgtattactatgattaact

SEQ ID NO: 352020 - DNA, 75 bp, Artificial Sequence
  Synthetic
cccacgatactatgcatattattaatcattaacttgcaaactatacctagtgctattttgacatacttgtgttct

SEQ ID NO: 352021 - DNA, 75 bp, Artificial Sequence
  Synthetic
tgtgtaattgcggtatctatattattaaagtacgtaaatctagctatagttttattatttaattttagataatat

SEQ ID NO: 352022 - DNA, 75 bp, Artificial Sequence
  Synthetic
accatctccttatttttaaaaattaccacatcctttattaaatcatggatgggaatttctatgtcatcgttagta

SEQ ID NO: 352023 - DNA, 75 bp, Artificial Sequence
  Synthetic
gagatacaggaatacaacaatcaaaccttactgaaactatacgtaactgtcaaaaaaaatagaaacatatatggt

SEQ ID NO: 352024 - DNA, 75 bp, Artificial Sequence
  Synthetic
tattgtgaacaacaagagcagatatctataggaaagggtggaatgcgatacattgatctatgtagttttaaaaca

SEQ ID NO: 352025 - DNA, 75 bp, Artificial Sequence
  Synthetic
cacgagaactttgaagaatttatataaattattccatcgatacatccttctatgttaatatgtatatatccagga

SEQ ID NO: 352026 - DNA, 75 bp, Artificial Sequence
  Synthetic
attcttttatgaatatcaggaaatgtataaactaaaacattgcccggatacggtgcttctattggcattatatcc

SEQ ID NO: 352027 - DNA, 75 bp, Artificial Sequence
  Synthetic
gttcttaacttgcaaaatgtaaccaatacctttgcatggcttgttttgttcggtaacgttagtttaaacttgacg

SEQ ID NO: 352028 - DNA, 75 bp, Artificial Sequence
  Synthetic
aatggattaattacaatagcatgatctgcgcatctattaagtttttttactttaacgcccttgtatgtttttaca

SEQ ID NO: 352029 - DNA, 75 bp, Artificial Sequence
  Synthetic
tctacccacggatacgaaataaacatgtctattgttaatcatgccaccaataatgtatagacaattatataaaac

SEQ ID NO: 352030 - DNA, 75 bp, Artificial Sequence
  Synthetic
gagactttatctaaatttctagtgcttgtatgtgttataaatataactggatatagaactgaatcacctacctta

SEQ ID NO: 352031 - DNA, 75 bp, Artificial Sequence
  Synthetic
gatacccaattacattttatcagatccagataataaacaaattttgtcgccctaactaattctatattgttatat

SEQ ID NO: 352032 - DNA, 75 bp, Artificial Sequence
  Synthetic
acagatatcatctttagagaatactagtcgcgttaatagtactaaaatttgtatttttaatctatctcaataaaa

SEQ ID NO: 352033 - DNA, 75 bp, Artificial Sequence
  Synthetic
attttacaattggttatgatatcatgtaataacttggaatctaacgcgcatcgtcgtacgtttacacaattgtga

SEQ ID NO: 352034 - DNA, 75 bp, Artificial Sequence
  Synthetic
tttagtatagtatatctacacatatatttttccgcgctatagtattctggactagcgataaaactatcgttatat

SEQ ID NO: 352035 - DNA, 75 bp, Artificial Sequence
  Synthetic
ctgtcttcgatgaactcatcaagatattgctctctgtcatattcatacacctgcataaactttctagacattgta

SEQ ID NO: 352036 - DNA, 75 bp, Artificial Sequence
  Synthetic
caatatgtgttattttaggatcatatttacatatttacggtatatcaaagatgttagatatagttaataggacac

SEQ ID NO: 352037 - DNA, 75 bp, Artificial Sequence
  Synthetic
aacatcataaaatgagtcgtcgtctgatttatgttttaaatatcaaccgcaaatcaactcataaaatacaagaga

SEQ ID NO: 352038 - DNA, 75 bp, Artificial Sequence
  Synthetic
atgaaatatatacatattttagttattgcaatatagaccatacttctacagaacttgattttgtagttaaaaact

SEQ ID NO: 352039 - DNA, 75 bp, Artificial Sequence
  Synthetic
atgatctaaacagacgacagcctgtaactgggtataccgcactacactgctatttgtataataattactttacaa

SEQ ID NO: 352040 - DNA, 75 bp, Artificial Sequence
  Synthetic
acgatgtactgaaggtattattaaatcatggagtggatgtaacgataaaacccagtagcggacatatgcctattt

SEQ ID NO: 352041 - DNA, 75 bp, Artificial Sequence
  Synthetic
atatattgcttactagatgttgcaatatttcacacaatgtagtgatagatatgataaacaaagataaaacccact

SEQ ID NO: 352042 - DNA, 75 bp, Artificial Sequence
  Synthetic
acatcactgtaagcatgtccgtaccatttattttaatttgacacatatcagcaatttctttttgcattcggttat

SEQ ID NO: 352043 - DNA, 75 bp, Artificial Sequence
  Synthetic
tatcgcataaagactattccaacctactactagagtatataaaatctcgttacatgctattgaaggaagaggata

SEQ ID NO: 352044 - DNA, 75 bp, Artificial Sequence
  Synthetic
atattctatataagatgaatacgtatcacatgtgtacttatagtttactaatatgaagtacctgatacacatttc

SEQ ID NO: 352045 - DNA, 75 bp, Artificial Sequence
  Synthetic
tcgatgagaacatagtatcaactttattagataagggaatcgatcctaactttaaacaagacggatatacagcat

SEQ ID NO: 352046 - DNA, 75 bp, Artificial Sequence
  Synthetic
tattaacgatttattatatatgtatacgtagtagcgacgttttatgttctcaactgtactttttatacattctat

SEQ ID NO: 352047 - DNA, 75 bp, Artificial Sequence
  Synthetic
tttaaacaagacggatatacagcattacattattattatttgtgtcttgcacacgtttataaaccaggcgagtgt

SEQ ID NO: 352048 - DNA, 75 bp, Artificial Sequence
  Synthetic
ggttggtaatctactcagaatacattccaatatctgaatgtataatttcgctatttcgggaatacatccatatgc

SEQ ID NO: 352049 - DNA, 75 bp, Artificial Sequence
  Synthetic
agaaaaccgataacgataaaaaaggccaagcgaattatttctttgtttatacaacatggagctaatctaaacgcg

SEQ ID NO: 352050 - DNA, 75 bp, Artificial Sequence
  Synthetic
atatctatgtctttatccaacactaaaaatataatagctaatattttattacaatcatccggatattcttctacg

SEQ ID NO: 352051 - DNA, 75 bp, Artificial Sequence
  Synthetic
ttagataattgtggtaatacaccattccatttgtatcttagtattgaaatgtgtaataatatccatatgactaaa

SEQ ID NO: 352052 - DNA, 75 bp, Artificial Sequence
  Synthetic
aagtataatacaaataccaataccaatacacgtataatcacactttgttgctatattaatatctacaccattatc

SEQ ID NO: 352053 - DNA, 75 bp, Artificial Sequence
  Synthetic
gactaaccattctactagtatggtattatgataataaacacaataataaagtatgctacgtccacgcgtatctat

SEQ ID NO: 352054 - DNA, 75 bp, Artificial Sequence
  Synthetic
atgctgttgacttttaatccgaatttcgaaatatgtaataatcatggattaacgcctatactatgttatataact

SEQ ID NO: 352055 - DNA, 75 bp, Artificial Sequence
  Synthetic
tttatttatatcgtcgatatacggcttacaaagttttaatatagataacacatcttcatcatgattattgtgaac

SEQ ID NO: 352056 - DNA, 75 bp, Artificial Sequence
  Synthetic
tccgactacatacaacacgatattcttgtcatgttgatacatcactatgaaacaaatgttggagaaatgcctata

SEQ ID NO: 352057 - DNA, 75 bp, Artificial Sequence
  Synthetic
catccaatttattatttttgacgatgtcaagatcttttgtataggagtcgacttgtattcaacatgcttttctat

SEQ ID NO: 352058 - DNA, 75 bp, Artificial Sequence
  Synthetic
gcagacagggaataatggcatataatatttattgtattattatcttctacgacatcaactccatttttcaaaata

SEQ ID NO: 352059 - DNA, 75 bp, Artificial Sequence
  Synthetic
gatgagcgtcgtatgatcgtattcgagtttatcaaaacatattctacacgtccgttagattcgataacttatttg

SEQ ID NO: 352060 - DNA, 75 bp, Artificial Sequence
  Synthetic
tactcaactactttaggatctactttgtgtatattaataaaaatattcatttacgtgcttatatctatctatata

SEQ ID NO: 352061 - DNA, 75 bp, Artificial Sequence
  Synthetic
atgaataggtttaaaaatatagatattcatacccgctatgaaggaaagacattattacacatagcatgtgaatat

SEQ ID NO: 352062 - DNA, 75 bp, Artificial Sequence
  Synthetic
atactgcgccttcatctatcatacatttgataatattagtacgcactataccatgtgaaatgtatctcgtcaata

SEQ ID NO: 352063 - DNA, 75 bp, Artificial Sequence
  Synthetic
aataatacacacgtaatagattatcttatacgtattaacggagatataaatgcgttaaccgacaataacaaacac

SEQ ID NO: 352064 - DNA, 75 bp, Artificial Sequence
  Synthetic
ggtcttggatagaatatttgtatcgtttaatactcgtatatattataacgcaccatattaaacaatactaaaata

SEQ ID NO: 352065 - DNA, 75 bp, Artificial Sequence
  Synthetic
gctatccaactcattatagataacaaagaaaattcccagtataccatcgattgtttattgtatatacttagatat

SEQ ID NO: 352066 - DNA, 75 bp, Artificial Sequence
  Synthetic
tcattaaaatattattagggtcagtactcattatcatatattggcagcagctattacttattttattttattttt

SEQ ID NO: 352067 - DNA, 75 bp, Artificial Sequence
  Synthetic
tctttagacccacaaccatctaataatcgatcaattatataattatcaatgggatttttatttttattcttatac

SEQ ID NO: 352068 - DNA, 75 bp, Artificial Sequence
  Synthetic
attgtagataagaatgtgataagatcgttggtggatcaacttccatatctacctatcttcgatataaaatcattt

SEQ ID NO: 352069 - DNA, 75 bp, Artificial Sequence
  Synthetic
cgtatacgtaaatagttatgtagaatattcatacgttcattattctaataattattgtcgtacatcgcacctacc

SEQ ID NO: 352070 - DNA, 75 bp, Artificial Sequence
  Synthetic
gagaaattcatatcatactgtatacttttagatgacacattttacgatagacacgttcagaatcgcgattctaaa

SEQ ID NO: 352071 - DNA, 75 bp, Artificial Sequence
  Synthetic
tatataaatactttttatttacggtatcttgtagtggtaatacccctactcgattattttttttaaaaaaaatac

SEQ ID NO: 352072 - DNA, 75 bp, Artificial Sequence
  Synthetic
aacgtaataatgaagtgtggtatatgatctataagtataatataataatagagcgcggttttacctattttatca

SEQ ID NO: 352073 - DNA, 75 bp, Artificial Sequence
  Synthetic
acttatcgatacacgttttcaaaatacatatcattcgataaatacgatagtataataactaaatgctatgaagaa

SEQ ID NO: 352074 - DNA, 75 bp, Artificial Sequence
  Synthetic
tctatataataatataatcctaatagtaatcgtcatcattgtacccacttgagaagttagtaacttttttctatt

SEQ ID NO: 352075 - DNA, 75 bp, Artificial Sequence
  Synthetic
acaatattgctcaaactatccactgttctagacacaacactatattctgttttaagatgtcataattcgagaaag

SEQ ID NO: 352076 - DNA, 75 bp, Artificial Sequence
  Synthetic
ttaaaaagatacctcagcgtgttaaaaaaatataataatgataagtccttcaaaatatattctaatattatgaat

SEQ ID NO: 352077 - DNA, 75 bp, Artificial Sequence
  Synthetic
gagagataccttaatgtctattataaagatatgtatgtgtcaaaagtatacgataaactatttcctgttttcaca

SEQ ID NO: 352078 - DNA, 75 bp, Artificial Sequence
  Synthetic
taaaaatacttacctaatgccttactcggtgtatataaacctacctctcttaaaatggttgagaccaagcttcgt

SEQ ID NO: 352079 - DNA, 75 bp, Artificial Sequence
  Synthetic
gataaaaaatgtctactaacattactaccttcagaaattatatatgaaatattatacatgttaacaatttacgat

SEQ ID NO: 352080 - DNA, 75 bp, Artificial Sequence
  Synthetic
tttctcatacgatgtgtgtaaaaactgatattataaattatcttagtgtcgtatgatgaagatgacgatgaaaat

SEQ ID NO: 352081 - DNA, 75 bp, Artificial Sequence
  Synthetic
tgatattataaattatcttagtgtcgtatgatgaagatgacgatgaaaatgatggtacatatatattttgtatca

SEQ ID NO: 352082 - DNA, 75 bp, Artificial Sequence
  Synthetic
tgataatgataatgacgataatgaacctatggtacaagttgaagctggtaaagtaaatcatagtgctagaagcga

SEQ ID NO: 352083 - DNA, 75 bp, Artificial Sequence
  Synthetic
tcagattatcatgagatgtgtttacactaactgtatcgatacggcacaccatttagtcataaccgtaatccaaaa

SEQ ID NO: 352084 - DNA, 75 bp, Artificial Sequence
  Synthetic
ttattgttattgctattccacagttacgccatagacattgaaaatgaaatcacagatttcttcaataaaatgaaa

SEQ ID NO: 352085 - DNA, 75 bp, Artificial Sequence
  Synthetic
gatactctaccagctaaagactctaaatggttgaatccaacatgtatatttggaggcacaatgaataatatggct

SEQ ID NO: 352086 - DNA, 75 bp, Artificial Sequence
  Synthetic
tttttacagtaccttgactaaagtctttagtcacacaatactaccaaccttacactattatatgattatagtttc

SEQ ID NO: 352087 - DNA, 75 bp, Artificial Sequence
  Synthetic
gctataggagagccattcagtgcaaagtgtcctcctattgaagacagtcttttatcgcgtagatatataaataaa

SEQ ID NO: 352088 - DNA, 75 bp, Artificial Sequence
  Synthetic
gacaacgtagttaactgggagaaaataggaaaaactagacgacctcttaatagacgtgttaaaaacggtgactta

SEQ ID NO: 352089 - DNA, 75 bp, Artificial Sequence
  Synthetic
tggatagccaactatacatctaacgacagtcatcgtatgtatttgtgtacagtgattacaaagaatggcgactgt

SEQ ID NO: 352090 - DNA, 75 bp, Artificial Sequence
  Synthetic
attcaaggtatagttagatcccatgtacggaaaccttcttcatgcattccagaaatctatgaactaggtactcat

SEQ ID NO: 352091 - DNA, 75 bp, Artificial Sequence
  Synthetic
gataagtatggaatagacttatactgtggaattatttacgcaaaacattataataatataacttggtataaagat

SEQ ID NO: 352092 - DNA, 75 bp, Artificial Sequence
  Synthetic
aataaggaaattaatatcgatgatattaagtattcacaaacgggaaaggaattaattattcataatccagcatta

SEQ ID NO: 352093 - DNA, 75 bp, Artificial Sequence
  Synthetic
gaagatagcggaagatatgactgttatgttcattacgacgacgttagaatcaagaatgatatcgtagtatcaaga

SEQ ID NO: 352094 - DNA, 75 bp, Artificial Sequence
  Synthetic
tgtaaaatacttacggttataccgtcacaagaccacaggtttaaactaatactagattcgaaaatcaacgtaatt

SEQ ID NO: 352095 - DNA, 75 bp, Artificial Sequence
  Synthetic
ataggagaacctgccaatataacatgcactgctgtatcaacgtcattattgttcgatgatgtactgattgaatgg

SEQ ID NO: 352096 - DNA, 75 bp, Artificial Sequence
  Synthetic
gaaaatccatccggatggcttataggattcgattttgatgtatactctgttttaactagtagaggcggtattact

SEQ ID NO: 352097 - DNA, 75 bp, Artificial Sequence
  Synthetic
aatagatctctggttctatgttcctcgtttcctgtattctttttaagatcgagaaacgccataatatcaaaatgc

SEQ ID NO: 352098 - DNA, 75 bp, Artificial Sequence
  Synthetic
gaggcgaccttgtattttaaaaatgttactgaagaatatataggtaatacatataaatgtcgtggacacaactat

SEQ ID NO: 352099 - DNA, 75 bp, Artificial Sequence
  Synthetic
ttactgaagaatatataggtaatacatataaatgtcgtggacacaactattattttgaaaaaacccttacaacta

SEQ ID NO: 352100 - DNA, 75 bp, Artificial Sequence
  Synthetic
ttggtaacgtatacatttaatgaattttcattacgttctaccaatgattgtgcactgcaggcatcaaaagtttta

SEQ ID NO: 352101 - DNA, 75 bp, Artificial Sequence
  Synthetic
cagtagtattggagtaaatacacaatgcatttttatatacattactgaattattattattaattatatcgtattt

SEQ ID NO: 352102 - DNA, 75 bp, Artificial Sequence
  Synthetic
gtgctatagaatggatgaagatacgaaactatctaggtatttgtatctcaccgatagagaacatataaatgtaga

SEQ ID NO: 352103 - DNA, 75 bp, Artificial Sequence
  Synthetic
cattagtatagtattaacttcgttatttatgtcataaactgtaaatgatttcgtagatgccatatcatacataat

SEQ ID NO: 352104 - DNA, 75 bp, Artificial Sequence
  Synthetic
ctctattaaacagttgtgtaaaatatcaaatcctaattcatgttatagatgtggatgtacggctttacatgagta

SEQ ID NO: 352105 - DNA, 75 bp, Artificial Sequence
  Synthetic
cttttataattatagatcagtcaacggaaaatacaagtatagatacaacggttactatcaatattattcatttag

SEQ ID NO: 352106 - DNA, 75 bp, Artificial Sequence
  Synthetic
ttacagccaacacatgcatccatgcaacatttcctacatatacccggctatgtaccgcgtcatcatcgactgtac

SEQ ID NO: 352107 - DNA, 75 bp, Artificial Sequence
  Synthetic
tctgtctatgatcgttttaatattgtgaatggtaaagaatgctgttatatacatcttcattcatctaatcagaat

SEQ ID NO: 352108 - DNA, 75 bp, Artificial Sequence
  Synthetic
cgattatgaaaattataatgaatattattatgatgattatgatagaactggtatgaatagcgagagtgagagtga

SEQ ID NO: 352109 - DNA, 75 bp, Artificial Sequence
  Synthetic
gttttcattaagatttgtaccctgtttaacatgatggcgttctatacgtctttattttctattttttaatttttt

SEQ ID NO: 352110 - DNA, 75 bp, Artificial Sequence
  Synthetic
taatatatcaatcaaaacagaatatgagaatgaatacgaattctatgatgaaacacaagatcaaagtacacaact

SEQ ID NO: 352111 - DNA, 75 bp, Artificial Sequence
  Synthetic
agtaggttacgacattaaactcaaaaccaatgaggatgattttgtggatgaattctatggctatgatagatcagt

SEQ ID NO: 352112 - DNA, 75 bp, Artificial Sequence
  Synthetic
gggtgtccatgattatatagataaatcaattaataaagtagtatatggaagagagtcttacgtaagatggcggga

SEQ ID NO: 352113 - DNA, 75 bp, Artificial Sequence
  Synthetic
tatatggcaagaacataatgatggtgtatacagtataggaaaggagtgcatagataatatatacgaagacagaca

SEQ ID NO: 352114 - DNA, 75 bp, Artificial Sequence
  Synthetic
tacagtagacgaattctacaagatagacagcgtatcaaatgtaaatgacgcggaacacatatctcagataactaa

SEQ ID NO: 352115 - DNA, 75 bp, Artificial Sequence
  Synthetic
tgatgtatctacacaaacatgggaaaagaaatcagagttagatagatacatggaaatgtatcctcgtcatagata

SEQ ID NO: 352116 - DNA, 75 bp, Artificial Sequence
  Synthetic
tagtaagcattctatctttaagggattttctgacaaagttagaaaaaatgatttagacatgaatgtggtaaaaga

SEQ ID NO: 352117 - DNA, 75 bp, Artificial Sequence
  Synthetic
attactttctaacggcgcatctctaacaatcaaggatagcagtaataaggatccaattgctgtttattttagaag

SEQ ID NO: 352118 - DNA, 75 bp, Artificial Sequence
  Synthetic
aacgataatgaatttagaaatgattgatatcattaacaaacatacaactatctatgaacgccggtatatagtaca

SEQ ID NO: 352119 - DNA, 75 bp, Artificial Sequence
  Synthetic
ctcctatctaaaaaattatagaaattttgattatccatttttcaggaagttagttttgactaataaacattgtct

SEQ ID NO: 352120 - DNA, 75 bp, Artificial Sequence
  Synthetic
cgataattattataatacaggtgaccgcagacatggaacgccgctacatatattggcgactaataaaaaattaat

SEQ ID NO: 352121 - DNA, 75 bp, Artificial Sequence
  Synthetic
aactccattacacaaatatttgtgtaaatttgtatatcataatattgaatatggtatccgatactataatgaaaa

SEQ ID NO: 352122 - DNA, 75 bp, Artificial Sequence
  Synthetic
atggtatccgatactataatgaaaagattatagacgcatttatagagttaggagccgatctaactattccaaatg

SEQ ID NO: 352123 - DNA, 75 bp, Artificial Sequence
  Synthetic
atgatgaaatgataccagtaatttactgcatacacgtaaatgctgaatatggttataacaatattactaacataa

SEQ ID NO: 352124 - DNA, 75 bp, Artificial Sequence
  Synthetic
ggataatacgtaaactacttaatcttagcagacatgcgccacataatctatttagagatcgagtcatgcacgatt

SEQ ID NO: 352125 - DNA, 75 bp, Artificial Sequence
  Synthetic
atataagtaatacatatattgatatagagtgtttagatattattagatcactggatgggttcgatattaattgtt

SEQ ID NO: 352126 - DNA, 75 bp, Artificial Sequence
  Synthetic
actttgaaggacgtacacctcttcattgcgctatacagtataacttcactcatattgcggaatacttattagatc

SEQ ID NO: 352127 - DNA, 75 bp, Artificial Sequence
  Synthetic
ttgcgctatacagtataacttcactcatattgcggaatacttattagatcgaggagctgatatatcattaaagac

SEQ ID NO: 352128 - DNA, 75 bp, Artificial Sequence
  Synthetic
aggcgatgaaaaatctgtattcgatttatcgttatgtagctacatacctcttaaatggactagttttttgattag

SEQ ID NO: 352129 - DNA, 75 bp, Artificial Sequence
  Synthetic
tcgtctaccgcctaaaagtgtcatgagctcactgactaaccatataatagattatgttcttacagacaataaaaa

SEQ ID NO: 352130 - DNA, 75 bp, Artificial Sequence
  Synthetic
tattatttggcaaagtcaaatgattaataagtatgtgttgttacttgatccatccttttattctagattcagaaa

SEQ ID NO: 352131 - DNA, 75 bp, Artificial Sequence
  Synthetic
tgctattaaaagcaaattaaatcaatacgattatcgttgcttcaattacaatagatatcgtgttaataaaaagta

SEQ ID NO: 352132 - DNA, 75 bp, Artificial Sequence
  Synthetic
tcgcaaagttttacatgacattgatatatatattaaggatgtacaagtattaaaatctattctcatcgccaataa

SEQ ID NO: 352133 - DNA, 75 bp, Artificial Sequence
  Synthetic
tgtaacactatacgacactattgtaaataatacatcagagtttcctgtacgtcgtctaaacaacaaacaattaat

SEQ ID NO: 352134 - DNA, 75 bp, Artificial Sequence
  Synthetic
taatacagtaaattccaatatatatcatgatcttatcgaaaaagttattaaaaaatcattagagaaatgtactct

SEQ ID NO: 352135 - DNA, 75 bp, Artificial Sequence
  Synthetic
catgatcttatcgaaaaagttattaaaaaatcattagagaaatgtactctaactaatgccgtcctcgagtatatg

SEQ ID NO: 352136 - DNA, 75 bp, Artificial Sequence
  Synthetic
aactaatgccgtcctcgagtatatgatcgcatctcgatctcaatcatcttatttaagtcgtattcctaatgagat

SEQ ID NO: 352137 - DNA, 75 bp, Artificial Sequence
  Synthetic
attactcaaaatactatataacctcagcgtctacgatttacgcaaactatatgcaagatacatgctagagaatga

SEQ ID NO: 352138 - DNA, 75 bp, Artificial Sequence
  Synthetic
gacagattatcatatagagtcaaggtcaatttctacgcagactgaataatgttatatacactacatatttttatg

SEQ ID NO: 352139 - DNA, 75 bp, Artificial Sequence
  Synthetic
tcattataactacttgtaatattgaaatcgtaatttgatatatagtgaaaaatggattttgatgatattaaacat

SEQ ID NO: 352140 - DNA, 75 bp, Artificial Sequence
  Synthetic
aatggattttgatgatattaaacataatagacgagtagtaagtaacattagcaatcttttagatgatgatatata

SEQ ID NO: 352141 - DNA, 75 bp, Artificial Sequence
  Synthetic
ttatgcgatgtaatcataactattggtgatggagaagaaattaaagcacataaaactatcttggctgctggatct

SEQ ID NO: 352142 - DNA, 75 bp, Artificial Sequence
  Synthetic
ataagttctatgaatataatagatgtattaaaatgcgccaactatcttctaatcgattatctagtcactgactgc

SEQ ID NO: 352143 - DNA, 75 bp, Artificial Sequence
  Synthetic
gaatcctatattaaagattatactaatcatgatacctgcatatgtatgtaccataggttaatgagatggttcata

SEQ ID NO: 352144 - DNA, 75 bp, Artificial Sequence
  Synthetic
ttatccgtaaaaatgttatcctggacattgtgtcaataataaaaaagctcatatatgtttgctattgtagaaatt

SEQ ID NO: 352145 - DNA, 75 bp, Artificial Sequence
  Synthetic
ttccaatagtcaaatatattaaacgtatgctgatgagtaatatatcaacattgataactacggacgcatttaaaa

SEQ ID NO: 352146 - DNA, 75 bp, Artificial Sequence
  Synthetic
aacagtatttgaaatattatttgatattctttctactaacgacaatgtatatttatacagagaaggctataaagt

SEQ ID NO: 352147 - DNA, 75 bp, Artificial Sequence
  Synthetic
cactttggagtctcatctttagtaaacatatcataatattcgatattacgagttgacatattgaacaaattccaa

SEQ ID NO: 352148 - DNA, 75 bp, Artificial Sequence
  Synthetic
aacgatactattgaagtggctagaatacaactacatcacaaaagaacagcttttgtatatactgtcctgtataga

SEQ ID NO: 352149 - DNA, 75 bp, Artificial Sequence
  Synthetic
gtatttgattttggataatattcgtattttgcatctgctataattaagatataatcgccacaagaacacacgaac

SEQ ID NO: 352150 - DNA, 75 bp, Artificial Sequence
  Synthetic
ttttgtatatactgtcctgtatagatatacaaaatctagataagaagtatagactactactctattcaaataaaa

SEQ ID NO: 352151 - DNA, 75 bp, Artificial Sequence
  Synthetic
agactactactctattcaaataaaactataaatatgcatccctcatgtatacaatttctattagataataaacag

SEQ ID NO: 352152 - DNA, 75 bp, Artificial Sequence
  Synthetic
ctataaatatgcatccctcatgtatacaatttctattagataataaacagaatagaaacattataccccaaccag

SEQ ID NO: 352153 - DNA, 75 bp, Artificial Sequence
  Synthetic
ctaatcacataattaattacacatccgcgattgtagataatgaaataataatagctggaggatataactttaata

SEQ ID NO: 352154 - DNA, 75 bp, Artificial Sequence
  Synthetic
atccatcgttaaacaaggtatataaaataaacattgagaacaaaatacatgtcgaactcccacccatgataatga

SEQ ID NO: 352155 - DNA, 75 bp, Artificial Sequence
  Synthetic
atagatgtcgtttttctttggctgtaatcgataacacaatttatgctataggtggtcaaaaactgaagtttaaca

SEQ ID NO: 352156 - DNA, 75 bp, Artificial Sequence
  Synthetic
aatcgataacacaatttatgctataggtggtcaaaaactgaagtttaacattatttatttatgatatatattata

SEQ ID NO: 352157 - DNA, 75 bp, Artificial Sequence
  Synthetic
actttccatcattaacacacgtactacttttgattttaacgacgacatattagtaactgttttccatttttttcg

SEQ ID NO: 352158 - DNA, 75 bp, Artificial Sequence
  Synthetic
tatcggtatcgttattgtttggtctataccatggatatctttaaagaactaatcttaaaataccctgatgaaaat

SEQ ID NO: 352159 - DNA, 75 bp, Artificial Sequence
  Synthetic
gttttgatttctccagtttccattttatctactttatctattctgaatcatggagcagctggttctacagctgaa

SEQ ID NO: 352160 - DNA, 75 bp, Artificial Sequence
  Synthetic
gtctatctatctgtattaccgacgattgtccaatattctgttctaggagagtaatgggttattgtggatataatc

SEQ ID NO: 352161 - DNA, 75 bp, Artificial Sequence
  Synthetic
caactatcaaaatatatagagaatgtgaatgaaaatacacccgatgataagaaggatgacaataatgacatggac

SEQ ID NO: 352162 - DNA, 75 bp, Artificial Sequence
  Synthetic
gtagatgttccgtattgtgcgacactagctattgcaaataaaatatactgtagcgatagtatcgagttccacgcc

SEQ ID NO: 352163 - DNA, 75 bp, Artificial Sequence
  Synthetic
tccttcctacaaaaaataaaagatgattttcaaactgtaaactttaataatgctaaccaaacaaaggaactaatc

SEQ ID NO: 352164 - DNA, 75 bp, Artificial Sequence
  Synthetic
aatgaatgggttaagacgatgacaaatggtaaaattaattccttattgactagtccactgcccattaatactcgc

SEQ ID NO: 352165 - DNA, 75 bp, Artificial Sequence
  Synthetic
atgacagttgttagcgccgtccattttaaagcaatgtggaaatatccattttctaaacatcttacatatacagac

SEQ ID NO: 352166 - DNA, 75 bp, Artificial Sequence
  Synthetic
aagttttatatttctaaaaatatagttaccagcgttgatatgatggtgagcactgaaaacgacttacaatatgta

SEQ ID NO: 352167 - DNA, 75 bp, Artificial Sequence
  Synthetic
catattaatgaattatttggaggattctctattatcgatattccatacgagggaaactctagtatggtaattata

SEQ ID NO: 352168 - DNA, 75 bp, Artificial Sequence
  Synthetic
ctaccagacgacatagaaggtttatataacatagaaaaacacataactgaagaaaattttaaaaaatggtgtggt

SEQ ID NO: 352169 - DNA, 75 bp, Artificial Sequence
  Synthetic
ttcaacatttatagcatttgtaccgcatacagatcaaaaaataccatcatcatagcatgcgactatgataccatg

SEQ ID NO: 352170 - DNA, 75 bp, Artificial Sequence
  Synthetic
aagttatacactaaaagtatagacttgtatatgccaaagtttaaactgaaaatgacagaatcgtataatctggta

SEQ ID NO: 352171 - DNA, 75 bp, Artificial Sequence
  Synthetic
cctattctagaaaatttaggacttactaatatattcggatattatgcagattttagcaagatgtgtaatgaaact

SEQ ID NO: 352172 - DNA, 75 bp, Artificial Sequence
  Synthetic
atcactgtagaaaaatttctacacaagacgtttatagatgttaatgaggagtatacagaagcatcggctattaca

SEQ ID NO: 352173 - DNA, 75 bp, Artificial Sequence
  Synthetic
ggagtatttatgactaacttttcgatggtatatcgtacgaaggtctacataaaccatccattcatatacatgatt

SEQ ID NO: 352174 - DNA, 75 bp, Artificial Sequence
  Synthetic
aaagacaacacaggacgtatactctttatagggaaatactgttatccacaataaatataaacaaatagacttttt

SEQ ID NO: 352175 - DNA, 75 bp, Artificial Sequence
  Synthetic
atctcatgtctaagaattacaaagtaatatagttagtataactaaagttaatactacattaaaacttaaaaaaat

SEQ ID NO: 352176 - DNA, 75 bp, Artificial Sequence
  Synthetic
aataatatcactattacaattaataagtataaactataaactaaaaattaaacaatatcgttattatataagtaa

SEQ ID NO: 352177 - DNA, 75 bp, Artificial Sequence
  Synthetic
tagcctgtcttatattcgtgactttatccattgctagtcactttacattcccgttattcctcccattacggaaga

SEQ ID NO: 352178 - DNA, 75 bp, Artificial Sequence
  Synthetic
taaatcgtttaatagtgtagaggtattagtttccttgtttagagatgatcaaaaagactatacggtaacttctca

SEQ ID NO: 352179 - DNA, 75 bp, Artificial Sequence
  Synthetic
gttcaataactacacatcgacaccaacgactggactataaatgtactatccgatggtctggatataccattgact

SEQ ID NO: 352180 - DNA, 75 bp, Artificial Sequence
  Synthetic
cgatggtctggatataccattgactaatataacttattggtcacggtttactataggtcgtgtattgttcaaatc

SEQ ID NO: 352181 - DNA, 75 bp, Artificial Sequence
  Synthetic
agagtctgaggatattttccaaaagaacatgagtattctaggtgtctctattgaatgtaagaagccgtcggtatt

SEQ ID NO: 352182 - DNA, 75 bp, Artificial Sequence
  Synthetic
acttactttttgaccgtgtgtaaaatgactcgagtatttgacttccagatatggattattatcgaggagactgtc

SEQ ID NO: 352183 - DNA, 75 bp, Artificial Sequence
  Synthetic
tttgcattatagaattgtctatctatctgtattaccgacgattgtccaatattctgttctaggagagtaatgggt

SEQ ID NO: 352184 - DNA, 75 bp, Artificial Sequence
  Synthetic
tagaagtcgtttatataacaatgacttataaaaatactaaaactgaagagactgattacgcatacctctctaatg

SEQ ID NO: 352185 - DNA, 75 bp, Artificial Sequence
  Synthetic
tgcggattcctgaatactatcgattgatgagtaatggggttgatggttgattattgattagttttccttattctt

SEQ ID NO: 352186 - DNA, 75 bp, Artificial Sequence
  Synthetic
tttattcacataaaagaatattttttataaacatgaaaccactgtctaaatgtaattatgatcttgatttataga

SEQ ID NO: 352187 - DNA, 75 bp, Artificial Sequence
  Synthetic
cttcttaccaacatcttaagcgtagaagttgtaaataacaatgagatgtatcatcttattccccatagactatcg

SEQ ID NO: 352188 - DNA, 75 bp, Artificial Sequence
  Synthetic
aataaatataacttattttaagattaagtgctattgtacttaattttttgttctataaactgaatatatagctac

SEQ ID NO: 352189 - DNA, 75 bp, Artificial Sequence
  Synthetic
atgattatactctgtattagttctattggaagatgtgttatctctatagataatgacgttaataacaaaaatatt

SEQ ID NO: 352190 - DNA, 75 bp, Artificial Sequence
  Synthetic
gtatgagaaaaactgcgttgtttcatgacaatcaattggggcatgcggaagacaatcaagatagtgtagcgtcgc

SEQ ID NO: 352191 - DNA, 75 bp, Artificial Sequence
  Synthetic
taccgtacaagtatctacaagtagtcaataaaagagaacgtagtagattgctggctacgtttaattggacaagta

SEQ ID NO: 352192 - DNA, 75 bp, Artificial Sequence
  Synthetic
tagctgagggtgttaaaaatgatttcattagaatatgtgatatcaacggaacatatctatataattatactattg

SEQ ID NO: 352193 - DNA, 75 bp, Artificial Sequence
  Synthetic
ctgttagtatgattattgattccatggaagaactaccaacaattacaacatatgaaccgtctacctataattata

SEQ ID NO: 352194 - DNA, 75 bp, Artificial Sequence
  Synthetic
ctttcgataatagcactgttagtactactgaagaactaaaagtgactccatcaccaactacatacgcgactgtaa

SEQ ID NO: 352195 - DNA, 75 bp, Artificial Sequence
  Synthetic
caactcctcttccaacatcatcagttccatatgatcaacgatctaataacaatgtaagtactatatctattcaga

SEQ ID NO: 352196 - DNA, 75 bp, Artificial Sequence
  Synthetic
tactgagtaaaatattgggagtcaatgaaacagaattaactaattatcttattacgcataaaaatgccacggttg

SEQ ID NO: 352197 - DNA, 75 bp, Artificial Sequence
  Synthetic
acaataacacattgtatggtaatataggatttttggaaataaataattgctacaatatttctgtatcaaatgcta

SEQ ID NO: 352198 - DNA, 75 bp, Artificial Sequence
  Synthetic
gttttagaataacattagtaaacaatacttctgaagaaattgttataatgctaacagggactagttcatccgaca

SEQ ID NO: 352199 - DNA, 75 bp, Artificial Sequence
  Synthetic
ccttcatatcttccaccaatatcactgaatgtttgaaaacattaatcaataatacgtcgaatattagtgatgtaa

SEQ ID NO: 352200 - DNA, 75 bp, Artificial Sequence
  Synthetic
gtataacacaaaatatgaatgtaacatctaattgtgataaatgttcaatgaatttgatgacatccgttatccctg

SEQ ID NO: 352201 - DNA, 75 bp, Artificial Sequence
  Synthetic
ccgttaaagaatttaacaatacgttgaaaaaaattggtgtaaaagatgataaaaacaatacagtatataactatt

SEQ ID NO: 352202 - DNA, 75 bp, Artificial Sequence
  Synthetic
ataattgtaaactaactacaaattctacatgtgacgagttaatcaatttagatgaagtcattaacaatataactt

SEQ ID NO: 352203 - DNA, 75 bp, Artificial Sequence
  Synthetic
tgacaaatattataagtagtagtgtttctacaaccaacagcagaaaaagacgagatctgaatggtgagtttgaat

SEQ ID NO: 352204 - DNA, 75 bp, Artificial Sequence
  Synthetic
catactgctccagaattaataatatctctaatagatttgattagtagatatatggctatcgcaaaacaccatata

SEQ ID NO: 352205 - DNA, 75 bp, Artificial Sequence
  Synthetic
tttctacatccgaggaattagattgtctttacaaatcatatggtgtaagtgatgatgtaagtcattgtttttcat

SEQ ID NO: 352206 - DNA, 75 bp, Artificial Sequence
  Synthetic
tctttacaaatcatatggtgtaagtgatgatgtaagtcattgtttttcattacctagacgtagacgatctgacga

SEQ ID NO: 352207 - DNA, 75 bp, Artificial Sequence
  Synthetic
attcattagtaatatcacatcaagtacaaaatatatcaactcatgtgtagtaaattcgtcactgagtttacagat

SEQ ID NO: 352208 - DNA, 75 bp, Artificial Sequence
  Synthetic
caaacaggagtacacagaaatgaaattactcgaccacgcgaaaaaagatttaagaatagacagtgttattcctag

SEQ ID NO: 352209 - DNA, 75 bp, Artificial Sequence
  Synthetic
aggtacaactcatttccaagtaggtgcatctggagcaagtggtggtgttgtaggtgatagttccccatttcaaaa

SEQ ID NO: 352210 - DNA, 75 bp, Artificial Sequence
  Synthetic
tgttaaatcacgggccagtctattggcagaaaaaataatgcctagagtacccactactgctaccgaagagcagct

SEQ ID NO: 352211 - DNA, 75 bp, Artificial Sequence
  Synthetic
atatgcaactataaatagacaaacaaagttgcctgcaggtgttaaaagtactccgtttacagaggcgcttgtgtc

SEQ ID NO: 352212 - DNA, 75 bp, Artificial Sequence
  Synthetic
ctccgtttacagaggcgcttgtgtctacgataaaccaaaagctttctagtgttaaagaggtaacttatgcttcgc

SEQ ID NO: 352213 - DNA, 75 bp, Artificial Sequence
  Synthetic
cgtagactagactgtttatacaagattgaaattatattctttttttatagagcgtgtgatgttacggatatctaa

SEQ ID NO: 352214 - DNA, 75 bp, Artificial Sequence
  Synthetic
tcaatctgccaggatcaagtggttatgttcatagaccatctgattctgttatttacagcactataagacggacac

SEQ ID NO: 352215 - DNA, 75 bp, Artificial Sequence
  Synthetic
agcatctcgtttagattttccatcggccttattaaatactctcccgtcgatgtctacacaggcataaaatgtagg

SEQ ID NO: 352216 - DNA, 75 bp, Artificial Sequence
  Synthetic
gtttacctagtgataccgatagtgattttgaggatatacaaactgttgttaaggaatataatgaaagatatggta

SEQ ID NO: 352217 - DNA, 75 bp, Artificial Sequence
  Synthetic
gacgagttagtagaacacagtcatcaagtagtgattttgaagatatagatgaggtggttgcagaatatagacaaa

SEQ ID NO: 352218 - DNA, 75 bp, Artificial Sequence
  Synthetic
aatatggtggagctagccgtggtagaacatcgtcatcaagtagtagtgattttgaagatatagatgaggtggttg

SEQ ID NO: 352219 - DNA, 75 bp, Artificial Sequence
  Synthetic
cagaatatagacaaaaatatggcaacgctatgacaaaaggacgtggttcttctaaaccggatccgttatatagta

SEQ ID NO: 352220 - DNA, 75 bp, Artificial Sequence
  Synthetic
ctgttaagaaaacacctaaaagtatagcatctggagtagacatagtttcaaaacaaacagactattctttattac

SEQ ID NO: 352221 - DNA, 75 bp, Artificial Sequence
  Synthetic
ccggcgttaatactggcagttctatcgtaacacctctcaccagaagaggagctactagacgacctaaacgcccat

SEQ ID NO: 352222 - DNA, 75 bp, Artificial Sequence
  Synthetic
gtcttcaataattctactttagtattacctgatgcaggcaatagcgacataaacatagaaaacgaatagccaaac

SEQ ID NO: 352223 - DNA, 75 bp, Artificial Sequence
  Synthetic
accgcttcctctaaatcctccgtatcgacaactttctcgtggtggtgatcattctctacaacaagttcctcaacg

SEQ ID NO: 352224 - DNA, 75 bp, Artificial Sequence
  Synthetic
attctctacaacaagttcctcaacgtgattattctccaccacatagacctcctccaccacttcctcctaaaccag

SEQ ID NO: 352225 - DNA, 75 bp, Artificial Sequence
  Synthetic
tgattattctccaccacatagacctcctccaccacttcctcctaaaccagttccagctattccacctagagatag

SEQ ID NO: 352226 - DNA, 75 bp, Artificial Sequence
  Synthetic
ttccagctattccacctagagatagtcaaccaaataataaaggatttagtaagtttgtatctcctagacggtgta

SEQ ID NO: 352227 - DNA, 75 bp, Artificial Sequence
  Synthetic
tcaaccaaataataaaggatttagtaagtttgtatctcctagacggtgtagaagatcaacctctggagtcgtatg

SEQ ID NO: 352228 - DNA, 75 bp, Artificial Sequence
  Synthetic
gaagatcaacctctggagtcgtatgtggtatgatacaatcaagaccaaacgatgatacatattcacttcttcaac

SEQ ID NO: 352229 - DNA, 75 bp, Artificial Sequence
  Synthetic
taccaaaaattgaaccagaatatgcggaggtaggtaatggcttacccaagaacaatgttcctgtgataggcaata

SEQ ID NO: 352230 - DNA, 75 bp, Artificial Sequence
  Synthetic
aacatagtaaaaaatatacatcgtcgatgtcaaaaatatcaacaaaatttgataaatctatggcatttggaacag

SEQ ID NO: 352231 - DNA, 75 bp, Artificial Sequence
  Synthetic
caatgttactaactggtcaacaggctattaaccaacaggatagatcaactgcgttgattaaaaaagatcaaatga

SEQ ID NO: 352232 - DNA, 75 bp, Artificial Sequence
  Synthetic
gcaaggacgaaaaaatattcgaagcagttacaatgactctatcaactataggttcaacgttgacaactgcaggta

SEQ ID NO: 352233 - DNA, 75 bp, Artificial Sequence
  Synthetic
tgatagctccaccactaatgattgctggaataggtatatcgcttatatcaggtataatagatacggcaaaagata

SEQ ID NO: 352234 - DNA, 75 bp, Artificial Sequence
  Synthetic
tatattacctattttcaggacaggagaagccagtagatccagttattaagttttttaacacatacgctggattag

SEQ ID NO: 352235 - DNA, 75 bp, Artificial Sequence
  Synthetic
cctggaattattaccatagaagatgttagaaaaatgatgctggttattacacatgtgttttaatatatatatata

SEQ ID NO: 352236 - DNA, 75 bp, Artificial Sequence
  Synthetic
tatccgatagtagtaaaatgggtgtaaggaaatgtttgacgcctggagaagacacacttatttacatcgcataca

SEQ ID NO: 352237 - DNA, 75 bp, Artificial Sequence
  Synthetic
aaaacgattccagttttaaacaaaatacggaggcaatggctttatatttcttagatgttatcaactcagagatcc

SEQ ID NO: 352238 - DNA, 75 bp, Artificial Sequence
  Synthetic
tatatctaaacacatcaaatttagttttagagtatcatctaaaggtggcttgtcccataggaacattaagatctg

SEQ ID NO: 352239 - DNA, 75 bp, Artificial Sequence
  Synthetic
tagatgtggacataactgcgtatacaatattatatgatacagcggataatattaaaaaatacaagtttatcagaa

SEQ ID NO: 352240 - DNA, 75 bp, Artificial Sequence
  Synthetic
tggcaacgctactatccaaacatccagttattagattgacatgtggtttagcagcaacattggtaattaaaccgt

SEQ ID NO: 352241 - DNA, 75 bp, Artificial Sequence
  Synthetic
gcagcaacattggtaattaaaccgtacgaggtacccatcagtgatatgcaactactaaaaatggcaacgcctggt

SEQ ID NO: 352242 - DNA, 75 bp, Artificial Sequence
  Synthetic
gaaccagaatccactaaatctataccatctgatgtctgtgataggtatcctctaaagaaattctatcttttggct

SEQ ID NO: 352243 - DNA, 75 bp, Artificial Sequence
  Synthetic
ggtggttgtccatatgatacatctcaaacttttattgtacatactacttgcagtattttactaagaacagctaca

SEQ ID NO: 352244 - DNA, 75 bp, Artificial Sequence
  Synthetic
tgggatcagtttagaaacagatgggtgttacaaaatccatttaggcaagaagggacatataagcaactgtttacc

SEQ ID NO: 352245 - DNA, 75 bp, Artificial Sequence
  Synthetic
tttagcaaatacgattttaacgacaccataatagatcctaatggtgtggcgggtcatgctagcttttgtaccaat

SEQ ID NO: 352246 - DNA, 75 bp, Artificial Sequence
  Synthetic
agaagcagcaaccaatgtttctggtcagaacctatgatattggaagatgtatcatcgtgtagttctagaactaga

SEQ ID NO: 352247 - DNA, 75 bp, Artificial Sequence
  Synthetic
aaaatatacgtaaaactgggaatatttaatactgaagggtttaatagttttgtactaaactgtccaactgggtct

SEQ ID NO: 352248 - DNA, 75 bp, Artificial Sequence
  Synthetic
acgccaacatacatcaaagataaaaatacggacagtaacaatgttatcatagagctacctgtaggtgattacggc

SEQ ID NO: 352249 - DNA, 75 bp, Artificial Sequence
  Synthetic
actgccaaattgtattcggtaacaaaaccatcgagaatagctgtattctgcacacataactatgataaacgattc

SEQ ID NO: 352250 - DNA, 75 bp, Artificial Sequence
  Synthetic
aaatcagatattatagttctaatatttaatagtatcagtggtattccattttcgagcatatacacaggaagtgtg

SEQ ID NO: 352251 - DNA, 75 bp, Artificial Sequence
  Synthetic
aacggtagaaatagactgttcaccacattgtctaaaggaatgccatatagatcaatgtattgcgataacagacga

SEQ ID NO: 352252 - DNA, 75 bp, Artificial Sequence
  Synthetic
ccaggttgttattatgcaggaataccatttaatgaaaatagtgtagaatcagatctgcattatggaccagaaata

SEQ ID NO: 352253 - DNA, 75 bp, Artificial Sequence
  Synthetic
atgcttaaggaaacatatgacacaaacagtattgatccacaagttataacaaagtcaaaaacacactttcctact

SEQ ID NO: 352254 - DNA, 75 bp, Artificial Sequence
  Synthetic
ccaataagtgtaaaatttacggttgacaatttaggaaatgggtataacaaacccgaaaatttttggaaagacgct

SEQ ID NO: 352255 - DNA, 75 bp, Artificial Sequence
  Synthetic
aaaagtaagaaaaggacatatagcgcaatgacaataaaaatcctaccatgtacagtgagaaataaaaatgtagac

SEQ ID NO: 352256 - DNA, 75 bp, Artificial Sequence
  Synthetic
tttggatataactatggacatattatttctaatatggtttatgcacaatctactagtcaggattatggagatggt

SEQ ID NO: 352257 - DNA, 75 bp, Artificial Sequence
  Synthetic
accaactatacatttaaatctgtaaatagatccgatcatgagtgtgaatctattttagatttgaaggctaaggaa

SEQ ID NO: 352258 - DNA, 75 bp, Artificial Sequence
  Synthetic
gtaactgtgatgtgtcccgcgtttagtataccaagaaatatatcagcgtatgaaggtctatgctttagtgtcact

SEQ ID NO: 352259 - DNA, 75 bp, Artificial Sequence
  Synthetic
acatctaaagatcattgtgcctcaaataaggaatggttaaaatcttatggttatgggaatacagatgctactaaa

SEQ ID NO: 352260 - DNA, 75 bp, Artificial Sequence
  Synthetic
caacgtgtctgttttcatcattggaattatgtcacaacgtcgttggattattactgttcatacgaagatatttgg

SEQ ID NO: 352261 - DNA, 75 bp, Artificial Sequence
  Synthetic
aaaagcgactggcctgactatgatccatgtaagtcatatatttatatagagtatagagacatatggatagaatct

SEQ ID NO: 352262 - DNA, 75 bp, Artificial Sequence
  Synthetic
aaagtgttgcagcaacctccttatacattcgaattcacacatgacgattctaatgaatacgtgaataaagaaatt

SEQ ID NO: 352263 - DNA, 75 bp, Artificial Sequence
  Synthetic
tacaatacagtgttcccttgtcattaaattgtgaatcatccagtccactgaatagcaaaatttttactattttgg

SEQ ID NO: 352264 - DNA, 75 bp, Artificial Sequence
  Synthetic
agtaacaaattgaatgatctgtacaatgaatacaagaacattatggaatatagcgacggatcattgcctgcttct

SEQ ID NO: 352265 - DNA, 75 bp, Artificial Sequence
  Synthetic
ataaacagattagcaaaatcattaacttcagagggtagagaaatagcaagtgttaatatagatggtaatctgtta

SEQ ID NO: 352266 - DNA, 75 bp, Artificial Sequence
  Synthetic
gatattgcatatcaagcagataaggaaaagatggctgatatacagaacaaaataaatgacatcacaagagattta

SEQ ID NO: 352267 - DNA, 75 bp, Artificial Sequence
  Synthetic
ttcattcacactttatcaaacaaagatataaaagacattatagaatccgaagaaggtaagagatgttgtataata

SEQ ID NO: 352268 - DNA, 75 bp, Artificial Sequence
  Synthetic
gatgttaagaacaatcgtgttaaaaagtactatcctattgataattatctatgtggtactttagatgattatata

SEQ ID NO: 352269 - DNA, 75 bp, Artificial Sequence
  Synthetic
accttactcatgattaaacctaaataattatactttgtaatataatgatatatattttcactttatctcatttga

SEQ ID NO: 352270 - DNA, 75 bp, Artificial Sequence
  Synthetic
tacacttctgtagaatataacaaatcctatgtgttaataaacgacacttacatgagctatgactatcttgaatca

SEQ ID NO: 352271 - DNA, 75 bp, Artificial Sequence
  Synthetic
tcaggtgtagttgttttatcatgttatgaaatgactataatctccttggatacaaaagacgccaaagatgctata

SEQ ID NO: 352272 - DNA, 75 bp, Artificial Sequence
  Synthetic
gaagatgagatagtagcaagtgctgtagccgaagcattgaatgacatgtttaaggaatttgataaaaacgtaagt

SEQ ID NO: 352273 - DNA, 75 bp, Artificial Sequence
  Synthetic
gttattataataaaagaagaagataattatctaaacagttctccgaatatataccatataatatacatcataggc

SEQ ID NO: 352274 - DNA, 75 bp, Artificial Sequence
  Synthetic
ggcactattctgatactgttagtcattattttaatattggtaatttatatagcatgcaataaatacagaaccagg

SEQ ID NO: 352275 - DNA, 75 bp, Artificial Sequence
  Synthetic
aaatataaaataatgaaagatgatactatgagcattaaatctgagcatcataatagtcttgaaacagtatctatg

SEQ ID NO: 352276 - DNA, 75 bp, Artificial Sequence
  Synthetic
gaaattatggataatcggtactaataaaaaatagtttaactctttttagaaccagtttggtactggaatttcagt

SEQ ID NO: 352277 - DNA, 75 bp, Artificial Sequence
  Synthetic
ttttttaagatgatatttactttttatatgcttgcattacagaataatattcacaggtattattaaaatgagtat

SEQ ID NO: 352278 - DNA, 75 bp, Artificial Sequence
  Synthetic
gcatgtttgatatattctttaaatggaacagacatcacagactgagatacgcaaagaatcctacattcctaaact

SEQ ID NO: 352279 - DNA, 75 bp, Artificial Sequence
  Synthetic
aatgtatcacttacgataatgtctctataaacgaccggtttatcattaattaatacaatgtctaaattccatagc

SEQ ID NO: 352280 - DNA, 75 bp, Artificial Sequence
  Synthetic
tataaacgaccggtttatcattaattaatacaatgtctaaattccatagcatattacaaaatcaccgtctaagat

SEQ ID NO: 352281 - DNA, 75 bp, Artificial Sequence
  Synthetic
atattacaaaatcaccgtctaagatgataaaaacacgtttattttatatgtcaaccattactaaaaaatatattg

SEQ ID NO: 352282 - DNA, 75 bp, Artificial Sequence
  Synthetic
ttctgtttttgttttctttttcttacacacatcgctaattatgaaaaagtaaatgatgaaatgtatgagatggtg

SEQ ID NO: 352283 - DNA, 75 bp, Artificial Sequence
  Synthetic
cacacatcgctaattatgaaaaagtaaatgatgaaatgtatgagatggtgagatggacgagattgtgaacattgt

SEQ ID NO: 352284 - DNA, 75 bp, Artificial Sequence
  Synthetic
aacacactctaccagtcaagtcaataatattagcctttacagatatattcatagtagttgtgacaatgactccat

SEQ ID NO: 352285 - DNA, 75 bp, Artificial Sequence
  Synthetic
tcgtgatagtatgtggtttatacctaacgtatttatggacaacggtgagaatgacggccacgtttctgtcaacaa

SEQ ID NO: 352286 - DNA, 75 bp, Artificial Sequence
  Synthetic
tttttagttatctgatgaaagataaactagatatataaataatcccattctaatactttaacatgatgtattaca

SEQ ID NO: 352287 - DNA, 75 bp, Artificial Sequence
  Synthetic
tgtctgtcatatgtatttcgcgttctttgatgttgatacatcgtctcatctgtttaagctagttattaaacactg

SEQ ID NO: 352288 - DNA, 75 bp, Artificial Sequence
  Synthetic
ttataatcgcaatatccttctccttcctcttctatatcgtccttaaacttattcttagtgtcacagaattgacca

SEQ ID NO: 352289 - DNA, 75 bp, Artificial Sequence
  Synthetic
agatagaaaagtgtattagacgactcatgttgtacatttctgtgagaaaaagaggatatcaaatacgcatataga

SEQ ID NO: 352290 - DNA, 75 bp, Artificial Sequence
  Synthetic
ggtatgtctccactacattgctatgtgatgaatacacgatttaagccatctgtattaaagatattgttacacaac

SEQ ID NO: 352291 - DNA, 75 bp, Artificial Sequence
  Synthetic
ggtgtgaataactttgataataaggataacaaaggacatattcctctacaccactatctgatttattcactatca

SEQ ID NO: 352292 - DNA, 75 bp, Artificial Sequence
  Synthetic
agattgggtgtagatctagatgcggtgatcagggctaacaataatagactaccaaaaagatctgtgatgttagta

SEQ ID NO: 352293 - DNA, 75 bp, Artificial Sequence
  Synthetic
atcgataacaaggtctttgatatactaactgaccccattgatgactttagtaaatcatccgatctattgctgtgt

SEQ ID NO: 352294 - DNA, 75 bp, Artificial Sequence
  Synthetic
tatcttagatataaattcaatgggagattaaactactacgttctgtacaaattattgactaaaggatctgaccct

SEQ ID NO: 352295 - DNA, 75 bp, Artificial Sequence
  Synthetic
aattgcgtcgacgaggatggactcacttctcttcattactactgtaaacacatatccgcattccacgaaagtaat

SEQ ID NO: 352296 - DNA, 75 bp, Artificial Sequence
  Synthetic
tattacaagtcaaagagttacactaagatgcgagctgagaagcgattcatctatacgataataaatcatggggca

SEQ ID NO: 352297 - DNA, 75 bp, Artificial Sequence; identical to SEQ ID NO: 253849
  Synthetic

SEQ ID NO: 352298 - DNA, 75 bp, Artificial Sequence
  Synthetic
tcaacagtataccaaacatagtcctcgtgtggtgtatgctcttttatctcgaggagccgatacgagaatacgtaa

SEQ ID NO: 352299 - DNA, 75 bp, Artificial Sequence
  Synthetic
taattttgattgtacacccatcatggaatacataaagaacgattgtgtaacaggtcatattctcataatgttact

SEQ ID NO: 352300 - DNA, 75 bp, Artificial Sequence
  Synthetic
caattggcacgaacaaaaatacgggaaattacaaaaggaagaaggacaccatttactttatctattcataaaaca

SEQ ID NO: 352301 - DNA, 75 bp, Artificial Sequence
  Synthetic
taatcaaggatacggaagtcacgctttcaatatattacggtatctactagataggttcgacattcagaaagacga

SEQ ID NO: 352302 - DNA, 75 bp, Artificial Sequence
  Synthetic
ataggttcgacattcagaaagacgaatattataataccatgactcctcttcatacagccttccagaattgtaaca

SEQ ID NO: 352303 - DNA, 75 bp, Artificial Sequence
  Synthetic
atattataataccatgactcctcttcatacagccttccagaattgtaacaacaatgttgcctcataccttgtata

SEQ ID NO: 352304 - DNA, 75 bp, Artificial Sequence
  Synthetic
catcggatacgacatcaaccttcctactaaagacgataagacagtattcgacttggtgtttgaaaacagaaacat

SEQ ID NO: 352305 - DNA, 75 bp, Artificial Sequence
  Synthetic
cttattcaatgcgggtgttattcacaacatcatccaccacagactgaaagtatctctacctatgattaaatcgtt

SEQ ID NO: 352306 - DNA, 75 bp, Artificial Sequence
  Synthetic
gttctataagatgttagaattctctccctacgacgattactacgtaaagaagataatagcctactgcatattaag

SEQ ID NO: 352307 - DNA, 75 bp, Artificial Sequence
  Synthetic
ggacgagtcattcacggaactacatagtaaattctgtttaaacgaggactataaaagtgtatttatgaaaaatat

SEQ ID NO: 352308 - DNA, 75 bp, Artificial Sequence
  Synthetic
ataaaagtgtatttatgaaaaatatatcattcgataagatagattccatcatcaaaaaatgcaactgggacataa

SEQ ID NO: 352309 - DNA, 75 bp, Artificial Sequence
  Synthetic
gtcgcctcaaagatattcaaatctctgacaccaacctgtatactgtattaagaacagaagacatccggtatcgta

SEQ ID NO: 352310 - DNA, 75 bp, Artificial Sequence
  Synthetic
cctatcttaaagccatacatttagatagtcacatttcatttcccatgtacgacgatcttatagaacagtgtcatc

SEQ ID NO: 352311 - DNA, 75 bp, Artificial Sequence
  Synthetic
tatcgatggagcgtaaaagtaaactcgtcgacaaagtactcaataaattaaagtctaccatcgatggtcaatcta

SEQ ID NO: 352312 - DNA, 75 bp, Artificial Sequence
  Synthetic
gactatcgtatttgcctccagaaattatacgcaacatcataaccaagctaagcgactatcatctaaacagtatgt

SEQ ID NO: 352313 - DNA, 75 bp, Artificial Sequence
  Synthetic
tgtacggaaagaaccattacaaatattatacatgataggaagaaaatatttaaaaaatatctatatgattggaga

SEQ ID NO: 352314 - DNA, 75 bp, Artificial Sequence
  Synthetic
agtaggaaacaggaacacggtgattactacattattaaatcatgaagtccgtattatacttgtatatattgtttc

SEQ ID NO: 352315 - DNA, 75 bp, Artificial Sequence
  Synthetic
ttctattagataataaacagaatagaaatattatacccccaaccagttatgtttagcgtgtcatgatactaagta

SEQ ID NO: 352316 - DNA, 75 bp, Artificial Sequence
  Synthetic
cggaagagatgcagcaccgtatacaccacccaatggaaagtgtaaagacaccgaatacaaacgccataatctgtg

SEQ ID NO: 352317 - DNA, 75 bp, Artificial Sequence
  Synthetic
tggttcgggtacctttacatctcgcaataatcatttacccgcttgtctaagttgtaacggaagatgcaatagtaa

SEQ ID NO: 352318 - DNA, 75 bp, Artificial Sequence
  Synthetic
tcaggtagagacgcgatcgtgtaacacgactcacaatagaatctgtgaatgctctcccggatattattgtcttct

SEQ ID NO: 352319 - DNA, 75 bp, Artificial Sequence
  Synthetic
agaatgagatagaaaagtgtattagacgacttcatgttgtacatttctgtgagaaaaagaggatatcaaatacgc

SEQ ID NO: 352320 - DNA, 75 bp, Artificial Sequence
  Synthetic
taaaggatcatccggatgcaaggcatgtgtttcccaaacaaaatgtggaataggatacggagtatccggacacac

SEQ ID NO: 352321 - DNA, 75 bp, Artificial Sequence
  Synthetic
taggatacggagtatccggacacacgtctgttggagacgtcatctgttctccgtgtggtttcggaacatattctc

SEQ ID NO: 352322 - DNA, 75 bp, Artificial Sequence
  Synthetic
acaccgtctcttccgcagataaatgcgaacccgtacccaacaatacatttaactatatcgatgtggaaattacac

SEQ ID NO: 352323 - DNA, 75 bp, Artificial Sequence
  Synthetic
tgtatccagttaacgacacatcgtgtactcggacgaccactaccggtctcagcgaatccatcttaacgtcggaac

SEQ ID NO: 352324 - DNA, 75 bp, Artificial Sequence
  Synthetic
taactattactatgaatcatacagattgcaatcccgtatttcgtgaggaatacttctctgtccttaataaggtag

SEQ ID NO: 352325 - DNA, 75 bp, Artificial Sequence
  Synthetic
caacttcaggattttttacaggagaaaatagatatcaaaatatttcaaaggtgtgtactttaaattttgagatta

SEQ ID NO: 352326 - DNA, 75 bp, Artificial Sequence
  Synthetic
gatgacggtatgatgtcgcattcggagacggtaactctagcgggtgactgtctatctagcgtcgacatctatata

SEQ ID NO: 352327 - DNA, 75 bp, Artificial Sequence
  Synthetic
ctatatagtaataccaatgctcaagactacgaaactgatacaatctcttatcgtgtgggtaatgttctcgatgat

SEQ ID NO: 352328 - DNA, 75 bp, Artificial Sequence
  Synthetic
actacgaaactgatacaatctcttatcgtgtgggtaatgttctcgatgatgatagccatatgcccggtagttgca

SEQ ID NO: 352329 - DNA, 75 bp, Artificial Sequence
  Synthetic
atatacataaaccgatcactaattccaaacccacccgctttttatagtaagtttttcacccataaatagtaaata

SEQ ID NO: 352330 - DNA, 75 bp, Artificial Sequence
  Synthetic
caataattaatttctcgtaaaagtagaaaatatattctaatttattgcacggtaaggaagtagaatcataaagaa

SEQ ID NO: 352331 - DNA, 75 bp, Artificial Sequence
  Synthetic
cagtactcaatcaatagcaatcatgaaacaatatatcgtcctggcatgcatgtgcctggcggcagctgctatgcc

SEQ ID NO: 352332 - DNA, 75 bp, Artificial Sequence
  Synthetic
tgccagtcttcagcaatcctcatcctcgtgtactgaagaagaaaacaaacattatatgggaatcgatgttattat

SEQ ID NO: 352333 - DNA, 75 bp, Artificial Sequence
  Synthetic
caaagtcacaaagcaagaccaaacaccaaccaatgataagatttgccaatccgtaacggaaattacagagtccga

SEQ ID NO: 352334 - DNA, 75 bp, Artificial Sequence
  Synthetic
gtcagatcccgaggtggaatcagaagatgattccacatcagtcgaggatgtagatcctcctaccacttattactc

SEQ ID NO: 352335 - DNA, 75 bp, Artificial Sequence
  Synthetic
cattattggcggaggtctgagaatgaactttggattcaccaaatgtcctcagattaaatccatctcagaatccgc

SEQ ID NO: 352336 - DNA, 75 bp, Artificial Sequence
  Synthetic
taatggaaacgcagtgaatgctagattgtccagtgtgcccccaggacaaggtaaggactctcccgctatcactcg

SEQ ID NO: 352337 - DNA, 75 bp, Artificial Sequence
  Synthetic
gactgtgagctgtctatcgacattagatgtagcgaagaagagaaagacagcgacatccagacccatccagtactc

SEQ ID NO: 352338 - DNA, 75 bp, Artificial Sequence
  Synthetic
gagtctaacatctctcataagaaagtgagttacgaagatatcatcggttcaacgatcgttgatacaaaatgcgtc

SEQ ID NO: 352339 - DNA, 75 bp, Artificial Sequence
  Synthetic
aagaatctagagtttagtgttcgtatcggagacatgtgcaaggaatcgtctgatcttgaggtcaaggatggattt

SEQ ID NO: 352340 - DNA, 75 bp, Artificial Sequence
  Synthetic
aagtatgtcgacggatcggtatctgaaggtgtaaccgatgatacttcactcatcgattcaacaaaactcaaatcg

SEQ ID NO: 352341 - DNA, 75 bp, Artificial Sequence
  Synthetic
catcgattcaacaaaactcaaatcgtgtgtctgaataaataactctattcatccgagattcgggtaagtagggtt

SEQ ID NO: 352342 - DNA, 75 bp, Artificial Sequence
  Synthetic
aatcgaacgatttagtcacactacgaattaaaaaagtgtacctgacactatactccggtttacaaaacaaaaatg

SEQ ID NO: 352343 - DNA, 75 bp, Artificial Sequence
  Synthetic
tgatggagtcactaaaatatttttattctcattctgatgcatcaactatttcttaaacaataacgttcaacaaca

SEQ ID NO: 352344 - DNA, 75 bp, Artificial Sequence
  Synthetic
gcttggaatgcctaccaatagaagaagtgaactagtcattgattcagaaatccagtcgctggaatattaaacatt

SEQ ID NO: 352345 - DNA, 75 bp, Artificial Sequence
  Synthetic
tcttaaacaataacgttcaacaacatatactctcgagcttatcaacatcccctatgtcccaactaggttaccaaa

SEQ ID NO: 352346 - DNA, 75 bp, Artificial Sequence
  Synthetic
caattgtatatcataaaataatgtttataatttacacgttaaaatcatataataaaacgtagatcgtataatatt

SEQ ID NO: 352347 - DNA, 75 bp, Artificial Sequence
  Synthetic
ttttggtatataaatgatctagtaaaatccatgtaggggatactgttcacgtttttttggtacaaaatttctcac

SEQ ID NO: 352348 - DNA, 75 bp, Artificial Sequence
  Synthetic
aagtttttatacagacaaattcttgtccatatattttaaaacattgacttttgcactaagaaaaatatatagact

SEQ ID NO: 352349 - DNA, 75 bp, Artificial Sequence
  Synthetic
gtctctataaagcgattgatttttttaccctctagagtttcctacagtcgtgggtcacacatttttttctagaca

SEQ ID NO: 352350 - DNA, 75 bp, Artificial Sequence
  Synthetic
tctctataaagcgattgatttttttaccctctagagtttcctacagtcgtgggtcacacatttttttctagacac

SEQ ID NO: 352351 - DNA, 75 bp, Artificial Sequence
  Synthetic
tcaacgccttagaaataagagacttaaacaacggacacctggaattattaccatagaagatgttagaaaaatgat

SEQ ID NO: 352352 - DNA, 75 bp, Artificial Sequence
  Synthetic
taacaatatgctaattctgaacccgacacaatcagactctggtatttatatgtgcattaccaagaaccgagacct

SEQ ID NO: 352353 - DNA, 75 bp, Artificial Sequence
  Synthetic
aaatagttgatgcatcagaatgagaataaaaatattttagtgactccatcagaaagaggtttaatattttttgtg

SEQ ID NO: 352354 - DNA, 75 bp, Artificial Sequence
  Synthetic
tggtccattatcagtaatagctccataaactgatacggcgatggtttttatatgtgtttgatctaacgaggaaga

SEQ ID NO: 352355 - DNA, 75 bp, Artificial Sequence
  Synthetic
tagaaataagagacttaaacaacggacacctggaattattaccatagaagatgttagaaaaatgatgctggttat

SEQ ID NO: 352356 - DNA, 75 bp, Artificial Sequence
  Synthetic
agaccatcgaagagagaaagagataaaactttttacgactccatcagaaagaggtttaatattttttgtgagacc

SEQ ID NO: 352357 - DNA, 75 bp, Artificial Sequence
  Synthetic
acgtagatcgtataatattttttggtatataaatgatctagtaaaatccatgtaggggatactgttcacgttttt

SEQ ID NO: 352358 - DNA, 75 bp, Artificial Sequence
  Synthetic
agagagaaagagataaaactttttacgactccatcagaaagaggtttaatattttttgtgagaccatcgaagaga

SEQ ID NO: 352359 - DNA, 75 bp, Artificial Sequence
  Synthetic
ctcgagagtatatgttgttgaacgttattgtttgagaaatagttgatgcatcagaatggtttgcatttattgtag

SEQ ID NO: 352360 - DNA, 75 bp, Artificial Sequence
  Synthetic
gaaagagaataaaaatatttttgtaaaacttttttgtgagaccatcgaagagagaataggaatatgaacagtgat

SEQ ID NO: 352361 - DNA, 75 bp, Artificial Sequence
  Synthetic
catatcgtacacactactgagacagaaaaagaagaagtcgcgagagataactttttgttaatgtagttaagaaca

SEQ ID NO: 352362 - DNA, 75 bp, Artificial Sequence
  Synthetic
ctttttgttaatgtagttaagaacatttttgttttgtaaaccggagtatagtgtcaggtattgagagtgagtgag

SEQ ID NO: 352363 - DNA, 75 bp, Artificial Sequence
  Synthetic
gtgaaggtagacgaaggttaacccgatggttaaccgtagccgtctgtgctaatagacggcattaatttccatttt

SEQ ID NO: 352364 - DNA, 75 bp, Artificial Sequence
  Synthetic
gttagctgttttcattaagatttgtaccctgtttaacatgatggcgcgttctatacgtctttattttctattttt

SEQ ID NO: 352365 - DNA, 75 bp, Artificial Sequence
  Synthetic
atcttgtatattattaactaaactaactccttggtttcaattcatgtttaaaatgatctatatgttttattaatt

SEQ ID NO: 352366 - DNA, 75 bp, Artificial Sequence
  Synthetic
tattatactgttaaatgtactgtatataatagtttctaacgtggagtacagaattttcggttaatgagttcatgg

SEQ ID NO: 352367 - DNA, 75 bp, Artificial Sequence
  Synthetic
aactataaactaaaaattaaacaatatcgttattatataagtaataccaaaatgatgatatacgattaatagcct

SEQ ID NO: 352368 - DNA, 75 bp, Artificial Sequence
  Synthetic
tggagtacagaattttcggttaatgagttcatggtaaagggcgaatgaatgcctgcctgtattataatatacata

SEQ ID NO: 352369 - DNA, 75 bp, Artificial Sequence
  Synthetic
tccagctatcagattatgcggtccagagggagataggtattgttttcacggtatctgtatccacgctagagatat

SEQ ID NO: 352370 - DNA, 75 bp, Artificial Sequence
  Synthetic
ccttgaaaataaatacagtgggtggttctgtatcaccagtaagaacataatggtcgaacacagtatccgattgag

SEQ ID NO: 352371 - DNA, 75 bp, Artificial Sequence
  Synthetic
gatacacactatactgtcgaatttgatagggacaaagtagttgacacgtttatttcatataatagacataatgac

SEQ ID NO: 352372 - DNA, 75 bp, Artificial Sequence
  Synthetic
atttttttatgagtatttttatgagtatttttacaaaaaatgtataaagtgtatgtcttatgtatatttataaaa

SEQ ID NO: 352373 - DNA, 75 bp, Artificial Sequence
  Synthetic
atttgtatttatctaaacaatacctctacctctagatattatacaaaaattttttatttcagtatattaaagtaa

SEQ ID NO: 352374 - DNA, 75 bp, Artificial Sequence
  Synthetic
tacacgaatgattttctaaagtacttggaaagttttatatagttgatagaacaaaatacatattttttgtaaaaa

SEQ ID NO: 352375 - DNA, 75 bp, Artificial Sequence
  Synthetic
tccgattgagattttgcatacaatactagtctagaaagaaatttgtaatcatcttctgtgacgggagtccatata

SEQ ID NO: 352376 - DNA, 75 bp, Artificial Sequence
  Synthetic
ctaaaagacggaggatctccatcaaatgccagacaatcacgtacaaagtacatggaaataggttttgttctattg

SEQ ID NO: 352377 - DNA, 75 bp, Artificial Sequence
  Synthetic
taacatcatacatcaattaacattcttataacatcgtaatcaaaagaattgcaattttgatgtataacaactgtc

SEQ ID NO: 352378 - DNA, 75 bp, Artificial Sequence
  Synthetic
aagttttaccattttaaaatttaaaaagtatttacatttttttcactgtttagtcgcggatatggaatttgatcc

SEQ ID NO: 352379 - DNA, 75 bp, Artificial Sequence
  Synthetic
agaggtatatattataaaaaagtttttgattacgatgttataagaggaaaaaggacacattaacatcatacatca

SEQ ID NO: 352380 - DNA, 75 bp, Artificial Sequence
  Synthetic
taacaactgtcaatgaattatggaattgtatattacacattatacggtatgttggtaacgacaaataccgattgg

SEQ ID NO: 352381 - DNA, 75 bp, Artificial Sequence
  Synthetic
gttatttttctcgtatgaaagattaatttgattctaatataatctttagtattagatgaactttaattcaaattt

SEQ ID NO: 352382 - DNA, 75 bp, Artificial Sequence
  Synthetic
tccaaaaacaatttgaccaaatctaaattcacatcttcattgtatctataatcactattcagataatcagccata

SEQ ID NO: 352383 - DNA, 75 bp, Artificial Sequence
  Synthetic
ttcttttttagtagatatttcatcgtgtaagaatcaatattaatatttctaaagtatccgtgtatagcctcttta

SEQ ID NO: 352384 - DNA, 75 bp, Artificial Sequence
  Synthetic
ggtttccttatcatttctccatagtggtacaatactacacattattccgtgtggctttccattttccaaaaacaa

SEQ ID NO: 352385 - DNA, 75 bp, Artificial Sequence
  Synthetic
aaagtcccagaccagaattgcccaaattcgattacccagatggagtgcaagacaatggatcaattgagagatttg

SEQ ID NO: 352386 - DNA, 75 bp, Artificial Sequence
  Synthetic
gtaattggattcatggcgggacacgactgcattaaactgatagagaatgagatagaaaagtgtattagacgactc

SEQ ID NO: 352387 - DNA, 75 bp, Artificial Sequence
  Synthetic
tttctattataatcttgtatccgtaagatacattactacacataggaattccctgatcgagcaatagtttaaata

SEQ ID NO: 352388 - DNA, 75 bp, Artificial Sequence
  Synthetic
gtacaaattttatcctcgctttgtgtatcatattcgtccctactataaaattgtatattcagattatcatgagat

SEQ ID NO: 352389 - DNA, 75 bp, Artificial Sequence
  Synthetic
tttttttttttttttttgttttaagatctacccacggatacgaaataaacatgtctattgttaatcatgccacca

SEQ ID NO: 352390 - DNA, 75 bp, Artificial Sequence
  Synthetic
ccaatctataatagatggtggccacaatatattctatgatggtattgaagaagataacaaccttggcatattgat

SEQ ID NO: 352391 - DNA, 75 bp, Artificial Sequence
  Synthetic
atatagatgttataaacgactataaaattattgattgtatactattgactcgtctactatttaatgcaaaggaca

SEQ ID NO: 352392 - DNA, 75 bp, Artificial Sequence
  Synthetic
gccgcataaaataaaatccattttcatttttaaccaatactatctcctctattcataattgagattgatgtaata

SEQ ID NO: 352393 - DNA, 75 bp, Artificial Sequence
  Synthetic
gactagactgtttatacaagattgaaattatattcttttttatagagcgtgtgatgtacggatatctaataatat

SEQ ID NO: 352394 - DNA, 75 bp, Artificial Sequence; identical to SEQ ID NO: 46084
  Synthetic

SEQ ID NO: 352395 - DNA, 75 bp, Artificial Sequence
  Synthetic
aattctagtctttagcctatttacctcctcagaagatgttccgttgcgtttacgctcgttaagctgtctatcaag

SEQ ID NO: 352396 - DNA, 75 bp, Artificial Sequence
  Synthetic
atattggttgttaaagcggatatacccagcaaacgactactatatgtaaataatctgtcactgattaattattag

SEQ ID NO: 352397 - DNA, 75 bp, Artificial Sequence
  Synthetic
ttttttttgttttaagatctacccacggatacgaaataaacatgtctattgttaatcatgccaccaataatgtat

SEQ ID NO: 352398 - DNA, 75 bp, Artificial Sequence
  Synthetic
gataaaactttttacgactccatcagaaagaggtttaatatttttgtgagaccatcgaagagagagagaaagaga

SEQ ID NO: 352399 - DNA, 75 bp, Artificial Sequence
  Synthetic
acacgcgaacatctttcctacatggttaaagtacatgtacaattctatccatttgtcttccttaactatatattt

SEQ ID NO: 352400 - DNA, 75 bp, Artificial Sequence
  Synthetic
tctttgccacaatccatagctattttggtgctaattattcctatattatatttcacaaaaaatgatgaaggcaat

SEQ ID NO: 352401 - DNA, 75 bp, Artificial Sequence
  Synthetic
attacatataactttccatcattaacacacgtactaacttttgattttaacgacgacatattagtaactgttttc

SEQ ID NO: 352402 - DNA, 75 bp, Artificial Sequence
  Synthetic
tttctctcttcgatggtctcacaaaaatattaaacctctttctgatggagtcgtaaaaagttttatctctttctc

SEQ ID NO: 352403 - DNA, 75 bp, Artificial Sequence
  Synthetic
atacaatatatcatcttttcactaaataagtagtaataatgattcaacaatgtcgagatatatgaacgataataa

SEQ ID NO: 352404 - DNA, 75 bp, Artificial Sequence
  Synthetic
cttgtattccaaattaaacatggcaacggatttaattttatattcctctattaggtcctcgtcgacaataacaga

SEQ ID NO: 352405 - DNA, 75 bp, Artificial Sequence
  Synthetic
taggggatgttgataagctcgagagtatatgttgttgaacgttattgtttaagaaatagttgatgcatcagaatg

SEQ ID NO: 352406 - DNA, 75 bp, Artificial Sequence
  Synthetic
tctctttctctctctcttcgatggtctcacaaaaatattaaacctctttctgatggagtcgtaaaaagttttatc

SEQ ID NO: 352407 - DNA, 75 bp, Artificial Sequence
  Synthetic
ttccattcttgaagtactataagtaattatagtataatgtaacgtttatatattcaatattttttataaaaaaat

SEQ ID NO: 352408 - DNA, 75 bp, Artificial Sequence
  Synthetic
cttgttaacgggctcgtaaattgggataaaaattatgtttttattattttatattcatttaatattcattcaata

SEQ ID NO: 352409 - DNA, 75 bp, Artificial Sequence
  Synthetic
tatcgttcctggtatatagataaagagtcctatatatttgaaaatcgttacggcacgattaaactttaatgattg

SEQ ID NO: 352410 - DNA, 75 bp, Artificial Sequence
  Synthetic
tattatcaattctggattatccctttgataaatagtatcatctatcagagaccatgtattgctgtatttgtaata

SEQ ID NO: 352411 - DNA, 75 bp, Artificial Sequence
  Synthetic
tcatgaagattaggaaatgtttctgatggaggtctatcaataactggcacaacaataacaggagttttattcaca

SEQ ID NO: 352412 - DNA, 75 bp, Artificial Sequence
  Synthetic
taatgtattctcttacaaatattcacaagatgaattcagtaatatgagtaacacggaacgtgatagtttctcatt

SEQ ID NO: 352413 - DNA, 75 bp, Artificial Sequence
  Synthetic
gtcgccatttagttattgaaattaatcatatacaactctctaatacgagttatattttcgtctatccattgtttc

SEQ ID NO: 352414 - DNA, 75 bp, Artificial Sequence
  Synthetic
tatttttctttattttattatttttcaccatatagatcaatcattagatcatcaaaatatgtttcaatcatccta

SEQ ID NO: 352415 - DNA, 75 bp, Artificial Sequence
  Synthetic
tttataggttcactcgaagaactaataaattacctttacaagatatggttgtgccataatttttataaatttttt

SEQ ID NO: 352416 - DNA, 75 bp, Artificial Sequence
  Synthetic
ttttccatgaaatcggatggattggtaacattatagattcttttaaatcccaattcagaaatcaatctatctgcg

SEQ ID NO: 352417 - DNA, 75 bp, Artificial Sequence
  Synthetic
taacattatagattcttttaaatcccaattcagaaatcaatctatctgcgacaaactccatatatgttttcatca

SEQ ID NO: 352418 - DNA, 75 bp, Artificial Sequence
  Synthetic
ataatgataatgataatgatacgtatatacacttttgtaaaatattattcggtgtctataacggaacaaacgcta

SEQ ID NO: 352419 - DNA, 75 bp, Artificial Sequence
  Synthetic
aaatcatcattataatatgatggatcgccatcatttctccaaagaatatatctaataagtagagtcctcatgctt

SEQ ID NO: 352420 - DNA, 75 bp, Artificial Sequence
  Synthetic
catcaaaagacttatgatcctctctcattgatttttcgcgggatacatcatctattatggcgtcagccatagtca

SEQ ID NO: 352421 - DNA, 75 bp, Artificial Sequence
  Synthetic
gttcattgttatccattgtagaggatgacatgctcgaatcatacaaaaatatattatttttatgttattttgtta

SEQ ID NO: 352422 - DNA, 75 bp, Artificial Sequence
  Synthetic
atctaataagtagagtcctcatgcttagtaatttaactattttagttaacaactatttttttatgttaaatcgag

SEQ ID NO: 352423 - DNA, 75 bp, Artificial Sequence
  Synthetic
cgaaagataatatagaggcgttttatgctgtttatcgcacgcgtttggatctgcgccgtgcgtcaatagcatcgc

SEQ ID NO: 352424 - DNA, 75 bp, Artificial Sequence
  Synthetic
ttttttaaaaaaaatacttattctgattattctagccatttccgtgttcgttcaaatgccacatcaaagatatgg

SEQ ID NO: 352425 - DNA, 75 bp, Artificial Sequence
  Synthetic
attttggtatcttccaatgtggctgcctaatgtaatggaaattcattctctagaagattttttaatgctccagcg

SEQ ID NO: 352426 - DNA, 75 bp, Artificial Sequence
  Synthetic
agcagtgcaatgcaggaagacatacgtagcttggcgtcatcgaatagctcgggaataaagccaatacctgcacct

SEQ ID NO: 352427 - DNA, 75 bp, Artificial Sequence
  Synthetic
gagcggtccaatacgagaacgggcgcttcacggtacccagaggagtcggggccagaggagacagtggacgaccca

SEQ ID NO: 352428 - DNA, 75 bp, Artificial Sequence
  Synthetic
cgcactgttactacccaacctcctgttccgaaaccgcgcagacgccgccgcagaccgtctagcgccagttcaaca

SEQ ID NO: 352429 - DNA, 75 bp, Artificial Sequence
  Synthetic
ttctggacaaccaggggcgggtggtcgctatcgtgctaggaggtgtgaatgaaggatccagaacagccctttcag

SEQ ID NO: 352430 - DNA, 75 bp, Artificial Sequence
  Synthetic
caaaattgatcgagacggaggtggaaccatccgatacgatcctagacattggaagtgcgcctgcccgcagaatgt

SEQ ID NO: 352431 - DNA, 75 bp, Artificial Sequence
  Synthetic
ttgtcatgtggaacgagaagggagtcacagtgaagtatactcctgagaactgcgagcaatggtcattagtgacca

SEQ ID NO: 352432 - DNA, 75 bp, Artificial Sequence
  Synthetic
acaccacttgtgcgaacgtcttgcgccacttccaggtccagtctggtttctaacccgcctggagaaagaagggtt

SEQ ID NO: 352433 - DNA, 75 bp, Artificial Sequence
  Synthetic
atcaccagggaagagtttgaagccttcgttgctcaacagcaatgacggtatgatgcgggtgcatacatcttttcc

SEQ ID NO: 352434 - DNA, 75 bp, Artificial Sequence
  Synthetic
ccatgtgtctgctcgcaaatgtgacgttcccatgcgcccaaccgccgatttgctatgatcggaaaccagcagaga

SEQ ID NO: 352435 - DNA, 75 bp, Artificial Sequence
  Synthetic
ccaagctgaagaagaactgtaaagagattacagataaggaactggacaagaagatgaaggagcttgcggaagtca

SEQ ID NO: 352436 - DNA, 75 bp, Artificial Sequence
  Synthetic
cgctggccatgctcagtgccaatgttgacaacccaggctatgatgaactgttgaaagcagctgtcacgtgccccg

SEQ ID NO: 352437 - DNA, 75 bp, Artificial Sequence
  Synthetic
aagatgaaggagcttgcggaagtcatgagcgaccctgatctcgaaactgaaacgatttgccttcacgacgatgaa

SEQ ID NO: 352438 - DNA, 75 bp, Artificial Sequence
  Synthetic
tccgataccggtcaagggcatttacaacaaaagtcagtaagacagacagtgttgtctgaaattgtactggaacga

SEQ ID NO: 352439 - DNA, 75 bp, Artificial Sequence
  Synthetic
gaagaaaaaggagatccaccgaggagctgtttaaggagtataagctgacgcgcccctatatggccagatgcgtta

SEQ ID NO: 352440 - DNA, 75 bp, Artificial Sequence
  Synthetic
acagaattggagatagcgtatgccccgcgcctcgacctggaaaaagaagaagctttacgcaagaaattacaagtg

SEQ ID NO: 352441 - DNA, 75 bp, Artificial Sequence
  Synthetic
aacccgacgcctgctaacagaagtagataccagtctagaagagtggaaaatatgaaggcagtgactacccgaaga

SEQ ID NO: 352442 - DNA, 75 bp, Artificial Sequence
  Synthetic
ggtgtgccgttgggagttgccatagcccaatagccatagaggcggtgaagagcgatgggcatgacggctacgtta

SEQ ID NO: 352443 - DNA, 75 bp, Artificial Sequence
  Synthetic
attctcagcggtctcggacactatctgagaagtgaggggaaggttgaatgttaccgtacattatacccggtcccc

SEQ ID NO: 352444 - DNA, 75 bp, Artificial Sequence
  Synthetic
gcaaacggtgctatccgaagtggtgttggagaggaccgaattggagatttcgtatgccccgcgcctcgaccaaga

SEQ ID NO: 352445 - DNA, 75 bp, Artificial Sequence
  Synthetic
gactccagacctcctcgcagtatggcctggacccctccggcaatctaaaaagcaggacaatgaggtataacatgt

SEQ ID NO: 352446 - DNA, 75 bp, Artificial Sequence
  Synthetic
ttatactctgcaagtgtcgaccgagcgttctcaagccctcgtgtggcaatagaggcttgtaacacggtgctgaag

SEQ ID NO: 352447 - DNA, 75 bp, Artificial Sequence
  Synthetic
acgggactattgaagagataccactacatcaagtgtcacttcatacgtctcgtccgtgccacattgtggatgggc

SEQ ID NO: 352448 - DNA, 75 bp, Artificial Sequence
  Synthetic
cctattggataggattcgacactacccctttcatgttcaagaacttggctggagcatatccctcctattcgacca

SEQ ID NO: 352449 - DNA, 75 bp, Artificial Sequence
  Synthetic
gaaaacttccctacagtagcgtcgtactgtataacaccggagtacgacgcctacatggacatggtagatggagcc

SEQ ID NO: 352450 - DNA, 75 bp, Artificial Sequence
  Synthetic
atggttactttttgctagcgaggtgtcctgcaggggattccataactatggaattcaagaaagattcggtcacac

SEQ ID NO: 352451 - DNA, 75 bp, Artificial Sequence
  Synthetic
accacgagaagcgagacttactcaggagttggcacctaccgtccgtttttcacctacgtggtaagcagaattaca

SEQ ID NO: 352452 - DNA, 75 bp, Artificial Sequence
  Synthetic
gagttggcacctaccgtccgtttttcacctacgtggtaagcagaattacacttgtcggtgtgagactatagttag

SEQ ID NO: 352453 - DNA, 75 bp, Artificial Sequence
  Synthetic
actcctgctcggtgccgtatgaggtgaaattcaatcctgtaggtagagaactttacactcatccgccagaacatg

SEQ ID NO: 352454 - DNA, 75 bp, Artificial Sequence
  Synthetic
tcatgctgcctggacacggcaagtttttgcccggcaaaattgcgtagctttccaaaaagacacgcatatttggag

SEQ ID NO: 352455 - DNA, 75 bp, Artificial Sequence
  Synthetic
gagcagagcaggcatgtcaagtctacgcacatgacgcacaaaacagaggagcttacgtcgaaatgcacctcccgg

SEQ ID NO: 352456 - DNA, 75 bp, Artificial Sequence
  Synthetic
cccactatccgctccgcggtaccttctgctatacagaacactctgcagaatgtactggcagcagcaacaaaaaga

SEQ ID NO: 352457 - DNA, 75 bp, Artificial Sequence
  Synthetic
aactgcaatgtcacacagatgagggaactgccagtgctagactcagctgcctttaatgtagagtgtttcaagaag

SEQ ID NO: 352458 - DNA, 75 bp, Artificial Sequence
  Synthetic
gatgcatcgcgagggattcttgtgctgcaaggtgacggacacgcttaacggggagagggtctctttccccgtatg

SEQ ID NO: 352459 - DNA, 75 bp, Artificial Sequence
  Synthetic
gctcagaagtggacagtagcttggtgtccttgagtagcggtttagtctctgtgacaccccctgctggaacaagtg

SEQ ID NO: 352460 - DNA, 75 bp, Artificial Sequence
  Synthetic
tacgcgtgtaacaatgaatactgggacacgtacaaagagaaccccattagattgacagacgagaacgtgactaac

SEQ ID NO: 352461 - DNA, 75 bp, Artificial Sequence
  Synthetic
ctctagtggaatgcgagtgcagcggtacaacgatctccaagaccattaataagacaaagcagttcagccagtgca

SEQ ID NO: 352462 - DNA, 75 bp, Artificial Sequence
  Synthetic
gaccaaatgacaggcattctggcaacagatgtcagtgcagacgacgcgcagaaattgttggttgggctcaaccag

SEQ ID NO: 352463 - DNA, 75 bp, Artificial Sequence
  Synthetic
tacatcaccaagctgaaaggtcctaaagcggccgccctgtacgcaaagactcacaatctcagcatgcttcaggac

SEQ ID NO: 352464 - DNA, 75 bp, Artificial Sequence
  Synthetic
caaagaaggagcagtgccgagcatatcgcctgcagaatgataagtgggtgtacaactcagacaaactgcccaaag

SEQ ID NO: 352465 - DNA, 75 bp, Artificial Sequence
  Synthetic
gactccagacttcctcacagtatggcctggattcctctggcaacttaaagggcaggaccatgcggtatgatatgc

SEQ ID NO: 352466 - DNA, 75 bp, Artificial Sequence
  Synthetic
atcccgatggaccgctttgtcatggatttaaaacgggatgtgaaggtgactcccggcacaaaacataccgaagag

SEQ ID NO: 352467 - DNA, 75 bp, Artificial Sequence
  Synthetic
cagcgggagctacgctaaaaggaaaattacatgtcccgtttttgctggcagatggtaaatgcacagtgcctttgg

SEQ ID NO: 352468 - DNA, 75 bp, Artificial Sequence
  Synthetic
acatcaagtgtcacttcatacatctcgcccgtgtcacattgtggatgggcatggctactttttgcttgctaggtg

SEQ ID NO: 352469 - DNA, 75 bp, Artificial Sequence
  Synthetic
cgacctaaagtgcaggtcatccaggcggctgatccgttggctactgcctatctgtgtgggatacatcgagaatta

SEQ ID NO: 352470 - DNA, 75 bp, Artificial Sequence
  Synthetic
cgccagaaccgatgataaccttcgggttccgatcggtgtcactgaaattgcaccctaagtatcccacctatttga

SEQ ID NO: 352471 - DNA, 75 bp, Artificial Sequence
  Synthetic
aaaggaatactaatacaatgaagaactatttactacccgtcgtggcacaagcatttgccagatgggctaaagaat

SEQ ID NO: 352472 - DNA, 75 bp, Artificial Sequence
  Synthetic
tcaggaaacacaagataacatcagtgtacaaacgaccagacacccaaacgatcatcaaggtaaacagcgatttcc

SEQ ID NO: 352473 - DNA, 75 bp, Artificial Sequence
  Synthetic
ccactcgcgaacttgctgacgagccccattacactcacgagctcatatccgaaccgtctgttaggaatttttccg

SEQ ID NO: 352474 - DNA, 75 bp, Artificial Sequence
  Synthetic
gtgcgcagattaaatgccgtcctgctccctaatgtccataccctgtttgatatgtctgcagaagatttcgatgcc

SEQ ID NO: 352475 - DNA, 75 bp, Artificial Sequence
  Synthetic
atcatcgcggagcatttccaaccaggagactgggtacttgagacagacatcgcctccttcgacaagagcgaggac

SEQ ID NO: 352476 - DNA, 75 bp, Artificial Sequence
  Synthetic
tcacagcaaaagggtgggagttcgtgtggggaaaccacccgccaaaaaggttttgggcacaggaaacagcccctg

SEQ ID NO: 352477 - DNA, 75 bp, Artificial Sequence
  Synthetic
gatgcgatggcactgacggcactaatgattcttgaagacttgggtgtagatcaggaattactcacgcttatagaa

SEQ ID NO: 352478 - DNA, 75 bp, Artificial Sequence
  Synthetic
gaaacccacatggactaccgcacgaggtgatagttcattattatcataggtatcctatgtctactatcacgggtt

SEQ ID NO: 352479 - DNA, 75 bp, Artificial Sequence
  Synthetic
gccaagaacgcggcggatgaggctaaggaagtcaaggaggccgaagagctcagggcagcattaccaccgctgtct

SEQ ID NO: 352480 - DNA, 75 bp, Artificial Sequence
  Synthetic
aggaagtcaaggaggccgaagagctcagggcagcattaccaccgctgtctgccgatgtagaggaacctgcactgg

SEQ ID NO: 352481 - DNA, 75 bp, Artificial Sequence
  Synthetic
tgtcaatttgcgctgccattgttgccgtttccattgcagcgtctacctggctgttgtgtagatccagagcctcgt

SEQ ID NO: 352482 - DNA, 75 bp, Artificial Sequence
  Synthetic
gcggcttttggtgaaatatcatcgatccacctaccgacaaagactaaatttaaattcggggcaatgatgaagtca

SEQ ID NO: 352483 - DNA, 75 bp, Artificial Sequence
  Synthetic
ggcatgtttctcactctgtttattaataccgtcattaacatcgtcatagctagcagagttttacgtgaacgcctg

SEQ ID NO: 352484 - DNA, 75 bp, Artificial Sequence
  Synthetic
gcttaaccccttacaggctaacacccaacgccaagatgccactttgcctggctgtgctttgctgcgcccgttctg

SEQ ID NO: 352485 - DNA, 75 bp, Artificial Sequence
  Synthetic
ggaggcgggagcaggatctgtcgaaacccccagggggctcatcaaagtcaccagctatgcaggagaagacaaaat

SEQ ID NO: 352486 - DNA, 75 bp, Artificial Sequence
  Synthetic
ccgcgttaatgattctggaagacctaggtgtggacgcagagctgttgacgctgattgaggcggctttcggcgaaa

SEQ ID NO: 352487 - DNA, 75 bp, Artificial Sequence
  Synthetic
cggctcatacgcggtgctctccccacaagcggtactgcgaagtgaaaaactgacgtgcattcacccgcttgcaga

SEQ ID NO: 352488 - DNA, 75 bp, Artificial Sequence
  Synthetic
cccgagccgaaactacctgggagtccttggaccacctctggaataataatcaacagatgttttggacccaactgc

SEQ ID NO: 352489 - DNA, 75 bp, Artificial Sequence
  Synthetic
actaactcaccctgtgcagcattcataggggatgataacatcgtaaaaggagttaaatcggacaaactgatggct

SEQ ID NO: 352490 - DNA, 75 bp, Artificial Sequence
  Synthetic
tgatccccttggccgccctaatagtggtgactcgcctgctcaagtgcatgtgctgcgttgtgccttttttagtcg

SEQ ID NO: 352491 - DNA, 75 bp, Artificial Sequence
  Synthetic
gaaccggctgttaggaacttttctgtcactgaaaaaggatgggagtttgtatggggtaaccacccgccgaaaagg

SEQ ID NO: 352492 - DNA, 75 bp, Artificial Sequence
  Synthetic
gggaggaagggtagatatgcagttgagccttaccacggaaaagtggtagtacccgaggggcaggctatacctgtc

SEQ ID NO: 352493 - DNA, 75 bp, Artificial Sequence
  Synthetic
tggccggcgccgcaggcgccggcgcatacgagcacgcgaccacgatgccgaatcaagcggggatctcgtataaca

SEQ ID NO: 352494 - DNA, 75 bp, Artificial Sequence
  Synthetic
gacagatgtgcaacgtggctgaacatggaggtaaagatcatagatgccgtggtcggcgaaaaggcgccatacttc

SEQ ID NO: 352495 - DNA, 75 bp, Artificial Sequence
  Synthetic
tgtggagggttcattctatgtgacacggtaactggcacggcgtgccgggtagctgatcctctgaagagactcttt

SEQ ID NO: 352496 - DNA, 75 bp, Artificial Sequence
  Synthetic
ccatagtcaacagagcaggttatgcaccactccctatcagcataacaccaacgaagatcaagctgataccaacag

SEQ ID NO: 352497 - DNA, 75 bp, Artificial Sequence
  Synthetic
cacattgccacgcacggtggagctctgaacacagacgaggagtattacagagtggtgaaacctagtgaacatgaa

SEQ ID NO: 352498 - DNA, 75 bp, Artificial Sequence
  Synthetic
aaactcggaaaaccactagccaccgacgacgagcacgacgacgatcgtcgccgtgcgttgtacgaggagtcgact

SEQ ID NO: 352499 - DNA, 75 bp, Artificial Sequence
  Synthetic
tgaacctggagtacgttacctgccattacaaaacaggaatggattcaccgaccattaagtgctgtggatcgcagg

SEQ ID NO: 352500 - DNA, 75 bp, Artificial Sequence
  Synthetic
cgctggaaccgtgtgggcatattttctgagttgtgtaaggcggtggagtcgcggtatgagaccacgggaacatct

SEQ ID NO: 352501 - DNA, 75 bp, Artificial Sequence
  Synthetic
gtgattatcgcagccatgactacgttggccagaaacgttgcagcgtttaaacacctaagagggaaccctgtgacc

SEQ ID NO: 352502 - DNA, 75 bp, Artificial Sequence
  Synthetic
aatgcaccccgacctataggcccgatgagcagtgtaaagtctttgcgggggtttacccgtttatgtggggaggtg

SEQ ID NO: 352503 - DNA, 75 bp, Artificial Sequence
  Synthetic
tgaacacagacgaggagtattacagagtggtgaaacctagtgaacatgaaggtgagtacttatatgacattgaca

SEQ ID NO: 352504 - DNA, 75 bp, Artificial Sequence
  Synthetic
cccgggccgagaccacctgggagtccttggaccatttatggaataataaccaacagatgttctggatccaattgc

SEQ ID NO: 352505 - DNA, 75 bp, Artificial Sequence
  Synthetic
catattgcttttgcgataccgagaacacccaaatcagcaaggcctacgtaatgaaatcagaggattgccttgcgg

SEQ ID NO: 352506 - DNA, 75 bp, Artificial Sequence
  Synthetic
ctctacggctaacctgaatggaccgtgacatagtccagtccgcaaccatgtttccatatcaacaaaccatgtatc

SEQ ID NO: 352507 - DNA, 75 bp, Artificial Sequence
  Synthetic
ctatgcaaccaatgcctcttcgcaacccctacgcgccacctagaagaccgtggtttcctaggaccgacccttttc

SEQ ID NO: 352508 - DNA, 75 bp, Artificial Sequence
  Synthetic
atcatgcagcagcatataaagcacacacagcttcagtgcaggcgctccttaacatcacagtaggagaacactcca

SEQ ID NO: 352509 - DNA, 75 bp, Artificial Sequence
  Synthetic
tgatccctctggccgccttgattgtagtgactcgcctgctcaggtgtatgtgctgtgtcgtgccttttttagtcg

SEQ ID NO: 352510 - DNA, 75 bp, Artificial Sequence
  Synthetic
tggctatgcaagtacaggaattggcccgttctatggcgaatctgacgtttaagcagcgccggagtacgcctccag

SEQ ID NO: 352511 - DNA, 75 bp, Artificial Sequence
  Synthetic
ccgtgaccactgtgtatgtgaatggagaaactcctgtgaactttaacggagtcaaactaactgcaggtccgcttt

SEQ ID NO: 352512 - DNA, 75 bp, Artificial Sequence
  Synthetic
aatgcccggacagtggactcagtgctgttaaatggatgcaagcacccggtcgagactttgtacattgatgaagcc

SEQ ID NO: 352513 - DNA, 75 bp, Artificial Sequence
  Synthetic
aggggccgcctgccaagaggaagcggaaggaaccacagcagcaggctactcaggcaaagggcaagaaaagaaatg

SEQ ID NO: 352514 - DNA, 75 bp, Artificial Sequence
  Synthetic
ccacggcttggacaccctttgaccgaaaaattgtgcagtacgccggggagatctataactatgatttccccgagt

SEQ ID NO: 352515 - DNA, 75 bp, Artificial Sequence
  Synthetic
gaactccaaagaagaagaagggtcctagtgccccaccccagaagaaccagaacaatccgaagaagaaggttaaca

SEQ ID NO: 352516 - DNA, 75 bp, Artificial Sequence
  Synthetic
acggggcaggacagccgggagcatttggggacatacaactcagaaccgtttcaagctctgatctgtatgccaaca

SEQ ID NO: 352517 - DNA, 75 bp, Artificial Sequence
  Synthetic
tggggacatacaactcagaaccgtttcaagctctgatctgtatgccaacaccaacttagtgctgcagcggccaaa

SEQ ID NO: 352518 - DNA, 75 bp, Artificial Sequence
  Synthetic
agaaacctggaaagagacaaaggatggtcatgaaattggaatctgacaaaacgttccctatcatgctggacggca

SEQ ID NO: 352519 - DNA, 75 bp, Artificial Sequence
  Synthetic
agatcaacggatatgcatgcgtagtcggaggaaagctattccggcccatgcatgttgaaggaaaaatcgacaacg

SEQ ID NO: 352520 - DNA, 75 bp, Artificial Sequence
  Synthetic
cctgaaatttactgcccctttcggatgcgaaatatacacaaaccccattcgcgccgagaattgtgctgtagggtc

SEQ ID NO: 352521 - DNA, 75 bp, Artificial Sequence
  Synthetic
acaccttagcctcccttaaaacaaagaaggcatctaaatatgacctggagtacgcagatgtccctcaaaatatgc

SEQ ID NO: 352522 - DNA, 75 bp, Artificial Sequence
  Synthetic
aaatcgaaattgacacaacaggaagtactaaaccaaaaaaggatgacttgattctcacatgttttaggggatggg

SEQ ID NO: 352523 - DNA, 75 bp, Artificial Sequence
  Synthetic
gggccgacacttttaaatacacccatgagaaaccccagggctattacaattggcaccacggagccgtgcagtacg

SEQ ID NO: 352524 - DNA, 75 bp, Artificial Sequence
  Synthetic
atgcactcttaacgagtgtgtatattcatctgactttggcgggatcgccacagtcaagtattcggccagcaaatc

SEQ ID NO: 352525 - DNA, 75 bp, Artificial Sequence
  Synthetic
aaaacggaaggttcaccgtgccaaaaggagtgggggcgaaaggcgatagcggccgccccatactcgataaccagg

SEQ ID NO: 352526 - DNA, 75 bp, Artificial Sequence
  Synthetic
acctcagagcatgtaaatgtgctgttgacccggacggaagacaagattgtgtggaagactcttgcaggggacccg

SEQ ID NO: 352527 - DNA, 75 bp, Artificial Sequence
  Synthetic
aggcaagtgtgcagtccatgtaccatcagggactgccaccctaaaagaagcatcagtcgagttagccgagcaagg

SEQ ID NO: 352528 - DNA, 75 bp, Artificial Sequence
  Synthetic
ggcgtgtcgtggccatagtacttggaggtgtgaacgagggctctagaactgccctgtctgtagtgatgtggaatg

SEQ ID NO: 352529 - DNA, 75 bp, Artificial Sequence
  Synthetic
gtcggtgactattcatttttcgactgcaaacattcacccggagttcaggctccaaatatgcacgtcatttgttac

SEQ ID NO: 352530 - DNA, 75 bp, Artificial Sequence
  Synthetic
acaaaggggttaccgtacggtacacccctgaaaactgtgagcagtggtcgctagtcaccaccatgtgtctgctcg

SEQ ID NO: 352531 - DNA, 75 bp, Artificial Sequence
  Synthetic
tggagacatacaatccagaactgtttcaagctcagatctgtacgccaataccaatctagtgctgcagagacccaa

SEQ ID NO: 352532 - DNA, 75 bp, Artificial Sequence
  Synthetic
gtgcaaaggagattgtcaccccccgaaagatcatattgtgacacatccacagtatcatgcccaaacattcacggc

SEQ ID NO: 352533 - DNA, 75 bp, Artificial Sequence
  Synthetic
caaatgtcacgtttccatgttctgccccgccgatgtgctacgaccgcaagcccgcagagactttggcactactta

SEQ ID NO: 352534 - DNA, 75 bp, Artificial Sequence
  Synthetic
aaataaagctaatgtttgttgggcaaaggcacttgtacctgtgcttaagacagccgggatagatttgacctcaga

SEQ ID NO: 352535 - DNA, 75 bp, Artificial Sequence
  Synthetic
tgcggtgtcaaaaaccgcatggacgtggttgacatctttgctgggagggtcagccgtaattattataattggttt

SEQ ID NO: 352536 - DNA, 75 bp, Artificial Sequence
  Synthetic
gtgccaaccttgacaacccgggatacgatgagctgctggaagctgttttgaagtgccctggaaaacagaagagat

SEQ ID NO: 352537 - DNA, 75 bp, Artificial Sequence
  Synthetic
accccggagacttcaccgcaacaatggaagaatggcaggcagaacacgatgccatcatgagacacatcctggaga

SEQ ID NO: 352538 - DNA, 75 bp, Artificial Sequence
  Synthetic
agtgctggctacccttgtggccatgtatgtgctgaccaaccagaaacataattgaatatagcagcaattggcgag

SEQ ID NO: 352539 - DNA, 75 bp, Artificial Sequence
  Synthetic
ccacggaagagctgttcaaggagtacaaacttacacgaccgtacacagccaagtgcgtccgctgcgccgttggta

SEQ ID NO: 352540 - DNA, 75 bp, Artificial Sequence
  Synthetic
gcgattcttcggtctagacttagattctggtttgttttccgcccccacagttccactctccattaggaacaacca

SEQ ID NO: 352541 - DNA, 75 bp, Artificial Sequence
  Synthetic
gctgtcacagccctattgccatcgaggcggtgaagagcgacggacacgacggctacgtccggttgcagacttcct

SEQ ID NO: 352542 - DNA, 75 bp, Artificial Sequence
  Synthetic
cgcagtacggtctggactcatccggaaacttgaaaggaagaacaatgaggtacgacgtgcaaggtaagatcgagg

SEQ ID NO: 352543 - DNA, 75 bp, Artificial Sequence
  Synthetic
agatcccgttacatcaagtctcactgcacacttcaaggccctgtcacatcatagacggtcatgggtacttcctcc

SEQ ID NO: 352544 - DNA, 75 bp, Artificial Sequence
  Synthetic
cataaatttagtaccggtgaaccgccgtctaccacatgctctcgtgacacaacatgctgatcatccccctagtga

SEQ ID NO: 352545 - DNA, 75 bp, Artificial Sequence
  Synthetic
tagctcgttgcccagaaggagactccattaccatggagtttaagaaggattcaatcatacattcgtgctctgtac

SEQ ID NO: 352546 - DNA, 75 bp, Artificial Sequence
  Synthetic
cctatgaagtaaagtttacaccggtgggcagggaactgtacaatcaccctcccgaacatggcaccgagcacccct

SEQ ID NO: 352547 - DNA, 75 bp, Artificial Sequence
  Synthetic
gacggtagactggttatctgaaacacccgattctactttcagggcgcgcctagacttaggcatacccaatgaact

SEQ ID NO: 352548 - DNA, 75 bp, Artificial Sequence
  Synthetic
gccgcgtgtatacacacgatgcccagaagaaggacgcttatgtcgaaatgcatctgcctggttccgaagtggaca

SEQ ID NO: 352549 - DNA, 75 bp, Artificial Sequence
  Synthetic
accgaagtacgatatcgtcttcgtaaacgtaagaacacaataccgctaccaccactaccagcagtgtgaggacca

SEQ ID NO: 352550 - DNA, 75 bp, Artificial Sequence
  Synthetic
ggcaagctgctcatatagaatttgcggcgattggcatgccgctttaaaatttttattttattttcttttcttttc

SEQ ID NO: 352551 - DNA, 75 bp, Artificial Sequence
  Synthetic
gcgcactactctcaatgagtgggagtgctgtcaaggtgacccctcctgcagggcaaagtgtttcggtcgagtgca

SEQ ID NO: 352552 - DNA, 75 bp, Artificial Sequence
  Synthetic
agcccaaaccaataactacccaaaatggagaaagttcacgttgacatcgaggaagatagccccttcctcagagca

SEQ ID NO: 352553 - DNA, 75 bp, Artificial Sequence
  Synthetic
aagaaggcatgcctgcacctgaatcccggaggaacttgtgtgagcattggttacggctatgcggaccgggccagc

SEQ ID NO: 352554 - DNA, 75 bp, Artificial Sequence
  Synthetic
actgtggctcagcaatctctgagactatcaacacggccaaaacctattctcagtgcaccaagactgctcagtgcc

SEQ ID NO: 352555 - DNA, 75 bp, Artificial Sequence
  Synthetic
gaaagcatcattggtgcagtggctcggcagttcaagttctcaagggtgtgcaaaccgaaggtgtctaaggaggag

SEQ ID NO: 352556 - DNA, 75 bp, Artificial Sequence
  Synthetic
gggcttaccgtttacagaatgacaagtgggtattcaattcggacaaacttccgaagggcgtcaggaaacacctga

SEQ ID NO: 352557 - DNA, 75 bp, Artificial Sequence
  Synthetic
aaggaaagctgcatgtaccatacctcctgtcggaggccaagtgtactgtgccgctggcacctgagcctataataa

SEQ ID NO: 352558 - DNA, 75 bp, Artificial Sequence
  Synthetic
gaagtgtgcagaagatccggacagactgtttaagtatgcagccaagctgaagaagaactgtaaagagattacaga

SEQ ID NO: 352559 - DNA, 75 bp, Artificial Sequence
  Synthetic
ctttcggctttagatctgtttccttgaaatttcacccaaggaacccgacctacctgaccactcgccacttgaatg

SEQ ID NO: 352560 - DNA, 75 bp, Artificial Sequence
  Synthetic
attgccactgccacggaaggagtaatcgtcaatgctgccaacagcaagggccagccaggcagtggggtgtgcgga

SEQ ID NO: 352561 - DNA, 75 bp, Artificial Sequence
  Synthetic
gtgagccaaattatacccatgagctgatttcggaacccacgacgagaaactttacagtgacagagcaagggtggg

SEQ ID NO: 352562 - DNA, 75 bp, Artificial Sequence
  Synthetic
agtacgtgtggggcaatcacccaccccagagatattgggcacaggaaaccgccccaggggacccacacggcctgc

SEQ ID NO: 352563 - DNA, 75 bp, Artificial Sequence
  Synthetic
ggggaaagctagattggttaaaggtaattcaaaacatctcatccatgcagtggggccgaatttcaacaaagtgtc

SEQ ID NO: 352564 - DNA, 75 bp, Artificial Sequence
  Synthetic
cgcatgaggtgatcacacattactaccacagatatcccatgtccacgatccttggattgtcgatctgcgccgcag

SEQ ID NO: 352565 - DNA, 75 bp, Artificial Sequence
  Synthetic
aagaatcccacatatctgaccacccgccaacttgctgatgagcctcactacacgcacgagctcatatctgaacca

SEQ ID NO: 352566 - DNA, 75 bp, Artificial Sequence
  Synthetic
tggtgacgactgcagtggcagcgtctacctggctgctctgcaaatcgcgcgccacctgcttgacaccatacaggc

SEQ ID NO: 352567 - DNA, 75 bp, Artificial Sequence
  Synthetic
atctgtggctatcccgcttctgtccactggaatatttgccggaaacaaggataggttaatgcaatccttaaacca

SEQ ID NO: 352568 - DNA, 75 bp, Artificial Sequence
  Synthetic
actggaatatttgccggaaacaaggataggttaatgcaatccttaaaccatctgttaacggcattggacacaaca

SEQ ID NO: 352569 - DNA, 75 bp, Artificial Sequence
  Synthetic
taaccccgaatgctcggttgcctgtgtgtctggcagtcctttgctgtgcgagagctgcgagggcagaaacgacat

SEQ ID NO: 352570 - DNA, 75 bp, Artificial Sequence
  Synthetic
gggaatcactagatcacctctggaatcacaaccagcaaatgttctggagccaactgcttattcctctggctgcac

SEQ ID NO: 352571 - DNA, 75 bp, Artificial Sequence
  Synthetic
tttgtgccgccattgcaaccgtttccgttgcggcgtctacctggctgttttgcagatccagagatgcgtgcctaa

SEQ ID NO: 352572 - DNA, 75 bp, Artificial Sequence
  Synthetic
ttatcgtggtgacgcgtttactgaagtgcctgtgttgcgtggtgccttttttagtgctagcaggcgccgcaagcg

SEQ ID NO: 352573 - DNA, 75 bp, Artificial Sequence
  Synthetic
cgcagagctggttagagttcacccaaagagctccttggctggaaggaaaggctacagcaccagtgatgggaagac

SEQ ID NO: 352574 - DNA, 75 bp, Artificial Sequence
  Synthetic
aagagctccttggctggaaggaaaggctacagcaccagtgatgggaagactttctcataccttgaaggaaccaaa

SEQ ID NO: 352575 - DNA, 75 bp, Artificial Sequence
  Synthetic
tcggcgcctacgaacacgcgaccacgatgccgaatcaggcaggcatcccgtataacaccgtggtcaacagagcag

SEQ ID NO: 352576 - DNA, 75 bp, Artificial Sequence
  Synthetic
tttcatcaagcggcgaaggacatggcagaaattaacgctatgtggcccaccgctacagaggctaatgagcaggtg

SEQ ID NO: 352577 - DNA, 75 bp, Artificial Sequence
  Synthetic
gatacgcaccattgtctatcagtgtcaccccgactaaagtgaggctaattcctacactgaacctcgagtacatca

SEQ ID NO: 352578 - DNA, 75 bp, Artificial Sequence
  Synthetic
tcgcctgctcaggtgcgtgtgctgtgtcgtgccttttttagtcgtggccggcgccgcaggcgccggcgcctacga

SEQ ID NO: 352579 - DNA, 75 bp, Artificial Sequence
  Synthetic
tgagcagtataagatctaaatgtcctgttgaggaatcagaggcatccaccccaccaagtacattgccttgcctgt

SEQ ID NO: 352580 - DNA, 75 bp, Artificial Sequence
  Synthetic
cgtgtcactacaaaaccggacttgattctccctctattaagtgctgtggagcgcaggaatgccctaaggtatata

SEQ ID NO: 352581 - DNA, 75 bp, Artificial Sequence
  Synthetic
ggcccgatgagcagtgcaaggtctttaccggagtgtacccctttatgtggggcggtgcgtactgtttctgcgatg

SEQ ID NO: 352582 - DNA, 75 bp, Artificial Sequence
  Synthetic
acccgtcgtggcacaagcatttgccagatgggctaaagaatacaaagaagatcaagaagatgaaagaccattggg

SEQ ID NO: 352583 - DNA, 75 bp, Artificial Sequence
  Synthetic
cagaaaacactcaggtgagtagagcatacgtaacgaaatctgacgattgctccacagatcacgctctggcctata

SEQ ID NO: 352584 - DNA, 75 bp, Artificial Sequence
  Synthetic
aagtacctgagtatatacatcctagaaagtaccttgcagacgcagcttccgcgaacaacgaggcagccgaatcac

SEQ ID NO: 352585 - DNA, 75 bp, Artificial Sequence
  Synthetic
aggcgcacacagcctccgttcaggcgttcttgaacataactattggaggacagtcgactactgcagtagtgtacg

SEQ ID NO: 352586 - DNA, 75 bp, Artificial Sequence
  Synthetic
attcatccacggaagtacctcgcggaaacaccaccggtagaagagactccggagccgccggctgagaatcaaacc

SEQ ID NO: 352587 - DNA, 75 bp, Artificial Sequence
  Synthetic
tgaatggagagactcctatcagcttcaacggagtcaaactggtggcaggaccgctttcgactgcctggactccat

SEQ ID NO: 352588 - DNA, 75 bp, Artificial Sequence
  Synthetic
aaagtaccttgcagacgcagcttccgcgaacaacgaggcagccgaatcactatcggtagacgtgcagccacagct

SEQ ID NO: 352589 - DNA, 75 bp, Artificial Sequence
  Synthetic
ttgatcggaaagtagtgcagtacgcaggagaaatctacaattatgacttcccagaatatggggctggtcatgcag

SEQ ID NO: 352590 - DNA, 75 bp, Artificial Sequence
  Synthetic
gggcgtttggagatcttcaagccaggacaaccaccagtaacgatttgtacgcaagtacgaatctgatactgcaaa

SEQ ID NO: 352591 - DNA, 75 bp, Artificial Sequence
  Synthetic
tggtgttggagaggaccgaattggagatttcgtatgccccgcgcctcgaccaagaaaaagaagaactattacgca

SEQ ID NO: 352592 - DNA, 75 bp, Artificial Sequence
  Synthetic
tcctgtgaatttcaatggggtcaaattaactgcaggtccgctttccacagcttggacaccctttgatcgcaaaat

SEQ ID NO: 352593 - DNA, 75 bp, Artificial Sequence
  Synthetic
gaccgaacgccggtacaatccatgtcccatacactcaggcaccttcgggttttgagcagtggaaaaaagacagac

SEQ ID NO: 352594 - DNA, 75 bp, Artificial Sequence
  Synthetic
cgccttcattgaagtacacagcgccttttgggtgcgagattctcataaatccagtgagggctgagaactgtgccg

SEQ ID NO: 352595 - DNA, 75 bp, Artificial Sequence
  Synthetic
tgggatcaattccactagcatttgacattccagacgccctgtttaccagggtatcagaaacaccgactttgtcag

SEQ ID NO: 352596 - DNA, 75 bp, Artificial Sequence
  Synthetic
atgctgggtgctctttaaatgaatgcgtgtactcttcagactttggcgggatcgccaccgtcaaatattcggcca

SEQ ID NO: 352597 - DNA, 75 bp, Artificial Sequence
  Synthetic
gtaaagcaggcaaatgtgcagtacacatcccttcaggcaccgcaaccttgaaagaatccatcgtagatgtggtcg

SEQ ID NO: 352598 - DNA, 75 bp, Artificial Sequence
  Synthetic
aacagggctccttgaccctgcatttttcaacagccaacatacacccggagttcaaacttcaaatttgcacaacca

SEQ ID NO: 352599 - DNA, 75 bp, Artificial Sequence
  Synthetic
caattacatgcaaaggtgactgtcacccacctaaagaccacatcgtaacacgtccacaacaccacgcccaaacat

SEQ ID NO: 352600 - DNA, 75 bp, Artificial Sequence
  Synthetic
tcacagcggcagtctctaagactgcgtggacgtggctatcatcactcctgggagggtcagccgcaattattataa

SEQ ID NO: 352601 - DNA, 75 bp, Artificial Sequence
  Synthetic
gcgcctcgacctgaacaaagaagagatactgagaaagaagttacaattgaaccctacgcaagctaaccggagtag

SEQ ID NO: 352602 - DNA, 75 bp, Artificial Sequence
  Synthetic
caaaattacacatgtcggtgtgagacgatagtgagctgcgacgggtacgtcgttaagcgtatcgctatcagtcct

SEQ ID NO: 352603 - DNA, 75 bp, Artificial Sequence
  Synthetic
tcggccttgtgttagcaactattgttgctatgtacgtgctgaccaaccagaaacataattaaacacatgcagcaa

SEQ ID NO: 352604 - DNA, 75 bp, Artificial Sequence
  Synthetic
ttggcgagctgcttatatgaatttatcgaaattaaccggcggcaattggcaagctgcctataacaattttatttt

SEQ ID NO: 352605 - DNA, 75 bp, Artificial Sequence
  Synthetic
cggcggcaattggcaagctgcctataacaattttattttcttttaccaacaattggattttgtttttaatatttc

SEQ ID NO: 352606 - DNA, 75 bp, Artificial Sequence
  Synthetic
aaaattttccgacagtggcgtcgtactgcataatacctgagtacgacgcctacctggacatggtggacggtgcat

SEQ ID NO: 352607 - DNA, 75 bp, Artificial Sequence
  Synthetic
atacagcagcaattggcaagctgcttacatagaactcgcggcgattggcatgccgctttaaaatttttattttat

SEQ ID NO: 352608 - DNA, 75 bp, Artificial Sequence
  Synthetic
gtgaagctgaccgctggtcctctgtccacagcctggtcgccgttcgacaagaagatcgtgcagtacgccggggaa

SEQ ID NO: 352609 - DNA, 75 bp, Artificial Sequence
  Synthetic
tgcaaatagactacaaaggaaatgaaataatgaccgcggctgcctcacagggattgacgcggaaaggtgtctatg

SEQ ID NO: 352610 - DNA, 75 bp, Artificial Sequence
  Synthetic
cagttaggtacaaggttaatgagaatcccttgtacgcacccacctcagagcatgtaaacgtgctgttgacccgga

SEQ ID NO: 352611 - DNA, 75 bp, Artificial Sequence
  Synthetic
cgcatgagagaagcgcaaaccaataactacccaaaatggagaaagttcacgttgacatcgaggaagacagcccct

SEQ ID NO: 352612 - DNA, 75 bp, Artificial Sequence
  Synthetic
tgaatcagctgtgcgtgcgattcttcggtctagacttagattctggtttgttttccgcccccacagttccactct

SEQ ID NO: 352613 - DNA, 75 bp, Artificial Sequence
  Synthetic
gatcctggaagacctcggggtggacccagagctgttgaccctgatcgaagcggcatttggcgaaatttcctccat

SEQ ID NO: 352614 - DNA, 75 bp, Artificial Sequence
  Synthetic
aggttcggagccatgatgaaatcagggatgttcttaactctgtttgtcaacactgtgatcaatatggtcatagcc

SEQ ID NO: 352615 - DNA, 75 bp, Artificial Sequence
  Synthetic
ctaactccccttgcgccgcgttcattggcgacgataacatcgtgaaaggggttaagtccgacaaactcatggccg

SEQ ID NO: 352616 - DNA, 75 bp, Artificial Sequence
  Synthetic
acccccagggggctcatcaaagtcaccagttatgcaggagaagacaaaattggctcttacgcggtgctctcccca

SEQ ID NO: 352617 - DNA, 75 bp, Artificial Sequence
  Synthetic
gtggtgggtttattctatgtgactccgtgaccggaactgcatgccgtgtggcggaccctttgaagagattattca

SEQ ID NO: 352618 - DNA, 75 bp, Artificial Sequence
  Synthetic
gcatacccaatgaattaccgaagtacgatatcgtcttcgtaaacgtaagaacacaataccgctaccaccactacc

SEQ ID NO: 352619 - DNA, 75 bp, Artificial Sequence
  Synthetic
agcttggaaaaccattggctgtggatgatgaacatgatgatgacaggcgacgagcactacaggaggaatctgccc

SEQ ID NO: 352620 - DNA, 75 bp, Artificial Sequence
  Synthetic
acccctttcatgttcaagaacttggctggagcatatccctcctattcgaccaactgggccgacgagaccgtgtta

SEQ ID NO: 352621 - DNA, 75 bp, Artificial Sequence
  Synthetic
gaacttgtcgatccccccttccatgaatttgcatatgaaagcttgaggacacgtccggccgcaccttatcaagta

SEQ ID NO: 352622 - DNA, 75 bp, Artificial Sequence
  Synthetic
ttccttatcaaccaatgtatccaatgcagcccatgcccttccgcaacccttttgcgactcccagaagaccatggt

SEQ ID NO: 352623 - DNA, 75 bp, Artificial Sequence
  Synthetic
tttgcgactcccagaagaccatggtttccaaggaccgaccccttcctagcgatgcaggtgcaagagctggcaagg

SEQ ID NO: 352624 - DNA, 75 bp, Artificial Sequence
  Synthetic
atctacaccggctcgaggctccatgaagctggctgcgcaccttcgtatcatgtagtgcgcggggacatagccact

SEQ ID NO: 352625 - DNA, 75 bp, Artificial Sequence
  Synthetic
gccacggaaggagtaatcgtcaatgctgccaacagcaagggccaaccaggcagtggagtgtgcggagctctgtat

SEQ ID NO: 352626 - DNA, 75 bp, Artificial Sequence
  Synthetic
aacggcgagatgtgccgcccgagggtccaccggctaagaagaagaagaaggataactcgcaacaaggtggtcgga

SEQ ID NO: 352627 - DNA, 75 bp, Artificial Sequence
  Synthetic
gctagtaaagaaaaagaagaagacagggccgccgcccccaaaaaataatgtcggcaaaaagaaagtcaataggaa

SEQ ID NO: 352628 - DNA, 75 bp, Artificial Sequence
  Synthetic
attccattagcctttgacatccccgacgccctgttcaccagggtgtcagaaacaccgacactttcagcggccgaa

SEQ ID NO: 352629 - DNA, 75 bp, Artificial Sequence
  Synthetic
gtgaatgaaggctccagaacggcattgtctgtcgtgacgtggaacgagaaaggggttacagtcaaatataccccc

SEQ ID NO: 352630 - DNA, 75 bp, Artificial Sequence
  Synthetic
gagaacagcgagcagtggtccctggtgaccactatgtgcctgcttgccaatgtcacgttcccgtgcacccaacca

SEQ ID NO: 352631 - DNA, 75 bp, Artificial Sequence
  Synthetic
tgtcacgttcccgtgcacccaaccacccatctgctacgaccgcaagccagcagagactttgtccatgctcagtca

SEQ ID NO: 352632 - DNA, 75 bp, Artificial Sequence
  Synthetic
tgccgaagtacagaataacaggagtgcagaagatccaatgttcgcatcctatacttttctctcctaaagtacctg

SEQ ID NO: 352633 - DNA, 75 bp, Artificial Sequence
  Synthetic
atgtacgactccagacctcatctcagtatggattagacccatcaggaaacttgaaaggcagaaccatgaggtatg

SEQ ID NO: 352634 - DNA, 75 bp, Artificial Sequence
  Synthetic
tcgttaatgctgccaacagcaagggccagccaggcagtggagtgtgcggagctctgtaccggaagtaccccgaaa

SEQ ID NO: 352635 - DNA, 75 bp, Artificial Sequence
  Synthetic
tgacgtgcattcacccgcttgcagagcaagtgatcgtaatcacacactctgggaggaagggtagatatgcagttg

SEQ ID NO: 352636 - DNA, 75 bp, Artificial Sequence
  Synthetic
gctctgtaccggaagtaccccgaaagcttcgatttacaaccaatagaagtggggaaagctagattggtcaaaggt

SEQ ID NO: 352637 - DNA, 75 bp, Artificial Sequence
  Synthetic
caggtgccctgcaggagactccataactatggaatttaagaaagaatcagtcacccattcttgctctgtgcccta

SEQ ID NO: 352638 - DNA, 75 bp, Artificial Sequence
  Synthetic
aactcaaaacatctcattcatgcagtggggccgaattttaacaaagtgtctgaagtggaaggtgacaaacagctg

SEQ ID NO: 352639 - DNA, 75 bp, Artificial Sequence
  Synthetic
agagaactgtacacacacccaccagagcacggagctgaacaaccttgtcacgtgtacgctcacgacgcacaaaat

SEQ ID NO: 352640 - DNA, 75 bp, Artificial Sequence
  Synthetic
aggggagcttacgtggaaatgcaccttccaggatccgaagtggacagtactttactgtccatgagcggtagttct

SEQ ID NO: 352641 - DNA, 75 bp, Artificial Sequence
  Synthetic
tctgttaacggcattggacacaacagacgcagatgtggccatatactgcagagacaagaaatgggaagtgacgtt

SEQ ID NO: 352642 - DNA, 75 bp, Artificial Sequence
  Synthetic
ttccaggatccgaagtggacagtactttactgtccatgagcggtagttctgttcatgtgactccacctgccgggc

SEQ ID NO: 352643 - DNA, 75 bp, Artificial Sequence
  Synthetic
tggtggcaccaagatctccgaaaccatcaattctgctaaacaatacagtcagtgctctaagacatctcaatgcag

SEQ ID NO: 352644 - DNA, 75 bp, Artificial Sequence
  Synthetic
atcaattctgctaaacaatacagtcagtgctctaagacatctcaatgcagggcatatcgcacacagaatgacaaa

SEQ ID NO: 352645 - DNA, 75 bp, Artificial Sequence
  Synthetic
cattggccccagagcccattattacctttgggttccgatcagtgtctctgaaactccatcccaagaaccccacct

SEQ ID NO: 352646 - DNA, 75 bp, Artificial Sequence
  Synthetic
ctttgggttccgatcagtgtctctgaaactccatcccaagaaccccaccttcctaaccacgaggcagctagatgg

SEQ ID NO: 352647 - DNA, 75 bp, Artificial Sequence
  Synthetic
ataacgtgcggcaattggcgagccgctttaattagaattttattttcttttaccataatcggattttgtttttaa

SEQ ID NO: 352648 - DNA, 75 bp, Artificial Sequence
  Synthetic
ccaaaccataaactacccaaaatggagaaagttcacgttgacatcgaggaggatagccccttcctcagagcatta

SEQ ID NO: 352649 - DNA, 75 bp, Artificial Sequence
  Synthetic
gagggttgaaaacatgaaggccataacaactaagagaatcttacagggattaggtcactatctgaaatctgaagg

SEQ ID NO: 352650 - DNA, 75 bp, Artificial Sequence
  Synthetic
gagcagtggaacacagtggattactttaaggaggacaaggcccactcagctgagatcgtcctgaatcagctgtgc

SEQ ID NO: 352651 - DNA, 75 bp, Artificial Sequence
  Synthetic
tttcctgcctgaccccctatcgcttgactccaaatgcccgcatgcctttgtgcttagccgtcttgtgctgcgcac

SEQ ID NO: 352652 - DNA, 75 bp, Artificial Sequence
  Synthetic
ctcggatgaaaccgatgtttccatctttgacaaaaggttggagtttctggccagacctgttcccgcaccgcgaac

SEQ ID NO: 352653 - DNA, 75 bp, Artificial Sequence
  Synthetic
tagtcgtggccggcgccgtaggcgccggcgcttacgagcacgcgaccacgatgccgaaccaagtggggatcccgt

SEQ ID NO: 352654 - DNA, 75 bp, Artificial Sequence
  Synthetic
cggcgcttacgagcacgcgaccacgatgccgaaccaagtggggatcccgtataataccattgtcaacagagcggg

SEQ ID NO: 352655 - DNA, 75 bp, Artificial Sequence
  Synthetic
tcacccgccattaaatgctgcggcactcaggagtgttctcctacttataggccggacgagcaatgcaaagtcttc

SEQ ID NO: 352656 - DNA, 75 bp, Artificial Sequence
  Synthetic
tctggagtatacccatttatgtggggaggggcgtattgcttttgcgatacggagaatacccagataagcaaggcg

SEQ ID NO: 352657 - DNA, 75 bp, Artificial Sequence
  Synthetic
cacaccgaagaaaggcctaaggtccaagtaatccaggctgcagatccattggctacggcttatctatgtgggatt

SEQ ID NO: 352658 - DNA, 75 bp, Artificial Sequence
  Synthetic
acttccaaccaggcgattgggtgttagagacagacatagcgtccttcgataaaagcgaagacgacgcgatggctc

SEQ ID NO: 352659 - DNA, 75 bp, Artificial Sequence
  Synthetic
gaatggagagactcccgttaattttaacggagtgaagctgaccgcgggtcctctgtccacagcctggtcgccttt

SEQ ID NO: 352660 - DNA, 75 bp, Artificial Sequence
  Synthetic
tgacggcactgatgattctggaagaccttggggtggacccagagctgttgaccctaatcgaagcggcatttggcg

SEQ ID NO: 352661 - DNA, 75 bp, Artificial Sequence
  Synthetic
tgacaaaaagatcgtgcagtacgccggggaaatctacaactacgactttccggaatatggagccggccacgcagg

SEQ ID NO: 352662 - DNA, 75 bp, Artificial Sequence
  Synthetic
ccgtacacccaggccccatcgggttatgaacaatggaagaaggacaaaccaccatctctcaagttcacagcccct

SEQ ID NO: 352663 - DNA, 75 bp, Artificial Sequence
  Synthetic
agtggggccgaatttcaacaaagtgtctgaagtggaaggtgacaaacagctggcagaagcgtatgaatctatagc

SEQ ID NO: 352664 - DNA, 75 bp, Artificial Sequence
  Synthetic
gggatcaattccactagcttttgacattcccgacgctctgtttaccagggtgtccgaaacaccgacattatctgc

SEQ ID NO: 352665 - DNA, 75 bp, Artificial Sequence
  Synthetic
caagattattaatgataacaattacagatctgtggctatcccgcttctgtccactggaatatttgccggaaacaa

SEQ ID NO: 352666 - DNA, 75 bp, Artificial Sequence
  Synthetic
gtatattcatccgactttggcgggatcgctacagtcaaatactcggcgagcaagtcaggcaaatgtgcagttcat

SEQ ID NO: 352667 - DNA, 75 bp, Artificial Sequence
  Synthetic
acagggttcggctactatacatttttcgactgccagcattcatccggagtttagactccaaatatgcacgtctta

SEQ ID NO: 352668 - DNA, 75 bp, Artificial Sequence
  Synthetic
gtgggcacggccgtcattatcatggccatgactacgctcgccagcagtgtcgagtcgttcagttgtctgagaggg

SEQ ID NO: 352669 - DNA, 75 bp, Artificial Sequence
  Synthetic
aagcggtagaggagatatgtatctccgatgattcctccgtagcagagccggatgcagagctggttagagttcacc

SEQ ID NO: 352670 - DNA, 75 bp, Artificial Sequence
  Synthetic
tacagctgcggtatcaaaaaccgcttggacgtggttaacatccttactgggagggtcagctataattataataat

SEQ ID NO: 352671 - DNA, 75 bp, Artificial Sequence
  Synthetic
tggacgtggttaacatccttactgggagggtcagctataattataataattggacttgtgttagccactgttgtg

SEQ ID NO: 352672 - DNA, 75 bp, Artificial Sequence
  Synthetic
tgaccaaccagaaacataattagaattagcagcgattggcatgctgcttgtaaagctttattacaaataatgtgc

SEQ ID NO: 352673 - DNA, 75 bp, Artificial Sequence
  Synthetic
atgggcggcgcatgagagaagcccaaaccaattacctacccaaaatggagaaagttcacgttgacatcgaggaag

SEQ ID NO: 352674 - DNA, 75 bp, Artificial Sequence
  Synthetic
aaccaattacctacccaaaatggagaaagttcacgttgacatcgaggaagacagcccattcctcagagctttgca

SEQ ID NO: 352675 - DNA, 75 bp, Artificial Sequence
  Synthetic
acggagcttcccgcagtttgaggtagaagccaagcaggtcactgataatgaccatgctaacgccagagcgttttc

SEQ ID NO: 352676 - DNA, 75 bp, Artificial Sequence
  Synthetic
gaagccaagcaggtcactgataatgaccatgctaacgccagagcgttttcgcatctggcttcaaaactgatcgaa

SEQ ID NO: 352677 - DNA, 75 bp, Artificial Sequence
  Synthetic
acggaggtggacccatccgacacgatccttgacattggaagtgcgcccgcccgcagaatgtattctaagcataag

SEQ ID NO: 352678 - DNA, 75 bp, Artificial Sequence
  Synthetic
taccattgcatctgtccgatgagatgtgcagaagatccggacagattgtacaagtacgcaactaagctgaagaaa

SEQ ID NO: 352679 - DNA, 75 bp, Artificial Sequence
  Synthetic
gtgcagaagatccggacagattgtacaagtacgcaactaagctgaagaaaaactgcaaggaaataactgacaagg

SEQ ID NO: 352680 - DNA, 75 bp, Artificial Sequence
  Synthetic
caagaccaaaaaggcatctaagtatgatctggagtacgcagacgtgccgcagagcatgcgcgcagacacatttaa

SEQ ID NO: 352681 - DNA, 75 bp, Artificial Sequence
  Synthetic
ctggaaactgaaaccatgtgcctccacgacgacgagtcgtgtcgctatgaagggcaagtcgctgtttaccaggat

SEQ ID NO: 352682 - DNA, 75 bp, Artificial Sequence
  Synthetic
agggcaagtcgctgtttaccaggatgtatacgcggttgacggaccgacaagtctttaccatcaagccaacaaggg

SEQ ID NO: 352683 - DNA, 75 bp, Artificial Sequence
  Synthetic
agtgcccaaaggagtcggagccaaaggagatagtggtcgccccatacttgacaatcaagggcgtgtggtcgctat

SEQ ID NO: 352684 - DNA, 75 bp, Artificial Sequence
  Synthetic
agttagagtcgcctactggataggctttgacaccaccccttttatgttcaagaacttggctggagcttatccatc

SEQ ID NO: 352685 - DNA, 75 bp, Artificial Sequence
  Synthetic
atactctaccaactgggccgacgaaaccgtgttaacggctcgtaacataggcctgtgcagctccgacgttatgga

SEQ ID NO: 352686 - DNA, 75 bp, Artificial Sequence
  Synthetic
cttagaaagaagtatctgaaaccatccaacaatgtcctattctctgttggctcaaccatctaccacgagaagagg

SEQ ID NO: 352687 - DNA, 75 bp, Artificial Sequence
  Synthetic
tatgctgctacgatgcaccgcgagggattcttgtgctgcaaagtgacagacacattgaacggggagagggtctct

SEQ ID NO: 352688 - DNA, 75 bp, Artificial Sequence
  Synthetic
cggatgtcttccagaataaagctaatgtctgttgggcaaaggcacttgtacccgtgcttaagaccgccgggatag

SEQ ID NO: 352689 - DNA, 75 bp, Artificial Sequence
  Synthetic
cggtcgcacccaaagaaacaccaataccatgaagaattaccttttgccagtggtggcccaggcatttgctaggtg

SEQ ID NO: 352690 - DNA, 75 bp, Artificial Sequence
  Synthetic
gctatcgtacgttgcaccccgttcctttgtattcagcaagtgtgaacagagcgttctccagtcccaaagttgctg

SEQ ID NO: 352691 - DNA, 75 bp, Artificial Sequence
  Synthetic
gagacagacagttagtcatggggtgctgttgggcttttagaaggcacaagataacatctatttacaaacgcccgg

SEQ ID NO: 352692 - DNA, 75 bp, Artificial Sequence
  Synthetic
ctgttgggcttttagaaggcacaagataacatctatttacaaacgcccggacacccaaaccatcatcaaagtgaa

SEQ ID NO: 352693 - DNA, 75 bp, Artificial Sequence
  Synthetic
gccgaggagttgcgtgcagcactaccacctttggcagccgatgttgaggagcccactttggaagccgacgtcgac

SEQ ID NO: 352694 - DNA, 75 bp, Artificial Sequence
  Synthetic
cccctcgctgaacaagtcatagtgataacacactctggccgaaaagggcgttacgccgtggaaccctatcatggg

SEQ ID NO: 352695 - DNA, 75 bp, Artificial Sequence
  Synthetic
ttacgccgtggaaccctatcatgggaaagtagttgtgccagagggacatgcaatacccgtccaggactttcaagc

SEQ ID NO: 352696 - DNA, 75 bp, Artificial Sequence
  Synthetic
aaagtagttgtgccagagggacatgcaatacccgtccaggactttcaagctctgagtgaaagtgctaccatcgtg

SEQ ID NO: 352697 - DNA, 75 bp, Artificial Sequence
  Synthetic
tataacgagcgagagttcgtaaacaggtacctgcaccatattgccacacacggaggagcgctgaacacagacgaa

SEQ ID NO: 352698 - DNA, 75 bp, Artificial Sequence
  Synthetic
cggaggagcgctgaacacagacgaagaatattataaaactgtcaagcccagcgagcacgacggcgaatacctgta

SEQ ID NO: 352699 - DNA, 75 bp, Artificial Sequence
  Synthetic
cattgcagcatccgtatggctcttttgcaaatcacggatttcctgcctgaccccctatcgcttgactccaaatgc

SEQ ID NO: 352700 - DNA, 75 bp, Artificial Sequence
  Synthetic
tcccttccatgaatttgcctacgagagtctgagaacacgacctgccgctccctaccaagtaccaaccataggggt

SEQ ID NO: 352701 - DNA, 75 bp, Artificial Sequence
  Synthetic
acgaaatcggaagattgcgtcaccgatcacgcccaggcatacaaagcacatacagcctcagtccaagccttctta

SEQ ID NO: 352702 - DNA, 75 bp, Artificial Sequence
  Synthetic
ataataattatagatctgtggctattccgcttctgtccactggaatatttgccggaaacaaagataggttaatgc

SEQ ID NO: 352703 - DNA, 75 bp, Artificial Sequence
  Synthetic
gtggggatcccgtataataccattgtcaacagagcgggttatgcacctctacccattagcatagtacctactaaa

SEQ ID NO: 352704 - DNA, 75 bp, Artificial Sequence
  Synthetic
aaatgctgcggcactcaggagtgctctccaacttataggccggacgagcaatgcaaagtcttctctggagtatac

SEQ ID NO: 352705 - DNA, 75 bp, Artificial Sequence
  Synthetic
tcggtcgtctcaactttgttttacgacaaaaagatgaggacgactaacccgaaagagactaagatcgagattgac

SEQ ID NO: 352706 - DNA, 75 bp, Artificial Sequence
  Synthetic
gctggaaggaaaggctatagcaccagtgacgggaaaaccttctcatatcttgaaggaaccaagtttcaccaggca

SEQ ID NO: 352707 - DNA, 75 bp, Artificial Sequence
  Synthetic
gaacgtcctgctgacccgcacggaggaccgcatcgtgtggaaaacattagccggtgacccatggataaaaacact

SEQ ID NO: 352708 - DNA, 75 bp, Artificial Sequence
  Synthetic
gacggccaagtatcccgggaatttcactgccacgatagaagaatggcaagcagagcatgatgccatcatgaggca

SEQ ID NO: 352709 - DNA, 75 bp, Artificial Sequence
  Synthetic
actgccacgatagaagaatggcaagcagagcatgatgccatcatgaggcacatcttggagagaccggaccccacc

SEQ ID NO: 352710 - DNA, 75 bp, Artificial Sequence
  Synthetic
ctgcttgtaaagttttattacaaataacgtgcggcaattggcgagccgctttaattagaattttattttctttta

SEQ ID NO: 352711 - DNA, 75 bp, Artificial Sequence
  Synthetic
atgggcggcgcatgagagaagcccacaccaattacctacccaaaaatggagaaagttcacgttgacatcgaggaa

SEQ ID NO: 352712 - DNA, 75 bp, Artificial Sequence
  Synthetic
caactatgcgtgaggttctttggactcgacctggactccggtcttttctctgcacccacagttccgttatccatt

SEQ ID NO: 352713 - DNA, 75 bp, Artificial Sequence
  Synthetic
cgtcctggtccattccccgtgcatccgattttgatgtcgagagtctctccgtgctcgaatccttgggtgccaatg

SEQ ID NO: 352714 - DNA, 75 bp, Artificial Sequence
  Synthetic
aggaataatcactgggataattccccgtcgcctaacatgtacgggctgaataaggaagtggtccgtcagctctcc

SEQ ID NO: 352715 - DNA, 75 bp, Artificial Sequence
  Synthetic
gcagacacattcaaatacactcatgaaaaacctcagggctactacagctggcaccatggagcagtacagtatgaa

SEQ ID NO: 352716 - DNA, 75 bp, Artificial Sequence
  Synthetic
catgaatactggcaccctgcgcaattatgatccgcgcataaatctagtacctgtgaacagaagactgcctcacgc

SEQ ID NO: 352717 - DNA, 75 bp, Artificial Sequence
  Synthetic
tcagcaaattgaagggcagaactgtcctggtggtcggggagaagctgtccgtcccgggcaaaacagttgattggc

SEQ ID NO: 352718 - DNA, 75 bp, Artificial Sequence
  Synthetic
tgtcagatcggcctgaggctaccttcagagctcggctggatctaggcatcccgggtgacgtgcccaaatacgaca

SEQ ID NO: 352719 - DNA, 75 bp, Artificial Sequence
  Synthetic
tgtgctgaccaaccagaaacacaattagaattagcagcgattggcatgctgcttgtaaagttttactacaaataa

SEQ ID NO: 352720 - DNA, 75 bp, Artificial Sequence
  Synthetic
ccgggtgacgtgcccaaatacgacataatattcattaatgtaaggactccatataaataccatcactaccagcag

SEQ ID NO: 352721 - DNA, 75 bp, Artificial Sequence
  Synthetic
gcatgttgaccaagaaagcttgtctgcatctgaatcccggcggaacctgtgtcagtataggttacggttacgccg

SEQ ID NO: 352722 - DNA, 75 bp, Artificial Sequence
  Synthetic
ccgtctgtatttcacttacgtggcaagcaaaattacacatgtcggtgtgagactatagttagttgcgacgggtac

SEQ ID NO: 352723 - DNA, 75 bp, Artificial Sequence
  Synthetic
gcccgtacgcacaatccttacaagctttcatccaccttgaccaacatctatacaggttccagactccacgaagcc

SEQ ID NO: 352724 - DNA, 75 bp, Artificial Sequence
  Synthetic
tgtattcattgggtacgatcgcaaggcccgtacgcacaatccttacaagctttcatccaccttgaccaacatcta

SEQ ID NO: 352725 - DNA, 75 bp, Artificial Sequence
  Synthetic
tgatatgcatggaactatagaagagataccgttgcatcaggtgtctgttcatacctcacgtccttgccacataat

SEQ ID NO: 352726 - DNA, 75 bp, Artificial Sequence
  Synthetic
aacagcaagggacaacctggcggaggggtgtgcggagcgctgtacaaaaaattcccggaaagcttcgatttacag

SEQ ID NO: 352727 - DNA, 75 bp, Artificial Sequence
  Synthetic
attcccggaaagcttcgatttacagccgatcgaagtgggaaaagcgcgactggtcaaaggcgcagctaaacatat

SEQ ID NO: 352728 - DNA, 75 bp, Artificial Sequence
  Synthetic
aataaagtatcggaaattgaaggtgacaaacagttggcagaggcttatgagtctatcgctaagattgtcaacgac

SEQ ID NO: 352729 - DNA, 75 bp, Artificial Sequence
  Synthetic
cactgttgtccaccggcatcttttccgggaacaaagatcgactaactcaatcattgaatcatttgctgacagctc

SEQ ID NO: 352730 - DNA, 75 bp, Artificial Sequence
  Synthetic
tagacaccaccgatgcagatgtagccatatactgcagggacaagaaatgggaaatgactctcaaggaagcagtgg

SEQ ID NO: 352731 - DNA, 75 bp, Artificial Sequence
  Synthetic
aggaaggaagggctatagcacaagtgatggcaagactttctcgtatttggaagggactaaattccaccaggcggc

SEQ ID NO: 352732 - DNA, 75 bp, Artificial Sequence
  Synthetic
caaggatatagcggaaattaatgccatgtggcccgtcgcaacggaggccaatgagcaagtatgcatgtatatcct

SEQ ID NO: 352733 - DNA, 75 bp, Artificial Sequence
  Synthetic
gccttgcttgtgcatccacgctatgactccagaaagagtacagcgcctgaaagcgtcacgcccagaacaaattac

SEQ ID NO: 352734 - DNA, 75 bp, Artificial Sequence
  Synthetic
ccctctcgctgaacaagtcatagtgataacacactctggccgaaaagggcgttatgccgtggaaccctatcatgg

SEQ ID NO: 352735 - DNA, 75 bp, Artificial Sequence
  Synthetic
gcaccagcgatgcgcgtagcataggatcgtcctctgaaaccgatgtatcaatttttgacaagaggttggagttcc

SEQ ID NO: 352736 - DNA, 75 bp, Artificial Sequence
  Synthetic
cgtgtgctcatcctttccattgccgaagtaccgaatcactggtgtgcagaagatccagtgctcccagcctatact

SEQ ID NO: 352737 - DNA, 75 bp, Artificial Sequence
  Synthetic
aagtaccgaatcactggtgtgcagaagatccagtgctcccagcctatactgttttcacctaaagtgcctgcatac

SEQ ID NO: 352738 - DNA, 75 bp, Artificial Sequence
  Synthetic
atccatccacggaagtacctcgtggaaacaccaccggtagacgagactccggagcccccggcagagaaccaatcc

SEQ ID NO: 352739 - DNA, 75 bp, Artificial Sequence
  Synthetic
aaacaccaccggtagacgagactccggagcccccggcagagaaccaatccacagagggaacacctgaacaaccgg

SEQ ID NO: 352740 - DNA, 75 bp, Artificial Sequence
  Synthetic
taagcttgctgtcagatggcccgacccaccaggtgctgcaagtcgaggcagacattcatgggccgccttcggcat

SEQ ID NO: 352741 - DNA, 75 bp, Artificial Sequence
  Synthetic
ccagttcatcttggtccattcctcatgcatccgactttgatgtggatagtctgtccatccttgacaccctggagg

SEQ ID NO: 352742 - DNA, 75 bp, Artificial Sequence
  Synthetic
gaccggtgcctgcgccccggacagtattcaggaaccctccacagcccgctccacgcacaagaacgccgtcactcg

SEQ ID NO: 352743 - DNA, 75 bp, Artificial Sequence
  Synthetic
tagcctagtttccaacccgccaggagtgaatagggtgattactagggaggagcttgaggcgctcgccccgtcacg

SEQ ID NO: 352744 - DNA, 75 bp, Artificial Sequence
  Synthetic
agcttgaggcgctcgccccgtcacgcgctcccagcaggtcggtctcaagagccagcctggtatccaatcctccag

SEQ ID NO: 352745 - DNA, 75 bp, Artificial Sequence
  Synthetic
gccagcctggtatccaatcctccaggcgtaaatagggtaattacaagagaggagttcgaggcgttcgtagcacaa

SEQ ID NO: 352746 - DNA, 75 bp, Artificial Sequence
  Synthetic
catacatcttttcctccgataccggtcaagggcatttacaacaaaaatcagtaaggcaaacggtgctatccgaag

SEQ ID NO: 352747 - DNA, 75 bp, Artificial Sequence
  Synthetic
cgaaagagactaagattgagattgacactactggcagtactaaaccaaagcaggacgatctcattctcacttgtt

SEQ ID NO: 352748 - DNA, 75 bp, Artificial Sequence
  Synthetic
agaaattacagttaaaccccacacccgctaacagaagcagataccagtccaggagagtggagaacatgaaggcca

SEQ ID NO: 352749 - DNA, 75 bp, Artificial Sequence
  Synthetic
tgcatcctgttcctttgtattcgtccagcgtgaatcgtgccttttcaagccccaaggtcgcagtggaagcctgca

SEQ ID NO: 352750 - DNA, 75 bp, Artificial Sequence
  Synthetic
acgccatgttgaaagaaaactttccgaccgtggcttcttactgcattattccggagtacgatgcctatttggaca

SEQ ID NO: 352751 - DNA, 75 bp, Artificial Sequence
  Synthetic
agacaccgccagtttttgccctgcaaagctgcgcagctttccaaagaaacattcctatttggaacccacaatacg

SEQ ID NO: 352752 - DNA, 75 bp, Artificial Sequence
  Synthetic
ctgccacgaaaagaaattgcaatgtcacgcaaatgagagaattgcccgtattggattcggccgcctttaatgtgg

SEQ ID NO: 352753 - DNA, 75 bp, Artificial Sequence
  Synthetic
accctccgaaagatcatattgtgacgcatccccaataccacgcccagtcatttacagctgcggtatcaaaaaccg

SEQ ID NO: 352754 - DNA, 75 bp, Artificial Sequence
  Synthetic
ccgcaggtacccacgactgcctcgagcagttgctactggaagagtctatgacatgaacaccggcgcactgtgcaa

SEQ ID NO: 352755 - DNA, 75 bp, Artificial Sequence
  Synthetic
ccggtttgtaatggatttgaagagggatgtgaaagtgactccaggaacaaaacatactgaggaacgaccaaaggt

SEQ ID NO: 352756 - DNA, 75 bp, Artificial Sequence
  Synthetic
acaggtgatccaggctgccgatccgctagcaacagcgtatctgtgcggaattcaccgagagctggttaggaggtt

SEQ ID NO: 352757 - DNA, 75 bp, Artificial Sequence
  Synthetic
aaacgctgtcctgcttccaaacatccatacactgttcgacatgtcagctgaagacttcgacgccattatcgccga

SEQ ID NO: 352758 - DNA, 75 bp, Artificial Sequence
  Synthetic
gcatttccagcctggggactgcgttctggaaactgacatcgcgtcgtttgacaaaagcgaggacgacgccatggc

SEQ ID NO: 352759 - DNA, 75 bp, Artificial Sequence
  Synthetic
tgacgctgatcgaggcggctttcggcgaaatttcatcaatacatttgcccactaaaactaaatttaaatttggag

SEQ ID NO: 352760 - DNA, 75 bp, Artificial Sequence
  Synthetic
ctatgatgaaatctgggatgttcctcacattgtttgtgaacacagtcatcaacatcgtgatcgcaagcagagtgt

SEQ ID NO: 352761 - DNA, 75 bp, Artificial Sequence
  Synthetic
taagagaacggttaaccggatcaccgtgtgctgcatttattggagatgacaatattgtgaaaggagtcaaatcgg

SEQ ID NO: 352762 - DNA, 75 bp, Artificial Sequence
  Synthetic
acaaattaatggcagacaggtgcgccacctggttgaacatggaagtcaagatcatagatgctgtagtgggcgaga

SEQ ID NO: 352763 - DNA, 75 bp, Artificial Sequence
  Synthetic
ccactgttgtccaccggcatcttttccgggaacaaagatcgactaacccaatcattgaaccatttgctgacagct

SEQ ID NO: 352764 - DNA, 75 bp, Artificial Sequence
  Synthetic
gttaaatcattcagctacctgagaggggcccctataactctctacggctaacctgaatggactacgacatagtct

SEQ ID NO: 352765 - DNA, 75 bp, Artificial Sequence
  Synthetic
aactgaaacgatttgccttcacgacgatgaaacctgtcgatttgagggtcaagtcgcagtgtatcaggatgtgta

SEQ ID NO: 352766 - DNA, 75 bp, Artificial Sequence
  Synthetic
ggccatgactaccctagctagcagtgttaaatcattcagctacctgagaggggcccctataactctctacggcta

SEQ ID NO: 352767 - DNA, 75 bp, Artificial Sequence
  Synthetic
agtccgccaagatgttcccgttccaaccaatgtatcctatgcagccaatgccctaccgcaacccgttcgcggccc

SEQ ID NO: 352768 - DNA, 75 bp, Artificial Sequence
  Synthetic
cgcgcaggccctggttccccagaaccgacccttttctggcgatgcaggtgcaggaattaacccgctcgatggcta

SEQ ID NO: 352769 - DNA, 75 bp, Artificial Sequence
  Synthetic
agggtacatccgaagagttctttggctggaaggaagggctacagcacaagcgatggcaagactttctcatatttg

SEQ ID NO: 352770 - DNA, 75 bp, Artificial Sequence
  Synthetic
acctgacgttcaagcaacgccgggaagcgccgcctgaggggccacctgctaagaaaccgaagagggaggccccgc

SEQ ID NO: 352771 - DNA, 75 bp, Artificial Sequence
  Synthetic
cgatggcaagactttctcatatttggaagggaccaaatttcaccaggcggccaaggatatagcagaaattaatgc

SEQ ID NO: 352772 - DNA, 75 bp, Artificial Sequence
  Synthetic
aagaaaccgaagagggaggccccgcaaaaacaaaaaggggggggccaagggaagaagaagaagaaccaggggaag

SEQ ID NO: 352773 - DNA, 75 bp, Artificial Sequence
  Synthetic
actgctcattcccctagccgcgctcattgtggtgacccgcttgctgaagtgcatgtgttgcgtcgttcctttttt

SEQ ID NO: 352774 - DNA, 75 bp, Artificial Sequence
  Synthetic
caataactacccaaaatggagaaagttcacgttgacatcgaggaagatagccccttcctcagagcattacaacgg

SEQ ID NO: 352775 - DNA, 75 bp, Artificial Sequence
  Synthetic
tacgcttgcgtggtcggggggaagttattcaggccgatgcatgtggaaggcaaaatcgacaacgacgttttggcc

SEQ ID NO: 352776 - DNA, 75 bp, Artificial Sequence
  Synthetic
cattcatccacggaagtacctcgtggaaacaccaccggtggaagagaaccaatccacagaggggacacctgaacc

SEQ ID NO: 352777 - DNA, 75 bp, Artificial Sequence
  Synthetic
agtcctagcaggcgccgcaagcgtcggcgcctacgaacacgcaaccacgatgccgaatcaggtggggatcccgta

SEQ ID NO: 352778 - DNA, 75 bp, Artificial Sequence
  Synthetic
ttcacggtgccaaaaggtgttggggctaaaggagacagtgggcgacccattctggataatcagggacgggtggtc

SEQ ID NO: 352779 - DNA, 75 bp, Artificial Sequence
  Synthetic
gacaacccgggctacgacgaactgctagaagcagctgttaagtgcccaggaagaaaaaggagatctactgaggag

SEQ ID NO: 352780 - DNA, 75 bp, Artificial Sequence
  Synthetic
ctgtttaaggagtataagctaacgcgcccctacatggccagatgcattaggtgcgccgtagggagctgtcatagt

SEQ ID NO: 352781 - DNA, 75 bp, Artificial Sequence
  Synthetic
gaggagtttgaggcgttcgtagcacaacagcaatgacggtttgacgcgggtgcatacatcttttcctccgatacc

SEQ ID NO: 352782 - DNA, 75 bp, Artificial Sequence
  Synthetic
ggaggaccatgcggtacgacatgcacgggaccattgaagagataccactacatcaagtgtcacttcacacatctc

SEQ ID NO: 352783 - DNA, 75 bp, Artificial Sequence
  Synthetic
gcccgtgtcatattgtggatgggcacggctactttttgcttgctaggtgcccggcaggggattccatcaccatgg

SEQ ID NO: 352784 - DNA, 75 bp, Artificial Sequence
  Synthetic
tgacacctcctgctgggactagcgccctggtggaatgcgagtgcggtggcacaaagatctccgagaccatcaaca

SEQ ID NO: 352785 - DNA, 75 bp, Artificial Sequence
  Synthetic
acggcaaatgcaccgtgcctctagcaccggaaccgataataaccttcggattccgatcagtgtcactgaaactgc

SEQ ID NO: 352786 - DNA, 75 bp, Artificial Sequence
  Synthetic
accccaagaatcccacatatctgaccacccgccaacttgctgatgagcctcattacacgcacgagctcatatctg

SEQ ID NO: 352787 - DNA, 75 bp, Artificial Sequence
  Synthetic
gcactggaggcggacgttgacttaatgctgcaggaggcgggagcgggatctgtcgaaacccccagggggctcatc

SEQ ID NO: 352788 - DNA, 75 bp, Artificial Sequence
  Synthetic
gaatccacatgggctgccgcacgaggtgataactcattattaccacagataccccatgtccactatcctgggttt

SEQ ID NO: 352789 - DNA, 75 bp, Artificial Sequence
  Synthetic
agaatgagaactactaacccaagggattccaaaatcgaaattgacacaacaggaagtactaaaccaaaaaaaatg

SEQ ID NO: 352790 - DNA, 75 bp, Artificial Sequence
  Synthetic
gtacaggtgatacaggctgccgatccgctagcgacagcgtacttgtgcggaatccaccgggagctggttaggaga

SEQ ID NO: 352791 - DNA, 75 bp, Artificial Sequence
  Synthetic
tgttatgcaaatccagagtctcgtgcctaactccttaccggctaacacctaacgccaggatgccactttgcctgg

SEQ ID NO: 352792 - DNA, 75 bp, Artificial Sequence
  Synthetic
acttgattctcacatgttttaggggatgggttaagcaactgcaaatagactacaaaggaaatgaaataatgaccg

SEQ ID NO: 352793 - DNA, 75 bp, Artificial Sequence
  Synthetic
ctgtgctttgctgtgctcgcaccgcccgggctgagaccacctgggagtccttggaccatttatggaacaataacc

SEQ ID NO: 352794 - DNA, 75 bp, Artificial Sequence
  Synthetic
tacgagcacgcgaccacgatgccgagccaagcgggaatctcgtataacaccatagtcaacagagcaggctacgcg

SEQ ID NO: 352795 - DNA, 75 bp, Artificial Sequence
  Synthetic
ggcgttcccgggtccgggaagtccggaattatcaagagcgcagtcacaaagaaggacttggtagtgagtgctaag

SEQ ID NO: 352796 - DNA, 75 bp, Artificial Sequence
  Synthetic
gggcaaaggcacttgtacctgtgcttaagacagccgggatagatttgaccacagagcagtggaacacagtggatt

SEQ ID NO: 352797 - DNA, 75 bp, Artificial Sequence
  Synthetic
acttcaaagaggataaggcccactcagctgagattgtcctgaatcagctgtgcgtgcgattcttcggtctagact

SEQ ID NO: 352798 - DNA, 75 bp, Artificial Sequence
  Synthetic
acatcacagtgggagaacattccatcgtgaccaccgtgtatgtgaatggagaaactcctgtgaacttcaatgggg

SEQ ID NO: 352799 - DNA, 75 bp, Artificial Sequence
  Synthetic
tcaaattaactgcaggcccactttccacagcttggacaccctttgaccgcaaaattgtgcagtatgccggggaga

SEQ ID NO: 352800 - DNA, 75 bp, Artificial Sequence
  Synthetic
cacagcttggacaccctttgaccgcaaaattgtgcagtatgccggggagatctacaattacgattttcctgagta

SEQ ID NO: 352801 - DNA, 75 bp, Artificial Sequence
  Synthetic
aaaattgtgcagtatgccggggagatctacaattacgattttcctgagtatggggcaggacagccaggagcattc

SEQ ID NO: 352802 - DNA, 75 bp, Artificial Sequence
  Synthetic
gtgaaatatatacaaaccccattcgcgccgaaaattgtgctgtggggtcaattccattagcctttgacatccctg

SEQ ID NO: 352803 - DNA, 75 bp, Artificial Sequence
  Synthetic
acgccttgttcaccagggtgtcagaaacaccgacactttcagcggccgaatgcactcttaatgagtgcgtgtatt

SEQ ID NO: 352804 - DNA, 75 bp, Artificial Sequence
  Synthetic
aagaagaagaccaacaagaaaccaggcaagagacagcgcatggtcatgaaattggaatctgacaagacattccca

SEQ ID NO: 352805 - DNA, 75 bp, Artificial Sequence
  Synthetic
caaacatccacccggagttcaggctccaaatatgcacatcatatgttacgtgcaaaggtgattgtcaccccccga

SEQ ID NO: 352806 - DNA, 75 bp, Artificial Sequence
  Synthetic
gcggtgtcaaaaaccgcgtggacgtggttaacatccctgctgggaggatcagccgtaattattataattggctta

SEQ ID NO: 352807 - DNA, 75 bp, Artificial Sequence
  Synthetic
gcaagctgctcacatagaattcgcggcgattggcatgccgcttttaaaaattttattttattttcttttcttttc

SEQ ID NO: 352808 - DNA, 75 bp, Artificial Sequence
  Synthetic
atgggcggcgcatgagagaagcccaaaccaataactacccaaaatggagaaagttcacgttgacatcgaggaaga

SEQ ID NO: 352809 - DNA, 75 bp, Artificial Sequence
  Synthetic
aagttcacgttgacatcgaggaagatagccccttcctcagagcattacaacggagcttcccgcagtttgaggtag

SEQ ID NO: 352810 - DNA, 75 bp, Artificial Sequence
  Synthetic
cctagacattggaagtgcgcctgcccgcagaatgtattccaagcataaataccactgcatctgtccgatgaagtg

SEQ ID NO: 352811 - DNA, 75 bp, Artificial Sequence
  Synthetic
gtccaatagcaatcgaggcagtgaagagtgacgggcacgacggctatgttagacttcagacttcctcgcagtacg

SEQ ID NO: 352812 - DNA, 75 bp, Artificial Sequence
  Synthetic
ctccaccttgaccaatatctacaccggctcgaggctccatgaagctggctgcgcaccttcgtatcatgtagtgcg

SEQ ID NO: 352813 - DNA, 75 bp, Artificial Sequence
  Synthetic
gcccggcaggggactccatcaccatggaatttaagaaaaattcagtcacacactcctgctcagtgccgtatgaag

SEQ ID NO: 352814 - DNA, 75 bp, Artificial Sequence
  Synthetic
tattcgaccaactgggccgacgagaccgtgttaacggctcgtaacataggcttgtgcagctccgatgtgatggag

SEQ ID NO: 352815 - DNA, 75 bp, Artificial Sequence
  Synthetic
aatgttcgcatcctatacttttctctcctaaagtacctgagtacatacaccctagaaagtaccttgcagacgcag

SEQ ID NO: 352816 - DNA, 75 bp, Artificial Sequence
  Synthetic
tccccgtatgcacgtacgtgccggccacattgtgcgaccaaatgacaggcattctggcaacagatgtcagtgcag

SEQ ID NO: 352817 - DNA, 75 bp, Artificial Sequence
  Synthetic
aagttttattacaaataatgtgcggcaattggcgagccgctttaattagaatttttattttcttttaccataatt

SEQ ID NO: 352818 - DNA, 75 bp, Artificial Sequence
  Synthetic
cacccaaacgatcatcaaggtaaacagcgatttccactctttcgtgctgcccagaattggaagcagcaccttgga

SEQ ID NO: 352819 - DNA, 75 bp, Artificial Sequence
  Synthetic
gattgggctaaggaccaggatcagaaaactactggaggaacctgtggacagaccaccattgattaccgccgatga

SEQ ID NO: 352820 - DNA, 75 bp, Artificial Sequence
  Synthetic
gatgaggctaaggaagtcaaggaggctgaagagctcagggcagcattaccaccgctgtctgccgatgtagaggaa

SEQ ID NO: 352821 - DNA, 75 bp, Artificial Sequence
  Synthetic
ctgaagagctcagggcagcattaccaccgctgtctgccgatgtagaggaacctgcactggaggcggacgtcgact

SEQ ID NO: 352822 - DNA, 75 bp, Artificial Sequence
  Synthetic
attgtgaccactgtgtatgtgaatggagaaactcctgtgaacttcaatggggtcaaattaactgcaggtccactt

SEQ ID NO: 352823 - DNA, 75 bp, Artificial Sequence
  Synthetic
aagaaggagaactgtgccgagataataagggacgtcaagaaaatgaaagggctggacgtcaatgcccggacagtg

SEQ ID NO: 352824 - DNA, 75 bp, Artificial Sequence
  Synthetic
aagcaggagcgatccatgtgccatacactcaggcgccatcgggttttgagcaatggaagaaagataaagctccgt

SEQ ID NO: 352825 - DNA, 75 bp, Artificial Sequence
  Synthetic
ggcatttggcgaaatatcctccattcacttaccaaccaaaactaaatttaggtttggagccatgatgaaatcagg

SEQ ID NO: 352826 - DNA, 75 bp, Artificial Sequence
  Synthetic
cctttgtattcagcaagtgtgaatagagcgttctccagtcccaaagttgctgtcgaagcatgcaatgttgttctg

SEQ ID NO: 352827 - DNA, 75 bp, Artificial Sequence
  Synthetic
aggggatgggttaagcaactgcaaatagactacaaaggaaatgaaataatgaccgcggctgcctcacagggatta

SEQ ID NO: 352828 - DNA, 75 bp, Artificial Sequence
  Synthetic
gaagtcaaaatcatcgacgcagtggttggcgagaaagctccctacttctgtggtgggtttattttatgtgactct

SEQ ID NO: 352829 - DNA, 75 bp, Artificial Sequence
  Synthetic
acgcggaaaggtgtctatgcagttaggtacaaggttaatgagaatcccttgtacgcacccacctcagagcatgta

SEQ ID NO: 352830 - DNA, 75 bp, Artificial Sequence
  Synthetic
ggcaatcttcagaagtcgtgctacctgagccacctgcggcagctgcagcacctgcgcaagaacctgagcccgtcg

SEQ ID NO: 352831 - DNA, 75 bp, Artificial Sequence
  Synthetic
ctccggaacctgaagcagtaactcccactgtgccacctaatgccgtcattgttcaggcggatgtgcacgctgaac

SEQ ID NO: 352832 - DNA, 75 bp, Artificial Sequence
  Synthetic
cacgacgatgagtcgtgtcgctacgaagggcaagtcgctgtttaccaggatgtatacgcagttgacggaccgaca

SEQ ID NO: 352833 - DNA, 75 bp, Artificial Sequence
  Synthetic
tgagcattggttacggctatgcggaccgggccagcgaaagcatcattggagcagtcgctcggcagttcaagttct

SEQ ID NO: 352834 - DNA, 75 bp, Artificial Sequence
  Synthetic
gaaggagtaatcgtcaatgctgccaacagcaagggccaaccaggcagtggagtgtgcggagctctgtatcggaaa

SEQ ID NO: 352835 - DNA, 75 bp, Artificial Sequence
  Synthetic
gccgtcacctctcattactgccgaggacatacaagaagctaagtgcgcagccgatgaggctaaggaggtgcgtga

SEQ ID NO: 352836 - DNA, 75 bp, Artificial Sequence
  Synthetic
tagcggcaattggcacgccgcttataaaatttttattttcttttaccaataattggattttgtttttaatatttc

SEQ ID NO: 352837 - DNA, 75 bp, Artificial Sequence
  Synthetic
acaaagtgtctgaagtggaaggtgacaaacagctggcagaggcgtacgaatctatagccaagattattaatgaca

SEQ ID NO: 352838 - DNA, 75 bp, Artificial Sequence
  Synthetic
acctacccaaaatggagaaagttcacgttgacatcgaggaagacagcccattcctcagagctttgcagcggagct

SEQ ID NO: 352839 - DNA, 75 bp, Artificial Sequence
  Synthetic
aggaaccaaatttcatcaggcggcgaaggacatggcagaaatcaacgccatgtggcctaccgctacagaggctaa

SEQ ID NO: 352840 - DNA, 75 bp, Artificial Sequence
  Synthetic
aaggacatggcagaaatcaacgccatgtggcctaccgctacagaggctaacgagcaggtatgcttatacattctg

SEQ ID NO: 352841 - DNA, 75 bp, Artificial Sequence
  Synthetic
ccaaatgccccgttgaggaatcagaggcatccactccaccaagtacattgccctgcttgtgcatccacgctatga

SEQ ID NO: 352842 - DNA, 75 bp, Artificial Sequence
  Synthetic
agtcagtgctctaagacatctcagtgcagggcataccgtacacagaatgacaaatgggtgtacaattcggacaaa

SEQ ID NO: 352843 - DNA, 75 bp, Artificial Sequence
  Synthetic
cctaaccacgaggcagctggatggagaaccagcttacacccacgaacttataacccaccctgtagtgagaaattt

SEQ ID NO: 352844 - DNA, 75 bp, Artificial Sequence
  Synthetic
ctcggttacagagaaaggttgggaatttgtgtggggaaaccatccgcctcaaaggtactggtctcaagaaactgc

SEQ ID NO: 352845 - DNA, 75 bp, Artificial Sequence
  Synthetic
gaacatctacctctaatcaacctggcaatgtttaccagcaaatcccggctgcagcgccaaccagagctgcgagaa

SEQ ID NO: 352846 - DNA, 75 bp, Artificial Sequence
  Synthetic
cacgaggtgatcacgcattactatcacaggtatcccatgtccaccatcctcggcttatcaatctgtgcggcgata

SEQ ID NO: 352847 - DNA, 75 bp, Artificial Sequence
  Synthetic
tgatgtcgagagtctttccgtgctcgaatccctgggtgctagtgacgcaatcagcatggagtcgtcctcaaacga

SEQ ID NO: 352848 - DNA, 75 bp, Artificial Sequence
  Synthetic
gcttagccgtcttgtgctgcgcacgcacagccaaagccgaaactacttgggaatccctagatcacctctggaacc

SEQ ID NO: 352849 - DNA, 75 bp, Artificial Sequence
  Synthetic
tgacggccaagtatcctgggaatttcactgccacgatagaggaatggcaagcagagcatgatgccatcatgaggc

SEQ ID NO: 352850 - DNA, 75 bp, Artificial Sequence
  Synthetic
ctcgagtgcagagtacatccacagatgtggacagtatttcagcactcgagtcttgcgatagcaccagcgatgcgc

SEQ ID NO: 352851 - DNA, 75 bp, Artificial Sequence
  Synthetic
acaaccagcagatgttctggagtcagctgctaatcccgctagcagcactgatagttgctacccgcttgctgaaat

SEQ ID NO: 352852 - DNA, 75 bp, Artificial Sequence
  Synthetic
taataccattgtcaacagagcgggttatgcacctctacctattagcatagtacctactaaagtgaagctgattcc

SEQ ID NO: 352853 - DNA, 75 bp, Artificial Sequence
  Synthetic
cgagtgatcactagggaagaattcgaggccttcgttgcccaacagcaatgacggttcgacgcgggcgcatacatt

SEQ ID NO: 352854 - DNA, 75 bp, Artificial Sequence
  Synthetic
acggttcgacgcgggcgcatacattttctcctcggacactggtcaaggacacttgcaacaaaaatcagtaaggca

SEQ ID NO: 352855 - DNA, 75 bp, Artificial Sequence
  Synthetic
acatgaacactggtacactgcgcaattatgatccgcgcataaatctagtacctgtgaacagaagactgcctcatg

SEQ ID NO: 352856 - DNA, 75 bp, Artificial Sequence
  Synthetic
ggagtagatatcagtcccggagggttgaaaacatgaaggccataacaactaagagaatcttacagggattaggtc

SEQ ID NO: 352857 - DNA, 75 bp, Artificial Sequence
  Synthetic
aatggagagactcccgttaattttaatggagtgaagctgaccgcgggccctctgtccacagcctggtcgccgttc

SEQ ID NO: 352858 - DNA, 75 bp, Artificial Sequence
  Synthetic
actatctgaaatctgaaggtaaggttgagtgctatcgtacgttgcaccccgttcctttgtattcagcaagtgtga

SEQ ID NO: 352859 - DNA, 75 bp, Artificial Sequence
  Synthetic
aatccacagaggggacacctgaaccagcacccgtaaacgtggatgcaaccaggactagaacgcctgaaccgatca

SEQ ID NO: 352860 - DNA, 75 bp, Artificial Sequence
  Synthetic
tcccatccgcgattcagaacacgctgcagaatgtactagcggctgccacaaagagaaactgcaatgtgactcaaa

SEQ ID NO: 352861 - DNA, 75 bp, Artificial Sequence
  Synthetic
tgagggagctgcctgtattggattctgcggccttcaatgtagagtgttttaaaaaatacgcttgcaataatgagt

SEQ ID NO: 352862 - DNA, 75 bp, Artificial Sequence
  Synthetic
atacaggttccagactccacgaagccggatgcgcaccctcatatcatgtggtgcgaggggatattgccatggcca

SEQ ID NO: 352863 - DNA, 75 bp, Artificial Sequence
  Synthetic
tgcggccttcaatgtagagtgttttaaaaaatacgcttgcaataatgagtactgggagacctataagaagaaccc

SEQ ID NO: 352864 - DNA, 75 bp, Artificial Sequence
  Synthetic
aaagactcataatttagacatgctgcaagacatacccatggacaggtttattatggatttaaaaagagatgtcaa

SEQ ID NO: 352865 - DNA, 75 bp, Artificial Sequence
  Synthetic
cagagcatgatgccatcatgaggcacatcttggagagaccagaccctaccgacgtattccaaaataaagcgaatg

SEQ ID NO: 352866 - DNA, 75 bp, Artificial Sequence
  Synthetic
tgatggcaagactttctcatatttggaagggactaaattccaccaggcggccaaggatatagcagaaattaatgc

SEQ ID NO: 352867 - DNA, 75 bp, Artificial Sequence
  Synthetic
cgcagtttgaggtagaagccaagcaggtcacggataatgaccatgctaacgccagagcgttttcgcatttggcat

SEQ ID NO: 352868 - DNA, 75 bp, Artificial Sequence
  Synthetic
ttatcaacactgtgatcaacatggtcatagccagcagagttttgcgggagagactgacaaactccccttgcgccg

SEQ ID NO: 352869 - DNA, 75 bp, Artificial Sequence
  Synthetic
cgttcatcggcgacgacaacatcgtgaaaggggttaaatctgacaaactcatggccgataggtgcgctacatggc

SEQ ID NO: 352870 - DNA, 75 bp, Artificial Sequence
  Synthetic
tatttttgtggtgggtttattctatgtgactctgtgacaggaactgcatgccgtgtggcagaccctttgaagaga

SEQ ID NO: 352871 - DNA, 75 bp, Artificial Sequence
  Synthetic
gtgactctgtgacaggaactgcatgccgtgtggcagaccctttgaagagattattcaagcttggaaaaccactgg

SEQ ID NO: 352872 - DNA, 75 bp, Artificial Sequence
  Synthetic
cggagctgccggcggagaaccaatccacagaggggacatctgaacaaccagcaccaaacgtggatgcaaccagga

SEQ ID NO: 352873 - DNA, 75 bp, Artificial Sequence
  Synthetic
catccgactttgatgtggacagtttatccatccttgccctggagggagctagcgtgactagcgaggcagcgtcag

SEQ ID NO: 352874 - DNA, 75 bp, Artificial Sequence
  Synthetic
ttcaagcaacggcgagacgtgccgcccgaaggtccaccagctaagaagaagaagaaggataactcgcaacaaagt

SEQ ID NO: 352875 - DNA, 75 bp, Artificial Sequence
  Synthetic
taagcgtgctgtctgaggatacaccaaaccaggtgcacctagtggaggctgatgtacaccacttcagcgcaagtg

SEQ ID NO: 352876 - DNA, 75 bp, Artificial Sequence
  Synthetic
agctggcatcatggagcagtacagtatgaaaatggcagattcacagtgcccaaaggagtcggagccaaaggagat

SEQ ID NO: 352877 - DNA, 75 bp, Artificial Sequence
  Synthetic
ttcaagaaatatgcgtgcaataatgaatattgggaaacgtttaaagaaaaccccatcaggcttactgaagaaaat

SEQ ID NO: 352878 - DNA, 75 bp, Artificial Sequence
  Synthetic
ctgaaatgtccaggcagaggcaagaggtccacggaggagctgtttaaggagtacaaattaacacgcccgtacatg

SEQ ID NO: 352879 - DNA, 75 bp, Artificial Sequence
  Synthetic
ttggcaagctgcttatgtagaacccgcggcgattggcatgccgctttaaaattttattttattttcttttttttt

SEQ ID NO: 352880 - DNA, 75 bp, Artificial Sequence
  Synthetic
gccaggtgcatcaggtgtgcggtcggaagttgccacagccccatagccatagaggcggtaaggagcgaagggcat

SEQ ID NO: 352881 - DNA, 75 bp, Artificial Sequence
  Synthetic
gaatcggtcacccattcttgctctgtgccctatgaagtaaagtttaatcctgtgggaagagaactgtatacacac

SEQ ID NO: 352882 - DNA, 75 bp, Artificial Sequence
  Synthetic
aactaaatttaaattcggagccatgatgaaatccggaatgttcctcacactgtttgtgaacacagtcattaacat

SEQ ID NO: 352883 - DNA, 75 bp, Artificial Sequence
  Synthetic
cgcaagtagcatggagtttctggcgcgaccggtacctgcgcctcgaacagtattcaggaaccctcctcaccccgc

SEQ ID NO: 352884 - DNA, 75 bp, Artificial Sequence
  Synthetic
agatcgggctgaggacaagaatcaggaaaatgttagaagagcacaaggagccgtcacctctcattactgccgagg

SEQ ID NO: 352885 - DNA, 75 bp, Artificial Sequence
  Synthetic
cacctgaagggccacccgctaagaaaccgaagcgggaggccccgcaaaaacaaaaagggggaggccaagggaaga

SEQ ID NO: 352886 - DNA, 75 bp, Artificial Sequence
  Synthetic
ttgatgttacaagaggctggggccggctcagtggagacaccgcgtggcttgataaaggttaccagctacgccggc

SEQ ID NO: 352887 - DNA, 75 bp, Artificial Sequence
  Synthetic
caaaagccgcggccctatatgctaagacccacaatctcgcaatgctgcaagatattcccatggaccggtttgtaa

SEQ ID NO: 352888 - DNA, 75 bp, Artificial Sequence
  Synthetic
gcgggtcctctgtccacagcctggtcgccgttcgacaaaaagatcgtgcagtatgccggggaaatctataattat

SEQ ID NO: 352889 - DNA, 75 bp, Artificial Sequence
  Synthetic
ttgacgaagcttttgcttgtcatgcaggtactcttagagcgctcatagccatcataagacctaaaaaggcagtgc

SEQ ID NO: 352890 - DNA, 75 bp, Artificial Sequence
  Synthetic
acgcaggagcgtttggtgacatccaggctaggacgatatctagttccgatgtatacgccaacacaaaccttgtgc

SEQ ID NO: 352891 - DNA, 75 bp, Artificial Sequence
  Synthetic
taaggagtataagctaacgcgcccttacatggccagatgcatcagatgtgccgttgggagctgccatagtccaat

SEQ ID NO: 352892 - DNA, 75 bp, Artificial Sequence
  Synthetic
gaaagagactaagattgagattgacactaccggcagtactaaacccaagcaggacgatctcatcctcacttgttt

SEQ ID NO: 352893 - DNA, 75 bp, Artificial Sequence
  Synthetic
taagcgtgctgtccgatacaccacaccaagtgcaccgagtggaggctgaagtgcatcgcttcagcgcaagtaccc

SEQ ID NO: 352894 - DNA, 75 bp, Artificial Sequence
  Synthetic
agttcatgtaccatcaggcacggctacattgaaagaagccgcagtcgagctggccgaacagggttcggccactat

SEQ ID NO: 352895 - DNA, 75 bp, Artificial Sequence
  Synthetic
acatttttcgactgccagcatccatccggagtttagactccaaatatgcacgtcttatgttacgtgcaaagggga

SEQ ID NO: 352896 - DNA, 75 bp, Artificial Sequence
  Synthetic
taataattggacttgtgttagccactgttgtggctatgtatgtgctgaccaaccagaaacacaactagaattagc

SEQ ID NO: 352897 - DNA, 75 bp, Artificial Sequence
  Synthetic
aaagttttattacaaataacgtgcggcaattggcgagccgctttaattagaattttattttcttttaccataatt

SEQ ID NO: 352898 - DNA, 75 bp, Artificial Sequence
  Synthetic
atataaataccatcattaccagcagtgcgaagaccatgccattaagcttagcatgttgaccaagaaagcttgtct

SEQ ID NO: 352899 - DNA, 75 bp, Artificial Sequence
  Synthetic
gcatgttgaccaagaaagcttgtctgcatctgaatcccggcggaacctgtgtcagcataggttatggttacgccg

SEQ ID NO: 352900 - DNA, 75 bp, Artificial Sequence
  Synthetic
attccaagcataagtaccattgcatctgtccgatgaaatgtgcagaagatccggacagactgtttaaatatgcag

SEQ ID NO: 352901 - DNA, 75 bp, Artificial Sequence
  Synthetic
tgacggaccgacgagcctttatcatcaggccaacaaaggggtcagagtcgcctattggataggattcgacactac

SEQ ID NO: 352902 - DNA, 75 bp, Artificial Sequence
  Synthetic
gtctatcgctaaaattgtcaacgacaacaattacaagtcagtagcgattccactgttgtccaccggcatcttttc

SEQ ID NO: 352903 - DNA, 75 bp, Artificial Sequence
  Synthetic
gagggatgtccatccttagaaagaaatttttaaaaccatccaataacgtcttgttctctgtaggatctaccatct

SEQ ID NO: 352904 - DNA, 75 bp, Artificial Sequence
  Synthetic
tctggcagcagatgatgaacatgacgatgataggagaagggccttatacgaagagtcaacacgctggaatcgagt

SEQ ID NO: 352905 - DNA, 75 bp, Artificial Sequence
  Synthetic
acaaagaagatcaagaagatgaaagaccattggggctcagggaccgccagttagtgatggggtgttgttgggcgt

SEQ ID NO: 352906 - DNA, 75 bp, Artificial Sequence
  Synthetic
ccagaactagaacgcccgaaccgattattattgaagaagaagaggatagcataagcttgctgtcagacggcccga

SEQ ID NO: 352907 - DNA, 75 bp, Artificial Sequence
  Synthetic
gcacctagcagggccagctcgagaattagcctagtttccaacccgccaggagtgaatagggtgattactagggag

SEQ ID NO: 352908 - DNA, 75 bp, Artificial Sequence
  Synthetic
aggcggacgttgacttaatgctgcaggaggcgggagcaggatctgtcgaaacccccagggggctcatcaaggtca

SEQ ID NO: 352909 - DNA, 75 bp, Artificial Sequence
  Synthetic
agaaacaatgtgtgaagaaagaactggtttcgggactaggtttgacgggagaacttgtagatccccctttccatg

SEQ ID NO: 352910 - DNA, 75 bp, Artificial Sequence
  Synthetic
cgaccgtggcttcttactgcattattccggagtacgatgcctatctggacatggttgacggcgcttcttgttgtt

SEQ ID NO: 352911 - DNA, 75 bp, Artificial Sequence
  Synthetic
ccaactataggtgtgtatggcgttcccgggtccgggaagtctggaattattaagagtgcagtcacaaagaaggac

SEQ ID NO: 352912 - DNA, 75 bp, Artificial Sequence
  Synthetic
gctgccacgaaaagaaattgcaacgtcacgcaaatgagagaattgcccgtattggattcggccgcctttaatgtg

SEQ ID NO: 352913 - DNA, 75 bp, Artificial Sequence
  Synthetic
aaggaaataactgacaaggaactggacaagaaaatgaaggagctcgccgccgtcatgagcgaccctgacctggaa

SEQ ID NO: 352914 - DNA, 75 bp, Artificial Sequence
  Synthetic
catctaccacgagaagagggacctattgaggagctggcacctgccgtctgtatttcacttacgtggcaagcaaaa

SEQ ID NO: 352915 - DNA, 75 bp, Artificial Sequence
  Synthetic
ccaaagcaatgtggcttcttcaacatgatgtgcctgaaggtgcacttcaaccatgaaatatgcactcaagttttt

SEQ ID NO: 352916 - DNA, 75 bp, Artificial Sequence
  Synthetic
taaacgctgtcctgcttccaaacatccatacactgttcgacatgtcagctgaagactttgacgctattatcgccg

SEQ ID NO: 352917 - DNA, 75 bp, Artificial Sequence
  Synthetic
ataactcattattaccacagataccctatgtccaccatcctgggtttgtcaatttgcgccgccattgtaaccgtt

SEQ ID NO: 352918 - DNA, 75 bp, Artificial Sequence
  Synthetic
agcatttccagcctggggactgcgttctggaaactgacatcgcgtcgtttgacaaaagcgaggatgacgccatgg

SEQ ID NO: 352919 - DNA, 75 bp, Artificial Sequence
  Synthetic
cctctcattactgccgaggatatacaagaagctaagtgcgcagccgacgaggctaaggaggtacgtgaagccgag

SEQ ID NO: 352920 - DNA, 75 bp, Artificial Sequence
  Synthetic
ggctaaggaggtacgtgaagccgaggagttgcgtgcagcactaccacctttggcagccgatgttgaggagcccac

SEQ ID NO: 352921 - DNA, 75 bp, Artificial Sequence
  Synthetic
gcctcacagggattgacgcggaaaggtgtctatgcggttaggtacaaagttaacgagaacccattgtacgcaccc

SEQ ID NO: 352922 - DNA, 75 bp, Artificial Sequence
  Synthetic
ctctgaccgcgttaatgattctggaagacttaggtgtggacgcagagctgttgacgctgatcgaggcggctttcg

SEQ ID NO: 352923 - DNA, 75 bp, Artificial Sequence
  Synthetic
gccatgatgaaatctgggatgttcctcacattgtttgtgaacacagtcatcaacatcgtgatcgcaagcagagtg

SEQ ID NO: 352924 - DNA, 75 bp, Artificial Sequence
  Synthetic
aagataggctcctatgcagtgctttccccgcaggctgtactcaagagtgaaaaactatcttgtatccaccccctc

SEQ ID NO: 352925 - DNA, 75 bp, Artificial Sequence
  Synthetic
gcgattcttcggtctagacctagattctggtttgttttccgctcccacagttccactctccattaggaacaacca

SEQ ID NO: 352926 - DNA, 75 bp, Artificial Sequence
  Synthetic
tgatgatgacaggagaagggcattacatgaagagtcaacacgctggaaccgagtgggaattcttccagagctgtg

SEQ ID NO: 352927 - DNA, 75 bp, Artificial Sequence
  Synthetic
cgacaggaaacagtgcgtcaagaaagaactagtcactgggctagggctcacaggcgaactggtggatcctccctt

SEQ ID NO: 352928 - DNA, 75 bp, Artificial Sequence
  Synthetic
caggcgaactggtggatcctcccttccatgaatttgcctacgagagtctgagaacacgacctgccgctccctacc

SEQ ID NO: 352929 - DNA, 75 bp, Artificial Sequence
  Synthetic
catgaagagtcaacacgctggaaccgagtgggaattcttccagagctgtgtaaggctgtagaatcaaggtatgaa

SEQ ID NO: 352930 - DNA, 75 bp, Artificial Sequence
  Synthetic
cataaatttagtaccggtgaaccgtcgtctaccacatgctcttgtgacgcaacatgctgattatcctcccagtga

SEQ ID NO: 352931 - DNA, 75 bp, Artificial Sequence
  Synthetic
actgaagtgctatttgtcttcatcgggttcgatcgtaaaacgcgaacccataacccatacaagctctcctccacc

SEQ ID NO: 352932 - DNA, 75 bp, Artificial Sequence
  Synthetic
gagcagtccaatatgaaaacgggcgtttcacggtgccaaaaggagttggagctaaaggagacagtgggcgaccca

SEQ ID NO: 352933 - DNA, 75 bp, Artificial Sequence
  Synthetic
cagcaattggcaagctgcttatatagaactcgcggcgattggcatgccgctttaaaattttattttattttcttt

SEQ ID NO: 352934 - DNA, 75 bp, Artificial Sequence
  Synthetic
ttgcacgttagttcgatccgctacaatgtttcctttccagcgaaccatgtttcctatgcagccaatgccctttag

SEQ ID NO: 352935 - DNA, 75 bp, Artificial Sequence
  Synthetic
ctgcatgtggagggtaagatcgacaacgacgtgttgtcctccctcaagaccaaaaaggcatctaagtatgatctg

SEQ ID NO: 352936 - DNA, 75 bp, Artificial Sequence
  Synthetic
gcttcgatttacaaccaatagaagtggggaaagctagactggtcaaaggcaactcaaaacatcttattcacgcag

SEQ ID NO: 352937 - DNA, 75 bp, Artificial Sequence
  Synthetic
ggacaacccgggctacgacgagctgctagaagcagctgttaagtgcccaggaaggaaaaggagatctactgagga

SEQ ID NO: 352938 - DNA, 75 bp, Artificial Sequence
  Synthetic
aagagctctttggctggaaggaaaggttacagcaccagcgatgggaagactttctcatatcttgaaggaaccaaa

SEQ ID NO: 352939 - DNA, 75 bp, Artificial Sequence
  Synthetic
tgagcagtataagatccaaatgccccgttgaggaatcagaggcatccaccccaccaagtacattgccttgcttgt

SEQ ID NO: 352940 - DNA, 75 bp, Artificial Sequence
  Synthetic
cgcacatgatgcacagaacagaggagcttatgtcgagatgcacctcccgggctctgaagtggacagcagtctggt

SEQ ID NO: 352941 - DNA, 75 bp, Artificial Sequence
  Synthetic
gctctgaagtggacagcagtctggtctctttgagcggcagttcagtcactgtgacacctcctgcggggactagcg

SEQ ID NO: 352942 - DNA, 75 bp, Artificial Sequence
  Synthetic
taagcgtgctgtccgaggatacaccacaccaagtgcaccaagtggaggctgaagtgcatcgcttcagcgcaagtg

SEQ ID NO: 352943 - DNA, 75 bp, Artificial Sequence
  Synthetic
caccccaagaatcccacatatctgactacccgccaacttgctgatgagcctcattacacgcacgagctcatatct

SEQ ID NO: 352944 - DNA, 75 bp, Artificial Sequence
  Synthetic
ctcaatcttcgtcctggtccattccacgtgcatccgactttgatgtcgagagtctttccgtgctcgaatccctgg

SEQ ID NO: 352945 - DNA, 75 bp, Artificial Sequence
  Synthetic
gcaccagcgatgcgcgcagcgtggactcggatgaaaccgatgtttccatctttgacaaaaggttggagttcatgg

SEQ ID NO: 352946 - DNA, 75 bp, Artificial Sequence
  Synthetic
agagactaactcttacttcgcaaggagcatggagtttctggcgcgaccggtgcctgcgccccggacagtattcag

SEQ ID NO: 352947 - DNA, 75 bp, Artificial Sequence
  Synthetic
ctggtcaaggacatttgcaacaaaaatcagtaaggcagacagtattgtctgaagtggtgctagagaggaccgagt

SEQ ID NO: 352948 - DNA, 75 bp, Artificial Sequence
  Synthetic
atcagtaaggcagacagtattgtctgaagtggtgctagagaggaccgagttagagatctcgtacgccccgcgcct

SEQ ID NO: 352949 - DNA, 75 bp, Artificial Sequence
  Synthetic
caaaattgtgcagtatgccggggagatctacaattacgattttcctgagtacggggcaggacagccaggagcttt

SEQ ID NO: 352950 - DNA, 75 bp, Artificial Sequence
  Synthetic
cagtcccaaagttgcagttgaagcatgtaacgttgttctgaaggaaaattttccgacagtggcgtcgtactgcat

SEQ ID NO: 352951 - DNA, 75 bp, Artificial Sequence
  Synthetic
tggagacatacaatccagaacagtttcaagctcagatctgtacgccaacaccaacctagtgctgcagagacccaa

SEQ ID NO: 352952 - DNA, 75 bp, Artificial Sequence
  Synthetic
gacatggtggacggtgcatcatgttgcttggatacggcgagtttttgccctgccaagttgcgtagctttccgaag

SEQ ID NO: 352953 - DNA, 75 bp, Artificial Sequence
  Synthetic
gcagctgccacaaagagaaactgcaatgtgactcaaatgagggagctgcctgtattggattctgcggccttcaat

SEQ ID NO: 352954 - DNA, 75 bp, Artificial Sequence
  Synthetic
gtagagtgttttaaaaaatacgcatgtaataatgagtattgggagacctacaagaagaatccaatcagattgacc

SEQ ID NO: 352955 - DNA, 75 bp, Artificial Sequence
  Synthetic
gattggaatgccgcttttaaaatttttattttattttcttttcttttccgaatcggattttgtttttaatatttc

SEQ ID NO: 352956 - DNA, 75 bp, Artificial Sequence
  Synthetic
gggattcatagagaattggtgcgcagactgaacgcagttctgctgcccaacatacacacattatttgacatgtct

SEQ ID NO: 352957 - DNA, 75 bp, Artificial Sequence
  Synthetic
gcggcgcatgagagaagcccaaatcaataactacccaaaatggagaaagttcacgttgacatcgaggaagatagt

SEQ ID NO: 352958 - DNA, 75 bp, Artificial Sequence
  Synthetic
ggagccatgatgaaatcagggatgttcttgactctgtttgtcaatactgtgatcaatatggtcatagccagcaga

SEQ ID NO: 352959 - DNA, 75 bp, Artificial Sequence
  Synthetic
tcttgactctgtttgtcaatactgtgatcaatatggtcatagccagcagagttctgcgtgagagactgacaaact

SEQ ID NO: 352960 - DNA, 75 bp, Artificial Sequence
  Synthetic
cctttgaagagattattcaagcttggaaaaccactggctgtggatgatgaacatgatgatgacaggcgtcgagca

SEQ ID NO: 352961 - DNA, 75 bp, Artificial Sequence
  Synthetic
ctacaggaggaatctgcccggtggaaccgggtgggaattttttccgagttgtgcaaagccgtcgagtcgcgatat

SEQ ID NO: 352962 - DNA, 75 bp, Artificial Sequence
  Synthetic
tcatggccatgactacgctcgccagcagtgtcgagtcgttcagttgtctaagaggggcccctattgccctctacg

SEQ ID NO: 352963 - DNA, 75 bp, Artificial Sequence
  Synthetic
catgcccttccgcaacccttttgcgactcccagaagaccatggtttccaaggaccgacccctttttagcgatgca

SEQ ID NO: 352964 - DNA, 75 bp, Artificial Sequence
  Synthetic
ggcagcagacgatgaacatgatgatgacaggagaagggcactacatgaagagtcaacacgctggaaccgagtggg

SEQ ID NO: 352965 - DNA, 75 bp, Artificial Sequence
  Synthetic
gccaacttgacgttcaagcaacggcgagatgtgccgcccgagggtccaccggctaagaagaagaagaaggacaac

SEQ ID NO: 352966 - DNA, 75 bp, Artificial Sequence
  Synthetic
atggaaagaaaaagaacaagctagtaaagaaaaagaagaagacagggccaccacccccaaaacatactggtggca

SEQ ID NO: 352967 - DNA, 75 bp, Artificial Sequence
  Synthetic
aaaagaaagtcaataggaagccagggaagagacaacgaatggtcatgaagttggagtcagacaagacattcccta

SEQ ID NO: 352968 - DNA, 75 bp, Artificial Sequence
  Synthetic
ttgacaagaaacaatgtgtgaagaaagaactggtttcgggactaggtttgacaggagaacttgttgatccccctt

SEQ ID NO: 352969 - DNA, 75 bp, Artificial Sequence
  Synthetic
cgctattgtgcttggcggagtgaatgaaggctccagaacggcactgtctgtcgtgacgtggaacgaaaaaggggt

SEQ ID NO: 352970 - DNA, 75 bp, Artificial Sequence
  Synthetic
aattccattagcctttgacatccctgacgccttgtttaccagggtgtcagaaacaccgacactatcagcggccga

SEQ ID NO: 352971 - DNA, 75 bp, Artificial Sequence
  Synthetic
tacacccatgagaaaccccaaggctactacagctggcaccacggagcagtccaatatgaaaatgggcgtttcacg

SEQ ID NO: 352972 - DNA, 75 bp, Artificial Sequence
  Synthetic
ggcagaaccatgaggtatgatatgcatggaaccatagaagagataccgttgcatcaggtgtctgttcatacctca

SEQ ID NO: 352973 - DNA, 75 bp, Artificial Sequence
  Synthetic
tgtgctcaaccaccaatttgctacgacagaaaaccagcagagaccttggccatgctcagcgtcaacgtggacaac

SEQ ID NO: 352974 - DNA, 75 bp, Artificial Sequence
  Synthetic
ttcgtaaatgtaagaacacagtaccgctaccaccactaccagcagtgtgaggaccacgccattaagttgagcatg

SEQ ID NO: 352975 - DNA, 75 bp, Artificial Sequence
  Synthetic
tcgagatgcacctcccgggctctgaagtggacagcagtctggtctccctgagcggcagctcagtcaccgtgacac

SEQ ID NO: 352976 - DNA, 75 bp, Artificial Sequence
  Synthetic
agtggacagcagtctggtctccctgagcggcagctcagtcaccgtgacaccttctgccgggactagcgtcctggt

SEQ ID NO: 352977 - DNA, 75 bp, Artificial Sequence
  Synthetic
gtaatccacacggactaccacatgaggtgattacgcattattatcacaggtatcccatgtccaccatcctcggct

SEQ ID NO: 352978 - DNA, 75 bp, Artificial Sequence
  Synthetic
tatcaatctgtacggcgatagtgacgacatccatcgcagcatccgtgtggctgttttgcaaatcacggatttcgt

SEQ ID NO: 352979 - DNA, 75 bp, Artificial Sequence
  Synthetic
ctgttttgcaaatcacggatttcgtgcctgaccccttatcgcttgactccaaatgcccgcatgcctctgtgctta

SEQ ID NO: 352980 - DNA, 75 bp, Artificial Sequence
  Synthetic
gccattaaatgctgcggcactcaggagtgttctccaacttacaggccggacaaacaatgcaaagtcttctcggga

SEQ ID NO: 352981 - DNA, 75 bp, Artificial Sequence
  Synthetic
gacattgacaagaaacaatgtgtgaagaaagaactggtttcgggactaggtttgacgggagaacttgtagatccc

SEQ ID NO: 352982 - DNA, 75 bp, Artificial Sequence
  Synthetic
tcaagctgatacctacagtgaacttggagtacgtcacctgccactacaaaacaggaatggattcaccagccatta

SEQ ID NO: 352983 - DNA, 75 bp, Artificial Sequence
  Synthetic
aatttataactatgactttccggaatatggagccggccacgcaggagcgttcggtgacatccaggctaggacggt

SEQ ID NO: 352984 - DNA, 75 bp, Artificial Sequence
  Synthetic
caatggaagaaagataaaccaccatccctcaagttcacagccccgtttggttgtgaaatttacaccaaccctatc

SEQ ID NO: 352985 - DNA, 75 bp, Artificial Sequence
  Synthetic
agtgcagagcacatccacagacgtggatagtatttcagcactcgagtcttgtgacagcaccagcgatgcgcgtag

SEQ ID NO: 352986 - DNA, 75 bp, Artificial Sequence
  Synthetic
acagtcaaatactcggcgagcaagtcaggcaaatgtgcagttcatgtaccatcaggcacggctacattgaaagaa

SEQ ID NO: 352987 - DNA, 75 bp, Artificial Sequence
  Synthetic
tgccagcattcatccggagttcagactccagatatgcacgtcttacgttacgtgcaaaggggattgtcaccctcc

SEQ ID NO: 352988 - DNA, 75 bp, Artificial Sequence
  Synthetic
cttaatgagtgcgtgtattcatccgactttggcgggatcgccacggtcaagtattcggccagcaagtcaggcaaa

SEQ ID NO: 352989 - DNA, 75 bp, Artificial Sequence
  Synthetic
actttggcgggatcgccacggtcaagtattcggccagcaagtcaggcaaatgcgcagtccatgtgccatcaggga

SEQ ID NO: 352990 - DNA, 75 bp, Artificial Sequence
  Synthetic
tgcggcaattggcgagccgctttaattagaatttttattttcttttaccataatcggattttgtttttaatattt

SEQ ID NO: 352991 - DNA, 75 bp, Artificial Sequence
  Synthetic
ggaacaaccactgggacaattcaccgtcacccaatatgtatgggttgaaccaagaagtggtcaggcaactatccc

SEQ ID NO: 352992 - DNA, 75 bp, Artificial Sequence
  Synthetic
tacgtgctgaccaaccagaaacataattgaacatagcagcaattggcaagctgctcatatagaattcgcggcgat

SEQ ID NO: 352993 - DNA, 75 bp, Artificial Sequence
  Synthetic
accatgctaatgccagagcgttttcgcatctggcttcaaaactgatcgaaacggaggtggacccatccgacacga

SEQ ID NO: 352994 - DNA, 75 bp, Artificial Sequence
  Synthetic
aactgtaaggaaataactgataaggaattggacaagaaaatgaaggagctcgccgccgtcatgagcgaccctgac

SEQ ID NO: 352995 - DNA, 75 bp, Artificial Sequence
  Synthetic
cgccgccgtcatgagcgaccctgacctggaaactgagactatgtgcctccacgacgacgagtcgtgtcgctacga

SEQ ID NO: 352996 - DNA, 75 bp, Artificial Sequence
  Synthetic
gtatacgcggttgacggaccgacaagtctctatcaccaagccaataagggagttagagtcgcctactggataggc

SEQ ID NO: 352997 - DNA, 75 bp, Artificial Sequence
  Synthetic
ggcctaaggtccaagtaatccaggctgcagatccattggctacggcttacctatgtgggattcatagagaattgg

SEQ ID NO: 352998 - DNA, 75 bp, Artificial Sequence
  Synthetic
agaacttggctggagcatatccatcatactctaccaactgggccgacgaaaccgtgttaacggctcgtaacatag

SEQ ID NO: 352999 - DNA, 75 bp, Artificial Sequence
  Synthetic
gcctatgcagctctgacgttatggagcggtcacgtagagggatgtccattcttagaaagaagtatttgaaaccat

SEQ ID NO: 353000 - DNA, 75 bp, Artificial Sequence
  Synthetic
cacattgaacggggagagggtctcttttcccgtgtgcacgtatgtgccagctacattgtgtgaccaaatgactgg

SEQ ID NO: 353001 - DNA, 75 bp, Artificial Sequence
  Synthetic
catactggcaacagatgtcagtgcggacgacgcgcaaaaactgctggttgggctcaaccagcgtatagtcgtcaa

SEQ ID NO: 353002 - DNA, 75 bp, Artificial Sequence
  Synthetic
ataacatctatttataagcgcccggatacccaaaccatcatcaaagtgaacagcgatttccactcattcgtgctg

SEQ ID NO: 353003 - DNA, 75 bp, Artificial Sequence
  Synthetic
agatcgggctgagaacaagaatcaggaaaatgttagaggagcacaaggagccgtcacctctcattaccgccgagg

SEQ ID NO: 353004 - DNA, 75 bp, Artificial Sequence
  Synthetic
ttgatgttacaagaggctggggccggctcagtggagacacctcgtggcttgataaaggttaccagctacgatggc

SEQ ID NO: 353005 - DNA, 75 bp, Artificial Sequence
  Synthetic
ggtccattccacgtgcatccgactttgatgtcgagagtctttccgtgctcgaatccctgggtgctaatgacacaa

SEQ ID NO: 353006 - DNA, 75 bp, Artificial Sequence
  Synthetic
tgatgtcgagagtctttccgtgctcgaatccctgggtgctaatgacacaatcagcatggagtcgtcctcaaacga

SEQ ID NO: 353007 - DNA, 75 bp, Artificial Sequence
  Synthetic
tctggcatcattaaaagcgcagtcaccaaaaaagatctagtggtgagcgccaagaaagaaaactgtgcagaaatt

SEQ ID NO: 353008 - DNA, 75 bp, Artificial Sequence
  Synthetic
ggactcagtgctcttgaatggatgcaaacaccccgtagagaccctgtatattgacgaagcttttgcttgtcatgc

SEQ ID NO: 353009 - DNA, 75 bp, Artificial Sequence
  Synthetic
aggggttacagtcaaatacacccccgagaatagcgagcagtggtccctggtgaccactatgtgcctgctagccaa

SEQ ID NO: 353010 - DNA, 75 bp, Artificial Sequence
  Synthetic
aggccattccatcctttgtctagtagatcaagctcgcgctctagtctggcgtctaatccaccaggtgttaaccga

SEQ ID NO: 353011 - DNA, 75 bp, Artificial Sequence
  Synthetic
tcggtcgtctcaaccttgttttacgacaaaaaaatgagaacgacgaatccgaaagagactaagattgtgattgac

SEQ ID NO: 353012 - DNA, 75 bp, Artificial Sequence
  Synthetic
aggacgatctcattctcacttgtttcagagggtgggtgaagcagttgcaaatagattacaaaggcaacgaaataa

SEQ ID NO: 353013 - DNA, 75 bp, Artificial Sequence
  Synthetic
cggtacaaggtgaatgaaaatcctctgtacgcacccacctcagaacatgtgaacgtcctactgacccgcacggag

SEQ ID NO: 353014 - DNA, 75 bp, Artificial Sequence
  Synthetic
gaccgcatcgtgtggaaaacactagccggcgacccatggataaaaacactgactgccaagtaccctgggaatttc

SEQ ID NO: 353015 - DNA, 75 bp, Artificial Sequence
  Synthetic
gacgtcttccagaataaggcaaacgtgtgttgggccaaggctttagtgccggtgctgaagaccgctggcatagac

SEQ ID NO: 353016 - DNA, 75 bp, Artificial Sequence
  Synthetic
atgaccactgaacaatggaacactgtggattattttgaaacggacaaagctcactcagcagagatagtattgaac

SEQ ID NO: 353017 - DNA, 75 bp, Artificial Sequence
  Synthetic
aactccaggaaccaagcataccgaagaaaggcctaaggtccaagtaatccaggctgcagatccattggctacggc

SEQ ID NO: 353018 - DNA, 75 bp, Artificial Sequence
  Synthetic
ccaggtgatgtgcccaaatatgacataatatttgttaatgtgaggaccccatataaataccatcactatcagcag

SEQ ID NO: 353019 - DNA, 75 bp, Artificial Sequence
  Synthetic
acagggccagcgaaagcatcattggtgctatagcgcggcagttcaagttttcccgggtatgcaaaccgaaatcct

SEQ ID NO: 353020 - DNA, 75 bp, Artificial Sequence
  Synthetic
tgtattcattgggtacgatcgcaaggcccgtacgcacaatccttacaagctttcatcaaccttgaccaacattta

SEQ ID NO: 353021 - DNA, 75 bp, Artificial Sequence
  Synthetic
cgaaggagtgattataaatgctgctaacagcaaaggacaacctggcggaggggtgtgcggagcgctgtataagaa

SEQ ID NO: 353022 - DNA, 75 bp, Artificial Sequence
  Synthetic
aacaattacaagtcagtagcgattccactgttgtccaccggcatcttttccgggaacaaagatcgactaacccaa

SEQ ID NO: 353023 - DNA, 75 bp, Artificial Sequence
  Synthetic
cgggaacaaagatcgactaacccaatcattgaaccatttgctgacagctttagacaccactgatgcagatgtagc

SEQ ID NO: 353024 - DNA, 75 bp, Artificial Sequence
  Synthetic
tcattgaaccatttgctgacagctttagacaccactgatgcagatgtagccatatactgcagggacaagaaatgg

SEQ ID NO: 353025 - DNA, 75 bp, Artificial Sequence
  Synthetic
aaggtccatggccaacttgacgttcaagcaacggcgagatgtgccgcccgagggtccaccggctaagaagaagaa

SEQ ID NO: 353026 - DNA, 75 bp, Artificial Sequence
  Synthetic
gaaatgactctcaaggaagcagtggctaggagagaagcagtggaggagatatgcatatccgacgactcttcagtg

SEQ ID NO: 353027 - DNA, 75 bp, Artificial Sequence
  Synthetic
ctaggagagaagcagtggaggagatatgcatatccgacgactcttcagtgacagaacctgatgcagagctggtga

SEQ ID NO: 353028 - DNA, 75 bp, Artificial Sequence
  Synthetic
ctatccgtgctgaaaactgcgctgtgggatcaattccactagcttttgacattcccgacgctctgtttaccaggg

SEQ ID NO: 353029 - DNA, 75 bp, Artificial Sequence
  Synthetic
tggaaggaagggctacagcacaagcgatggcaaaactttctcatatttggaagggaccaagtttcaccaggcggc

SEQ ID NO: 353030 - DNA, 75 bp, Artificial Sequence
  Synthetic
atgagcaggtatgcatgtatatcctcggagaaagcatgagcagtattaggtcgaaatgccccgtcgaagagtcgg

SEQ ID NO: 353031 - DNA, 75 bp, Artificial Sequence
  Synthetic
gctatgtatgtgctgaccaaccagaaacataattagaattagcagcgattggcatgctgcttgtaaagttttatt

SEQ ID NO: 353032 - DNA, 75 bp, Artificial Sequence
  Synthetic
actccagaaagagtacagcgcctaaaagcctcacgtccagaacaaattactgtgtgctcatcctttccattgccg

SEQ ID NO: 353033 - DNA, 75 bp, Artificial Sequence
  Synthetic
tgtgtgctcatcctttccattgccgaagtatagaatcactggtgtgcagaagatccaatgctcccagcctatatt

SEQ ID NO: 353034 - DNA, 75 bp, Artificial Sequence
  Synthetic
gcgcatgagagaagcccaaaccatttacctacccaaaatggagaaagttcacgttgacatcgaggaagacagccc

SEQ ID NO: 353035 - DNA, 75 bp, Artificial Sequence
  Synthetic
gttctcaccgaaagtgcctgcgtatattcatccaaggaagtatctcgtggaaacaccaccggtagacgagactcc

SEQ ID NO: 353036 - DNA, 75 bp, Artificial Sequence
  Synthetic
catcctttccattgccgaagtatagaatcactggtgtgcagaagatccagtgctcccagcctatactgttctcac

SEQ ID NO: 353037 - DNA, 75 bp, Artificial Sequence
  Synthetic
ggagccatcggcagagaaccaatccacagaggggacacctgaacaaccaccacttataaccgaggatgagaccag

SEQ ID NO: 353038 - DNA, 75 bp, Artificial Sequence
  Synthetic
tgctcccagcctatactgttctcaccgaaggtgcctgcgtacattcatccacggaagtacctcgtggaaacacca

SEQ ID NO: 353039 - DNA, 75 bp, Artificial Sequence
  Synthetic
cacttataaccgaggatgagaccaggactagaacgcctgagccgatcatcatcgaagaggaagaagaggatagca

SEQ ID NO: 353040 - DNA, 75 bp, Artificial Sequence
  Synthetic
cgaaggtgcctgcgtacattcatccacggaagtacctcgtggaaacaccaccggtagaagagactccggagtcgc

SEQ ID NO: 353041 - DNA, 75 bp, Artificial Sequence
  Synthetic
cggcagagaaccaatccacagaggggacacctgaacaaccagcacttgtaaacgtggatgcaaccaggactagaa

SEQ ID NO: 353042 - DNA, 75 bp, Artificial Sequence
  Synthetic
ccaccaggtgctgcaagtcgaggcagacattcacgggccgccctctgtatctagctcatcctggtccattcctca

SEQ ID NO: 353043 - DNA, 75 bp, Artificial Sequence
  Synthetic
ctgaaaccatgtgcctccacgacgacgagtcgtgtcgctacgaagggcaagtcgctgtttaccaggatgtatacg

SEQ ID NO: 353044 - DNA, 75 bp, Artificial Sequence
  Synthetic
cgagtcgtgtcgctacgaagggcaagtcgctgtttaccaggatgtatacgcggttgacggaccgacaagtctcta

SEQ ID NO: 353045 - DNA, 75 bp, Artificial Sequence
  Synthetic
gaccggtgcctgcgcctcgaacagtattcaggaaccctccacatcccgctccgcgcacaagaacaccgtcacttg

SEQ ID NO: 353046 - DNA, 75 bp, Artificial Sequence
  Synthetic
cacccagcagggcctgctcgagaaccagcctagtttccaccccgccaggcgtgaatagggtgatcactagagagg

SEQ ID NO: 353047 - DNA, 75 bp, Artificial Sequence
  Synthetic
agctcgaggcgcttaccccgtcacgcactcctagcaggtcggtctcgagaaccagcctggtctccaacccgccag

SEQ ID NO: 353048 - DNA, 75 bp, Artificial Sequence
  Synthetic
gcgtaaatagggtgattacaagagaggagtttgaggcgttcgtagcacaacaacaatgacggtttgatgcgggtg

SEQ ID NO: 353049 - DNA, 75 bp, Artificial Sequence
  Synthetic
tacacatgtcggtgtgagactatagttagttgcgacgggtacgtcgttaaaagaatagctattagtccaggcctg

SEQ ID NO: 353050 - DNA, 75 bp, Artificial Sequence
  Synthetic
cctagggcattatttgaaggcagaaggaaaagtggagtgctaccgaaccctgcatcctgttcctttgtattcatc

SEQ ID NO: 353051 - DNA, 75 bp, Artificial Sequence
  Synthetic
tgcatcctgttcctttgtattcatctagtgtgaaccgtgccttttcaagccccaaggtcgcagtggaagcctgta

SEQ ID NO: 353052 - DNA, 75 bp, Artificial Sequence
  Synthetic
acgccatgttgaaagagaactttccgactgtggcttcttactgtattattccagagtacgatgcctatttggaca

SEQ ID NO: 353053 - DNA, 75 bp, Artificial Sequence
  Synthetic
gactgtggcttcttactgtattattccagagtacgatgcctatttggacatggttgacggagcttcatgctgctt

SEQ ID NO: 353054 - DNA, 75 bp, Artificial Sequence
  Synthetic
cactgatagttgctacccgcttgctgaaatgtgtgtgttgcgtcgtgccttttttagtcgtggccggcgccgtag

SEQ ID NO: 353055 - DNA, 75 bp, Artificial Sequence
  Synthetic
acaggtgatccaggctgccgatccgctagcaacagcgtatctgtgcggaatccaccgagagctggttaggagatt

SEQ ID NO: 353056 - DNA, 75 bp, Artificial Sequence
  Synthetic
caggacataccaatggacaggtttgtaatggacttaaagagggacgtgaaagtgactccaggaacaaaacatact

SEQ ID NO: 353057 - DNA, 75 bp, Artificial Sequence
  Synthetic
aaatgcggtcctgcttccgaacattcatacactgtttgatatgtcggctgaagactttgacgctattatagccga

SEQ ID NO: 353058 - DNA, 75 bp, Artificial Sequence
  Synthetic
catacactgtttgatatgtcggctgaagactttgacgctattatagccgagcacttccagcctggggattgtgtt

SEQ ID NO: 353059 - DNA, 75 bp, Artificial Sequence
  Synthetic
gcaccatattgccacacacggaggagcgctgaacacagatgaagaatactataaaactgtcaagcccagcgagca

SEQ ID NO: 353060 - DNA, 75 bp, Artificial Sequence
  Synthetic
agtaccaaccataggggtgtatggcgtgccaggatcaggcaagtctggcatcattaaaagcgcggtcaccaaaaa

SEQ ID NO: 353061 - DNA, 75 bp, Artificial Sequence
  Synthetic
ggacctggtggtgagcgccaagaaagaaaactgtgcagaaataataagggacgtcaagaaaataaaagggctgga

SEQ ID NO: 353062 - DNA, 75 bp, Artificial Sequence
  Synthetic
agtgggtattctttcagagctgtgcaaggcagtagaatcaaggtatgaaaccgtaggaacttccatcatagttat

SEQ ID NO: 353063 - DNA, 75 bp, Artificial Sequence
  Synthetic
ttcttccagagctgtgtaaggcagtagaatcaaggtatgaaaccgtaggaacttccatcatagttatggccatga

SEQ ID NO: 353064 - DNA, 75 bp, Artificial Sequence
  Synthetic
ggactacgacatagtctagtccgccaagatgttcccgttccaaccaatgtatccgatgcagccaatgccctatcg

SEQ ID NO: 353065 - DNA, 75 bp, Artificial Sequence
  Synthetic
gaagaagaagaagaaccaagggaagaagaaggctaagacagggccgcctaatccgaaggcacagaatggaaacaa

SEQ ID NO: 353066 - DNA, 75 bp, Artificial Sequence
  Synthetic
aagagacagcgcatggtcatgaaattggaatctgacaagacgttcccaatcatgttggaagggaagataaacggc

SEQ ID NO: 353067 - DNA, 75 bp, Artificial Sequence
  Synthetic
tacgcttgtgtggtcggagggaagttattcaggccgatgcatgtggaaggcaagatcgacaacgacgttctggcc

SEQ ID NO: 353068 - DNA, 75 bp, Artificial Sequence
  Synthetic
gccacagaacatgcgggccgatacattcaaatacacccatgagaaaccccaaggctattacagctggcatcatgg

SEQ ID NO: 353069 - DNA, 75 bp, Artificial Sequence
  Synthetic
ttcccatgtgctcaaccaccaatttgctacgacagaaaaccagcagagactttggccatgctcagcgttaacgtt

SEQ ID NO: 353070 - DNA, 75 bp, Artificial Sequence
  Synthetic
cagaagactgcctcacgctttagtcctccaccataatgaacacccacagagtgacttttcttcattcgtcagcaa

SEQ ID NO: 353071 - DNA, 75 bp, Artificial Sequence
  Synthetic
gtgacttttcttcattcgtcagcaaattgaagggcagaactgtcctggtggtcggggagaagctgtccgtcccag

SEQ ID NO: 353072 - DNA, 75 bp, Artificial Sequence
  Synthetic
taactacccaaaatggagaaagttcacgttgatatcgaggaagacagccccttcctcagagcattacaacggagc

SEQ ID NO: 353073 - DNA, 75 bp, Artificial Sequence
  Synthetic
ccaatagcaatcgaggcagtaaagagcgacgggcacgacggttatgttagacttcagacttcctcgcagtatggc

SEQ ID NO: 353074 - DNA, 75 bp, Artificial Sequence
  Synthetic
aatcccggcggaacctgtgtcagcataggttatggttacgccgacagggccagcgaaagcatcatcggcgctata

SEQ ID NO: 353075 - DNA, 75 bp, Artificial Sequence
  Synthetic
cggttatttcctgcttgccaggtgcccggcaggggactccatcaccatggaatttaagaaagattccgtcagaca

SEQ ID NO: 353076 - DNA, 75 bp, Artificial Sequence
  Synthetic
cacattgtggatgggcatggttattttctgcttgctaggtgcccggcaggggactccatcaccatggaatttaag

SEQ ID NO: 353077 - DNA, 75 bp, Artificial Sequence
  Synthetic
tccagactccacgaagccggatgcgcaccctcatatcatgtggtgcgaggggacattgccacggccaccgaagga

SEQ ID NO: 353078 - DNA, 75 bp, Artificial Sequence
  Synthetic
gcacatgatgcacagaacagaggagcttatgtcgagatgcacctcccgggctcagaagtggacagcagtttggtt

SEQ ID NO: 353079 - DNA, 75 bp, Artificial Sequence
  Synthetic
acaaagatctccgagaccatcaacaagacaaaacagttcagccagtgcacaaagaaggagcagtgcagagcatat

SEQ ID NO: 353080 - DNA, 75 bp, Artificial Sequence
  Synthetic
cggctgcagaacgataagtgggtgtataattctgacaaactgcccaaagcagcgggagccaccttaaaaggaaaa

SEQ ID NO: 353081 - DNA, 75 bp, Artificial Sequence
  Synthetic
ctgcatgtcccattcttgctggcagacggcaaatgcaccgtgcctctagcaccagaacctatgataaccttcggt

SEQ ID NO: 353082 - DNA, 75 bp, Artificial Sequence
  Synthetic
accagaacctatgataaccttcggtttcagatcagtgtcactgaaactgcaccctaagaatcccacatatctaat

SEQ ID NO: 353083 - DNA, 75 bp, Artificial Sequence
  Synthetic
aaccagctgttaggaattttaccgtcaccgaaaaagggtgggagtttgtatggggaaaccacccgccgaaaaggt

SEQ ID NO: 353084 - DNA, 75 bp, Artificial Sequence
  Synthetic
cctaactccttaccggctaacacctaacgctaggataccattttgtctggctgtgctttgctgcgcccgcactgc

SEQ ID NO: 353085 - DNA, 75 bp, Artificial Sequence
  Synthetic
gtgctcccagcctatactgttctcaccgaaagtgcctgcatacatccatccacggaagtacctcgtggaaacacc

SEQ ID NO: 353086 - DNA, 75 bp, Artificial Sequence
  Synthetic
ggacacctgaacaaccgacacttataaccgtggatgaaaccagaactagaacgcccgaaccgattattattgaag

SEQ ID NO: 353087 - DNA, 75 bp, Artificial Sequence
  Synthetic
gactttgatgtggatagtctgtccatccttgacaccctggagggagctagcgtgaccagcgaagaggcgtcagta

SEQ ID NO: 353088 - DNA, 75 bp, Artificial Sequence
  Synthetic
ggcgctcaccccgtcacgcgctcccagcaggtcggtctcaagaaccagcctggtatccaatcctccaggcgtaaa

SEQ ID NO: 353089 - DNA, 75 bp, Artificial Sequence
  Synthetic
caacctagtgctgcagagacccaaagcaggagcgatccacgtgccatacactcaggcaccttcgggttttgagca

SEQ ID NO: 353090 - DNA, 75 bp, Artificial Sequence
  Synthetic
atggaagaaagataaagctccatcattgaaatttaccgcccctttcggatgcgaaatatatacaaaccccattcg

SEQ ID NO: 353091 - DNA, 75 bp, Artificial Sequence
  Synthetic
tgctgcagagacccaaagcaggagcgatccatgtgccatacactcaggcaccatcgggttttgagcaatggaaga

SEQ ID NO: 353092 - DNA, 75 bp, Artificial Sequence
  Synthetic
ttgaaatttaccgcccctttcggatgcgaaatatatacaaaccccattcgcgccgaaaactgtgctgtagggtca

SEQ ID NO: 353093 - DNA, 75 bp, Artificial Sequence
  Synthetic
cttccgactttggtgggatcgccacggtcaagtactcggccagcaagtcaggcaagtgcgcagtccatgtgccat

SEQ ID NO: 353094 - DNA, 75 bp, Artificial Sequence
  Synthetic
ggtcaagtactcggccagcaagtcaggcaagtgcgcagtccatgtgccatcagggactgctaccctaaaagaagc

SEQ ID NO: 353095 - DNA, 75 bp, Artificial Sequence
  Synthetic
tgcaaaggtgattgtcaccccccgaaagaccatattgtgacacaccctcagtatcacgcccaaacatttacagcc

SEQ ID NO: 353096 - DNA, 75 bp, Artificial Sequence
  Synthetic
cacccggagttcaggctccaaatatgcacatcatatgtcacgtgcaaaggtgattgtcaccccccgaaagaccac

SEQ ID NO: 353097 - DNA, 75 bp, Artificial Sequence
  Synthetic
attgtgacacacccccagtatcacgcccaaacatttacagccgcggtgtcaaaaaccgcgtggacgtggttaaca

SEQ ID NO: 353098 - DNA, 75 bp, Artificial Sequence
  Synthetic
tttggaacccacaatacgatcggcagtgccatcagcgattcagaacacgctccagaacgtcctggcagctgccac

SEQ ID NO: 353099 - DNA, 75 bp, Artificial Sequence
  Synthetic
gattggcatgccgccttaaaatttttattttatttttcttttcttttccgaatcggattttgtttttaatatttc

SEQ ID NO: 353100 - DNA, 75 bp, Artificial Sequence
  Synthetic
tacccaaaatggagaaagttcacgttgacatcgaggaagatagccccttcctcagagcattacaacggagcttcc

SEQ ID NO: 353101 - DNA, 75 bp, Artificial Sequence
  Synthetic
ggcatgccgctttaaaattttattttattttcttttcttttccgaatcggattttgtttttaatatttcaaaaaa

SEQ ID NO: 353102 - DNA, 75 bp, Artificial Sequence
  Synthetic
ccatcaggcttactgaagaaaatgtggtaaattacattactaaattaaaaggaccaaaagctgcagctctttttg

SEQ ID NO: 353103 - DNA, 75 bp, Artificial Sequence
  Synthetic
agagaagcccaaaccaattacctacccaaaatggagaaagttcacgttgacatcgaggaagacagcccattcctc

SEQ ID NO: 353104 - DNA, 75 bp, Artificial Sequence
  Synthetic
ttgcgacgggtacgtcgtcaaaaggatagctattagtccaggtctgtacgggaaaccgtcgggctacgctgccac

SEQ ID NO: 353105 - DNA, 75 bp, Artificial Sequence
  Synthetic
tgatcgcaagcagagtgttaagagaacggctaaccggatcaccgtgtgcagcattcattggagatgacaatatcg

SEQ ID NO: 353106 - DNA, 75 bp, Artificial Sequence
  Synthetic
caccttgactaatatctacaccggctcgaggctccatgaagctggctgcgcgccttcgtatcatgtagtgcgcgg

SEQ ID NO: 353107 - DNA, 75 bp, Artificial Sequence
  Synthetic
attcttccagagctgtgtaaggctgtagaatcaaggtatgaaaccgtaggaacttccatcatagttatggccatg

SEQ ID NO: 353108 - DNA, 75 bp, Artificial Sequence
  Synthetic
ccagctatgcaggagaagacaaaatcggctcctacgcggtgctctccccacaggcagtactgcgaagtgaaaaac

SEQ ID NO: 353109 - DNA, 75 bp, Artificial Sequence
  Synthetic
tgacgtgtattcacccgcttgcagagcaagtaatcgtaattacacactctgggaggaaaggtagatacgcagttg

SEQ ID NO: 353110 - DNA, 75 bp, Artificial Sequence
  Synthetic
caagacttccaagcactcagtgagagcgccacaattgtgtataacgaacgtgagttcgtgaataggtatttacac

SEQ ID NO: 353111 - DNA, 75 bp, Artificial Sequence
  Synthetic
actgctggttgggctcaaccagcgtatagtcgtcaacggtcgcacccaaagaaacaccaataccatgaagaatta

SEQ ID NO: 353112 - DNA, 75 bp, Artificial Sequence
  Synthetic
tcttgagtatgcagatgtgccacagaacatgcgggccgatacattcaagtacacccatgagaaaccccaaggcta

SEQ ID NO: 353113 - DNA, 75 bp, Artificial Sequence
  Synthetic
ccaaagcaatgtggcttctttaatatgatgtgcttgaaagtgcacttcaaccatgaaatatgcactcaagtcttc

SEQ ID NO: 353114 - DNA, 75 bp, Artificial Sequence
  Synthetic
tgatgtgcttgaaagtgcacttcaaccatgaaatatgcactcaagtcttccacaaaagcatatctcgtaggtgta

SEQ ID NO: 353115 - DNA, 75 bp, Artificial Sequence
  Synthetic
cacaaaagcatatctcgtaggtgtaccaagtcagtgacgtcggtagtgtccacactgttttatgacaaaagaatg

SEQ ID NO: 353116 - DNA, 75 bp, Artificial Sequence
  Synthetic
agaactactaacccaagggattctaaaatcgaaattgacacaacaggaagtactaaaccaaaaaaggatgacttg

SEQ ID NO: 353117 - DNA, 75 bp, Artificial Sequence
  Synthetic
gaaagattcagtcacacactcctgctcagtgccgtatgaagtgaaatttaatcctgtaggcagagaactctacac

SEQ ID NO: 353118 - DNA, 75 bp, Artificial Sequence
  Synthetic
tcaggcaactatcccgcaggtaccctcaactaccgcgtgcggtgactactgggagagtatacgacatgaacaccg

SEQ ID NO: 353119 - DNA, 75 bp, Artificial Sequence
  Synthetic
cgagatgcacctcccgggctctgaagtggacagcagtctggtctctttgagcggcagttcagtcaccgtgacacc

SEQ ID NO: 353120 - DNA, 75 bp, Artificial Sequence
  Synthetic
aaaggcagtgctctgcggggatccaaaacagtgcggctttttcaacatgatgtgcctgaaagtgcattttaacca

SEQ ID NO: 353121 - DNA, 75 bp, Artificial Sequence
  Synthetic
tttttccgcctttgtcagtaagcttaaaggcagaacggtcctagtagttggtgagaagatgagtatttcaggtaa

SEQ ID NO: 353122 - DNA, 75 bp, Artificial Sequence
  Synthetic
gagcagtgcagagcatatcgactgcagaatgacaagtgggtgtataattctgacaaactgcccaaagcagcggga

SEQ ID NO: 353123 - DNA, 75 bp, Artificial Sequence
  Synthetic
actgaagtgctatttgtcttcatcgggttcgatcgtaaaacgcgaacccataacccatacaaactttcctccacc

SEQ ID NO: 353124 - DNA, 75 bp, Artificial Sequence
  Synthetic
tcgcagcgtccacctggctgttatgcaaatccagagtctcgtgcctaactccttaccggctaacacctaacgcca

SEQ ID NO: 353125 - DNA, 75 bp, Artificial Sequence
  Synthetic
gcagaggcgtatgaatctatagccaagattattaatgataacaattacagatctgtggctatcccgcttctgtcc

SEQ ID NO: 353126 - DNA, 75 bp, Artificial Sequence
  Synthetic
gtcagctctcccgcaggtacccacaactgcctcgtgcagttaccactggaagagtttatgacatgaatactggca

SEQ ID NO: 353127 - DNA, 75 bp, Artificial Sequence
  Synthetic
gcggtagaggagatatgtatctccgaagattcctccgtagcagagccggatgcagagctggttagagttcaccca

SEQ ID NO: 353128 - DNA, 75 bp, Artificial Sequence
  Synthetic
cccgaacaaattacagtttgctcttccttcccattgccgaagtacagaataacaggagtgcagaagatccaatgt

SEQ ID NO: 353129 - DNA, 75 bp, Artificial Sequence
  Synthetic
aagtacctgagtatatacaccctagaaagtatcttgcagacgcagcttctgcgagcaatgtgcaaccacaggtgg

SEQ ID NO: 353130 - DNA, 75 bp, Artificial Sequence
  Synthetic
gtacatccacagacgtggacagtatttcagcactcgagtcttgtgacagcaccagcgatgcgcgtagcataggat

SEQ ID NO: 353131 - DNA, 75 bp, Artificial Sequence
  Synthetic
ccacccggagttcaggctccaaatatgcacatcatatgttacgtgcaaaggtgattgtcaccccccgaaagacca

SEQ ID NO: 353132 - DNA, 75 bp, Artificial Sequence
  Synthetic
accagcgatgcgcgtagcataggatcgtcctctgaaaccgatgtatcaatttttgacaaggggttggagttcctg

SEQ ID NO: 353133 - DNA, 75 bp, Artificial Sequence
  Synthetic
gctagacctgttcccgcaccgcgaaccatttttaggactccacctgtcccgaaaccgcgtgtgcggaggccattg

SEQ ID NO: 353134 - DNA, 75 bp, Artificial Sequence
  Synthetic
gcccaaaccattaactacccaaaatggagaaagttcacgttgatatcgaggaagacagccccttcctcagagcat

SEQ ID NO: 353135 - DNA, 75 bp, Artificial Sequence
  Synthetic
cgagaccgtgctaacggctcgtaacataggcttgtgcagctccgatgtgatggagcggtcacgtagagggatgtc

SEQ ID NO: 353136 - DNA, 75 bp, Artificial Sequence
  Synthetic
tgtagagtgttttaaaaaatacgcttgcaataatgagtactgggagacctataagaagaaccctattagattgac

SEQ ID NO: 353137 - DNA, 75 bp, Artificial Sequence
  Synthetic
tttagacatgctgcaagacatacccatggacaggtttattatggatttaaaaagagatgtcaaggtaactccagg

SEQ ID NO: 353138 - DNA, 75 bp, Artificial Sequence
  Synthetic
tgctgaggatttcgacgccataattgccgagcacttccaaccaggcgattgggtgttagagacagacatagcgtc

SEQ ID NO: 353139 - DNA, 75 bp, Artificial Sequence
  Synthetic
ttggagattgggctgaggaccaggatcagaaaactactggaggaacctgtggacagaccaccattgattaccgcc

SEQ ID NO: 353140 - DNA, 75 bp, Artificial Sequence
  Synthetic
tgcgctacatggctgaacatggaagtcaagatcatcgacgcagtggtcggcgagaaagctccctatttttgtggt

SEQ ID NO: 353141 - DNA, 75 bp, Artificial Sequence
  Synthetic
actacaggaggaatctgcccggtggaatcgggtgggaattttttccgagttgtgcaaagccgtcgagtcgcgata

SEQ ID NO: 353142 - DNA, 75 bp, Artificial Sequence
  Synthetic
tgaaacagtgggcacggccgtcattatcatggccatgactacgctcgccagcagtgtcgagtcgttcagttgtct

SEQ ID NO: 353143 - DNA, 75 bp, Artificial Sequence
  Synthetic
ggctaacctgaatggactgcgacgtagtcaagtccgccaaaatgtttccttatcaaccaatgtacccaatgcagc

SEQ ID NO: 353144 - DNA, 75 bp, Artificial Sequence
  Synthetic
ctcgcaacaaggtggtcggaatcagaatggaaagaaaaagaacaagctagtaaagaaaaagaagaagacagggcc

SEQ ID NO: 353145 - DNA, 75 bp, Artificial Sequence
  Synthetic
gccaccccccaaaaataatggcggcaaaaagaaagtcaataggaagccagggaagagacaacgaatggtcatgaa

SEQ ID NO: 353146 - DNA, 75 bp, Artificial Sequence
  Synthetic
atcatgcttgatggaaaagttaatgggtatgcatgcgtggtcggtggcaagctgtttagaccactgcatgtggag

SEQ ID NO: 353147 - DNA, 75 bp, Artificial Sequence
  Synthetic
ccgtgaccggcacagcgtgccgtgtggcagaccccctaaaaaggctgtttaagcttggcaaaccactggcagcag

SEQ ID NO: 353148 - DNA, 75 bp, Artificial Sequence
  Synthetic
ggcagaccccctaaaaaggctgtttaagcttggcaaaccactggcagcagacgatgaacatgatgatgacaggag

SEQ ID NO: 353149 - DNA, 75 bp, Artificial Sequence
  Synthetic
acgtccttgccacataatagatgggcatggatactttctgcttgccaggtgccctgcaggagactccataactat

SEQ ID NO: 353150 - DNA, 75 bp, Artificial Sequence
  Synthetic
cggtcgcacccaaagaaacaccaataccatgaagaattaccttttgcccgtagtggcccaggcatttgctaggtg

SEQ ID NO: 353151 - DNA, 75 bp, Artificial Sequence
  Synthetic
accatgaagaattaccttttgcccgtagtggcccaggcatttgctaggtgggcaaaggaatataaggaagatcaa

SEQ ID NO: 353152 - DNA, 75 bp, Artificial Sequence
  Synthetic
aactgcatgtgcccttcgtactgaccgaagcaaaatgcacagtaccattggccccggaacccattatcacctttg

SEQ ID NO: 353153 - DNA, 75 bp, Artificial Sequence
  Synthetic
gtatcccatgtccaccattctaggcttatcaatttgtgcggcgatagtgacgacatccattgcagcatccgtatg

SEQ ID NO: 353154 - DNA, 75 bp, Artificial Sequence
  Synthetic
ggaagtaccccgaaagcttcgacttacaaccaatagaagtggggaaagctagattagtcaaaggtaactcaaaac

SEQ ID NO: 353155 - DNA, 75 bp, Artificial Sequence
  Synthetic
gggactagcgccctggtggaatgcgagtgcggtggcacaaagatctccgagaccatcaacacggcaaaacagttc

SEQ ID NO: 353156 - DNA, 75 bp, Artificial Sequence
  Synthetic
atacagcctcagtccaagccttcttaaatatcacagttggaggacactcaacgacagcagtggtgtatgtgaatg

SEQ ID NO: 353157 - DNA, 75 bp, Artificial Sequence
  Synthetic
aaacaccaccggtggaagagattccggagctgccggcagagaaccaatccacagaggggacacctgaacaaccag

SEQ ID NO: 353158 - DNA, 75 bp, Artificial Sequence
  Synthetic
ttaccacagataccccatgtccactatcctgggtttgtcaatttgcgctgccatcgtgaccgtttccatcgcagc

SEQ ID NO: 353159 - DNA, 75 bp, Artificial Sequence
  Synthetic
gtcctggtccattccatgtgcatccgactttgatgtcgagagtctttccgtgctcgaatccctgggtgctagtga

SEQ ID NO: 353160 - DNA, 75 bp, Artificial Sequence
  Synthetic
gaaacaccgacattatctgctgccgaatgcactctgaatgagtgtgtatattcatccgactttggcgggatcgct

SEQ ID NO: 353161 - DNA, 75 bp, Artificial Sequence
  Synthetic
acagacgtggacagtatttcagcactcgagtcttgcgacagcaccagcgatgcgcgtagcataggatcgtcctct

SEQ ID NO: 353162 - DNA, 75 bp, Artificial Sequence
  Synthetic
tgcggcaattggcgagccgctttaattagaattttattttcttttaccataatcggattttgtttttaatatttc

SEQ ID NO: 353163 - DNA, 75 bp, Artificial Sequence
  Synthetic
gagagaagcccacaccaattacctacccaaaatggagaaagttcacgttgatatcgaggaagacagcccattcct

SEQ ID NO: 353164 - DNA, 75 bp, Artificial Sequence
  Synthetic
cccaaaatggagaaagttcacgttgatatcgaggaagacagcccattcctcagagctttgcaacggagcttcccg

SEQ ID NO: 353165 - DNA, 75 bp, Artificial Sequence
  Synthetic
agccaacaagggagttagagtcgcctactggataggctttgacaccaccccttttatgtttaagaacttggctgg

SEQ ID NO: 353166 - DNA, 75 bp, Artificial Sequence
  Synthetic
tcaaatgagggaactgcctgtattggattctgcggccttcaatgtagagtgttttaaaaaatacgcttgcaataa

SEQ ID NO: 353167 - DNA, 75 bp, Artificial Sequence
  Synthetic
ccatgtgccatcagggacagccaccctaaaagaagcagcagtcgagttaaccgagcaagggtcggcgactattca

SEQ ID NO: 353168 - DNA, 75 bp, Artificial Sequence
  Synthetic
ggaatgtccattcttagaaagaagtatttgaaaccatccaacaacgtcctattctccgtgggctcgaccatctat

SEQ ID NO: 353169 - DNA, 75 bp, Artificial Sequence
  Synthetic
ccgagcaagggtcggcgactattcatttctcgactgcaaacatccacccggagttcaggctccaaatatgcacat

SEQ ID NO: 353170 - DNA, 75 bp, Artificial Sequence
  Synthetic
tgtcggtgtgagactatagttagttgcgacgggtacgtcgttaaaagaatagctattagtccaggcctgtacggg

SEQ ID NO: 353171 - DNA, 75 bp, Artificial Sequence
  Synthetic
tgcaccgcgagggattcctgtgctgcaaagtgacagacacattgaacggggagagggtctcttttcccgtatgta

SEQ ID NO: 353172 - DNA, 75 bp, Artificial Sequence
  Synthetic
gagagggtctcttttcccgtatgtacgtatgtgccagccacattgtgtgaccaaatgactggcatactggcaaca

SEQ ID NO: 353173 - DNA, 75 bp, Artificial Sequence
  Synthetic
tcacatagaattcgcggcgattggcatgccgcttttaaaattttttattttattttcttttcttttccgaatcgg

SEQ ID NO: 353174 - DNA, 75 bp, Artificial Sequence
  Synthetic
acaagcgcccggatacccaaaccatcatcaaagtgaacagcgatttccactcgttcgtgctgcccaggataggta

SEQ ID NO: 353175 - DNA, 75 bp, Artificial Sequence
  Synthetic
gtaacacactggagattgggctgagaacgagaatcaggaaactgttagaagagcacaaggagccatcacctctca

SEQ ID NO: 353176 - DNA, 75 bp, Artificial Sequence
  Synthetic
agctacgctggcgaagacaagatcggctcctatgcagtgctttcaccgcaggctgtactcaagagtgagaaatta

SEQ ID NO: 353177 - DNA, 75 bp, Artificial Sequence
  Synthetic
gctcctatgcagtgctttcaccgcaggctgtactcaagagtgagaaattatcttgcatacaccctctcgctgaac

SEQ ID NO: 353178 - DNA, 75 bp, Artificial Sequence
  Synthetic
ggactttcaagctctgagtgaaagtgccaccatcgtgtacaacgaacgagagttcgtaaacaggtacttgcacca

SEQ ID NO: 353179 - DNA, 75 bp, Artificial Sequence
  Synthetic
caagaagatgaaagggctagacgtcaatgcccggacagtggactcagtgctgttaaatggatgcaagcacccggt

SEQ ID NO: 353180 - DNA, 75 bp, Artificial Sequence
  Synthetic
ggatcaggcaagtctggcatcattaaaagcgcagtcaccaaaaaagatctggtggtgagcgccaagaaagaaaac

SEQ ID NO: 353181 - DNA, 75 bp, Artificial Sequence
  Synthetic
tgcttgtcatgcaggcactctcagagcgctcatagccatcataagacctaaaaaggcagtgctctgcggggatcc

SEQ ID NO: 353182 - DNA, 75 bp, Artificial Sequence
  Synthetic
atgtgcctgaaagtgcattttaaccacgagatttgcacgcaagtcttccacaaaagcatctctcgccgttgcact

SEQ ID NO: 353183 - DNA, 75 bp, Artificial Sequence
  Synthetic
acgagatttgcacgcaagtcttccacaaaagcatctctcgccgttgcactaaatctgtgacttcggtcgtctcaa

SEQ ID NO: 353184 - DNA, 75 bp, Artificial Sequence
  Synthetic
gtggaacgaaaaaggggttacagtcaaatacacccccgagaacagcgagcagtggtccttggtgaccactatgtg

SEQ ID NO: 353185 - DNA, 75 bp, Artificial Sequence
  Synthetic
ggaaaacactagccggtgacccatggataaaaacactgacggccaagtatcccgggaatttcactgcaacaatgg

SEQ ID NO: 353186 - DNA, 75 bp, Artificial Sequence
  Synthetic
aggaatggcaagcagagcatgatgctatcatgaggcatatcttggagagaccggatcctactgacgtcttccaaa

SEQ ID NO: 353187 - DNA, 75 bp, Artificial Sequence
  Synthetic
ataaggcgaacgtgtgttgggccaaggctctagtgccggtactgaagaccgcaggcatagacatgaccactgaac

SEQ ID NO: 353188 - DNA, 75 bp, Artificial Sequence
  Synthetic
aatggaacactgtggatcacttcgaaatggacaaagcacactcggcagagatagtattgaatcaactatgcgtga

SEQ ID NO: 353189 - DNA, 75 bp, Artificial Sequence
  Synthetic
ggttctttggactcgacctggactccggtcttttctctgcaccctcagttccgttatccattaggaacaatcact

SEQ ID NO: 353190 - DNA, 75 bp, Artificial Sequence
  Synthetic
gggacaactctccatcgcctaacatgtacgggctgaataaagaagtggtccgtcagctctcccgtaggtacccgc

SEQ ID NO: 353191 - DNA, 75 bp, Artificial Sequence
  Synthetic
ccaccaagtacattgccttgcctgtgcatccacgctatgaccccggaacgggttcagcgtttgaaagcctctcgc

SEQ ID NO: 353192 - DNA, 75 bp, Artificial Sequence
  Synthetic
aactgccgcgggcagttgccaccgggagagtctatgacatgaataccggcacattgcgcagttatgatccgcgca

SEQ ID NO: 353193 - DNA, 75 bp, Artificial Sequence
  Synthetic
taaatctagtgcctgtgaatagaagactgcctcacgctttagtcctccaccataatgaacacccacagagcgact

SEQ ID NO: 353194 - DNA, 75 bp, Artificial Sequence
  Synthetic
tttcttcattcatcagcaaactgaagggcagaaccgtcctggtggtcggggagaagatgtccgtcccaggcaaaa

SEQ ID NO: 353195 - DNA, 75 bp, Artificial Sequence
  Synthetic
cggttgactggttatcagaccgtcctgatgctacctttagagctcggctggatttaggcatcccaggtgacgtgc

SEQ ID NO: 353196 - DNA, 75 bp, Artificial Sequence
  Synthetic
acccattatcacctttgggtttcgctccgtgtctctgaaacttcatcccaagaaccccaccttcctaaccacgag

SEQ ID NO: 353197 - DNA, 75 bp, Artificial Sequence
  Synthetic
ccaaatatgatataatattcattaatgtgaggactccatataaataccatcactatcagcagtgtgaagaccacg

SEQ ID NO: 353198 - DNA, 75 bp, Artificial Sequence
  Synthetic
ccatcaagcttagcatgttgaccaagaaagcttgtttgcatctgaatcccggcggaacctgcgtcagcataggtt

SEQ ID NO: 353199 - DNA, 75 bp, Artificial Sequence
  Synthetic
acggttacgctgacagggctagcgaaagcatcattggtgctgtagcacggcagttcaagttctcccgggtatgca

SEQ ID NO: 353200 - DNA, 75 bp, Artificial Sequence
  Synthetic
aagcatcattggtgctgtagcacggcagttcaagttctcccgggtatgcaaaccgaaatcttcacttgaagagac

SEQ ID NO: 353201 - DNA, 75 bp, Artificial Sequence
  Synthetic
acacggactgccacatgaggtgatcacgcactactaccacaggtatcccatgtccaccattctaggcttatcaat

SEQ ID NO: 353202 - DNA, 75 bp, Artificial Sequence
  Synthetic
gggcccaatttcaacaaagtttcagaagttgaaggtgacaaacagttggcagaggcttatgagtctatcgctaaa

SEQ ID NO: 353203 - DNA, 75 bp, Artificial Sequence
  Synthetic
gactcttcggtgacagaaccggacgcggagttggtgagggtgcatccgaagagttccttggctggaaggaagggc

SEQ ID NO: 353204 - DNA, 75 bp, Artificial Sequence
  Synthetic
cggagttggtgagggtgcatccgaagagttccttggctggaaggaagggctatagcataagtgatggcaagactt

SEQ ID NO: 353205 - DNA, 75 bp, Artificial Sequence
  Synthetic
gccgtgctttgctgcgcccgtactgcccgggccgagaccatctgggagtccttggatcacctatggaataataac

SEQ ID NO: 353206 - DNA, 75 bp, Artificial Sequence
  Synthetic
ggaagtcaagatcatcgatgcagtggttggcgagaaagctccctatttctgtggtgggtttatcttgtgtgactc

SEQ ID NO: 353207 - DNA, 75 bp, Artificial Sequence
  Synthetic
agaacaaattactgtgtgctcatcctttccattgccgaagtatagaatcactggtgtgcagaagatccagtgctc

SEQ ID NO: 353208 - DNA, 75 bp, Artificial Sequence
  Synthetic
ccagcctatactgttctcaccgaaagtgcctgcgtacatccacccacggaagtacctcgtggaaacaccgccggt

SEQ ID NO: 353209 - DNA, 75 bp, Artificial Sequence
  Synthetic
agaagagaatcaacccatagcggggacacctgaacaaccagcacctaccgtggatgagactagaactgaaacgcc

SEQ ID NO: 353210 - DNA, 75 bp, Artificial Sequence
  Synthetic
agagccgattatcattgaagaagaagaagaggatagcataagtttattgtcagacggcccaacccaccatgtact

SEQ ID NO: 353211 - DNA, 75 bp, Artificial Sequence
  Synthetic
gaagaggatagcataagtttattgtcagacggcccaacccaccatgtactgcaagtcgaggcagacattcacggg

SEQ ID NO: 353212 - DNA, 75 bp, Artificial Sequence
  Synthetic
ccgccttctgtatccagctcatcttggtccgttcctcatgcatccgactttgatgtgggcagtttatccatcctt

SEQ ID NO: 353213 - DNA, 75 bp, Artificial Sequence
  Synthetic
gatacctcggagggaaccagtgtgaccagcgagtctgtgtcagccgagactgactcctacttcgcaaggagcttg

SEQ ID NO: 353214 - DNA, 75 bp, Artificial Sequence
  Synthetic
gttgtcctccctcaagaccaaaaaggcatctaagtatgatctggagtacgctgacgtgccacagagcatgcgtgc

SEQ ID NO: 353215 - DNA, 75 bp, Artificial Sequence
  Synthetic
gagtttctggcgcgaccggtgcctgcgcctcggacagtattcaggatccctccacatcccgccccacgcacaaga

SEQ ID NO: 353216 - DNA, 75 bp, Artificial Sequence
  Synthetic
acaccgtcactcgcacctagccgggccagctcgagaactagcctagtttctaacccgccaggcgtgtttacaaga

SEQ ID NO: 353217 - DNA, 75 bp, Artificial Sequence
  Synthetic
gaggagctcgaggcgcctacctcgtcacgcgctcctagcagggcggtctcaagaactagcctggtctccaacccg

SEQ ID NO: 353218 - DNA, 75 bp, Artificial Sequence
  Synthetic
aagaactagcctggtctccaacccgccaggcgtaaacagggtgatcactagagaggagttcgaggcgttcgtagc

SEQ ID NO: 353219 - DNA, 75 bp, Artificial Sequence
  Synthetic
ttagcagcgattggcatgctgcttgtaaagttttatcacaaataacgtgcggcaattggcgagccgctttaatta

SEQ ID NO: 353220 - DNA, 75 bp, Artificial Sequence
  Synthetic
gcccaaaccaattacctacccaaaatggagaaagttcacgttgacatcgaggaagacagcccattcctcagagct

SEQ ID NO: 353221 - DNA, 75 bp, Artificial Sequence
  Synthetic
agaaggaaaagtggagtgctaccgaaccctgcaccctgtccctttgtattcatctagtgtgaatcgtgccttttc

SEQ ID NO: 353222 - DNA, 75 bp, Artificial Sequence
  Synthetic
tttactgtccatgagcggtagttctgttcatgtgactccacctgccgggcaaagcgttcaagtggaatgcgaatg

SEQ ID NO: 353223 - DNA, 75 bp, Artificial Sequence
  Synthetic
ttccgactgtggcttcttactgtattatcccggagtacgatgcctatttggacatggttgatggagcttcctgtt

SEQ ID NO: 353224 - DNA, 75 bp, Artificial Sequence
  Synthetic
gcttagatactgccagtttttgccccgcaaagctgcgaagctttccaaagaaacactcctatttggaacccacga

SEQ ID NO: 353225 - DNA, 75 bp, Artificial Sequence
  Synthetic
tacgatcggcagtgccatcagcgatccagaacacgctccagaacgtactggcagctgccactaaaagaaattgca

SEQ ID NO: 353226 - DNA, 75 bp, Artificial Sequence
  Synthetic
gttggctcgaccatctaccacgagaagagggacttactgaggagctggcacctgccgtctgtatttcacttacgt

SEQ ID NO: 353227 - DNA, 75 bp, Artificial Sequence
  Synthetic
caacagtgaatcttgagtacattacatgccattacaagaccggaatggattcacccgccattaaatgctgcggca

SEQ ID NO: 353228 - DNA, 75 bp, Artificial Sequence
  Synthetic
aggtacaggtgatccaggctgccgatccgttagcaaccgcgtatctgtgtggaatccatcgagagctggttagga

SEQ ID NO: 353229 - DNA, 75 bp, Artificial Sequence
  Synthetic
gattaaatgctgtcctgcttccaaacatccatacactgtttgacatgtcggctgaagacttcgacgctattatcg

SEQ ID NO: 353230 - DNA, 75 bp, Artificial Sequence
  Synthetic
gaagaggaagaagaggatagcataagtttgctgtcagacggcccgacccaccaggtgctgcaagtcgaggcagac

SEQ ID NO: 353231 - DNA, 75 bp, Artificial Sequence
  Synthetic
ccgaacatttccagccaggggactgtgttctggaaactgacatcgcgtcttttgataaaagcgaggatgatgcca

SEQ ID NO: 353232 - DNA, 75 bp, Artificial Sequence
  Synthetic
tgttctggaaactgacatcgcgtcttttgataaaagcgaggatgatgccatggctctgactgcgttaatgattct

SEQ ID NO: 353233 - DNA, 75 bp, Artificial Sequence
  Synthetic
ggagccatgatgaaatctggaatgttcctcacactgtttgtgaacacagtcattaacatcgtgatcgcaagcaga

SEQ ID NO: 353234 - DNA, 75 bp, Artificial Sequence
  Synthetic
aataactacccaaaatggagaaagttcacgttgacatcgaggaagatagccccttcctcagagcattacaacgga

SEQ ID NO: 353235 - DNA, 75 bp, Artificial Sequence
  Synthetic
gtgctgagagaacggctaactggatcaccatgtgcggcattcattggagatgacaatatcgtaaaaggagtcaaa

SEQ ID NO: 353236 - DNA, 75 bp, Artificial Sequence
  Synthetic
tcggacaaattaatggcagacaggtgcgccacctggttgaatatggaagtcaagatcatagatgctgtagtgggc

SEQ ID NO: 353237 - DNA, 75 bp, Artificial Sequence
  Synthetic
cggcacggcgtgccgtgtggcagaccccttaaaaaggttgtttaagctcggcaaacctctggcggcagacgatga

SEQ ID NO: 353238 - DNA, 75 bp, Artificial Sequence
  Synthetic
cccttaaaaaggttgtttaagctcggcaaacctctggcggcagacgatgaacatgatgatgacaggagaagggca

SEQ ID NO: 353239 - DNA, 75 bp, Artificial Sequence
  Synthetic
ggccggctcagtggagacacctcgtggcttgataaaggttaccagctatgccggcgaggacaagatcggctctta

SEQ ID NO: 353240 - DNA, 75 bp, Artificial Sequence
  Synthetic
gtgtaaggcagtagaatcaaggtatgagactgtaggaacctccatcatagttatggccatgactactttagctag

SEQ ID NO: 353241 - DNA, 75 bp, Artificial Sequence
  Synthetic
gagactgtaggaacctccatcatagttatggccatgactactttagctagcagtgttaaatcattcagccacctg

SEQ ID NO: 353242 - DNA, 75 bp, Artificial Sequence
  Synthetic
gttaacggctcgtaacataggcttgtgcagctccgatgtgatggagcggtcacgtagagggatgtccatccttag

SEQ ID NO: 353243 - DNA, 75 bp, Artificial Sequence
  Synthetic
tgctgtcctgcttccgaacatccacacactgtttgacatgtcggctgaagactttgacgctattattgccgagca

SEQ ID NO: 353244 - DNA, 75 bp, Artificial Sequence
  Synthetic
ggtgcaggaattaacccgctcgatggctaacctgacgttcaaacaacgccgagacgcgccacctgaggggccgcc

SEQ ID NO: 353245 - DNA, 75 bp, Artificial Sequence
  Synthetic
tgctaagaaaccgaagggagaagccccgcaaaaacaaaaagggggaggtcaagggaagaagaagaagaaccaggg

SEQ ID NO: 353246 - DNA, 75 bp, Artificial Sequence
  Synthetic
caagaaaaaggctaagacagggccgcctaatccaaaggcacaaaatggaagtaagaagaagaccaacaagaaacc

SEQ ID NO: 353247 - DNA, 75 bp, Artificial Sequence
  Synthetic
aaattggaatctgacaagacgttcccaattatgctggaagggaagattaacggctacgcgtgcgtggtcggaggc

SEQ ID NO: 353248 - DNA, 75 bp, Artificial Sequence
  Synthetic
aagctattcaggccgatgcatgtggcaggcaagatcgacaatgacgttctggccgcgcttaagacgaagaaagca

SEQ ID NO: 353249 - DNA, 75 bp, Artificial Sequence
  Synthetic
tctaaatatgatcttgagtatgcagacgtaccacagaacatgcgggccgacacattcaaatacacccatgagaaa

SEQ ID NO: 353250 - DNA, 75 bp, Artificial Sequence
  Synthetic
aaggctaagacggggccgcctaatccgaaggcacagagtggaaacaagaagaagaccaacaagaaaccaggcaag

SEQ ID NO: 353251 - DNA, 75 bp, Artificial Sequence
  Synthetic
cactggaggcggacgttgacttaatgctgcaggaggcgggagcgggatctgtcgaaacccccagggggctcatca

SEQ ID NO: 353252 - DNA, 75 bp, Artificial Sequence
  Synthetic
gtcgaaacccccagggggctcatcaaagtcaccagctatgcaggagaagacaaaatcggctcctacgcggtgctc

SEQ ID NO: 353253 - DNA, 75 bp, Artificial Sequence
  Synthetic
ccattctggataatcagggacgggtggtcgctattgtgctgggaggtgtgaatgaaggatctaggacagcccttt

SEQ ID NO: 353254 - DNA, 75 bp, Artificial Sequence
  Synthetic
cagttgttatgtggaacgagaagggagttactgtgaagtacactccggagaactgcgagcaatggtcactagtga

SEQ ID NO: 353255 - DNA, 75 bp, Artificial Sequence
  Synthetic
ctaccatgtgcctgctcgccaacgtgacgttcccatgtgctcaaccaccaatttgctacgacagaaaaccatccg

SEQ ID NO: 353256 - DNA, 75 bp, Artificial Sequence
  Synthetic
aataatgacggcagctgcctctcaagggctgacccgtaaaggcgtgtatgccgttcggtacaaggtgaatgaaaa

SEQ ID NO: 353257 - DNA, 75 bp, Artificial Sequence
  Synthetic
cgttgacaacccgggctacgatgagctactggaagcagctgtcaagtgctccggcagaaaacggaggtctaccga

SEQ ID NO: 353258 - DNA, 75 bp, Artificial Sequence
  Synthetic
tagtcctatagcaattgaggcagtgaagagcgatgggcacgacggctatgttagactccagacttcctcgcagta

SEQ ID NO: 353259 - DNA, 75 bp, Artificial Sequence
  Synthetic
cggcctggattcctccggcaatttaaagggcaggaccatgcggtatgacatgcatgggactatcgaagagatacc

SEQ ID NO: 353260 - DNA, 75 bp, Artificial Sequence
  Synthetic
gggagccaccctaaaaggaaaattacacgtcccattcttgctggcagacggcaaatgtaccgtgcctctggcacc

SEQ ID NO: 353261 - DNA, 75 bp, Artificial Sequence
  Synthetic
actacatcaagtgtccttacatacatctcgcccgtgccacattgtggacgggcatggctacttcctgcttgctag

SEQ ID NO: 353262 - DNA, 75 bp, Artificial Sequence
  Synthetic
tgaaccaactatgcgtgaggttctttggactcgacctggactccggtctattttctgcacccactgttccgttat

SEQ ID NO: 353263 - DNA, 75 bp, Artificial Sequence
  Synthetic
gtgcccagctggggactccattaccatggaatttaagaaagattcagtcacacattcttgctcagtgccgcatga

SEQ ID NO: 353264 - DNA, 75 bp, Artificial Sequence
  Synthetic
agtgaaatttaaccctgtaggcagagagctctatacgcatccaccagagcacggagcagagcaagcgtgccaagt

SEQ ID NO: 353265 - DNA, 75 bp, Artificial Sequence
  Synthetic
ctacgcacatgatgcacaaaacagaggagcctatgtcgagatgcacctcccgggctcagaagtggacagcagatt

SEQ ID NO: 353266 - DNA, 75 bp, Artificial Sequence
  Synthetic
gcaattatgatccgcgcataaatctagtacctgtgaacagaagactgcctcatgctttagtcctccaccataatg

SEQ ID NO: 353267 - DNA, 75 bp, Artificial Sequence
  Synthetic
gatctccctgagcggcagttcagtcaccgtgacacctcctgctgggactagtgccctggtagaatgcgagtgcgg

SEQ ID NO: 353268 - DNA, 75 bp, Artificial Sequence
  Synthetic
gtgccctggtagaatgcgagtgcggcggcacaaagatctctgagaccatcaatacggcgaaacagttcagccagt

SEQ ID NO: 353269 - DNA, 75 bp, Artificial Sequence
  Synthetic
gcagacggcaaatgcaccgtgcctctagcaccggaaccaatgataactttcggcttccgatcagtgtcactgaaa

SEQ ID NO: 353270 - DNA, 75 bp, Artificial Sequence
  Synthetic
gacccgtggataaagaccctgaccgcgaagtaccccggagatttcaccgcaacaatggaagaatggcaggcagaa

SEQ ID NO: 353271 - DNA, 75 bp, Artificial Sequence
  Synthetic
cctgcgtcagcataggttatggttacgctgacagggccagcgagagcatcattggtgctatagcgcggcagttca

SEQ ID NO: 353272 - DNA, 75 bp, Artificial Sequence
  Synthetic
tctgaaccagctattaggaattttaccgtcactgagaaaggatgggagtttgtatggggaaaccacccgccgaaa

SEQ ID NO: 353273 - DNA, 75 bp, Artificial Sequence
  Synthetic
aaatcaataactacccaaaatggagaaagttcacgttgacatcgaggaagatagtcccttcctcagagcattaca

SEQ ID NO: 353274 - DNA, 75 bp, Artificial Sequence
  Synthetic
agataccctatgtccaccatcctgggtttgtccatttgcgccgccattgtaaccgtttccgtttcagcgtccatc

SEQ ID NO: 353275 - DNA, 75 bp, Artificial Sequence
  Synthetic
tggctgttttgcaaatccagagtttcgtgtctaaccccttaccggctaacacccaacgctaggatgccaatttgc

SEQ ID NO: 353276 - DNA, 75 bp, Artificial Sequence
  Synthetic
aaccgtcgtctaccacatgctctcgtgacgcaacatgctgatcacccccccagtgatttttccgcctttgtcagt

SEQ ID NO: 353277 - DNA, 75 bp, Artificial Sequence
  Synthetic
aggtaagacggtagactggttatctgatacacctgattctactttcagggcgcgcctagacttaggcatacccaa

SEQ ID NO: 353278 - DNA, 75 bp, Artificial Sequence
  Synthetic
cagtgaacctggagtacgtcacctgccactacaaaacaggaatggattcgccggccattaaatgctgcggatctc

SEQ ID NO: 353279 - DNA, 75 bp, Artificial Sequence
  Synthetic
cgcaccttcgtatcatgtagtgcgcggggacatagccactgccacggaaggagtaatcgtcaatgctgccaacag

SEQ ID NO: 353280 - DNA, 75 bp, Artificial Sequence
  Synthetic
ctcaatatcacagtgggagaacactctactgtgaccaccgtgtatgtgaatggggaaactcctgtgaattttaat

SEQ ID NO: 353281 - DNA, 75 bp, Artificial Sequence
  Synthetic
ctactgtgaccaccgtgtatgtgaatggggaaactcctgtgaattttaatggggttaaattaattgcaggcccac

SEQ ID NO: 353282 - DNA, 75 bp, Artificial Sequence
  Synthetic
agtatggggcaggacaaccaggagcatttggagatatacagtccagaacagtttcaagctcagatctgtacgcca

SEQ ID NO: 353283 - DNA, 75 bp, Artificial Sequence
  Synthetic
agagaagcggtagaggagatatgtatctccgaagattcctccgtagcagagccggatgcagagctggttagagtt

SEQ ID NO: 353284 - DNA, 75 bp, Artificial Sequence
  Synthetic
ccacggtcaagtattcggccagcaagtcaggcaaatgcgcagtccatgtaccatcggggactgccaccctaaaag

SEQ ID NO: 353285 - DNA, 75 bp, Artificial Sequence
  Synthetic
aagcagtagtcgagttaaccgagcaagggtcggcgactattcatttctcgactgcaaatatccatccggagttta

SEQ ID NO: 353286 - DNA, 75 bp, Artificial Sequence
  Synthetic
actgcaaatatccatccggagtttaggctccaaatatgcacatcatacgtaacatgcaaaggtgattgtcacccc

SEQ ID NO: 353287 - DNA, 75 bp, Artificial Sequence
  Synthetic
agaactagcctagtttccaccccgccaggcgtgaatagggtgattactagagaggagctcgaggcgcttaccccg

SEQ ID NO: 353288 - DNA, 75 bp, Artificial Sequence
  Synthetic
cttagtgctggctactattgtggctatgtacgtgctgactaaccagaaacataattaaacatagcagcaattggc

SEQ ID NO: 353289 - DNA, 75 bp, Artificial Sequence
  Synthetic
atgtacgtgctgactaaccagaaacataattaaacatagcagcaattggcaagctgcttatagaaaattcgcggc

SEQ ID NO: 353290 - DNA, 75 bp, Artificial Sequence
  Synthetic
atacgcagttgagccttaccacggaaaagtggtagtacccgaagggcaggctatacctgtccaagacttccaagc

SEQ ID NO: 353291 - DNA, 75 bp, Artificial Sequence
  Synthetic
cgattggaatgccgctttaaaatttttattttattttcttttcttttccgaatcggattttgtttttaatatttc

SEQ ID NO: 353292 - DNA, 75 bp, Artificial Sequence
  Synthetic
acaggtggaagagagtcctgagaacacggaacaaccggtggaggaggaagacagtataagcgtgctgtccgagga

SEQ ID NO: 353293 - DNA, 75 bp, Artificial Sequence
  Synthetic
caaagaaggacttggtagtgagtgctaagaaggagaactgcgccgagataataagggacgtcaagaagatgaaag

SEQ ID NO: 353294 - DNA, 75 bp, Artificial Sequence
  Synthetic
atccaccgaggagctgtttaaggagtataagctaacgcgcccttacatggccagatgcatcagatgtgcagttgg

SEQ ID NO: 353295 - DNA, 75 bp, Artificial Sequence
  Synthetic
tgcttagacactgccagtttttgccctgcgaagctgcgcagctttccaaagaaacactcctatttggaacccaca

SEQ ID NO: 353296 - DNA, 75 bp, Artificial Sequence
  Synthetic
atacggtcggcagtgccatcagcgattcagaacacgctccagaacgtcctggcagctgccacaaaaagaaattgc

SEQ ID NO: 353297 - DNA, 75 bp, Artificial Sequence
  Synthetic
ccatcctgggtttgtcaatttgtgccgccattgcaaccgtttccgttgcagcgtctacctggctgttttgcagat

SEQ ID NO: 353298 - DNA, 75 bp, Artificial Sequence
  Synthetic
tatgatccgcgcataaatttagtaccggtgaaccgtcgtctaccacatgctctcgtgacgcaacatgctgatcat

SEQ ID NO: 353299 - DNA, 75 bp, Artificial Sequence
  Synthetic
cgtcacctgccactacaaaacaggaatggattcaccagccatcaaatgctgcggatctcaggaatgcactccaac

SEQ ID NO: 353300 - DNA, 75 bp, Artificial Sequence
  Synthetic
gaaattggaatctgacaagacattcccaattatgctggaagggaagattaacggctacgcttgcgtggtcggagg

SEQ ID NO: 353301 - DNA, 75 bp, Artificial Sequence
  Synthetic
gaagttattcaggccgatgcacgtggaaggcaagatcgacaacgacgttctggccgcacttaagacgaagaaagc

SEQ ID NO: 353302 - DNA, 75 bp, Artificial Sequence
  Synthetic
gtaccccgaaagcttcgatttacaaccaatagaagtggggaaagctagattggtcaaaggtaactcaaaacatct

SEQ ID NO: 353303 - DNA, 75 bp, Artificial Sequence
  Synthetic
gagactttggccatgctcagcgttaacgttgacaacccgggctacgatgagctgctggaagcagctgttaagtgc

SEQ ID NO: 353304 - DNA, 75 bp, Artificial Sequence
  Synthetic
agtttgttcttccttcccattgccgaagtacagaataacaggagtgcagaagattcaatgttcgcatcctatact

SEQ ID NO: 353305 - DNA, 75 bp, Artificial Sequence
  Synthetic
cgcagacacatttaaatacactcatgaaaaaccccagggctactacagctggcaccatggagcagtacagtatga

SEQ ID NO: 353306 - DNA, 75 bp, Artificial Sequence
  Synthetic
atacaccctagaaagtaccttgcagacgcagcttccgcaaacaatgaggcagccgaatcaacatcggtagacgtg

SEQ ID NO: 353307 - DNA, 75 bp, Artificial Sequence
  Synthetic
tgatttccttgagcggcagttcagtcaccgtgacacctcctgtcgggactagcgccttggtggaatgcaagtgcg

SEQ ID NO: 353308 - DNA, 75 bp, Artificial Sequence
  Synthetic
aatgtccaggcagaggcaagaggtccacggaggagctgttcaaggagtacaagttaacacgcccgtacatggcca

SEQ ID NO: 353309 - DNA, 75 bp, Artificial Sequence
  Synthetic
acccccagggggctcatcaaagtcaccagttatgcaggagaagacaaaatcggctcctacgcggtgctctcccca

SEQ ID NO: 353310 - DNA, 75 bp, Artificial Sequence
  Synthetic
tttgcatgccacgctggcactctcagggccttaatagccattatacgccccaagaaagcagtgctatgtggtgac

SEQ ID NO: 353311 - DNA, 75 bp, Artificial Sequence
  Synthetic
ggaagaatggcaggcagaacatgatgccatcatgagacacatcctggagaaaccggaccccacggatgtcttcca

SEQ ID NO: 353312 - DNA, 75 bp, Artificial Sequence
  Synthetic
ttagattgaccgaggaaaatgtggtcaactatataaccaagttaaaagggccgaaggcggctgccctgtatgcaa

SEQ ID NO: 353313 - DNA, 75 bp, Artificial Sequence
  Synthetic
actgacaaactccccttgcgccgcgttcattggcgacgataatatcgtgaaaggggttaagtccgacaaactcat

SEQ ID NO: 353314 - DNA, 75 bp, Artificial Sequence
  Synthetic
tacggagaatacccagataagcaaggcgtacgtgacgaaatcagaagattgcgtcaccgatcacgcccaggcata

SEQ ID NO: 353315 - DNA, 75 bp, Artificial Sequence
  Synthetic
gactctgtgaccggaactgcatgccgtgtagcagaccctttgaagagattattcaagcttggaaaaccactggct

SEQ ID NO: 353316 - DNA, 75 bp, Artificial Sequence
  Synthetic
aactcaaaacatctcatccatgcagtggggcctaattttaacaaagtgtctgaagtggaaggtgacaaacagctg

SEQ ID NO: 353317 - DNA, 75 bp, Artificial Sequence
  Synthetic
ggcgattggcatgccgctttaaaattttattttattttcttttcttttccgaatcggattttgtttttaatattt

SEQ ID NO: 353318 - DNA, 75 bp, Artificial Sequence
  Synthetic
acgccaacacaaaccttgtgctgcagagaccaaaagccggagcgatccatgtcccgtacacccaggccccatcgg

SEQ ID NO: 353319 - DNA, 75 bp, Artificial Sequence
  Synthetic
tgttcagcgtttgaaagcctctcgccccgaacaaattacagtctgctcttccttccctttgccgaagtacagaat

SEQ ID NO: 353320 - DNA, 75 bp, Artificial Sequence
  Synthetic
gccgaggagttgcgtgcagcactaccacctttggcagctgatgttgaggagcccactttggaagccgatgtcgac

SEQ ID NO: 353321 - DNA, 75 bp, Artificial Sequence
  Synthetic
gatgtacaccacttcagcgcaagtgctcagtcctcgtcctggtccattccatgtgcatccgactttgatgtcgag

SEQ ID NO: 353322 - DNA, 75 bp, Artificial Sequence
  Synthetic
tgcatcctttggctagcagatcaagctcgcgctccagcctggcgtctaatccaccgggtgttaaccgagtgatca

SEQ ID NO: 353323 - DNA, 75 bp, Artificial Sequence
  Synthetic
agtcataacatagacaatcctggttatgacgagttgcttgaagcagtactgaaatgtccaggcagaggcaagagg

SEQ ID NO: 353324 - DNA, 75 bp, Artificial Sequence
  Synthetic
attcaggaaccctccacatcccgctccacgcacaagaacaccgtcacttgcacccagcagggcctgctcgagaac

SEQ ID NO: 353325 - DNA, 75 bp, Artificial Sequence
  Synthetic
acaaatgggtgtacaattcggacaaattgcctaaagcatcgggagaaactctcaaaggcaaactgcatgtgccct

SEQ ID NO: 353326 - DNA, 75 bp, Artificial Sequence
  Synthetic
cgggaacaaagatcgcctaactcaatcattgaaccatttgctgacagctttagacaccaccgatgcagatgtagc

SEQ ID NO: 353327 - DNA, 75 bp, Artificial Sequence
  Synthetic
cggagaaagtatgagcagcatcaggtcgaaatgccccgtcgaagagtcggaagcatccacaccgcctagtacgct

SEQ ID NO: 353328 - DNA, 75 bp, Artificial Sequence
  Synthetic
gagggagctagcgtgaccagcgaagaggcgtcagtagagactaactcttacttcgcaaggagcatggagtttctg

SEQ ID NO: 353329 - DNA, 75 bp, Artificial Sequence
  Synthetic
gacaacccgggctacgatgagctgctggaagcagccgtaatgtgccccggaaggaaaaggagatccaccgaggag

SEQ ID NO: 353330 - DNA, 75 bp, Artificial Sequence
  Synthetic
atggagaaagttcacgttgacatcgaggaagacagcccattcctcagagctttgcagcggagcttcccgcagttt

SEQ ID NO: 353331 - DNA, 75 bp, Artificial Sequence
  Synthetic
ctatcatgcttgatggaaaagttaatggatacgcatgcgtggtcggtggcaagctgtttagaccactgcatgtgg

SEQ ID NO: 353332 - DNA, 75 bp, Artificial Sequence
  Synthetic
ctacgaagggcaagtcgctgtttaccaggatgtatacgcggttgacggaccgacaagtctctatcaccaagccaa

SEQ ID NO: 353333 - DNA, 75 bp, Artificial Sequence
  Synthetic
aagggaagaagaagaagaaccaggggaagaagaaggctaagacgggaccgcccaatccgaaggcacaaaatggaa

SEQ ID NO: 353334 - DNA, 75 bp, Artificial Sequence
  Synthetic
acaagaagaagaccaacaagaaaccaggcaagagacagcgcatggttatgaaactggaatctgataagacattcc

SEQ ID NO: 353335 - DNA, 75 bp, Artificial Sequence
  Synthetic
cggctacgcttgcgtggtcggagggaagttattcaggccgatgcatgtggaaggcaaaatcgacaacgacgttct

SEQ ID NO: 353336 - DNA, 75 bp, Artificial Sequence
  Synthetic
ggccgcgcttaagacgaagaaagcgtccaaatatgatcttgagtatgcagatgtgccacagaacatgcgggccga

SEQ ID NO: 353337 - DNA, 75 bp, Artificial Sequence
  Synthetic
gatggcgaggacaagatcggctcttacgctgtgctttctccgcaggctgtactcaagagtgaaaaattatcttgc

SEQ ID NO: 353338 - DNA, 75 bp, Artificial Sequence
  Synthetic
tcgcatcctatacttttctctcctaaagtacctgagtatatacaccctagaaagtatcttgcagacgcagcttcc

SEQ ID NO: 353339 - DNA, 75 bp, Artificial Sequence
  Synthetic
aatgaaggatctaggacagccctttcagtcgtcatgtggaacgagaagggagttactgtgaagtatactccggag

SEQ ID NO: 353340 - DNA, 75 bp, Artificial Sequence
  Synthetic
caaccggtggaggaggaagacagtataagcgtgctgtccgaggatgcaccaaaccaagtgcaccaagtggaggct

SEQ ID NO: 353341 - DNA, 75 bp, Artificial Sequence
  Synthetic
cgtggacaacccgggctacgacgagctgctagaagcagctgttaaatgcccaggaaggaaaaggagatctactga

SEQ ID NO: 353342 - DNA, 75 bp, Artificial Sequence
  Synthetic
ggagctgtttaaggagtataagctaacgcgcccctacatggccagatgcattaggtgcgccgttgggagctgcca

SEQ ID NO: 353343 - DNA, 75 bp, Artificial Sequence
  Synthetic
gtgcccggcaggggattccatcaccatggaatttaagaaagattcagtcacacactcctgctcagtgccgtatga

SEQ ID NO: 353344 - DNA, 75 bp, Artificial Sequence
  Synthetic
ggagtgaagctgaccgcgggtcctctgtccacagcctggtcgccgttcgacaaaaagatcgtgcagtacgccggg

SEQ ID NO: 353345 - DNA, 75 bp, Artificial Sequence
  Synthetic
tgggttccgatctgtgtctctgaaacttcatcccaagaaccccaccttcctaaccacgaggcagctggatggaga

SEQ ID NO: 353346 - DNA, 75 bp, Artificial Sequence
  Synthetic
gcggcgcatgagagaagcccaaaccaattacctacccaaaatggagaaagttcacgttgacatcgaggaagacag

SEQ ID NO: 353347 - DNA, 75 bp, Artificial Sequence
  Synthetic
ccagccattaaatgctgcggatcgcaggaatgcactccaacttacaggcctgatgaacagtgcaaagtctttaca

SEQ ID NO: 353348 - DNA, 75 bp, Artificial Sequence
  Synthetic
ggggtttacccgttcatgtggggaggggcatattgcttttgcgacactgagaatacccaagtcagcaaggcttat

SEQ ID NO: 353349 - DNA, 75 bp, Artificial Sequence
  Synthetic
gtaatgaaatctgacgactgccttgcggatcatgctgaagcatacaaagcgcacacagcctcagtgcaggcgttc

SEQ ID NO: 353350 - DNA, 75 bp, Artificial Sequence
  Synthetic
tagttagttgcgacgggtacgtcgttaaaagaatagctattagtccaggcctgtatgggaagccttcaggctatg

SEQ ID NO: 353351 - DNA, 75 bp, Artificial Sequence
  Synthetic
ataattgaacatagcagcaattggcaagctgctcatatagaatttgcggcgattggcatgccgcttttaaaattt

SEQ ID NO: 353352 - DNA, 75 bp, Artificial Sequence
  Synthetic
gcaagctgctcatatagaatttgcggcgattggcatgccgcttttaaaatttttattttattttcttttcttttc

SEQ ID NO: 353353 - DNA, 75 bp, Artificial Sequence
  Synthetic
ggcgcatgagagaagcccaaaccaataactacccaaaatggagaaagttcacgttgacatcgaggaagatagtcc

SEQ ID NO: 353354 - DNA, 75 bp, Artificial Sequence
  Synthetic
catctatttataagcgcccagatacccaaaccatcatcaaagtgaacagcgatttccactcatttgtgctgccca

SEQ ID NO: 353355 - DNA, 75 bp, Artificial Sequence
  Synthetic
cacctctcattactgccgaggacgtacaagaagctaagtgcgcagccgatgaggctaaggaggtgcgtgaagccg

SEQ ID NO: 353356 - DNA, 75 bp, Artificial Sequence
  Synthetic
acaagaagctaagtgcgcagccgatgaggctaaggaggtgcgtgaagccgaggagttgcgcgctgcactaccacc

SEQ ID NO: 353357 - DNA, 75 bp, Artificial Sequence
  Synthetic
gaggcagacatactcgggcagccatcggcagcgaaccaatccacagccattcctcacgcatccgactttgatgtg

SEQ ID NO: 353358 - DNA, 75 bp, Artificial Sequence
  Synthetic
gacagtttatccatacttgacaccctggagggagctagcgtgaccagcggggcaacgtcagccgagactaactct

SEQ ID NO: 353359 - DNA, 75 bp, Artificial Sequence
  Synthetic
tcgctgaacaagtcatagtgataacacactctggccgaaaagggcgttatgccgtggaaccctaccatggaaaag

SEQ ID NO: 353360 - DNA, 75 bp, Artificial Sequence
  Synthetic
gcacgacggcgaatacctgtatgacatcgacaggaaacagtgcgtcaagaaagaactagtcactgggctagggct

SEQ ID NO: 353361 - DNA, 75 bp, Artificial Sequence
  Synthetic
ttccatgaatttgcatatgaaagcttgaggacacgtccggccgcaccttatcaagtaccaactataggtgtgtat

SEQ ID NO: 353362 - DNA, 75 bp, Artificial Sequence
  Synthetic
atcgacaggaaacagtgcgtcaagaaagaactagtcactgggctagggcttacaggcgagctggtggatcctccc

SEQ ID NO: 353363 - DNA, 75 bp, Artificial Sequence
  Synthetic
ctcgaccaagaaaaagaagaattactacgcaagaaattacagttaaatcccacacctgctaacagaagcagatac

SEQ ID NO: 353364 - DNA, 75 bp, Artificial Sequence
  Synthetic
aaagaccattggggcttagggaccgccagttagtaatggggtgttgttgggcgttcaggaaacacaagataacat

SEQ ID NO: 353365 - DNA, 75 bp, Artificial Sequence
  Synthetic
cgttgcactaaatctgtgacttcggtcgtctcaaccttgttttacgacaaaagaatgagaacgacgaacccgaaa

SEQ ID NO: 353366 - DNA, 75 bp, Artificial Sequence
  Synthetic
gtcaccagttacgcaggagaagacaaaattggctcttacgcggtgctctccccacaagcagtactgcgaagtgaa

SEQ ID NO: 353367 - DNA, 75 bp, Artificial Sequence
  Synthetic
aaactgacgtgcattcacccgcttgcagagcaagtaattgtaatcacacactctggaaggaagggtagatacgca

SEQ ID NO: 353368 - DNA, 75 bp, Artificial Sequence
  Synthetic
tattccaaaataaagcgaatgtgtgttgggccaaggctttggtgccggtactgaaaactgcaggcatagacatga

SEQ ID NO: 353369 - DNA, 75 bp, Artificial Sequence
  Synthetic
agctgttgacgctgattgaggcggctttcggcgaaatttcatcaatacatttgcccactaaaactaaatttaaat

SEQ ID NO: 353370 - DNA, 75 bp, Artificial Sequence
  Synthetic
cccactgttccgttatccattaggaataatcactgggataattccccgtcgcctaacatgtacgggctgaataaa

SEQ ID NO: 353371 - DNA, 75 bp, Artificial Sequence
  Synthetic
gcgagaaagcgccctatttctgtggagggtttattttgtgtgactccgtgaccggcacagcgtgccgtgtggcag

SEQ ID NO: 353372 - DNA, 75 bp, Artificial Sequence
  Synthetic
gtgacgtgcccaaatacgacattgtatttattaatgtgaggactccatataaataccatcattatcagcagtgtg

SEQ ID NO: 353373 - DNA, 75 bp, Artificial Sequence
  Synthetic
gtgcggagctctgtaccggaagtaccccgaaagcttcgatttacaaccaatagaagtggggaaagctagattggt

SEQ ID NO: 353374 - DNA, 75 bp, Artificial Sequence
  Synthetic
atagcgcggcagttcaagttctcccgggtatgcaaaccgaaatcctcacttgaagagacagaagttctgtttgta

SEQ ID NO: 353375 - DNA, 75 bp, Artificial Sequence
  Synthetic
tgggttaagcaactgcaaatagactacaaaggaaatgaaataatgaccgcggctgcctcacagggattgacgcgg

SEQ ID NO: 353376 - DNA, 75 bp, Artificial Sequence
  Synthetic
agattctggtttgttttccgcccccacagttccactctccattaggaacaaccattgggacaattcaccgtcacc

SEQ ID NO: 353377 - DNA, 75 bp, Artificial Sequence
  Synthetic
atatccgacgactcttcggtgacagaaccggatgcagagctggtgagggtacatccgaagagttctttggctgga

SEQ ID NO: 353378 - DNA, 75 bp, Artificial Sequence
  Synthetic
gcaagtatgcatgtatatccttggtgaaagcatgagcagcattaggtcaaaatgccccgtcgaagagtcggaagc

SEQ ID NO: 353379 - DNA, 75 bp, Artificial Sequence
  Synthetic
atagaatcactggtgtgcagaagatccagtgctcccagcctatactgttctcacctaaggtgcctgcgtacattc

SEQ ID NO: 353380 - DNA, 75 bp, Artificial Sequence
  Synthetic
aaccccggaggaacctgtgtgagcattggttacggctatgcggaccgggccagtgaaagcatcataggtgcagtt

SEQ ID NO: 353381 - DNA, 75 bp, Artificial Sequence
  Synthetic
aggggacacctgaacaaccagcacccgtaaacgtggatgcaaccaggactagaacgcctgaaccgatcatcattg

SEQ ID NO: 353382 - DNA, 75 bp, Artificial Sequence
  Synthetic
tccgactttgatgtggacagtttatccatccttgacaccctggagggagctagcgtgaccagcgaggcagcgtca

SEQ ID NO: 353383 - DNA, 75 bp, Artificial Sequence
  Synthetic
aacagacgcagatgtggccatatactgcagagacaaaaaatgggaagtcacgttgaaagaggtcgtagccaggag

SEQ ID NO: 353384 - DNA, 75 bp, Artificial Sequence
  Synthetic
tcgtatgccccgcgcctcgaccaagaaaaagaagaactactacgcaagaaattacagctgaatcccacacctgct

SEQ ID NO: 353385 - DNA, 75 bp, Artificial Sequence
  Synthetic
aggtcgcagtggaagcctgcaatgccatgctgaaagaaaactttccgactgtagcttcttactgtattattccag

SEQ ID NO: 353386 - DNA, 75 bp, Artificial Sequence
  Synthetic
agtacgatgcctatctggacatggttgacggcgcttcttgttgcttagacactgccagtttttgccctgcgaagc

SEQ ID NO: 353387 - DNA, 75 bp, Artificial Sequence
  Synthetic
actgccagtttttgccctgcgaagctgcgcagctttccaaagaaacactcttatttggaacccacaatacggtcg

SEQ ID NO: 353388 - DNA, 75 bp, Artificial Sequence
  Synthetic
cacaaaaagaaattgcaatgtcacgcaaatgagagaattgcccgtattggattcggctgcctttaatgtggaatg

SEQ ID NO: 353389 - DNA, 75 bp, Artificial Sequence
  Synthetic
aaaggaccaaaagctgctgctctttttgcgaagacacataatttgaacatgttacaggacataccaatggacagg

SEQ ID NO: 353390 - DNA, 75 bp, Artificial Sequence
  Synthetic
gctgtcctgcttccgaacatccacacgctgtttgacatgtcggctgaagactttgacgctattattgccgagcat

SEQ ID NO: 353391 - DNA, 75 bp, Artificial Sequence
  Synthetic
ttccagcctggggattgtgttctggaaactgacattgcgtcgtttgataaaagtgaggacgacgccatggctctg

SEQ ID NO: 353392 - DNA, 75 bp, Artificial Sequence
  Synthetic
gcagcattcattggagatgacaatatcgtgaaaggagtcaaatctgacaaattaatggcagacaggtgcgccact

SEQ ID NO: 353393 - DNA, 75 bp, Artificial Sequence
  Synthetic
ttgtgtgacaccgtgaccggcacagcgtgccgtgtggcagaccccctaaaaaggctgtttaagcttggcaaacct

SEQ ID NO: 353394 - DNA, 75 bp, Artificial Sequence
  Synthetic
agagtcaacacgctggaatcgagtgggaattcttccagagctgtgtaaggcagtagaatcaaggtatgaaaccgt

SEQ ID NO: 353395 - DNA, 75 bp, Artificial Sequence
  Synthetic
tagtagcccaggcatttgctaggtgggcaaaggaatataaggaagatcaagaagatgagaggccactaggactac

SEQ ID NO: 353396 - DNA, 75 bp, Artificial Sequence
  Synthetic
agtcggagccaaaggagatagcggtcgccccatacttgacaaccaagggcgtgtggtcgctattgtgcttggcgg

SEQ ID NO: 353397 - DNA, 75 bp, Artificial Sequence
  Synthetic
atctgataagacattcccaattatgctggaagggaagattaacggctatgcttgcgtggtcggagggaagttatt

SEQ ID NO: 353398 - DNA, 75 bp, Artificial Sequence
  Synthetic
ttaagacgaagaaagcatccaaatatgatcttgagtatgcagatgtgccacagaacatgcgggccgatacattca

SEQ ID NO: 353399 - DNA, 75 bp, Artificial Sequence
  Synthetic
cgagttgctcgaagcagtactgaaatgtccaggcagaggcaagaggtccacggaggagctgtttaaggagtacaa

SEQ ID NO: 353400 - DNA, 75 bp, Artificial Sequence
  Synthetic
acccgggctacgatgagctgctggaagcagctgttaagtgccccggaaggaaaaggagatctaccgaggagctgt

SEQ ID NO: 353401 - DNA, 75 bp, Artificial Sequence
  Synthetic
agcagctgttaagtgccccggaaggaaaaggagatctaccgaggagctgtttaaggagtacaagctaacgcgccc

SEQ ID NO: 353402 - DNA, 75 bp, Artificial Sequence
  Synthetic
cagacttcctcgcagtatggcctggactcctctggcaacttaaaaggaaggactatgcggtatgacatgcacggg

SEQ ID NO: 353403 - DNA, 75 bp, Artificial Sequence
  Synthetic
catcaattcagctaaacaatacagtcagtgctcaaagacatctcagtgcagggcataccgtacacagaatgacaa

SEQ ID NO: 353404 - DNA, 75 bp, Artificial Sequence
  Synthetic
ttctgacaaactgcccaaagctgcgggagccaccctaaaaggaaaattacacgtcccattcttgctggcagacgg

SEQ ID NO: 353405 - DNA, 75 bp, Artificial Sequence
  Synthetic
tgtcctccctcaagacaaaaaaggcatctaagtatgatctggagtatgctgatgtgccgcagagtatgcgcgcag

SEQ ID NO: 353406 - DNA, 75 bp, Artificial Sequence
  Synthetic
agctgttaggaattttaccgtcactgaaaaggggtgggagtttgtatggggaaaccacccgccgaaaaggttttg

SEQ ID NO: 353407 - DNA, 75 bp, Artificial Sequence
  Synthetic
acagaggggacacctgaacaaccgacactcataaccgtggatgaaaccagaaccagaacgcctgaaccgatcatc

SEQ ID NO: 353408 - DNA, 75 bp, Artificial Sequence
  Synthetic
ttgcaaatccagagtttcgtgcctaactccttaccggctaacacccaacgccaggatgccgctttgcctggctgt

SEQ ID NO: 353409 - DNA, 75 bp, Artificial Sequence
  Synthetic
gatgttctggattcaattgctgatccctctggccgccttgattgtagtgactcgcctgctcaagtgcgtgtgctg

SEQ ID NO: 353410 - DNA, 75 bp, Artificial Sequence
  Synthetic
taacagccagacgtattctgcaaggcctagggcattatttgaaggcagaaggaaaagtggagtgctaccgaaccc

SEQ ID NO: 353411 - DNA, 75 bp, Artificial Sequence
  Synthetic
tcgtgcagtatgccggggagatctataattacgattttcctgagtatggggcaggacaaccaggagcatttggag

SEQ ID NO: 353412 - DNA, 75 bp, Artificial Sequence
  Synthetic
aattataataattggacttgtgttagccacagttgtggctatgtatgtgctgaccaaccagaaacataattagta

SEQ ID NO: 353413 - DNA, 75 bp, Artificial Sequence
  Synthetic
atgggcggcgcatgagagaagcccaaaccgaattacctacccaaaatggagaaagttcacgttgacatcgaggaa

SEQ ID NO: 353414 - DNA, 75 bp, Artificial Sequence
  Synthetic
attaaaaggaccaaaagctgcagctctttttgcgaagacacacaatctgaatatgttgcaggacataccaatgga

SEQ ID NO: 353415 - DNA, 75 bp, Artificial Sequence
  Synthetic
cgactttggcgggatcgccacggtcaagtattcggccagcaagtcaggcaagtgcgcagtccatgtgccatcagg

SEQ ID NO: 353416 - DNA, 75 bp, Artificial Sequence
  Synthetic
gactgctaccctaaaagaagcagcagtcgagctaaccgagcaagggtcggcgaccattcatttctcgaccgcaaa

SEQ ID NO: 353417 - DNA, 75 bp, Artificial Sequence
  Synthetic
gtggctgttttgcaaatcacggatttcatgcctgaccccctatcgcttgactccaaatgcccgcatgcctctgtg

SEQ ID NO: 353418 - DNA, 75 bp, Artificial Sequence
  Synthetic
cacgcccaaacatttacagccgcggtgtcaaaaaccgcgtggacgtggttaacatccctgctgggaggatcggcc

SEQ ID NO: 353419 - DNA, 75 bp, Artificial Sequence
  Synthetic
gtaattattataattggcttagtgctggctactattgtggccatgtacgtgctgaccaaccagaaacataattga

SEQ ID NO: 353420 - DNA, 75 bp, Artificial Sequence
  Synthetic
catgagagaagcccacaccaataactacccaaaatggagaaagttcacgttgacatcgaggaagatagtcccttc

SEQ ID NO: 353421 - DNA, 75 bp, Artificial Sequence
  Synthetic
atcatagatgctgtagtgggcgagaaggcgccctatttctgtggagggtttattttgtgtgactccgtgaccggc

SEQ ID NO: 353422 - DNA, 75 bp, Artificial Sequence
  Synthetic
aaggctgtagaatcaaggtatgaaaccgtaggaacttccatcatagttatggccatgactaccctagctagcagt

SEQ ID NO: 353423 - DNA, 75 bp, Artificial Sequence
  Synthetic
tcaggcaactatcccgcaggtaccctcaattaccacgtgcggtaactactgggagagcatacgacatgaacaccg

SEQ ID NO: 353424 - DNA, 75 bp, Artificial Sequence
  Synthetic
tcccgacgctctgtttaccagggtgtccgaaacaccgacattatctgctgccgagtgcactctgaacgagtgtgt

SEQ ID NO: 353425 - DNA, 75 bp, Artificial Sequence
  Synthetic
agtctttccgtgctcgaatccctgggtgctaatgacacaatcagcatggagtcgtcttcaaacgaaacagctctt

SEQ ID NO: 353426 - DNA, 75 bp, Artificial Sequence
  Synthetic
tatgtatgtgctgaccaaccagaaacataattagaattagcagcgattggcatgctgcttgtaaagttttatcac

SEQ ID NO: 353427 - DNA, 75 bp, Artificial Sequence
  Synthetic
agcagagcaagcgtgccaagtctacgcacatgatgctcagaacagaggagcctatgtcgagatgcacctcccggg

SEQ ID NO: 353428 - DNA, 75 bp, Artificial Sequence
  Synthetic
catgagagaagcccaaaccaataacgtacccaaaatggagaaagttcacgttgatatcgaggaagacagcccctt

SEQ ID NO: 353429 - DNA, 75 bp, Artificial Sequence
  Synthetic
aaacacgcatacctcgagcccaccattcgatctgcagtcccatcagcaattcagaacacgctgcaaaatgtactc

SEQ ID NO: 353430 - DNA, 75 bp, Artificial Sequence
  Synthetic
cctaactccttaccggctaacacctaacgccaggatgccactctgcctggctgtgctttgctgtgctcgcactgc

SEQ ID NO: 353431 - DNA, 75 bp, Artificial Sequence
  Synthetic
tcacttgaagagacagaagttctgtttgtattcattgggtacgatcgcaaggcccgtacgcacaatccttacaag

SEQ ID NO: 353432 - DNA, 75 bp, Artificial Sequence
  Synthetic
caccaagatttcggaaaccatcaattcggctaaacaatacaatcagtgctcaaagacatctcagtgcagagcata

SEQ ID NO: 353433 - DNA, 75 bp, Artificial Sequence
  Synthetic
aatattacagtcggaggacactcaacgacagcagtggtgtatgtgaatggagagactcccgttaatttcaatgga

SEQ ID NO: 353434 - DNA, 75 bp, Artificial Sequence
  Synthetic
aggcagacattcacgggccgccttctgtatccagctcatcctggtccattcctcatgcatccgactttgatgtgg

SEQ ID NO: 353435 - DNA, 75 bp, Artificial Sequence
  Synthetic
tatgtgctgaccaaccagaaacataattagaattagcagcgattggcatgctgcttgtaaagttttattacaaat

SEQ ID NO: 353436 - DNA, 75 bp, Artificial Sequence
  Synthetic
aaatcatgtgcggcaattggcgagccgctttaattagaatttttattttcttttaccataattggatttttgttt

SEQ ID NO: 353437 - DNA, 75 bp, Artificial Sequence
  Synthetic
tatcattgcatctgtccgatgagatgtgcggaagatccggacagattgtacaagtatgcaactaagctgaagaaa

SEQ ID NO: 353438 - DNA, 75 bp, Artificial Sequence
  Synthetic
cggagccatgatgaaatccggaatgttcctcacactgtttgtgaacacagtcattaacatcgtaatcgcaagcag

SEQ ID NO: 353439 - DNA, 75 bp, Artificial Sequence
  Synthetic
ggctaacctgacgttcaagcaacgccgggacgcgccacctgaggggccacccgctaagaaaccgaagagggaggc

SEQ ID NO: 353440 - DNA, 75 bp, Artificial Sequence
  Synthetic
agaaatttctcggttacagagaaaggttgggaatttgtgtggggaaaccatccgcctcaaaggtactggtcccaa

SEQ ID NO: 353441 - DNA, 75 bp, Artificial Sequence
  Synthetic
aacaagaagaagaccaacaagaaaccaggcaagagacagcgcatggtcatgaaactggaatctgacaagacattc

SEQ ID NO: 353442 - DNA, 75 bp, Artificial Sequence
  Synthetic
agttttatcacaaataacgtgcggcaattggcgagccgctttaattagaattttattttcttttttaccataatt

SEQ ID NO: 353443 - DNA, 75 bp, Artificial Sequence
  Synthetic
cccaggataggcagtaacacattggagatcgggctgagaacaagaatcaggaaaatgctagaagagcacaaggag

SEQ ID NO: 353444 - DNA, 75 bp, Artificial Sequence
  Synthetic
ggcaagctgcttacatagaactcgcggcgattggcatgccgctttaaaatttttattttattttcttttcttttc

SEQ ID NO: 353445 - DNA, 75 bp, Artificial Sequence
  Synthetic
gaacgtcctactgacccgcacggaggaccgtatcgtgtggaaaacactagccggcgatccatggataaaaacact

SEQ ID NO: 353446 - DNA, 75 bp, Artificial Sequence
  Synthetic
cctggctgtgctttgctgcgcccgcactgcccgggccgagaccacctgggagtccttggatcacctatggaacaa

SEQ ID NO: 353447 - DNA, 75 bp, Artificial Sequence
  Synthetic
catgaatactggcacactgcgcaattatgatccgcgcataaatctagtacctgtgaacagaagactgcctcatgc

SEQ ID NO: 353448 - DNA, 75 bp, Artificial Sequence
  Synthetic
tttagtcctccaccataatgaacacccacagagtgacttttcttcattcgttagcaaactgaagggcagaactgt

SEQ ID NO: 353449 - DNA, 75 bp, Artificial Sequence
  Synthetic
cgtgacacaccctcagtatcacgcccaaacatttacagccgcggtgtcaaaaaccgcgtggacgtggttaacatc

SEQ ID NO: 353450 - DNA, 75 bp, Artificial Sequence
  Synthetic
ccaaaccaataactacccaaaatggagaaagttcacgttgacatcgaggaagacagccccttcctcagagcatta

SEQ ID NO: 353451 - DNA, 75 bp, Artificial Sequence
  Synthetic
aacaaagtttcggaagttgaaggtgacaaacagttggcagaggcttatgagtccatcgctaaaattgtcaacgat

SEQ ID NO: 353452 - DNA, 75 bp, Artificial Sequence
  Synthetic
caaggatatagcagaaattaatgccatgtggcccgttgcaacggaggccaatgagcaagtatgcatgtatatcct

SEQ ID NO: 353453 - DNA, 75 bp, Artificial Sequence
  Synthetic
attcatccacggaagtacctcgtggaaacaccaccggtggaagagactccggagctgccgacagagaaccaatcc

SEQ ID NO: 353454 - DNA, 75 bp, Artificial Sequence
  Synthetic
gtcagccgagactaactcctacttcgcaaggagcatggagtttctggcgcgaccggtgcctgcgcctcgaacagt

SEQ ID NO: 353455 - DNA, 75 bp, Artificial Sequence
  Synthetic
ccaagaaccccaccttcctaaccacgaggcagctggatggagaaccagcctacacccacgaacttataacccacc

SEQ ID NO: 353456 - DNA, 75 bp, Artificial Sequence
  Synthetic
ctagcgacagcgtatctgtgcggaatccaccgggagctggttaggagattaaatgctgtcctgcttccgaacatc

SEQ ID NO: 353457 - DNA, 75 bp, Artificial Sequence
  Synthetic
gcatttccagcctggggattgtgttctggaaactgacattgcgtcgtttgataaaagtgaggacgacgccatggc

SEQ ID NO: 353458 - DNA, 75 bp, Artificial Sequence
  Synthetic
gaccccctatcgcttgactccaaatgcccgcatgcctttgtgcttagccgtcttgtgctgcgcacgcacagccaa

SEQ ID NO: 353459 - DNA, 75 bp, Artificial Sequence
  Synthetic
cgaaatatcatcaatacatttgcccaccaaaactaaatttaaattcggagccatgatgaaatccggaatgttcct

SEQ ID NO: 353460 - DNA, 75 bp, Artificial Sequence
  Synthetic
ttaggaacaaccattgggacaactcaccgtcacccaacatgtacgggttgaaccatgaagtggtcaggcaactat

SEQ ID NO: 353461 - DNA, 75 bp, Artificial Sequence
  Synthetic
agtgcgcggggacattgccactgccacggaaggagtaatcgtcaatgctgccaacagcaagggccagccaggcag

SEQ ID NO: 353462 - DNA, 75 bp, Artificial Sequence
  Synthetic
ttaacaaagtgtctgaagtggaaggtgacaaacagctggcagaagcgtatgaatctatagccaagattattaatg

SEQ ID NO: 353463 - DNA, 75 bp, Artificial Sequence
  Synthetic
aaggatctaggacagccctttcagtcgtcatgtggaacgagaaaggagtaactgtgaagtatactccggagaact

SEQ ID NO: 353464 - DNA, 75 bp, Artificial Sequence
  Synthetic
gccatatactgcagagacaaaaaatgggaagtgacgttgaaagaggtcgtagccaggagagaagcggtagaggag

SEQ ID NO: 353465 - DNA, 75 bp, Artificial Sequence
  Synthetic
gaattagcagcgattggcatgctgcttgtaaagttttattacaaataacgtgcggcaattggcgagccgctttaa

SEQ ID NO: 353466 - DNA, 75 bp, Artificial Sequence
  Synthetic
gcgaaggacatggcagaaattaacgctatgtggcccaccgctacagaggctaatgagcaggtgtgcttgtacatt

SEQ ID NO: 353467 - DNA, 75 bp, Artificial Sequence
  Synthetic
ctcctgctcagtgccgtatgaagtgaaatttaatcctgtaggcagagaactctatactcatcccccagaacacgg

SEQ ID NO: 353468 - DNA, 75 bp, Artificial Sequence
  Synthetic
gcgcatgatgcacagaacagaggagcttatgtcgagatgcacctcccgggctcagaagtggacagcagtttggtt

SEQ ID NO: 353469 - DNA, 75 bp, Artificial Sequence
  Synthetic
tgcagccacagctggaagagagtcctgagaacacggaacaaccggtggaggaggaagacagtataagcgtgctgt

SEQ ID NO: 353470 - DNA, 75 bp, Artificial Sequence
  Synthetic
caaccagaaacacaactagaattagcagcgattggcatgctgcttgtaaagttttattacaaataacgtgcggca

SEQ ID NO: 353471 - DNA, 75 bp, Artificial Sequence
  Synthetic
aagaagtatttgaaaccatccaataatgtcctattctctgttggctcgaccatctaccacgagaagagggactta

SEQ ID NO: 353472 - DNA, 75 bp, Artificial Sequence
  Synthetic
ctcgaatccctaggtgctaatgacacaatcagtatggagtcgtcctcaaacgaaacagctcttgctttgcggacc

SEQ ID NO: 353473 - DNA, 75 bp, Artificial Sequence
  Synthetic
ttccgatcagtgtcactgaaactgcaccctaagaatcccacatatctgaccactcgccaacttgctgatgagcct

SEQ ID NO: 353474 - DNA, 75 bp, Artificial Sequence
  Synthetic
gcaagctgcttacatagaactcgcggcgattggcatgccgctttaaaatttttattttatttttcttttcttttc

SEQ ID NO: 353475 - DNA, 75 bp, Artificial Sequence
  Synthetic
cactcgccaacttgctgatgagcctcattacacgcacgagctcatatctgaaccagctgttaggaattttaccgt

SEQ ID NO: 353476 - DNA, 75 bp, Artificial Sequence
  Synthetic
aattcgaggccttcgttgcccaacagcaatgacggttcgacgcgggcgcatacattttctcctcggatactggtc

SEQ ID NO: 353477 - DNA, 75 bp, Artificial Sequence
  Synthetic
ataggcagtaacacattggagatcgggctgagaacaagaatcaggaaaatgctagaagagcacaaggagccgtca

SEQ ID NO: 353478 - DNA, 75 bp, Artificial Sequence
  Synthetic
acaactaagagaatcttacagggattaggtcactacctgaaatctgaaggtaaggtggagtgctatcgtacgttg

SEQ ID NO: 353479 - DNA, 75 bp, Artificial Sequence
  Synthetic
ccactccctatcagcataacaccaacaaagatcaagctgatacccacagtgaacttggagtacgtcacctgccac

SEQ ID NO: 353480 - DNA, 75 bp, Artificial Sequence
  Synthetic
gaatattacaaaactgtcaagcccagcgagcacgacggcgaatacctgtatgacatcgacaggaaacagtgcgtc

SEQ ID NO: 353481 - DNA, 75 bp, Artificial Sequence
  Synthetic
cacagcttggacaccctttgaccgcaaaatcgtgcagtatgccggggagatctataattacgattttcctgagta

SEQ ID NO: 353482 - DNA, 75 bp, Artificial Sequence
  Synthetic
tggggcaggacaaccaggagcatttggagacatacaatccagaacagtctcaagctcagatctgtatgccaatac

SEQ ID NO: 353483 - DNA, 75 bp, Artificial Sequence
  Synthetic
actgccacgatagaggaatggcaagcagagcatgatgccatcatgaggcacatcttggagagaccggaccctacc

SEQ ID NO: 353484 - DNA, 75 bp, Artificial Sequence
  Synthetic
caggcgagctggtggatcctcccttccatgaattcgcctacgagagtctgagaacacgaccggccgctccttacc

SEQ ID NO: 353485 - DNA, 75 bp, Artificial Sequence
  Synthetic
atgaccactgaacaatggaacactgtggattatttcgaaacggacaaagctcactcagcagagatagtattgaac

SEQ ID NO: 353486 - DNA, 75 bp, Artificial Sequence
  Synthetic
tgtcagaccagcctgaggctaccttcagagctcggctggatttaggtatcccaggtgacgtgcccaaatacgaca

SEQ ID NO: 353487 - DNA, 75 bp, Artificial Sequence
  Synthetic
tttaaccacgagatttgcacgcaggtcttccacaaaagcatctctcgtcgttgcactaaatctgtgacttcggtc

SEQ ID NO: 353488 - DNA, 75 bp, Artificial Sequence
  Synthetic
tcttccacaaaagcatctctcgtcgttgcactaaatctgtgacttcggtcgtctcaaccttgttttacgacaaaa

SEQ ID NO: 353489 - DNA, 75 bp, Artificial Sequence
  Synthetic
gcgattggcatgccgctttaaaattttattttattttcttttcttttccgaatcggattttgtttttaatatttc

SEQ ID NO: 353490 - DNA, 75 bp, Artificial Sequence
  Synthetic
aaaatggagaaagttcacgttgacatcgaggaagacagcccattcctcagagctttacaacggagcttcccgcag

SEQ ID NO: 353491 - DNA, 75 bp, Artificial Sequence
  Synthetic
ctgaatggactgcgacgtagtcaagtccgccaaaatgtttccttatcaaccaatgtatccaatgcagcccatgcc

SEQ ID NO: 353492 - DNA, 75 bp, Artificial Sequence
  Synthetic
caagtatcctgggaatttcactgccacgatagaggaatggcaagcagagcatgatgccatcatgaggcacatctt

SEQ ID NO: 353493 - DNA, 75 bp, Artificial Sequence
  Synthetic
ctaggagagaagcagtggaggagatatgcatatccgacgactcttcggtgacagaaccggatgcagagctggtga

SEQ ID NO: 353494 - DNA, 75 bp, Artificial Sequence
  Synthetic
gttctcacctaaggtgcctgcgtacattcatccacggaagtacctcgtggaaacaccaccggagactccggagcc

SEQ ID NO: 353495 - DNA, 75 bp, Artificial Sequence
  Synthetic
atgcgtggtcggtggcaagctgtttagaccactgcatgtggagggtaagatcgacaatgacgtgttgtcctccct

SEQ ID NO: 353496 - DNA, 75 bp, Artificial Sequence
  Synthetic
atatccatcatactctaccaactgggccgacgaaaccgtgttaacggctcgtaacataggcctatgcagctccga

SEQ ID NO: 353497 - DNA, 75 bp, Artificial Sequence
  Synthetic
agtggtccgtcagctctcccgcaggtacccacaactgcctcgagcagttgccactggaagagtctatgacatgaa

SEQ ID NO: 353498 - DNA, 75 bp, Artificial Sequence
  Synthetic
cacgggccgccttctgtatccagctcatcctggtccattcctcatgcatccgactttgatgtggacagtttatcc

SEQ ID NO: 353499 - DNA, 75 bp, Artificial Sequence
  Synthetic
cggtcggaagttgccacagccccatagccatagaggcggtaaggagcgaagggcatgatggctatgtacgactcc

SEQ ID NO: 353500 - DNA, 75 bp, Artificial Sequence
  Synthetic
tgctaggtgggcaaaggaatataaggaagatcaagaagatgagaggccactaggactacgagatagacagttagt

SEQ ID NO: 353501 - DNA, 75 bp, Artificial Sequence
  Synthetic
taggactacgagatagacagttagtcatggggtgctgctgggcttttagaaggcacaagataacatctatttata

SEQ ID NO: 353502 - DNA, 75 bp, Artificial Sequence
  Synthetic
cagaagcagataccagtccaggagggtggagaacatgaaagccataacagctagacgtattctgcaaggcctagg

SEQ ID NO: 353503 - DNA, 75 bp, Artificial Sequence
  Synthetic
gcggagcgctgtataagaaattcccggaaagcttcgatttacagccgatcgaagtgggaaaagcgcgactggtca

SEQ ID NO: 353504 - DNA, 75 bp, Artificial Sequence
  Synthetic
gtgcgtgaagccgaggagctgcgcgctgcactaccacctttggcagctgattttgaggagcccactctggaagcc

SEQ ID NO: 353505 - DNA, 75 bp, Artificial Sequence
  Synthetic
tatgccggcgaggacaagatcggctcttacgcagtgctttctccacaggctgtactcaagagtgagaaactatct

SEQ ID NO: 353506 - DNA, 75 bp, Artificial Sequence
  Synthetic
tgcattcaccctctcgctgaacaagtcatagtgataacacactctggccgaaaagggcgttatgccgtggaaccc

SEQ ID NO: 353507 - DNA, 75 bp, Artificial Sequence
  Synthetic
cacacggactaccacacgaggtgattacgcactactatcacaggtatcccatgtccaccattttaggcttatcaa

SEQ ID NO: 353508 - DNA, 75 bp, Artificial Sequence
  Synthetic
atccgaagagttctttggctggaaggaagggctacagcacaagtgatggcaagactttctcatatttggaaggga

SEQ ID NO: 353509 - DNA, 75 bp, Artificial Sequence
  Synthetic
tggtaaattacattactaaattaaaaggaccaaaagctgctgctctttttgcgaagacacataatttgaatatgt

SEQ ID NO: 353510 - DNA, 75 bp, Artificial Sequence
  Synthetic
tacaggacataccaatggacaggtttgtaatggacttaaagagggacgtgaaagtgactccaggaacaaaacata

SEQ ID NO: 353511 - DNA, 75 bp, Artificial Sequence
  Synthetic
aaagtgactccaggaacaaaacatactgaagaacggcccaaggtacaggtgatccaggctgccgatccgctagcg

SEQ ID NO: 353512 - DNA, 75 bp, Artificial Sequence
  Synthetic
ggtgagcgccaagaaagaaaactgcgcagaaataataagggacgtcaagaaaatgaaagggctggacgtcaatgc

SEQ ID NO: 353513 - DNA, 75 bp, Artificial Sequence
  Synthetic
ccacggaagtacctcgtggaaacaccaccggtagaagagactccggagccgccggcagagaaccaatccacagag

SEQ ID NO: 353514 - DNA, 75 bp, Artificial Sequence
  Synthetic
gcagaaataataagggacgtcaagaaaatgaaagggctggacgtcaatgccagaactgtggactcagtgctcttg

SEQ ID NO: 353515 - DNA, 75 bp, Artificial Sequence
  Synthetic
cctggtcgccttttgacaaaaagatcgtgcagtacgccggggaaatctacaactacgactttccggaatatggag

SEQ ID NO: 353516 - DNA, 75 bp, Artificial Sequence
  Synthetic
cacttgtttcagagggtgggtgaagcagttgcaaatagattacaaaggcaacgaaataatgacggcagctgcctc

SEQ ID NO: 353517 - DNA, 75 bp, Artificial Sequence
  Synthetic
catgaggcacatcttggagagaccggaccctaccgacgttttccaaaataaggcgaacgtgtgttgggccaaggc

SEQ ID NO: 353518 - DNA, 75 bp, Artificial Sequence
  Synthetic
cgtaatccattcgcggccccgcgcaggccctggttccccagaaccgacccttttctggcgatgcaggtgcaggaa

SEQ ID NO: 353519 - DNA, 75 bp, Artificial Sequence
  Synthetic
cgttcaagcaacgccgggacgcgccacctgaggggccacccgctaagaaaccgaagagggaggccccgcaaaagc

SEQ ID NO: 353520 - DNA, 75 bp, Artificial Sequence
  Synthetic
ccgaagagggaggccccgcaaaagcaaaaagggggaggccaagggaagaagaagaagaaccaggggaagaagaag

SEQ ID NO: 353521 - DNA, 75 bp, Artificial Sequence
  Synthetic
aaaaagggggaggccaagggaagaagaagaagaaccaggggaagaagaaggctaagacggggccgcctaatccga

SEQ ID NO: 353522 - DNA, 75 bp, Artificial Sequence
  Synthetic
cgtaacccgttcgcggccccgcgcaggccctggttccccagaaccgacccttttctggcgatgcaggtgcaggaa

SEQ ID NO: 353523 - DNA, 75 bp, Artificial Sequence
  Synthetic
aatgaacacccacagagtgacttttcttcattcgtcagcaaactgaagggcagaactgtcttggtggtcggggag

SEQ ID NO: 353524 - DNA, 75 bp, Artificial Sequence
  Synthetic
aagtatactccggagaactgcgagcaatggtcactagtgaccaccatgtgcctgctcgccaatgtgacgttccca

SEQ ID NO: 353525 - DNA, 75 bp, Artificial Sequence
  Synthetic
gacttcctcgcagtatggcctggattcctctggcaacttaaagggaaggaccatgcggtatgacatgcacgggac

SEQ ID NO: 353526 - DNA, 75 bp, Artificial Sequence
  Synthetic
acatacaggaggccaagaacgcggcggatgaggctaaggaagtcaaggaggctgaagagctcagggcagcattac

SEQ ID NO: 353527 - DNA, 75 bp, Artificial Sequence
  Synthetic
ggaatgcgagtgcggcggcacaaagatctccgagaccatcaacaaggcaaaacagttcagccagtgcacaaagaa

SEQ ID NO: 353528 - DNA, 75 bp, Artificial Sequence
  Synthetic
agccaccctaaaaggaaaactacacgtcccattcttgctggcagacggcaaatgcaccgtgcctctagcaccgga

SEQ ID NO: 353529 - DNA, 75 bp, Artificial Sequence
  Synthetic
aatgctgcggatctcaggaatgtactccaacttacaggcctgatgaacagtgcaaagtcttcacaggggtttacc

SEQ ID NO: 353530 - DNA, 75 bp, Artificial Sequence
  Synthetic
tccaacttacaggcctgatgaacagtgcaaagtcttcacaggggtttacccgttcatgtggggaggtgcatattg

SEQ ID NO: 353531 - DNA, 75 bp, Artificial Sequence
  Synthetic
tgcaaccaggactagaatgcctgaaccgatcatcattgaagaggaagaagaggatagtataagtttgctgtcaga

SEQ ID NO: 353532 - DNA, 75 bp, Artificial Sequence
  Synthetic
cttctgtatccagctcatcctggtccattcctcatgcatccgactttgatgtggacagcttatccatccttgaca

SEQ ID NO: 353533 - DNA, 75 bp, Artificial Sequence
  Synthetic
ttcgggcgcgaccggtgcctgcgcctcgaaccgtattcaggaaccctccacatcccgcaccgcgcacaagaacac

SEQ ID NO: 353534 - DNA, 75 bp, Artificial Sequence
  Synthetic
cgccactcgcacacagcagggccagctcgagaactagcctagtttccaccccgccaggcgtgaatagggtgatta

SEQ ID NO: 353535 - DNA, 75 bp, Artificial Sequence
  Synthetic
caaccagaaacataattgaacatagcagcaattggcaagctgcttatatagaactcgcggcgattggcatgccgc

SEQ ID NO: 353536 - DNA, 75 bp, Artificial Sequence
  Synthetic
cccgtcccgcgctcctagcaggtcggcctcaagaactagcctggtctctaacccgccaggcgtaaatagggtgat

SEQ ID NO: 353537 - DNA, 75 bp, Artificial Sequence
  Synthetic
ttaagctgatacccacagtgaacttggagtacgtcacctgccactacaaaacaggaatggattcaccggctatca

SEQ ID NO: 353538 - DNA, 75 bp, Artificial Sequence
  Synthetic
cctggagaaaccggatcccacggatgtcttccaaaacaaagctaatgtttgctgggcaaaggcacttgtacctgt

SEQ ID NO: 353539 - DNA, 75 bp, Artificial Sequence
  Synthetic
tcagtgcaggcgttcctcaacatcacagtgggagaacactctattgtgaccaccgtgtatgtgaatggagaaact

SEQ ID NO: 353540 - DNA, 75 bp, Artificial Sequence
  Synthetic
ttgcaacgtcacgcaaatgagagaattgcccgtattggattcggctgcctttaatgtggaatgcttcaagaaata

SEQ ID NO: 353541 - DNA, 75 bp, Artificial Sequence
  Synthetic
tgcgtgcaataatgaatattgggaaacgtttaaagaaaaccccatcaggcttactgaagaaaatgtggtaaatta

SEQ ID NO: 353542 - DNA, 75 bp, Artificial Sequence
  Synthetic
agcattggttacggctatgcggaccgggccagtgaaagcatcattggagcagttgctcggcagttcaagttctcg

SEQ ID NO: 353543 - DNA, 75 bp, Artificial Sequence
  Synthetic
gctactattgtggccatgtacgtgctgaccaaccagaaacataattgaacatagcagcaattggcaagctgctta

SEQ ID NO: 353544 - DNA, 75 bp, Artificial Sequence
  Synthetic
gcggggacatagccactgccacggaaggagtaattgtcaatgctgccaacagcaagggccaaccaggcagtggag

SEQ ID NO: 353545 - DNA, 75 bp, Artificial Sequence
  Synthetic
tggcaagctgcttatatagaactcgcggcgattggcatgccgctttaaaattttattttattttcttttcttttc

SEQ ID NO: 353546 - DNA, 75 bp, Artificial Sequence
  Synthetic
gcagagtgttaagagagcggctaaccggatcaccatgtgcagcattcattggagatgacaatatcgtgaaaggag

SEQ ID NO: 353547 - DNA, 75 bp, Artificial Sequence
  Synthetic
ttcacccaaagagctctttggctggaaggaaaggctacagcactagtgacgggaagactttctcatatcttgaag

SEQ ID NO: 353548 - DNA, 75 bp, Artificial Sequence
  Synthetic
atgcaggtgcaggaattaacccgctcgatggctaacctgacgttcaagcaacgccgggacgcgccacctgagggg

SEQ ID NO: 353549 - DNA, 75 bp, Artificial Sequence
  Synthetic
ctctcctaaagtacctgagtatatacaccctagaaagtatcttgcagacgcagcttccgcgagcaatgaggcagc

SEQ ID NO: 353550 - DNA, 75 bp, Artificial Sequence
  Synthetic
aatgaaggagctcgccgccgtcatgagcgaccctgacctggaaactgagactatgtgcctccacgacgacgagtc

SEQ ID NO: 353551 - DNA, 75 bp, Artificial Sequence
  Synthetic
agcatggagtcgtcctcaaacgaaacagctctcgctttgcggaccatttttaggactccacccattccaaggcct

SEQ ID NO: 353552 - DNA, 75 bp, Artificial Sequence
  Synthetic
cgacgttatggagcggtcacgtagagggatgtccattcttaggaagaagtatttgaaaccatccaacaatgtcct

SEQ ID NO: 353553 - DNA, 75 bp, Artificial Sequence
  Synthetic
cgagtgcagagtacatccacagacgtggacagtatttcagcactcgagtcttgtgacagcaccagcgatgcgcgt

SEQ ID NO: 353554 - DNA, 75 bp, Artificial Sequence
  Synthetic
agtgctatcgtacgttgcaccccgttcctttgtattcagcaagtgtgaatagagcgttctccagtcccaaagttg

SEQ ID NO: 353555 - DNA, 75 bp, Artificial Sequence
  Synthetic
gccgatgttgacttgatgttacaagaggctggggccggctcagtggagacacctcgtggcttgataaaggttacc

SEQ ID NO: 353556 - DNA, 75 bp, Artificial Sequence
  Synthetic
cagtcaccgtgacacctcctgtcgggactagcgccttggtggaatgcaagtgcggcggcacaaagatctccgaaa

SEQ ID NO: 353557 - DNA, 75 bp, Artificial Sequence
  Synthetic
ttagattgaccgaggaaaatgtggtcaactacataaccaaactaaaagggccgaaggcggctgccctgtatgcaa

SEQ ID NO: 353558 - DNA, 75 bp, Artificial Sequence
  Synthetic
agttcgtaaacaggtacctgcaccatattgccacacatggaggagcgctgaacacagatgaagaatattacaaaa

SEQ ID NO: 353559 - DNA, 75 bp, Artificial Sequence
  Synthetic
gcctctagcaccggaacctatgataaccttcggtttccgatcagtgtcactgaaactgcaccctaagaatcccac

SEQ ID NO: 353560 - DNA, 75 bp, Artificial Sequence
  Synthetic
ttggcaagctgcttacatagaactcgcggcgattggcatgccgctttaaaatttttattttatttttcttttctt

SEQ ID NO: 353561 - DNA, 75 bp, Artificial Sequence
  Synthetic
accacagataccctatgtccaccatcctgggtttgtcaatttgcgccgccattgtaaccgtttccgttgcagcgt

SEQ ID NO: 353562 - DNA, 75 bp, Artificial Sequence
  Synthetic
ggccgataggtgcgctacatggctgaacatggaagtcaagatcatcgatgcagtggtcggcgagaaagctcccta

SEQ ID NO: 353563 - DNA, 75 bp, Artificial Sequence
  Synthetic
acaataaccaacagatgttctggattcaattgctgatccctctggccgccttgattgtagtgactcgcctgctca

SEQ ID NO: 353564 - DNA, 75 bp, Artificial Sequence
  Synthetic
aacgacgaacccgaaagagactaagattgagattgacactactggcagtaccaaaccaaagcaggacgatctcat

SEQ ID NO: 353565 - DNA, 75 bp, Artificial Sequence
  Synthetic
ggctacgcgccactccctatcagcataacaccaacaaagatcaagctgatacccacagtgaacttggagtacgtc

SEQ ID NO: 353566 - DNA, 75 bp, Artificial Sequence
  Synthetic
aaagtagtggtgccagagggacatgcaatacccgtccaggactttcaagctctgagtgaaagtgccaccatcgtg

SEQ ID NO: 353567 - DNA, 75 bp, Artificial Sequence
  Synthetic
gggaggtgcatattgcttttgcgacactgagaatactcaggtcagcaaggcctacgtaatgaaatctgacgactg

SEQ ID NO: 353568 - DNA, 75 bp, Artificial Sequence
  Synthetic
caagcaacggcgagacgtgccgcccgagggtccaccggctaagaagaagaagaaggataactcgcaacaaggtgg

SEQ ID NO: 353569 - DNA, 75 bp, Artificial Sequence
  Synthetic
ggagcatttggagacatacaatccagaacagtctcaagctcagatctgtatgccaataccaacctagtgctgcag

SEQ ID NO: 353570 - DNA, 75 bp, Artificial Sequence
  Synthetic
tgcacccactgttccgttatccattaggaataatcactgggataattccccgtcgcctaacatgtacgggttgaa

SEQ ID NO: 353571 - DNA, 75 bp, Artificial Sequence
  Synthetic
gcggccgaatgcactcttaacgagtgcgtgtattcatccgactttggcgggatcgccacggtcaagtattcggcc

SEQ ID NO: 353572 - DNA, 75 bp, Artificial Sequence
  Synthetic
ttggcaagctgcttatatagaacttgcggcgattggcatgccgctttaaaattttattttattttcttttctttt

SEQ ID NO: 353573 - DNA, 75 bp, Artificial Sequence
  Synthetic
ccataactatggaatttaagaaagaatcggtcacccattcttgctctgtgccctacgaagtaaagtttaatcctg

SEQ ID NO: 353574 - DNA, 75 bp, Artificial Sequence
  Synthetic
ggatgcgcaccctcatatcatgtggtgcgaggggatattgccacggccaccgaaggagtgatcataaatgctgct

SEQ ID NO: 353575 - DNA, 75 bp, Artificial Sequence
  Synthetic
gaaaagcgcgactggtcaaaggtgcagctaaacatatcattcatgccgtagggcccaacttcaacaaagtttcgg

SEQ ID NO: 353576 - DNA, 75 bp, Artificial Sequence
  Synthetic
ccctacgaagtaaagtttaatcctgtgggaagagaactgtacacacacccaccagagcacggagctgaacaacct

SEQ ID NO: 353577 - DNA, 75 bp, Artificial Sequence
  Synthetic
gttgatatcgaggaagacagccccttcctcagagcattacaacggagcttcccgcagtttgaggtagaagccaag

SEQ ID NO: 353578 - DNA, 75 bp, Artificial Sequence
  Synthetic
tcctcagagcattacaacggagcttcccgcagtttgaggtagaagccaagcaggtcacggataacgaccatgcta

SEQ ID NO: 353579 - DNA, 75 bp, Artificial Sequence
  Synthetic
gcgcatgagagaagcccaaacaataactacccaaaatggagaaagttcacgttgatatcgaggaagacagcccct

SEQ ID NO: 353580 - DNA, 75 bp, Artificial Sequence
  Synthetic
cgactaacccaatcattgaaccatttgctgacagctttagacaccaccgatgcagatgtagccatatactgcagg

SEQ ID NO: 353581 - DNA, 75 bp, Artificial Sequence
  Synthetic
tcgaagagtcggaagcctccacaccacctagcacgctgccttgcttgtgcatccatgctatgactccagaaagag

SEQ ID NO: 353582 - DNA, 75 bp, Artificial Sequence
  Synthetic
gtgaatagggtgattactagagaggagctcgaggcgcttaccccgtcccgcgctcctagcaggtcggcctcaaga

SEQ ID NO: 353583 - DNA, 75 bp, Artificial Sequence
  Synthetic
aactcttacttcgcaaggagcatggagtttctggcgcgaccggtgcctgcgcctcgaacagtattcaggaaccct

SEQ ID NO: 353584 - DNA, 75 bp, Artificial Sequence
  Synthetic
cagcgattggcatgctgcttgtaaagttttattacaaataacgtgcggcaattggcgagccgctttaattagaat

SEQ ID NO: 353585 - DNA, 75 bp, Artificial Sequence
  Synthetic
ggttaggagattaaatgctgtcctgcttccgaacatccatacactgtttgacatgtcggctgaagactttgacgc

SEQ ID NO: 353586 - DNA, 75 bp, Artificial Sequence
  Synthetic
cgggaccattgaagagataccactacatcaagtgtcactccacacatctcgcccgtgtcacattgtggatgggca

SEQ ID NO: 353587 - DNA, 75 bp, Artificial Sequence
  Synthetic
cgactgcagaatgacaagtgggtgtataattctgacaaactgcccaaagcagcgggagccaccctaaaaggaaaa

SEQ ID NO: 353588 - DNA, 75 bp, Artificial Sequence
  Synthetic
tcggcagttcaagttctcgagggtgtgcaaaccaaaggtgtctaaggaggagactgaagtgctatttgtcttcat

SEQ ID NO: 353589 - DNA, 75 bp, Artificial Sequence
  Synthetic
gcacgtggaaggcaagattgacaacgacgttctggccgcacttaagacgaagaaagcatccaaatatgatcttga

SEQ ID NO: 353590 - DNA, 75 bp, Artificial Sequence
  Synthetic
caagctcagatctgtatgccaataccaacctagtgctgcagagacccaaagcaggagcgatccatgtgccataca

SEQ ID NO: 353591 - DNA, 75 bp, Artificial Sequence
  Synthetic
tctaccgaggagctgtttaaggagtataagctaacgcgcccttacatggccagatgcatcagatgtgccgttggg

SEQ ID NO: 353592 - DNA, 75 bp, Artificial Sequence
  Synthetic
aacatcggtggacgtgcaaccacaggtggaagagagtcctgagaacacggaacaaccggtggaggaggaagacgg

SEQ ID NO: 353593 - DNA, 75 bp, Artificial Sequence
  Synthetic
cagccagtgcacaaagaaggagcagtgcagagcatatcgactgcagaatgacaaatgggtgtataattctgacaa

SEQ ID NO: 353594 - DNA, 75 bp, Artificial Sequence
  Synthetic
tccacccattccaaggcctcgagtgcagagtacatccacagacgtggacagtatttcagcactcgagtcttgcga

SEQ ID NO: 353595 - DNA, 75 bp, Artificial Sequence
  Synthetic
cgccgaaaaggttttgggcacaggaaacagcacccggaaatccacatgggctgccgcacgaggtgataactcatt

SEQ ID NO: 353596 - DNA, 75 bp, Artificial Sequence
  Synthetic
cagcaccagcgatgcgcgtagcataggatcgtcctctgaaaccgatgcatcaatttttgacaaggggttggagtt

SEQ ID NO: 353597 - DNA, 75 bp, Artificial Sequence
  Synthetic
cgtccacctggctgttttgcaaatccagagtttcgtgcctaactccttaccggctaacacctaacgccaggatgc

SEQ ID NO: 353598 - DNA, 75 bp, Artificial Sequence
  Synthetic
caaaaatcagtaaggcagacagtgttgtctgaagtggtgctagagaggaccgagttagagatctcgtatgccccg

SEQ ID NO: 353599 - DNA, 75 bp, Artificial Sequence
  Synthetic
aggaaatgaaataatgaccgcggctgcctcacagggactgacgcggaaaggtgtctatgcagttaggtacaaggt

SEQ ID NO: 353600 - DNA, 75 bp, Artificial Sequence
  Synthetic
gatgttcttgactctgtttgtcaacactgtgatcaacatggtcatagccagcagagttttgcgggagagactgac

SEQ ID NO: 353601 - DNA, 75 bp, Artificial Sequence
  Synthetic
gcagcaattggcaagctgcttatatagaactcgcggcgattggcatgccgctttaaaattttattttattttctt

SEQ ID NO: 353602 - DNA, 75 bp, Artificial Sequence
  Synthetic
gcgaacaatgaggcagccgaatcaacatcggtggacgtgcagccacagctggaagagagtcctgagaacacggaa

SEQ ID NO: 353603 - DNA, 75 bp, Artificial Sequence
  Synthetic
catcggtggacgtgcagccacagctggaagagagtcctgagaacacggaacaaccggtggaggaggaagacagta

SEQ ID NO: 353604 - DNA, 75 bp, Artificial Sequence
  Synthetic
acaccaagtgcaccaagtggaggctgaagtacaccgcttcagcgcaagtgttcaatcctcgtcctggtccattcc

SEQ ID NO: 353605 - DNA, 75 bp, Artificial Sequence
  Synthetic
gagtacatccacagacgtggacagtatttcagcacttgattcttgcgacagcgccagcgatgcgcgtagcatagg

SEQ ID NO: 353606 - DNA, 75 bp, Artificial Sequence
  Synthetic
taaagcatcgggagaaactctcaaaggcaaactgcatgtgcccttcgtactgaccgaagcaaaatgcacagtacc

SEQ ID NO: 353607 - DNA, 75 bp, Artificial Sequence
  Synthetic
atgctcagcgtcaacgtggacaacccgggctacgacgaactgctagaagcagctgttaagtgcccaggaagaaaa

SEQ ID NO: 353608 - DNA, 75 bp, Artificial Sequence
  Synthetic
cccgcacggaggaccgcatcgtgtggaaaacattagccggtgacccatggataaaaacactgacggccaagtatc

SEQ ID NO: 353609 - DNA, 75 bp, Artificial Sequence
  Synthetic
ataacccaccctgtagtgagaaatttctcggttacagagaaaggttgggaatttgtgtggggaaaccatccgcct

SEQ ID NO: 353610 - DNA, 75 bp, Artificial Sequence
  Synthetic
atgaacaatggaagaaagacaaaccaccatctctcaagttcacagccccttttggttgtgaaatttacaccaacc

SEQ ID NO: 353611 - DNA, 75 bp, Artificial Sequence
  Synthetic
tgttacgtgcaaaggggattgtcaccctccgaaagatcatattgtgacgcatccccaataccacgcccagtcatt

SEQ ID NO: 353612 - DNA, 75 bp, Artificial Sequence
  Synthetic
gaagcatacaaagcgcacacagcctcagtgcaggcattcctcaacatcacagtgggagaacattccatcgtgacc

SEQ ID NO: 353613 - DNA, 75 bp, Artificial Sequence
  Synthetic
acaagaaatgggaaatgactctcaaggaagcagtggccaggagagaagcagtggaggagatatgcatctctgacg

SEQ ID NO: 353614 - DNA, 75 bp, Artificial Sequence
  Synthetic
attcatcggtgacagaaccagatgcggagctggtgagagtgcatccgaagagttctttggcaggaaggaaaggct

SEQ ID NO: 353615 - DNA, 75 bp, Artificial Sequence
  Synthetic
catgagagaagcccaaaccaataactacccaaaatggagaaagttcacgttgacatcgaggaagacagccccttc

SEQ ID NO: 353616 - DNA, 75 bp, Artificial Sequence
  Synthetic
attgaagaagaagaagaggatagcataagcttgctgtcagacggcccgacccaccaggtgctgcaagtcgaggca

SEQ ID NO: 353617 - DNA, 75 bp, Artificial Sequence
  Synthetic
taagcttgctgtcagacggcccgacccaccaggtgctgcaagtcgaggcagacattcatgggccgccttcagcat

SEQ ID NO: 353618 - DNA, 75 bp, Artificial Sequence
  Synthetic
aggaccaggatcagaaaactactggaggaacctgtggacagaccaccactgattaccgccgacgacatacaggag

SEQ ID NO: 353619 - DNA, 75 bp, Artificial Sequence
  Synthetic
aaagataaggccccatcattgaaatttacagccccttttggatgtgaaatatatacaaaccccattcgcgccgaa

SEQ ID NO: 353620 - DNA, 75 bp, Artificial Sequence
  Synthetic
gtacctcgtggaaacaccaacggtagaagaaactccggagcccccggcagagaaccaacccacagaggggacacc

SEQ ID NO: 353621 - DNA, 75 bp, Artificial Sequence
  Synthetic
ggtgagtacttatatgacattgacaagaaacagtgtgtgaagaaagaactggtttcgggactaggtttgacagga

SEQ ID NO: 353622 - DNA, 75 bp, Artificial Sequence
  Synthetic
gaacttgtcgatccccccttccatgaatttgcatatgaaagcttgaggacacgtccggctgcaccttatcaagta

SEQ ID NO: 353623 - DNA, 75 bp, Artificial Sequence
  Synthetic
ccaaagcaatgcggcttctttaacatgatgtgcttaaaagtgcacttcaaccatgaaatctgcactcaagtcttc

SEQ ID NO: 353624 - DNA, 75 bp, Artificial Sequence
  Synthetic
attccaagcataaataccactgcatctgtccgatgaaatgtgcagaagatccggacagactgtttaagtatgcag

SEQ ID NO: 353625 - DNA, 75 bp, Artificial Sequence
  Synthetic
gaaattgctggttgggctcaaccagcgaatagtcgtaaacggtcgcactcaaaggaatactaacacaatgaagaa

SEQ ID NO: 353626 - DNA, 75 bp, Artificial Sequence
  Synthetic
ctatctattacccgtcgtagcacaagcatttgctagatgggctaaagaatacaaagaagaccaagaagatgaaag

SEQ ID NO: 353627 - DNA, 75 bp, Artificial Sequence
  Synthetic
tccaatcctcgtcctggtccattccacgtgcatccgactttgatgtcgagagtcccgtgctcgaatccctaggtg

SEQ ID NO: 353628 - DNA, 75 bp, Artificial Sequence
  Synthetic
gtcctcaaacgaaacagctcttgctttgcggaccatttttaggactccacccattccaaggcctcgagtgcagag

SEQ ID NO: 353629 - DNA, 75 bp, Artificial Sequence
  Synthetic
ccagcgatgcgcgtagcataggatcgtcctcggacgaaaccgatgtttccatctttgacaaagggttggagtttc

SEQ ID NO: 353630 - DNA, 75 bp, Artificial Sequence
  Synthetic
caagcagtactgcgaagtgaaaaactgacgtgcattcacccgcttgcagagcaagtaatcgtaatcacacactct

SEQ ID NO: 353631 - DNA, 75 bp, Artificial Sequence
  Synthetic
tgcatcctttgtctagcagatcaagctcgcgctctagcctggcgtctaatccaccgggtgttaaccgagtgatca

SEQ ID NO: 353632 - DNA, 75 bp, Artificial Sequence
  Synthetic
gccacagaacatgcgggccgatacattcaagtacacccatgagaaaccccaaggctactacagttggcaccacgg

SEQ ID NO: 353633 - DNA, 75 bp, Artificial Sequence
  Synthetic
aagaaacacgcataccttgagcccaccattcggtctgcagtcccatcagcaattcagaacacgctgcagaatgta

SEQ ID NO: 353634 - DNA, 75 bp, Artificial Sequence
  Synthetic
actccagacttcctcacagtatggcctggattcttccggcaacttaaagggcaggaccatgcggtatgacatgca

SEQ ID NO: 353635 - DNA, 75 bp, Artificial Sequence
  Synthetic
gcaggaccatgcggtatgacatgcacgggaccattgaagagataccactacatcaagtgtcacttcatacatctc

SEQ ID NO: 353636 - DNA, 75 bp, Artificial Sequence
  Synthetic
ccggaggaacttgtgtgagcattggttacggctatgcggaccgggccagtgaaagcatcattggtgcagttgctc

SEQ ID NO: 353637 - DNA, 75 bp, Artificial Sequence
  Synthetic
acattcccaattatgctggaaggaaagattaacggctacgcttgcgtggtcggagggaagttattcaggccgatg

SEQ ID NO: 353638 - DNA, 75 bp, Artificial Sequence
  Synthetic
atagccactgccacggaaggagtaatcgtcaatgctgctaacagcaagggccagccaggcagtggtgtgtgcgga

SEQ ID NO: 353639 - DNA, 75 bp, Artificial Sequence
  Synthetic
cagaaattaacgctatgtggcctaccgctacagaggctaatgagcaggtgtgcttatacattctgggtgaaagta

SEQ ID NO: 353640 - DNA, 75 bp, Artificial Sequence
  Synthetic
gctgccatagtccaatagcaattgaggcagtgaagagcgacgggcacgacggctatgttagactccagacttcct

SEQ ID NO: 353641 - DNA, 75 bp, Artificial Sequence
  Synthetic
gcgaacaatgaggcagccgtatcaacattggcggacgtgcaaccacaggtggaagagagagaacacggagcaacc

SEQ ID NO: 353642 - DNA, 75 bp, Artificial Sequence
  Synthetic
aagtgcaccaagtggaggctgaagtgtaccgcttcagcgcaagtgctcaatcctcgtcctggtccattccacgtg

SEQ ID NO: 353643 - DNA, 75 bp, Artificial Sequence
  Synthetic
agcgatgcgcgtagcatagatcgtcctctgaaaccgatgtatccatctttgacaaagggctggagttcctggcta

SEQ ID NO: 353644 - DNA, 75 bp, Artificial Sequence
  Synthetic
atggtggacggtgcatcatgttgcttggatacggcgagtttttgccctgccaagttgcgtagttttccaaagaaa

SEQ ID NO: 353645 - DNA, 75 bp, Artificial Sequence
  Synthetic
caagctgctcatatagaatttgcggcgattggcatgccgcttttaaaatttttattttattttttcttttctttt

SEQ ID NO: 353646 - DNA, 75 bp, Artificial Sequence
  Synthetic
ggcgcgtgagagaagcccaaaccaattacctacccaaaatggagaaagttcacgttgacatcgaggaagacagcc

SEQ ID NO: 353647 - DNA, 75 bp, Artificial Sequence
  Synthetic
gaacacgctgcagaatgtactcgcagctgccacaaagagaaactgcaatgtgactcaaatgagggaactgcctgt

SEQ ID NO: 353648 - DNA, 75 bp, Artificial Sequence
  Synthetic
ttacctacccaaaatggagaaagttcacgttgacatcgaggaagacagcccattcctcagagctttgcaacggag

SEQ ID NO: 353649 - DNA, 75 bp, Artificial Sequence
  Synthetic
gcttatcaatctgtgcggcgatagtgacgacatccattgcagcatccgtatggcttttttgcaaatcacggattt

SEQ ID NO: 353650 - DNA, 75 bp, Artificial Sequence
  Synthetic
caatatggtcatagccagcagagttttgcgggagagactgacaaactccccttgcgccgcgttcattggcgacga

SEQ ID NO: 353651 - DNA, 75 bp, Artificial Sequence
  Synthetic
taatatcgtgaaaggggttaagtccgacaaactcatggccgataggtgcgctacatggctgaacatggaagtcaa

SEQ ID NO: 353652 - DNA, 75 bp, Artificial Sequence
  Synthetic
gatcatcgacgcagtggttggtgagaaagctccctacttctgcggtgggtttattctatgtgactctgtgaccgg

SEQ ID NO: 353653 - DNA, 75 bp, Artificial Sequence
  Synthetic
gcgcatatagaatttgcggcgattggcatgccgctttaaaatttttattttattttcttttcttttccgaatcgg

SEQ ID NO: 353654 - DNA, 75 bp, Artificial Sequence
  Synthetic
aaaccatcatcaaagtgaacagcgatttccactcattcgtgctgcccagaataggcagtaacacgttggagatcg

SEQ ID NO: 353655 - DNA, 75 bp, Artificial Sequence
  Synthetic
ccgacccctttttagcgatgcaggtgcaagagctggcacggtccatggccaacttgacgttcaagcaacggcgag

SEQ ID NO: 353656 - DNA, 75 bp, Artificial Sequence
  Synthetic
aatgcttcaagaaatatgcatgcaataatgaatattgggaaacgtttaaagaaaaccccatcaggcttactgaag

SEQ ID NO: 353657 - DNA, 75 bp, Artificial Sequence
  Synthetic
gaaagaaaaagaataagctagtaaagaaaaagaagaagacagggccgccacccccaaaacccaacggcagcaaaa

SEQ ID NO: 353658 - DNA, 75 bp, Artificial Sequence
  Synthetic
ttgcaagaggctggggccggctcggtggagacaccgcgtggcttgataaaggttaccagctacgccggcgaggat

SEQ ID NO: 353659 - DNA, 75 bp, Artificial Sequence
  Synthetic
aagctgggctcctatgctgtgctttccccgcaggctgtactcaagagtgaaaaactatcttgtatccaccccctc

SEQ ID NO: 353660 - DNA, 75 bp, Artificial Sequence
  Synthetic
tatgatctggagtacgctgacgtgccgcagagcatgcgcgcagacacatttaaatacactcatgaaaaaccccag

SEQ ID NO: 353661 - DNA, 75 bp, Artificial Sequence
  Synthetic
cctatagcaattgaggcagtgaagagcgacgggcacgacggctatgtcagactccagacttcctcacagtatggc

SEQ ID NO: 353662 - DNA, 75 bp, Artificial Sequence
  Synthetic
aagacctggtggtgagcgctaagaaagaaaactgtgcagaaatcataagggacgtcaagaaaataaaagggttgg

SEQ ID NO: 353663 - DNA, 75 bp, Artificial Sequence
  Synthetic
aagcttttgcttgtcatgcgggcactcttagagcgctcatagccatcatcagaccaaaaaaggcagtgctctgcg

SEQ ID NO: 353664 - DNA, 75 bp, Artificial Sequence
  Synthetic
gcaagctgctcatatagaatttgcggcgattggcatgccgcttttaaaatttttattttattttttcttttcttt

SEQ ID NO: 353665 - DNA, 75 bp, Artificial Sequence
  Synthetic
taaaggcgtgtatgccgttcggtacaaggtgaatgaaaaccctctgtacgcacccacctcagaacatgtgaacgt

SEQ ID NO: 353666 - DNA, 75 bp, Artificial Sequence
  Synthetic
aagtggaatgcgaatgtggcggcaccaagatttcagaaaccatcaattctgctaagcaatacagtcagtgctcta

SEQ ID NO: 353667 - DNA, 75 bp, Artificial Sequence
  Synthetic
tggctctgacggcactgatgatcctggaagacctcggggtggacccagagctgttgaccctaatcgaagcggcat

SEQ ID NO: 353668 - DNA, 75 bp, Artificial Sequence
  Synthetic
agacatctcagtgcagggcataccgtacacagaatgacaaatgggtgtacaattcggacaaactgcctaaagcat

SEQ ID NO: 353669 - DNA, 75 bp, Artificial Sequence
  Synthetic
ggagagaccggaccccaccgacgtcttccaaaacaaggcgaacgtgtgctgggccaaggctctggtgccggtact

SEQ ID NO: 353670 - DNA, 75 bp, Artificial Sequence
  Synthetic
gggccaaggctctggtgccggtactgaagactgcaggtatagacatgaccactgaacaatggaacactgtggatt

SEQ ID NO: 353671 - DNA, 75 bp, Artificial Sequence
  Synthetic
atgaacaccggtaccttgcgcaattatgatccgcgcataaatttcgtaccggtgaaccgtcgtctaccacatgct

SEQ ID NO: 353672 - DNA, 75 bp, Artificial Sequence
  Synthetic
aaccacaggtggaagagagtcctgagaacacggaacaaccggtggaggaggaagacggtataagcgtgctgtctg

SEQ ID NO: 353673 - DNA, 75 bp, Artificial Sequence
  Synthetic
agtgatcataaatgctgctaacagcaagggacaacctggcggaggggtgtgcggagcgctgtacaaaaaattccc

SEQ ID NO: 353674 - DNA, 75 bp, Artificial Sequence
  Synthetic
cagcagtggtgtatgtgaatggagagactcccgttaattttaatggagtgaagctgaccgcgggtcctctgtcca

SEQ ID NO: 353675 - DNA, 75 bp, Artificial Sequence
  Synthetic
cgtggatagtatctcagcactcgagtcttgtgacagcaccagcgatgcgcgtagcatagactcggatgaaaccga

SEQ ID NO: 353676 - DNA, 75 bp, Artificial Sequence
  Synthetic
gatcgtgcagtacgccggggaaatctataactatgactttccggaatatggagccggccacgcaggagcgtttgg

SEQ ID NO: 353677 - DNA, 75 bp, Artificial Sequence
  Synthetic
gagttcctggccagacctgttcccgcaccgcgaaccaaatttaggactccacccgtcccgaaaccgcgtgcgcgg

SEQ ID NO: 353678 - DNA, 75 bp, Artificial Sequence
  Synthetic
tataactatgactttccggaatatggagccggccacgcaggagcgtttggtgacatccaggctaggacgatatct

SEQ ID NO: 353679 - DNA, 75 bp, Artificial Sequence
  Synthetic
aggccattacatcctttgtctagtagatcaagctcgcgctctagcctggcgtctaatccaccaggtgttaaccga

SEQ ID NO: 353680 - DNA, 75 bp, Artificial Sequence
  Synthetic
accttgtgctgcagagaccaaaagccggagcgatccatgtcccgtacacccaggccccatcggggtatgaacaat

SEQ ID NO: 353681 - DNA, 75 bp, Artificial Sequence
  Synthetic
atccgatgattcatcggtgacagaaccggatgcggagctggtgagggtgcatccgaagagttctttggcaggaag

SEQ ID NO: 353682 - DNA, 75 bp, Artificial Sequence
  Synthetic
gtccatcgctaaaattgtcaacgataacaattataagtcagtagcgattccactgttgtccaccggcatcttttc

SEQ ID NO: 353683 - DNA, 75 bp, Artificial Sequence
  Synthetic
cggtgaaagcatgagcagcattaggtcgaaatgccccgtcgaagagtcggaagcctccacaccacctagcacgct

SEQ ID NO: 353684 - DNA, 75 bp, Artificial Sequence
  Synthetic
aaggaaaattttccgacagtggcgtcgtactgcataatacctgagtacgacgcctacttggacatggtggacggt

SEQ ID NO: 353685 - DNA, 75 bp, Artificial Sequence
  Synthetic
gcatcatgttgcttggatacagcgagtttttgccctgccaagctgcgtagcttcccaaagaaacatgcataccta

SEQ ID NO: 353686 - DNA, 75 bp, Artificial Sequence
  Synthetic
acagaggggacacctgaacaaccagcacttgtaaacgtggatgcaaccaggactagaacgcctgaaccgatcatc

SEQ ID NO: 353687 - DNA, 75 bp, Artificial Sequence
  Synthetic
gttagccactgttgtggctatgtatgtgctgaccaaccagaaacataattagaattagcagcgattggcatgctg

SEQ ID NO: 353688 - DNA, 75 bp, Artificial Sequence
  Synthetic
gagcccaccattcggtccgcagtcccatccgcgattcagaacacgctgcagaatgtactagcggctgccacaaag

SEQ ID NO: 353689 - DNA, 75 bp, Artificial Sequence
  Synthetic
agagggaacacctgaacaatcggcacctataaccgtggatgaaaccagaactagaacgcccgaaccaattatcat

SEQ ID NO: 353690 - DNA, 75 bp, Artificial Sequence
  Synthetic
acccaaagtgcctgcatacatccatccacggaagtatctcgtggaaacaccaccggtagacgagaaccgatccac

SEQ ID NO: 353691 - DNA, 75 bp, Artificial Sequence
  Synthetic
tgaagaagaagaagaggatagtataagcttgctgtcagatggcccgacccaccaggtgctgcaagtcgaggcaga

SEQ ID NO: 353692 - DNA, 75 bp, Artificial Sequence
  Synthetic
ccacgcacaagaacaccgtcacttgcacccagcagggccagctcgagaactagcctagtttccaccccgccaggc

SEQ ID NO: 353693 - DNA, 75 bp, Artificial Sequence
  Synthetic
taaaaaggctgtttaagcttggcaaacctctggcagcagacgatgaacatgacgatgacaggagaagggcattac

SEQ ID NO: 353694 - DNA, 75 bp, Artificial Sequence
  Synthetic
gcgtgaatcgtgccttttcaagccccaaggtcgcagtggaagcctgcaacgccatgttgaaagaaaactttccga

SEQ ID NO: 353695 - DNA, 75 bp, Artificial Sequence
  Synthetic
gccatgttgaaagaaaactttccgaccgtggcttcttactgcattatcccggagtacgatgcctatttggacatg

SEQ ID NO: 353696 - DNA, 75 bp, Artificial Sequence
  Synthetic
gttgacggcgcttcatgttgcttagacaccgccagtttttgccctgcaaagctgcgcagctttccaaagaaacat

SEQ ID NO: 353697 - DNA, 75 bp, Artificial Sequence
  Synthetic
ggtttgtaatggatttgaagagagatgtgaaagtgactccaggaacaaaacatactgaggaacgaccaaaggtac

SEQ ID NO: 353698 - DNA, 75 bp, Artificial Sequence
  Synthetic
tccttgagcggcagttcagtcaccgtgacacctcctgctgggactagcgccctggtggaatgcgagtgcggcggc

SEQ ID NO: 353699 - DNA, 75 bp, Artificial Sequence
  Synthetic
gcctatgcagctccgacgttatggagcggtcacgtagagggatgtccattcttaggaagaagtatttgaaaccat

SEQ ID NO: 353700 - DNA, 75 bp, Artificial Sequence
  Synthetic
gggcaaagcgtccaagtggagtgcgaatgtggtggcaccaagatctctgaaaccatcaattctgctaagcaatac

SEQ ID NO: 353701 - DNA, 75 bp, Artificial Sequence
  Synthetic
cgggagccactctaaaaggaaaattacatgtcccattcttgctggcagacggcaaatgcaccgtgcctctagcac

SEQ ID NO: 353702 - DNA, 75 bp, Artificial Sequence
  Synthetic
aaacaccaccggtggaagagactccggagctgccgacagagaaccaatccacagggacacctgaacaaccagcac

SEQ ID NO: 353703 - DNA, 75 bp, Artificial Sequence
  Synthetic
tccctctggccgccttgattgtagtgactcgcctgctcaggtgtgtgtgctgtgtcgtgccttttttagtcgtgg

SEQ ID NO: 353704 - DNA, 75 bp, Artificial Sequence
  Synthetic
gttcatgtgactccacctgccgggcaaagcgtccaagtggaatgcgaatgtggtggcaccaagatctctgaaacc

SEQ ID NO: 353705 - DNA, 75 bp, Artificial Sequence
  Synthetic
aagttttattacaaataacgtgcggcaattggcgagccgctttaattagaattttattttctttttaccataatt

SEQ ID NO: 353706 - DNA, 75 bp, Artificial Sequence
  Synthetic
aaatctgacgactgccttgcggatcacgctgaagcatacaaagcgcacacagcctcagtgcaggcgttcctcaac

SEQ ID NO: 353707 - DNA, 75 bp, Artificial Sequence
  Synthetic
cgggaccattaaagagataccactacatcaagtgtcactccatacatctcgcccgtgtcacattgtggatgggca

SEQ ID NO: 353708 - DNA, 75 bp, Artificial Sequence
  Synthetic
gtgactcgcctgctcaggtgcgtgtgctgtgtcgtgccttttttagtcatggccggcgccgcagccggcgcctac

SEQ ID NO: 353709 - DNA, 75 bp, Artificial Sequence
  Synthetic
tgttacaggacataccaatggacaggtttgtaatggacttaaagagggacgtgaaagtgactccaggaacaaaac

SEQ ID NO: 353710 - DNA, 75 bp, Artificial Sequence
  Synthetic
ttgcttttgcgacactgagaacacccaagtcagcaaggcctacgtaatgaaatctgacgactgccttgcggatca

SEQ ID NO: 353711 - DNA, 75 bp, Artificial Sequence
  Synthetic
gaatttgcggcgattggcatgccgcttttaaaaattttattttattttcttttcttttccgaatcggattttgtt

SEQ ID NO: 353712 - DNA, 75 bp, Artificial Sequence
  Synthetic
tctggcagcagatgatgaacatgacgatgacaggagaagggcattacacgaagagtcaacacgctggaatcgagt

SEQ ID NO: 353713 - DNA, 75 bp, Artificial Sequence
  Synthetic
gatgacaggagaagggcattacacgaagagtcaacacgctggaatcgagtgggaattcttccagagctgtgtaag

SEQ ID NO: 353714 - DNA, 75 bp, Artificial Sequence
  Synthetic
ggctggacgtcaatgccagaactgtggactcggtgctcctgaatggatgcaaacaccccgtagagaccctgtata

SEQ ID NO: 353715 - DNA, 75 bp, Artificial Sequence
  Synthetic
aatacagcagcaattggcaagctgcttacatagaactcgcggcgattggcatgccgccttaaaatttttatttta

SEQ ID NO: 353716 - DNA, 75 bp, Artificial Sequence
  Synthetic
attggcatgccgccttaaaatttttattttattttttcttttcttttccgaatcggattttgtttttaatatttc

SEQ ID NO: 353717 - DNA, 75 bp, Artificial Sequence
  Synthetic
atgggcggcgtatgagagtagcccaaattaaaactacccattatggagaaagttcacgttgatatcgaggaggat

SEQ ID NO: 353718 - DNA, 75 bp, Artificial Sequence
  Synthetic
agttcacgttgatatcgaggaggatagccccttcctcagagctttgcaacggagcttcccccagtttgaggtaga

SEQ ID NO: 353719 - DNA, 75 bp, Artificial Sequence
  Synthetic
agccaagcaggtcacagacaatgaccatgctaatgctagagcgttttcgcatctagcttccaaactgatcgaaac

SEQ ID NO: 353720 - DNA, 75 bp, Artificial Sequence
  Synthetic
ggaggtagaaccatccgacacgatcctagacattggaagtgcgcccgcccgcagaatgtattcaaaacacaagta

SEQ ID NO: 353721 - DNA, 75 bp, Artificial Sequence
  Synthetic
tttggccatgctcagcgttaacgttgacaacccgggctacgatgagctactggaagcagctgttaagtgccccgg

SEQ ID NO: 353722 - DNA, 75 bp, Artificial Sequence
  Synthetic
ccattgtgtctgtccgatgagatgtgctgaagacccggacagattatttaagtatgcagccaagctgaagaagaa

SEQ ID NO: 353723 - DNA, 75 bp, Artificial Sequence
  Synthetic
ttgtaaagacataacagacaaggacctagacaaaaagatggcagagctcgcagctgtcatggaggaccccgattt

SEQ ID NO: 353724 - DNA, 75 bp, Artificial Sequence
  Synthetic
ggagcaggataccatatgtttgcatgatgatgaaacgtgccgctatgaaggacacgttgctgtttaccaggacgt

SEQ ID NO: 353725 - DNA, 75 bp, Artificial Sequence
  Synthetic
tcggtcgtctcaaccttgttttacgacaaaaggatgagaacgacgaacccgaaagagactaagattgagattgac

SEQ ID NO: 353726 - DNA, 75 bp, Artificial Sequence
  Synthetic
ctatgcggtagacggtcccaccagcatttaccatcaagcaaataaaggtgtaagagtggcctattggatcggctt

SEQ ID NO: 353727 - DNA, 75 bp, Artificial Sequence
  Synthetic
tgataccacgccgtttatgtttaaaaatttggccggagcctatccttcctactctacaaattgggctgacgaaac

SEQ ID NO: 353728 - DNA, 75 bp, Artificial Sequence
  Synthetic
cctattggataggattcgacactaccccctttatgtttaagaacctggctggagcatatccctcctattcgacca

SEQ ID NO: 353729 - DNA, 75 bp, Artificial Sequence
  Synthetic
agtgttgacagcccgtaacatcggcttatgcagctcagatgtcatggaaaggtcccgtagaggtttgtctatttt

SEQ ID NO: 353730 - DNA, 75 bp, Artificial Sequence
  Synthetic
atcatcaaggtaaacagcgatttccactctttcgtgctgcccagaattgggagcagcaccttggagattgggctg

SEQ ID NO: 353731 - DNA, 75 bp, Artificial Sequence
  Synthetic
aaggaagaaatatttaaaaccatcgaataacatcatattttcagtgggttccaccatctaccatgaaaaaagaga

SEQ ID NO: 353732 - DNA, 75 bp, Artificial Sequence
  Synthetic
aataacatcatattttcagtgggttccaccatctaccatgaaaaaagagacttgttaaaaagttggcacctacct

SEQ ID NO: 353733 - DNA, 75 bp, Artificial Sequence
  Synthetic
tctgtgtttcacctacgtggcaagcagaattacacatgtcggtgtgagacgatagtgagttgcgacgggtacgtc

SEQ ID NO: 353734 - DNA, 75 bp, Artificial Sequence
  Synthetic
agaattacacatgtcggtgtgagacgatagtgagttgcgacgggtacgtcgtaaaacggatcgctatcagtccag

SEQ ID NO: 353735 - DNA, 75 bp, Artificial Sequence
  Synthetic
gtaaaacggatcgctatcagtccaggcctgtatgggaaaccgtcgggctatgctgccactatgcatcgcgaggga

SEQ ID NO: 353736 - DNA, 75 bp, Artificial Sequence
  Synthetic
ttcttgtgctgcaaggtaacagatacgctcaacggggagagggtctcttttcccgtctgcacgtatgtgccagcg

SEQ ID NO: 353737 - DNA, 75 bp, Artificial Sequence
  Synthetic
actctatgcgaccaaatgaccggcatattggctacagatgtcagtgccgaagacgcacaaaagctgttggttggg

SEQ ID NO: 353738 - DNA, 75 bp, Artificial Sequence
  Synthetic
ctcaaccaacgcattgtcgtaaatggccgcacacagagaaatactaatactatgaaaaactatttattaccagta

SEQ ID NO: 353739 - DNA, 75 bp, Artificial Sequence
  Synthetic
gttgcacaggcttttgccaggtgggctaaagaatacaaagatgaccaagatgatgagagaccgctagggttacgg

SEQ ID NO: 353740 - DNA, 75 bp, Artificial Sequence
  Synthetic
gcagtggaacacagtggattacttcaaagaggataaggcccactcagctgagatcgttctgaatcagctgtgcgt

SEQ ID NO: 353741 - DNA, 75 bp, Artificial Sequence
  Synthetic
gaccgacagctcgtgatgggctgttgttgggcatttaagaaacacaagattacatctgtgtataaacgtcccgac

SEQ ID NO: 353742 - DNA, 75 bp, Artificial Sequence
  Synthetic
actcaaacggttatcaaggtacctagtgacttccattcctttgtgctacccagacctggtagcaatacattggaa

SEQ ID NO: 353743 - DNA, 75 bp, Artificial Sequence
  Synthetic
tctgaccgcgttaatgattttggaagatctaggtgtagacgcagagctgttgacgctgatcgaggcggctttcgg

SEQ ID NO: 353744 - DNA, 75 bp, Artificial Sequence
  Synthetic
attgggcttagaacccggataaagaagttactggaagataaaaagataccaccacctataattactccagaagac

SEQ ID NO: 353745 - DNA, 75 bp, Artificial Sequence
  Synthetic
gtctcaacagcaaaagaagccgcagcggaagccaaggagattagggaggctgaggagttgcgaatcgcactaccc

SEQ ID NO: 353746 - DNA, 75 bp, Artificial Sequence
  Synthetic
cctatagtgccggacgtggaagaaccaactctagaagccgacgtggacttgatgctgcaagaggcaggcgctggt

SEQ ID NO: 353747 - DNA, 75 bp, Artificial Sequence
  Synthetic
tattttgtgtgactccgtgaccggcacagcgtgccgtgtggcagaccccttaaaaaggctgtttaagcttggcaa

SEQ ID NO: 353748 - DNA, 75 bp, Artificial Sequence
  Synthetic
tccgtcgagactcccagaggattaatcaaagttactagctactctggtgaggataagattggttcttatgccgtg

SEQ ID NO: 353749 - DNA, 75 bp, Artificial Sequence
  Synthetic
ttgtcgcctcaagccgtcctgagaagtgaaaaactgtcctgcatacacccccttgcggaggaagtcatcgtaata

SEQ ID NO: 353750 - DNA, 75 bp, Artificial Sequence
  Synthetic
acgcacgcaggaaggaaaggacgctatgctgttgagccgtatcatggcaaagtggtggtccctgaaggacatgcg

SEQ ID NO: 353751 - DNA, 75 bp, Artificial Sequence
  Synthetic
atccctgtagcagactttcaggctctcagtgagagcgctactattgtgtacaacgaacgagagtttgtgaacagg

SEQ ID NO: 353752 - DNA, 75 bp, Artificial Sequence
  Synthetic
tacttgcatcacatcgccattaatggaggagccttgaataccgatgaagagtactataaagtggtcaaacctacc

SEQ ID NO: 353753 - DNA, 75 bp, Artificial Sequence
  Synthetic
gagtatgatggagagtacttgtatgatattgacaggaaacagtgtgtcaagaaagaacaggtgtctggcctcggc

SEQ ID NO: 353754 - DNA, 75 bp, Artificial Sequence
  Synthetic
ctgacaggtgagctggtagagcctccatttcacgaattcgcgtatgaaagcctgaagaccagaccggcagctcca

SEQ ID NO: 353755 - DNA, 75 bp, Artificial Sequence
  Synthetic
tatcaagtgcctaccataggagtgtacggagtaccaggctcgggtaagtcaggaattataaaaagtgccgttacc

SEQ ID NO: 353756 - DNA, 75 bp, Artificial Sequence
  Synthetic
tggccagacctgttcccgcaccgcgaaccatttttaggactccacctgtcccgaaaccgcgtgtgcggaggccat

SEQ ID NO: 353757 - DNA, 75 bp, Artificial Sequence
  Synthetic
aagagagatctggtggtcagcgcaaagaaggaaaattgcgccgaggttatccgcgacgtgaagaaaatgcgaggc

SEQ ID NO: 353758 - DNA, 75 bp, Artificial Sequence
  Synthetic
ttagacatagtggcacgcactgtagattcagtgctgctgaatggctgcaagcacccagttgatacactgtacatt

SEQ ID NO: 353759 - DNA, 75 bp, Artificial Sequence
  Synthetic
gatgaggcttttgcttgtcatgccgggaccctccgcgctttgattgcaattattaaaccaaaaaaggcagttctc

SEQ ID NO: 353760 - DNA, 75 bp, Artificial Sequence
  Synthetic
cgctgaagcatacaaagcgcacacagcctcagtgcaggcgttcctcaacatcacagtgggagaacactctattgt

SEQ ID NO: 353761 - DNA, 75 bp, Artificial Sequence
  Synthetic
tgcggagacccgaagcagtgcggcttctttaatatgatgtgcctcagagtgcatttcaatcacgaaatttgcacg

SEQ ID NO: 353762 - DNA, 75 bp, Artificial Sequence
  Synthetic
gaccaccgtgtatgtgaatggagaaactcctgtgaacttcaatggggtcaaattaactgcaggcccactttccac

SEQ ID NO: 353763 - DNA, 75 bp, Artificial Sequence
  Synthetic
caggtgttccataaaagcatatcccgtaggtgcactaaatcggtcacatccgtggtgtctacgctgttttatgac

SEQ ID NO: 353764 - DNA, 75 bp, Artificial Sequence
  Synthetic
aattaactgcaggcccactttccacagcttggacaccctttgaccgcaaaatcgtgcagtatgccggggagatct

SEQ ID NO: 353765 - DNA, 75 bp, Artificial Sequence
  Synthetic
aagaagatgcgcactactaatcccagggagacaaaaattgaaattgacaccacagggagtacaaagcctagaaaa

SEQ ID NO: 353766 - DNA, 75 bp, Artificial Sequence
  Synthetic
gatgatctcatattgacgtgcttcaggggatgggtaaagcagctgcaaattgactacaagggcaatgaaatcatg

SEQ ID NO: 353767 - DNA, 75 bp, Artificial Sequence
  Synthetic
acggcggcagcctcacagggattaacccgaaaaggggtttatgccgtcaggtataaagtcaatgagaatccccta

SEQ ID NO: 353768 - DNA, 75 bp, Artificial Sequence
  Synthetic
ttgggtgttagagacagacatagcgtccttcgataaaagcgaagacgacgcgatggctctgacggcactgatgat

SEQ ID NO: 353769 - DNA, 75 bp, Artificial Sequence
  Synthetic
gaagaaagataaagctccgtcattgaaattcaccgcccctttcggatgcgaaatatatacaaaccccattcgcgc

SEQ ID NO: 353770 - DNA, 75 bp, Artificial Sequence
  Synthetic
tacgccgcaaattcagagcacgtcaacgtcctactcactcgtacagaggataggattgtgtggaaaaccctggca

SEQ ID NO: 353771 - DNA, 75 bp, Artificial Sequence
  Synthetic
aaatatatacaaaccccattcgcgccgaaaattgtgctgtagggtcaattccattagcctttgacatccccgacg

SEQ ID NO: 353772 - DNA, 75 bp, Artificial Sequence
  Synthetic
ggagatccttggattaaaactcttacggccaagtacaccggtgactttactgctaccttggaagaatggcaacaa

SEQ ID NO: 353773 - DNA, 75 bp, Artificial Sequence
  Synthetic
agcaattggcaagctgcttatatagaactcgcggcgattggcatgccgctttaaaattttattttattttctttt

SEQ ID NO: 353774 - DNA, 75 bp, Artificial Sequence
  Synthetic
gagcatgacgccattatgaagcacattctggaaagacctgatcctgcggacgtgttccagaataaagccaatgtg

SEQ ID NO: 353775 - DNA, 75 bp, Artificial Sequence
  Synthetic
tgctgggctaaagccttagtacccgtactgaagactgcaggtattgacctaacggcagagcagtggaacaccatt

SEQ ID NO: 353776 - DNA, 75 bp, Artificial Sequence
  Synthetic
gtccaattcagagatgacaaggctcactcggcagaaatagcactcaaccaattgtgtgtacggttctttggacta

SEQ ID NO: 353777 - DNA, 75 bp, Artificial Sequence
  Synthetic
tgtacgcggttgacggaccgacgagcctttatcatcaggccaacaaaggggttagagtcgcctattggataggat

SEQ ID NO: 353778 - DNA, 75 bp, Artificial Sequence
  Synthetic
gatttggattcagggttgttttctgcccccactgtgccgttgtctataaaaaataaccactgggataattcacct

SEQ ID NO: 353779 - DNA, 75 bp, Artificial Sequence
  Synthetic
cacatttaaatacactcatgaaaaaccccagggctactacagctggcaccatggagcagtacagtatgaaaatgg

SEQ ID NO: 353780 - DNA, 75 bp, Artificial Sequence
  Synthetic
tcacccaatatgtacgggttgaataaggaagtagcgcgacaactttctcgacgctacccgcagcttcctcgtgca

SEQ ID NO: 353781 - DNA, 75 bp, Artificial Sequence
  Synthetic
gtggcgactggcagagttttggacatgaatactgggaccctgcgtggttacgacccatgcattaatcttgtgccc

SEQ ID NO: 353782 - DNA, 75 bp, Artificial Sequence
  Synthetic
gttaatcggaggctaccgcatgcattggtaacgcaccattcagagcaaccacgcagcgatttttcggcatttgcc

SEQ ID NO: 353783 - DNA, 75 bp, Artificial Sequence
  Synthetic
atgggcggcgcattagagagtagcccaaaactaaactacccaacatggagaaagttcacgttgacatcgaggaag

SEQ ID NO: 353784 - DNA, 75 bp, Artificial Sequence
  Synthetic
aacagcgagcagtggtccttggtgaccactatgtgcctgcttgccaatgtcacgttcccgtgcacccaaccaccc

SEQ ID NO: 353785 - DNA, 75 bp, Artificial Sequence
  Synthetic
agcaagttgaggggtaggactgtcctggttgtaggagagaaactaaacataaccgggaaaaatgttgactggcta

SEQ ID NO: 353786 - DNA, 75 bp, Artificial Sequence
  Synthetic
acagtccgttcctcagagctttacaacggagttttccacagtttgaggtagaagccaagcaggtcacagacaacg

SEQ ID NO: 353787 - DNA, 75 bp, Artificial Sequence
  Synthetic
ttggcaagctgcttatatagaactcgcggcgattggcatgccgctttaaaatttattttattttcttttcttttc

SEQ ID NO: 353788 - DNA, 75 bp, Artificial Sequence
  Synthetic
tccgaaagtcccgaagccactttcaaatcgcgcctggatctcggtatcccgcacgaactgcccaaatatgacatt

SEQ ID NO: 353789 - DNA, 75 bp, Artificial Sequence
  Synthetic
accatgctaatgctagagcgttttcgcatctagcttccaaattaatcgaaacggaggttgacccatccgatacga

SEQ ID NO: 353790 - DNA, 75 bp, Artificial Sequence
  Synthetic
gtgtttgtgaatgtccggacaccttacaagtaccatcactaccagcagtgtgaagaccatgcgatcaagctcagt

SEQ ID NO: 353791 - DNA, 75 bp, Artificial Sequence
  Synthetic
ttttagacataggcagtgcgcctgcccgcagaatgtactcgaaacacaagtaccactgtatctgtccgatgaaat

SEQ ID NO: 353792 - DNA, 75 bp, Artificial Sequence
  Synthetic
atgttgacaaagaaagcgtgcttacatcttaatcctggtggaacctgtgtcagcattggctatggctacgcagat

SEQ ID NO: 353793 - DNA, 75 bp, Artificial Sequence
  Synthetic
gcgccgaagatccggacagattatttaagtatgcatccaaattaaagaagaactgcaaagacataactgacaaga

SEQ ID NO: 353794 - DNA, 75 bp, Artificial Sequence
  Synthetic
cgagccagtgaaagcattgtcggagctattgcaaggcagtttaagttctcccgagtgtgtaagccaaaagtatca

SEQ ID NO: 353795 - DNA, 75 bp, Artificial Sequence
  Synthetic
atttggataagaaaatggaagacctggcagcagtgatgactgagcccgacatcgagcgagaaacgctatgcctgc

SEQ ID NO: 353796 - DNA, 75 bp, Artificial Sequence
  Synthetic
acggaggagacagagatactatttgtcttcatagggtatgaccggaaggttcgtacacacaatccctataaattg

SEQ ID NO: 353797 - DNA, 75 bp, Artificial Sequence
  Synthetic
atgatgatgaatcttgcaggtatactgggcaagtcgccgtctatcaagacgtttatgctgtcgacggtcctacga

SEQ ID NO: 353798 - DNA, 75 bp, Artificial Sequence
  Synthetic
tcttcaacattgaccaacatttacacaggctcacacttacatgaggcaggctgcgctccatcctaccatgtagtg

SEQ ID NO: 353799 - DNA, 75 bp, Artificial Sequence
  Synthetic
gcctttaccatcaggccaacaaaggggtaagagttgcatattggataggatttgacaccacgccgttcatgttca

SEQ ID NO: 353800 - DNA, 75 bp, Artificial Sequence
  Synthetic
cgtggtgatattgccaatgctgaggagggagtaattgtcaacgccgctaatagcagagggcaacctgggggtggg

SEQ ID NO: 353801 - DNA, 75 bp, Artificial Sequence
  Synthetic
agaacctcgcgggggcctacccgtcttattccacaaactggtccgacgaggttgtgctgacggcgcggaacatcg

SEQ ID NO: 353802 - DNA, 75 bp, Artificial Sequence
  Synthetic
gtatgtggagctctttacaaacgcttcccggagaacttcgacctgcagcccatagaggtcggcaagtcaaggctg

SEQ ID NO: 353803 - DNA, 75 bp, Artificial Sequence
  Synthetic
gactgtgcagttctgacgtcatggaaagatcacgacgcggactctccataatgcgtaaaaaattcctcaaaccct

SEQ ID NO: 353804 - DNA, 75 bp, Artificial Sequence
  Synthetic
gttaaaggggcggctaaacatatcattcatgcagtaggacccaattttaataaggtgtcggaacttgatggggac

SEQ ID NO: 353805 - DNA, 75 bp, Artificial Sequence
  Synthetic
tgtgtggggaaaccatccgcctcaaaggtactggtcccaagaaactgcaccgggtaatccacacggactaccaca

SEQ ID NO: 353806 - DNA, 75 bp, Artificial Sequence
  Synthetic
ccagtaacatcatattttctgtaggatcaactatttatcatgagaaaagagacttgttgaaaagctggcatttac

SEQ ID NO: 353807 - DNA, 75 bp, Artificial Sequence
  Synthetic
aagcaattggcagaagcttatgaatcagtagctaaaatcattaatgataatcattaccgcaccgtggcaattccg

SEQ ID NO: 353808 - DNA, 75 bp, Artificial Sequence
  Synthetic
cgtccgtatttcacctacgtggaaaaaacaactacacgtgtcggtgtgagactatagttagttgcgacgggtacg

SEQ ID NO: 353809 - DNA, 75 bp, Artificial Sequence
  Synthetic
ctgctgtcgacaggtatttttgccggaaacaaagacagactcatgcagtcattaaatcacctgcttacggcatta

SEQ ID NO: 353810 - DNA, 75 bp, Artificial Sequence
  Synthetic
tcgtcaaaaggatagctattagtccgggcctgtatgggaaaccgtcaggctacgctgccactatgcaccgcgagg

SEQ ID NO: 353811 - DNA, 75 bp, Artificial Sequence
  Synthetic
gacactaccgatgcagatgtagctatatactgcagagataagaagtgggaaactactctgaaggaagttatagca

SEQ ID NO: 353812 - DNA, 75 bp, Artificial Sequence
  Synthetic
gattcttgtgctgcaaggtgacggacacgctgaacggggagagggtatcttttcccgtttgcacatatgtgccgg

SEQ ID NO: 353813 - DNA, 75 bp, Artificial Sequence
  Synthetic
cggagagaggctgtcgaagagatatgtatctctgaagacgcatccgtagcagaacctgacgcagagctggtaaga

SEQ ID NO: 353814 - DNA, 75 bp, Artificial Sequence
  Synthetic
caactttgtgcgaccaaatgacaggcatcttagctactgacgtaagtgctgatgatgctcaaaaattgttggttg

SEQ ID NO: 353815 - DNA, 75 bp, Artificial Sequence
  Synthetic
gtacatcccaaaagttcgctggcaggacgcaaaggctttagcacggtcgacgggaaaacattttcatatttggaa

SEQ ID NO: 353816 - DNA, 75 bp, Artificial Sequence
  Synthetic
ggctcaaccagcgtattgtcgtgaatggacgcactcaaagaaacaccaataccatgaagaactacttactacctg

SEQ ID NO: 353817 - DNA, 75 bp, Artificial Sequence
  Synthetic
gggactaaatttcatcaggcagcgaaggatgtggccgagattaatgcgatgtggcccacagttaccgaggctaat

SEQ ID NO: 353818 - DNA, 75 bp, Artificial Sequence
  Synthetic
tagtggcgcaggcgttcgcgcgctgggccaaggaatacaaagaagatcaagaggatgaacgacctttagggctca

SEQ ID NO: 353819 - DNA, 75 bp, Artificial Sequence
  Synthetic
gagcaaatatgcctgtacattttgggcgaaagtatgagcagcatccgatcgaagtgccccgttgaagaatctgag

SEQ ID NO: 353820 - DNA, 75 bp, Artificial Sequence
  Synthetic
gagaccgtcaactggtaatggggtgctgctgggcatttagaaaacacaaggttacctccgtctacaaaaaaccag

SEQ ID NO: 353821 - DNA, 75 bp, Artificial Sequence
  Synthetic
gcgtcaactccacccagcacgttgccgtgtctctgtatccattctatgacaccggaacgagtacacaggcttaag

SEQ ID NO: 353822 - DNA, 75 bp, Artificial Sequence
  Synthetic
acacccaaaccattgtcaaagtgccaagtgatttccactcatttgtgcttcctcgatctgggagtacggcgctcg

SEQ ID NO: 353823 - DNA, 75 bp, Artificial Sequence
  Synthetic
gcctcacgtccagagcaaataacggtgtgttcgtcgtttcccctacccaagtacagaatcaccggggtgcagaag

SEQ ID NO: 353824 - DNA, 75 bp, Artificial Sequence
  Synthetic
atatcaagctgcgagatcgcatcaggaaattgatggagcgcaagaaacagccgccgcccctgacaacaccggagg

SEQ ID NO: 353825 - DNA, 75 bp, Artificial Sequence
  Synthetic
attcaatgcgctcagcctatactcttcctcccgaaagtgccggaacatatccatccacgcaggtatcttcccccg

SEQ ID NO: 353826 - DNA, 75 bp, Artificial Sequence
  Synthetic
ataattataataattggacttgtgttagccactgttgtggctatgtatgtgctgaccaaccagaaacacaattag

SEQ ID NO: 353827 - DNA, 75 bp, Artificial Sequence
  Synthetic
atgggcggcgtatgagagaagcccaaaacctagactacccataatggagaaggttcacgttgacatcgaggagga

SEQ ID NO: 353828 - DNA, 75 bp, Artificial Sequence
  Synthetic
caggagaacagagaggaagaggagaattctgtggaaacgctgcctgaatcgcctgaaattcctacagttgctgcc

SEQ ID NO: 353829 - DNA, 75 bp, Artificial Sequence
  Synthetic
acgtacaagaggccacggcggcagcagtagaggcgcgcgaagttcgcgaagccgaggaattgcgtgcagcactac

SEQ ID NO: 353830 - DNA, 75 bp, Artificial Sequence
  Synthetic
cagccccttcctcagagcactacaacggagctttccgcagtttgaggtagaagccaagcaggtcacggataatga

SEQ ID NO: 353831 - DNA, 75 bp, Artificial Sequence
  Synthetic
gcctctgaaattgacacccaaacggaagagaccatgagcataacgtcggaaacgactgttgcctcgttcgtgcct

SEQ ID NO: 353832 - DNA, 75 bp, Artificial Sequence
  Synthetic
cacccttagcaccagatgtcgaggagccggccctcgaagcagatgtcgacttaatgctacaggaagccggggcag

SEQ ID NO: 353833 - DNA, 75 bp, Artificial Sequence
  Synthetic
ccatgctaatgctagagcgttttcgcatctagcttccaaactgatcgagacggaggtggaaccatccgatacgat

SEQ ID NO: 353834 - DNA, 75 bp, Artificial Sequence
  Synthetic
aacgaaattgtggtcgaggcggaaatacactcggatctcatgcgattctcctctgactggtccattcctcaagcc

SEQ ID NO: 353835 - DNA, 75 bp, Artificial Sequence
  Synthetic
gtacggtggaaacgcctagaggactcatcaaagttactagctatccaggggaggaaaagatcggctcctatgcta

SEQ ID NO: 353836 - DNA, 75 bp, Artificial Sequence
  Synthetic
cctagacattggaagtgcgcccgcccgcagaatgtattcaaatcacaagtaccattgtatctgtccgatgaagtg

SEQ ID NO: 353837 - DNA, 75 bp, Artificial Sequence
  Synthetic
tctgactttgacgttgacagcgtgtcggttcaaggtactgtggacatatttaacagtgcgctgcaggaggatgcg

SEQ ID NO: 353838 - DNA, 75 bp, Artificial Sequence
  Synthetic
ttctttctcctcaagctgtgctgaagagtgaaaaactcagctgcatccatccactggcagagcaagttgtggtga

SEQ ID NO: 353839 - DNA, 75 bp, Artificial Sequence
  Synthetic
tgcagaagacccggacagattatacaaatatgcatctaaattgaagaagaactgtaaagatattacagataaaga

SEQ ID NO: 353840 - DNA, 75 bp, Artificial Sequence
  Synthetic
cgtagcgccgtatcatcttactgctcgggaataaaacccattcccgcgccacgtaccgtttttatccagccaccg

SEQ ID NO: 353841 - DNA, 75 bp, Artificial Sequence
  Synthetic
ttacccattcagggcggaaaggtagatacgcagtagaaccttatcatggcaaagtagtcgttcctgaaggtcatg

SEQ ID NO: 353842 - DNA, 75 bp, Artificial Sequence
  Synthetic
attggacaagaaaatggcagagcttgcagcggtcatggaggacccggatctagagcaggaaaccatttgtttgca

SEQ ID NO: 353843 - DNA, 75 bp, Artificial Sequence
  Synthetic
aaacctcgcagaagacgtcgtaagtcgaaggccagtaccagttctacggctcccttggtaactgtgtccagcgcc

SEQ ID NO: 353844 - DNA, 75 bp, Artificial Sequence
  Synthetic
ctattcctgtcaccgatttccaagcgttaagtgaaagcgctaccatcgtgtacaacgaacgagaattcgtgaaca

SEQ ID NO: 353845 - DNA, 75 bp, Artificial Sequence
  Synthetic
tgatgatgaatcatgccgctatgaaggcaacgtggcggtatatcaggacgtctacgctgtagatggtcccactag

SEQ ID NO: 353846 - DNA, 75 bp, Artificial Sequence
  Synthetic
acttcgagatctagtttggtgtctaacccacccggaagaaaaggggttattaccagagaggagttcgaagccttc

SEQ ID NO: 353847 - DNA, 75 bp, Artificial Sequence
  Synthetic
ggtacctacaccacattgcagtgaacggtggagcattaaacactgatgaggagtactacaaaactgtaaaaccat

SEQ ID NO: 353848 - DNA, 75 bp, Artificial Sequence
  Synthetic
tatataccatcaggcaaacaaaggcgttagagtcgcctactggataggctttgatactacgccatttatgttcaa

SEQ ID NO: 353849 - DNA, 75 bp, Artificial Sequence
  Synthetic
gtcgcgcaacaacaatgacggtacgaagcgggtgcgtacatcttctcctccgacaccggtcaagggcatctacaa

SEQ ID NO: 353850 - DNA, 75 bp, Artificial Sequence
  Synthetic
ctgaatatgaaggggaatacttgtacgacatcgataagaaacaatgtgtaaagaaagaactcattaccgggttag

SEQ ID NO: 353851 - DNA, 75 bp, Artificial Sequence
  Synthetic
aaatttagctggagcctacccttcctactctactaactgggccgacgagaccgtgctgacagcccgtaacatcgg

SEQ ID NO: 353852 - DNA, 75 bp, Artificial Sequence
  Synthetic
caaaaatctgtgaggcaaacagcgctgtccgaagtggtgcttgaacggacggagttggagaattcgtacgccccg

SEQ ID NO: 353853 - DNA, 75 bp, Artificial Sequence
  Synthetic
gactgtccggcgagctaattgaaccaccttttcatgagttcgcctatgaaagcttgaagacaagaccggcagcac

SEQ ID NO: 353854 - DNA, 75 bp, Artificial Sequence
  Synthetic
cttatgcagctcagatgtcatggaacggtctcgtcggggactgtccattttaaggaagaagtatttgaaaccatc

SEQ ID NO: 353855 - DNA, 75 bp, Artificial Sequence
  Synthetic
cgcctcgacttaataaaagaggaaagtttacgtaagaaattgcaattgaatccgacacaggctaataggagcagg

SEQ ID NO: 353856 - DNA, 75 bp, Artificial Sequence
  Synthetic
cttaccaagtacctacgattggtgtgtacggagtacccggttcaggcaagtctggtattataaaaagtgcagtaa

SEQ ID NO: 353857 - DNA, 75 bp, Artificial Sequence
  Synthetic
aaacaatgtcatattttccgtgggttctaccatctaccacgagaaaagagacttattaaaaagctggcacctacc

SEQ ID NO: 353858 - DNA, 75 bp, Artificial Sequence
  Synthetic
tatcaatccagaagagtggagaatatgaaagcagtgaccaccaaaagactactcggcggactgggacattacttg

SEQ ID NO: 353859 - DNA, 75 bp, Artificial Sequence
  Synthetic
ccaaaagagacttggtagtgagtgcaaagaaagaaaactgcgcggaaataatccgcgatgtgaaacgaatgagag

SEQ ID NO: 353860 - DNA, 75 bp, Artificial Sequence
  Synthetic
ttctgtatttcacctacgtggcaagcaaaattacacatgtcggtgtgagacgatagtgagctgcgacgggtacgt

SEQ ID NO: 353861 - DNA, 75 bp, Artificial Sequence
  Synthetic
aagtctgaaggaaaagttgaatgttaccgtacattgtaccccgtccccttgtattcagcaagcgttaaccgcgtt

SEQ ID NO: 353862 - DNA, 75 bp, Artificial Sequence
  Synthetic
gtctagatgtgatagcacgcactgtggactctgtattgctcaatggatgcaagtacccagtagacaccttgtatg

SEQ ID NO: 353863 - DNA, 75 bp, Artificial Sequence
  Synthetic
tggatgaagcttttgcttgccacactggtaccttgcgcgcattgattgccatcgtgaagccgaagaagacggtac

SEQ ID NO: 353864 - DNA, 75 bp, Artificial Sequence
  Synthetic
ggcctgtacgggaagccgtcaggctatgctgccactatgcaccgcgagggattcttgtgctgcaaggtaacagac

SEQ ID NO: 353865 - DNA, 75 bp, Artificial Sequence
  Synthetic
ttctcgaatcctcgagtggcagtcgaagcgtgtaatgctatgctaaaggagaactttccaacagtggcttcgtac

SEQ ID NO: 353866 - DNA, 75 bp, Artificial Sequence
  Synthetic
tgtgtggagacccgaagcagtgcggattctttaacatgatgtgcttgaaagtccatttcaaccatgaactgtgca

SEQ ID NO: 353867 - DNA, 75 bp, Artificial Sequence
  Synthetic
tgcataacaccagagtacgatgcgtacatggacatggtggacggcgcctcttgttgtttagacactgcgagtttt

SEQ ID NO: 353868 - DNA, 75 bp, Artificial Sequence
  Synthetic
acgttgaacggggagagggtctctttcccagtttgtacttatgtgccagctaccctatgtgaccagatgactggc

SEQ ID NO: 353869 - DNA, 75 bp, Artificial Sequence
  Synthetic
cgcaggtattccataagagcatatccagaagatgcacacctgcagtcacctctatcgtttctaccctattttatg

SEQ ID NO: 353870 - DNA, 75 bp, Artificial Sequence
  Synthetic
tgccctgccaaattgcgtagttttcctaagagacatgcttatttggagccgaccattcgctcagcagtgccgtct

SEQ ID NO: 353871 - DNA, 75 bp, Artificial Sequence
  Synthetic
attctggcaacagatgtcagcgcggaagacgcgcaaaagctgctggttgggctcaaccagcgcattgtcgtgaat

SEQ ID NO: 353872 - DNA, 75 bp, Artificial Sequence
  Synthetic
acaaacgcatgagaaccacgaatactcgccctacgaaaattgaaattgatacagtaggaggcacaaaaccacgta

SEQ ID NO: 353873 - DNA, 75 bp, Artificial Sequence
  Synthetic
gctatacaaaataccttgcagaatgtactagcagcggccaccaaacggaactgcaatgttacacaaatgagagag

SEQ ID NO: 353874 - DNA, 75 bp, Artificial Sequence
  Synthetic
ggccgcactcagaggaatactaataccatgaagaattacttactaccagtagttgcacaggcatttgcccggtgg

SEQ ID NO: 353875 - DNA, 75 bp, Artificial Sequence
  Synthetic
aagatgatttgatccttacatgttttagagggtgggtgaagcagttgcaaattgattacaagggcaatgagataa

SEQ ID NO: 353876 - DNA, 75 bp, Artificial Sequence
  Synthetic
ctacctgtgttggattccgccgccttcaatgtagagtgctttaagaagtatgcatgcaataatgaatattgggaa

SEQ ID NO: 353877 - DNA, 75 bp, Artificial Sequence
  Synthetic
gctaaggagtacaaagaggaccaagatgatgaaagaccgctgggattgagggacagacaacttgtgatgggttgc

SEQ ID NO: 353878 - DNA, 75 bp, Artificial Sequence
  Synthetic
tgacggcggcggcgtcccagggccttacacgtaagggagtgtatgccgtcaggtataaggtcaacgagaaccccc

SEQ ID NO: 353879 - DNA, 75 bp, Artificial Sequence
  Synthetic
acatataaggaatgtcctattagattaactgaagagaatgtgactaattatattactaaattgaaaggtccgaag

SEQ ID NO: 353880 - DNA, 75 bp, Artificial Sequence
  Synthetic
tgctgggcgtttaagaagcacaagattacatccgtgtacaaacgccctgacacccagacagtcataaaggtaccc

SEQ ID NO: 353881 - DNA, 75 bp, Artificial Sequence
  Synthetic
tgtatgccgcgaattccgagcacgttaacgtgctactgactaggactgaagacagaatagtctggaaaacgctgg

SEQ ID NO: 353882 - DNA, 75 bp, Artificial Sequence
  Synthetic
gcggctgctttgtatgctaaaacccacaaccttagcatgcttcaggacattcccatggatagatttgttatggat

SEQ ID NO: 353883 - DNA, 75 bp, Artificial Sequence
  Synthetic
agtgacttccactcctttgtgctacccagattggggagcagttctctggagatggggctaagaactagaataaag

SEQ ID NO: 353884 - DNA, 75 bp, Artificial Sequence
  Synthetic
caggagatccgtggatcaagacactcacggcaaaatacccagggaacttctccgcaaccttggaagagtggcaac

SEQ ID NO: 353885 - DNA, 75 bp, Artificial Sequence
  Synthetic
ttaaaaagagatgtgaaggtgacacctggtaccaaacatacggaggagagacccaaggtacaggtaatccaggca

SEQ ID NO: 353886 - DNA, 75 bp, Artificial Sequence
  Synthetic
aagttgctggaagataagaagacaaccccacctataattactcctgaagacatctcatcggcaaaagatgctgcc

SEQ ID NO: 353887 - DNA, 75 bp, Artificial Sequence
  Synthetic
aggaacatgatgccatcatgaggcatatattggaaaaaccccaaccaaccgacgtgttccagaataaagcaaatg

SEQ ID NO: 353888 - DNA, 75 bp, Artificial Sequence
  Synthetic
gcagatccattggccacagcctacttatgcgggattcatcgtgaactggtgcggaggttaaacgcagttttactg

SEQ ID NO: 353889 - DNA, 75 bp, Artificial Sequence
  Synthetic
acggaagctaaggaaatcaaggaggcagaagagttacgtattgcactgcctcctatggttccagacgtggaggaa

SEQ ID NO: 353890 - DNA, 75 bp, Artificial Sequence
  Synthetic
tatgctgggccaaagcactggtgcccatactccgcaccgcgggcatctctatgactcaagagcagtggaatacaa

SEQ ID NO: 353891 - DNA, 75 bp, Artificial Sequence
  Synthetic
ccgaacgtccataccttgttcgacatgtccgctgaggatttcgatgccattattgctgaacatttccaacctggg

SEQ ID NO: 353892 - DNA, 75 bp, Artificial Sequence
  Synthetic
ccgactctggaagccgatgtagatttgatgctgcaagaagcaggggcagggtcagtagagacgccccgaggacta

SEQ ID NO: 353893 - DNA, 75 bp, Artificial Sequence
  Synthetic
ttccgtatttcaaagaagataaagcacattcagctgagatagtactcaaccagttatgcgtgcgtttcttcggct

SEQ ID NO: 353894 - DNA, 75 bp, Artificial Sequence
  Synthetic
gacagtgtgttggagaccgacatcgcttcgttcgataagagcgaggacgatgcgatggcactgacagcattgatg

SEQ ID NO: 353895 - DNA, 75 bp, Artificial Sequence
  Synthetic
attaaagttaccagctattccggtgaagacaagatcggctcctatgcggtactttcaccccaggctgtccttcgg

SEQ ID NO: 353896 - DNA, 75 bp, Artificial Sequence
  Synthetic
tggatttggactccggactgttctctgcccctacagtgccactggccataaaaaataatcactgggacaactcac

SEQ ID NO: 353897 - DNA, 75 bp, Artificial Sequence
  Synthetic
atcctggaagatttaggcgtagaccaagagttgcttacgttgattgaagccgcattcggagaaatatcatccatc

SEQ ID NO: 353898 - DNA, 75 bp, Artificial Sequence
  Synthetic
agtgagaaactctcctgcatacacccgctggcggaagaggttattgttataacccacgcgggaaggaaaggaagg

SEQ ID NO: 353899 - DNA, 75 bp, Artificial Sequence
  Synthetic
cgtcaccaaatatgtatggtattaataaggaagtggttcggcaactggcccgtcggtaccctcaattgccgaggg

SEQ ID NO: 353900 - DNA, 75 bp, Artificial Sequence
  Synthetic
caccttcccacgaaaactaaatttaaatttggtgctatgatgaaatctggtatgtttcttaccctgtttgtgaat

SEQ ID NO: 353901 - DNA, 75 bp, Artificial Sequence
  Synthetic
tatgcagttgaaccttatcacggcaaagtggtggtccctgaagggcacgctattcccgtagcagacttccaggca

SEQ ID NO: 353902 - DNA, 75 bp, Artificial Sequence
  Synthetic
cgacagccactgggaggatgctcgacgtaaataccggtacgttgagagaatatgatcccaaagttaacccagtgc

SEQ ID NO: 353903 - DNA, 75 bp, Artificial Sequence
  Synthetic
acagttattaatattgttatagccagcagagtgctccgagaacgcctgacacagtcgccttgcgctgcatttatc

SEQ ID NO: 353904 - DNA, 75 bp, Artificial Sequence
  Synthetic
ctcagtgagagcgccaccattgtgtataacgagcgggagtttgtgaacaggtacctacaccacatcgccatcaac

SEQ ID NO: 353905 - DNA, 75 bp, Artificial Sequence
  Synthetic
ccgttaaccgtagactgccacatgccctggtgacatcacacactaatcaccccgcctgcgattactccgcttttg

SEQ ID NO: 353906 - DNA, 75 bp, Artificial Sequence
  Synthetic
ggcgatgacaacattgttaaaggcgttaaatcggataagttgatggccgacaggtgtgccacgtggttgaacatg

SEQ ID NO: 353907 - DNA, 75 bp, Artificial Sequence
  Synthetic
ggaggagccttgaataccgatgaagagtactacaaagtggtcaaacccaatgaacatgatggagaatacctatat

SEQ ID NO: 353908 - DNA, 75 bp, Artificial Sequence
  Synthetic
caagcaaactaaaggggcggactgtacttgtgatcggagagaaaatgaatattcccggaaagactgtcgactggc

SEQ ID NO: 353909 - DNA, 75 bp, Artificial Sequence
  Synthetic
gaggtaaaaattattgatgccgtagtaggaataaaggccccgtacttttgcggcgggtttatcctgtgtgacacg

SEQ ID NO: 353910 - DNA, 75 bp, Artificial Sequence
  Synthetic
gacattgataaaaaacagtgtgttaagaaggaacaggtgtccggcctcgggctggcaggtgaactggtggagcct

SEQ ID NO: 353911 - DNA, 75 bp, Artificial Sequence
  Synthetic
tttcagaccatccggattcgaccttccggtctcgactagatcttggaattccggcagatgtacccaagtatgact

SEQ ID NO: 353912 - DNA, 75 bp, Artificial Sequence
  Synthetic
gtaaccggcacggcatgtcgtgtggccgatcctttgaagagactgtttaaactcgggaaacctctcgcggctgac

SEQ ID NO: 353913 - DNA, 75 bp, Artificial Sequence
  Synthetic
ccgttccacgaattcgcgtatgagagcctaaggactagaccggcagctccttatcaagtaccaactataggagtg

SEQ ID NO: 353914 - DNA, 75 bp, Artificial Sequence
  Synthetic
taatattcattaatgtccgcacccagtacatacatcaccactaccagcagtgtgaagatcacgccattaaactaa

SEQ ID NO: 353915 - DNA, 75 bp, Artificial Sequence
  Synthetic
gatgaacacgatgacgatcgtcgccgcgctctgcaggaggaatcagcccgctggaaccgcgtaggcatacactct

SEQ ID NO: 353916 - DNA, 75 bp, Artificial Sequence
  Synthetic
tacggagtacctggctcgggtaagtccgggattataaaaagtgccgtgacaaaaagagatctggtggtcagtgca

SEQ ID NO: 353917 - DNA, 75 bp, Artificial Sequence
  Synthetic
gtatgctgactaagaaagcgtgcctccacttgcaaccaggaggcacctgtgttagtattggctacggatatgcgg

SEQ ID NO: 353918 - DNA, 75 bp, Artificial Sequence
  Synthetic
gaattatgcaaggcggtggagtcacgttacgagaccacaggcacgtccgtgattataacagctatgaccaccttg

SEQ ID NO: 353919 - DNA, 75 bp, Artificial Sequence
  Synthetic
aagaaggaaaattgtaccgagatcatacgcgacgtgaagaagatgcgcgatctagacatagtggcgcgtactgtc

SEQ ID NO: 353920 - DNA, 75 bp, Artificial Sequence
  Synthetic
acagagctagcgagaacattatcggggccgtcgctagacaatttaaattcgcccgagtgtgcaaaccacgtattt

SEQ ID NO: 353921 - DNA, 75 bp, Artificial Sequence
  Synthetic
gcacagagtgttcctgcgttcaagcacctgagaggaaacccagtaactctctacggctgacctgaatggactgta

SEQ ID NO: 353922 - DNA, 75 bp, Artificial Sequence
  Synthetic
gattcggtactgctgaatggctgtaaacacccagttgacacgctgtacattgatgaggccttcgcatgtcacgca

SEQ ID NO: 353923 - DNA, 75 bp, Artificial Sequence
  Synthetic
ccatggaggagactgagatcttgtttgtattcatagggtatgaccgaaagaaccgtactcataatccctacaagt

SEQ ID NO: 353924 - DNA, 75 bp, Artificial Sequence
  Synthetic
acgtagttcagtccgcaaccatgttcccttaccaatccacaatgtttccaatgcaaccagcgccttttcgcaacc

SEQ ID NO: 353925 - DNA, 75 bp, Artificial Sequence
  Synthetic
ggaacgctacgtgcgttgattgccatcattaaacctaaaaaggcagttctctgcggagatccgaaacagtgtggc

SEQ ID NO: 353926 - DNA, 75 bp, Artificial Sequence
  Synthetic
tgtctacgactttgacaaacatctacacaggctcagggctccacgaggctggcacagctccatcctaccacgtag

SEQ ID NO: 353927 - DNA, 75 bp, Artificial Sequence
  Synthetic
cgtacgctcctcctagaagaccgtggttccctagaaccgatcccttcttagccatgcaggtgcaggagttggccc

SEQ ID NO: 353928 - DNA, 75 bp, Artificial Sequence
  Synthetic
ttttttaacatgatgtgccttaaagtgcattttaatcatgaaatttgcacgcaggtgttccacaagagcatctct

SEQ ID NO: 353929 - DNA, 75 bp, Artificial Sequence
  Synthetic
ttagaggggatatagccacggccaccgagagtgtcatagtgaacgcagccaatagcaaaggacaaccaggaggtg

SEQ ID NO: 353930 - DNA, 75 bp, Artificial Sequence
  Synthetic
gatcaatggcgagcttgacgtttaaacagcgtcgagatacgccacccgaggggccacctgctaagaagaagcgta

SEQ ID NO: 353931 - DNA, 75 bp, Artificial Sequence
  Synthetic
cgtaggtgcactaaatcggttacgtctgttgtgtccacgctgttttatgacaaaagaatgcgaaccaccaaccca

SEQ ID NO: 353932 - DNA, 75 bp, Artificial Sequence
  Synthetic
gagtatgcggggcactgtacaagaaatttcctgatagcttcgacatgcaggctatagaagttggaaaggcccggt

SEQ ID NO: 353933 - DNA, 75 bp, Artificial Sequence
  Synthetic
aggagcctcaacagcaggtagctcaggcgcaggttaagaaaaagaacggaaaaccgaagaagaagaaaagtaacg

SEQ ID NO: 353934 - DNA, 75 bp, Artificial Sequence
  Synthetic
aaggagaccaaaatcgaaattgacactaccggaagtactaagcctaagaaggacgacttgatcttgacgtgcttc

SEQ ID NO: 353935 - DNA, 75 bp, Artificial Sequence
  Synthetic
tagtgaaaggtggcaagcacattattcacgcagtcgggccgaatttcaacaaagtggcggagatggaaggtgata

SEQ ID NO: 353936 - DNA, 75 bp, Artificial Sequence
  Synthetic
gagcaccacccccaaaaaatcagaagagcaccaagaagaagaccaataagaaacctggaaaaagacaacggatgg

SEQ ID NO: 353937 - DNA, 75 bp, Artificial Sequence
  Synthetic
agaggatgggtgaagcaattgcaaattgattacaagggcaatgaaatcatgacggctgcagcctcgcaaggcttg

SEQ ID NO: 353938 - DNA, 75 bp, Artificial Sequence
  Synthetic
agcagctagccgaggcttatgagtctatcgctaagctagtaaatgacaacaattaccagtccgtagccatcccct

SEQ ID NO: 353939 - DNA, 75 bp, Artificial Sequence
  Synthetic
ttatgaagttagaatcagacaaaacatttcctattttgctggatggaaaaattaatggatatgcttgcgttgttg

SEQ ID NO: 353940 - DNA, 75 bp, Artificial Sequence
  Synthetic
acccggaaaggagtctacgctgtcagatataaagtcaatgagaatcccttgtacgcacctagctcagagcacgtc

SEQ ID NO: 353941 - DNA, 75 bp, Artificial Sequence
  Synthetic
tgttgtccacaggaatttttgcagggagcaaggacagacttatgcagtctcttaaccatctattgactgctatgg

SEQ ID NO: 353942 - DNA, 75 bp, Artificial Sequence
  Synthetic
gaggaaagctatttcgacccatgcacgtggaaggcaaaattgacaatgaaactcttgcctccctgaagacgaaga

SEQ ID NO: 353943 - DNA, 75 bp, Artificial Sequence
  Synthetic
aatgtcctgcttacccgcacagaggataggattgtgtggaagaccttggctggagatccctggattaagactctc

SEQ ID NO: 353944 - DNA, 75 bp, Artificial Sequence
  Synthetic
atacaactgatgcagatattgcaatatattgtagggacaagaagtgggaaacgacactgaaggaggtcatagcac

SEQ ID NO: 353945 - DNA, 75 bp, Artificial Sequence
  Synthetic
aggcatccaaatacgacctagagtatgccgatgttcctcaaagcatgcgagcagatacctttaaatacacacatg

SEQ ID NO: 353946 - DNA, 75 bp, Artificial Sequence
  Synthetic
actgccagatacgttggcgacttcaccgccactctagaagagtggcaacaagagcatgatgccatcatgaagcac

SEQ ID NO: 353947 - DNA, 75 bp, Artificial Sequence
  Synthetic
gggagagtatacgacatgaacaccggtactttgcgcaattatgatccgcgcataaatttagtaccggtgaaccgt

SEQ ID NO: 353948 - DNA, 75 bp, Artificial Sequence
  Synthetic
ataagcctcaagggtattataattggcatcacggcgccgtgcagtatgaaaatgggagattcacggtgccgaaag

SEQ ID NO: 353949 - DNA, 75 bp, Artificial Sequence
  Synthetic
gacggtagactggttatctgaaacacctgattctacttttagggcgcgcctagatttaggcatacccaatgaact

SEQ ID NO: 353950 - DNA, 75 bp, Artificial Sequence
  Synthetic
atcttggagaagcctgaccctacagacgtgtttcagaacaaagctaacgtatgctgggccaaggccttagtacca

SEQ ID NO: 353951 - DNA, 75 bp, Artificial Sequence
  Synthetic
gtgtgggagcgaaaggagacagtggacgccccatactagataatcaaggcagagtcgtggccattgtgctgggag

SEQ ID NO: 353952 - DNA, 75 bp, Artificial Sequence
  Synthetic
gtgctgaagaccgccggtattgatttgacaacagaccaatggaacactgtagttcattttaaggaagacaaagct

SEQ ID NO: 353953 - DNA, 75 bp, Artificial Sequence
  Synthetic
gaagagaagcggtggaggaaatatgtatctcagaagattctaacgaagagcctgatgcggaactagttagagtac

SEQ ID NO: 353954 - DNA, 75 bp, Artificial Sequence
  Synthetic
gggtgaatgaaggatccaggacagctttgtccgtagttatgtggaatgaaaaaggggtcaccgtaaaatatacac

SEQ ID NO: 353955 - DNA, 75 bp, Artificial Sequence
  Synthetic
cattcggcagagatcgtactaaaccagctatgcgtacgattcttcggactggatttggactcaggtttgttctcc

SEQ ID NO: 353956 - DNA, 75 bp, Artificial Sequence
  Synthetic
accccaagagttcactggccggtagaaaggggtacagtgtgacggatggaaaaactttttcttacctagaaggta

SEQ ID NO: 353957 - DNA, 75 bp, Artificial Sequence
  Synthetic
cagaaaactgtgagcaatggtcactagttaccaccatgtgtcttctcgccaatgttacgttcccttgttccactc

SEQ ID NO: 353958 - DNA, 75 bp, Artificial Sequence
  Synthetic
gcacccaccgtaccactgtcaataaagagcaaccattgggacaattcgccctcaccgaacatgtatgggttgaac

SEQ ID NO: 353959 - DNA, 75 bp, Artificial Sequence
  Synthetic
ctaagttccaccaggctgccaaggacatagcggagattaacgccatgtggcccaaagtaacagaggccaacgaac

SEQ ID NO: 353960 - DNA, 75 bp, Artificial Sequence
  Synthetic
caccaatttgctacgaccgagcacccgcagaaaccctgatgatgcttagcaagaacattgacaatcctggctatg

SEQ ID NO: 353961 - DNA, 75 bp, Artificial Sequence
  Synthetic
aaggacgtggtgcgccaactttcagtgcgttaccctcagcttgcccgagcaacagcgacaggcagagtattcgat

SEQ ID NO: 353962 - DNA, 75 bp, Artificial Sequence
  Synthetic
aaatttgcttgtacatcctaggggagagcatgagcagtatacgttcgaaatgtcctgtggaagaatctgaggcct

SEQ ID NO: 353963 - DNA, 75 bp, Artificial Sequence
  Synthetic
atgaattgctggaagcagtgctgaaatgccccggcagacagaagagatctacggaggagttatttaaggagtaca

SEQ ID NO: 353964 - DNA, 75 bp, Artificial Sequence
  Synthetic
atgaataccgggacgctgcgaagctatgacccgcgtgtcaatctagtgcccgtcaatcgcaagctgccgcacgcg

SEQ ID NO: 353965 - DNA, 75 bp, Artificial Sequence
  Synthetic
ccacgcctccaactaccttgccgtgcctgtgcatccatgctatgacgcctgaaagagtgcaaaggcttaaggctt

SEQ ID NO: 353966 - DNA, 75 bp, Artificial Sequence
  Synthetic
aacttacacgtccgtacatggccaagtgtgtgcggtgtgccgttggaagttgccacagcccgatcgctatagaag

SEQ ID NO: 353967 - DNA, 75 bp, Artificial Sequence
  Synthetic
ctggttacacaccgctcggagcagccccgtagtgatttttctacgtttgttagtaagttgaggggtcgaacagtc

SEQ ID NO: 353968 - DNA, 75 bp, Artificial Sequence
  Synthetic
cgcgccctgagcagattactgtttgttcctcttttgctttgcccaagtatcgtattacgggtgtgcaaaaaattc

SEQ ID NO: 353969 - DNA, 75 bp, Artificial Sequence
  Synthetic
cagtaagaagcgacgggcatgacggctacatccgaatacagacatcatcacagtacggtttagacccctccggga

SEQ ID NO: 353970 - DNA, 75 bp, Artificial Sequence
  Synthetic
ctggttgtgggagataagatgaatatcactggtaagacagtcgactggctgtctgaaaatcctgaggccaccttc

SEQ ID NO: 353971 - DNA, 75 bp, Artificial Sequence
  Synthetic
aatgttccacccctatactgttttcaccgaaggttcccgattatataccaccacggcgatacattccttcgagtg

SEQ ID NO: 353972 - DNA, 75 bp, Artificial Sequence
  Synthetic
tttcatcaggcggcgaaggacatggcagaaattaacgctatgtggcctgccgctacagaggctaatgagcaggtg

SEQ ID NO: 353973 - DNA, 75 bp, Artificial Sequence
  Synthetic
acgttaagagcagagttatgaggtataatctgtatggcaagatcgtagaagttccattacatcaggtttcattac

SEQ ID NO: 353974 - DNA, 75 bp, Artificial Sequence
  Synthetic
tgcttatacattctgggtgaaagtatgagcagtataagatccaaatgccccgttgaggaatcagaggcatccacc

SEQ ID NO: 353975 - DNA, 75 bp, Artificial Sequence
  Synthetic
acacatctcggccttgccacattattgatggtcacggatatttcctcctcgcacgctgcccagagggcgactcta

SEQ ID NO: 353976 - DNA, 75 bp, Artificial Sequence
  Synthetic
aaatcccgtctagaccttggcatcccaaatgggctacccaaatatgacatcgtgtttgtgaacgttcggacgccc

SEQ ID NO: 353977 - DNA, 75 bp, Artificial Sequence
  Synthetic
tacaagtatcatcactaccagcaatgtgaagaccatgcgataaagctcagcatgctgacaaagaaagcgtgcttg

SEQ ID NO: 353978 - DNA, 75 bp, Artificial Sequence
  Synthetic
tcaccatggagtttaagaaggattccgtcacccattcctgttcagtgccttatgaagtgaaattcacacccgtgg

SEQ ID NO: 353979 - DNA, 75 bp, Artificial Sequence
  Synthetic
catctcaaccccggaggaacctgcgtcagcatcggttatggctatgcagacagggccagtgaaagcatcatcggg

SEQ ID NO: 353980 - DNA, 75 bp, Artificial Sequence
  Synthetic
aagcttcctctaggtggtctataccttcagcttctgattttgaactggacagcatttccatactagacggattca

SEQ ID NO: 353981 - DNA, 75 bp, Artificial Sequence
  Synthetic
gcagagaattatatagccatcccccagaacacggcacagaacatccgtgccgtgtgtatgtccacgacgcccagc

SEQ ID NO: 353982 - DNA, 75 bp, Artificial Sequence
  Synthetic
gctatcgcacggcagtttaagttttctagagtgtgtaagccgaaagcttcattggaggagacggaagtgctgttt

SEQ ID NO: 353983 - DNA, 75 bp, Artificial Sequence
  Synthetic
gcatgcaccagagctcttctgcaactagtactggtacgttttccataaggtcagcaccatctttaaattcattag

SEQ ID NO: 353984 - DNA, 75 bp, Artificial Sequence
  Synthetic
aaaaagatgcgtatgtggagatgcacctgcccgggtccgaagttgacagttccctgctctccatgagcggtagag

SEQ ID NO: 353985 - DNA, 75 bp, Artificial Sequence
  Synthetic
gttttcatagggtatgaccggagggttcgtacgcacaacccatacaaactatcctctaccctgaccaatatctac

SEQ ID NO: 353986 - DNA, 75 bp, Artificial Sequence
  Synthetic
ctagtagtgccaatcaatcgcaggccagttcgagagctagcgcaagtacatctagatcgaatcgcagtgctcgga

SEQ ID NO: 353987 - DNA, 75 bp, Artificial Sequence
  Synthetic
cggtccgggtaacaccaccatcagggcaaagtgtccttgtggagtgcaactgtggctccgctgtgtcagaaacca

SEQ ID NO: 353988 - DNA, 75 bp, Artificial Sequence
  Synthetic
accggatcgcacctgcatgaggccggatgtgccccttcctaccacgtggtacgtggagacattgccaacgccgag

SEQ ID NO: 353989 - DNA, 75 bp, Artificial Sequence
  Synthetic
ctagtcgtagctctcgggcaagttccaggaccagtgccggcaccagaagctcacggactagtaacgccagcgtta

SEQ ID NO: 353990 - DNA, 75 bp, Artificial Sequence
  Synthetic
taaacactgcaaaatcatacagccaatgcacaaaaacatcacaatgccgcgcgtaccgtctgcagaatgataagt

SEQ ID NO: 353991 - DNA, 75 bp, Artificial Sequence
  Synthetic
gagggggttattgtcaacgcagcaaatagcagagggcagccgggtgggggtgtatgtggggctctctacaaacgc

SEQ ID NO: 353992 - DNA, 75 bp, Artificial Sequence
  Synthetic
ccagcgatgcgcgtagcatagattcggatgaaaccgatgtttccatctttgacaaaaggttggagttcctggcca

SEQ ID NO: 353993 - DNA, 75 bp, Artificial Sequence
  Synthetic
gggtatacaattcagacaaacttccaaaggcatcgggagaaacgctgaaagggaaactgcatgtaccttatctcc

SEQ ID NO: 353994 - DNA, 75 bp, Artificial Sequence
  Synthetic
ttcccggagagtttcgacatgcaacccatcgaggtgggtaaatcaaggttagtaaaaggggcagcgaagcacatc

SEQ ID NO: 353995 - DNA, 75 bp, Artificial Sequence
  Synthetic
gtacaggctcaaggacaagcttagtatctaatccgccgggagtgaacagagtgattactagggaagaattcgagg

SEQ ID NO: 353996 - DNA, 75 bp, Artificial Sequence
  Synthetic
tttccgaagcgaagtgtaccgtacctttagcacccgagccaatagtaaccttcggctttcgattcgtatctttga

SEQ ID NO: 353997 - DNA, 75 bp, Artificial Sequence
  Synthetic
attcatgctgtggggccgaattttaacaaggtatcagagctggaaggggacaaacaattggccgaagcttatgaa

SEQ ID NO: 353998 - DNA, 75 bp, Artificial Sequence
  Synthetic
ctttcgtggcgcaacaacaatgacgatatgaagcgggtgcatacatattctcctcggacaccggccaaggacatt

SEQ ID NO: 353999 - DNA, 75 bp, Artificial Sequence
  Synthetic
aattgcatccacggaatccgacatatttgactacccgccagctagatggagaaccgaattacacccacgagctaa

SEQ ID NO: 354000 - DNA, 75 bp, Artificial Sequence
  Synthetic
tctgtcgctaagattattaatgacaatcattaccggacagtggcaataccgcttttgtctactggcatttttgcc

SEQ ID NO: 354001 - DNA, 75 bp, Artificial Sequence
  Synthetic
tacagcaaaaatcggtgaggcagacggtgctgtccgaggtcgtgctagaacgcacggaattggagatatcgtatg

SEQ ID NO: 354002 - DNA, 75 bp, Artificial Sequence
  Synthetic
tttcagaaccaacaactagaaattttacagtgactgagcatggatgggaatacgtttggggtaatcacccgcctc

SEQ ID NO: 354003 - DNA, 75 bp, Artificial Sequence
  Synthetic
gggaacaaggaccgacttatgcagtctctgaatcatttgctcacggcgttagatactaccgacgcggacgtggct

SEQ ID NO: 354004 - DNA, 75 bp, Artificial Sequence
  Synthetic
ccccgcgcctcgatttaaataaagaagaaattttaaggaagaaactgcaggccaaccccaccccggccaaccgta

SEQ ID NO: 354005 - DNA, 75 bp, Artificial Sequence
  Synthetic
agaggtactgggcacaggagacagctccaggcaacccgcatgggctgccgcacgaggtgattactcattactatc

SEQ ID NO: 354006 - DNA, 75 bp, Artificial Sequence
  Synthetic
atatattgtagagacaagaagtgggaggccaccctgaaagaagttatagcaaggagagaggctgttgaagagata

SEQ ID NO: 354007 - DNA, 75 bp, Artificial Sequence
  Synthetic
gtcgttaccagtcacgcaaagttgaaaatatgaaagctgttactacccagcgtgtcctcaaaggattaggacact

SEQ ID NO: 354008 - DNA, 75 bp, Artificial Sequence
  Synthetic
acaggtacccaatgtccacgattttcggactatcgatttgcgccgcagtggtaaccacctcaatagccgcatcca

SEQ ID NO: 354009 - DNA, 75 bp, Artificial Sequence
  Synthetic
tgtatctcggaagatgcgtctattgcggaaccggacgctgaattggtcagggtacatcccaagagctccctggcg

SEQ ID NO: 354010 - DNA, 75 bp, Artificial Sequence
  Synthetic
ttttgaaggctgaaggcaaggttgaatgctatcgaacactgtatccgatccccatttactcctcaagcgttgaca

SEQ ID NO: 354011 - DNA, 75 bp, Artificial Sequence
  Synthetic
cctggctgttgtgcaagtcgagagtatcttgtttgactccgtatcgactgaccccgaatgctcagttacctgtgt

SEQ ID NO: 354012 - DNA, 75 bp, Artificial Sequence
  Synthetic
gggcgcagaggctttagtacgaccgatgggaagacattctcataccttgaggggactaaatttcatcaggcggct

SEQ ID NO: 354013 - DNA, 75 bp, Artificial Sequence
  Synthetic
gggcattttctaatccgcgggtagccgtggaggcgtgcaatgttatgctgaaggaaaattttccaaccgtcacct

SEQ ID NO: 354014 - DNA, 75 bp, Artificial Sequence
  Synthetic
gtctagccttcctgtgctgcgcgaggacagcccgtgcagagaccacatgggaatcactagaccatttatggaacc

SEQ ID NO: 354015 - DNA, 75 bp, Artificial Sequence
  Synthetic
aaggatgtggctgagatcaacgcgatgtggcctaatgcaactgaggcgaatgaacagatctgcctgtacatcttg

SEQ ID NO: 354016 - DNA, 75 bp, Artificial Sequence
  Synthetic
cgtacgggatcattcctgagtacgatgcttatttggatatggtggatggtgcaacctgctgcttggacacagcga

SEQ ID NO: 354017 - DNA, 75 bp, Artificial Sequence
  Synthetic
ataatcaacagatgttctggagtcaactgctcattcccctagccgcgctcattgtggtgacccgcttgctgaagt

SEQ ID NO: 354018 - DNA, 75 bp, Artificial Sequence
  Synthetic
ggagagagcatgagcagcattcgttcaaagtgtccagttgaagaatcagaagcttcgacaccacccagtacattg

SEQ ID NO: 354019 - DNA, 75 bp, Artificial Sequence
  Synthetic
acttctgtccagccaagttgcgtagctttccaaaaagacatgcctacttagaaccgacagtgagatcggctgtcc

SEQ ID NO: 354020 - DNA, 75 bp, Artificial Sequence
  Synthetic
ccatgcctatgcatccattccatgacacccgaacgagttcacagacttaaggcctcacgtcctgagcagataacg

SEQ ID NO: 354021 - DNA, 75 bp, Artificial Sequence
  Synthetic
cttccgctatacagaacacactgcagaatgtattggcagcggccacgaaaagaaattgcaatgtgacacaaatga

SEQ ID NO: 354022 - DNA, 75 bp, Artificial Sequence
  Synthetic
caagttgcgtagctttccgaagaaacacgcatacctcgagcccaccattcggtctgcagtcccatcagcaattca

SEQ ID NO: 354023 - DNA, 75 bp, Artificial Sequence
  Synthetic
gtgtgctcgtctttctcgttgcccaagtacaggatcaccggagtgcaaaaaattcaatgctctcatcctatactc

SEQ ID NO: 354024 - DNA, 75 bp, Artificial Sequence
  Synthetic
taatacagtagtcaaccgcgcagggtacgcaccattggcaatcagcattattccaaccaagatacggctaattcc

SEQ ID NO: 354025 - DNA, 75 bp, Artificial Sequence
  Synthetic
gagaattacccgtattagattcagctgcatttaatgtggaatgctttaagaaatttgcctgcaatcaggagtatt

SEQ ID NO: 354026 - DNA, 75 bp, Artificial Sequence
  Synthetic
ttcctcccgaaagtgcctgagtacattcatccgcgcaggtatcttccccaaacggagaaccctgtggatccacct

SEQ ID NO: 354027 - DNA, 75 bp, Artificial Sequence
  Synthetic
tactttgaatttagaatatattacatgccactataagacaggattagattcacctttcattaaatgctgcggaac

SEQ ID NO: 354028 - DNA, 75 bp, Artificial Sequence
  Synthetic
ggaagaccttcaaagaaaatcccattcgactgaccacagaaaatgtaacgaattatattaccaagttaaaaggcc

SEQ ID NO: 354029 - DNA, 75 bp, Artificial Sequence
  Synthetic
gagtgttttaaaaaatacgcttgcaataatgagtactgggagacctacaagaagaatcctattagattgaccgag

SEQ ID NO: 354030 - DNA, 75 bp, Artificial Sequence
  Synthetic
gcaggaatgccccaaagtgaatagacccgatgaacagtgtaaagtcttcacgggggtgtatccgtttatgtgggg

SEQ ID NO: 354031 - DNA, 75 bp, Artificial Sequence
  Synthetic
gaacttccggagccttcagccgtcgccacacctacagcagacggtcagacagaggaggccatgagcataatgtcg

SEQ ID NO: 354032 - DNA, 75 bp, Artificial Sequence
  Synthetic
gaaacgactgttgcctctcttgtacctaatgagattgagccatcaaccgccgccacacctgcagcagatagtcag

SEQ ID NO: 354033 - DNA, 75 bp, Artificial Sequence
  Synthetic
aggcgcctactgcttctgtgactctgaaaacacgcaaattagtcgagcgtatgtgatgaaatcagatgactgctc

SEQ ID NO: 354034 - DNA, 75 bp, Artificial Sequence
  Synthetic
tggacctgaaacgcgatgttaaagtaacaccaggtaccaagcacactgaagaacgtcctaaagtgcaggtaatac

SEQ ID NO: 354035 - DNA, 75 bp, Artificial Sequence
  Synthetic
acagaggagaccatgagcataatgtcggaaacgactgttgcctcttttgtacctaatgagattgtggtcgaagcg

SEQ ID NO: 354036 - DNA, 75 bp, Artificial Sequence
  Synthetic
agctgaccacgccttggcctacaaagctcatactgcctcagtccaagcttttctgaatataactgtgggagagca

SEQ ID NO: 354037 - DNA, 75 bp, Artificial Sequence
  Synthetic
aggcagcagacccactcgcaaccgcgtatctgtgtggaatacatagggaacttgtgaggaggctaaatgcagtac

SEQ ID NO: 354038 - DNA, 75 bp, Artificial Sequence
  Synthetic
caagtacactcagaccttatgcgcttctcctctagctggtcaataccgcaagcatctgacttcgatgtagacagc

SEQ ID NO: 354039 - DNA, 75 bp, Artificial Sequence
  Synthetic
atcgacgacagcggtagtgtacgtgaatggagaaacaccggtcaattttaacggcattaaattggttgcaggccc

SEQ ID NO: 354040 - DNA, 75 bp, Artificial Sequence
  Synthetic
tcctgcctaatgtgcatactttgtttgatatgtcagcagaagactttgatgccattattgcagaacatttttcac

SEQ ID NO: 354041 - DNA, 75 bp, Artificial Sequence
  Synthetic
gtgtcagtccagggcaccgtggatatattcaacagtgcgctgcaggaggatgcgagtagtgtagcatcgtcgtac

SEQ ID NO: 354042 - DNA, 75 bp, Artificial Sequence
  Synthetic
tttatcaactgcctggaccccatttgatcggaaagtggtgcagtacgccggagagatctacaattatgacttccc

SEQ ID NO: 354043 - DNA, 75 bp, Artificial Sequence
  Synthetic
aaggtgacatagtgcttgagactgacattgcatcctttgacaagagtgaggacgatgcgatggcgctaacagcgc

SEQ ID NO: 354044 - DNA, 75 bp, Artificial Sequence
  Synthetic
tgctcgggaataaaacctgtccctgcaccgcgcactgtttttactcaatcaccaaaacctcgcagacggcgccgt

SEQ ID NO: 354045 - DNA, 75 bp, Artificial Sequence
  Synthetic
ggagtacggagctgggcatgcaggggcgttcggggatcttcaagccagaacaatcaccagtaatgacctgtacgc

SEQ ID NO: 354046 - DNA, 75 bp, Artificial Sequence
  Synthetic
tgatgattttggaagatctaggcgtcgaccaggaactgttaacattgatagaagcagcttttggggaaataacat

SEQ ID NO: 354047 - DNA, 75 bp, Artificial Sequence
  Synthetic
cgatctaaagccagcacgagttctacggcccctctggtgaccacatcccgtgctacatcacgatcaagccttgtc

SEQ ID NO: 354048 - DNA, 75 bp, Artificial Sequence
  Synthetic
caacacgaatttagtattgcaaagacccaacacaggcaccatccatgttccttacacgcaggcaccgtcaggctt

SEQ ID NO: 354049 - DNA, 75 bp, Artificial Sequence
  Synthetic
caattcatttgccaaccaagacaaaattcaggttcggagccatgatgaaatctggcatgttcttaaccttgttcg

SEQ ID NO: 354050 - DNA, 75 bp, Artificial Sequence
  Synthetic
tcaaatccacctggggaaaaggtgaccacatcccgtgccacatcacgatcaagccttgtctcaaatccacctggg

SEQ ID NO: 354051 - DNA, 75 bp, Artificial Sequence
  Synthetic
tgagcagtggaagaaagacaaaccaccatcattaaagtacaccgcaccatttgggtgcgaaattcatgtgaatcc

SEQ ID NO: 354052 - DNA, 75 bp, Artificial Sequence
  Synthetic
tgaatactatcatcaatatagtcatagctagtcgagtgctccgtgagcggctaaccaattcaccgtgtgccgcat

SEQ ID NO: 354053 - DNA, 75 bp, Artificial Sequence
  Synthetic
gaaaagagggttattactagagaggagttcgaggcctttgttgcgcaacagcaatgacggtacgaagcgggtgcg

SEQ ID NO: 354054 - DNA, 75 bp, Artificial Sequence
  Synthetic
cgtcagagctgagaattgcgcagtaggatttataccattagccttcgacatacccgatgccttgtttaccagggt

SEQ ID NO: 354055 - DNA, 75 bp, Artificial Sequence
  Synthetic
ttataggtgatgacaacattatcaagggggttaagtccgacaagctgatggcggatcgatgcgcgacctggctga

SEQ ID NO: 354056 - DNA, 75 bp, Artificial Sequence
  Synthetic
tacattttttcctctgataccggtcaggggcatttacaacaaaagtcagtgaggcagacgacgctgtccgaggta

SEQ ID NO: 354057 - DNA, 75 bp, Artificial Sequence
  Synthetic
gtcagaaacaccgacgttgtcgagcgctgagtgctccttgaatgagtgtacatactcaacggactttggcgggat

SEQ ID NO: 354058 - DNA, 75 bp, Artificial Sequence
  Synthetic
acatggaggttaagatcattgatgcagtagtcggtgagaaagcaccatacttttgtggagggtttatactgtgtg

SEQ ID NO: 354059 - DNA, 75 bp, Artificial Sequence
  Synthetic
gtacttgaacggacagagttagagcattcgtacgccccgcgcctcgacctagagaaagaagagatactacgtaaa

SEQ ID NO: 354060 - DNA, 75 bp, Artificial Sequence
  Synthetic
cgccactgtcaagtactcggctagtaaatcaggcaaatgcgcagtacatgttccctcaggcactgcaactctgaa

SEQ ID NO: 354061 - DNA, 75 bp, Artificial Sequence
  Synthetic
actcagttacaggtacagcatgtagggtggctgatccactgaaacgactatttaaacttggaaagccactggctg

SEQ ID NO: 354062 - DNA, 75 bp, Artificial Sequence
  Synthetic
aaattacaattgaacccgacaccagctaataggagcagatatcaatccagaagagtggagaacatgaaagcggtg

SEQ ID NO: 354063 - DNA, 75 bp, Artificial Sequence
  Synthetic
agagtcattggtggaagtggtcgaacaagggtcaatgacccttcacttttcgaccgccagtatacacccagagtt

SEQ ID NO: 354064 - DNA, 75 bp, Artificial Sequence
  Synthetic
ccgacgacgaacatgatgacgatcggcgccgagcactctatgaggaagccgaacggtggtgtcgagtaggtatct

SEQ ID NO: 354065 - DNA, 75 bp, Artificial Sequence
  Synthetic
actaccaaaagactcctcggtggtttggggagctacctgaaaacagaaggaaaggttgaatgctaccgtacactg

SEQ ID NO: 354066 - DNA, 75 bp, Artificial Sequence
  Synthetic
taaattgcagatctgtacgaaggtactcacatgtaaaggcgactgtcatccgcctaaagaccatattgtgacgca

SEQ ID NO: 354067 - DNA, 75 bp, Artificial Sequence
  Synthetic
tcgctgagttgtgtaaggcagtggagtcacgttatgaagtgataggaacctccatcattataatggctatggcag

SEQ ID NO: 354068 - DNA, 75 bp, Artificial Sequence
  Synthetic
tatcctgttcccgagtattctgcaagcgtcaaccaagtcttttctagtccgcgcgtggctattgaagcatgtaat

SEQ ID NO: 354069 - DNA, 75 bp, Artificial Sequence
  Synthetic
cccccagcaccacgcccagacatttacagctgcggtatccaagaccgcttggacgtggttaacgtcactcttagg

SEQ ID NO: 354070 - DNA, 75 bp, Artificial Sequence
  Synthetic
ccttggcaaaggataatgccgcctttagacacctaagagggaaccccatagttctctacggctaacctgaatgga

SEQ ID NO: 354071 - DNA, 75 bp, Artificial Sequence
  Synthetic
gctgtattgaaagagaattttccaacagtgacttcatactgcataacacccgagtatgacgcctacatggacatg

SEQ ID NO: 354072 - DNA, 75 bp, Artificial Sequence
  Synthetic
ggggcccctatatccctctacggctaacctgaatggactgcgacgtagtcaagtccgccgaaatgtttccttatc

SEQ ID NO: 354073 - DNA, 75 bp, Artificial Sequence
  Synthetic
agggtcagcagtaattattataattggccttgtattagcaactgttgttgctatgtatgtgctgaccaaccagaa

SEQ ID NO: 354074 - DNA, 75 bp, Artificial Sequence
  Synthetic
gttgatggagcctcctgctgtttagacactgctagcttttgcccagcaaagttgcgcagctttccgaaacgacac

SEQ ID NO: 354075 - DNA, 75 bp, Artificial Sequence
  Synthetic
acataattagaccacagcagcgattggaaagctgcctattagaaacatgtagcggcaattggcaagccgcctata

SEQ ID NO: 354076 - DNA, 75 bp, Artificial Sequence
  Synthetic
aaacccttttccggcaccacgccggccgtggtttcctcgacctgatccgttcctggcgatgcgagtcgaagagtt

SEQ ID NO: 354077 - DNA, 75 bp, Artificial Sequence
  Synthetic
gcctatctggagccaactattcgttctgcagtaccatcagccatacagaataccttgcagaatgtgctggcggcg

SEQ ID NO: 354078 - DNA, 75 bp, Artificial Sequence
  Synthetic
aatgtttagcagcaattggcaagctgcatatataaattacctagcggcaattggcacgccgcttataaaattttt

SEQ ID NO: 354079 - DNA, 75 bp, Artificial Sequence
  Synthetic
ggcccgtacgatggccaacttgacgttcaagcagcgtcggaacgcgaatccaggcgggccaccggccaagaaacg

SEQ ID NO: 354080 - DNA, 75 bp, Artificial Sequence
  Synthetic
gccacaaaaagaaactgtaacgttacccagatgagagagttacctgttttggattccgctgcttttaacgtggag

SEQ ID NO: 354081 - DNA, 75 bp, Artificial Sequence
  Synthetic
cgcatgagagaagcccagaccaattacctacccaaaatggagaaagttcacgttgacatcgaggaagacagccca

SEQ ID NO: 354082 - DNA, 75 bp, Artificial Sequence
  Synthetic
caagccggctaatcaagggaatggctctggaaaagtcaatgggaagaagaacaatcaaccacaaggaaagaagca

SEQ ID NO: 354083 - DNA, 75 bp, Artificial Sequence
  Synthetic
tgttttaaaaaatatgcatgtaataatgaatattgggaaacgtacagggaacatcctattaggctaaccgaggag

SEQ ID NO: 354084 - DNA, 75 bp, Artificial Sequence
  Synthetic
gaagaaaaagaatcctgggaaaactggaaaccaaactggcaagaaaaacgccaaggcgaagaataagccaggcaa

SEQ ID NO: 354085 - DNA, 75 bp, Artificial Sequence
  Synthetic
tcccgcagtttgaggtagaagccaagcaggtcactgataatgaccatgctaatgccagagcgttttcgcatctgg

SEQ ID NO: 354086 - DNA, 75 bp, Artificial Sequence
  Synthetic
aatgtaaccaattacattactaaattgaagggcccgaaagcagccgctttgtatgcaaaaactcataaccttagc

SEQ ID NO: 354087 - DNA, 75 bp, Artificial Sequence
  Synthetic
gaggcagcgaatggtcatgaaattggaatcggacaagacgttccccattttactggacggacgcgtaaatgggta

SEQ ID NO: 354088 - DNA, 75 bp, Artificial Sequence
  Synthetic
tgcgtgcgtggtaggaggtaaactattccgccctatgcacgtagaaggtaagatcgacaatgacgttttgtccac

SEQ ID NO: 354089 - DNA, 75 bp, Artificial Sequence
  Synthetic
atgttgcaggatattccaatggataggttcgttatggacttgaaaagagatgtcaaggtgacgcctggtactaaa

SEQ ID NO: 354090 - DNA, 75 bp, Artificial Sequence
  Synthetic
catcaagaccaagaaagcctcaaaatatgatctagagtatgcagatgttccccaaaatatgagatcagacacatt

SEQ ID NO: 354091 - DNA, 75 bp, Artificial Sequence
  Synthetic
caagtacacccacgaaaagccccaaggctactacaactggcaccatggagcagtccagtatgaaaatggaagatt

SEQ ID NO: 354092 - DNA, 75 bp, Artificial Sequence
  Synthetic
catacggaggagaggccgaaggtgcaggtcatccaggcggcggacccattggctacggcttacctgtgcggaatc

SEQ ID NO: 354093 - DNA, 75 bp, Artificial Sequence
  Synthetic
cactgtgcctaaaggtgtaggagcgaaaggcgatagcggccgtcccattctggacaatcaagggagagtggtagc

SEQ ID NO: 354094 - DNA, 75 bp, Artificial Sequence
  Synthetic
catcgagagctagtgcgcaggctgaatgcggtcctattgcctaacgtccataccttgtttgacatgtctgctgaa

SEQ ID NO: 354095 - DNA, 75 bp, Artificial Sequence
  Synthetic
tatcgtcctaggtggggctaatgaaggatctaggactgccctctccgtggtgacatggaacgaaaaaggtgtcac

SEQ ID NO: 354096 - DNA, 75 bp, Artificial Sequence
  Synthetic
gacttcgacgccattattgccgaacattttcagcccggagacagtgtgttagagactgacattgcgtcgtttgat

SEQ ID NO: 354097 - DNA, 75 bp, Artificial Sequence
  Synthetic
ggtcaaatatacaccggaaaattgtgaacagtggtctttgattaccaccatgtgcatactggctaatgtcacctt

SEQ ID NO: 354098 - DNA, 75 bp, Artificial Sequence
  Synthetic
aagagcgaggatgatgcaatggcgttgactgctctgatgatattggaggatttgggcgtagatccagagctgctc

SEQ ID NO: 354099 - DNA, 75 bp, Artificial Sequence
  Synthetic
cccatgcgcacagccaccgatgtgctatgacaaacaaccatcggagacccttgcactgctgagtgcgaacgtaga

SEQ ID NO: 354100 - DNA, 75 bp, Artificial Sequence
  Synthetic
acactaatagaggctgcatttggggagatatcatccatccatctccccacgaaaaccaagtttaaatttggagca

SEQ ID NO: 354101 - DNA, 75 bp, Artificial Sequence
  Synthetic
caacccagggtacgatgagctgttagatggagtactgagatgtcaagggaggtccaagaggtccctggacgacct

SEQ ID NO: 354102 - DNA, 75 bp, Artificial Sequence
  Synthetic
atgatgaagtctggtatgtttcttactttgtttattaacacggttatcaacattgtcatagccagcagagttcta

SEQ ID NO: 354103 - DNA, 75 bp, Artificial Sequence
  Synthetic
gttcaaagaatacaagctgactaagccgtacatggcaacgtgtgcacggtgcgccgtaggtagctgccagagccc

SEQ ID NO: 354104 - DNA, 75 bp, Artificial Sequence
  Synthetic
cgtgaacgtctgaccaactcaccctgtgctgcatttattggtgacgacaacatcgtcaagggtatcaagtcagat

SEQ ID NO: 354105 - DNA, 75 bp, Artificial Sequence
  Synthetic
tgtggccattgaatctgctctaagcgaagggcatgatgggtacgtgcgcttgcaaacatcttcacagtacggctt

SEQ ID NO: 354106 - DNA, 75 bp, Artificial Sequence
  Synthetic
aagctgatggccgatagatgtgctacctggctgaacatggaagtcaagatcatcgatgccgtagtaggaacaaaa

SEQ ID NO: 354107 - DNA, 75 bp, Artificial Sequence
  Synthetic
ggatccttccggaactgtaaaagggagaactatgcgatactacttgcatggaaaaattgaggaaattccactaca

SEQ ID NO: 354108 - DNA, 75 bp, Artificial Sequence
  Synthetic
gccccttatttttgtggaggcttcatcttgtgtgacacagtaacaggtacagcatgtcgggtggctgaccctctg

SEQ ID NO: 354109 - DNA, 75 bp, Artificial Sequence
  Synthetic
tgaagttacactcaggacttcacaaccctgtcacatcgtggacgggcacggttattttcttttagccaggtgccc

SEQ ID NO: 354110 - DNA, 75 bp, Artificial Sequence
  Synthetic
aagagattgttcaaactagggaagccgctcgcagcagacgacgaacatgacgatgatcgtcgtcgggctttgcat

SEQ ID NO: 354111 - DNA, 75 bp, Artificial Sequence
  Synthetic
ggcgggtcactcaatcacattggaattcaagaagaatgccgtgctgcactcgtgcacagtacctcacgaggtgaa

SEQ ID NO: 354112 - DNA, 75 bp, Artificial Sequence
  Synthetic
gaggagtcagctcgctggaaccgtgtgggcatacactccgagctgtgtaaggccgtagagtcacgctatgaaact

SEQ ID NO: 354113 - DNA, 75 bp, Artificial Sequence
  Synthetic
attcaacccagtgggtagagaactgtattcccagccgcccgaacacggagtagaacacccatgccacgtctacgc

SEQ ID NO: 354114 - DNA, 75 bp, Artificial Sequence
  Synthetic
acaggtacatctgtaatcataacagccatgactaccctggcacagagtgtctccgcattcaaacatctgagagga

SEQ ID NO: 354115 - DNA, 75 bp, Artificial Sequence
  Synthetic
tcacgatgcgcaagtacgtggttcctacgttgaaatgcaccttcctggatcggaagtagacagttcgttactgtc

SEQ ID NO: 354116 - DNA, 75 bp, Artificial Sequence
  Synthetic
aaccctctgaccctctacggctaacctgaatggactgtgacgtagtacagtccccaaaaatgttcccttatcaac

SEQ ID NO: 354117 - DNA, 75 bp, Artificial Sequence
  Synthetic
catgagtgggaatgcggtgaaagtaactccgccagctggaacgaatgtgttcgtggagtgcaaatgcagcagtgg

SEQ ID NO: 354118 - DNA, 75 bp, Artificial Sequence
  Synthetic
caaccatgtttccaatgcaaccagcaccctttcgcaatccttatgctgcgcctagaagaccgtggttcccgagga

SEQ ID NO: 354119 - DNA, 75 bp, Artificial Sequence
  Synthetic
gcaaatatcagaaaccaccagccaggccaaaacgtacaaccagtgcacgcagacatcacaatgccgggtgtacag

SEQ ID NO: 354120 - DNA, 75 bp, Artificial Sequence
  Synthetic
ccgaccccttcttagctatgcaggtgcaggagttggcccggtcgatggcgaacctgacgtttaaacagcgtcggg

SEQ ID NO: 354121 - DNA, 75 bp, Artificial Sequence
  Synthetic
gctgcagatggacaagtgggtttacaattccgataagctcccaaaagcagcaggcgagacgctgaaagggaagct

SEQ ID NO: 354122 - DNA, 75 bp, Artificial Sequence
  Synthetic
gcgccatgccaggcgggccccctgcaaaaaagaagcggaaggaaccacagcagcaggttactcaggcgcaggata

SEQ ID NO: 354123 - DNA, 75 bp, Artificial Sequence
  Synthetic
gcacgtgccctacctccttacaggtgcgaagtgcactgtgccattagcccctgagcccgtgctgcgttttggtta

SEQ ID NO: 354124 - DNA, 75 bp, Artificial Sequence
  Synthetic
tctcattaccgccgaggacgtacaagaagctaagtgcgcagccgatgaggctaaggaggtgcgtgaagccgagga

SEQ ID NO: 354125 - DNA, 75 bp, Artificial Sequence
  Synthetic
agaagaagaatggaaagatgaaaaagaagaaacgtaatggagcagccccccctaaaaataaaaatagtcccaaga

SEQ ID NO: 354126 - DNA, 75 bp, Artificial Sequence
  Synthetic
gcatgtgcccttcgtactgaccgaagcaaaatgcacagtaccattggctccagaacccattatcacctttgggtt

SEQ ID NO: 354127 - DNA, 75 bp, Artificial Sequence
  Synthetic
agaaaacgaacaagaaacccggaaaaaggcagaggatggtcatgaagttggaatctgataaaacatttccgatca

SEQ ID NO: 354128 - DNA, 75 bp, Artificial Sequence
  Synthetic
cagatcagtttctatgaagttacacccgaagcaccccacgtatttgacaacacgtcatttgactggggaacctca

SEQ ID NO: 354129 - DNA, 75 bp, Artificial Sequence
  Synthetic
ggttactcacgagctgattactgagcctaccaccaagaatttttctgtcacagaccagggttgggaatttgtgtg

SEQ ID NO: 354130 - DNA, 75 bp, Artificial Sequence
  Synthetic
tgctggacggaaagatcaaccgatatgcttgcgtggtcggaggcaagctattccgacctatgcatgtagaaggaa

SEQ ID NO: 354131 - DNA, 75 bp, Artificial Sequence
  Synthetic
gggaaaccatcccccgaagagattctgggcgcaggagacagcaccaggagacccgcatggaatgccacatgaaat

SEQ ID NO: 354132 - DNA, 75 bp, Artificial Sequence
  Synthetic
aaattgataatgacacccttgccgcattgaagatgaagaaagcatccaaatatgacttagagtatgctgatgtac

SEQ ID NO: 354133 - DNA, 75 bp, Artificial Sequence
  Synthetic
aataacacactactaccacaggtacccactaactacgactgtagggttgtccatttgcgccgctataatagcatt

SEQ ID NO: 354134 - DNA, 75 bp, Artificial Sequence
  Synthetic
cccagaacatgcgctcagatactcttaaatatacacatgagaaaccccagggatactataactggcaccacggcg

SEQ ID NO: 354135 - DNA, 75 bp, Artificial Sequence
  Synthetic
atcgtgtggcgcaactacgtggatgctctgcaagtcgcggaacacgtgcctcaccccttacagactgaccccgaa

SEQ ID NO: 354136 - DNA, 75 bp, Artificial Sequence
  Synthetic
ccgtgcagtatgaaaatgggagatttacagtgccgaaaggagtaggagcaaaaggagacagcggacgccctatat

SEQ ID NO: 354137 - DNA, 75 bp, Artificial Sequence
  Synthetic
tgcccagttaccattctgcgtagcattagcgtgttgcgcacgtacagcgagggcagagaccgcatgggagagtct

SEQ ID NO: 354138 - DNA, 75 bp, Artificial Sequence
  Synthetic
tggacaaccagggcagagtagtggctatagtgctgggcggtgcaaacgagggatcaaggacagctttgtccgtag

SEQ ID NO: 354139 - DNA, 75 bp, Artificial Sequence
  Synthetic
cgaccacctgtggaacaacaaccagcaaatgttctgggtccagctgctgttacctctagctgcactcatcgtact

SEQ ID NO: 354140 - DNA, 75 bp, Artificial Sequence
  Synthetic
tcatgtggactgaaaaaggggtcacagtgaaatacacaccagagaattgcgagcaatggtcgctggtcaccacct

SEQ ID NO: 354141 - DNA, 75 bp, Artificial Sequence
  Synthetic
agcaagaatcatcaaatgcctgtgttgcgtggtgccttttttagtgctagccggcgccgtaggcgccggcgcatt

SEQ ID NO: 354142 - DNA, 75 bp, Artificial Sequence
  Synthetic
tgtgcctcctcgcgaacgtcacattcccttgctccacacccccgatttgctacgaccgagcacctgccgaaactt

SEQ ID NO: 354143 - DNA, 75 bp, Artificial Sequence
  Synthetic
cgagcacgcgaccacgatgccgaatcaggtggggatgccgtttaacactatcgtcaatagacccgggtacgctcc

SEQ ID NO: 354144 - DNA, 75 bp, Artificial Sequence
  Synthetic
tgacaatgctcagtaccaacattgaaaacccgggttatgatgaattgcttgaagccgtattgaagtgtccaggta

SEQ ID NO: 354145 - DNA, 75 bp, Artificial Sequence
  Synthetic
tctggccatcagcgtgaccccgatcaaagtcaaacttgtgccgacgctaaatctagagtacattacttgccatta

SEQ ID NO: 354146 - DNA, 75 bp, Artificial Sequence
  Synthetic
ggcagaagagatccacggaagcgctgtttaaagaatacaagctaacacgcccgtacatggcaaagtgcgtccgat

SEQ ID NO: 354147 - DNA, 75 bp, Artificial Sequence
  Synthetic
caagacagggcttgattccccagctatcaaatgctgtgggatacaagaatgtactgcggccacaagaccagacga

SEQ ID NO: 354148 - DNA, 75 bp, Artificial Sequence
  Synthetic
gcgcagtgggcagctgtcacagcccaattgccatagaagcagtgcggagtgatgggcacgacggctacattaggt

SEQ ID NO: 354149 - DNA, 75 bp, Artificial Sequence
  Synthetic
acagtgcaaggtgttcaccggggtatacccattcatgtggggaggggcatattgcttctgcgacaccgagaacac

SEQ ID NO: 354150 - DNA, 75 bp, Artificial Sequence
  Synthetic
tacagacatcatctcagtacggtttggaccccgcaggtaatgtgaagagcagagttatgaggtacaatctgtatg

SEQ ID NO: 354151 - DNA, 75 bp, Artificial Sequence
  Synthetic
gcaagtgagcaaggcatacgtcacaaaatcagacgactgcacccacaaccatgccacggcatacaaggcacacac

SEQ ID NO: 354152 - DNA, 75 bp, Artificial Sequence
  Synthetic
acctaaaaaggcagtgctctgcggggatcccaaacagtgcggtttttttaacatgatgtgcctgaaagtgcattt

SEQ ID NO: 354153 - DNA, 75 bp, Artificial Sequence
  Synthetic
gcaagatcgtagagattccactacatgaagtctcgttgcatacatcgcggccgtgtcacatcatagacggccatg

SEQ ID NO: 354154 - DNA, 75 bp, Artificial Sequence
  Synthetic
cgcatctgtccaggcacagctgaacataactgttggagatctattcaccaccgctatcatttacgtgaatggaga

SEQ ID NO: 354155 - DNA, 75 bp, Artificial Sequence
  Synthetic
gatacttcctcttagcacgctgcccggaaggagactctattactatggagtttagaaaggattcagtcacccact

SEQ ID NO: 354156 - DNA, 75 bp, Artificial Sequence
  Synthetic
aacacccgtcaacttcaacggtgtgaaaatggtggcagggccactatccactgcctggacaccctttgacaggaa

SEQ ID NO: 354157 - DNA, 75 bp, Artificial Sequence
  Synthetic
cttgctctgtgccgtatgaagtgaaatttacaccagtgggcagagaactgtacagtcatccgcccgagcatggag

SEQ ID NO: 354158 - DNA, 75 bp, Artificial Sequence
  Synthetic
aatcgtgcaatatgcaggcgaagtgtacaattatgattttccagagtacggagcaggacacgctggggcttttgg

SEQ ID NO: 354159 - DNA, 75 bp, Artificial Sequence
  Synthetic
cggaacacccatgccgtgtgtacgctcacgatgcccagcagaaggatgcgtatgtagagatgcacctacccggtt

SEQ ID NO: 354160 - DNA, 75 bp, Artificial Sequence
  Synthetic
agacattcaagctcggaccacatctagccctgacgtttatgcaaataccaatcttgtactgcaaagacctaaggc

SEQ ID NO: 354161 - DNA, 75 bp, Artificial Sequence
  Synthetic
ctgaagtagacagttcgttactctccatgagtggtagcgctgtccgggtaacaccaccgtctgggcagaacgtgc

SEQ ID NO: 354162 - DNA, 75 bp, Artificial Sequence
  Synthetic
aggattcatccatgtcccgtacacacaagcaccatcaggatttgcccaatgggtgaaggacaaaccaccatcttt

SEQ ID NO: 354163 - DNA, 75 bp, Artificial Sequence
  Synthetic
ttgtagagtgtaattgcggctcggcagtatctgaaaccatcagcaccgcaaagacatacaatcagtgcactaaga

SEQ ID NO: 354164 - DNA, 75 bp, Artificial Sequence
  Synthetic
gaagtacaccgccccttttgggtgcgaaatacaagtgaacccggtgcgggcggaaaactgcgccgtaggctctat

SEQ ID NO: 354165 - DNA, 75 bp, Artificial Sequence
  Synthetic
cctcccagtgccgtgcgtatcgcttacagaatgacaagtgggtgtacaattcggataaacttccaaaagcatcag

SEQ ID NO: 354166 - DNA, 75 bp, Artificial Sequence
  Synthetic
accactatctttcgacattcccgatgccttgtttaccagggtctcggatacaccgacactatccacggccgagtg

SEQ ID NO: 354167 - DNA, 75 bp, Artificial Sequence
  Synthetic
gagaaaccttgaaaggaaaattgcacgtgccctaccttctgtctgatgcgaagtgcactgtgccactggcaccgg

SEQ ID NO: 354168 - DNA, 75 bp, Artificial Sequence
  Synthetic
cacactcaatgaatgtgtttactcatctgacttcggcgggatcgccacggtcaaatatgccgctagtaaaccagg

SEQ ID NO: 354169 - DNA, 75 bp, Artificial Sequence
  Synthetic
ggcacggctacattgaaagaagccgcagtcgagttggccgaacagggttcggctactatacatttttcgactgcc

SEQ ID NO: 354170 - DNA, 75 bp, Artificial Sequence
  Synthetic
aaccaatagtgacctttggtttccggtccatttccttaaaattacacccacgcaatccaacctatctgactactc

SEQ ID NO: 354171 - DNA, 75 bp, Artificial Sequence
  Synthetic
aaaatgcgctgtacatatatcatcaagtacggccactttgaaagaatcagtggtcagcctaactgaagaaggctc

SEQ ID NO: 354172 - DNA, 75 bp, Artificial Sequence
  Synthetic
gccaactagatggcgagccaaattatacccatgaacttatttcagaaccctcgattagaaattttactgtgacgg

SEQ ID NO: 354173 - DNA, 75 bp, Artificial Sequence
  Synthetic
gctaacattccacttttcaacagcgagcatccacccagaatttacaatgcaaatttgcacctcagaggtgctttg

SEQ ID NO: 354174 - DNA, 75 bp, Artificial Sequence
  Synthetic
agcacggatgggaatacgtttggggcaaccatccgccccaacggtattgggcacaagaaacagctccaggtaacc

SEQ ID NO: 354175 - DNA, 75 bp, Artificial Sequence
  Synthetic
cagaggagattgtcaccctcctaaagatcatattgtgacacaaccacaacagcacgtccaaacttatacagcggc

SEQ ID NO: 354176 - DNA, 75 bp, Artificial Sequence
  Synthetic
cacacgggctgccgcatgaggtgattattcattactatcacaggtaccctatgtctactacactcggattgtcga

SEQ ID NO: 354177 - DNA, 75 bp, Artificial Sequence
  Synthetic
agtctctaagaccgcctggacgtggctaacctctttacttggagggtcagcagctataattattattggcctcgt

SEQ ID NO: 354178 - DNA, 75 bp, Artificial Sequence
  Synthetic
tctgcgccgctgtggtaatcacagcaatagccgcatccacttggctattttgtaagtcgcgagtatcctgtctga

SEQ ID NO: 354179 - DNA, 75 bp, Artificial Sequence
  Synthetic
attggcgactatagtggccatgtatgtgctgaccaaccaaagacgcaattaggaagaagcagcaattggcaagct

SEQ ID NO: 354180 - DNA, 75 bp, Artificial Sequence
  Synthetic
ctccttaccgattgacgccgaatgctcagttaccagtatgcttagcgttcttgtgttgcgcaaggaccgctaggg

SEQ ID NO: 354181 - DNA, 75 bp, Artificial Sequence
  Synthetic
gcatgcaaaatatatgtagagcaaattacgacagcaattggcaggctgtatagagttttattagattttgtgtat

SEQ ID NO: 354182 - DNA, 75 bp, Artificial Sequence
  Synthetic
cagagacaacatgggaatccctggatcacctctggaatcataatcaaaacatgttttggagccagttgctcattc

SEQ ID NO: 354183 - DNA, 75 bp, Artificial Sequence
  Synthetic
ttgaagggcagaactgtcctggtggtcggggaaaagttgtccgtcccaggcaaaatggttgactggttgtcagac

SEQ ID NO: 354184 - DNA, 75 bp, Artificial Sequence
  Synthetic
cacctttggcagctgatgttgaggagcccactctggaagccgacgttgacttgatgttacaagaggctggggccg

SEQ ID NO: 354185 - DNA, 75 bp, Artificial Sequence
  Synthetic
aattgtttagcagcaattggcaagctgcttttaaaatttttattagatttttttttttttttatataccaattgg

SEQ ID NO: 354186 - DNA, 75 bp, Artificial Sequence
  Synthetic
cggcctgaggctaccttcagagctcggctggatttaggcatcccaggtgatgtgcccaaatatgacataatattt

SEQ ID NO: 354187 - DNA, 75 bp, Artificial Sequence
  Synthetic
gtagttccttttttagtcctagcaggcgccgcaagcgtcggcgcctacgagcacgcaaccacgatgccgaatcag

SEQ ID NO: 354188 - DNA, 75 bp, Artificial Sequence
  Synthetic
atgttttggagccagttgctcattccactagccgcgcttattgtgttgacccgcctactgaagtgtctgtgttgc

SEQ ID NO: 354189 - DNA, 75 bp, Artificial Sequence
  Synthetic
cgcatgagagaagcccaaacaataactacccaaaatggagaaagttcacgttgatatcgaggaagacagcccctt

SEQ ID NO: 354190 - DNA, 75 bp, Artificial Sequence
  Synthetic
gcggggatgccatttaacacagtagttaatcgcgcagggtatgcaccattagtcatcagcattaccccgacaaag

SEQ ID NO: 354191 - DNA, 75 bp, Artificial Sequence
  Synthetic
gcaagctgcttttaaaatttttattagatttttttttttttttatataccaattggattttgtttttaatatttc

SEQ ID NO: 354192 - DNA, 75 bp, Artificial Sequence
  Synthetic
gtaaggctcattcctacattgaacttggagtatgttacatgccactacaagacagggcttgactcaccttccatc

SEQ ID NO: 354193 - DNA, 75 bp, Artificial Sequence
  Synthetic
ttatccatccttgacaccctggatggagctagcgtgaccagcgaggcagcgtcagccgagactaactcctacttc

SEQ ID NO: 354194 - DNA, 75 bp, Artificial Sequence
  Synthetic
aagtgctgcggaacgcaggaatgtccaaaggtaaacagacccgatgagcaatgtaaggtatttaccggtgtgtac

SEQ ID NO: 354195 - DNA, 75 bp, Artificial Sequence
  Synthetic
ccttttatgtggggcggcgcatactgcttctgtgactctgaaaacacccaactcagccgcgcgtatgtgacaaaa

SEQ ID NO: 354196 - DNA, 75 bp, Artificial Sequence
  Synthetic
tctgacgactgctcagctgatcacgctctagcttacaaagcccacaccgcctcagttcaggcgttcttgaatatc

SEQ ID NO: 354197 - DNA, 75 bp, Artificial Sequence
  Synthetic
aagcgccctatttttgtggagggtttattttgtgtgactccgtgaccggcacagcgtgccgtgtggcagaccccc

SEQ ID NO: 354198 - DNA, 75 bp, Artificial Sequence
  Synthetic
acagcgtgccgtgtggcagaccccctaaaaaggctgtttaagcttggcaaacccctggcagcagacgatgaacat

SEQ ID NO: 354199 - DNA, 75 bp, Artificial Sequence
  Synthetic
actgtgggagagcagtcaacaacagcagtggtgtacgtgaatggtgaaacgcctattagttttaatggcatcaga

SEQ ID NO: 354200 - DNA, 75 bp, Artificial Sequence
  Synthetic
ttggtcgcaggtcctttatctactgcttggacgccgtttgacaggaaggtggtgcagtacgctggagagatatat

SEQ ID NO: 354201 - DNA, 75 bp, Artificial Sequence
  Synthetic
aattatgatttcccagagtacggagcaggacacgccggagcattcggagatcttcaagccagaacgacaaccagc

SEQ ID NO: 354202 - DNA, 75 bp, Artificial Sequence
  Synthetic
aatgacctgtatgccaacaccaatttggtgttgcaaagacccaccgccggaaccattcacgtgccttacacgcag

SEQ ID NO: 354203 - DNA, 75 bp, Artificial Sequence
  Synthetic
tggaagcagctgttaagtgccccggaagaaaaaggagatctactgaggagctgtttaaggagtataagctaacgc

SEQ ID NO: 354204 - DNA, 75 bp, Artificial Sequence
  Synthetic
gcaccatcaggctttgaacagtggaagaaagacaagcctccatcactgaagtatacagcaccatttggatgtgag

SEQ ID NO: 354205 - DNA, 75 bp, Artificial Sequence
  Synthetic
gcagggacaagaaatgggaaatgactctcaaggaagcagtggctaggagagaagcagtggaggagatatgcatat

SEQ ID NO: 354206 - DNA, 75 bp, Artificial Sequence
  Synthetic
atctatgtgaatcctgtcagagctgaaaattgtgccgtgggatctataccattagccttcgacatacccgacgcc

SEQ ID NO: 354207 - DNA, 75 bp, Artificial Sequence
  Synthetic
ttgtttaccagggtgtctgaaacaccgacactgtcgaacgcagagtgctccttgaatgagtgcgtatactcatct

SEQ ID NO: 354208 - DNA, 75 bp, Artificial Sequence
  Synthetic
gattttggcgggatcgccactgtcaagtacacagcgagtaaatcaggcaaatgtgcagtacatattccctcaggc

SEQ ID NO: 354209 - DNA, 75 bp, Artificial Sequence
  Synthetic
acggcgactctgaaagaatcactagtggatgtggtagaacaaggatccctgacccttcatttttcaactgccaat

SEQ ID NO: 354210 - DNA, 75 bp, Artificial Sequence
  Synthetic
atacatccggaatttaaacttcagatatgtacaacgcatcttacatgcaaaggcgattgtcatccgcctaaagac

SEQ ID NO: 354211 - DNA, 75 bp, Artificial Sequence
  Synthetic
catatagtaacacacccacagctccacgcccagacatttacagccgcggtctctaagaccgcatggacgtggttg

SEQ ID NO: 354212 - DNA, 75 bp, Artificial Sequence
  Synthetic
acttcactcctgggaggttcagccgtaattattataatcggccttgtgttagcaactgttgttgctatgtacgtg

SEQ ID NO: 354213 - DNA, 75 bp, Artificial Sequence
  Synthetic
ctgaccaaccagagacacaattaaaccgcagtagcaattggcaagctatataaaagaattataaagcgataattg

SEQ ID NO: 354214 - DNA, 75 bp, Artificial Sequence
  Synthetic
gcaaatcgcatgtaaatcccagcagcaattggcacgctgcatatataatttacttggcggcaattggcaagccgc

SEQ ID NO: 354215 - DNA, 75 bp, Artificial Sequence
  Synthetic
tctgcggggatccaaaacagtgcggctttttcaacatgatgtgcctgaaagtgcattttaaccacgagatttgca

SEQ ID NO: 354216 - DNA, 75 bp, Artificial Sequence
  Synthetic
actaccggcagtaccaaacccaagcaggacgatctcattctcacttgtttcagagggtgggtgaagcagttgcaa

SEQ ID NO: 354217 - DNA, 75 bp, Artificial Sequence
  Synthetic
ggcggcaattggcaagccgcccataacaaatttttattttcttttccaataattggattttgtttttaatatttc

SEQ ID NO: 354218 - DNA, 75 bp, Artificial Sequence
  Synthetic
ttggaagtgcgcctgcccgcagaatgtattccaagcataaataccactgcatctgtccgatgaaatgtgcagaag

SEQ ID NO: 354219 - DNA, 75 bp, Artificial Sequence
  Synthetic
acagggccagtgaaagcatcatcggcgctatagctcggcagttcaagttctcccgggtatgtaagccgaaatcct

SEQ ID NO: 354220 - DNA, 75 bp, Artificial Sequence
  Synthetic
gacgtattccaaaataaggcgaacgtgtgttgggccaaggctttggtgccggtactgaaaactgcaggcatagac

SEQ ID NO: 354221 - DNA, 75 bp, Artificial Sequence
  Synthetic
tcagcaaactgaagggcagaactgtcttggtggtcggggagaagttgtccgtcccaggcaaaacggttgactggt

SEQ ID NO: 354222 - DNA, 75 bp, Artificial Sequence
  Synthetic
agcgaatagtcgtaaatggtcgcactcaaaggaatactaacacaatgaagaactatttattacccgtcgtggcac

SEQ ID NO: 354223 - DNA, 75 bp, Artificial Sequence
  Synthetic
attcccggaaagcttcgatttacagccgatcgaagtgggaaaagcgcgactggtcaaaggtgcagctaaacatat

SEQ ID NO: 354224 - DNA, 75 bp, Artificial Sequence
  Synthetic
taagtttgctgtcagacggcccgacccaccaggtgctgcaagtcgaggcagacattcacgggccgccttctgtat

SEQ ID NO: 354225 - DNA, 75 bp, Artificial Sequence
  Synthetic
attaaaaggaccaaaagctgcagctctttttgcaaagacacacaatttgaatatgttacaggacataccaatgga

SEQ ID NO: 354226 - DNA, 75 bp, Artificial Sequence
  Synthetic
actagcctggtctctaacccgccgggcgtaaatagggtgattacaagagaggagtttgaggcgttcgtagcacaa

SEQ ID NO: 354227 - DNA, 75 bp, Artificial Sequence
  Synthetic
tgcatcctgttcctttgtattcatctagtgtgaaccgtgctttttcaagccccaaggtcgcagtggaagcctgca

SEQ ID NO: 354228 - DNA, 75 bp, Artificial Sequence
  Synthetic
taccaactataggtgtgtatggcgttcccgggtccgggaagtctggaattatcaagagcgcagtcacaaagaagg

SEQ ID NO: 354229 - DNA, 75 bp, Artificial Sequence
  Synthetic
tctgaccgcgttaatgattctggaagatctaggagtggacgcagagctgttgacgctgattgaggcggctttcgg

SEQ ID NO: 354230 - DNA, 75 bp, Artificial Sequence
  Synthetic
cggctaaccggatcaccatgtgcagcattcattggagatgacaatatcgtgaaaggagtcaaatcggacaaatta

SEQ ID NO: 354231 - DNA, 75 bp, Artificial Sequence
  Synthetic
atggcagacaggtgcgccacctggttgaatatggaagtcaagattatagatgctgtggtgggcgagaaagcgccc

SEQ ID NO: 354232 - DNA, 75 bp, Artificial Sequence
  Synthetic
tatttctgtggagggtttattttgtgtgactccgtgaccggcacagcgtgccgtgtggcagaccccctaaaaagg

SEQ ID NO: 354233 - DNA, 75 bp, Artificial Sequence
  Synthetic
aagatgttcccgttccagccaatgtatccgatgcagccaatgccctatcgcaacccgttcgcggccccgcgcagg

SEQ ID NO: 354234 - DNA, 75 bp, Artificial Sequence
  Synthetic
ccaccactaccagcagtgtgaggaccacgccattaagttgagcatgttgactaagaaggcatgcctgcacctgaa

SEQ ID NO: 354235 - DNA, 75 bp, Artificial Sequence
  Synthetic
gaagaaggaggcctcgcaaaaacagaaagggggaggccaagggaagaagaagaagaaccaagggaagaagaaggc

SEQ ID NO: 354236 - DNA, 75 bp, Artificial Sequence
  Synthetic
agactgaagtgctatttgtcttcattgggttcgatcgtaaaacgcggacccataacccatacaagctttcctcca

SEQ ID NO: 354237 - DNA, 75 bp, Artificial Sequence
  Synthetic
aaatttaatcctgtaggcagagaactctacactcatcccccagaacacggagcagagcaagcgtgccaagtctac

SEQ ID NO: 354238 - DNA, 75 bp, Artificial Sequence
  Synthetic
accagaaacataattgaacatagcagcaattggcaagctgctcacatagaattcgcggcgattggcatgccgctt

SEQ ID NO: 354239 - DNA, 75 bp, Artificial Sequence
  Synthetic
atgggcggcgcatgagagaagcccaaaccataaactacccaaaatggagaaagttcacgttgacatcgaggagga

SEQ ID NO: 354240 - DNA, 75 bp, Artificial Sequence
  Synthetic
gtgcatccacgctatgaccccggaacgggttcagcgtttgaaagcctctcgccccgaacaaattacagtttgttc

SEQ ID NO: 354241 - DNA, 75 bp, Artificial Sequence
  Synthetic
gtttccgttgcagcgtccacctggctgttttgcaaatccagagtttcgtgcctaactccttaccggctaacaccc

SEQ ID NO: 354242 - DNA, 75 bp, Artificial Sequence
  Synthetic
ttggcaagctgcttatatagaactcgcggcgattggcatgccgctttaaaattttattttatttcttttcttttc

SEQ ID NO: 354243 - DNA, 75 bp, Artificial Sequence
  Synthetic
atgggcggcgcatgagagattagcccaataccaaatcatactacccaaatatggagaaagttcacgttgacatcg

SEQ ID NO: 354244 - DNA, 75 bp, Artificial Sequence
  Synthetic
ataacgaccatgctaatgctagagccttttcgcatctagcttctaagttgatcgaaacggaggtagacccatccg

SEQ ID NO: 354245 - DNA, 75 bp, Artificial Sequence
  Synthetic
atacgatcctagacataggcagtgcacctgcccgtagaatgtattctaaacacaaatatcattgtatctgtccaa

SEQ ID NO: 354246 - DNA, 75 bp, Artificial Sequence
  Synthetic
tgaagtgcgccgaagacccggacagattgttcaagtacgcgtctaagttgaagaggaattgtaaggagattacag

SEQ ID NO: 354247 - DNA, 75 bp, Artificial Sequence
  Synthetic
tctacgcacatgatgcacagaacagaggagcttatgtcgagatgcacctcccgggctcagaagtggacagcagtt

SEQ ID NO: 354248 - DNA, 75 bp, Artificial Sequence
  Synthetic
ataagaacttagagaagaagatggaagacctggcagcagtcatgtcagacccgaatttggaacgagattcgatgt

SEQ ID NO: 354249 - DNA, 75 bp, Artificial Sequence
  Synthetic
gtcttcacgacgacgaatcctgccgattcgagggacaagtggccatctatcaagatgtgtatgcagtggacggcc

SEQ ID NO: 354250 - DNA, 75 bp, Artificial Sequence
  Synthetic
ctactagcctatatcatcaggcaaacaaaggagtcagagtcgcatactgggtaggctttgacacaaccccgttta

SEQ ID NO: 354251 - DNA, 75 bp, Artificial Sequence
  Synthetic
tgttcaagaaccttgcgggagcctatccctcatactccaccaactggtcagacgaagtggtgctgacggctcgta

SEQ ID NO: 354252 - DNA, 75 bp, Artificial Sequence
  Synthetic
atatcgggctgtgcagttcagacgtcatggagcggtcgaggaggggtctgtccattatgaggaaaaagtatttga

SEQ ID NO: 354253 - DNA, 75 bp, Artificial Sequence
  Synthetic
aaactgcaatgtgacccaaatgagggaactgcctgtattagattctgcggcctttaatgtagagtgttttaaaaa

SEQ ID NO: 354254 - DNA, 75 bp, Artificial Sequence
  Synthetic
aaccatccaatagtatcatcttctcggttggttctactatctaccacgagaagcgtgatttattaaagagctggc

SEQ ID NO: 354255 - DNA, 75 bp, Artificial Sequence
  Synthetic
aagatgaaagacccttgggacttagggaccgccagctggtgatggggtgttgctgggcgttcaggaaacacaaga

SEQ ID NO: 354256 - DNA, 75 bp, Artificial Sequence
  Synthetic
aagcgtgatttattaaagagctggcacctaccgtccgtgttccacctgcgtggaaaaaacaactacacatgtcgg

SEQ ID NO: 354257 - DNA, 75 bp, Artificial Sequence
  Synthetic
tgtgagactatagttagttgcgacgggtacgtcgtaaagagaatagctattagtccaggcctgtatgggaaacct

SEQ ID NO: 354258 - DNA, 75 bp, Artificial Sequence
  Synthetic
tcaggctacgcatccaccatgcaccgcgagggtttcttgtgttgcaaggtgacggacacgcttaacggtgagagg

SEQ ID NO: 354259 - DNA, 75 bp, Artificial Sequence
  Synthetic
gatcgggctgaggaccaggatcaagaaactgctggaggaacctgtagaccgaccacccctgattactgccgacga

SEQ ID NO: 354260 - DNA, 75 bp, Artificial Sequence
  Synthetic
gtctctttccccgtgtgcacttacgtgccagcaactttgtgcgaccagatgacaggtatcctagcgactgacgtt

SEQ ID NO: 354261 - DNA, 75 bp, Artificial Sequence
  Synthetic
ctggctgttttgcagatctagagttgcgtgcctaactccttaccggctaacacctaacgctaggataccattttg

SEQ ID NO: 354262 - DNA, 75 bp, Artificial Sequence
  Synthetic
agcgcagatgacgctcagaagctgttggttgggctcaaccagaggatagtcgtgaacggccgtacgcaaaggaat

SEQ ID NO: 354263 - DNA, 75 bp, Artificial Sequence
  Synthetic
cctgcactggaggcagacgttgatttaatgctgcaagaagctggagcgggatctgtcgaaacccccagggggctc

SEQ ID NO: 354264 - DNA, 75 bp, Artificial Sequence
  Synthetic
actaatactatgaaaaattatttgctcccagttgtagcgcaggcgtttgcgcgatgggctaaggagtataaggaa

SEQ ID NO: 354265 - DNA, 75 bp, Artificial Sequence
  Synthetic
actgcccgggccgagaccacctgggagtccttggatcacctatggaacaataaccaacagatgttctggattcaa

SEQ ID NO: 354266 - DNA, 75 bp, Artificial Sequence
  Synthetic
atcaaagtcaccagctatggaggagaagacaaaatcggctcctacgcagtgctctctccacaagcagtactgcgg

SEQ ID NO: 354267 - DNA, 75 bp, Artificial Sequence
  Synthetic
gaccaggaagatgaaagacccctagggctgagagatcgccaattggtgatgggttgctgctgggctttcaaaaaa

SEQ ID NO: 354268 - DNA, 75 bp, Artificial Sequence
  Synthetic
agcgaaaaactgacatgcattcatccactcgcagagcaagtaatcgtaattacacactcagggagaaagggtagg

SEQ ID NO: 354269 - DNA, 75 bp, Artificial Sequence
  Synthetic
cacaaagtcacatctgtgtacaagaagcccgacactcagaccattattaaggtgcaaagcgacttccattcgttc

SEQ ID NO: 354270 - DNA, 75 bp, Artificial Sequence
  Synthetic
tacgcagtagaaccctaccacggaaaagtggtagtacctgaggggcaagctatacccgtccaagactttcaagca

SEQ ID NO: 354271 - DNA, 75 bp, Artificial Sequence
  Synthetic
gtgttaccacgcattggaagcacgtcgctggacataggtctgagagacaggattcgtaaactgatggaggacaaa

SEQ ID NO: 354272 - DNA, 75 bp, Artificial Sequence
  Synthetic
ctcagtgagagcgctacaattgtgtacaacgaacgcgagttcgtgaacaggtatttacaccatattgccacgcat

SEQ ID NO: 354273 - DNA, 75 bp, Artificial Sequence
  Synthetic
aagaacccgacacctatcatcacagccgaagatgttcacgaagccaaagcagccgccgacgaagcacgcgaggtg

SEQ ID NO: 354274 - DNA, 75 bp, Artificial Sequence
  Synthetic
tctgtgaccggaactgcatgtcgtgtggcggaccctttgaagagattattcaagcttggaaaaccactggctgtg

SEQ ID NO: 354275 - DNA, 75 bp, Artificial Sequence
  Synthetic
ggtggagctctgaacacagatgaggagtactacagagtggtgaagcccagtgaacatgagggcgagtacctatat

SEQ ID NO: 354276 - DNA, 75 bp, Artificial Sequence
  Synthetic
agagaggctgaagagctgagggctgcgctccctcctctagcacccgatgtagaggagccggccctggaagccgaa

SEQ ID NO: 354277 - DNA, 75 bp, Artificial Sequence
  Synthetic
gacattgacaagaaacagtgtgttaagaaagaactggtttcggggctagggttgacaggagaacttgtcgatccc

SEQ ID NO: 354278 - DNA, 75 bp, Artificial Sequence
  Synthetic
gtcgacctgatgctacaggaagccggagccggttcggtggaaacacctcggggtcttattaaggtgactagttac

SEQ ID NO: 354279 - DNA, 75 bp, Artificial Sequence
  Synthetic
ccttttcatgaatttgcatacgagagcttgaggacacgcccagccgcaccttaccaggtaccaaccataggtgtg

SEQ ID NO: 354280 - DNA, 75 bp, Artificial Sequence
  Synthetic
aaaggtgaggagaagatcggatcttacgctgtactgtcacctcaagcagtgttaaagagcgaaaaattaagctgc

SEQ ID NO: 354281 - DNA, 75 bp, Artificial Sequence
  Synthetic
tacggcgttcccgggtccgggaagtctggaattatcaagagcgcagttactaagaaagacttggtagtgagtgct

SEQ ID NO: 354282 - DNA, 75 bp, Artificial Sequence
  Synthetic
attcatccattggccgaacaagtggttgtagtgacgcactctggccggaaagggcgatacgccgtagaaccttac

SEQ ID NO: 354283 - DNA, 75 bp, Artificial Sequence
  Synthetic
aagaaggagaactgtgccgagataatcagggacgtcaagaagatgaaggggctggacgttaacgcccggacagtg

SEQ ID NO: 354284 - DNA, 75 bp, Artificial Sequence
  Synthetic
catggtaaagtagtggttcctgaagggcacgccatacccgtgacggattttcaggccatgagtgaaagtgccacc

SEQ ID NO: 354285 - DNA, 75 bp, Artificial Sequence
  Synthetic
gactcagtgctgttaaacggatgcaaacacccggtcgagactttgtacattgacgaagcctttgcatgccacgct

SEQ ID NO: 354286 - DNA, 75 bp, Artificial Sequence
  Synthetic
attgtctacaacgaaagagagtttgtgaacaggtacttgcaccacatcgctgtgcacggaggcgctctgaatacg

SEQ ID NO: 354287 - DNA, 75 bp, Artificial Sequence
  Synthetic
gacgaggagtactacaaggtagtgaaaccgtcagaatacgacggtgaatatctgtatgacatagacaaaaaacaa

SEQ ID NO: 354288 - DNA, 75 bp, Artificial Sequence
  Synthetic
atgtggtgatcctaaacaatgtggcttctttaacatgatgtgcttgaaagtgcacttcaaccatgaaatatgcac

SEQ ID NO: 354289 - DNA, 75 bp, Artificial Sequence
  Synthetic
tgtgtcaagaaggagcaagtctccgggttgggcctaacgggtgagctgattgaaccgccattccacgagttcgcc

SEQ ID NO: 354290 - DNA, 75 bp, Artificial Sequence
  Synthetic
cgtaggtgtaccaagtcggtgacgtcggtagtgtctacactgttttatgacaaaagaatgagaaccactaaccca

SEQ ID NO: 354291 - DNA, 75 bp, Artificial Sequence
  Synthetic
tacgagagcctaaagaccagaccagcagcaccgtaccaggtacccactattggagtgtacggggtcccaggatcc

SEQ ID NO: 354292 - DNA, 75 bp, Artificial Sequence
  Synthetic
agagactccaaaattgaaattgacacaactggaagtactaaatcaaaaaaagaggacttgattctcacgtgcttc

SEQ ID NO: 354293 - DNA, 75 bp, Artificial Sequence
  Synthetic
ggaaaatcaggcattatcaaaagcgctgtgacaaaaagggacctggtggtcagcgcaaagaaggaaaattgcgca

SEQ ID NO: 354294 - DNA, 75 bp, Artificial Sequence
  Synthetic
gaaatcatccgggatgttaaacgtatgagggggctggacgttacagcccgaactgtggattccgtgttgctaaac

SEQ ID NO: 354295 - DNA, 75 bp, Artificial Sequence
  Synthetic
agcagagactttgtccatgctcagtcataacgtagacaatcctggatatgacgagttgctcgaagcagtactgaa

SEQ ID NO: 354296 - DNA, 75 bp, Artificial Sequence
  Synthetic
ggtacaaggtgaatgagaaccccttgtacgcacccacctcagagcatgtgaatgtgttgttgacccgcacggaag

SEQ ID NO: 354297 - DNA, 75 bp, Artificial Sequence
  Synthetic
ggttgtaaatatctggtggacacgctctatgtggacgaagcgttcgcttgtcacacagggacactgcgtgcacta

SEQ ID NO: 354298 - DNA, 75 bp, Artificial Sequence
  Synthetic
acaaaattgtgtggaagactcttgcaggggacccgtggataaaaaccttgaccgccaaatatcccggagacttca

SEQ ID NO: 354299 - DNA, 75 bp, Artificial Sequence
  Synthetic
attgccattgtcaaacctaagaagactgtgctttgtggtgaccctaaacagtgcggtttcttcaacatgatgtgt

SEQ ID NO: 354300 - DNA, 75 bp, Artificial Sequence
  Synthetic
ccgcaacaatggaagaatggcaggcggagcacgatgccatcatgagacatatcctggagaaacctgatcccacgg

SEQ ID NO: 354301 - DNA, 75 bp, Artificial Sequence
  Synthetic
cttaaggtgcatttcaatcacgaactgtgcacccaagtgttccataagagtatttctagacggtgtactccggcc

SEQ ID NO: 354302 - DNA, 75 bp, Artificial Sequence
  Synthetic
gtcacctccattgtctccaccctgttttatgacaaaagaatgagaacgaccaacacacggaatacgaagatagag

SEQ ID NO: 354303 - DNA, 75 bp, Artificial Sequence
  Synthetic
ctgttgggcaaaggcacttgtacccgtgcttaagaccgccgggatagatctgaccacagagcagtggaacacagt

SEQ ID NO: 354304 - DNA, 75 bp, Artificial Sequence
  Synthetic
atagacaccaccggtagtactaagccaaaaaaggatgatttgattttaacctgcttcagggggtgggtgaaacag

SEQ ID NO: 354305 - DNA, 75 bp, Artificial Sequence
  Synthetic
ggcaagctgcttacatagaactcgcggcgattggcatgccgctttaaaatttttattttatttttcttttctttt

SEQ ID NO: 354306 - DNA, 75 bp, Artificial Sequence
  Synthetic
cccaaaccaattacctacccaaaatggagaaagttcacgttgacatcgaggaagacagcccattcctcagggctt

SEQ ID NO: 354307 - DNA, 75 bp, Artificial Sequence
  Synthetic
agctgtgcgtgcgatacttcggcctagacttagattcaggtttgttctccgcacccacagttccgctttctatca

SEQ ID NO: 354308 - DNA, 75 bp, Artificial Sequence
  Synthetic
ctgcaaattgattacaaaggcaatgaagtgatgactgcagccgcatctcaggggttaacccgtaaaggtgtctat

SEQ ID NO: 354309 - DNA, 75 bp, Artificial Sequence
  Synthetic
gcagtgcgatataaagtcaatgaaaatccactgtacgcttccaactccgagcacgtgaatgtattgctgacaagg

SEQ ID NO: 354310 - DNA, 75 bp, Artificial Sequence
  Synthetic
cgaaacggaggtggacccatccgacacgatccttgacattggaagtgcgcccgcccgcagaatgtattctaagca

SEQ ID NO: 354311 - DNA, 75 bp, Artificial Sequence
  Synthetic
catgaagtggtcaggcaactatcccgcaggtatcctcaactaccgcgtgcagtgaccactgggagagtatacgac

SEQ ID NO: 354312 - DNA, 75 bp, Artificial Sequence
  Synthetic
acggaagacaggatagtgtggaaaaccttggccggtgatccctgggtgaaaacattaacagcaaggtacccagga

SEQ ID NO: 354313 - DNA, 75 bp, Artificial Sequence
  Synthetic
atgaacaccggtactctgcgcaattatgacccgcgcataaatttagtaccggtgaaccgtcgcctaccacatgct

SEQ ID NO: 354314 - DNA, 75 bp, Artificial Sequence
  Synthetic
aacttttcagccaccctggaagaatggcaacaagaacacgacgccattatgaagcacataatggagaagccggat

SEQ ID NO: 354315 - DNA, 75 bp, Artificial Sequence
  Synthetic
gaaaaattgcaaggaaataactgacaaggaattggacaagaaaatgaaggagctcgccgccgtcatgagcgaccc

SEQ ID NO: 354316 - DNA, 75 bp, Artificial Sequence
  Synthetic
ctcgtgacgcaacacgctgaccatccccccagtgacttttccgcctttgtcagcaagcttaagggtagaacggtc

SEQ ID NO: 354317 - DNA, 75 bp, Artificial Sequence
  Synthetic
cctattaacgtgttccaaaacaaggccaacgtgtgctgggccaaagcactggtcccgatattacgcacggccgga

SEQ ID NO: 354318 - DNA, 75 bp, Artificial Sequence
  Synthetic
ctagtagttggtgagaagatgaatatttcgggtaaggcagtagactggttatctgaaacaccggatgctacattc

SEQ ID NO: 354319 - DNA, 75 bp, Artificial Sequence
  Synthetic
attaacatgactgcagagcagtggaacacggtaccgtatttcaaagaggacaaggcacactcagccgaaattgta

SEQ ID NO: 354320 - DNA, 75 bp, Artificial Sequence
  Synthetic
agggcgcgcctagatttaggcatacccactgaactgccgaaatatgatatcgtcttcgtaaatgtaagaacacag

SEQ ID NO: 354321 - DNA, 75 bp, Artificial Sequence
  Synthetic
ttgaaccagttgtgcacaaggtttttcggacttgatttagattcagggttgttttctgccccgacggtaccccta

SEQ ID NO: 354322 - DNA, 75 bp, Artificial Sequence
  Synthetic
taccgctaccatcactaccagcagtgtgaggaccacgccatcaagttgagcatgctgactaagaaggcctgcctg

SEQ ID NO: 354323 - DNA, 75 bp, Artificial Sequence
  Synthetic
gccatccgtaacaatcactgggacaattcaccgtctcccaacatgtacggactaaacagtgaagtggtgaggcag

SEQ ID NO: 354324 - DNA, 75 bp, Artificial Sequence
  Synthetic
cacctaaatcccgggggaacatgtgtaagcattggctacggctacgcggaccgggctagcgaaagcattattggt

SEQ ID NO: 354325 - DNA, 75 bp, Artificial Sequence
  Synthetic
ctagtgaagcgttaccctcagttgccaaaggcgacggcggctggaaggatgttggacatgaacacaggaaatctg

SEQ ID NO: 354326 - DNA, 75 bp, Artificial Sequence
  Synthetic
gcagttgctcggcagttcaagttctcacgggtgtgcaaaccaaaagtgtctaaggaggagaccgaagttttattt

SEQ ID NO: 354327 - DNA, 75 bp, Artificial Sequence
  Synthetic
tgcaccaggtaatccacacggactaccacacgaggtgattacgcattactatcacaggtatcccatgtccaccat

SEQ ID NO: 354328 - DNA, 75 bp, Artificial Sequence
  Synthetic
cgggattatgacccggtcgtgaacactgtgccagtgaaccgtagattgcctcacgctctggtaaccgttcacaca

SEQ ID NO: 354329 - DNA, 75 bp, Artificial Sequence
  Synthetic
gtcttcattggattcgatcgcaaaacacgaacccataatccatataagctttcctccaccttgaccaacatctac

SEQ ID NO: 354330 - DNA, 75 bp, Artificial Sequence
  Synthetic
caacagcctgccagcgactattcagccttcgtgagcaaactgaagggcaggactgtacttgtggtgggggataag

SEQ ID NO: 354331 - DNA, 75 bp, Artificial Sequence
  Synthetic
accggttcggggctccatgaagccggctgcgcaccctcataccatgtagtgcgcggggacatagccactgccacg

SEQ ID NO: 354332 - DNA, 75 bp, Artificial Sequence
  Synthetic
atgaacattcccggaaaaactgtagactggctttctgaacatccagatgctaccttcagatcacgcctggatctt

SEQ ID NO: 354333 - DNA, 75 bp, Artificial Sequence
  Synthetic
atacccaaaccatcattaaagtgaacagcgatttccactcattcgtgctgcctagaataggcagtaacacgttgg

SEQ ID NO: 354334 - DNA, 75 bp, Artificial Sequence
  Synthetic
gaaggagtaattgtcaatgctgccaacagcaagggacagccaggcagtggagtgtgtggagctctatatcggaag

SEQ ID NO: 354335 - DNA, 75 bp, Artificial Sequence
  Synthetic
ggcataccggctgaagtacctaagtatgatcttgtgtttgttaatgtcaggacaccttacatccaccaccactac

SEQ ID NO: 354336 - DNA, 75 bp, Artificial Sequence
  Synthetic
taccccgaaagcttcgatttacaaccaatagaagtggggaaagctagattggtcaaaggtagctcaaaacatatt

SEQ ID NO: 354337 - DNA, 75 bp, Artificial Sequence
  Synthetic
caacagtgtgaagatcacgctatcaagctgagtatgcttactaagaaagcttgcttgcatctccaaccgggcggc

SEQ ID NO: 354338 - DNA, 75 bp, Artificial Sequence
  Synthetic
attcatgcagtggggccgaatttcagcaaggtgtccgaagtggaaggcgacaagcagctggcagaagcgtatgaa

SEQ ID NO: 354339 - DNA, 75 bp, Artificial Sequence
  Synthetic
acctgtgtcagcattggctacgggtatgctgacagagcgagcgagaatataattggggcgattgccagacagttc

SEQ ID NO: 354340 - DNA, 75 bp, Artificial Sequence
  Synthetic
gcaaggtgtccgaagtggaaggcgacaagcagctggcagaagcgtatgaatctatagctaagattatcaatgata

SEQ ID NO: 354341 - DNA, 75 bp, Artificial Sequence
  Synthetic
gttgggctcaaccagcgcatagtcgtcaacggtcgcacccaaagaaacaccaataccatgaagaattatcttttg

SEQ ID NO: 354342 - DNA, 75 bp, Artificial Sequence
  Synthetic
aaattcacccgagtttgtaagccgaaggtatctctagaagagacagaggtactttttgtgtttatcgggtacgac

SEQ ID NO: 354343 - DNA, 75 bp, Artificial Sequence
  Synthetic
ggaaacaaagataggttaatgcaatctttaaaccatctgctaacggcattagacacaaccgatgcagatgtggcc

SEQ ID NO: 354344 - DNA, 75 bp, Artificial Sequence
  Synthetic
cggaggaacaggacccacaacccctacaagttgtccaccacattgactaacatatacacaggatcgggactgcat

SEQ ID NO: 354345 - DNA, 75 bp, Artificial Sequence
  Synthetic
gaagccggcagtgcaccttcctaccacgtggtgcgaggtgatatcgctaccgcgtcagaaactgttatagttaat

SEQ ID NO: 354346 - DNA, 75 bp, Artificial Sequence
  Synthetic
tgtatctccgaagattcctccgtagctgagccggatgcagagctggttagagtacatccaaagagctctttggct

SEQ ID NO: 354347 - DNA, 75 bp, Artificial Sequence
  Synthetic
gctgctaatagtagggggcaaccaggaggaggggtttgcggggccctctataagaaattcccggagagcttcgat

SEQ ID NO: 354348 - DNA, 75 bp, Artificial Sequence
  Synthetic
tggctatgtatgtgctgaccaaccagaaacacaattagaattagcagcgattggcatgctgcttgtaaagtttta

SEQ ID NO: 354349 - DNA, 75 bp, Artificial Sequence
  Synthetic
ctgcaagccatagaggtcggcaaggcacgacttgttaaaaacggggcgaagcacatcatccacgccgtcgggccc

SEQ ID NO: 354350 - DNA, 75 bp, Artificial Sequence
  Synthetic
tagcagcgattggcatgctgcttgtaaagttttattacaaataatgtgcggcaattggcgagccgctttaattag

SEQ ID NO: 354351 - DNA, 75 bp, Artificial Sequence
  Synthetic
tgaagccgaggagttgcgcgctgcactaccacctttggcagctgatgttgaggagcccactctggaagccgatgt

SEQ ID NO: 354352 - DNA, 75 bp, Artificial Sequence
  Synthetic
aatttcaataaggttgcagaggtcgagggagacagacagctggccgaagcgtatgaatcaattgctaaactggtt

SEQ ID NO: 354353 - DNA, 75 bp, Artificial Sequence
  Synthetic
aaggacatggcagaaattaacgctatgtggccaaccgctacagaggctaatgagcaggtgtgcttatacattttg

SEQ ID NO: 354354 - DNA, 75 bp, Artificial Sequence
  Synthetic
ggggaaagcatgagtagtataagatctaaatgccccgtagaggaatcagaggcatccaccccaccaagtacactg

SEQ ID NO: 354355 - DNA, 75 bp, Artificial Sequence
  Synthetic
aatgacaataactaccggtctgtagccatacctttgctttcgacaggcatatttgcaggaggcaaggaccggctc

SEQ ID NO: 354356 - DNA, 75 bp, Artificial Sequence
  Synthetic
ccttgtttgtgtattcacgctatgaccccggagcgggtccagcgtttgaaagcctctcgccccgaacagatcaca

SEQ ID NO: 354357 - DNA, 75 bp, Artificial Sequence
  Synthetic
atgcagtcggtgaatcaccttttgacagcaatggacactacagatgccgatgtggccatctattgtagggataag

SEQ ID NO: 354358 - DNA, 75 bp, Artificial Sequence
  Synthetic
gtttgttcttccttcccattgccgaagtacagaataacaggagtgcagaagattcaatgctcgcatcctatactc

SEQ ID NO: 354359 - DNA, 75 bp, Artificial Sequence
  Synthetic
aaatgggagatgacattaaaggaagtaatcgcaaggagggaagccgcagaagagatctgtatttctgatgatgct

SEQ ID NO: 354360 - DNA, 75 bp, Artificial Sequence
  Synthetic
ttttctcctaaagtgccagagtatatacatcctagaaaataccttgcagacgcgactcccgcggacaatgaggca

SEQ ID NO: 354361 - DNA, 75 bp, Artificial Sequence
  Synthetic
catgcaatacccgtccaggactttcaagctctgagtgaaagtgccaccattgtgtacaacgaacgagagttcgta

SEQ ID NO: 354362 - DNA, 75 bp, Artificial Sequence
  Synthetic
agcgaagaaccggatgcggaactggttagggttcatccaaaaagctccttggcaggtaggaaaggatacagcaca

SEQ ID NO: 354363 - DNA, 75 bp, Artificial Sequence
  Synthetic
gccgaaccaacaatggagtgcgtgcagccgctgcaggaagagaggcctgcgaacacggaacaaccggtggaggaa

SEQ ID NO: 354364 - DNA, 75 bp, Artificial Sequence
  Synthetic
gtcgatggtaagactttctcctacctggagggcacaaagttccaccaagcagcgaaggacatagcagaaatcaat

SEQ ID NO: 354365 - DNA, 75 bp, Artificial Sequence
  Synthetic
gatgacagtattagtgtgctgtccgaggacgcaccacaccaagtacatcaagtggaggcagaagtgcatcgctca

SEQ ID NO: 354366 - DNA, 75 bp, Artificial Sequence
  Synthetic
gctatgtggccgaaggaaacggaagctaatgaacaggtctgcttgtacattctgggcgaaagcatgagtagtata

SEQ ID NO: 354367 - DNA, 75 bp, Artificial Sequence
  Synthetic
agtggaggcagaagtgcatcgctcactctgcgcaagtgctcagtcctcgtcctggtccattccccgtgcatccga

SEQ ID NO: 354368 - DNA, 75 bp, Artificial Sequence
  Synthetic
ctctgcgcaagtgctcagtcctcgtcctggtccattccccgtgcatccgattttgagagtctctccgtgctcgat

SEQ ID NO: 354369 - DNA, 75 bp, Artificial Sequence
  Synthetic
cgctccaagtgccctgttgaggagtcggaagcctctacgccgccgacgacgctcccatgcctatgtatccatgct

SEQ ID NO: 354370 - DNA, 75 bp, Artificial Sequence
  Synthetic
tccttgggtgccaatgacacaatcagtatggggtcttcctcaaatgaaacagcgcttgcgcttcggaccatcttc

SEQ ID NO: 354371 - DNA, 75 bp, Artificial Sequence
  Synthetic
atgacccccgagcgggtccaaaggctgaaggcatctcgccctgaacaaattaccgtctgttcatccttcgcgttg

SEQ ID NO: 354372 - DNA, 75 bp, Artificial Sequence
  Synthetic
aggactccacctatcccaaagcctcgagtgaggagtacatccacagacgtggacagtatttcagtactcgagtct

SEQ ID NO: 354373 - DNA, 75 bp, Artificial Sequence
  Synthetic
ccgaagtaccgtattgctggtgtgcagaagatccagtgctctcaccccatccttttctcgccgaaggtgccggat

SEQ ID NO: 354374 - DNA, 75 bp, Artificial Sequence
  Synthetic
ttgggcagtaccagcgatgtgcgcagcataggttcgtcctcggatgagaccgatgtctccgtctttgacaagggg

SEQ ID NO: 354375 - DNA, 75 bp, Artificial Sequence
  Synthetic
tacattccaccccgacgttacttgcctgcaaccctgcccactcctacacttgaggcacctgaattgcccgctcca

SEQ ID NO: 354376 - DNA, 75 bp, Artificial Sequence
  Synthetic
gcataggttcgtcctcggatgagaccgatgtctccgtctttgacaaggggctggagttcatggctagacctgttc

SEQ ID NO: 354377 - DNA, 75 bp, Artificial Sequence
  Synthetic
gccctggaggtgcatgggcaggaggggcagccggagcggccacccttagctgaatcagagcccgaggaacagcct

SEQ ID NO: 354378 - DNA, 75 bp, Artificial Sequence
  Synthetic
ccgcaccgcgaaccattttcaggactccacctgtcccgaaaccgcgtgcgcggaggccattgcaccccttgtcta

SEQ ID NO: 354379 - DNA, 75 bp, Artificial Sequence
  Synthetic
gcagatcgagctcgcgctccagcctggtgtctaatccaccgggtgtcaaccgagtgatcaccagggaagagtttg

SEQ ID NO: 354380 - DNA, 75 bp, Artificial Sequence
  Synthetic
ctcgagcacgaggaacggcctctcgagataacaccgaatgtgattatcgtgcaggcggatgttcatatggcacca

SEQ ID NO: 354381 - DNA, 75 bp, Artificial Sequence
  Synthetic
aggccttcgtcgcccaacagcaatgacggttcgacgcgggtgcatacattttctcctcggatactggccaaggac

SEQ ID NO: 354382 - DNA, 75 bp, Artificial Sequence
  Synthetic
tctatgtcagaatggtcagtaccatcggcctcagactttgatttggacagcatctccgtcttggacggatcaagt

SEQ ID NO: 354383 - DNA, 75 bp, Artificial Sequence
  Synthetic
acggttcgacgcgggtgcatacattttctcctcggatactggccaaggacatctgcaacaaaaatcagtaaggca

SEQ ID NO: 354384 - DNA, 75 bp, Artificial Sequence
  Synthetic
gagacctctagtacatcagacgctggcacattttctatccgttcagcacctagtttgaccggtagtgacatttca

SEQ ID NO: 354385 - DNA, 75 bp, Artificial Sequence
  Synthetic
acgaggagcagacactttgcgcacactacttctaatgtccctgcggcatcacaacagtctgcagaactaactttc

SEQ ID NO: 354386 - DNA, 75 bp, Artificial Sequence
  Synthetic
agaagagatactgagaaagaagttacaattgaaccctacgcaagctaaccggagtagatatcaatcccggcgggt

SEQ ID NO: 354387 - DNA, 75 bp, Artificial Sequence
  Synthetic
actaattcgaatatagcagctcgagctacgagtcctacaagtacggcggttgtctcagctgccgcttccagagca

SEQ ID NO: 354388 - DNA, 75 bp, Artificial Sequence
  Synthetic
tgaaaatatgaaggccataacaactaagagaattttacagggattaggtcactatttgaaatctgaaggtaaggt

SEQ ID NO: 354389 - DNA, 75 bp, Artificial Sequence
  Synthetic
aactcacgagcttcccgcgctggctcaggaactggttctgtacgctcagtacatactacgtccagcaacgatact

SEQ ID NO: 354390 - DNA, 75 bp, Artificial Sequence
  Synthetic
ggagtgctatcgcacgttgcaccctgttcctttgtattcagcaagtgtaaacagagcgttctccagtcccaaggt

SEQ ID NO: 354391 - DNA, 75 bp, Artificial Sequence
  Synthetic
cgtgcagagtttagcgcaaacaggacaccggtagctagctccagatccagtttgacctctaatccacccggagtc

SEQ ID NO: 354392 - DNA, 75 bp, Artificial Sequence
  Synthetic
acagagcgttctccagtcccaaggttgctgtcgaagcatgcaatgtggttctgaaggaaaattttccgacagtgg

SEQ ID NO: 354393 - DNA, 75 bp, Artificial Sequence
  Synthetic
aatagggtcatcaccagagaggagtttgaagcgtttgttgcgcaacagcaatgacgctatgacgcgggtgcatac

SEQ ID NO: 354394 - DNA, 75 bp, Artificial Sequence
  Synthetic
cttcgtactgcataatacctgagtacgacgcctacctggacatggtggacggcgcatcatgctgcttggatacag

SEQ ID NO: 354395 - DNA, 75 bp, Artificial Sequence
  Synthetic
cgagtttttgccctgccaagttgcgtagcttcccaaagaaacacgcatacctcgagcccaccattaggtctgcag

SEQ ID NO: 354396 - DNA, 75 bp, Artificial Sequence
  Synthetic
atcttctcttcggataccggacaaggacatttacaacagaaatcggtgaggcaaaccgtcttgtccgaggtgatt

SEQ ID NO: 354397 - DNA, 75 bp, Artificial Sequence
  Synthetic
ctagagcgcacagaactggaaattgcgtatgccccgcgcctcgacttagctaaagaagagctgctgagaaagaag

SEQ ID NO: 354398 - DNA, 75 bp, Artificial Sequence
  Synthetic
ttccatccgcaatccagaacacgctgcagaatgtactcgcagctgccacaaagaggaactgtaatgtgactcaaa

SEQ ID NO: 354399 - DNA, 75 bp, Artificial Sequence
  Synthetic
ttgcaagtcaatccaacccctgctaatcgtagtcgctatcaatcgcgcaaagtagagaatatgaaagcactcatt

SEQ ID NO: 354400 - DNA, 75 bp, Artificial Sequence
  Synthetic
cattaggaataatcactgggataattccccgtcgcctaacatgtacgggctgaataaagaagtggtccgtcagct

SEQ ID NO: 354401 - DNA, 75 bp, Artificial Sequence
  Synthetic
acgcagaggatgctaaaaggcttgggtcactacttgcgtgcagaagggaaagtcgaatgttatcgtactttgtat

SEQ ID NO: 354402 - DNA, 75 bp, Artificial Sequence
  Synthetic
aataagattgaccgaagaaaacgtggtcaactacataactaaattaaaggggccgaaggcagccgctctgtatgc

SEQ ID NO: 354403 - DNA, 75 bp, Artificial Sequence
  Synthetic
cctgtccctttgtactcagcttgtgtagaccgagcattttctaatcctaagttcgcagtagaagcatgcaatgtg

SEQ ID NO: 354404 - DNA, 75 bp, Artificial Sequence
  Synthetic
aaagactcacaacttagacatgctgcaagacatacccatggataggtttatcatggatttaaaaagagatgtcaa

SEQ ID NO: 354405 - DNA, 75 bp, Artificial Sequence
  Synthetic
caagacatacccatggataggtttatcatggatttaaaaagagatgtcaaggtgactccaggaacaaagcacacc

SEQ ID NO: 354406 - DNA, 75 bp, Artificial Sequence
  Synthetic
atgctaaaggagaattttcctacagttacttcttatggcatagtaccggagtatgatgcctatttagatatggta

SEQ ID NO: 354407 - DNA, 75 bp, Artificial Sequence
  Synthetic
gatggtgcgtcgtgttgcttagacacagctagcttctgccctgctaagcttaggagcttcccgaagaagcattcc

SEQ ID NO: 354408 - DNA, 75 bp, Artificial Sequence
  Synthetic
ggcttatctatgtgggattcacagagagctggtgcgcagactgaatgcagttctgttacctaacatacatacatt

SEQ ID NO: 354409 - DNA, 75 bp, Artificial Sequence
  Synthetic
tatctggatcccactatacgatcagcagtaccatcggcaatccaaaatactttgcagaatgtattggcagcggcc

SEQ ID NO: 354410 - DNA, 75 bp, Artificial Sequence
  Synthetic
atttgacatgtctgctgaggattttgacgccataattgctgagcactttcaaccaggcgattgggtgttagagac

SEQ ID NO: 354411 - DNA, 75 bp, Artificial Sequence
  Synthetic
actaagagaaactgcaatgttacacaaatgagagaactaccagtccttgactctgcagcctttaatgttgagtgc

SEQ ID NO: 354412 - DNA, 75 bp, Artificial Sequence
  Synthetic
gcagtgtgaagaccacgccattaagcttagtatgttgaccaagaaagcttgtctgcatctgaatcccggcggaac

SEQ ID NO: 354413 - DNA, 75 bp, Artificial Sequence
  Synthetic
ttcaagaaatacgcctgtaaccaggaatattgggacacatttaaagataatcctattagattgacaactgaaaac

SEQ ID NO: 354414 - DNA, 75 bp, Artificial Sequence
  Synthetic
cactgatgatcctggaagacctcggggtggatccagagctgctgaccctaatcgaagcggcatttggcgaaattt

SEQ ID NO: 354415 - DNA, 75 bp, Artificial Sequence
  Synthetic
cctccattcacctaccaactaaaactaaattcaggtttggggccatgatgaaatcaggaatgtttctgaccctgt

SEQ ID NO: 354416 - DNA, 75 bp, Artificial Sequence
  Synthetic
gtaacaaattatattacaaagttaaaaggacctaaggcagctgcactgtatgcaaagacacacaatctagcgatg

SEQ ID NO: 354417 - DNA, 75 bp, Artificial Sequence
  Synthetic
ttgtcaacaccgtgatcaacatggtcatagccagcagagttttgcgggagagactgacgaactccccttgtgccg

SEQ ID NO: 354418 - DNA, 75 bp, Artificial Sequence
  Synthetic
ctgcaggacattcccatggaccgtttcgttatggatttgaagcgcgacgttaaggttacaccgggaacaaagcac

SEQ ID NO: 354419 - DNA, 75 bp, Artificial Sequence
  Synthetic
tgtttgtattcattgggtacgatcgcaaggcccgtacgcacaatccttacaagctttcatctaccttgaccaaca

SEQ ID NO: 354420 - DNA, 75 bp, Artificial Sequence
  Synthetic
acagaggagcgccctaaagtgcaagtgatacaggctgccgatccgttggctaccgcatacctgtgtgggatccat

SEQ ID NO: 354421 - DNA, 75 bp, Artificial Sequence
  Synthetic
gaatactataaaactgtcaagcccagcgagcacgacggtgaatacttgtatgacatcgacaagaaacagtgcgtc

SEQ ID NO: 354422 - DNA, 75 bp, Artificial Sequence
  Synthetic
tgaacatggaggtcaagatcatcgacgcggtggtcggcgagaaagcgccctatttctgtggtgggtttattctct

SEQ ID NO: 354423 - DNA, 75 bp, Artificial Sequence
  Synthetic
ccaccgaaggagtgatcataaatgctgctaacagcaaaggacaacctggcggaggggtgtgcggagcgctgtata

SEQ ID NO: 354424 - DNA, 75 bp, Artificial Sequence
  Synthetic
tatttctgtggtgggtttattctctgtgattctgtaaccggaacagcatgtcgcgtggcggaccctttgaagaga

SEQ ID NO: 354425 - DNA, 75 bp, Artificial Sequence
  Synthetic
cgtgagctggtccggcgcttgaacgcagtgttacttcctaatgtccacacgctatttgatatgtcagcagaagac

SEQ ID NO: 354426 - DNA, 75 bp, Artificial Sequence
  Synthetic
tttgacgccatcatcgccgaacactttgtgcaaggcgacagtgtactagaaactgacattgcgtcgttcgataag

SEQ ID NO: 354427 - DNA, 75 bp, Artificial Sequence
  Synthetic
ttattcaagcttggaaaaccactggctgtggatgatgaacatgacgatgacaggcggcgagcattacaagaggaa

SEQ ID NO: 354428 - DNA, 75 bp, Artificial Sequence
  Synthetic
agcgaagacgacgcaatggcactgaccgcactaatgatcctggaggatcttggtgtggatcaggagttgctgaca

SEQ ID NO: 354429 - DNA, 75 bp, Artificial Sequence
  Synthetic
atatcattcatgccgtagggcccaacttcaacaaagtttcggaagttgaaggtgacaaacagttggcagaggctt

SEQ ID NO: 354430 - DNA, 75 bp, Artificial Sequence
  Synthetic
tccgcccggtggaaccgcgtgggtatcttttccgagttgtgtaaagccgtcgagtcgcgatatgaaacagtgggt

SEQ ID NO: 354431 - DNA, 75 bp, Artificial Sequence
  Synthetic
ttgatagaagcagcatttggagagatttcctctgtgcatctacccactaagacgaagttcaaatttggagccatg

SEQ ID NO: 354432 - DNA, 75 bp, Artificial Sequence
  Synthetic
acggccgttatcatcatggctatgactacgctcgccagtagtgttgggtcgttcggttacctgagaggggcccct

SEQ ID NO: 354433 - DNA, 75 bp, Artificial Sequence
  Synthetic
atgaaatccggtatgtttttgacattatttgtgaatacaattatcaatatagttattgcaagtcgcgtgttacgc

SEQ ID NO: 354434 - DNA, 75 bp, Artificial Sequence
  Synthetic
gaaagattgacacattctccttgctctgcatttattggtgatgataatattataaaaggagtcaaatcagataag

SEQ ID NO: 354435 - DNA, 75 bp, Artificial Sequence
  Synthetic
ggactgcgacgtagtcaagtccgccgaaatgtttccttatcaaccaatgtatccaatgcagcctatgcctttccg

SEQ ID NO: 354436 - DNA, 75 bp, Artificial Sequence
  Synthetic
caacccttttgcggctcctagaagaccatggttcccaaggaccgacccctttctagcgatgcaagtgcaagagct

SEQ ID NO: 354437 - DNA, 75 bp, Artificial Sequence
  Synthetic
ttgatggctgacagatgtgcaacctggttgaacatggaagtgaagatcattgatgctgtggttggtgaaaaagca

SEQ ID NO: 354438 - DNA, 75 bp, Artificial Sequence
  Synthetic
ccatggttcccaaggaccgacccctttctagcgatgcaagtgcaagagctagcaaggtctatggccaacttgacg

SEQ ID NO: 354439 - DNA, 75 bp, Artificial Sequence
  Synthetic
ccttatttttgtggcggattcatcctgtgcgacacggttacaggtacagcgtgcagggtagcggatccgttgaaa

SEQ ID NO: 354440 - DNA, 75 bp, Artificial Sequence
  Synthetic
ttcaagcaacggcgagatgtgccgcccgaaggtccaccggctaagaagaagaagaaggacacctcgcaacagggt

SEQ ID NO: 354441 - DNA, 75 bp, Artificial Sequence
  Synthetic
cggctgttcaagttgggtaagccgttggccgctgacgatgagcatgatgatgaccgccgtagagcactgcaggag

SEQ ID NO: 354442 - DNA, 75 bp, Artificial Sequence
  Synthetic
ggtcggaaccagaatggaaagaaaaagaataagctagtaaagaaaaagaagaagacagggccgccaccccaaaaa

SEQ ID NO: 354443 - DNA, 75 bp, Artificial Sequence
  Synthetic
gaaactgctagatggaatagggtcggcatctttgaggagctatgtaaggcagttgaatcaaggtacgaggtagtc

SEQ ID NO: 354444 - DNA, 75 bp, Artificial Sequence
  Synthetic
actaatggcggcaaaaagaaagttaataagaagccagggaagagacaacgtatggtcatgaagctggagtcagat

SEQ ID NO: 354445 - DNA, 75 bp, Artificial Sequence
  Synthetic
ggtacatcggtcattataatggccatggctgcactggccaggagtacctcgtcttttaggtgcctgagagggaac

SEQ ID NO: 354446 - DNA, 75 bp, Artificial Sequence
  Synthetic
aagaccttccccatcatgcttgatggaagaattaatgggtatgcatgcgtggtcggtggtaagttgtttagacca

SEQ ID NO: 354447 - DNA, 75 bp, Artificial Sequence
  Synthetic
cccataaccctctacggctgacctgaatggattgcgacgtagtccgatccgccaacatgtttcctttccaacgag

SEQ ID NO: 354448 - DNA, 75 bp, Artificial Sequence
  Synthetic
ctgcatgtggagggcaagattgacaacgatgtgttgtcctctctcaagaccaagaaggcatccaagtatgatctg

SEQ ID NO: 354449 - DNA, 75 bp, Artificial Sequence
  Synthetic
ccatgtatccaatgcaaccaatgagctacagaaacccatttgcagctccccgtcgtccttggtttcctaggtctg

SEQ ID NO: 354450 - DNA, 75 bp, Artificial Sequence
  Synthetic
gagtacgctgacgtgccgcagagcatgcgcgcagacactttcaaatacacccatgaaaaacctcagggctactac

SEQ ID NO: 354451 - DNA, 75 bp, Artificial Sequence
  Synthetic
accccttcttggctatgagggtggaagaattggcccggtccatggccaatcttacttttaagcaacgaagaagta

SEQ ID NO: 354452 - DNA, 75 bp, Artificial Sequence
  Synthetic
ctccggagctgccgacagagaaccaatccacagaggggacacctgaacaaccagcacccgtaaacgtggatgcaa

SEQ ID NO: 354453 - DNA, 75 bp, Artificial Sequence
  Synthetic
ccagcacccgtaaacgtggatgcaaccaggactagaacgcctgaaccgatcatcattgaagaggaagaagaggat

SEQ ID NO: 354454 - DNA, 75 bp, Artificial Sequence
  Synthetic
atccacctgacggaccacctgctaagaggaggcgtaggaccaaccaagggaacgggcagaccaaccagaacaatg

SEQ ID NO: 354455 - DNA, 75 bp, Artificial Sequence
  Synthetic
tggcggggtgaatgaaggctctagaacagcactgtccgttgtgacgtggaacgagaaaggggttacggtcaaata

SEQ ID NO: 354456 - DNA, 75 bp, Artificial Sequence
  Synthetic
ggcagagaagcagtaaggctaaagcaaaacagcagaagaagaaaccaccagcagccaaaggacccaagaatacgc

SEQ ID NO: 354457 - DNA, 75 bp, Artificial Sequence
  Synthetic
acagcactgtccgttgtgacgtggaacgagaaaggggttacggtcaaatatacccctgagaacagcgagcagtgg

SEQ ID NO: 354458 - DNA, 75 bp, Artificial Sequence
  Synthetic
agaagaccgctaaatcaaagaacaagcctggtaaacgccaaagaacggcgatgaagctagaatctgataagacat

SEQ ID NO: 354459 - DNA, 75 bp, Artificial Sequence
  Synthetic
ctcatgcatccgactttgatgtggacagtttatccatccttgacaccctggagggagctagcgtgaccagcgagg

SEQ ID NO: 354460 - DNA, 75 bp, Artificial Sequence
  Synthetic
ttgccaatgtcacgttcccgtgctcccaaccacccatttgctatgaccgtaagccagcagagactttgtccatgc

SEQ ID NO: 354461 - DNA, 75 bp, Artificial Sequence
  Synthetic
ttccgattcgactagacggcaaaataaatgggtatgcctgtgtggtgggcggtaagttgttccggccactgcatg

SEQ ID NO: 354462 - DNA, 75 bp, Artificial Sequence
  Synthetic
ttgaaggaaaaattgacaatgacatcttagcagcattgaagaccaagaaagcctccaagtatgacttggagtatg

SEQ ID NO: 354463 - DNA, 75 bp, Artificial Sequence
  Synthetic
gcgcgaccggtgcctgcgcctcgaacagtattcaggaaccctccacatcccgctccacgcacaagaacaccgtca

SEQ ID NO: 354464 - DNA, 75 bp, Artificial Sequence
  Synthetic
cagacgtaccccagagcatgcgttcggatacctttaagtatacgcatgagaaaccccgaggttattacagctggc

SEQ ID NO: 354465 - DNA, 75 bp, Artificial Sequence
  Synthetic
gaagttgccatagccccatagccatagaggcggtaaggagcgaagggcatgatggctacgtacgactccagacct

SEQ ID NO: 354466 - DNA, 75 bp, Artificial Sequence
  Synthetic
accatggggctgtgcagtacgagaacggaaggttcactgtcccgaaaggagtaggagcgaaaggggacagcggcc

SEQ ID NO: 354467 - DNA, 75 bp, Artificial Sequence
  Synthetic
cgtcccaatacggattggacccatctggaaatttgaaaggcagaaccatgaggtatgacatgcatggaaccatag

SEQ ID NO: 354468 - DNA, 75 bp, Artificial Sequence
  Synthetic
gtcccatcttagacaatcaaggcagagtcgtggctatagtactcggaggagccaacgaggggtcgcgtactgcgt

SEQ ID NO: 354469 - DNA, 75 bp, Artificial Sequence
  Synthetic
aagagataccattgcaccaagtgtctgttcatacctcgcgcccatgccacataatagatgggcatggctacttct

SEQ ID NO: 354470 - DNA, 75 bp, Artificial Sequence
  Synthetic
tatcagtcgtcacttggaatgaaagaggggtcaccgtcaaatatacacctgagaactgtgagccgtggtccctag

SEQ ID NO: 354471 - DNA, 75 bp, Artificial Sequence
  Synthetic
tgcttgctaggtgcccagcaggtgactccataactatggaattcaagaaagaatccgtcactcactcctgctccg

SEQ ID NO: 354472 - DNA, 75 bp, Artificial Sequence
  Synthetic
taactaccatgtgcctgttggctaacatcagtttcccgtgctcgcagtcccctctgtgttatgacaagaaaccag

SEQ ID NO: 354473 - DNA, 75 bp, Artificial Sequence
  Synthetic
tggagatttcgtatgccccgcgcctcgaccaagaaaaagaagaattactacgcaagaaattacagctgaatccca

SEQ ID NO: 354474 - DNA, 75 bp, Artificial Sequence
  Synthetic
tgccctacgaagtaaagttcaatcctgtgggaagggaactgtacacacatccaccagagcacggagccgaacaac

SEQ ID NO: 354475 - DNA, 75 bp, Artificial Sequence
  Synthetic
cggacaccctggcattgctaagtgcaaacgtagacaacccgggttatgatttgctactggagtccgtgctgagtt

SEQ ID NO: 354476 - DNA, 75 bp, Artificial Sequence
  Synthetic
cacctgctaacagaagcagataccagtccaggagggtggagaacatgaaagccataacagcaagacgtattctgc

SEQ ID NO: 354477 - DNA, 75 bp, Artificial Sequence
  Synthetic
ccaccagagcacggagccgaacaaccatgccacgtgtacgctcacgatgcacagaataggggagcttacgtggaa

SEQ ID NO: 354478 - DNA, 75 bp, Artificial Sequence
  Synthetic
gtccaggcagaaagaaaagatccacagaagaattgtttaaggaatataagcttaccacgccgtacatggccaggt

SEQ ID NO: 354479 - DNA, 75 bp, Artificial Sequence
  Synthetic
gctccagatgtgcagtaggcagctgccatagccccatagccatagaatcggtgcgcagcgatgggcacgacggct

SEQ ID NO: 354480 - DNA, 75 bp, Artificial Sequence
  Synthetic
gccgggcaaagcgtcctcgtagaatgtgaatgtggtggcaccaagatctccgaaaccatcaattctgctaagcaa

SEQ ID NO: 354481 - DNA, 75 bp, Artificial Sequence
  Synthetic
acgtacggctgcaaacatcttcccagtacggactagattcatcaggcaatttaaaaggcaggactatgaggtact

SEQ ID NO: 354482 - DNA, 75 bp, Artificial Sequence
  Synthetic
tacagccagtgctccaagacagctcagtgcagggcataccgaacacagaatgacaaatgggtgtataattcggac

SEQ ID NO: 354483 - DNA, 75 bp, Artificial Sequence
  Synthetic
atatgcatggaaagatagaggagattcctttgcacgaagtcaccctacgaacatcccaaccgtgtcatattgtgg

SEQ ID NO: 354484 - DNA, 75 bp, Artificial Sequence
  Synthetic
aaattgcctaaagcagcgggagaaactctcaaaggcaaactgcatgtgcccttcgtgctgactgaagcaaaatgc

SEQ ID NO: 354485 - DNA, 75 bp, Artificial Sequence
  Synthetic
atggacacggctacttcttactggcaagatgtccccctggagactccgtaaccatggagtttaagaaggagagtg

SEQ ID NO: 354486 - DNA, 75 bp, Artificial Sequence
  Synthetic
acagtgccactggccccagaacccattattacttttgggttccgttctgtgtctctgaaacttcaccccaagaat

SEQ ID NO: 354487 - DNA, 75 bp, Artificial Sequence
  Synthetic
tactacattcctgcaccgtcccttatgaggtcaaattcacgcctgctggaagagaattgtattctcagcctccag

SEQ ID NO: 354488 - DNA, 75 bp, Artificial Sequence
  Synthetic
cccacctttttgaccacgaggcagctggatggagaaccagcttacacccacgaactcataactaaccctgtagtg

SEQ ID NO: 354489 - DNA, 75 bp, Artificial Sequence
  Synthetic
agcacggagtcgaacaaccgtgccatgtctacgctcatgacgctatggtgagaggatcttatgtagaaatgcata

SEQ ID NO: 354490 - DNA, 75 bp, Artificial Sequence
  Synthetic
gaagaaaatgtggtaaattacattactaaattaaaaggaccaaaagctgctgctctttttgcgaagacacataat

SEQ ID NO: 354491 - DNA, 75 bp, Artificial Sequence
  Synthetic
gagactgcaccaggtaatccccacggactgccgcacgaggtgatcacccattactatcacaggtatcccatgtcc

SEQ ID NO: 354492 - DNA, 75 bp, Artificial Sequence
  Synthetic
tgccagggtccgaggttgacagctccctgctgtcaatgagtggatcatctgtgaaagtgacccccccagcaggta

SEQ ID NO: 354493 - DNA, 75 bp, Artificial Sequence
  Synthetic
tgagcgtgttcgtggactgcaaatgcagcagcgggcagatcacagagacggtcaacagtgaaaagacctatagcc

SEQ ID NO: 354494 - DNA, 75 bp, Artificial Sequence
  Synthetic
agtgtacccagacagggcaatgtcgcgcatatcggctgcaatccacaaagtgggtgtacaactcagataaactac

SEQ ID NO: 354495 - DNA, 75 bp, Artificial Sequence
  Synthetic
agcatccgtatggcttttctgcaaatcacggatttcctgcctgaccccctatcgcttgactccaaatgctcgtat

SEQ ID NO: 354496 - DNA, 75 bp, Artificial Sequence
  Synthetic
gcccttgtgcctagcagttttgtgctgcgcacgcacagccagagccgaaaccacttgggaatccctggatcacct

SEQ ID NO: 354497 - DNA, 75 bp, Artificial Sequence
  Synthetic
cacgtgcggctggggacactttgaaggggaagcttcatgtgccttacctccttactgaagccaaatgtaccgttc

SEQ ID NO: 354498 - DNA, 75 bp, Artificial Sequence
  Synthetic
ttggaaccataatcagcagatgttctggagccagttgctaatcccgctagcagcactgatagtcgctacccgctt

SEQ ID NO: 354499 - DNA, 75 bp, Artificial Sequence
  Synthetic
cgcttgctccagaacccgtcgttaagtacgggtttaggtcagtatctctgaagcttcatccaaagcaccctacgt

SEQ ID NO: 354500 - DNA, 75 bp, Artificial Sequence
  Synthetic
atctgactaccagacacctgacaggagatccagggtatactcatgagcttatttcggagcctaccgttaaaaact

SEQ ID NO: 354501 - DNA, 75 bp, Artificial Sequence
  Synthetic
ttaccatcacagagcaaggctgggagtacgtgtggggcaatcaccctccaaagagactgtgggcccaagagacgg

SEQ ID NO: 354502 - DNA, 75 bp, Artificial Sequence
  Synthetic
atcccgtataataccattgtcaacagagcgggttatgcacctctacccatcagcatagtacctaccaaagtgaag

SEQ ID NO: 354503 - DNA, 75 bp, Artificial Sequence
  Synthetic
cgcccggggatcctcatggattgcctcacgaattagttactcactactatcatcggtatcccctaacgacatcta

SEQ ID NO: 354504 - DNA, 75 bp, Artificial Sequence
  Synthetic
ttgattccaacagtgaaccttgagtacattacttgccattacaagactggaatggattcacctgccatcaaatgt

SEQ ID NO: 354505 - DNA, 75 bp, Artificial Sequence
  Synthetic
taggagtgtccatttgtgtctcgatagtggtgatttcgtgtgcagcttccacctggctattttgtaaatcgagga

SEQ ID NO: 354506 - DNA, 75 bp, Artificial Sequence
  Synthetic
tgcggcacccaggagtgttctccaacctataggccggacgaacaatgcaaagtcttctctggagtatacccattt

SEQ ID NO: 354507 - DNA, 75 bp, Artificial Sequence
  Synthetic
atacttgcctgaccccttacagactgacacctaatgcccaattgccgctctgtgtggctgtcttgtgctgcgccc

SEQ ID NO: 354508 - DNA, 75 bp, Artificial Sequence
  Synthetic
gcacggctagagcggagaccatgtgggagagcctggaccacttgtggaacaataaccagcagatgttctggatac

SEQ ID NO: 354509 - DNA, 75 bp, Artificial Sequence
  Synthetic
catacaaagcacatacagcctcagtccaagccttcctgaacatcacagtgggaggacactcaacgaccgcagtgg

SEQ ID NO: 354510 - DNA, 75 bp, Artificial Sequence
  Synthetic
agctactcctaccactagcggccttgatagtgttgacgcgtgtcctgaagtgcatgtgctgtatggtgccttttt

SEQ ID NO: 354511 - DNA, 75 bp, Artificial Sequence
  Synthetic
ccaagccttcctgaacatcacagtgggaggacactcaacgaccgcagtggtgtatgtgaatggagagactcccgt

SEQ ID NO: 354512 - DNA, 75 bp, Artificial Sequence
  Synthetic
tagtgctggccggcgccgcaggcgccggcgccttcgaacacgcgaccacgatgccgaatcaggtgggaatgccgt

SEQ ID NO: 354513 - DNA, 75 bp, Artificial Sequence
  Synthetic
taactttaatggagtgaagctgactgcgggccctctgtccacagcctggtcgccgttcgataaaaagatcgtgca

SEQ ID NO: 354514 - DNA, 75 bp, Artificial Sequence
  Synthetic
gtatgccggggaaatctacaattatgacttcccagagtacggagccggccatgcaggtgcgttcggtgacatcca

SEQ ID NO: 354515 - DNA, 75 bp, Artificial Sequence
  Synthetic
ttaacaccatagtgaatagacctggctacgcaccattggccatcagcgtgactcccacaaaagtccaattggtgc

SEQ ID NO: 354516 - DNA, 75 bp, Artificial Sequence
  Synthetic
agctaggacgatatccagctccgatgtatacgccaacacaaaccttgtactgcagagacccaaagccggagcgat

SEQ ID NO: 354517 - DNA, 75 bp, Artificial Sequence
  Synthetic
ccacattgaacttggagtacattacatgccactacaaaactggactcgactcgcctgctataaattgctgcggca

SEQ ID NO: 354518 - DNA, 75 bp, Artificial Sequence
  Synthetic
acatggaagtcaagatcatcgatgcagtggtcggcgagaaagctccctatttttgtggtgggtttattctatgtg

SEQ ID NO: 354519 - DNA, 75 bp, Artificial Sequence
  Synthetic
tcatgtcccgtacacccaggccccgtcagggtatgaacaatggaagaaggacaaaccgccatctctcaagttcac

SEQ ID NO: 354520 - DNA, 75 bp, Artificial Sequence
  Synthetic
cccaggagtgttctcccgccacacgacctgatgagcattgcaaggtgttcaccggtgtgtatccgttcatgtggg

SEQ ID NO: 354521 - DNA, 75 bp, Artificial Sequence
  Synthetic
acaaaccgccatctctcaagttcacagccccttttgggtgtgaaatttataccaaccccatccgtgctgaaaact

SEQ ID NO: 354522 - DNA, 75 bp, Artificial Sequence
  Synthetic
gcggagcttattgcttttgtgataccgagaacacgcaagtgagtaaagcatatgtcatgaaatcagacgactgca

SEQ ID NO: 354523 - DNA, 75 bp, Artificial Sequence
  Synthetic
cccaaaattacgcatccgcgtacaaagcacacactgcgtccgtgcaagctcagttgaacgttacggtgggggacc

SEQ ID NO: 354524 - DNA, 75 bp, Artificial Sequence
  Synthetic
tatctactgccgagtgcactctgaatgagtgtgtgtattcatcagactttggcgggatcgccacagtcaaatact

SEQ ID NO: 354525 - DNA, 75 bp, Artificial Sequence
  Synthetic
actttaccacagccaccatctatgttaatggagagactcctattaactttaatggagtgaaattggttgcaggcc

SEQ ID NO: 354526 - DNA, 75 bp, Artificial Sequence
  Synthetic
ctttatcgactgcctggtccccttttgaccgtaagattgtgcaatacgcaggcgaggtttacaactatgacttcc

SEQ ID NO: 354527 - DNA, 75 bp, Artificial Sequence
  Synthetic
ctgagtatggtgcgggacacccaggagcatttggagacatccaagcgaggactacctccagcgccgacctgtatg

SEQ ID NO: 354528 - DNA, 75 bp, Artificial Sequence
  Synthetic
caaatacgaacctggtgctacagcgtcctaaatctggctccatccatgtcccatacactcaggccccttccggat

SEQ ID NO: 354529 - DNA, 75 bp, Artificial Sequence
  Synthetic
atgtgccacagaacatgcgggccgatacattcaagtacacccatgagaagccccaaggctattacagctggcatc

SEQ ID NO: 354530 - DNA, 75 bp, Artificial Sequence
  Synthetic
tttcccagtgggtgaaggacaaaccgccctctttgaagtacaccgcgccgtttgggtgcgaggtacatgtaaacc

SEQ ID NO: 354531 - DNA, 75 bp, Artificial Sequence
  Synthetic
atggagcagtccaatatgaaaatgggcgtttcacggtgccaaaaggagttggggccaagggagacagcggacgac

SEQ ID NO: 354532 - DNA, 75 bp, Artificial Sequence
  Synthetic
ctgtgagggccgagaattgtgctgtggggtctatccctctgtcttttgacatccccgatgccttgttcaccaggg

SEQ ID NO: 354533 - DNA, 75 bp, Artificial Sequence
  Synthetic
tatctgaaacaccgacgttgtccaccgcagagtgtacgcttaatgagtgcgtctactcttctgactttggcggga

SEQ ID NO: 354534 - DNA, 75 bp, Artificial Sequence
  Synthetic
gcggcaattggcgagccgctttaattagaatttttattttcttttaccataattggattttgtttttaatatttc

SEQ ID NO: 354535 - DNA, 75 bp, Artificial Sequence
  Synthetic
tcgccacagtcaaatacgcggcaagtaagacaggtaagtgtgcagtgcatataccatccggcacagccacactga

SEQ ID NO: 354536 - DNA, 75 bp, Artificial Sequence
  Synthetic
gggaatctatagtcgaaataaccccagaaggtactcaaaccttccacttctcgacagccagcattcacccagact

SEQ ID NO: 354537 - DNA, 75 bp, Artificial Sequence
  Synthetic
ttaaaatacagatttgtaccactatggtgcattgtagtggggactgtcaccccccaaaagatcatattgtgacac

SEQ ID NO: 354538 - DNA, 75 bp, Artificial Sequence
  Synthetic
agccccagcgacacgtccaaacctacaccgccgcggtatctaagaccgcatggacgtggttaacatcattgctgg

SEQ ID NO: 354539 - DNA, 75 bp, Artificial Sequence
  Synthetic
gagggtcggcgttaataatcatcattggcctcgtattggcgactctagtggccatgtatgtgctgaccaaccaaa

SEQ ID NO: 354540 - DNA, 75 bp, Artificial Sequence
  Synthetic
aacataattagagtatgtagcaattggcaagctactttgtaaaatttttatttgattttccgattaattggattt

SEQ ID NO: 354541 - DNA, 75 bp, Artificial Sequence
  Synthetic
atgggcggcgcatgagagaagcccatttaatatctacccaatatggagaaagttcacgttgatatcgaggaggat

SEQ ID NO: 354542 - DNA, 75 bp, Artificial Sequence
  Synthetic
atgggcaatacgtaagagtagcccaaaaactgaatacacctacccatcatggagaaagttcacgttgacatcgag

SEQ ID NO: 354543 - DNA, 75 bp, Artificial Sequence
  Synthetic
tgtagcaattggcaagctactttgtaaaatttttatttgattttccgattaattggattttgtttttaatatttc

SEQ ID NO: 354544 - DNA, 75 bp, Artificial Sequence
  Synthetic
ggagaaagttcacgttgacatcgaggaagacagcccgttccttcgagctttacagcggagcttcccacagtttga

SEQ ID NO: 354545 - DNA, 75 bp, Artificial Sequence
  Synthetic
agcaaagcaggtcactgataacgaccatgctaacgccagagcgttttcgcatctggcatcaaagttgatcgagac

SEQ ID NO: 354546 - DNA, 75 bp, Artificial Sequence
  Synthetic
ggtagaagccaagcaggtcaccgataatgaccatgctaatgccagagcgttttcgcatctggcctccaaattgat

SEQ ID NO: 354547 - DNA, 75 bp, Artificial Sequence
  Synthetic
ggaggtagatccatccgagacgatccttgatattggaagtgcgcccgcccgcagaatgtactctaagcataagta

SEQ ID NO: 354548 - DNA, 75 bp, Artificial Sequence
  Synthetic
agtgaaatttaatcctgtaggcagagaactctatactcatcccccagaacacggagcagagcaagcgtgccaagt

SEQ ID NO: 354549 - DNA, 75 bp, Artificial Sequence
  Synthetic
cgagacggaggtagaaccatccgatacgatcctagacataggcagtgcaccggcacgccgaatgtattcaaagaa

SEQ ID NO: 354550 - DNA, 75 bp, Artificial Sequence
  Synthetic
ccattgtatctgtcctatgaaatgcgcagaggacccagacagactctataagtacgcctccaagctgaagaagaa

SEQ ID NO: 354551 - DNA, 75 bp, Artificial Sequence
  Synthetic
taagtatcattgcatttgcccaatgaaatgtgcagaagatccggacagattatacaaatatgcggcgaaactaaa

SEQ ID NO: 354552 - DNA, 75 bp, Artificial Sequence
  Synthetic
cagtaaggcgataactgataaagagctggacaagaagatgaccgaactggcagctgtcatgagtgatcctgacct

SEQ ID NO: 354553 - DNA, 75 bp, Artificial Sequence
  Synthetic
gaaaaactgcaaagacatcacggacaaaggactagatcagaagctagcagatcttgcagcagtcatgcaggaacc

SEQ ID NO: 354554 - DNA, 75 bp, Artificial Sequence
  Synthetic
tgagcaggacaccatttgcttgcatgacgacgagtcatgccgttttagcggccatatagcggtgtatcaggacgt

SEQ ID NO: 354555 - DNA, 75 bp, Artificial Sequence
  Synthetic
cggcacaaagatctccgagaccatcaacacggcaaaacagttcagccagtgcacaaagaaggagcagtgcagagc

SEQ ID NO: 354556 - DNA, 75 bp, Artificial Sequence
  Synthetic
ttccttagagcgagaatcgatttgtcttcatgacgacgagtcatgccgctatgaagggcagattgctgtctacca

SEQ ID NO: 354557 - DNA, 75 bp, Artificial Sequence
  Synthetic
ctacgcggtagacggaccaaccagtctttaccaccaagctgaaaaaggggtgagagtggcctactggattgggtt

SEQ ID NO: 354558 - DNA, 75 bp, Artificial Sequence
  Synthetic
atatcgactgcagaatgacaaatgggtgtataattctgacaaactgcccaaagctgcgggagccaccctaaaagg

SEQ ID NO: 354559 - DNA, 75 bp, Artificial Sequence
  Synthetic
gacgtattccagaataaggcgaacgtgtgttgggccaaggctttggtgccggtactgaaaactgcaggcatagac

SEQ ID NO: 354560 - DNA, 75 bp, Artificial Sequence
  Synthetic
agatgtctatgcagtagacggacctactagtctttatcatcaagccaataagggtgtaagggtcgcctattggat

SEQ ID NO: 354561 - DNA, 75 bp, Artificial Sequence
  Synthetic
tggctttgacactacgccttttatgtttaagaatttagccggcgcatacccctcctattcgaccaactgggccga

SEQ ID NO: 354562 - DNA, 75 bp, Artificial Sequence
  Synthetic
tgacaccacccctttcatgttcaaaaatcttgctggggcgtacccgtcctactccacaaactgggccgacgagtc

SEQ ID NO: 354563 - DNA, 75 bp, Artificial Sequence
  Synthetic
agtgctaactgcgcgcaatataggactttgcagctccgatgttatggagcgttctaggagagggttatctatcct

SEQ ID NO: 354564 - DNA, 75 bp, Artificial Sequence
  Synthetic
cgagacagtgttaacagctcgtaatataggcctatgtagttccgatgtaatggaacggtccaggagaggactatc

SEQ ID NO: 354565 - DNA, 75 bp, Artificial Sequence
  Synthetic
tagaaagaagtatctgaaaccgacagacaacatcatcttttcagtcgggtctactatctaccatgagaaacgaga

SEQ ID NO: 354566 - DNA, 75 bp, Artificial Sequence
  Synthetic
catccttaggaagaaatacttaaaaccgtcgaacaatatcatattttcggtgggctctactatctatcacgaaaa

SEQ ID NO: 354567 - DNA, 75 bp, Artificial Sequence
  Synthetic
gttgctgagaagctggcacttaccttcagtgttccacctacgcggaaaaaacagctacacatgtcggtgtgagac

SEQ ID NO: 354568 - DNA, 75 bp, Artificial Sequence
  Synthetic
gagggacctactgcggagctggcacttaccatcagtgttccatttacgcggtacgcataattacacgtgtcggtg

SEQ ID NO: 354569 - DNA, 75 bp, Artificial Sequence
  Synthetic
tatagttagttgcgacgggtacgttgtcaaaaggatagctataagtccaggcctgtacgggaaaccttcgggcta

SEQ ID NO: 354570 - DNA, 75 bp, Artificial Sequence
  Synthetic
tgagacgatagtaagctgcgacgggtacgtcgttaagagaattgctatcagtccaggcctgtacgggacaccgtc

SEQ ID NO: 354571 - DNA, 75 bp, Artificial Sequence
  Synthetic
tgtgaagaccacgccatcaagcttagcatgttgaccaagaaagcttgtctgcatctgaatcccggcggaacctgc

SEQ ID NO: 354572 - DNA, 75 bp, Artificial Sequence
  Synthetic
gggctatgcggccacgatgcatcgcgagggattcttgtgttgcaaagtcacggatacacttaacggggagagggt

SEQ ID NO: 354573 - DNA, 75 bp, Artificial Sequence
  Synthetic
tggctgttttgcaaatccagagtttcgtgcctaactccttaccggctaacacccaacgccaggatgccgctttgc

SEQ ID NO: 354574 - DNA, 75 bp, Artificial Sequence
  Synthetic
cgccgcaacgatgcatcgcgagggattcttgtgttgcaaggtgacggacacactcaacggggagagggtttcttt

SEQ ID NO: 354575 - DNA, 75 bp, Artificial Sequence
  Synthetic
ttcttttcccgtatgtacgtacgtgcctgctaccttgtgcgaccagatgacaggtatactggcgacagacgtaag

SEQ ID NO: 354576 - DNA, 75 bp, Artificial Sequence
  Synthetic
tcccgtgtgtacgtacgtgccagctacgctctgtgaccagatgaccggaatactggctacagacgtcagtgcaga

SEQ ID NO: 354577 - DNA, 75 bp, Artificial Sequence
  Synthetic
cgacgctcaaaaactgcttgttgggctcaaccagcggattgtcgtcaacggtcgcacgcagagaaatactaacac

SEQ ID NO: 354578 - DNA, 75 bp, Artificial Sequence
  Synthetic
cgcagatgacgctcagaagttgctggtaggacttaaccagcggattgtagtgaacggacgcactcaaagaaatac

SEQ ID NO: 354579 - DNA, 75 bp, Artificial Sequence
  Synthetic
tatgaaaaattacctgctgcctatcgtcgcacaagcatttgcgcggtgggccaaagagtacaaggaagatcaaga

SEQ ID NO: 354580 - DNA, 75 bp, Artificial Sequence
  Synthetic
tgtagtgactcgcctgctcaagtgcgtgtgctgtgtagtgccttttttagtcgtggccggcgccgcaggcgccgg

SEQ ID NO: 354581 - DNA, 75 bp, Artificial Sequence
  Synthetic
taatactatgaagaattacttactaccagtagtggctcaggcattcgccaggtgggcaagagagtacaaggagga

SEQ ID NO: 354582 - DNA, 75 bp, Artificial Sequence
  Synthetic
cgcctacgagcacgcgaccacgatgccgagccaagcgggaatctcgtataacaccatagtcaacagagcaggcta

SEQ ID NO: 354583 - DNA, 75 bp, Artificial Sequence
  Synthetic
ccaggacgatgaacgtccgctgggattgagagatcgccagctggtgatgggatgttgctgggcctttaagaagca

SEQ ID NO: 354584 - DNA, 75 bp, Artificial Sequence
  Synthetic
ggatgaaaggccgatgggactgcgggaccgacaattagtcatgggttgctgctgggcgtttaagaagcacaaaat

SEQ ID NO: 354585 - DNA, 75 bp, Artificial Sequence
  Synthetic
aacgtcagtgtataagcgcccggatacccagactattgtcaaagtgcccagtgatttccattctttcgtgctacc

SEQ ID NO: 354586 - DNA, 75 bp, Artificial Sequence
  Synthetic
ccaacaaagatcaagctgatacccacagtgaacttggagtacgtcacctgccactacaaaacaggaatggattca

SEQ ID NO: 354587 - DNA, 75 bp, Artificial Sequence
  Synthetic
taagatcacttctgtgtacaaacgcccggatacccaaacggtagtaaaagtgcccagtgatttccattctttcgt

SEQ ID NO: 354588 - DNA, 75 bp, Artificial Sequence
  Synthetic
acgtgttgggtcatgcacactggatatcgggctgagagatcgcattaagaagatgctcgcggaccgaaaggagac

SEQ ID NO: 354589 - DNA, 75 bp, Artificial Sequence
  Synthetic
tctgccaagagtagggagcagtactttggaaatcggcctcagagaccgaattaagaaattgctggagaaaccaaa

SEQ ID NO: 354590 - DNA, 75 bp, Artificial Sequence
  Synthetic
ccactacaaaacaggaatggattcaccagccatcaaatgctgcggatctcaggaatgtactccaacttacaggcc

SEQ ID NO: 354591 - DNA, 75 bp, Artificial Sequence
  Synthetic
cgcgccgctgattacagctgatgacattgaggaggccaggagtgcagcggaagaggcgaaggaagtgcaggctgc

SEQ ID NO: 354592 - DNA, 75 bp, Artificial Sequence
  Synthetic
ggaacctgtaccgctggttacagacgaagacatcggcgaggctaagaacgcagctgctgaggcgaaagaaatcaa

SEQ ID NO: 354593 - DNA, 75 bp, Artificial Sequence
  Synthetic
tgaggctctgagagaggcccttcctcctctcgccccggatgttgaagaacccaccctagaggcagacgtagacct

SEQ ID NO: 354594 - DNA, 75 bp, Artificial Sequence
  Synthetic
agaggcagaagaattgcgggcagccttgccgcccctgactgctgacgttgaagaaccgacgctcgaagcagatgt

SEQ ID NO: 354595 - DNA, 75 bp, Artificial Sequence
  Synthetic
catgttgcaggaggcaggggcgggatctgtcgagacaccccgcggattgattaaagtcaccagctacccaggaga

SEQ ID NO: 354596 - DNA, 75 bp, Artificial Sequence
  Synthetic
tgacctcatgttgcaagaagcaggggcaggatccgtagagacgccgcgggggttgatcaaagtcaccagctatag

SEQ ID NO: 354597 - DNA, 75 bp, Artificial Sequence
  Synthetic
ggagaagattggatcttacgcggtgttgtcacctcaggcagtgcttaggagcgagaaactgtcctgcatacaccc

SEQ ID NO: 354598 - DNA, 75 bp, Artificial Sequence
  Synthetic
cggtgaggagaaaatcggttcctacgctatactctcaccgcaagccgtgttacgcagtgaaaaacttgcgtgtat

SEQ ID NO: 354599 - DNA, 75 bp, Artificial Sequence
  Synthetic
cttggccgagcaagtgatagtgataacgcactcgggacgacgcggaaggtacgctgtcgagccgtatcacggcaa

SEQ ID NO: 354600 - DNA, 75 bp, Artificial Sequence
  Synthetic
tcatgcactcgctgagcaggtgatcgtgattacccattccggcaggaaaggtaggtatgcagtggagccgtatca

SEQ ID NO: 354601 - DNA, 75 bp, Artificial Sequence
  Synthetic
ggtggtggtcccagaaggacatgccattccagtccctgacttccaggccttgagcgagagcgccaccatcgtgta

SEQ ID NO: 354602 - DNA, 75 bp, Artificial Sequence
  Synthetic
tggaaaagtaattgtacctgagggcaccgccattcctgtgcctgattttcaggcactcagtgagagtgccacgat

SEQ ID NO: 354603 - DNA, 75 bp, Artificial Sequence
  Synthetic
tccacgcacaagaacaccgtcacttgcaccctgcagggccagttcgagaactagcctagtttccaccccgccagg

SEQ ID NO: 354604 - DNA, 75 bp, Artificial Sequence
  Synthetic
taacgaacgggagttcgtaaacagatacctacatcacatagccgtcaatggcggagctctgaacaccgacgaaga

SEQ ID NO: 354605 - DNA, 75 bp, Artificial Sequence
  Synthetic
agtgtataacgaacgggagttcgtgaacaggtacttgcaccatatcgcggtccacggaggggcgcttaataccga

SEQ ID NO: 354606 - DNA, 75 bp, Artificial Sequence
  Synthetic
gtactataaggtcgtgaaaccagaagaccatgacggtgagtatctgtatgacatagacaggaagcagtgtgtcaa

SEQ ID NO: 354607 - DNA, 75 bp, Artificial Sequence
  Synthetic
cgaagagtactataagacagtgaaacctggcgactatgacggagaatatctatatgatatagacaaaaaacagtg

SEQ ID NO: 354608 - DNA, 75 bp, Artificial Sequence
  Synthetic
gaaagaccaagtgcacgggctggggctgaccggtgagctggtagagccgccgttccatgagtttgcatatgagag

SEQ ID NO: 354609 - DNA, 75 bp, Artificial Sequence
  Synthetic
cgtgaagaaagaactggttagcggtctagggatgacgggtgaactcattgaacccccatttcatgagttcgcgta

SEQ ID NO: 354610 - DNA, 75 bp, Artificial Sequence
  Synthetic
tctaaggaccaggcctgcagccccctaccaggtgccaacaatcggcgtgtatggtgtgcccgggtcgggcaaatc

SEQ ID NO: 354611 - DNA, 75 bp, Artificial Sequence
  Synthetic
cgaaagcctgaagactagacctgccgcaccccaccaagtacctactattggggtgtatggagtaccaggttctgg

SEQ ID NO: 354612 - DNA, 75 bp, Artificial Sequence
  Synthetic
gggcatcatcaagagcgcagttaccaagcgagacctggtggtaagcgctaagaaagagaactgcgctgagatcat

SEQ ID NO: 354613 - DNA, 75 bp, Artificial Sequence
  Synthetic
taaatctggaatcataaagagcgcagtcacgaagaaagatttagtagttagcgctaaaaaagagaattgtgcgga

SEQ ID NO: 354614 - DNA, 75 bp, Artificial Sequence
  Synthetic
agggtcggcgaccattcatttctcgaccgcaaatatccacccggagttcaggctccaaatatgcacatcatatgt

SEQ ID NO: 354615 - DNA, 75 bp, Artificial Sequence
  Synthetic
aattatcagagacgtcaaacgcgctagagggctggacgtcaatgcgcggactgtggactccgtactgctgaacgg

SEQ ID NO: 354616 - DNA, 75 bp, Artificial Sequence
  Synthetic
gagagatgtcaagaggatgcgcaacctggaggtctcggcgcgcacagtggactctgtgctgctaaacgggtgcaa

SEQ ID NO: 354617 - DNA, 75 bp, Artificial Sequence
  Synthetic
gcactcagtggagaccctgtacgtggatgaagccttcgcgtgtcacgcggggactttacgcgcactgattgcaat

SEQ ID NO: 354618 - DNA, 75 bp, Artificial Sequence
  Synthetic
ttgtaagtacccagtcgaaaccttatacattgacgaagcttttgcgtgccacgcaggaacccttagggccttgat

SEQ ID NO: 354619 - DNA, 75 bp, Artificial Sequence
  Synthetic
cgttaaacccaggaaagcagtgctatgcggagaccccaagcagtgcggcttctttaacatgatgtgcctaaaggt

SEQ ID NO: 354620 - DNA, 75 bp, Artificial Sequence
  Synthetic
tgcgattgtcaagcccaagaaagccgtgttgtgcggggaccctaagcaatgtgggttcttcaacatgatgtgcct

SEQ ID NO: 354621 - DNA, 75 bp, Artificial Sequence
  Synthetic
gcactacaaccatgagatatgcacgcaagtattccacaagagcatatcacgtaggtgcaccaaatcagtaacatc

SEQ ID NO: 354622 - DNA, 75 bp, Artificial Sequence
  Synthetic
gaaggtacacttcaatcatgaaatttgcacacaagtgttccataagagcatatcgcgtagatgcaccaagtctgt

SEQ ID NO: 354623 - DNA, 75 bp, Artificial Sequence
  Synthetic
tgtcgtgtcgacgttgttctacgacaagaagatgaggaccacgaaccccagagagacaccgattgagatagacac

SEQ ID NO: 354624 - DNA, 75 bp, Artificial Sequence
  Synthetic
gacttctgtcgtgtccaccctgttttacgacaagaaaatgaggacaaccaaccagaaagagacgcaaatcgaaat

SEQ ID NO: 354625 - DNA, 75 bp, Artificial Sequence
  Synthetic
aacgggcagcaccaagccgaagaaggaggatctgatcctcacatgctttagggggtgggtgaaacaattgcagat

SEQ ID NO: 354626 - DNA, 75 bp, Artificial Sequence
  Synthetic
cgataccacagggagcacgaagcctaagaaggaggatttgatcctcacttgcttccgagggtgggtaaagcaact

SEQ ID NO: 354627 - DNA, 75 bp, Artificial Sequence
  Synthetic
gagggatgtccatccttagaaagaaatttttaaaaccatccaataatgtcttgttctctgtaggatctaccatct

SEQ ID NO: 354628 - DNA, 75 bp, Artificial Sequence
  Synthetic
agactacaaaggccacgaggtgatgactgcggcggcctcccaggggctaacgcgaaagggcgtttacgcggtcag

SEQ ID NO: 354629 - DNA, 75 bp, Artificial Sequence
  Synthetic
gcagattgactacaaaggcaatgaaatcatgacagcggcagcatcgcaaggactaacccggaagggcgtctatgc

SEQ ID NO: 354630 - DNA, 75 bp, Artificial Sequence
  Synthetic
atacaaggtaaatgagaaccctctctactcaccgacgtcggagcatgtcaatgtcctgctcacgcgtactgagga

SEQ ID NO: 354631 - DNA, 75 bp, Artificial Sequence
  Synthetic
cgtcaggtacaaggtcaatgagaacccgctgtatgcccccaattccgaacacgtgaatgttctgctgactcgaac

SEQ ID NO: 354632 - DNA, 75 bp, Artificial Sequence
  Synthetic
tcgggtggtatggaagaccctggccggggacccgtggatcaagacacttacagccaagtacgcgggcaactttag

SEQ ID NO: 354633 - DNA, 75 bp, Artificial Sequence
  Synthetic
ggaggaccgaatcgtttggaagaccctggcgggtgacccctggattaagaccctgaccgccaagtatccaggtga

SEQ ID NO: 354634 - DNA, 75 bp, Artificial Sequence
  Synthetic
tgccacgctcgaggagtggcaggcggagcacgacgccatcatgcagcacattatggagaaacctgcaccggccga

SEQ ID NO: 354635 - DNA, 75 bp, Artificial Sequence
  Synthetic
attctcagcgacgctagaagaatggcaagctgaacatgacgccattatgaagcacatcatggaagaacctaaccc

SEQ ID NO: 354636 - DNA, 75 bp, Artificial Sequence
  Synthetic
ggacgtgaaagtgactccaggaacaaaacatactgaagaacggccaaaggtacaggtgatccaggctgccgatcc

SEQ ID NO: 354637 - DNA, 75 bp, Artificial Sequence
  Synthetic
cgtctttcagaacaaagcgaacgtctgctgggctaaggcgctggtgcccattctcaggacggcgggggtgacgat

SEQ ID NO: 354638 - DNA, 75 bp, Artificial Sequence
  Synthetic
tgccgacgtcttccagaacaaagcgaacgtttgctgggctaaagctcttgtccctgtgctgaaaacagccggaat

SEQ ID NO: 354639 - DNA, 75 bp, Artificial Sequence
  Synthetic
gaccgcagaacagtggaatacggtgggatactttaaggaggataaagcacattcggccgaaatagtgctaaacca

SEQ ID NO: 354640 - DNA, 75 bp, Artificial Sequence
  Synthetic
ttccttgacggcagaccaatggaataccgtcgaaaattttaaaactgacaaggcgcactctgcagagattgtgtt

SEQ ID NO: 354641 - DNA, 75 bp, Artificial Sequence
  Synthetic
attgtgtgtgaggttctttggactggatcttgactcgggtctattctcagccccgacagtcccgttgtcaattag

SEQ ID NO: 354642 - DNA, 75 bp, Artificial Sequence
  Synthetic
aaatcaactgtgcgtacggttcttcgggctagacttggattcaggtatattctcagcgcctacagtcccgctgtc

SEQ ID NO: 354643 - DNA, 75 bp, Artificial Sequence
  Synthetic
agcagcaattggctagctgcttttaccattattttattttctttaccaacaattggattttgtttttaatatttc

SEQ ID NO: 354644 - DNA, 75 bp, Artificial Sequence
  Synthetic
gaataaccactgggacaactcgccctcaccaaaccgatatggactgaacaaagatgtggttaggcagctatccca

SEQ ID NO: 354645 - DNA, 75 bp, Artificial Sequence
  Synthetic
tataaagaataatcactgggacaactccccatctccgaatatgtacggaatcaacatggacgtggtgaggcagct

SEQ ID NO: 354646 - DNA, 75 bp, Artificial Sequence
  Synthetic
cggcgcatgagagaagcccagaccaattacctacccaaaatggagaaagttcacgttgacatcgaggaagacagc

SEQ ID NO: 354647 - DNA, 75 bp, Artificial Sequence
  Synthetic
ccggtatccacagttaccccgcgcggttgcgacgggtcaagttttagacatgagttccgggacactgcggaactt

SEQ ID NO: 354648 - DNA, 75 bp, Artificial Sequence
  Synthetic
ttctaggcgctacccgcagctgccacgagcggtaaccacagggcgagcgctggatatgaactcgggtgcgttgcg

SEQ ID NO: 354649 - DNA, 75 bp, Artificial Sequence
  Synthetic
tgatccgtgcgttaacctggtcccggtgaacaggagactgccacatgccctggtgactcaccataccgagcagcc

SEQ ID NO: 354650 - DNA, 75 bp, Artificial Sequence
  Synthetic
cgcctacgatccccggataaacttagtgcctatgaacaggaggttaccccatgctcttgtcaccaaccactcaga

SEQ ID NO: 354651 - DNA, 75 bp, Artificial Sequence
  Synthetic
gagaagcgatttctctggttttatcggtaagttgaggggccggactgtcctagtggtcggggaccaggccaacat

SEQ ID NO: 354652 - DNA, 75 bp, Artificial Sequence
  Synthetic
acaccctcctagcgacttttcgacatttgttagtaaacttaaaggtcggaccgtactagtggtcggagacaaaat

SEQ ID NO: 354653 - DNA, 75 bp, Artificial Sequence
  Synthetic
gacaaattaatggcagacaggtgcgccacttggttgaacatggaggtcaagatcatagacgccgtggtgggcgag

SEQ ID NO: 354654 - DNA, 75 bp, Artificial Sequence
  Synthetic
gaccgtgaccggaaagaccgtcgactggctgtccgaatcccccgaagctacttttcgcacgcgcctagacttagg

SEQ ID NO: 354655 - DNA, 75 bp, Artificial Sequence
  Synthetic
acccgggaaagtggttgattggctgtcggacaacccggaggctaactacagggcccgcctagatttaggcatccc

SEQ ID NO: 354656 - DNA, 75 bp, Artificial Sequence
  Synthetic
aagtgagatcccgaagtttgacattgtgtttgtgaacgtgaggaccccgtatagataccaccattatcaacagtg

SEQ ID NO: 354657 - DNA, 75 bp, Artificial Sequence
  Synthetic
gattccagcagagcttcctaagtacgacattgtcttcgtcaatgtaagaacgccgtatagataccaccactatca

SEQ ID NO: 354658 - DNA, 75 bp, Artificial Sequence
  Synthetic
tgaggaccatgctatcaaacttagcatgctgacaaagaaggcatgcctgcacctaaatcctggagggacttgtgt

SEQ ID NO: 354659 - DNA, 75 bp, Artificial Sequence
  Synthetic
gcagtgtgaagatcacgctattaagctgagcatgctgactaagaaagcatgtttgcacctcaatcctgggggcac

SEQ ID NO: 354660 - DNA, 75 bp, Artificial Sequence
  Synthetic
cagcatcgggtacgggtacgcggaccgtgccagcgagagcattattggcgccgtcgctaggcagtttcggttttc

SEQ ID NO: 354661 - DNA, 75 bp, Artificial Sequence
  Synthetic
atgcgtcagcgtgggatacggatatgcagaccgagccagtgaaagcataataggtgcagttgccagacagttcaa

SEQ ID NO: 354662 - DNA, 75 bp, Artificial Sequence
  Synthetic
gcgtgtctgcaagccgaagacttcactggaggagacagaggtgctattcgttttcatagggtacgatagaagggc

SEQ ID NO: 354663 - DNA, 75 bp, Artificial Sequence
  Synthetic
ccaccaagtacattgccctgcttgtgcatccacgctatgaccccggaacgtgttcagcgtttgaaagcctctcgc

SEQ ID NO: 354664 - DNA, 75 bp, Artificial Sequence
  Synthetic
attcgccagagtgtgcaaacctaaaatatccttagaagagacggaagtgctgtttgtattcattggatatgatcg

SEQ ID NO: 354665 - DNA, 75 bp, Artificial Sequence
  Synthetic
gcgtacccacaacccctacaaactttcatctacacttaccaacatatacactggagcaggtttgcatgaggcggg

SEQ ID NO: 354666 - DNA, 75 bp, Artificial Sequence
  Synthetic
gcgagcaatgaggcagccgaattaacatcggtggacgtgcaaccacaggtggaagagagtcctgagaacacggaa

SEQ ID NO: 354667 - DNA, 75 bp, Artificial Sequence
  Synthetic
taggacacgcacccacaacccgtataaactctcctctacgctaacaaacatctattcgggctccaactttcatga

SEQ ID NO: 354668 - DNA, 75 bp, Artificial Sequence
  Synthetic
gtgcgcaccatcgtaccatgtggtccggggggatattgccttggcggaagagggagtgatagtaaacgcggctaa

SEQ ID NO: 354669 - DNA, 75 bp, Artificial Sequence
  Synthetic
agcggggtgtgctccctcataccatgttgtccgaggggacattgccaccgcagaagatggggtgatcattaacgc

SEQ ID NO: 354670 - DNA, 75 bp, Artificial Sequence
  Synthetic
tagccgcggacagccaggcagcggagtgtgcggagcgctgtacaggaagtacccagagaacttcgacctgcaacc

SEQ ID NO: 354671 - DNA, 75 bp, Artificial Sequence
  Synthetic
agctaatagtaggggccaaccaggaggaggcgtgtgtggggctctatacaagaagtttccggaaagctttgacct

SEQ ID NO: 354672 - DNA, 75 bp, Artificial Sequence
  Synthetic
catcgaggtgggaaaagcaaggcttgtccagggtccgttgaagcacgtgatacacgcggtgggaccgaacttcaa

SEQ ID NO: 354673 - DNA, 75 bp, Artificial Sequence
  Synthetic
acagcctatagaagtgggtaaggcgcgcttggtaaagggtgcgaaaaaacacatcatacacgcggtcggacctaa

SEQ ID NO: 354674 - DNA, 75 bp, Artificial Sequence
  Synthetic
taaagtgtctgaagtggagggcgacagacagctggctgaggcatatgagtctgtggcaaaaattataaatgataa

SEQ ID NO: 354675 - DNA, 75 bp, Artificial Sequence
  Synthetic
ctttaacaaggtgtcagaaatagaaggcgacaaacaactcgccgaggcgtatgaatccgtcgccaaactagtgaa

SEQ ID NO: 354676 - DNA, 75 bp, Artificial Sequence
  Synthetic
ccactaccgctccgtggcggtgccattgttgtccaccggagtatttgctggaaacaaagataggctgatgcagtc

SEQ ID NO: 354677 - DNA, 75 bp, Artificial Sequence
  Synthetic
tgacaataattaccgatcagtcgccatcccgctcctgtccacaggcatatttgccggtaataaagaccgacttat

SEQ ID NO: 354678 - DNA, 75 bp, Artificial Sequence
  Synthetic
atttaaccacctgttgactgcgttggattccacggatgcggacgtggcaatttactgcagagacaaaaaatggga

SEQ ID NO: 354679 - DNA, 75 bp, Artificial Sequence
  Synthetic
gcagtcattaaaccacctcctcactgccatggatacgaccgacgcggatgtcgctatctactgtcgcgataaaaa

SEQ ID NO: 354680 - DNA, 75 bp, Artificial Sequence
  Synthetic
gactacactgaaagaagtaatagcccgtagggaagcgacagaggagatttgcctctccgaggatgagtcgctatg

SEQ ID NO: 354681 - DNA, 75 bp, Artificial Sequence
  Synthetic
atgggaaactacgctcaaggaagtggtggcccggagggaggcggtagaggagatatgcatatcggaagacgcttc

SEQ ID NO: 354682 - DNA, 75 bp, Artificial Sequence
  Synthetic
cgaacctgacgctgagttggtcagggtgcacccgaagagttcactggcgggcaggaagggatacagtactactga

SEQ ID NO: 354683 - DNA, 75 bp, Artificial Sequence
  Synthetic
cctgaccgagcctgatgtggagttagttcgggttcacccgaagagctcgctagccggcagaaaaggttatagcat

SEQ ID NO: 354684 - DNA, 75 bp, Artificial Sequence
  Synthetic
tggaaagaccttttcatatttggaggggactaaattccaccaggcggcaaaggatatcgcggagatcaacgcgat

SEQ ID NO: 354685 - DNA, 75 bp, Artificial Sequence
  Synthetic
cacggatggaaaaaccttttcttacctagaaggaaccaagttccaccaggcggcgaaagatgtggccgaaataaa

SEQ ID NO: 354686 - DNA, 75 bp, Artificial Sequence
  Synthetic
gtggccagtggcagcagatgctaacgagcagatttgtatgtatatcttgggggagagtatgagtagcatcaggtc

SEQ ID NO: 354687 - DNA, 75 bp, Artificial Sequence
  Synthetic
cgccatgtggccgaatgcaacagaagctaacgagcaaatatgcctctatatcctgggggaaagcatgagtagcat

SEQ ID NO: 354688 - DNA, 75 bp, Artificial Sequence
  Synthetic
taaatgtccagtggaggagtcagaggcgtctatgccgccaacgacgcttccttgtttgtgcatacatgctatgac

SEQ ID NO: 354689 - DNA, 75 bp, Artificial Sequence
  Synthetic
aagatctaaatgccccgtagaagagtctgaagcatcaacaccacctaatacactcccttgtttatgtatccatgc

SEQ ID NO: 354690 - DNA, 75 bp, Artificial Sequence
  Synthetic
gttcccatgtgcccaaccaccaatttgctacgacagaaaaccagcagagaccttggccatgctcagcgttaacgt

SEQ ID NO: 354691 - DNA, 75 bp, Artificial Sequence
  Synthetic
tatgacaccagagcgtgttcagcggttgaaggcatcaaggccggaacagatcacggtgtgctcatcgttcccgtt

SEQ ID NO: 354692 - DNA, 75 bp, Artificial Sequence
  Synthetic
acctgagagagtgcaacgcctgaaagcctcacgccctgagcagattacagtgtgctcctcttttcctttgccgaa

SEQ ID NO: 354693 - DNA, 75 bp, Artificial Sequence
  Synthetic
gtatcgcattgcgggtgtgcagaagattcaatgtgcttgcccgatacttttttcaccgaaggtacctgaacacat

SEQ ID NO: 354694 - DNA, 75 bp, Artificial Sequence
  Synthetic
gccgaagtacagaataaccggcgtacagaagatccaatgttcttgccctatattgttctctccgaaggtgccaga

SEQ ID NO: 354695 - DNA, 75 bp, Artificial Sequence
  Synthetic
acaccctcgcagatatattcaaacacccaccgtccaagagagcggactacaacagtgcgactcaacagtcgccca

SEQ ID NO: 354696 - DNA, 75 bp, Artificial Sequence
  Synthetic
gtacatccaccctagaagataccttcctcgcccacttgaaattgaggtggaacgtgcaggaaccccggcgccggc

SEQ ID NO: 354697 - DNA, 75 bp, Artificial Sequence
  Synthetic
ggcggtggacgctgatgggtcagcacctagtataacagtggatgcgggcgtggaccgactggacaccgattctgt

SEQ ID NO: 354698 - DNA, 75 bp, Artificial Sequence
  Synthetic
ttcgaacgtagaagctgcaacggaagagaactttgaaacgatctccgtagttgacagcgtagttagctcggagag

SEQ ID NO: 354699 - DNA, 75 bp, Artificial Sequence
  Synthetic
gtggagtgacaatcccatcttgcctggtccgaccgggggcgcggaggtacgtctggagggcatggattggtcaac

SEQ ID NO: 354700 - DNA, 75 bp, Artificial Sequence
  Synthetic
tacagccgaaacaaatcttgacggaccaaacgcaatcgtagtagaggcagatgtacacgcagacttgatgcgttt

SEQ ID NO: 354701 - DNA, 75 bp, Artificial Sequence
  Synthetic
tgacagcaccaggctctctgatgcgtctggcccgatcgtgatcggggccgaaatccatgtggagcagagttcgct

SEQ ID NO: 354702 - DNA, 75 bp, Artificial Sequence
  Synthetic
ctcatccacctggtctatcccacacgcttccgatttcgatgcggacagcatctccttggctttgtcagagttttc

SEQ ID NO: 354703 - DNA, 75 bp, Artificial Sequence
  Synthetic
gtcagacgtctccattagcgcttccacggaagatgtgtccggtccagttgtgatcaaggccgaaatccacgcgga

SEQ ID NO: 354704 - DNA, 75 bp, Artificial Sequence
  Synthetic
ctcgacagacgcacgaagcgtagtttccagttctagttctgatgcgggcataagacctatccctgctcctaggac

SEQ ID NO: 354705 - DNA, 75 bp, Artificial Sequence
  Synthetic
gcagggttcgctgtcagacatctccgtcgagtcatgggagagttatgatggcagcacatccacgtacgctgccat

SEQ ID NO: 354706 - DNA, 75 bp, Artificial Sequence
  Synthetic
tatcttcagacaggcgcctgttcctcgacctcgcaaaactaggagttctagtgcgtcactgtcgccaccgattca

SEQ ID NO: 354707 - DNA, 75 bp, Artificial Sequence
  Synthetic
gcgccctgtgccggcgccgcgcactgtgtttaggcgcccaccaaccccgatgccgcgctccctgcctttgaaacc

SEQ ID NO: 354708 - DNA, 75 bp, Artificial Sequence
  Synthetic
cgctcgtaggcaagtatcaggctccagatccagtctggcatccaatccgccaggagttaacagagtgatcaccag

SEQ ID NO: 354709 - DNA, 75 bp, Artificial Sequence
  Synthetic
ggccccgtcccggtgcgggtcgcagctgagtttgtcctcgcgccctccgggcgtcaaccgttctataacggttga

SEQ ID NO: 354710 - DNA, 75 bp, Artificial Sequence
  Synthetic
ggaggagttcgaagccttcgtcgcacaacagcaatgacggtatgaagcgggtgcgtacatcttttcctccgatac

SEQ ID NO: 354711 - DNA, 75 bp, Artificial Sequence
  Synthetic
ggaattcgaggcgttcatcgctcaacagcaatgacggtttgacgcgggtgcatacatcttttcctccgacaccgg

SEQ ID NO: 354712 - DNA, 75 bp, Artificial Sequence
  Synthetic
aggccaaggacatttgcaacaaaaatccgtacggcagaccgttctatctgaggtcgtattggaacgcacgctatt

SEQ ID NO: 354713 - DNA, 75 bp, Artificial Sequence
  Synthetic
tcaggggcacctgcaacagaaatcagtccggcaaacggttttgtcggaggtggtgctggagaggaccgagttgga

SEQ ID NO: 354714 - DNA, 75 bp, Artificial Sequence
  Synthetic
ggatgacgtgtacgccccgcgtctcgatcttaacaaggaggagttactgaggaagaagctccaacttaaccctac

SEQ ID NO: 354715 - DNA, 75 bp, Artificial Sequence
  Synthetic
gatagcgtatgccccgcgcctcgacctggagaaggaggaagcactacggaagaagctgcagttgaatgcatcaca

SEQ ID NO: 354716 - DNA, 75 bp, Artificial Sequence
  Synthetic
tcaagctaataggagcagatatcagtcacggaaagtagagaatatgaaggcgataaccaccatgagaatgttgcg

SEQ ID NO: 354717 - DNA, 75 bp, Artificial Sequence
  Synthetic
ggcaaataggagcaggtacttgtcgcgtaaggtggagaatatgaaggcagtaacgactaataggattttgaaagg

SEQ ID NO: 354718 - DNA, 75 bp, Artificial Sequence
  Synthetic
cggtctaggtcattacttgaaaaccgacaacaaagtagagtgctaccgcaccttataccccgtcccgctgtattc

SEQ ID NO: 354719 - DNA, 75 bp, Artificial Sequence
  Synthetic
cttgggtcattacctgagatcagagggacgggtcgagtgctatcggaccttgcatccggtgccgttgtactccgc

SEQ ID NO: 354720 - DNA, 75 bp, Artificial Sequence
  Synthetic
cagcagtgtgaaccgatcgttttcatgccctaaagtggccgtagaagcctgcaacgtggtgcttaaagagaattt

SEQ ID NO: 354721 - DNA, 75 bp, Artificial Sequence
  Synthetic
gtgtgttgaccgcgcatttgctagcccgcgcgtggccattgaggcgtgtaacgttgtgctcaaggataactttcc

SEQ ID NO: 354722 - DNA, 75 bp, Artificial Sequence
  Synthetic
tccgaccgtggcctcgtattgcattacccccgaatacgacgcatacctagatatggtggacggcgctacttgctg

SEQ ID NO: 354723 - DNA, 75 bp, Artificial Sequence
  Synthetic
aactgtcgcctcatactgcatcatgccggagtacgatgcatatctggatatggtggacggagcatcttgctgcct

SEQ ID NO: 354724 - DNA, 75 bp, Artificial Sequence
  Synthetic
cctagataccgccagtttttgccccgctaagctgcgcagttttcctaagaaacactcatacctggaaccgaccat

SEQ ID NO: 354725 - DNA, 75 bp, Artificial Sequence
  Synthetic
tgatacggccagtttctgtccagcgaagttgcgaagcttcccgaaaaaacacacttatttggaacccacaataag

SEQ ID NO: 354726 - DNA, 75 bp, Artificial Sequence
  Synthetic
tagatcagcagttccgtcagcgattcagaatacactgcagaacgtactggccgctgctacaaaaagaaactgcaa

SEQ ID NO: 354727 - DNA, 75 bp, Artificial Sequence
  Synthetic
atccgcagtgccgtcagctattcagaacacacttcagaacgtcctggcggctgcaacgaagaggaattgtaatgt

SEQ ID NO: 354728 - DNA, 75 bp, Artificial Sequence
  Synthetic
tgttacacaaatgcgtgaactgccagtgctggactccgcggcctttaatgtagagtgtttcaagaagtatgcctg

SEQ ID NO: 354729 - DNA, 75 bp, Artificial Sequence
  Synthetic
tacccaaatgagagagctgcctgtgttggattccgccgcttttaatgtggagtgctttaaaaaatatgcatgcaa

SEQ ID NO: 354730 - DNA, 75 bp, Artificial Sequence
  Synthetic
caacaacgagtattgggacacatacagagataatcctatcagattaactgaggaaaatgtaactaactacatcac

SEQ ID NO: 354731 - DNA, 75 bp, Artificial Sequence
  Synthetic
taatgagtactgggagacatatcgagaaaaccccattagattgaccacagaaaatgtcactaactacatcaccaa

SEQ ID NO: 354732 - DNA, 75 bp, Artificial Sequence
  Synthetic
caagctaaaagggccgaaggcagcagcactgtatgccaagacccacaatctctgcatgctgcaagatatacctat

SEQ ID NO: 354733 - DNA, 75 bp, Artificial Sequence
  Synthetic
gctaaaaggaccgaaggctgccgcattgttcgctaagacacacgacctgaccatgcttcaggacatcccgatgga

SEQ ID NO: 354734 - DNA, 75 bp, Artificial Sequence
  Synthetic
ggacagattcgtgatggatttgaaacgtgacgtcaaagtgacgccgggtactaaacatactgaagaacggcccaa

SEQ ID NO: 354735 - DNA, 75 bp, Artificial Sequence
  Synthetic
caggttcgtgatggatttgaagcgggatgtcaaggtgacccctggaactaaacatactgaggagagaccgaaggt

SEQ ID NO: 354736 - DNA, 75 bp, Artificial Sequence
  Synthetic
ggttcaggtgatccaagccgctgatccactagctactgcgtacctatgcggaatacatcgtgagctggttcggcg

SEQ ID NO: 354737 - DNA, 75 bp, Artificial Sequence
  Synthetic
acaggtaatacaagctgccgaccccttggccacggcgtacctgtgtgggatacacagggagcttgtccgcaggtt

SEQ ID NO: 354738 - DNA, 75 bp, Artificial Sequence
  Synthetic
gctgaatgcagtactactacctaacgtccatacactttttgatatgtcggcagaagacttcgatgcgattattgc

SEQ ID NO: 354739 - DNA, 75 bp, Artificial Sequence
  Synthetic
gaacgcagtgttattgcctaacatccacacactgtttgacatgtctgctgaggacttcgacgccatcatcgccga

SEQ ID NO: 354740 - DNA, 75 bp, Artificial Sequence
  Synthetic
cgagcatttccaacacggagatcaagttctagaaacggacatagcgtccttcgataaaagcgaagacgatgcgat

SEQ ID NO: 354741 - DNA, 75 bp, Artificial Sequence
  Synthetic
acacttcctgaatggggatagcgtgctggagactgacatcgcgtcatttgataagagcgaggatgacgctatggc

SEQ ID NO: 354742 - DNA, 75 bp, Artificial Sequence
  Synthetic
ggcgctaactgcacttatgatacttgaagatctaggagtcgaccaagagctattgactctaattgaagctgcctt

SEQ ID NO: 354743 - DNA, 75 bp, Artificial Sequence
  Synthetic
tcttacggcgctgatgatactggaggacttgggtgtggaccaagagttgttgacactgatagaggcagcattcgg

SEQ ID NO: 354744 - DNA, 75 bp, Artificial Sequence
  Synthetic
tggtgagatatcttctatccacctccccactaaaacgaaattcaaatttggggcgatgatgaagtcaggcatgtt

SEQ ID NO: 354745 - DNA, 75 bp, Artificial Sequence
  Synthetic
ggagattacgtccattcacctgccgaccaaaactaaattcaagtttggagccatgatgaaatcgggcatgttcct

SEQ ID NO: 354746 - DNA, 75 bp, Artificial Sequence
  Synthetic
tcttactctattcgtaaatacaattataaacatagttattgcgagcagagtattgcgagaaaggcttactaactc

SEQ ID NO: 354747 - DNA, 75 bp, Artificial Sequence
  Synthetic
gaccctgtttgttaacacagtcattaacatcgttattgcgagcagggtattgagggagcgcttgacaaattcacc

SEQ ID NO: 354748 - DNA, 75 bp, Artificial Sequence
  Synthetic
tccgtgcgcagctttcatcggagacgataatatagtgaaaggagtaaaatctgataagctaatggccgataggtg

SEQ ID NO: 354749 - DNA, 75 bp, Artificial Sequence
  Synthetic
ttgtgcagcattcatcggagatgacaacatcgttaaaggggtaaagtctgacaagctgatggcggacaggtgcgc

SEQ ID NO: 354750 - DNA, 75 bp, Artificial Sequence
  Synthetic
cgctacgtggttaaacatggaagtgaagatcatagatgcagttgtaggggagaaagcaccgtatttctgcggtgg

SEQ ID NO: 354751 - DNA, 75 bp, Artificial Sequence
  Synthetic
cacatggttaaatatggaggtcaagatcattgatgcggtggtcggcgagaaagcaccatatttttgcggcggatt

SEQ ID NO: 354752 - DNA, 75 bp, Artificial Sequence
  Synthetic
tttcatcctgtgcgataccgtgaccggaactgcatgtcgcgtcgcggatcccctaaaaaggctatttaagttggg

SEQ ID NO: 354753 - DNA, 75 bp, Artificial Sequence
  Synthetic
agcaggagcgatccatgtgccatacactcaggcgccatcgggttttgagcaatggaagaaagataaagctccgtc

SEQ ID NO: 354754 - DNA, 75 bp, Artificial Sequence
  Synthetic
catcttgtgcgacacggtgactggaaccgcctgtagggtggctgaccccctcaagagattatttaaactgggcaa

SEQ ID NO: 354755 - DNA, 75 bp, Artificial Sequence
  Synthetic
gaaaccattggcagccgacgacgagcatgacgacgaccgcagacgagcgctgtttgaggaggcagagaggtggaa

SEQ ID NO: 354756 - DNA, 75 bp, Artificial Sequence
  Synthetic
accactcgccgtggacgatgagcacgatgacgatcgccgccgtgccctacacgaagagtcacaacgctggtgccg

SEQ ID NO: 354757 - DNA, 75 bp, Artificial Sequence
  Synthetic
ccgggctggcatttccgtagaactttgcaaggcagtagaatccaggtacgagatcgtgggcacttctattataat

SEQ ID NO: 354758 - DNA, 75 bp, Artificial Sequence
  Synthetic
cgtgggcatattcgaggagctgtgtaaagctgtggagtcccggtatgagacagtaggtaccgcagtgatcgtcat

SEQ ID NO: 354759 - DNA, 75 bp, Artificial Sequence
  Synthetic
agcagctatggccaccttagctcgtaacgtagcgacattcaaacacctgcgaggaaaccccatacacctctacgg

SEQ ID NO: 354760 - DNA, 75 bp, Artificial Sequence
  Synthetic
ggctatggctacgctggcaggtagtgtgcagtcattccgccatctgcgaggggaccctatatgcctctacggctg

SEQ ID NO: 354761 - DNA, 75 bp, Artificial Sequence
  Synthetic
ctaacctgaatggactgtgatatagtacagtccgcaaccatgttcccttaccaaccatccatgtacccaatgcaa

SEQ ID NO: 354762 - DNA, 75 bp, Artificial Sequence
  Synthetic
acctgaatggactgcaacatagttcagtccgcaatgttccctttcactcccgctatgtatccaatgcaaccaatg

SEQ ID NO: 354763 - DNA, 75 bp, Artificial Sequence
  Synthetic
cctgcgccgtaccgtccgtatccggctccccggagaccatggtatccgcgcaccgacccattcttggcgttgcaa

SEQ ID NO: 354764 - DNA, 75 bp, Artificial Sequence
  Synthetic
cctttccgcagcccgtttccggcccctaggagaccctggttccccagaccggatccttacctggctttacaggtg

SEQ ID NO: 354765 - DNA, 75 bp, Artificial Sequence
  Synthetic
gtgcaagagttggccaggtccatggccaacctaacattcaagcagcgccgggagagtccgcccgaaggcccccct

SEQ ID NO: 354766 - DNA, 75 bp, Artificial Sequence
  Synthetic
caggagctggcccggtccatggctaatttgactttcacacagcgcagggagtcgcaaggagaaggacccccggca

SEQ ID NO: 354767 - DNA, 75 bp, Artificial Sequence
  Synthetic
gctaagaaaaagaaacgtgaaccccagcaagcagcgaccccgattaaaaatgcgcagaagaagaatggcaagggg

SEQ ID NO: 354768 - DNA, 75 bp, Artificial Sequence
  Synthetic
aaaaagaagaggaaaaatccgcgtcaaccggttcagcggaatcagaacgggatgaagaaaggagaaagagggaag

SEQ ID NO: 354769 - DNA, 75 bp, Artificial Sequence
  Synthetic
aagaagaagaagccgaaaggtgccgttcaacccaagaatcaaccggccagtaagaagaaacctaataagaaaccc

SEQ ID NO: 354770 - DNA, 75 bp, Artificial Sequence
  Synthetic
aagaagaaacagcgcgagaacgccccgcaaaagaaccaagcgaagaagaagaaagttaataacaagcctggcaag

SEQ ID NO: 354771 - DNA, 75 bp, Artificial Sequence
  Synthetic
ggaaaaaggcagcgcatggttatgaaactcgaatctgacaaaactttcccgattatgctagacggaaaaattaac

SEQ ID NO: 354772 - DNA, 75 bp, Artificial Sequence
  Synthetic
agacagagaatggtgatgaaacttgaatctgacaagacctttcccatcatgcttgaggggagaactaacgggtat

SEQ ID NO: 354773 - DNA, 75 bp, Artificial Sequence
  Synthetic
ggctacgcctgtgtggtcggaggcaaattgttcagaccgatgcatgttgaaggaaagattgataacgagacgttg

SEQ ID NO: 354774 - DNA, 75 bp, Artificial Sequence
  Synthetic
gcatgcgtggtgggcggtaaactatttagacccatgcatgtggaggggcgtattgacaatgatgcgctggctgct

SEQ ID NO: 354775 - DNA, 75 bp, Artificial Sequence
  Synthetic
gcagccttgaagacgaagaaggcaaccaagtacgacttggagtacgcagacgttccccaaagtatgcgtgcagat

SEQ ID NO: 354776 - DNA, 75 bp, Artificial Sequence
  Synthetic
cttaaaaccaagaaggcgtccaagtacgatctagagtacgccgacgtccctcagagtatgcgcgcagacacattc

SEQ ID NO: 354777 - DNA, 75 bp, Artificial Sequence
  Synthetic
acgtttcgttacacccatgaaaagccccaagggtattataattggcaccacggagccgttcagtatgaaaacggc

SEQ ID NO: 354778 - DNA, 75 bp, Artificial Sequence
  Synthetic
cattcatgctgtagggcccaacttcaataaagtctcggaaattgaaggtgacaaacagttggcagaggcttatga

SEQ ID NO: 354779 - DNA, 75 bp, Artificial Sequence
  Synthetic
aagtacactcatgagaagccacagggctactacagctggcaccatggagcggtacagtacgagaatgggaggttc

SEQ ID NO: 354780 - DNA, 75 bp, Artificial Sequence
  Synthetic
aggttcacggtcccaaaaggagtaggcgctaaaggagatagtggccgacctatactagacaaccaaggaagggta

SEQ ID NO: 354781 - DNA, 75 bp, Artificial Sequence
  Synthetic
acagaggggacacctgaacaaccgacactcataaccgtggatgaaaccagaaccagaacgcccgaaccaattatt

SEQ ID NO: 354782 - DNA, 75 bp, Artificial Sequence
  Synthetic
acggtaccaaaaggtgttggggcgaagggagacagtggacgccccatacttgataaccaggggcgcgtcgtggct

SEQ ID NO: 354783 - DNA, 75 bp, Artificial Sequence
  Synthetic
gtagccatagtgctaggaggagtaaacgaaggttcacgcactgcactgtccgttgtaatgtggactgaaaaaggg

SEQ ID NO: 354784 - DNA, 75 bp, Artificial Sequence
  Synthetic
ctgaaatgtccaggcagaggcaagaggtccacggaggagctgtttaaggagtacaaactaacacgcccgtacatg

SEQ ID NO: 354785 - DNA, 75 bp, Artificial Sequence
  Synthetic
atcgtgctgggcggtgtaaatgagggctcaagaacagccctctctgtggtcatgtggaatgaaaaaggggttacc

SEQ ID NO: 354786 - DNA, 75 bp, Artificial Sequence
  Synthetic
gtcaccgtcaagtacactcccgaaaattgtgagcaatggtctctagttactgccgtttgcttgcttgcaaatgta

SEQ ID NO: 354787 - DNA, 75 bp, Artificial Sequence
  Synthetic
gtaaagtacactcccgagaactgcgagcaatggtctcttgttactaccatgtgcctgcttgccaatgtctcgttc

SEQ ID NO: 354788 - DNA, 75 bp, Artificial Sequence
  Synthetic
acgtttccgtgttcccagccgcctatatgctacgaccgcaaaccgtcagaaactcttgccatgcttagcgagaat

SEQ ID NO: 354789 - DNA, 75 bp, Artificial Sequence
  Synthetic
ccatgttcccagccgcccatgtgctacgatcacaaacccgccgccacacttgcgctgctcagcgccaacgtggac

SEQ ID NO: 354790 - DNA, 75 bp, Artificial Sequence
  Synthetic
atagacaacccaggttacgacgtgttactggattccgtgctgaagtgtccgggcaggcagaaacgttcaacggag

SEQ ID NO: 354791 - DNA, 75 bp, Artificial Sequence
  Synthetic
cgcccagggtatgacgacctgctggaggccgtgctgaaatgcccaggtagggctagaagatccactgatgagctg

SEQ ID NO: 354792 - DNA, 75 bp, Artificial Sequence
  Synthetic
gaactcttcaaagaatataagctgacgaaaccctacatggctaagtgcatcaggtgtgctgtgggcagctgccac

SEQ ID NO: 354793 - DNA, 75 bp, Artificial Sequence
  Synthetic
atgggcggcgcatgagagaagcccaaacacctaactgcccaaaatggagaaagttcacgttgacatcgaggaaga

SEQ ID NO: 354794 - DNA, 75 bp, Artificial Sequence
  Synthetic
ttcaaagagtacaagctcacacggccatatatggcgaagtgcattagatgtgctgttggcagctgccatagtccc

SEQ ID NO: 354795 - DNA, 75 bp, Artificial Sequence
  Synthetic
agccctatagccatagaagaggtgagaagtgacggacatgatggctacatacgcattcagacctcatcgcagtac

SEQ ID NO: 354796 - DNA, 75 bp, Artificial Sequence
  Synthetic
aacacctaactgcccaaaatggagaaagttcacgttgacatcgaggaagatagtcctttcctcagagctttgcaa

SEQ ID NO: 354797 - DNA, 75 bp, Artificial Sequence
  Synthetic
atagctattgaggctgtgcgcagcgacggccatgacggctacgtgagaatacagacatcatctcagtacggattg

SEQ ID NO: 354798 - DNA, 75 bp, Artificial Sequence
  Synthetic
ggactggacccttcaggaggtgtaaagagcagaacgatgcgctacaatctgcaaggaaacattgaagagatacct

SEQ ID NO: 354799 - DNA, 75 bp, Artificial Sequence
  Synthetic
gatccatcgggaagcgtcaaaagaaggactatgaggtacaacatgcatggtaaaatagaggaggtgccgctccat

SEQ ID NO: 354800 - DNA, 75 bp, Artificial Sequence
  Synthetic
ctgcatgaggtgtccctacatacttcccgcccctgccatattatagacggccacggctacttcctcttagctaga

SEQ ID NO: 354801 - DNA, 75 bp, Artificial Sequence
  Synthetic
cggaggtggacccatccgacacgatccttgacattggaagcgcgcccgcccgcagaatgtattcaaagcataaat

SEQ ID NO: 354802 - DNA, 75 bp, Artificial Sequence
  Synthetic
accattgcatctgcccgatgagatgcgcagaggacccggacagattgtacaagtacgctactaagctgaagaaaa

SEQ ID NO: 354803 - DNA, 75 bp, Artificial Sequence
  Synthetic
tgccctgaaggggactcattgaccatggagttcaagaaagatacagtaacgcactcatgctccgtaccctacaaa

SEQ ID NO: 354804 - DNA, 75 bp, Artificial Sequence
  Synthetic
gaggtttctctccacacatcacggccgtgccacatcgtcgacggccatggttatttcctgcttgctagatgccct

SEQ ID NO: 354805 - DNA, 75 bp, Artificial Sequence
  Synthetic
actgcaaggaaataactgataaagaactggacaagaaaatgaaggagctcgccgccgtcatgagcgacccggacc

SEQ ID NO: 354806 - DNA, 75 bp, Artificial Sequence
  Synthetic
gttaaattcatacctgtagggcgcgaactttatacgcacccccccgaacacggcacagaccacccatgccgagtg

SEQ ID NO: 354807 - DNA, 75 bp, Artificial Sequence
  Synthetic
cccggagactcaataacaatggaattcaagaaggaacatgttactcacctgtgttcggtgccgtacgaggtgcgg

SEQ ID NO: 354808 - DNA, 75 bp, Artificial Sequence
  Synthetic
tggaaactgagaccgtgtgcctccacgacgatgagtcgtgtcgctatgaagggcaggtcgctgtataccaggatg

SEQ ID NO: 354809 - DNA, 75 bp, Artificial Sequence
  Synthetic
tatgctcatgatgcccagaagagaggtgcttacgtcgaaatgcacctccctggatccgaagtggatagtactctg

SEQ ID NO: 354810 - DNA, 75 bp, Artificial Sequence
  Synthetic
ttcacccccgtgggtagagaactgtacacgcaccctccagaacacggagcagaacacccttgtcgtgtatacgcg

SEQ ID NO: 354811 - DNA, 75 bp, Artificial Sequence
  Synthetic
tatacgcggttgacggaccgacaagtctttatcatcaagccaataagggggttagagttgcctactggataggtt

SEQ ID NO: 354812 - DNA, 75 bp, Artificial Sequence
  Synthetic
ctctccatgagcggaggggctgtgcaggtgaatcctccagcaggaactaacgtcttagtggagtgtaactgcggc

SEQ ID NO: 354813 - DNA, 75 bp, Artificial Sequence
  Synthetic
cacgatgcacaacaccacggggcctatgtggagatgcatctgcccgggctggaggtggacagcacaatgctctcg

SEQ ID NO: 354814 - DNA, 75 bp, Artificial Sequence
  Synthetic
tcgacactaccccttttatgtttaagaacttggcaggagcatatccttcgtactctaccaattgggccgacgaga

SEQ ID NO: 354815 - DNA, 75 bp, Artificial Sequence
  Synthetic
acccaaatttccgagaccgtcagtaccgtaaaaaagttcaaccagtgcacgcagaccaacaggtgtcgcgcctac

SEQ ID NO: 354816 - DNA, 75 bp, Artificial Sequence
  Synthetic
ttgagcggcggagcagttcagatcacgccgccgaccggaaaaacagcgtttgtagaatgcaaatgcggtgctcaa

SEQ ID NO: 354817 - DNA, 75 bp, Artificial Sequence
  Synthetic
ccgtgctcacggctcgaaatataggcctgtgcagctccgacgttatggagcggtcacgcagaggtatgtccattc

SEQ ID NO: 354818 - DNA, 75 bp, Artificial Sequence
  Synthetic
cgactgcagagtgacaaatgggtgtttaattccgataaactgccgaaagcttcaggggacactctaaaaggtaaa

SEQ ID NO: 354819 - DNA, 75 bp, Artificial Sequence
  Synthetic
atatcagaaacagtgagcacggtgaagaagtacacccaatgcacgaagacaacacagtgcagggcctaccacatg

SEQ ID NO: 354820 - DNA, 75 bp, Artificial Sequence
  Synthetic
ttaggaagaaatacttaaaaccatccaataatgtcctattctctgttggctcaaccatttaccacgagaagagag

SEQ ID NO: 354821 - DNA, 75 bp, Artificial Sequence
  Synthetic
ctgcatgtaccattcctcctatcagaagcaaagtgcacagtgcccctggcgccagagccggtagtgtcgttcgga

SEQ ID NO: 354822 - DNA, 75 bp, Artificial Sequence
  Synthetic
cagaatgacaagtgggtgtacaattcggacaaattaccgaaagcacccggagagacattgaaaggaaaactacat

SEQ ID NO: 354823 - DNA, 75 bp, Artificial Sequence
  Synthetic
gtgccttaccttctgactgacgcgagatgcacagtgccgctggccccggaacccgtggtgtctttcgggtttagg

SEQ ID NO: 354824 - DNA, 75 bp, Artificial Sequence
  Synthetic
ttcaggtcggtgtctttaaaactccatcctaataacccaacttacctgacgaccagacatttaggcggcgaacca

SEQ ID NO: 354825 - DNA, 75 bp, Artificial Sequence
  Synthetic
caataatgtcctattctctgttggctcaaccatttaccacgagaagagagacttattgaagagctggcacctacc

SEQ ID NO: 354826 - DNA, 75 bp, Artificial Sequence
  Synthetic
tcagtgtcgctcaggctgcatccacgacaccccacctatctgaccacacggggcctggatggggagtccgggcac

SEQ ID NO: 354827 - DNA, 75 bp, Artificial Sequence
  Synthetic
cagtatacccatgaacttatctcggagcccgttgtaaagaacttctccatcacggaaaagggttgggaattcgtg

SEQ ID NO: 354828 - DNA, 75 bp, Artificial Sequence
  Synthetic
actcatgagctcataaccgaaccagtcacaagaaacttcacggtcacggagaagggttgggaattcgtttgggga

SEQ ID NO: 354829 - DNA, 75 bp, Artificial Sequence
  Synthetic
tggggtaaccacccgccgcaaaggttctgggctcaggagacagcgcctggaaaccctcacggtatgccgcatgaa

SEQ ID NO: 354830 - DNA, 75 bp, Artificial Sequence
  Synthetic
ttcccgtatgtacatacgtaccagctatattgtgtgaccaaatgactggcatactggcaacagatgtcagtgcag

SEQ ID NO: 354831 - DNA, 75 bp, Artificial Sequence
  Synthetic
atagttacccactattactacaggtatccaatgtcaaccgtggtgggattatctatatgtgccgcaattgtcata

SEQ ID NO: 354832 - DNA, 75 bp, Artificial Sequence
  Synthetic
aatcatccacccaaacgttactgggcccaggagacagctccgggcgacccccatggattgccacacgagatggtg

SEQ ID NO: 354833 - DNA, 75 bp, Artificial Sequence
  Synthetic
acgacgctcagaaattgttggttgggctcaaccaacgcatagtcgtcaacggtcgcactcaaaggaataccaaca

SEQ ID NO: 354834 - DNA, 75 bp, Artificial Sequence
  Synthetic
atatccatagcggcgtcactctgcttgttatgcaaatctcgagtctcgtgcttaacaccttacagattgaccccg

SEQ ID NO: 354835 - DNA, 75 bp, Artificial Sequence
  Synthetic
gtgcattactaccacaggtaccccacgccaaccatcgtgggcttgacgctctgcgcggccataatcgcgatctcg

SEQ ID NO: 354836 - DNA, 75 bp, Artificial Sequence
  Synthetic
caatgaagaattaccttttgcccgtagtggcccaggcgtttgccaggtgggcaaaggaatataaagaagatcaag

SEQ ID NO: 354837 - DNA, 75 bp, Artificial Sequence
  Synthetic
aacgcacgccttcccatctgtctggcattgctttgctgcgcgcgtcctacgagagctgaaacgacgtgggaaact

SEQ ID NO: 354838 - DNA, 75 bp, Artificial Sequence
  Synthetic
gcgtctgcctctgcatggctgctgtgcaaatcgagggcctcatgcttgacaccctaccgtctaacaccaaacgtc

SEQ ID NO: 354839 - DNA, 75 bp, Artificial Sequence
  Synthetic
aagatgagaggccgctaggtctacgagatagacagttagtcttgggatgctgctgggcctttaagaggcacaaga

SEQ ID NO: 354840 - DNA, 75 bp, Artificial Sequence
  Synthetic
cttgaccacctatggaataataatcagcagatgttctggctccaactgcttataccccttgcagctttaatagtg

SEQ ID NO: 354841 - DNA, 75 bp, Artificial Sequence
  Synthetic
aagttgcccgtttaccttgcgatactgtgttgtgctcgcacagcccgagctgaaacggcgtgggagtcgttggac

SEQ ID NO: 354842 - DNA, 75 bp, Artificial Sequence
  Synthetic
taacgtctatttataaacgtcccgacacccaaactattattaaagtgaatagtgatttccattcatttgtgctgc

SEQ ID NO: 354843 - DNA, 75 bp, Artificial Sequence
  Synthetic
attactagaatcctaaaatgcgtctgttgctttgtgccttttttagtcctagccggcgccgccggcgccggcgct

SEQ ID NO: 354844 - DNA, 75 bp, Artificial Sequence
  Synthetic
cacctgtggaaccacaaccagcaaatgttttggatccaactgctgataccgctggccgctttgattgtgttgctc

SEQ ID NO: 354845 - DNA, 75 bp, Artificial Sequence
  Synthetic
ccaggattggcagtaacacgttggagatcgggctgagaaatagaatcaggaagatgctggaagagcataaggagc

SEQ ID NO: 354846 - DNA, 75 bp, Artificial Sequence
  Synthetic
tacgagcacgcaacaacgatgccgagccaagtgggaatcccgtttaacaccatcgtgaatagggccgggtacgca

SEQ ID NO: 354847 - DNA, 75 bp, Artificial Sequence
  Synthetic
cgagtgctgaaatgcgtgtgctgtgtgctgccttttttagtgctggccggcgccgtaggcgccggcgcatacgag

SEQ ID NO: 354848 - DNA, 75 bp, Artificial Sequence
  Synthetic
cgtcacctctcatcactgccgaggatgtacacgaggctaagtgcgcggccgatgaggctaaggaggctcgcgaag

SEQ ID NO: 354849 - DNA, 75 bp, Artificial Sequence
  Synthetic
cccctagcaatcagcatcacccctactaagatccaaattattcccaccctgaacttagagtatattacatgtcat

SEQ ID NO: 354850 - DNA, 75 bp, Artificial Sequence
  Synthetic
cacgcgactacgatgccgaatcaggtgggcatcccatataacaccatagtgaacagggcggggtacgcccctttg

SEQ ID NO: 354851 - DNA, 75 bp, Artificial Sequence
  Synthetic
cagaggagttgcgggtagcactaccacctttggcggccgacgttgaggagcccactttggaagccgatgtcgacc

SEQ ID NO: 354852 - DNA, 75 bp, Artificial Sequence
  Synthetic
tataaaaccgggttagattctcccgcggtgaagtgctgcggaacgcaggaatgctctgaagtcacccgccccgat

SEQ ID NO: 354853 - DNA, 75 bp, Artificial Sequence
  Synthetic
gccatcagcgttacgcctaccaaagtgaaattgatccctacgctgaatttggagtacatcacatgtcactacaag

SEQ ID NO: 354854 - DNA, 75 bp, Artificial Sequence
  Synthetic
tgatgctacaggaggccggagccggctcagtggagacaccacgtggcttaataaaagttactagctacgccggag

SEQ ID NO: 354855 - DNA, 75 bp, Artificial Sequence
  Synthetic
gaaaagtgtaaagtatttacaggtgtgtatccattcatgtggggcggcgcctattgtttctgcgacacagagaac

SEQ ID NO: 354856 - DNA, 75 bp, Artificial Sequence
  Synthetic
accggacttgattctcccgccattaattgctgcggctcacaagagtgcacggccgcccgcaggcctgacgagcag

SEQ ID NO: 354857 - DNA, 75 bp, Artificial Sequence
  Synthetic
aggataaaatcggctcctatgcagtgctttccccgcaggccgtgcttaagagtgaaaaattatcgtgcatccacc

SEQ ID NO: 354858 - DNA, 75 bp, Artificial Sequence
  Synthetic
tcccaggtgagtaaagcatatgtaatgaagtctgatgactgcgctgctgaccatgctcaggcgtataaagcacac

SEQ ID NO: 354859 - DNA, 75 bp, Artificial Sequence
  Synthetic
tgccaggtgttcactggggtgtatccgttcatgtggggaggagcgtactgcttctgcgactccgagaatacacag

SEQ ID NO: 354860 - DNA, 75 bp, Artificial Sequence
  Synthetic
ccttggctgaacaagtcatagtaataacacactctggccgaaaggggcgctacgcggtggaaccgtatcacggaa

SEQ ID NO: 354861 - DNA, 75 bp, Artificial Sequence
  Synthetic
acagctgcagcacaggcctttctcaacattacggtcgcagatcaatcaaccacaacgatcgtgtatgttaatgga

SEQ ID NO: 354862 - DNA, 75 bp, Artificial Sequence
  Synthetic
gtgagtcgagcctacgtgatgagatcggacgactgtgcttcagatcatgcggccgcttacaaggctcacacggca

SEQ ID NO: 354863 - DNA, 75 bp, Artificial Sequence
  Synthetic
aagtagtcgtacctgagggacatgctatacctgtccaggattttcaagctctgagtgaaagcgccaccattgtgt

SEQ ID NO: 354864 - DNA, 75 bp, Artificial Sequence
  Synthetic
gagacagacagttagtcatggggtgctgctgggcttttagaagacacaagataacatctatttataaacgcccgg

SEQ ID NO: 354865 - DNA, 75 bp, Artificial Sequence
  Synthetic
gaaacacccgtcaactttaacggcatcagattaactgcaggccctttatcaacagcgtggacgcctttcgaccgc

SEQ ID NO: 354866 - DNA, 75 bp, Artificial Sequence
  Synthetic
acaacgaacgagagttcgtgaacaggtacctgcatcacattgccacacatgggggggcgttgaatacagatgaag

SEQ ID NO: 354867 - DNA, 75 bp, Artificial Sequence
  Synthetic
aagatagttcagtacgctgaagaagtgtacaactatgatttccctgaatacggagcaggtaccgcaggagctttc

SEQ ID NO: 354868 - DNA, 75 bp, Artificial Sequence
  Synthetic
tcggtccaggccttcctgaatgtaactgtaggagggcgtttcaccactgtggcggtgtacgtgaatggagagacc

SEQ ID NO: 354869 - DNA, 75 bp, Artificial Sequence
  Synthetic
aatactacagagttatcaagcctagcgagcatgacggcgaatatctgtatgatatcgacagaaaacagtgtgtca

SEQ ID NO: 354870 - DNA, 75 bp, Artificial Sequence
  Synthetic
ggcgacatccaagctagaacaactaccagcacagacctatacgccaacaccaatctggtattgcagagaccgaaa

SEQ ID NO: 354871 - DNA, 75 bp, Artificial Sequence
  Synthetic
cctattgattttaatggtgtcaaaatgaccgcaggtccgctgtccactgcttggaccccttttgacagaaaaata

SEQ ID NO: 354872 - DNA, 75 bp, Artificial Sequence
  Synthetic
ggaaagaactagtcactgggctagggctagccggcgagctggtggatccgccattccatgaattcgcctacgaga

SEQ ID NO: 354873 - DNA, 75 bp, Artificial Sequence
  Synthetic
tccggaacggttcacgttccgtatacccaggccccttcaggttttgagcagtggaaaaaggacaaaccaccgtca

SEQ ID NO: 354874 - DNA, 75 bp, Artificial Sequence
  Synthetic
gtccagtatgcaggggaggtctataattatgacttccccgaatacggagcgggtcgtgcgggtgcattcggagac

SEQ ID NO: 354875 - DNA, 75 bp, Artificial Sequence
  Synthetic
gcttgaggacacgaccagctgctccctaccaagtaccgaccataggggtgtatggcgtgccagggtcaggtaaat

SEQ ID NO: 354876 - DNA, 75 bp, Artificial Sequence
  Synthetic
ctgaaatacaccgccccatttgggtgtgaaatcaaagtgaaccccatccgagctgagaattgcgctgtaggctct

SEQ ID NO: 354877 - DNA, 75 bp, Artificial Sequence
  Synthetic
attcaagccagatccatctccagcacggacttgtttgccaacacgaacttggttttgcaaaggccaaagtcgggg

SEQ ID NO: 354878 - DNA, 75 bp, Artificial Sequence
  Synthetic
ctggcattattaaaagtgcagttactaagaaagacctggtggtaagcgccaagaaggaaaactgcacagaaataa

SEQ ID NO: 354879 - DNA, 75 bp, Artificial Sequence
  Synthetic
attccgctttctttcgacattcctgatgccctgtttaccagggtgtctgaaacaccgacgctgtcgaacgcggaa

SEQ ID NO: 354880 - DNA, 75 bp, Artificial Sequence
  Synthetic
accatccatgtgccctacacccaggctccgtccggttttgagcaatggaagcgtgataggcctccgtcgttgagg

SEQ ID NO: 354881 - DNA, 75 bp, Artificial Sequence
  Synthetic
gaggacaagataggctcctacgcagtgctttccccgcaggccgtactcaagagtgaaaaactatcttgtatccac

SEQ ID NO: 354882 - DNA, 75 bp, Artificial Sequence
  Synthetic
tgcaccctaaatgaatgcgtatattcttcggatttcgggggaattgcttcggtgaagtattcagccactaaagca

SEQ ID NO: 354883 - DNA, 75 bp, Artificial Sequence
  Synthetic
taagggacgtcaagaaaatgaaagggttagacgtcaatgccagaaccgtggactcggtgctcttgaatggatgca

SEQ ID NO: 354884 - DNA, 75 bp, Artificial Sequence
  Synthetic
aacaccccgttgagaccttgtacatcgatgaggcatttgcctgccatgcaggcaccctcagagcgcttatagcca

SEQ ID NO: 354885 - DNA, 75 bp, Artificial Sequence
  Synthetic
gggaagtgtgcagtacacataccttcaggtactgcgaccgttagagaagccacagtggatcttgtcgaacaggga

SEQ ID NO: 354886 - DNA, 75 bp, Artificial Sequence
  Synthetic
aaagtagtcgtgccagagggacacgcaatacccgtccaggactttcaagctctgagcgaaagtgctaccattgtg

SEQ ID NO: 354887 - DNA, 75 bp, Artificial Sequence
  Synthetic
ttatacgaccaaaaaaggctgtactatgtggggacccgaaacagtgcggtttcttcaatatgatgtgtctgaaag

SEQ ID NO: 354888 - DNA, 75 bp, Artificial Sequence
  Synthetic
tccctcacagtacacttctcaacagcgaatatccacccagaatttaggctgcagatctgcaccacttatgtgaca

SEQ ID NO: 354889 - DNA, 75 bp, Artificial Sequence
  Synthetic
ctaacatttgacatccccgacgccctgtttaccagggtgtcggatacaccgacattgtcaaacgccgagtgcact

SEQ ID NO: 354890 - DNA, 75 bp, Artificial Sequence
  Synthetic
tgcactttaatcacgagatttgcacgcaagtttttcataaaagcatctctcgccggtgcactaaatctgtgacct

SEQ ID NO: 354891 - DNA, 75 bp, Artificial Sequence
  Synthetic
tgcaaaggcgattgtcatccgcccaaagatcatattgtcacgcacccacagtaccacgcccagacgtttacagca

SEQ ID NO: 354892 - DNA, 75 bp, Artificial Sequence
  Synthetic
cttaacgagtgtgtatattcatcagacttcggcgggatcgcctcggtcaagtactcggcgagcaaggcggggaag

SEQ ID NO: 354893 - DNA, 75 bp, Artificial Sequence
  Synthetic
ctgtcgtctcaactctgttttacgacaggaagatgaggacgacaaacccgaaagagaccaagatcgagatagaca

SEQ ID NO: 354894 - DNA, 75 bp, Artificial Sequence
  Synthetic
gcagtgtccaaaacagcatggacgtggatcacatcgttactcggaggttcggcagtgctcgtagtaattggatta

SEQ ID NO: 354895 - DNA, 75 bp, Artificial Sequence
  Synthetic
tgcgctgttcacgttccatctgggacggcgactctgaaggagtcgatcgtcgatctaaccgaggaggggaccctc

SEQ ID NO: 354896 - DNA, 75 bp, Artificial Sequence
  Synthetic
ctaccggcagcaccaaaccaaagcagggcgatcttatccttacttgcttcagagggtgggtaaagcagttgcaaa

SEQ ID NO: 354897 - DNA, 75 bp, Artificial Sequence
  Synthetic
atattggcaattatcgtagctacgtatgtactgaccggccagaggaggtactaaactaacacagcaattggcagg

SEQ ID NO: 354898 - DNA, 75 bp, Artificial Sequence
  Synthetic
acggtgcatttttcgacagccagtattcacccagatttcaggctgcagatctgcacaacattcgttacgtgcagg

SEQ ID NO: 354899 - DNA, 75 bp, Artificial Sequence
  Synthetic
tagattataaaggcaacgaaataatgacggcagcagcctcccaagggttgacacgcaaaggcgtgtatgccgttc

SEQ ID NO: 354900 - DNA, 75 bp, Artificial Sequence
  Synthetic
ctgtaaattgagtaccattaatcagataatagcagcaattggcgagctgcataaaatttttaataacaactatta

SEQ ID NO: 354901 - DNA, 75 bp, Artificial Sequence
  Synthetic
ggtgattgccatccacccaaggatcacattgtgacccacccgcagtaccactctcagtctttttcatctgctgtt

SEQ ID NO: 354902 - DNA, 75 bp, Artificial Sequence
  Synthetic
ggtacaaggtgaatgaaaatcctttgtacgcacccacctcagagcatgtgaatgtcctgctaacccgcacggagg

SEQ ID NO: 354903 - DNA, 75 bp, Artificial Sequence
  Synthetic
taactatcgtagcagcaattggctagctgcttttaccattattttattttctttaccaacaattggattttgttt

SEQ ID NO: 354904 - DNA, 75 bp, Artificial Sequence
  Synthetic
tccaaaacggcgtggacgtggttaacctctctgttgggaggttctgcggtggtacttgtagtgggtctatcactg

SEQ ID NO: 354905 - DNA, 75 bp, Artificial Sequence
  Synthetic
accgcatcgtgtggaaaacgctagctggtgatccctggataaaaacattgacggctaaatattcaggaaatttta

SEQ ID NO: 354906 - DNA, 75 bp, Artificial Sequence
  Synthetic
gcagccattgttgccatatatatattcacacaaaaacataaataatcgcagcattgctgcatctaaatttttata

SEQ ID NO: 354907 - DNA, 75 bp, Artificial Sequence
  Synthetic
atgggcggcgcatgagagaagcccaagaataaaactacccatcatggagaaggttcacgttgatatcgaggaaga

SEQ ID NO: 354908 - DNA, 75 bp, Artificial Sequence
  Synthetic
ctgccacgatggaggaatggcaaacagagcatgatgccattatgaggcacatcttggagaaaccggatcctaccg

SEQ ID NO: 354909 - DNA, 75 bp, Artificial Sequence
  Synthetic
ccatgctaacgctagagcgttttcgcatctagcatctaaactgatcgagacggaggtggaaccatccgatacgat

SEQ ID NO: 354910 - DNA, 75 bp, Artificial Sequence
  Synthetic
atcgcagcattgctgcatctaaatttttataattttctctgccaatattagattggattttgtttttaatatttc

SEQ ID NO: 354911 - DNA, 75 bp, Artificial Sequence
  Synthetic
acgtcttccagaataaggcgaatgtgtgctgggccaaggctctagtgcctgtactgaagactgcaggcatagata

SEQ ID NO: 354912 - DNA, 75 bp, Artificial Sequence
  Synthetic
cttagacattggaagtgcgcccgctcgcagaatgtactctaaacacaagtaccactgtatctgtccgatgaaatg

SEQ ID NO: 354913 - DNA, 75 bp, Artificial Sequence
  Synthetic
cagccccttcctcagagctttacaacggagcttcccccagtttgaggtagaagccaagcaggttacagacaacga

SEQ ID NO: 354914 - DNA, 75 bp, Artificial Sequence
  Synthetic
tcgccgttgcactaaatctgtgacttcggtcgtctcaactttgttttacgacaaaaggatgagaacgacaaaccc

SEQ ID NO: 354915 - DNA, 75 bp, Artificial Sequence
  Synthetic
tgactaccgaacaatggagcactgtggaccactttgaaacggataaagcccactcagcagaaatagtgttgaacc

SEQ ID NO: 354916 - DNA, 75 bp, Artificial Sequence
  Synthetic
cgcggaggatccggacagattattcaaatacgcagccaaactcaagaagaactgcaaggacatcacagacaagga

SEQ ID NO: 354917 - DNA, 75 bp, Artificial Sequence
  Synthetic
aattgtgcgtgagattcttcggactcgacttggattccggtcttttttctgcgcccacaattccgttatccatca

SEQ ID NO: 354918 - DNA, 75 bp, Artificial Sequence
  Synthetic
gttggacaaaaagatggctgaattggcagccgtcatggaggaccccgatctggaacaggacactatttgcttgca

SEQ ID NO: 354919 - DNA, 75 bp, Artificial Sequence
  Synthetic
ggaacaaccactgggataactccccgtcgcctaatatgtacgggttgaataaggaagtggttcgccaactttccc

SEQ ID NO: 354920 - DNA, 75 bp, Artificial Sequence
  Synthetic
cgacgacgaaacttgtcgttatgaagggcacgtggccgtctaccaggacgtttacgcagtggacggaccaaccag

SEQ ID NO: 354921 - DNA, 75 bp, Artificial Sequence
  Synthetic
atagactacaaaggcaacgaaataatgactgcagctgcctcccaagggctgacccgtaaaggagtgtatgccgtt

SEQ ID NO: 354922 - DNA, 75 bp, Artificial Sequence
  Synthetic
gcaggtacccacaactgcctcgtgcggttgctactggaagagtctatgacatgaacaccggcacactacgcaact

SEQ ID NO: 354923 - DNA, 75 bp, Artificial Sequence
  Synthetic
cctttaccatcaagcaaataagggtgtgcgagtcgcctactggataggttttgacaccacgcccttcatgttcaa

SEQ ID NO: 354924 - DNA, 75 bp, Artificial Sequence
  Synthetic
atgacccgcgcataaacttagtacctgtgaatagaagattgcctcatgctctagtcctccaccacaatgaacatc

SEQ ID NO: 354925 - DNA, 75 bp, Artificial Sequence
  Synthetic
gaacctcgcgggagcgtacccgtcctactccacaaactgggccgatgagacggtgctaacagcccgtaacatagg

SEQ ID NO: 354926 - DNA, 75 bp, Artificial Sequence
  Synthetic
tgcagagtgacttttcgtcattcgttagcaaactgaagggcaggaccgtcctggtggtcggggaaaaattgtccg

SEQ ID NO: 354927 - DNA, 75 bp, Artificial Sequence
  Synthetic
tctatgcagttcggacgttatggagaggtcccgcaggggactatccgtcctacgaaagaaatacttaaaaccatc

SEQ ID NO: 354928 - DNA, 75 bp, Artificial Sequence
  Synthetic
tgcagctccgacgttatggagcggtcacgtagagggatgtccattcttagaaagaagtatttgaaaccatccaac

SEQ ID NO: 354929 - DNA, 75 bp, Artificial Sequence
  Synthetic
gacgtcttccaaaacaaggcgaacgtgtgttgggccaaggctctagtgccggtactgaagactgcaggtattgac

SEQ ID NO: 354930 - DNA, 75 bp, Artificial Sequence
  Synthetic
ttccaggcaaatcggttgactggttgtcagaccggcccgaggctaccttcagagctcgcctggacttgggcatcc

SEQ ID NO: 354931 - DNA, 75 bp, Artificial Sequence
  Synthetic
ctggtgaagtacccaagtatgacatagtattcattaatgtgaggaccccgtataaatatcatcattatcagcagt

SEQ ID NO: 354932 - DNA, 75 bp, Artificial Sequence
  Synthetic
taacaatgtcatattttccgtgggatccactatttaccacgaaaagagagacttactaaaaagctggcacttacc

SEQ ID NO: 354933 - DNA, 75 bp, Artificial Sequence
  Synthetic
tccactatttaccacgaaaagagagacttactaaaaagctggcacttaccatcagtgtttcacctacgtggcaag

SEQ ID NO: 354934 - DNA, 75 bp, Artificial Sequence
  Synthetic
gcgaagatcatgccattaaacttagcatgctgaccaagaaagcttgcctgcacctgaatcccggaggtacctgtg

SEQ ID NO: 354935 - DNA, 75 bp, Artificial Sequence
  Synthetic
tcagcataggttacggctatgcagacagagccagcgagagcatcattggtgccatagcgaggcagttcaagttct

SEQ ID NO: 354936 - DNA, 75 bp, Artificial Sequence
  Synthetic
acactcaacggggagagggtctcttttcccgtgtgtacttatgtgccagcaaccttatgcgaccagatgaccggc

SEQ ID NO: 354937 - DNA, 75 bp, Artificial Sequence
  Synthetic
cccgggtatgcaaaccgaaatcatcgcttgaagagacagaagtgctatttgtattcattggatacgatcgcaggg

SEQ ID NO: 354938 - DNA, 75 bp, Artificial Sequence
  Synthetic
atcttggctacagatgtcagtgcggacgacgctcaaaaactactggttgggctcaaccagcgtattgtcgtgaat

SEQ ID NO: 354939 - DNA, 75 bp, Artificial Sequence
  Synthetic
catgaatactggcacactgcgcaattatgatccgcgcataaatttagtacctgtgaacagaagactgcctcacgc

SEQ ID NO: 354940 - DNA, 75 bp, Artificial Sequence
  Synthetic
cacgcacgcacaatccctacaagctctcatcgacattgactaacatttacacaggttccggactccatgaagccg

SEQ ID NO: 354941 - DNA, 75 bp, Artificial Sequence
  Synthetic
ggtcgcacacagaggaatactaacactatgaagaattacctactgccggtggtcgcccaggcatttgccagatgg

SEQ ID NO: 354942 - DNA, 75 bp, Artificial Sequence
  Synthetic
tcagcaaattgaagggcagaactgtcctggtggtcggggagaagctgtccgtcccaggcaaaacggtagactggc

SEQ ID NO: 354943 - DNA, 75 bp, Artificial Sequence
  Synthetic
ggtgcgcaccctcgtatcacgtggtgcgcggggacattgccacagccaccgaaggagtgattgtgaatgctgcca

SEQ ID NO: 354944 - DNA, 75 bp, Artificial Sequence
  Synthetic
gcaaaagagtataaggaagatcaagaagatgaaagaccactggagttgagagatcgacagctggtaatgggctgc

SEQ ID NO: 354945 - DNA, 75 bp, Artificial Sequence
  Synthetic
acagcaaaggacaacccggcggcggagtgtgcggagcgctgtacaaaaaatttccggagagcttcgatttacagc

SEQ ID NO: 354946 - DNA, 75 bp, Artificial Sequence
  Synthetic
cagagctcggctggatttaggcatcccgggtgacgtgcccaaatatgacataatattcattaatgtaaggacccc

SEQ ID NO: 354947 - DNA, 75 bp, Artificial Sequence
  Synthetic
tgttgggcgttcaagaaacacaagattacatcagtgtacaagcgccctgatacccagactgtcataaaagttccc

SEQ ID NO: 354948 - DNA, 75 bp, Artificial Sequence
  Synthetic
cgatcgaagtaggaaaggcgcgattggttaaaggcgcaacaaaacacattatccacgctgtggggcccaatttca

SEQ ID NO: 354949 - DNA, 75 bp, Artificial Sequence
  Synthetic
agcgacttccactcctttgtactgccaagattaggtagttgttcattggagatcgggctgaagagcaggataaag

SEQ ID NO: 354950 - DNA, 75 bp, Artificial Sequence
  Synthetic
acaaagtctctgaggttgaaggtgacaaacagctggcggaagcttatgagtccattgcaaaaattgtcaacgaca

SEQ ID NO: 354951 - DNA, 75 bp, Artificial Sequence
  Synthetic
ttcactgctccgtttgggtgtgatgtacttgtgaaccccgtgcgcgcggaaaactgcgctgtgggttcaatccca

SEQ ID NO: 354952 - DNA, 75 bp, Artificial Sequence
  Synthetic
aagttgctggaggataaaagagaagcacccccgctgatttcccctgaagatgtctctgcggcgaaagaggcagca

SEQ ID NO: 354953 - DNA, 75 bp, Artificial Sequence
  Synthetic
acaattacaaatcgattgcaattccgctgttgtctaccggcatattttccgggaacagagatcgattgacccagt

SEQ ID NO: 354954 - DNA, 75 bp, Artificial Sequence
  Synthetic
gcagaagctaaagagatcaaggaggccgaggaattgcgcgttgcgttgccccctatcgtccctgacgtggaggaa

SEQ ID NO: 354955 - DNA, 75 bp, Artificial Sequence
  Synthetic
atagggccagcgaaagcatcatcggcgctatagcgcggcagtttaagttctcccgggtatgcaagccgaaatctt

SEQ ID NO: 354956 - DNA, 75 bp, Artificial Sequence
  Synthetic
cactgaatcatttgctgacagccttggataccactgatgcagatgtagccatatactgccgggacaagaaatggg

SEQ ID NO: 354957 - DNA, 75 bp, Artificial Sequence
  Synthetic
cctactctggaagccgacgttgatctgatgctgcaagaagcaggagcaggctccgtagagactccccgagggcta

SEQ ID NO: 354958 - DNA, 75 bp, Artificial Sequence
  Synthetic
tcccgggtatgcaagccgaaatcttcacttgaagagacagaagttctgtttgtattcattgggtatgatcgcaag

SEQ ID NO: 354959 - DNA, 75 bp, Artificial Sequence
  Synthetic
aaatgaccctcaaggaggcagtggctaggagagaggcagtggaggagatatgcatatctgatgattcgtcagtga

SEQ ID NO: 354960 - DNA, 75 bp, Artificial Sequence
  Synthetic
attaaagtcactagttactcgggtgaagacaaaatcggatcctacgctgttctgtcgcctcaagcagtcctccgt

SEQ ID NO: 354961 - DNA, 75 bp, Artificial Sequence
  Synthetic
cagaaccggatgcggagttagtgagggtgcatccgaaaagctccctagccggaaggaagggctacagcaccagcg

SEQ ID NO: 354962 - DNA, 75 bp, Artificial Sequence
  Synthetic
agcgagaaactttcctgcatccacccgctagcggaggaggccatcgtgatcactcattcaggtaggaaaggacgc

SEQ ID NO: 354963 - DNA, 75 bp, Artificial Sequence
  Synthetic
acggaaagactttttcatacctggaagggacaaaatttcatcaggcggccaaagacatagctgaaattaatgcca

SEQ ID NO: 354964 - DNA, 75 bp, Artificial Sequence
  Synthetic
tatgccgtggaaccttaccacggtaaggtggtggtgccagaggggcatgcgatccccgtcgcggacttccaagcg

SEQ ID NO: 354965 - DNA, 75 bp, Artificial Sequence
  Synthetic
cactctggccgaaaagggcgttatgccgtggaaccataccatggaaaagtagtggtgccagagggacatgcaata

SEQ ID NO: 354966 - DNA, 75 bp, Artificial Sequence
  Synthetic
tgtggcccgtggtaacggaagccaatgagcaggtgtgcatgtacattcttggagaaagcatgagcagtatcaggt

SEQ ID NO: 354967 - DNA, 75 bp, Artificial Sequence
  Synthetic
ctcagtgagagtgctaccatcgtgtacaacgagagggagttcgtgaacaggtacctgcaccacattgccgtccac

SEQ ID NO: 354968 - DNA, 75 bp, Artificial Sequence
  Synthetic
caaaatgccccgttgaagagtcggaggcatctacaccacctagcacactgccttgcttgtgtatccatgcaatga

SEQ ID NO: 354969 - DNA, 75 bp, Artificial Sequence
  Synthetic
ggcggggcactgaacaccgatgaggagtactacaaggtggttaaacctagtgaatatgaaggggaatatctgtac

SEQ ID NO: 354970 - DNA, 75 bp, Artificial Sequence
  Synthetic
ctccagaaagggtgcagcgcctgaaagcctcgcgccctgaacaaattacggtgtgctcgtctttcccgctgccga

SEQ ID NO: 354971 - DNA, 75 bp, Artificial Sequence
  Synthetic
gacattgacaaaaggcagtgcgtcaagaaggaccaagtgtcaggtctaggcctgactggagagttagtagaacct

SEQ ID NO: 354972 - DNA, 75 bp, Artificial Sequence
  Synthetic
tcattgaaccatttgctgacagctttagataccaccgatgcagatgtagccatctattgcagggacaagaaatgg

SEQ ID NO: 354973 - DNA, 75 bp, Artificial Sequence
  Synthetic
agtatagaattactggcgtgcagaagatccagtgctcccagcctatactgttttcaccgaaagtgcctgcataca

SEQ ID NO: 354974 - DNA, 75 bp, Artificial Sequence
  Synthetic
ccgtttcacgaattcgcgtatgagagcttaaaaaccagaccagccgcgccctaccaggtgccgaccataggtgtg

SEQ ID NO: 354975 - DNA, 75 bp, Artificial Sequence
  Synthetic
tccatccgcggaagtatctcgtggtagagaaccaatccgcggaaagggaaatggaacagccagcaaacaggactg

SEQ ID NO: 354976 - DNA, 75 bp, Artificial Sequence
  Synthetic
tacggcgtgcctggatcaggcaagtcaggtatcataaaaagcgctgtcaccaaacgagatctggtggtcagcgcg

SEQ ID NO: 354977 - DNA, 75 bp, Artificial Sequence
  Synthetic
aggaaggaaaggctacagcacaagtgatggcaagactttctcgtatttggaagggactaaattccaccaggcggc

SEQ ID NO: 354978 - DNA, 75 bp, Artificial Sequence
  Synthetic
caagtaccaaccataggggtgtatggcgtgccaggatcaggcaagtctggcatcattaaaagcgcagtcaccaaa

SEQ ID NO: 354979 - DNA, 75 bp, Artificial Sequence
  Synthetic
tgagcgagacaagtgctagaatgcctgagccagtcaatatcgaagaagaagaggagggcagcataagttcgctgt

SEQ ID NO: 354980 - DNA, 75 bp, Artificial Sequence
  Synthetic
aagaaggagaactgcgctgagatcatgcgcgacgtgaagaaactgcgaggtctggacatagtggcacgcaccgtt

SEQ ID NO: 354981 - DNA, 75 bp, Artificial Sequence
  Synthetic
cagatggccctacccggcaggtgctgcaggttgaggcggacgtccacaggccaccttccgtgttcggctcatctt

SEQ ID NO: 354982 - DNA, 75 bp, Artificial Sequence
  Synthetic
gattcagtgctgctaaatggatgtaagcacccagttgacacactgtacattgatgaagcgtttgcatgtcatgca

SEQ ID NO: 354983 - DNA, 75 bp, Artificial Sequence
  Synthetic
ggtccattccccatgcatctgactttgacgtggatagtttatccatccttactttggagggggctagcatgattg

SEQ ID NO: 354984 - DNA, 75 bp, Artificial Sequence
  Synthetic
ggcactcttagagcgttgatcgcaatcattaaaccgaagaaggccgtgctatgcggagaccctaagcagtgcggc

SEQ ID NO: 354985 - DNA, 75 bp, Artificial Sequence
  Synthetic
aggcggcgcccacggagactgactcttactccgcaagaagtatggagtttatggtgcgaccggtgccagcgccca

SEQ ID NO: 354986 - DNA, 75 bp, Artificial Sequence
  Synthetic
ttcttcaatatgatgtgccttaaagtgcattttaaccatgaaatctgtacgagagtgtttcacaagagtatctct

SEQ ID NO: 354987 - DNA, 75 bp, Artificial Sequence
  Synthetic
ggacaatatttaggaaaccccctcaccctgctccacgcacaagaatacagtcgcatgcactaagcaggtttaatt

SEQ ID NO: 354988 - DNA, 75 bp, Artificial Sequence
  Synthetic
atccatccacggaagtacctcgtggaaacaccaacggtagaagagaaccaatccacagaggggacacctgaacaa

SEQ ID NO: 354989 - DNA, 75 bp, Artificial Sequence
  Synthetic
cgcagatgcacaaaatctgtcacatccgttgtgtcgacgctgttctatgacaagaaaatgcgaaccaccaatcct

SEQ ID NO: 354990 - DNA, 75 bp, Artificial Sequence
  Synthetic
atccacagaggggacacctgaacaaccgacacttataaccgtggatgaaaccagaaccagaacgcccgaaccaat

SEQ ID NO: 354991 - DNA, 75 bp, Artificial Sequence
  Synthetic
cgagaaccagcctagtctctagcccgccagatgtaaatagggtgaccactagagaggaactcgaggcgttaccgt

SEQ ID NO: 354992 - DNA, 75 bp, Artificial Sequence
  Synthetic
aaagagactaagattgaaattgacaccactggctgcacaaagcccaaaaaaaatgaccttatactaacttgcttc

SEQ ID NO: 354993 - DNA, 75 bp, Artificial Sequence
  Synthetic
cacgagcaccaagtaggccggcctcgaggaccagcctggtttccaacccaccaggcgtgaatagggagattacta

SEQ ID NO: 354994 - DNA, 75 bp, Artificial Sequence
  Synthetic
aggggctgggtaaaacaactgcaaatcgattataaaggtaatgaaatcatgactgcagcggcttcccagggattg

SEQ ID NO: 354995 - DNA, 75 bp, Artificial Sequence
  Synthetic
gggaagagttcgaggcgttcgtagcacaacagcaatgacggttcgacgcgggtgcatacatattttcctccgata

SEQ ID NO: 354996 - DNA, 75 bp, Artificial Sequence
  Synthetic
accagaaagggaatctatgcagtcaggtacaaggttaatgagaatcctttgtatgcccccaactcagaacacgtc

SEQ ID NO: 354997 - DNA, 75 bp, Artificial Sequence
  Synthetic
aatgtcttgctcactcgcacggaggacaggatcgtgtggaagactttggcgggtgacccatggattaaaaccctc

SEQ ID NO: 354998 - DNA, 75 bp, Artificial Sequence
  Synthetic
gaagtggtattggagaggaccgaattggagatttcgtatgccccgcgcctcgacctagagaaggaagaattacta

SEQ ID NO: 354999 - DNA, 75 bp, Artificial Sequence
  Synthetic
cgaccggtgcctgcgccccggacagtattcaggaaccctccacagcccgctccgcgcacaagaacaccgtcactc

SEQ ID NO: 355000 - DNA, 75 bp, Artificial Sequence
  Synthetic
cgcaagaaattacagttaaaccccacacccgccaacagaagtagatatcagtccaggaaggtggagaacatgaaa

SEQ ID NO: 355001 - DNA, 75 bp, Artificial Sequence
  Synthetic
accgccaagtactccggagatttttcggctactctcgaagaatggcaacaagagcacgatgctattatgagacac

SEQ ID NO: 355002 - DNA, 75 bp, Artificial Sequence
  Synthetic
attttggagaaacccgatccggcggatgtcttccagaataaggctaacgtgtgctgggctaaggccttggtgcct

SEQ ID NO: 355003 - DNA, 75 bp, Artificial Sequence
  Synthetic
gctataacagctagacgtattctgcaaggcctggggcactatttgaaggcagaagggaaagtggaatgctaccgc

SEQ ID NO: 355004 - DNA, 75 bp, Artificial Sequence
  Synthetic
gagctcgaggcgctcaccccgtcacgcactcccagcaggtcggtctcaagaaccagcctggtatccaatcctcca

SEQ ID NO: 355005 - DNA, 75 bp, Artificial Sequence
  Synthetic
actctgcatcccgttcccttgtattcgtccagtgtgaatcgtgccttttctagccctaaggtcgcagtggaggcc

SEQ ID NO: 355006 - DNA, 75 bp, Artificial Sequence
  Synthetic
gtgctgagaacggccggcattgacttgactgcggaacagtggaacacggttgcccattttagggatgataaggca

SEQ ID NO: 355007 - DNA, 75 bp, Artificial Sequence
  Synthetic
cattctgcggaaatagtgcttaaccagctgtgtgtccgcttttttggactcgacttagactctggcctgttctca

SEQ ID NO: 355008 - DNA, 75 bp, Artificial Sequence
  Synthetic
tgtaacgccatgttgaaagaaaattttccgaccgtggcctcgtattgcataattccggagtacgatgcctatctg

SEQ ID NO: 355009 - DNA, 75 bp, Artificial Sequence
  Synthetic
gcacccaccgtaccgttgtcgataaggaacaaccactgggacaactcgccttcaccgaatatgtacggtctgaac

SEQ ID NO: 355010 - DNA, 75 bp, Artificial Sequence
  Synthetic
gacatggttgatggtgcttcctgttgcctggacacagctagtttttgccctgcaaagttgcgtagttttccaaag

SEQ ID NO: 355011 - DNA, 75 bp, Artificial Sequence
  Synthetic
aaagaggtggtccggcacttggcccgacgttatccacaacttcctcgggcagtggcgactggaagagtcctggat

SEQ ID NO: 355012 - DNA, 75 bp, Artificial Sequence
  Synthetic
aagcactcttacttggaacccacaatacggtcggcagtaccctcggcgattcagaacacgctccagaacgttctg

SEQ ID NO: 355013 - DNA, 75 bp, Artificial Sequence
  Synthetic
atgaacaccgggactttgcgtagctacgacccgagtgtcaacctcgtgccggttaaccgcagactacctcatgcc

SEQ ID NO: 355014 - DNA, 75 bp, Artificial Sequence
  Synthetic
gctgctgccactaagaggaactgcaatgtcacgcaaatgagagaactgccagttttggattcggccgctttcaat

SEQ ID NO: 355015 - DNA, 75 bp, Artificial Sequence
  Synthetic
ttggtcacacacaggacagaacagcctcctagcgacttctcagcgttcgctagtaaactaaagggccggaccgtt

SEQ ID NO: 355016 - DNA, 75 bp, Artificial Sequence
  Synthetic
gtggagtgcttcaagaaatacgcgtgcaacaacgaatattggaagacatttaaagagaaccccataaggcttact

SEQ ID NO: 355017 - DNA, 75 bp, Artificial Sequence
  Synthetic
ttggtcattggagataaaatgcatatcacagggaagactgttgattggttgtccgagagccctgaagccaccttt

SEQ ID NO: 355018 - DNA, 75 bp, Artificial Sequence
  Synthetic
gaagagaatgtgataaattatattactaaattaaaaggacctaaagctgctgccctttatgcaaagacacataac

SEQ ID NO: 355019 - DNA, 75 bp, Artificial Sequence
  Synthetic
aaacatcgcttggacctaggcatcccgagcgagctacctaaatatgacattgtgttcgtgaacactaggacccct

SEQ ID NO: 355020 - DNA, 75 bp, Artificial Sequence
  Synthetic
ttgaacatgttgcaggatataccaatggacaggtttgttatggatttaaagagggatgtgaaagtgactcccgga

SEQ ID NO: 355021 - DNA, 75 bp, Artificial Sequence
  Synthetic
tataagtaccatcattatcaacagtgtgaggaccatgcaataaaactcagcatgcttgcaaagaaagcgtgtcta

SEQ ID NO: 355022 - DNA, 75 bp, Artificial Sequence
  Synthetic
tagatactgccagtttttgccctgcaaagctgcgcagctttccaaagaaacattcctatttggaacccacaatac

SEQ ID NO: 355023 - DNA, 75 bp, Artificial Sequence
  Synthetic
accaaacatactgaagaacggccgaaggtgcaggtaattcaggcggcagatcccctagcaactgcgtacttgtgc

SEQ ID NO: 355024 - DNA, 75 bp, Artificial Sequence
  Synthetic
cacctaaatcctggtggaacctgtgtcagcgtcggctacggatacgcggacagggccagtgaaagtattgtgggg

SEQ ID NO: 355025 - DNA, 75 bp, Artificial Sequence
  Synthetic
ggaatccaccgcgagctggttagaagattaaacgcggtcttgcttccaaacattcacacactgtttgacatgtca

SEQ ID NO: 355026 - DNA, 75 bp, Artificial Sequence
  Synthetic
gcgatagctcgacaatttaaattttctcgggtgtgtaagcctaaagtctcattggaagagacagaagtgctattt

SEQ ID NO: 355027 - DNA, 75 bp, Artificial Sequence
  Synthetic
gctgaagacttcgacgccattatcgcagagcacttccagcctggggattgtgtcttggaaactgacattgcgtcg

SEQ ID NO: 355028 - DNA, 75 bp, Artificial Sequence
  Synthetic
gtcttcataggctatgacagaaaggttcgcacccacaacccttacaaattatcctccaccctaacaaatatctac

SEQ ID NO: 355029 - DNA, 75 bp, Artificial Sequence
  Synthetic
tttgataaaagcgaagacgacgccatggctctgaccgcgatgatgattttggaagatctaggcgtggatgcagag

SEQ ID NO: 355030 - DNA, 75 bp, Artificial Sequence
  Synthetic
agaaaatcccatcaggcttactgaagaaaatgtggtaaattacatcactaaattaaaaggaccaaaagctgcagc

SEQ ID NO: 355031 - DNA, 75 bp, Artificial Sequence
  Synthetic
actggctcacgattgcacgaagcagggtgcgccccttcttaccatgtggtaaggggcgacatagctaatgcagag

SEQ ID NO: 355032 - DNA, 75 bp, Artificial Sequence
  Synthetic
ctgttgacgctgattgaagcagcttttggcgaaatttcatctatacacttgcccaccaaaaccaaatttaaattt

SEQ ID NO: 355033 - DNA, 75 bp, Artificial Sequence
  Synthetic
gaatgcttcaagaaatatgcatgtaataatgaatattgggaaacgtttaaagaaaatcccatcaggcttactgaa

SEQ ID NO: 355034 - DNA, 75 bp, Artificial Sequence
  Synthetic
gaaggggtcatcgtcaatgcggctaacagtaaagggcaaccaggtggtggagtctgtggcgccctatacaaaaaa

SEQ ID NO: 355035 - DNA, 75 bp, Artificial Sequence
  Synthetic
ggagccatgatgaagtctgggatgttccttacactgtttgtgaacaccgtcattaacattgtcattgccagtagg

SEQ ID NO: 355036 - DNA, 75 bp, Artificial Sequence
  Synthetic
aatatgttgcaggacataccaatggataggtttgtaatggacttgaagagagatgtgaaagtgactccaggaaca

SEQ ID NO: 355037 - DNA, 75 bp, Artificial Sequence
  Synthetic
ttccctgaaaattttgatctgcagccaatcgaggtcggtaaatcccgacttgtaaaagggggggtaaagcacata

SEQ ID NO: 355038 - DNA, 75 bp, Artificial Sequence
  Synthetic
gtgttgagagaacggctaactggatcaccctgcgcagcatttatcggagacgacaacatcgtaaaaggagtcaaa

SEQ ID NO: 355039 - DNA, 75 bp, Artificial Sequence
  Synthetic
attcatgcagtgggacctaacttcagcaaagtgtcagagctggaaggggataaacagctggcagacgcgtatgag

SEQ ID NO: 355040 - DNA, 75 bp, Artificial Sequence
  Synthetic
tcggacaagttaatggcagacaggtgcgccacatggctgaatatggaagttaagattatagatgccgtagtggga

SEQ ID NO: 355041 - DNA, 75 bp, Artificial Sequence
  Synthetic
gcgccacatggctgaatatggaagttaagattatagatgccgtagtgggagagaaagcgccctatttttgtggag

SEQ ID NO: 355042 - DNA, 75 bp, Artificial Sequence
  Synthetic
tcggtcgcgaagatcctaaatgacaatcattatagatctgtggcgatcccgctactgtctacgggcatattcgcg

SEQ ID NO: 355043 - DNA, 75 bp, Artificial Sequence
  Synthetic
ggtagtaaggaccgactcatgcagtcactaaatcacttgctgacagctctggataccacagacgctgatgtggct

SEQ ID NO: 355044 - DNA, 75 bp, Artificial Sequence
  Synthetic
ctctgaccgcgctaatgattctggaagacctaggtgtggacgcagagttgttgacgctgatcgaagcggctttcg

SEQ ID NO: 355045 - DNA, 75 bp, Artificial Sequence
  Synthetic
gaaaacccctggcagcagacgatgaacatgatgatgataggaggagggcattgcatgaagagtcaacacgctgga

SEQ ID NO: 355046 - DNA, 75 bp, Artificial Sequence
  Synthetic
atctactgccgagacaaaaaatgggagacaacattgaaggaggttattgcgagaagggaggccgtcgaagagata

SEQ ID NO: 355047 - DNA, 75 bp, Artificial Sequence
  Synthetic
accgagtgggaattcttccagagttgtgtaaagcagtagaatcaaggtatgagaccgtaggaacttctgttatag

SEQ ID NO: 355048 - DNA, 75 bp, Artificial Sequence
  Synthetic
tgcatctccgaagatgcgtcccaggtagagccagatgcggagttggtcagagtgcatccgaagagctccctggca

SEQ ID NO: 355049 - DNA, 75 bp, Artificial Sequence
  Synthetic
gccatgatgaaatctgggatgttcctcacactgtttgtgaacacagttatcaatatcgtgatcgcaagcagagtg

SEQ ID NO: 355050 - DNA, 75 bp, Artificial Sequence
  Synthetic
gagaccgtaggaacttctgttatagttatggctatggcaaccctggctagcagtgttaaatcattcagctacctg

SEQ ID NO: 355051 - DNA, 75 bp, Artificial Sequence
  Synthetic
ggacgcaaaggtttcagcacgaccgacggcaaaaccttctcgtacctcgaagggacaaagttccaccaagcggca

SEQ ID NO: 355052 - DNA, 75 bp, Artificial Sequence
  Synthetic
agaggggcctctataactctctacggctaacctgaatggactacgacttagtctggtccgccaagatgttcccat

SEQ ID NO: 355053 - DNA, 75 bp, Artificial Sequence
  Synthetic
aaggacgtggcggaaataaacgcaatgtggccgaatgctgccgaagctaacgagcagatatgcttgtatatattg

SEQ ID NO: 355054 - DNA, 75 bp, Artificial Sequence
  Synthetic
tccaaccaatgtatccaatgcagccaatgccctaccgcaacccattcgcggctccgcgcaggccttggttccctc

SEQ ID NO: 355055 - DNA, 75 bp, Artificial Sequence
  Synthetic
ggtgagagcatgagcagcattaggtctaagtgccctgtggaggaatctgaagcgtccacacctccaaatacatta

SEQ ID NO: 355056 - DNA, 75 bp, Artificial Sequence
  Synthetic
gaaccgatccttttctggcgatgcaagtgcaagaattaactcgctccatggccaacctgacttttaagcaacgtc

SEQ ID NO: 355057 - DNA, 75 bp, Artificial Sequence
  Synthetic
ccctgcatgtgcattcattctatgacgcctgaacgcgtacacaggcttaaggcggcacgccccgaacaaattaca

SEQ ID NO: 355058 - DNA, 75 bp, Artificial Sequence
  Synthetic
ggggcgcaccgcctgaggggccccctgctaagaagtcgaagagggaggcgcctcaaaaacaacggggtggccaaa

SEQ ID NO: 355059 - DNA, 75 bp, Artificial Sequence
  Synthetic
tgatgatgacaggagaagggcgctacatgaagagtcaacacgctggaaccgagtggggattcttccggagctgtg

SEQ ID NO: 355060 - DNA, 75 bp, Artificial Sequence
  Synthetic
gtgtgctcatcattccctctgcccaagtacaggattacaggtgtacaaaagattcaatgcgctcaccccatcctc

SEQ ID NO: 355061 - DNA, 75 bp, Artificial Sequence
  Synthetic
ggaagaaaaagaagaatgaggggaagaagaaggctaagactgggccgcctaatctgaagacacaaaatggaaaca

SEQ ID NO: 355062 - DNA, 75 bp, Artificial Sequence
  Synthetic
ttcctcccgaaggtgcctgagtatatccatcctcgcagatacctcccaaatccggagagaagcgagactcaggag

SEQ ID NO: 355063 - DNA, 75 bp, Artificial Sequence
  Synthetic
aaaagaagaccaacaagaaaccaggcaaaagacaacgcatggtcatgaagttggaatctgacaagacattcccta

SEQ ID NO: 355064 - DNA, 75 bp, Artificial Sequence
  Synthetic
acgctgccggatgtccaggaatctatacccgagcctgtgacatcggttacagactctttaagcgtagtttcggag

SEQ ID NO: 355065 - DNA, 75 bp, Artificial Sequence
  Synthetic
ttatgctggaaggaaagatcaacggctacgcgtgtgtggtaggtgggaagttgtttaggccaatgcatgtggaag

SEQ ID NO: 355066 - DNA, 75 bp, Artificial Sequence
  Synthetic
agcaccgtggcttcgataacacccaatgaaatcgtggtggaggcagaggtacactcggatcttatgaggttttcc

SEQ ID NO: 355067 - DNA, 75 bp, Artificial Sequence
  Synthetic
gcaaaattgacaacgacgtcctggccgcgctcaagacgaagaaagcatctaaatatgatcttgagtacgcagacg

SEQ ID NO: 355068 - DNA, 75 bp, Artificial Sequence
  Synthetic
tctaattggtcaatcccgcaagcatctgactttgacatcgacagtgtatcggtacagggcacaatagacatattt

SEQ ID NO: 355069 - DNA, 75 bp, Artificial Sequence
  Synthetic
gatatcatggataatctcacaaaagttcgtgagtatctcaagtcctactctcgtctagatcaggcggtaggagag

SEQ ID NO: 355070 - DNA, 75 bp, Artificial Sequence
  Synthetic
tcgtctagatcaggcggtaggagagatagatgagatcgaagcacaacgagctgaaaagtccaattatgagttgtt

SEQ ID NO: 355071 - DNA, 75 bp, Artificial Sequence
  Synthetic
cgccatgttgtatttggacccttccattggaggtgtgtcaggcatgtctttgtcccgattcctgattagagcctt

SEQ ID NO: 355072 - DNA, 75 bp, Artificial Sequence
  Synthetic
cccagatcccgtgacagaaagtctttcattctggagattcatccatgtacatgctcggagtgagcatctgaagga

SEQ ID NO: 355073 - DNA, 75 bp, Artificial Sequence
  Synthetic
atgctcggagtgagcatctgaaggaaatgagcgcagtattcggaaacccagaaatagccaaatttcgaataactc

SEQ ID NO: 355074 - DNA, 75 bp, Artificial Sequence
  Synthetic
ttgtatgtaccagatccggaagctgagcaagttgaaggctttatacaggggcctttagatgactatgcagatgag

SEQ ID NO: 355075 - DNA, 75 bp, Artificial Sequence
  Synthetic
agcaagttgaaggctttatacaggggcctttagatgactatgcagatgaggacgtggatgttgtattcacttcgg

SEQ ID NO: 355076 - DNA, 75 bp, Artificial Sequence
  Synthetic
actggaaacagcctgagcttgaatccgacgagcatggaaagaccttacggttgacattgccagagggtttaagtg

SEQ ID NO: 355077 - DNA, 75 bp, Artificial Sequence
  Synthetic
gacgattaaagcagtcgttcaaagtgccaaacactggaatctggcagagtgcacatttgaagcatcgggagaagg

SEQ ID NO: 355078 - DNA, 75 bp, Artificial Sequence
  Synthetic
gccaaacactggaatctggcagagtgcacatttgaagcatcgggagaaggggtcatcataaaaaagcgccagata

SEQ ID NO: 355079 - DNA, 75 bp, Artificial Sequence
  Synthetic
actccggatgtatataaggtcactccagtgatgaacacacatccgtaccaatcagaagccgtatcagatgtttgg

SEQ ID NO: 355080 - DNA, 75 bp, Artificial Sequence
  Synthetic
atcagaagccgtatcagatgtttggtctctctcaaagacatccatgactttccaacccaagaaagcaagtcttca

SEQ ID NO: 355081 - DNA, 75 bp, Artificial Sequence
  Synthetic
tccaacccaagaaagcaagtcttcagcctctcaccatatccttggatgaattgttctcatctagaggagaattca

SEQ ID NO: 355082 - DNA, 75 bp, Artificial Sequence
  Synthetic
gtctcataaagaggccatcctgctcggtctgaggtacaaaaagttgtacaatcaggcgagagtcaaatattctct

SEQ ID NO: 355083 - DNA, 75 bp, Artificial Sequence
  Synthetic
tctttagttcacggggacccttgcctgcttatttagggtctaaaacatctgaatctacatccattttgcagcctt

SEQ ID NO: 355084 - DNA, 75 bp, Artificial Sequence
  Synthetic
tccagtggaatacccggcagattacttcagaaaatcaaaggagattcctctttacatcaatactacaaaaagttt

SEQ ID NO: 355085 - DNA, 75 bp, Artificial Sequence
  Synthetic
gtcagatctaagaggatatgtctaccaaggcctcaaatccggaaatgtatcaatcatacatgtcaacagctactt

SEQ ID NO: 355086 - DNA, 75 bp, Artificial Sequence
  Synthetic
caaggcctcaaatccggaaatgtatcaatcatacatgtcaacagctacttgtatggagcattaaaggacatccgg

SEQ ID NO: 355087 - DNA, 75 bp, Artificial Sequence
  Synthetic
ccgactctaaactagcaattacaatactctctaacatccactctctaacaggtgaggaatggaccaagaggcagc

SEQ ID NO: 355088 - DNA, 75 bp, Artificial Sequence
  Synthetic
gtttcggaataaacatcgggaaagcaggggatacaatcggaatatttgaccttgtatccttgaaagccctggacg

SEQ ID NO: 355089 - DNA, 75 bp, Artificial Sequence
  Synthetic
gcgtacttccagatggagtatcggatgcttccagaaccagcgcagatgacaaatggttgcctttgtatctacttg

SEQ ID NO: 355090 - DNA, 75 bp, Artificial Sequence
  Synthetic
gatggcaactacagacactatgagtgatctgggagatcagaatttcgactttttatttcaggcaacattgctcta

SEQ ID NO: 355091 - DNA, 75 bp, Artificial Sequence
  Synthetic
gatctgggagatcagaatttcgactttttatttcaggcaacattgctctatgctcaaattaccaccactgttgcg

SEQ ID NO: 355092 - DNA, 75 bp, Artificial Sequence
  Synthetic
gcttatacagagtgggcagaacacaaatgcctgaatacagaaaaaagctcatggatgggctgacaaatcaatgca

SEQ ID NO: 355093 - DNA, 75 bp, Artificial Sequence
  Synthetic
cgagacggatggaccaccagttgcacagatcattatcatattacctgtaagtcctgtttgagacccatagaagag

SEQ ID NO: 355094 - DNA, 75 bp, Artificial Sequence
  Synthetic
cagatcattatcatattacctgtaagtcctgtttgagacccatagaagagatcaccctggactcaaatatggact

SEQ ID NO: 355095 - DNA, 75 bp, Artificial Sequence
  Synthetic
aaatgatcaatgaacagtttgaacctcttgtgccagaaggtcgtgacatttttgatgtgtggggaaatgacagta

SEQ ID NO: 355096 - DNA, 75 bp, Artificial Sequence
  Synthetic
acacacccccagacgtctcccacgtgctgaagacatggaggaatggagaaggttcttggggacaagagataaaac

SEQ ID NO: 355097 - DNA, 75 bp, Artificial Sequence
  Synthetic
attacacaaaaattgtcgctgcagtggacatgttcttccacatgttcaaaaaacatgaatgtgcctcgttcagat

SEQ ID NO: 355098 - DNA, 75 bp, Artificial Sequence
  Synthetic
ggacatgttcttccacatgttcaaaaaacatgaatgtgcctcgttcagatacggaactattgtttccagattcaa

SEQ ID NO: 355099 - DNA, 75 bp, Artificial Sequence
  Synthetic
agattgtgctgcattggcaacatttggacacctctgcaaaataaccggaatgtctacagaagatgtaacgacctg

SEQ ID NO: 355100 - DNA, 75 bp, Artificial Sequence
  Synthetic
ggacacctctgcaaaataaccggaatgtctacagaagatgtaacgacctggatcttgaaccgagaagttgcagat

SEQ ID NO: 355101 - DNA, 75 bp, Artificial Sequence
  Synthetic
aaagtcgtattagaggtcgaggtttcttgaaagggttgctagacggactaatgagagccagttgctgccaagtga

SEQ ID NO: 355102 - DNA, 75 bp, Artificial Sequence
  Synthetic
cttctgggggcaattgacagctcttctgctcagatccaccagagcaaggaatgcccgacagcctgatgacattga

SEQ ID NO: 355103 - DNA, 75 bp, Artificial Sequence
  Synthetic
atgcccgacagcctgatgacattgagtatacatctcttactacagcaggtttgttgtacgcttatgcagtaggat

SEQ ID NO: 355104 - DNA, 75 bp, Artificial Sequence
  Synthetic
agagatgaactagaaactattcctcacaagatcccaacatcctatccgacgagcaaccgtgatatgggagtgatt

SEQ ID NO: 355105 - DNA, 75 bp, Artificial Sequence
  Synthetic
acaagatcccaacatcctatccgacgagcaaccgtgatatgggagtgattgtcagaaattacttcaaataccaat

SEQ ID NO: 355106 - DNA, 75 bp, Artificial Sequence
  Synthetic
ttgtgttggagataacaaatacactccagatgatagtaccggaggattgacgactaatgcaccgccacaaggcag

SEQ ID NO: 355107 - DNA, 75 bp, Artificial Sequence
  Synthetic
gccgtctaattgaaaagggaaaatacagatcacactattcccaattatggttattctcagatgtcctatctatag

SEQ ID NO: 355108 - DNA, 75 bp, Artificial Sequence
  Synthetic
ccagatgatagtaccggaggattgacgactaatgcaccgccacaaggcagagatgtggtcgaatggctcggatgg

SEQ ID NO: 355109 - DNA, 75 bp, Artificial Sequence
  Synthetic
acttccttggaccattctctatttccaccaccctcttacaaatcctatacaagccatctttatctgggaaagata

SEQ ID NO: 355110 - DNA, 75 bp, Artificial Sequence
  Synthetic
ctaagagagaagacaattggcaagtatgctaagtcagaatttgacaaatgaccctataattctcagatcacctat

SEQ ID NO: 355111 - DNA, 75 bp, Artificial Sequence
  Synthetic
atgctaagtcagaatttgacaaatgaccctataattctcagatcacctattatatattatgctacatatgaaaaa

SEQ ID NO: 355112 - DNA, 75 bp, Artificial Sequence
  Synthetic
accctataattctcagatcacctattatatattatgctacatatgaaaaaaactaacagatatcacaatctaagt

SEQ ID NO: 355113 - DNA, 75 bp, Artificial Sequence
  Synthetic
gttatcccaatccattcatcatgagttccttaaagaagattctcggtctgaaggggaaaggtaagaaatctaaga

SEQ ID NO: 355114 - DNA, 75 bp, Artificial Sequence
  Synthetic
tgcaagttcgggattgcaaaagataataataaagacatgagctatcccccctggggaagggagtctagagggaca

SEQ ID NO: 355115 - DNA, 75 bp, Artificial Sequence
  Synthetic
ttccttaaagaagattctcggtctgaaggggaaaggtaagaaatctaagaaattagggatcgcaccaccccctta

SEQ ID NO: 355116 - DNA, 75 bp, Artificial Sequence
  Synthetic
attacaacaatccctgtttattatacgactaccccttacccaaagatgctagaggtgcctccaagaatacaaaat

SEQ ID NO: 355117 - DNA, 75 bp, Artificial Sequence
  Synthetic
aatgtgcatagcagaggaatcttcaatagtctgttagaattgtcagggtcagtcatgcgaggcgcctctcctgag

SEQ ID NO: 355118 - DNA, 75 bp, Artificial Sequence
  Synthetic
atagtctgttagaattgtcagggtcagtcatgcgaggcgcctctcctgagccccccagtgctctagaaaccttag

SEQ ID NO: 355119 - DNA, 75 bp, Artificial Sequence
  Synthetic
gaggagacagatcaagatgtgtaaatggtgaaacatgttgggaacatccatctgacttatgtgacccaaggactt

SEQ ID NO: 355120 - DNA, 75 bp, Artificial Sequence
  Synthetic
tggtgaaacatgttgggaacatccatctgacttatgtgacccaaggacttgggactatttcctcagactcaaagc

SEQ ID NO: 355121 - DNA, 75 bp, Artificial Sequence
  Synthetic
ggatggggaagacccctcccatgctcaatgtaccagagcacttcagaagaccattcaatataggtctttacaagg

SEQ ID NO: 355122 - DNA, 75 bp, Artificial Sequence
  Synthetic
aggcttggggcttcaaattgatctaattgtcatggatatggaagttcgggattcctccactagcctgaaaattga

SEQ ID NO: 355123 - DNA, 75 bp, Artificial Sequence
  Synthetic
gtaacaatccttggtcccttgttcaagacggtcgacttagttcaaacagaatttagtagttctcaaacatctgaa

SEQ ID NO: 355124 - DNA, 75 bp, Artificial Sequence
  Synthetic
agcttctgaacaatccccggtttactcagtctctcctaattccagcctttcgaacaactaatatcctgtcttttc

SEQ ID NO: 355125 - DNA, 75 bp, Artificial Sequence
  Synthetic
tatccctatgaaaaaaactaacagagatcgatctgtttccttgacaccatgaagtgccttttgtacttagctttt

SEQ ID NO: 355126 - DNA, 75 bp, Artificial Sequence
  Synthetic
gatcgatctgtttccttgacaccatgaagtgccttttgtacttagcttttttattcatcggggtgaattgcaagt

SEQ ID NO: 355127 - DNA, 75 bp, Artificial Sequence
  Synthetic
tggaaaaacctgtacgcattccagtcatcagaaaaagaatttgccagagcaaagaaggttagtacatattttacc

SEQ ID NO: 355128 - DNA, 75 bp, Artificial Sequence
  Synthetic
tcaccatagtttttccacacaaccgaaaaggaaactggaaaaatgttccttccaattaccattattgcccgtcaa

SEQ ID NO: 355129 - DNA, 75 bp, Artificial Sequence
  Synthetic
gctcagatttaaattggcataatgacttaataggcacagccttacaagtcaaaatgcccaagagtcacaaggcta

SEQ ID NO: 355130 - DNA, 75 bp, Artificial Sequence
  Synthetic
ccttaaaatcttccgatagacctgcagatttattgaccattagccttttttatatggcaatcatatcatattata

SEQ ID NO: 355131 - DNA, 75 bp, Artificial Sequence
  Synthetic
cttaataggcacagccttacaagtcaaaatgcccaagagtcacaaggctattcaagcagacggttggatgtgtca

SEQ ID NO: 355132 - DNA, 75 bp, Artificial Sequence
  Synthetic
tgcttccaaatgggtcactacttgtgatttccgctggtacggaccgaagtatataacacattccatccgatcctt

SEQ ID NO: 355133 - DNA, 75 bp, Artificial Sequence
  Synthetic
ggaattgcacaaaatgtggggatcgctataactggtataagcttttggctgagtttgatggagaaagacattcca

SEQ ID NO: 355134 - DNA, 75 bp, Artificial Sequence
  Synthetic
atataacacattccatccgatccttcactccatctgtagaacaatgcaaggaaagcattgaacaaacgaaacaag

SEQ ID NO: 355135 - DNA, 75 bp, Artificial Sequence
  Synthetic
gaaagcattgaacaaacgaaacaaggaacttggctgaatccaggcttccctcctcaaagttgtggatatgcaact

SEQ ID NO: 355136 - DNA, 75 bp, Artificial Sequence
  Synthetic
ctataactggtataagcttttggctgagtttgatggagaaagacattccattgtatcaacagtgtttagcagtta

SEQ ID NO: 355137 - DNA, 75 bp, Artificial Sequence
  Synthetic
tccgacaatcgtttcctattagatgggaagctgtgtcagtgaaaggaggatacaagcagaagtggagtactagag

SEQ ID NO: 355138 - DNA, 75 bp, Artificial Sequence
  Synthetic
tccaggtgactcctcaccatgtgcttgttgatgaatacacaggagaatgggttgattcacagttcatcaacggaa

SEQ ID NO: 355139 - DNA, 75 bp, Artificial Sequence
  Synthetic
gtgatggactcccaaaagatacccgaatttcggactcattggccccgatcggaaactggattaggtctctggaat

SEQ ID NO: 355140 - DNA, 75 bp, Artificial Sequence
  Synthetic
gttgattcacagttcatcaacggaaaatgcagcaatgacatatgccccactgtccataactccacaacctggcat

SEQ ID NO: 355141 - DNA, 75 bp, Artificial Sequence
  Synthetic
cagctatgtcgtacagtggataatcatttgaaatggtcaaatttgcgaaaaaacacaggaataatcgaatggatc

SEQ ID NO: 355142 - DNA, 75 bp, Artificial Sequence
  Synthetic
aatagacgaatttcaaaagaagaccggtctatactgatattgaaaagcgacctacatgaagaaaactcatggaga

SEQ ID NO: 355143 - DNA, 75 bp, Artificial Sequence
  Synthetic
tgcaaaatgcagtactgcaagcattggggagtcagactcccatcaggtgtctggttcgagatggctgataaggat

SEQ ID NO: 355144 - DNA, 75 bp, Artificial Sequence
  Synthetic
aatgcccagaagggtcaagtatctctgctccatctcagacctcagtggatgtaagtctcattcaggacgttgaga

SEQ ID NO: 355145 - DNA, 75 bp, Artificial Sequence
  Synthetic
gtaagtctcattcaggacgttgagaggatcttggattattccctctgccaagaaacctggagcaaaatcagagcg

SEQ ID NO: 355146 - DNA, 75 bp, Artificial Sequence
  Synthetic
agaaacctggagcaaaatcagagcgggtcttcccatctctccagtggatctcagctatcttgctcctaaaaaccc

SEQ ID NO: 355147 - DNA, 75 bp, Artificial Sequence
  Synthetic
tgctgctccaatcctctcaagaatggtcggaatgatcagtggaactaccacagaaagggaactgtgggatgactg

SEQ ID NO: 355148 - DNA, 75 bp, Artificial Sequence
  Synthetic
cagaaagggaactgtgggatgactgggctccatatgaagacgtggaaattggacccaatggagttctgaggacca

SEQ ID NO: 355149 - DNA, 75 bp, Artificial Sequence
  Synthetic
ggacccaatggagttctgaggaccagttcaggatataagtttcctttatatatgattggacatggtatgttggac

SEQ ID NO: 355150 - DNA, 75 bp, Artificial Sequence
  Synthetic
ctacttgtatggagcattaaaggacatccggggtaagttggataaagattggtcaagtttcggaataaacatcgg

SEQ ID NO: 355151 - DNA, 75 bp, Artificial Sequence
  Synthetic
ctcaggtgtttgaacatcctcacattcaagacgctgcttcgcagcttcctgatgatgagactttattttttggtg

SEQ ID NO: 355152 - DNA, 75 bp, Artificial Sequence
  Synthetic
agcacaccaagaaaagacagatttatacagacatagagatgaaccgacttggaaagtaactcaaatcctgcacaa

SEQ ID NO: 355153 - DNA, 75 bp, Artificial Sequence
  Synthetic
atcatggaagtccacgattttgagaccgacgagttcaatgatttcaatgaagatgactatgccacaagagaattc

SEQ ID NO: 355154 - DNA, 75 bp, Artificial Sequence
  Synthetic
ccgacgagttcaatgatttcaatgaagatgactatgccacaagagaattcctgaatcccgatgagcgcatgacgt

SEQ ID NO: 355155 - DNA, 75 bp, Artificial Sequence
  Synthetic
acttgaatcatgctgattacaatttgaattctcctctaattagtgatgatattgacaatttgatcaggaaattca

SEQ ID NO: 355156 - DNA, 75 bp, Artificial Sequence
  Synthetic
gaattctcctctaattagtgatgatattgacaatttgatcaggaaattcaattctcttccgattccctcgatgtg

SEQ ID NO: 355157 - DNA, 75 bp, Artificial Sequence
  Synthetic
ggatagtaagaactgggatggagttcttgagatgttaacatcatgtcaagccaatcccatctcaacatctcagat

SEQ ID NO: 355158 - DNA, 75 bp, Artificial Sequence
  Synthetic
gctggggcaacaaaccaattgaatacatcaaaaaggaaagatggactgactcattcaaaattctcgcttatttgt

SEQ ID NO: 355159 - DNA, 75 bp, Artificial Sequence
  Synthetic
ggatccagaagctgagcaagttgaaggctttatacaggggcctttagatgactatgcagatgaggaagtggatgt

SEQ ID NO: 355160 - DNA, 75 bp, Artificial Sequence
  Synthetic
actatgcagatgaggaagtggatgttgtatttacttcggactggaaaccacctgagcttgaatctgacgagcatg

SEQ ID NO: 355161 - DNA, 75 bp, Artificial Sequence
  Synthetic
gtcaaaagtttttggacttacacaagttgacattaatcttaaatgctgtctctgaggtggaattgctcaacttgg

SEQ ID NO: 355162 - DNA, 75 bp, Artificial Sequence
  Synthetic
gtcctacttttatttcagaaggatgggcttacttcaagaaacttgatattctaatggaccgaaactttctgttaa

SEQ ID NO: 355163 - DNA, 75 bp, Artificial Sequence
  Synthetic
gaatctggcagagtgcacatttgaagcatcgggagaaggggtcattatgaaggagcgccagataactccggatgt

SEQ ID NO: 355164 - DNA, 75 bp, Artificial Sequence
  Synthetic
gcatcgggagaaggggtcattatgaaggagcgccagataactccggatgtatataaggtcactccagtgatgaac

SEQ ID NO: 355165 - DNA, 75 bp, Artificial Sequence
  Synthetic
tggtcaaagatgtgattatagggaggatgcaaacggtgctatccatggtatgtagaatagacaacctgttctcag

SEQ ID NO: 355166 - DNA, 75 bp, Artificial Sequence
  Synthetic
gatgcaaacggtgctatccatggtatgtagaatagacaacctgttctcagagcaagacatcttctcccttctaaa

SEQ ID NO: 355167 - DNA, 75 bp, Artificial Sequence
  Synthetic
gtggagaggcagggaaatttttcttatgacttgattaaaatggtggaaccgatatgcaacttgaagctgatgaaa

SEQ ID NO: 355168 - DNA, 75 bp, Artificial Sequence
  Synthetic
gatatgcaacttgaagctgatgaaattagcaagagaatcaaggcctttagtcccacaattccctcattttgaaaa

SEQ ID NO: 355169 - DNA, 75 bp, Artificial Sequence
  Synthetic
ggtgacggacgaatgtctcataaagaggccatcctgctcggcctgagatacaaaaagttgtacaatcaggcgaga

SEQ ID NO: 355170 - DNA, 75 bp, Artificial Sequence
  Synthetic
tcccacaattccctcattttgaaaatcatatcaagacttctgttgatgaaggggcaaaaattgaccgaggtataa

SEQ ID NO: 355171 - DNA, 75 bp, Artificial Sequence
  Synthetic
tgtgaaaacagtggatctcacactggtgatttatggatcgttcagacattggggtcatccttttatagattatta

SEQ ID NO: 355172 - DNA, 75 bp, Artificial Sequence
  Synthetic
ggcagccgctgtatcccattgggatcacatgtacatcggaatggcagggaaacgtcccttctacaaaatcttggc

SEQ ID NO: 355173 - DNA, 75 bp, Artificial Sequence
  Synthetic
aagtgatttagctcggattgttctatttcaacagttcaatgatcataaaaagtggttcgtgaatggagacttgct

SEQ ID NO: 355174 - DNA, 75 bp, Artificial Sequence
  Synthetic
cacatgtacatcggaatggcagggaaacgtcccttctacaaaatcttggcttttttgggttcttctaatctaaag

SEQ ID NO: 355175 - DNA, 75 bp, Artificial Sequence
  Synthetic
ccctcatgatcatccctttaaaagtcatgttaaagaaaatacatggcccacagctgctcaagttcaagattttgg

SEQ ID NO: 355176 - DNA, 75 bp, Artificial Sequence
  Synthetic
attaaatgttttgaaatacccgacttactagacccatcgataatatactctgacaaaagtcattcaatgaatagg

SEQ ID NO: 355177 - DNA, 75 bp, Artificial Sequence
  Synthetic
aagggaacgattgagctcacaatgaccatctacgatgatgagtcactggaagcagctcctatgatctgggatcat

SEQ ID NO: 355178 - DNA, 75 bp, Artificial Sequence
  Synthetic
tgaatccgaacactcctatccctagtaaaaaggtgttgcagactatgttggacacaaaggctaccaattggaaag

SEQ ID NO: 355179 - DNA, 75 bp, Artificial Sequence
  Synthetic
gacacaaaggctaccaattggaaagaatttcttaaagagattgatgagaagggcttagatgatgatgatctaatt

SEQ ID NO: 355180 - DNA, 75 bp, Artificial Sequence
  Synthetic
attggtcttaaaggaaaggagagggaactgaagttggcaggtagatttttctccctaatgtcttggaaattgcga

SEQ ID NO: 355181 - DNA, 75 bp, Artificial Sequence
  Synthetic
ctccctaatgtcttggaaattgcgagaatactttgtaattaccgaatatttgataaagactcatttcgtccctat

SEQ ID NO: 355182 - DNA, 75 bp, Artificial Sequence
  Synthetic
ctatgaagtgccttttgtacttagcctttttattcattggggtgaattgcaagttcaccatagtttttccacaca

SEQ ID NO: 355183 - DNA, 75 bp, Artificial Sequence
  Synthetic
gtttaaaggcctgacaatggcggacgatctaactgcagtcattaaaaagatgttagattcctcatccggccaagg

SEQ ID NO: 355184 - DNA, 75 bp, Artificial Sequence
  Synthetic
gatctaactgcagtcattaaaaagatgttagattcctcatccggccaaggattgaagtcatatgaggcaatttgc

SEQ ID NO: 355185 - DNA, 75 bp, Artificial Sequence
  Synthetic
aatggaataaccaccaaaggaagttatcaaacggcccagtgttccgagttatgggccagttcttaggttatccat

SEQ ID NO: 355186 - DNA, 75 bp, Artificial Sequence
  Synthetic
ccttaatcgagagaactcatgaattttttgagaaaagtcttatatactacaatggaagaccagacttgatgcgtg

SEQ ID NO: 355187 - DNA, 75 bp, Artificial Sequence
  Synthetic
ttttgagaaaagtcttatatactacaatggaagaccagacttgatgcgtgttcacaacaacacactgatcaattc

SEQ ID NO: 355188 - DNA, 75 bp, Artificial Sequence
  Synthetic
caatctactggttattcaaagagaggctaaaatcagaaacactgctgtcaaagtcttggcacaaggtgataatca

SEQ ID NO: 355189 - DNA, 75 bp, Artificial Sequence
  Synthetic
atgggttgattcacagttcatcaacggaaaatgcagcaattacatatgccccactgtccataactctacaacctg

SEQ ID NO: 355190 - DNA, 75 bp, Artificial Sequence
  Synthetic
ttctaataatgagaaaattatgactgcaatcaaaatagggacagggaagttaggacttttgataaatgacgatga

SEQ ID NO: 355191 - DNA, 75 bp, Artificial Sequence
  Synthetic
taggacttttgataaatgacgatgagactatgcaatctgcagattacttgaattatggaaaaataccgattttcc

SEQ ID NO: 355192 - DNA, 75 bp, Artificial Sequence
  Synthetic
gtggagtgattagagggttagagaccaagagatggtcacgagtgacttgtgtcaccaatgaccaaatacccactt

SEQ ID NO: 355193 - DNA, 75 bp, Artificial Sequence
  Synthetic
gtgctaatataatgagctcagtttccacaaatgctctcaccgtagctcattttgctgagaacccaatcaatgcca

SEQ ID NO: 355194 - DNA, 75 bp, Artificial Sequence
  Synthetic
tgatacagtacaattattttgggacatttgctagactcttgttgatgatgcatgatcctgctcttcgtcaatcat

SEQ ID NO: 355195 - DNA, 75 bp, Artificial Sequence
  Synthetic
cataatcaatggtaccctaaaatactttgagaccagatacatcagagtcgatattgctgctccaatcctctcaag

SEQ ID NO: 355196 - DNA, 75 bp, Artificial Sequence
  Synthetic
tctcattctggagattcatccatgtacatgctcgaagtgagcatctgaaggagatgagtgcagtatttggaaacc

SEQ ID NO: 355197 - DNA, 75 bp, Artificial Sequence
  Synthetic
tcctgatgatgagagtttattttttggtgatactgggctatccaaaaatccaatcgagcttgtagaaggttggtt

SEQ ID NO: 355198 - DNA, 75 bp, Artificial Sequence
  Synthetic
ggtgatactgggctatccaaaaatccaatcgagcttgtagaaggttggttcagtagttggaaaagctctattgcc

SEQ ID NO: 355199 - DNA, 75 bp, Artificial Sequence
  Synthetic
gactgaggttaaaaaatgcttaatcgaatcaagacaaaccatcaggaaccaggtgattaaggatgcaaccatata

SEQ ID NO: 355200 - DNA, 75 bp, Artificial Sequence
  Synthetic
tcttttttctttatcatagggttaatcattggactattcttggttctccgagttggtatccatctttgcattaaa

SEQ ID NO: 355201 - DNA, 75 bp, Artificial Sequence
  Synthetic
gtcgcagacgggctcatcagtctatttcaaaattctcgtactattcggaactcctttaagaaaaagtatcatagg

SEQ ID NO: 355202 - DNA, 75 bp, Artificial Sequence
  Synthetic
ctcctttaagaaaaagtatcatagggaattggatgatttgattgtgaggagtgaggtatcctctttgacacattt

SEQ ID NO: 355203 - DNA, 75 bp, Artificial Sequence
  Synthetic
aaatcaacttgtgataccatgctcaaagaggcctcaattatatttgagtttttaatttttatgaaaaaaactaac

SEQ ID NO: 355204 - DNA, 75 bp, Artificial Sequence
  Synthetic
tcatgtaaaatgtggacatgttcagctactcatgctgacacattaagatacaaatcctggggccgtacagttatt

SEQ ID NO: 355205 - DNA, 75 bp, Artificial Sequence
  Synthetic
caaatcctggggccgtacagttattgggacaactgtaccccatccattagaaatgttgggtccacaacatcgaaa

SEQ ID NO: 355206 - DNA, 75 bp, Artificial Sequence
  Synthetic
cgtctttagttcacggggaccattgcctgcttatctagggtctaaaacatctgaatctacatctattttgcagcc

SEQ ID NO: 355207 - DNA, 75 bp, Artificial Sequence
  Synthetic
ttgggaaagggaaagcaaagtcccactgattaaaagagctacacgtcttagagatgctatctcttggtttgttga

SEQ ID NO: 355208 - DNA, 75 bp, Artificial Sequence
  Synthetic
gcatgggttcaaaagaacagggtctgcccttcataggttttcgacatctcggatgagccatggtgggttcgcatc

SEQ ID NO: 355209 - DNA, 75 bp, Artificial Sequence
  Synthetic
tatgctcaaattaccaccactgttgcaagagacggatggatcaccagttgtacagatcattatcatattgcctgt

SEQ ID NO: 355210 - DNA, 75 bp, Artificial Sequence
  Synthetic
caagagacggatggatcaccagttgtacagatcattatcatattgcctgtaagtcctgtttgagacccatagaag

SEQ ID NO: 355211 - DNA, 75 bp, Artificial Sequence
  Synthetic
agatcaccctggactcaagtatggactacacgcccccagatgtatcccatgtgctgaagacatggaggaatgggg

SEQ ID NO: 355212 - DNA, 75 bp, Artificial Sequence
  Synthetic
acagatctatcctttagaagggaattggaagaatttagcacctgctgagcaatcctatcaagtcggcagatgtat

SEQ ID NO: 355213 - DNA, 75 bp, Artificial Sequence
  Synthetic
tggaagaatttagcacctgctgagcaatcctatcaagtcggcagatgtataggttttctatatggagacttggcg

SEQ ID NO: 355214 - DNA, 75 bp, Artificial Sequence
  Synthetic
aatcctatcaagtcggcagatgtataggttttctatatggagacttggcgtatagaaaatctactcatgccgagg

SEQ ID NO: 355215 - DNA, 75 bp, Artificial Sequence
  Synthetic
acagttctctatttcctctatctatacaaggtcgtattagaggtcgaggtttcttaaaagggttgctagacggat

SEQ ID NO: 355216 - DNA, 75 bp, Artificial Sequence
  Synthetic
ttgaagaggccggccaacgcagtgtacggaggtttgatttacttgattgataaattgagtgtatcacctccattc

SEQ ID NO: 355217 - DNA, 75 bp, Artificial Sequence
  Synthetic
acggaggtttgatttacttgattgataaattgagtgtatcacctccattcctttctcttactagatcaggaccta

SEQ ID NO: 355218 - DNA, 75 bp, Artificial Sequence
  Synthetic
ctttctcttactagatcaggacctattagagacgaattagaaacgattccccacaagatcccaacctcctatccg

SEQ ID NO: 355219 - DNA, 75 bp, Artificial Sequence
  Synthetic
acaagcaaccgtgatatgggggtgattgtcagaaattacttcaaataccaatgccgtctaattgaaaagggaaaa

SEQ ID NO: 355220 - DNA, 75 bp, Artificial Sequence
  Synthetic
ggttattctcagatgtcttatccatagacttcattggaccattctctatttccaccaccctcttgcaaatcctat

SEQ ID NO: 355221 - DNA, 75 bp, Artificial Sequence
  Synthetic
ttgtgtccagaggaaatcagacatgcttgcaagttcgggattgctaaggataataataaagacatgagctatccc

SEQ ID NO: 355222 - DNA, 75 bp, Artificial Sequence
  Synthetic
cttgcaagttcgggattgctaaggataataataaagacatgagctatcccccttggggaagggaatccagaggga

SEQ ID NO: 355223 - DNA, 75 bp, Artificial Sequence
  Synthetic
taataataaagacatgagctatcccccttggggaagggaatccagagggacaattacaacaatccctgtttatta

SEQ ID NO: 355224 - DNA, 75 bp, Artificial Sequence
  Synthetic
gggatgactgctgcattactacgagaaaatgtgcatagcagaggaatattcaatagtctgttagaattatcaggg

SEQ ID NO: 355225 - DNA, 75 bp, Artificial Sequence
  Synthetic
catctgacttatgtgacccaaggacttgggactatttcctccgactcaaagcaggcttggggcttcaaattgatt

SEQ ID NO: 355226 - DNA, 75 bp, Artificial Sequence
  Synthetic
gcaggcttggggcttcaaattgatttaattgtaatggatatggaagttcgggattcttctactagcctgaaaatt

SEQ ID NO: 355227 - DNA, 75 bp, Artificial Sequence
  Synthetic
accggattttggatgagcaaggagttttaatctacaagacttatggaacatatatttgtgagagcgaaaagaatg

SEQ ID NO: 355228 - DNA, 75 bp, Artificial Sequence
  Synthetic
caagacggtcgacttagttcaaacagaatttagtagttctcaaacgtctgaagtatatatggtatgtaaaggttt

SEQ ID NO: 355229 - DNA, 75 bp, Artificial Sequence
  Synthetic
gaatttagtagttctcaaacgtctgaagtatatatggtatgtaaaggtttgaagaaattaatcgatgaacccaat

SEQ ID NO: 355230 - DNA, 75 bp, Artificial Sequence
  Synthetic
cccgattggtcttccatcaatgaatcctggaaaaacctgtacgcattccagtcatcagaacaggaatttgccaga

SEQ ID NO: 355231 - DNA, 75 bp, Artificial Sequence
  Synthetic
gtcatcagaacaggaatttgccagagcaaagaaggttagtacatactttaccttgacaggtattccctcccaatt

SEQ ID NO: 355232 - DNA, 75 bp, Artificial Sequence
  Synthetic
taacatcaatcatatcagagtaggaccgatacctccgaaccccccatcagatggaattgcacaaaatgtggggat

SEQ ID NO: 355233 - DNA, 75 bp, Artificial Sequence
  Synthetic
cgctataactggtataagcttttggctgagtttgatggagaaagacattccactatatcaacagtgtttggcagt

SEQ ID NO: 355234 - DNA, 75 bp, Artificial Sequence
  Synthetic
gttacagtcaagagaatcattgacaacacagtcatagttccaaaacttcctgcaaatgaggatccagtggaatac

SEQ ID NO: 355235 - DNA, 75 bp, Artificial Sequence
  Synthetic
tgcaaatgaggatccagtggaatacccggcagattacttcagaaaatcaaaggagattcctctttacatcaatac

SEQ ID NO: 355236 - DNA, 75 bp, Artificial Sequence
  Synthetic
aggagattcctctttacatcaatactacaaaaagtttgtcagatctaagaggatatgtctaccaaggcctcaaat

SEQ ID NO: 355237 - DNA, 75 bp, Artificial Sequence
  Synthetic
agtctccatattcttccgtcaaaaaccctgccttccacttctgggggcaattgacagctcttctgctcagatcca

SEQ ID NO: 355238 - DNA, 75 bp, Artificial Sequence
  Synthetic
ccctgccttccacttctgggggcaattgacagctcttctgctcagatccaccagagcaaggaatgcccgacagcc

SEQ ID NO: 355239 - DNA, 75 bp, Artificial Sequence
  Synthetic
actacagcaggtttgttgtacgcttatgcagtaggatcctctgccgacttggcacaacagttttgtgttggagat

SEQ ID NO: 355240 - DNA, 75 bp, Artificial Sequence
  Synthetic
gccacaaggcagagatgtggtcgaatggctcggatggtttgaagatcaaaacagaaaaccgactcctgatatgat

SEQ ID NO: 355241 - DNA, 75 bp, Artificial Sequence
  Synthetic
tggctcggatggtttgaagatcaaaacagaaaaccgactcctgatatgatgcagtatgcgaaaagagcagtcatg

SEQ ID NO: 355242 - DNA, 75 bp, Artificial Sequence
  Synthetic
cagatcacctattatatattatgctacatatgaaaaaaactaacagatatcatggataatctcacaaaagttcgt

SEQ ID NO: 355243 - DNA, 75 bp, Artificial Sequence
  Synthetic
gccctcttattttcaggcagcagatgattctgacacagaatctgaaccagaaattgaagacaatcaaggcttgta

SEQ ID NO: 355244 - DNA, 75 bp, Artificial Sequence
  Synthetic
aaacagcctgagcttgaatccgacgagcatggaaagaccttacggttgacattgccagagggtttaagtggagag

SEQ ID NO: 355245 - DNA, 75 bp, Artificial Sequence
  Synthetic
attatacgaccaccccttacccaaagatgctagagatgcctccaagaatccaaaatcccctgctgtccggaatca

SEQ ID NO: 355246 - DNA, 75 bp, Artificial Sequence
  Synthetic
cacccccttatgaagaggacactagcatggtgtatgctccgagcgctccaattgacaaatcctattttggagttg

SEQ ID NO: 355247 - DNA, 75 bp, Artificial Sequence
  Synthetic
ctaaaggccactccagcggtattggcagatcaaggtcaaccagagtatcacgctcactgcgaaggcagggcttat

SEQ ID NO: 355248 - DNA, 75 bp, Artificial Sequence
  Synthetic
cagatcaaggtcaaccagagtatcacgctcactgcgaaggcagggcttatttgccacataggatggggaagaccc

SEQ ID NO: 355249 - DNA, 75 bp, Artificial Sequence
  Synthetic
caatgaccatctacgatgatgagtcactggaagcggctcctatgatctgggatcatttcaattcttccaaatttt

SEQ ID NO: 355250 - DNA, 75 bp, Artificial Sequence
  Synthetic
gtttggcctgattgtcgagaaaaaggcatctggagcgtgggtcctggattctatcagccacttcaaatgagctag

SEQ ID NO: 355251 - DNA, 75 bp, Artificial Sequence
  Synthetic
tggaattggtccgaaaccaagttcgtctaaatccattcaatgagatcttgttcaatcagctatgtcgtacagtgg

SEQ ID NO: 355252 - DNA, 75 bp, Artificial Sequence
  Synthetic
tctaaatccattcaatgagatcttgttcaatcagctatgtcgtacagtggataatcatttgaaatggtcaaattt

SEQ ID NO: 355253 - DNA, 75 bp, Artificial Sequence
  Synthetic
ttcaatcagctatgtcgtacagtggataatcatttgaaatggtcaaatttgcgaagaaacacaggaatgattgaa

SEQ ID NO: 355254 - DNA, 75 bp, Artificial Sequence
  Synthetic
gactccaaactttaagtatgaaaaaaactttgatccttaagaccctcttgtggtttttattttttatctggtttt

SEQ ID NO: 355255 - DNA, 75 bp, Artificial Sequence
  Synthetic
ttaagtatgaaaaaaactttgatccttaagaccctcttgtggtttttattttttatctggttttgtggtcttcgt

SEQ ID NO: 355256 - DNA, 75 bp, Artificial Sequence
  Synthetic
acgaaacaaggaacttggctgaatccaggcttccctcctcaaagttgtggatatgcaactgtgacggatgctgaa

SEQ ID NO: 355257 - DNA, 75 bp, Artificial Sequence
  Synthetic
aaagggctatgtgattctaacctcatttccatggacatcaccttcttctcagaggacggagagctatcatcccta

SEQ ID NO: 355258 - DNA, 75 bp, Artificial Sequence
  Synthetic
agaggacggagagctatcatccctaggaaaggagggcacagggttcagaagtaactactttgcttatgaaactgg

SEQ ID NO: 355259 - DNA, 75 bp, Artificial Sequence
  Synthetic
tgcaagcattggggagtcagactcccatcaggtgtctggttcgagatggctgataaggatctctttgctgcagcc

SEQ ID NO: 355260 - DNA, 75 bp, Artificial Sequence
  Synthetic
gaaaaaaactaacagatatcatggataatctcacaaaagttcgtgagtatctcaagtcctattctcgtctagatc

SEQ ID NO: 355261 - DNA, 75 bp, Artificial Sequence
  Synthetic
gacagatttatacagacatagagatgaaccgacttggaaagtaactcaaatcctgcacaacagattcttcatgtt

SEQ ID NO: 355262 - DNA, 75 bp, Artificial Sequence
  Synthetic
tcctgcacaacagattcttcatgtttgaaccaaatcaacttgtgatatcatgctcaaagaggccttaattatatt

SEQ ID NO: 355263 - DNA, 75 bp, Artificial Sequence
  Synthetic
tgaaccaaatcaacttgtgatatcatgctcaaagaggccttaattatattttaatttttaatttttatgaaaaaa

SEQ ID NO: 355264 - DNA, 75 bp, Artificial Sequence
  Synthetic
aaaaaagtaacagatatcacaatctaagtgttatcccaatccattcatcatgagttccttaaagaagattctcgg

SEQ ID NO: 355265 - DNA, 75 bp, Artificial Sequence
  Synthetic
gccactccagcggtattggcagatcaaggtcaaccagagtatcatgctcactgtgaaggcagggcttatttgcca

SEQ ID NO: 355266 - DNA, 75 bp, Artificial Sequence
  Synthetic
catctcagatgcataaatggatgggaagttggttaatgtctgataatcatgatgccagtcaagggtatagttttt

SEQ ID NO: 355267 - DNA, 75 bp, Artificial Sequence
  Synthetic
tacatgaagtggacaaagaggcagaaataacatttgacgtggtggagaccttcatccgcggctggggcaacaaac

SEQ ID NO: 355268 - DNA, 75 bp, Artificial Sequence
  Synthetic
atggactgactcattcaaaattctcgcttatttgtgtcaaaagtttttggacttacacaagttgacattaatctt

SEQ ID NO: 355269 - DNA, 75 bp, Artificial Sequence
  Synthetic
ctcaacttggcgaggactttcaaaggcaaagtcagaagaagttctcatggaacgaacatatgcaggattagggtt

SEQ ID NO: 355270 - DNA, 75 bp, Artificial Sequence
  Synthetic
cccagcttgggtcctacttttatttcagaaggatgggcttacttcaagaaacttgatattctaatggaccgaaac

SEQ ID NO: 355271 - DNA, 75 bp, Artificial Sequence
  Synthetic
cccttctaaatatctacagaattggagataaaattgtggagaggcagggaaatttttcttatgacttgattaaaa

SEQ ID NO: 355272 - DNA, 75 bp, Artificial Sequence
  Synthetic
ggatgtaagtctcattcaggacgttgagaggatcttggattattccctctgccaagaaacctggagcaaaatcag

SEQ ID NO: 355273 - DNA, 75 bp, Artificial Sequence
  Synthetic
ctttaaaagtcatgttaaagaaaatacatggcccacagctgctcaagttcaagattttggagataaatggcatga

SEQ ID NO: 355274 - DNA, 75 bp, Artificial Sequence
  Synthetic
atacccgacttactagacccatcgataatatactctgacaaaagtcattcaatgaataggtcagaggtgttgaaa

SEQ ID NO: 355275 - DNA, 75 bp, Artificial Sequence
  Synthetic
attaaaaagatgttagattcctcatccggccaaggattgaagtcatatgaggcaatttgcatagccaatcacatt

SEQ ID NO: 355276 - DNA, 75 bp, Artificial Sequence
  Synthetic
tgatcaattcaacctcccaacgagtttgttggcaaggacaagagggtggactggaaggtctacggcaaaaaggat

SEQ ID NO: 355277 - DNA, 75 bp, Artificial Sequence
  Synthetic
gttgtagaattacagggtgctctcaatcaaatggtttctaataatgagaaaattatgactgcaatcaaaataggg

SEQ ID NO: 355278 - DNA, 75 bp, Artificial Sequence
  Synthetic
ggttagagaccaagagatggtcacgagtgacttgtgtcaccaatgaccaaatacccacttgtgctaatataatga

SEQ ID NO: 355279 - DNA, 75 bp, Artificial Sequence
  Synthetic
ataagataccgggcttgcacagttctactttcaaatacgccatgttgtatttggacccttccattggaggagtgt

SEQ ID NO: 355280 - DNA, 75 bp, Artificial Sequence
  Synthetic
catgatcctgctcttcgtcaatcattgtatgaagttcaagacaagataccgggcttgcacagttctactttcaaa

SEQ ID NO: 355281 - DNA, 75 bp, Artificial Sequence
  Synthetic
tttggaaaccccgagatagccaagtttcgaataactcacatagacaagctagtagaagatccaacctctctgaac

SEQ ID NO: 355282 - DNA, 75 bp, Artificial Sequence
  Synthetic
ttcgaataactcacatagacaagctagtagaagatccaacctctctgaacatcgctatgggaatgagtccagcga

SEQ ID NO: 355283 - DNA, 75 bp, Artificial Sequence
  Synthetic
aacagtaatcaaaatgtctgttacagtcaagagaatcattgacaacacagtcatagttccgaaacttcccgcaaa

SEQ ID NO: 355284 - DNA, 75 bp, Artificial Sequence
  Synthetic
caaccatatatttgtatcatgaagaggatcggctcagaagtttcttatggtcaataaatcctctgttccctagat

SEQ ID NO: 355285 - DNA, 75 bp, Artificial Sequence
  Synthetic
tcaataaatcctctgttccctagatttttaagtgaattcaaatcaggcacttttttgggagtcgcagacgggctc

SEQ ID NO: 355286 - DNA, 75 bp, Artificial Sequence
  Synthetic
atgtatcaatcatacatgtcaacagctatttgtatggagcattaaaagacatccgaggcaagttggataaagatt

SEQ ID NO: 355287 - DNA, 75 bp, Artificial Sequence
  Synthetic
ttttttgggagtcgcagacgggctcatcagtctatttcaaaattctcgtactattcggaactcctttaagaaaaa

SEQ ID NO: 355288 - DNA, 75 bp, Artificial Sequence
  Synthetic
attgtgaggagtgaggtatcctctttgacacatttagggaaacttcatttgagaaggggatcatgtaaaatgtgg

SEQ ID NO: 355289 - DNA, 75 bp, Artificial Sequence
  Synthetic
tggacggcgtacttccagatggagtatcagatgcttccagaaccagcgcagatgacaaatggctacctttgtatc

SEQ ID NO: 355290 - DNA, 75 bp, Artificial Sequence
  Synthetic
acatgttcagctactcatgctgacacattaagatacaaatcctggggccgtacagttattgggacaactgtaccc

SEQ ID NO: 355291 - DNA, 75 bp, Artificial Sequence
  Synthetic
aatgcaaaatgatcaatgaacagtttgaacctcttgtaccagaaggtcgtgacatttttgatgtatggggaaatg

SEQ ID NO: 355292 - DNA, 75 bp, Artificial Sequence
  Synthetic
accatgtaacacatcagggttcaattatgtttctgtgcattgtccagacgggatccatgacgtctttagttcacg

SEQ ID NO: 355293 - DNA, 75 bp, Artificial Sequence
  Synthetic
acattcggacacctctgcaaaataaccggaatgtctacagaagatgtgacgacctggatcctgaaccgagaagta

SEQ ID NO: 355294 - DNA, 75 bp, Artificial Sequence
  Synthetic
agcaatgactatactttctaacatccactctttaacaggcgaagaatggaccaaaaggcagcatgggttcaaaag

SEQ ID NO: 355295 - DNA, 75 bp, Artificial Sequence
  Synthetic
ttccaggccaagaaattgacaaggccgattcatacatgccttatttaatcgactttggattgtcttccaagtctc

SEQ ID NO: 355296 - DNA, 75 bp, Artificial Sequence
  Synthetic
aacagggtctgcccttcataggttttcgacatctcggatgagccatggtgggttcgcatctcagagcactgcagc

SEQ ID NO: 355297 - DNA, 75 bp, Artificial Sequence
  Synthetic
attgaccaggttgatggcaactacagacaccatgagggatctgggagatcagaatttcgactttttattccaagc

SEQ ID NO: 355298 - DNA, 75 bp, Artificial Sequence
  Synthetic
aagagataaaacagatctatcctttagaagggaattggaagaatttagcacctgctgagcaatcctatcaagtcg

SEQ ID NO: 355299 - DNA, 75 bp, Artificial Sequence
  Synthetic
tgcgaaaagagcagtcatgtcattgcaaggcctgagagagaagacaatcggcaagtatgctaagtcagaatttga

SEQ ID NO: 355300 - DNA, 75 bp, Artificial Sequence
  Synthetic
agaagggaattggaagaatttagcacctgctgagcaatcctatcaagtcggcagatgtataggttttctatatgg

SEQ ID NO: 355301 - DNA, 75 bp, Artificial Sequence
  Synthetic
aggcagtaggagagatagatgagattgaagcacaacgggaggaaaagtccaattatgaattgttccaagaggacg

SEQ ID NO: 355302 - DNA, 75 bp, Artificial Sequence
  Synthetic
tctggctcatttgaagaggccggccaacgcagtgtacggaggtttgatttacttgattgataaattgagtgtatc

SEQ ID NO: 355303 - DNA, 75 bp, Artificial Sequence
  Synthetic
tgaagcacaacgggaggaaaagtccaattatgaattgttccaagaggacggatcggaagagcatactaagccctc

SEQ ID NO: 355304 - DNA, 75 bp, Artificial Sequence
  Synthetic
ttattttcaggcagcagatgattctgatacagaatctgaaccagaaattgaagacaatcaaggcttgtttgtacc

SEQ ID NO: 355305 - DNA, 75 bp, Artificial Sequence
  Synthetic
gatacagaatctgaaccagaaattgaagacaatcaaggcttgtttgtaccagacctggaagctgagccggttgaa

SEQ ID NO: 355306 - DNA, 75 bp, Artificial Sequence
  Synthetic
ggctttatacaggagcctttagatgattatgcagatgaggaagtggatattgtattcacttcggactggaaacag

SEQ ID NO: 355307 - DNA, 75 bp, Artificial Sequence
  Synthetic
tcaaataccaatgccgtctaattgaaaagggaaaatacagatcacattattcacaattatggttattctcagatg

SEQ ID NO: 355308 - DNA, 75 bp, Artificial Sequence
  Synthetic
attatgcagatgaggaagtggatattgtattcacttcggactggaaacagcctgagcttgaatctaatgagcatg

SEQ ID NO: 355309 - DNA, 75 bp, Artificial Sequence
  Synthetic
gaaagatcttacggttggctttgccagagggtttgagtggagagcagaaatcccagtggcttttaacgattaaag

SEQ ID NO: 355310 - DNA, 75 bp, Artificial Sequence
  Synthetic
agagggtttgagtggagagcagaaatcccagtggcttttaacgattaaagcagtcgtccaaagtgccaaatactg

SEQ ID NO: 355311 - DNA, 75 bp, Artificial Sequence
  Synthetic
caaatcctatacaagccatttttatctgggaaagataagaatgagttgagagagctggcaaatctttcttcattg

SEQ ID NO: 355312 - DNA, 75 bp, Artificial Sequence
  Synthetic
agagctggcaaatctttcttcattgctaagatcaggagaggggtgggaagacatacatgtgaaattcttcaccaa

SEQ ID NO: 355313 - DNA, 75 bp, Artificial Sequence
  Synthetic
gaatctagccgagtgcacattcgaagcatctggagaaggagtcattatgaaggagcgccagatgactccggatgt

SEQ ID NO: 355314 - DNA, 75 bp, Artificial Sequence
  Synthetic
gcatctggagaaggagtcattatgaaggagcgccagatgactccggatgtatataaggtcactccagtgatgaac

SEQ ID NO: 355315 - DNA, 75 bp, Artificial Sequence
  Synthetic
acacatccatctcaatcagaagccgtattagacatttggtctctctcaaagacatccatgacattccagcccaag

SEQ ID NO: 355316 - DNA, 75 bp, Artificial Sequence
  Synthetic
tattagacatttggtctctctcaaagacatccatgacattccagcccaagaaagcaagtcttcagcctctcacca

SEQ ID NO: 355317 - DNA, 75 bp, Artificial Sequence
  Synthetic
tatctttggaggaattgttctcatctagaggagagttcatctctgtcggaggcaatggacgaatgtctcacaaag

SEQ ID NO: 355318 - DNA, 75 bp, Artificial Sequence
  Synthetic
tagaggagagttcatctctgtcggaggcaatggacgaatgtctcacaaagatgccatcttgctcggtctgaggta

SEQ ID NO: 355319 - DNA, 75 bp, Artificial Sequence
  Synthetic
tggcgctcattataaaattcggagtatattacatggaatgggaatccattacagggacttcttgagttgtggaga

SEQ ID NO: 355320 - DNA, 75 bp, Artificial Sequence
  Synthetic
caaaaagttgtacaatcaggcaagagtcaaatattttctgtagactatgaaaaaaagtaacagatatcacaatct

SEQ ID NO: 355321 - DNA, 75 bp, Artificial Sequence
  Synthetic
gtcaaatattttctgtagactatgaaaaaaagtaacagatatcacaatctaagtgtgatccgaatccattcatca

SEQ ID NO: 355322 - DNA, 75 bp, Artificial Sequence
  Synthetic
tgagttccttaaagaagattctcggtctgaagggaaaaggtaagaagtctaagaaattagggatcgcaccacctc

SEQ ID NO: 355323 - DNA, 75 bp, Artificial Sequence
  Synthetic
tctgaagggaaaaggtaagaagtctaagaaattagggatcgcaccacctccttatgaagaggacactagcatgga

SEQ ID NO: 355324 - DNA, 75 bp, Artificial Sequence
  Synthetic
gcctctcctgagccccccagtgccctagaaactttaggaggagataaatcgagatgtgtaaatggtgaaacatgt

SEQ ID NO: 355325 - DNA, 75 bp, Artificial Sequence
  Synthetic
gtatgctccgagcgctcccattgacaaatcatattttggagttgacgaaatggacacccatgatccgaatcaatt

SEQ ID NO: 355326 - DNA, 75 bp, Artificial Sequence
  Synthetic
aaatcatattttggagttgacgaaatggacacccatgatccgaatcaattaagatatgagaaattcttcttcaca

SEQ ID NO: 355327 - DNA, 75 bp, Artificial Sequence
  Synthetic
gtgaaaatgacggttagatctaatcgtccattcagaacatactcagatgtggcagccgctgtatctcattgggat

SEQ ID NO: 355328 - DNA, 75 bp, Artificial Sequence
  Synthetic
gtccattcagaacatactcagatgtggcagccgctgtatctcattgggatcatatgtacatcggaatggcaggga

SEQ ID NO: 355329 - DNA, 75 bp, Artificial Sequence
  Synthetic
aattatgtgcaccggattttggatgagcaaggagttttaatctacaagacttatggaacatatatttgtgagagc

SEQ ID NO: 355330 - DNA, 75 bp, Artificial Sequence
  Synthetic
aacgtcccttctataagatcttggcttttttgggttcttctaatctgaaggccactccggcggtattggcagatc

SEQ ID NO: 355331 - DNA, 75 bp, Artificial Sequence
  Synthetic
ttttttgggttcttctaatctgaaggccactccggcggtattggcagatcgaggtcaacccgagtatcacgctca

SEQ ID NO: 355332 - DNA, 75 bp, Artificial Sequence
  Synthetic
ttgtgaaggcagggcttatttgccacataggatggggaagactcctcccatgctcaatgtaccagaacacttcag

SEQ ID NO: 355333 - DNA, 75 bp, Artificial Sequence
  Synthetic
cataggatggggaagactcctcccatgctcaatgtaccagaacacttcagaagaccgttcaatataggtctttac

SEQ ID NO: 355334 - DNA, 75 bp, Artificial Sequence
  Synthetic
aagggaaccgtcgagctcacaatgaccatctatgatgatgaatcactagaagcggcccctatgatctgggatcat

SEQ ID NO: 355335 - DNA, 75 bp, Artificial Sequence
  Synthetic
ccatctatgatgatgaatcactagaagcggcccctatgatctgggatcatttcaattcttccaaattttctgatt

SEQ ID NO: 355336 - DNA, 75 bp, Artificial Sequence
  Synthetic
tcagagagaaggccttaatgtttggcctaattgttgagaaaaaggcatctggagcttgggtcctagactctgtca

SEQ ID NO: 355337 - DNA, 75 bp, Artificial Sequence
  Synthetic
cctaattgttgagaaaaaggcatctggagcttgggtcctagactctgtcagccacttcaaataagctagtctagc

SEQ ID NO: 355338 - DNA, 75 bp, Artificial Sequence
  Synthetic
ctcatgcggctgccttaaaatcatctgatagacctgcagatttattgaccattagccttttttatatggcgatta

SEQ ID NO: 355339 - DNA, 75 bp, Artificial Sequence
  Synthetic
ttctagctcctgaacaatccccggtttacccaatctctcctaattccaacatttcgaacaactaatatcctgtct

SEQ ID NO: 355340 - DNA, 75 bp, Artificial Sequence
  Synthetic
ttacccaatctctcctaattccaacatttcgaacaactaatatcctgtcttttctatctctatgaaaaaaaccaa

SEQ ID NO: 355341 - DNA, 75 bp, Artificial Sequence
  Synthetic
cagagatcaatctgtttccttgacactatgaagtgccttttgtacttagctttgttattcattggggtgtattgc

SEQ ID NO: 355342 - DNA, 75 bp, Artificial Sequence
  Synthetic
aagttcaccacagttttccctcacaacaaaaaaggagactggaaaaatgttccttccaattaccattattgccca

SEQ ID NO: 355343 - DNA, 75 bp, Artificial Sequence
  Synthetic
ggagtactagaggtgatgggctcccaaaagatacccgaatttcagactccttggccccaatcgggaactggatca

SEQ ID NO: 355344 - DNA, 75 bp, Artificial Sequence
  Synthetic
gtcatgcttcaaagtgggtcactacttgtgatttccgctggtatggaccgaaatatataacacattccatcagat

SEQ ID NO: 355345 - DNA, 75 bp, Artificial Sequence
  Synthetic
atcttgttcaatcagctatgtcgtacagtggataatcatttgaagtggtcaaatttgcgaaaaaacacaggaatg

SEQ ID NO: 355346 - DNA, 75 bp, Artificial Sequence
  Synthetic
ccttcactccatctgtagaacaatgcaaggaaagcattgaacagacaaagcaaggaacctggctgaatccaggct

SEQ ID NO: 355347 - DNA, 75 bp, Artificial Sequence
  Synthetic
caaggaaagcattgaacagacaaagcaaggaacctggctgaatccaggcttccctccccaaagttgcggatacgc

SEQ ID NO: 355348 - DNA, 75 bp, Artificial Sequence
  Synthetic
caaaagaagaccggtctatactgatgttgaagagtgacctacatgaggaaaactcttggagagattaaaaaatca

SEQ ID NO: 355349 - DNA, 75 bp, Artificial Sequence
  Synthetic
gttgaagagtgacctacatgaggaaaactcttggagagattaaaaaatcaggaggagactccaaactttaagtat

SEQ ID NO: 355350 - DNA, 75 bp, Artificial Sequence
  Synthetic
acgaagacaaacaaaccattattaccattaaaaggctcaggagaaactttaacagtaatcaaaatgtctgttaca

SEQ ID NO: 355351 - DNA, 75 bp, Artificial Sequence
  Synthetic
cattaaaaggctcaggagaaactttaacagtaatcaaaatgtctgttacagtcaagagaatcattgacaacacag

SEQ ID NO: 355352 - DNA, 75 bp, Artificial Sequence
  Synthetic
aacagtaatcaaaatgtctgttacagtcaagagaatcattgacaacacagtcatagttccaaaacttcctgcaaa

SEQ ID NO: 355353 - DNA, 75 bp, Artificial Sequence
  Synthetic
ccactgttcataactccacaacctggcattctgactataaggttaaaggactatgtgattctaacctcatttcca

SEQ ID NO: 355354 - DNA, 75 bp, Artificial Sequence
  Synthetic
ctatgtgattctaacctcatttccatggacatcaccttcttctcagaagatggagagctatcatccctaggaaag

SEQ ID NO: 355355 - DNA, 75 bp, Artificial Sequence
  Synthetic
gtgtctggttcgagatggctgataagaatctctttgctgcagccaaattccctgaatgcccagaaggttcaagta

SEQ ID NO: 355356 - DNA, 75 bp, Artificial Sequence
  Synthetic
tctctgctccttctcagacctcagtggatgtgagcctcattcaggatgttgagaggatcttggattattccctct

SEQ ID NO: 355357 - DNA, 75 bp, Artificial Sequence
  Synthetic
ggtcaagtttcggaataaacatcgggaaggcaggagatacaatcggaatatttgaccttgtatccctgaaagccc

SEQ ID NO: 355358 - DNA, 75 bp, Artificial Sequence
  Synthetic
gagaggatcttggattattccctctgccaagaaacctggagcaaaatcagagcgggtcttcctatatctccagtg

SEQ ID NO: 355359 - DNA, 75 bp, Artificial Sequence
  Synthetic
atattgctgctccaatcctctcaagaatggtcggaatgattagtggaactaccactgaaagggaactatgggagg

SEQ ID NO: 355360 - DNA, 75 bp, Artificial Sequence
  Synthetic
aatggtcggaatgattagtggaactaccactgaaagggaactatgggaggactgggcaccatatgaagacgtgga

SEQ ID NO: 355361 - DNA, 75 bp, Artificial Sequence
  Synthetic
tcctgatgatgagactttattttttggtgatacagggctatccaaagatccaatcgagcttgtagaaggttggtt

SEQ ID NO: 355362 - DNA, 75 bp, Artificial Sequence
  Synthetic
ggtgatacagggctatccaaagatccaatcgagcttgtagaaggttggttcagtggttggaagagttctattgct

SEQ ID NO: 355363 - DNA, 75 bp, Artificial Sequence
  Synthetic
tcctttttctttatcatagggttaatcattggattattctttgttctccgaattggtgtttacctttgcattaaa

SEQ ID NO: 355364 - DNA, 75 bp, Artificial Sequence
  Synthetic
aaatccacttgtgatgcaaagctcaaagaggccttaatcatattttaattttttaatttttaatttttaattttt

SEQ ID NO: 355365 - DNA, 75 bp, Artificial Sequence
  Synthetic
aagaggccttaatcatattttaattttttaatttttaatttttaatttttaatttttaatttttaatttttaatt

SEQ ID NO: 355366 - DNA, 75 bp, Artificial Sequence
  Synthetic
ttatttttatttttttatttttatttttaattattttttattttttattttttattttcatttttatttttattt

SEQ ID NO: 355367 - DNA, 75 bp, Artificial Sequence
  Synthetic
tttaattattttttattttttattttttattttcatttttatttttattttttgtctttttattttttattttta

SEQ ID NO: 355368 - DNA, 75 bp, Artificial Sequence
  Synthetic
tttttatttttatttttatttttatttttattcttatgaaaaaaattaacagcaatcatggagatccatgatttt

SEQ ID NO: 355369 - DNA, 75 bp, Artificial Sequence
  Synthetic
ggatggtttgaagatcaaaacagaaaaccgactcctgatatgatgcagtatgcaaaacgagcagtcatgtcattg

SEQ ID NO: 355370 - DNA, 75 bp, Artificial Sequence
  Synthetic
ttttattcttatgaaaaaaattaacagcaatcatggagatccatgattttgaggccgacgaattcattgatttca

SEQ ID NO: 355371 - DNA, 75 bp, Artificial Sequence
  Synthetic
atgaagatgactatgccacaagagaattcttgaatcctgatgaacgcatgacatatttgaatcatgctgattaca

SEQ ID NO: 355372 - DNA, 75 bp, Artificial Sequence
  Synthetic
acttgaattctccgctaattagtgatgatattgacaatttgatcaggaaattcaattctcttccaattccttcga

SEQ ID NO: 355373 - DNA, 75 bp, Artificial Sequence
  Synthetic
gagtggaagagcatactaagccctcttattttcaggcagcagatgattctgacacagaatctgaaccagaaattg

SEQ ID NO: 355374 - DNA, 75 bp, Artificial Sequence
  Synthetic
atttgacgtggtggagaccttcatccgcggctggggcaacaaactaattgaatacaccaaaaaggaaaaatggac

SEQ ID NO: 355375 - DNA, 75 bp, Artificial Sequence
  Synthetic
actatgcagatgaggaagtggatgttgtatttacttcagactggaaacagcctgagctcaaatctgacgagcatg

SEQ ID NO: 355376 - DNA, 75 bp, Artificial Sequence
  Synthetic
tgattcattcaaaattctcgcttatttgtgtcaaaagtttttggacttgcacaagttgacattaatcttaaatgc

SEQ ID NO: 355377 - DNA, 75 bp, Artificial Sequence
  Synthetic
ttgtgtcaaaagtttttggacttgcacaagttgacattaatcttaaatgccgtttctgaggtagaattgctcaac

SEQ ID NO: 355378 - DNA, 75 bp, Artificial Sequence
  Synthetic
gaaagaccttacggttgacattgccagagggtttaagtggagagcagaaatcccagtggctttcgacgattaaag

SEQ ID NO: 355379 - DNA, 75 bp, Artificial Sequence
  Synthetic
agagggtttaagtggagagcagaaatcccagtggctttcgacgattaaagcagtcgttcaaagtgccaaatactg

SEQ ID NO: 355380 - DNA, 75 bp, Artificial Sequence
  Synthetic
ttggcgaggactttcaaaggcaaagttagagtgagttctcatggaacgaatatatgcaggcttagggttcccagc

SEQ ID NO: 355381 - DNA, 75 bp, Artificial Sequence
  Synthetic
cagtcgttcaaagtgccaaatactggaatctagcagagtgcacatttgaagcatcgagagaaggggtcattatgg

SEQ ID NO: 355382 - DNA, 75 bp, Artificial Sequence
  Synthetic
ttagagtgagttctcatggaacgaatatatgcaggcttagggttcccagcttaggtcctacttttatttcagaag

SEQ ID NO: 355383 - DNA, 75 bp, Artificial Sequence
  Synthetic
aagagcgccagatgactccggatgtatataaggtcactccagtgatgaacacacatccgtcccaatcagaagccg

SEQ ID NO: 355384 - DNA, 75 bp, Artificial Sequence
  Synthetic
gatgggcttacttcaagaaacttgatattatcatggatcgaaactttcttttaatggtcaaagatgtgattatag

SEQ ID NO: 355385 - DNA, 75 bp, Artificial Sequence
  Synthetic
acacatccgtcccaatcagaagccgtatcagatgtttggtctctctcgaagacatccatgactttccaacccaag

SEQ ID NO: 355386 - DNA, 75 bp, Artificial Sequence
  Synthetic
tattatcatggatcgaaactttcttttaatggtcaaagatgtgattataggaaggatgcaaacggtgctatccat

SEQ ID NO: 355387 - DNA, 75 bp, Artificial Sequence
  Synthetic
ggtatgtagaacagacaaccttttctcagagcaagacatcttctcccttctaaatatctacagaattggagataa

SEQ ID NO: 355388 - DNA, 75 bp, Artificial Sequence
  Synthetic
tatccttggatgaattgttctcatctagaggagaattcatctctgtcggaggtaacggacgaatgtctcataaag

SEQ ID NO: 355389 - DNA, 75 bp, Artificial Sequence
  Synthetic
caaaaagttgtacaatcaggcgagagtcaaatattctctgtagactatgaaaaaaagtaacagatatcacaatct

SEQ ID NO: 355390 - DNA, 75 bp, Artificial Sequence
  Synthetic
aagtgttatcccaatccattcataatgagttccttaaagaagattctcggcctgaagggaaaaggtaagaagtct

SEQ ID NO: 355391 - DNA, 75 bp, Artificial Sequence
  Synthetic
cttatgaagaggacactagcatggagtatgctccgagcgctccaattgacaaatcctattttggagttgacgaga

SEQ ID NO: 355392 - DNA, 75 bp, Artificial Sequence
  Synthetic
attgatgtgtcgtatgcaaaggcacttgcaagtgatttagctcggattgtcttatttcaacagttcaatgatcat

SEQ ID NO: 355393 - DNA, 75 bp, Artificial Sequence
  Synthetic
aaaaagtggtttgtgaatggagacttgcttcctcatgatcatccctttaaaagtcatgttaaagaaaatacatgg

SEQ ID NO: 355394 - DNA, 75 bp, Artificial Sequence
  Synthetic
tgcttcctcatgatcatccctttaaaagtcatgttaaagaaaatacatggcctactgccgctcaaattcaagatt

SEQ ID NO: 355395 - DNA, 75 bp, Artificial Sequence
  Synthetic
ttggagataaatggcatgaacttcccctgatcaaatgttttgaaatacccgacttattagacccatcaataatat

SEQ ID NO: 355396 - DNA, 75 bp, Artificial Sequence
  Synthetic
actctgacaaaagtcattcgatgaataggtcagaggtgttgaaacatgtccgaatgaatcccaacactcctatcc

SEQ ID NO: 355397 - DNA, 75 bp, Artificial Sequence
  Synthetic
ctgcgaaggcagggcttatttgccacatagaatggggaagacccctcccatgctcaatgtaccagagcacttcag

SEQ ID NO: 355398 - DNA, 75 bp, Artificial Sequence
  Synthetic
ccagtaaaaaggtgttgcagactatgttggacacaaaagctaccaattggaaagaatttctcaaagagattgatg

SEQ ID NO: 355399 - DNA, 75 bp, Artificial Sequence
  Synthetic
gttggacacaaaagctaccaattggaaagaatttctcaaagagattgatgagaaaggtttagatgatgatgatct

SEQ ID NO: 355400 - DNA, 75 bp, Artificial Sequence
  Synthetic
ccatctacgatgatgagtcactggaagcagctcctatgatctgggatcatttcaattcttccaaattttctgatt

SEQ ID NO: 355401 - DNA, 75 bp, Artificial Sequence
  Synthetic
agcagctcctatgatctgggatcatttcaattcttccaaattttctgatttcagagagaaggccttaatgtttgg

SEQ ID NO: 355402 - DNA, 75 bp, Artificial Sequence
  Synthetic
aattattggccttaaaggaaaggagagggaactgaagttagcaggtagatttttctccctaatgtcttggaagct

SEQ ID NO: 355403 - DNA, 75 bp, Artificial Sequence
  Synthetic
cctgattgtcgagaaaaaggcatctggagcttggatcctggattctgtcagccacttcaaatgagctagtctagc

SEQ ID NO: 355404 - DNA, 75 bp, Artificial Sequence
  Synthetic
ttttctccctaatgtcttggaagctgcgagaatactttgtaatcaccgaatatttgataaaaactcatttcgttc

SEQ ID NO: 355405 - DNA, 75 bp, Artificial Sequence
  Synthetic
ttctagcttctgaacaatccccggtttactcagtatttcctaattccagcctttcaaacaactaatatcctgtct

SEQ ID NO: 355406 - DNA, 75 bp, Artificial Sequence
  Synthetic
ttgcatagcaaatcacattgattacgagaaatggaacaaccaccaaaggaagttatcaaatggcccagtattccg

SEQ ID NO: 355407 - DNA, 75 bp, Artificial Sequence
  Synthetic
ccatgaagtgccttttgtacttagcttttttatccattggggtgaattgcaagttcaccatagtttttccacaca

SEQ ID NO: 355408 - DNA, 75 bp, Artificial Sequence
  Synthetic
agtgatgggccagttcttgggttatccatccttaattgagagaactcatgaattttttgaaaaaagtcttatata

SEQ ID NO: 355409 - DNA, 75 bp, Artificial Sequence
  Synthetic
atcaagttatttgcacacagtataaaacgaagaaatcgagaaacgttgtagaattacaaagtgctctcaatcaaa

SEQ ID NO: 355410 - DNA, 75 bp, Artificial Sequence
  Synthetic
aagttaggacttttgataaatgacgatgagactatgcaatctgcagattacttaaattatgggaaaataccgatt

SEQ ID NO: 355411 - DNA, 75 bp, Artificial Sequence
  Synthetic
tttccacaaatgctctcactgtagctcattttgctgagaacccaatcaatgccatgatacaatacaattatttcg

SEQ ID NO: 355412 - DNA, 75 bp, Artificial Sequence
  Synthetic
tcattttgctgagaacccaatcaatgccatgatacaatacaattatttcgggacatttgctcgactcttgttgat

SEQ ID NO: 355413 - DNA, 75 bp, Artificial Sequence
  Synthetic
tcattgtatgaagttcaagacaagataccgggcttgcacagttctactttcaaatatgcaatgttgtatttggac

SEQ ID NO: 355414 - DNA, 75 bp, Artificial Sequence
  Synthetic
ccttccattggaggtgtgtcaggcatgtctttgtctaggtttttaattagagccttcccagatcctgtgacagaa

SEQ ID NO: 355415 - DNA, 75 bp, Artificial Sequence
  Synthetic
agccttcccagatcctgtgacagaaagtctctcattctggagattcatccatatacatgctcgaagtgagcacct

SEQ ID NO: 355416 - DNA, 75 bp, Artificial Sequence
  Synthetic
gagaggatcttggattattccctctgccaagaaacctggagcaaaatcggggcaggtcttcccatctctccagtg

SEQ ID NO: 355417 - DNA, 75 bp, Artificial Sequence
  Synthetic
gatctcagctatcttgctcctaaaaacccaggaaccggccctgccttcactataatcaatggtaccctaaaatac

SEQ ID NO: 355418 - DNA, 75 bp, Artificial Sequence
  Synthetic
acccaggaaccggccctgccttcactataatcaatggtaccctaaaatactttgagaccagatacatcagggttg

SEQ ID NO: 355419 - DNA, 75 bp, Artificial Sequence
  Synthetic
atgggaatgagtccagcgaatttgttaaagactgaggttaaaaaatgcttactcgaatcaagacagaccattaga

SEQ ID NO: 355420 - DNA, 75 bp, Artificial Sequence
  Synthetic
tagggaattagatgatttgatagtgaggagtgaagtatcctctttgatacatttagggaaacttcatttgagaag

SEQ ID NO: 355421 - DNA, 75 bp, Artificial Sequence
  Synthetic
tcctgatgatgagactttattttttggtgacactggattatccaaaaatccaatcgagcttgtagaaggttggtt

SEQ ID NO: 355422 - DNA, 75 bp, Artificial Sequence
  Synthetic
tcattggactattcttggttctccgagttggtatttatctttgcattaaattaaagcacaccaagaaaagacaga

SEQ ID NO: 355423 - DNA, 75 bp, Artificial Sequence
  Synthetic
ttggaaatgttgggtccacaacatcgaaaagagactccgtgtgcaccatgtaatacatcagggttcaattatgtt

SEQ ID NO: 355424 - DNA, 75 bp, Artificial Sequence
  Synthetic
agttggtatttatctttgcattaaattaaagcacaccaagaaaagacagatttatacagatatagagatgaatcg

SEQ ID NO: 355425 - DNA, 75 bp, Artificial Sequence
  Synthetic
gaaaagagactccgtgtgcaccatgtaatacatcagggttcaattatgtttctgtgcattgtccggacgggatac

SEQ ID NO: 355426 - DNA, 75 bp, Artificial Sequence
  Synthetic
atgatgtctttagttcaagaggaccattgcctgcttatctagggtctaaaacatctgaatctacatccattctgc

SEQ ID NO: 355427 - DNA, 75 bp, Artificial Sequence
  Synthetic
attgcctgcttatctagggtctaaaacatctgaatctacatccattctgcagccttgggaaagagaaagcaaagt

SEQ ID NO: 355428 - DNA, 75 bp, Artificial Sequence
  Synthetic
cccactgattaaaagggctacacgtcttagagatgctatctcctggtttgttgaacctgactctaaactagcaat

SEQ ID NO: 355429 - DNA, 75 bp, Artificial Sequence
  Synthetic
ttttaagttttatgaaaaaaactaacagcaatcatggaagtccatgattttgagaccgacgaattcaatgatttc

SEQ ID NO: 355430 - DNA, 75 bp, Artificial Sequence
  Synthetic
cagcaatcatggaagtccatgattttgagaccgacgaattcaatgatttcaacgaagatgactatgccacaagag

SEQ ID NO: 355431 - DNA, 75 bp, Artificial Sequence
  Synthetic
cttagagatgctatctcctggtttgttgaacctgactctaaactagcaatgaccatcctttctaacatacgctct

SEQ ID NO: 355432 - DNA, 75 bp, Artificial Sequence
  Synthetic
aattcctgaatcctgatgagcgcatgacgtacttgaatcatgctgattacaacttgaattctcctctaattagtg

SEQ ID NO: 355433 - DNA, 75 bp, Artificial Sequence
  Synthetic
ttgacaggcgaggaatggaccaaaaggcagcgtgggttcaaaagaacggggtctgcccttcacaggttttcgaca

SEQ ID NO: 355434 - DNA, 75 bp, Artificial Sequence
  Synthetic
aacttgaattctcctctaattagtgatgatattgacaatttgattaggaaattcaattctcttccaattccctcg

SEQ ID NO: 355435 - DNA, 75 bp, Artificial Sequence
  Synthetic
ggcagcgtgggttcaaaagaacggggtctgcccttcacaggttttcgacatctcgaatgagccatggtgggtttg

SEQ ID NO: 355436 - DNA, 75 bp, Artificial Sequence
  Synthetic
catctcaaagcactgctgcattgaccaggctgatggcgactacagacactatgagggatctgggagatcagaatt

SEQ ID NO: 355437 - DNA, 75 bp, Artificial Sequence
  Synthetic
atgtgggatagtaagaactgggatggagttcttgagatgttaacgtcatgtcaagccaatcccatcccaacatct

SEQ ID NO: 355438 - DNA, 75 bp, Artificial Sequence
  Synthetic
caggctgatggcgactacagacactatgagggatctgggagatcagaatttcgactttttatttcaagctacgtt

SEQ ID NO: 355439 - DNA, 75 bp, Artificial Sequence
  Synthetic
tcaagccaatcccatcccaacatctcggatgcataaatggatgggaaattggttaatgtctgacaatcatgatgc

SEQ ID NO: 355440 - DNA, 75 bp, Artificial Sequence
  Synthetic
gctctacgctcaaattaccaccactgttgcaagagacggatggaccaccagttgtacagatcattatcatattac

SEQ ID NO: 355441 - DNA, 75 bp, Artificial Sequence
  Synthetic
gttgcaagagacggatggaccaccagttgtacagatcattatcatattacctgtaagtcctgtctgagacccata

SEQ ID NO: 355442 - DNA, 75 bp, Artificial Sequence
  Synthetic
gaagagattaccctagactcaagtatggattacacacccccagacgtatcccatgtgctgaagacatggagaaat

SEQ ID NO: 355443 - DNA, 75 bp, Artificial Sequence
  Synthetic
ccgcggctggggcaacaaaccaattgaatacatcaaaaaggaaaaatggactgactcgttcaagattctcgctta

SEQ ID NO: 355444 - DNA, 75 bp, Artificial Sequence
  Synthetic
gaattggaagaatttagcacctgctgagcaatcctatcaagtcggcagatgtataggttttttgtatggagactt

SEQ ID NO: 355445 - DNA, 75 bp, Artificial Sequence
  Synthetic
cttggcgaggactttcaaaggcaaagttagaagaagttctcatggaacgaacatatgcaggcttcgggttcccag

SEQ ID NO: 355446 - DNA, 75 bp, Artificial Sequence
  Synthetic
ggcgtataggaaatctactcatgccgaggacagttctctatttcctctatctatacaaaatcgtgtccgaggtcg

SEQ ID NO: 355447 - DNA, 75 bp, Artificial Sequence
  Synthetic
ctatacaaaatcgtgtccgaggtcgaggtttcttaaaagggttactagacggattaatgagggctagttgttgcc

SEQ ID NO: 355448 - DNA, 75 bp, Artificial Sequence
  Synthetic
atcaatgccgtctgattgaaaagggaaaatacagatcacattactcacaattatggttattctcagatgtcttat

SEQ ID NO: 355449 - DNA, 75 bp, Artificial Sequence
  Synthetic
aaaatacagatcacattactcacaattatggttattctcagatgtcttatctatagacttcttgggcccattctc

SEQ ID NO: 355450 - DNA, 75 bp, Artificial Sequence
  Synthetic
atgagtgtgaaaacagtggatctcacactggtgatttatggatcattcagacattggggtcatccttttatagat

SEQ ID NO: 355451 - DNA, 75 bp, Artificial Sequence
  Synthetic
catttccaccaccctcttgaaaatcctatacaagtcatctttatctgggaaagataagaatgagttgagagagct

SEQ ID NO: 355452 - DNA, 75 bp, Artificial Sequence
  Synthetic
acattggggtcatccttttatagattattacgctgggctggaaaaattacattcccaagtaaccatgaagaaaga

SEQ ID NO: 355453 - DNA, 75 bp, Artificial Sequence
  Synthetic
ctatacaagtcatctttatctgggaaagataagaatgagttgagagagctggcaaatctttcttcattgctgaga

SEQ ID NO: 355454 - DNA, 75 bp, Artificial Sequence
  Synthetic
attcccaagtaaccatgaagaaagatattgatgtgtcatatgcaaaggcacttgcaagtgatttagctcggattg

SEQ ID NO: 355455 - DNA, 75 bp, Artificial Sequence
  Synthetic
tcaggagagggatgggaagacatccatgtaaaattcttcaccaaggacatattattgtgtccagaagaaatcaga

SEQ ID NO: 355456 - DNA, 75 bp, Artificial Sequence
  Synthetic
atgtaaaattcttcaccaaggacatattattgtgtccagaagaaatcagacatgcttgcaagttcgggattgcta

SEQ ID NO: 355457 - DNA, 75 bp, Artificial Sequence
  Synthetic
aagacaacaataaagacatgagctatcccccttggggtagggaatccagagggacaattacaacaatccctgttt

SEQ ID NO: 355458 - DNA, 75 bp, Artificial Sequence
  Synthetic
attacacggccacccattacccaaagatgctagagatgcctccaagaatccaaaatcccctgctgtccggaatca

SEQ ID NO: 355459 - DNA, 75 bp, Artificial Sequence
  Synthetic
cggagggattactgctgcattactacgagaaaatgtacatagcagaggaatattcaatagtctgttggaattgtc

SEQ ID NO: 355460 - DNA, 75 bp, Artificial Sequence
  Synthetic
tgttggacacaaaagctaccaattggaaagaatttctcaaagagattgatgagaagggcttagatgatgatgacc

SEQ ID NO: 355461 - DNA, 75 bp, Artificial Sequence
  Synthetic
cgagaaaatgtacatagcagaggaatattcaatagtctgttggaattgtcagggtcagttatgagaggtgcttct

SEQ ID NO: 355462 - DNA, 75 bp, Artificial Sequence
  Synthetic
ctttaggaggagataaatcgagatgtgtaaatggtgaaacatgttgggaacacccatctgacttatgtgatccga

SEQ ID NO: 355463 - DNA, 75 bp, Artificial Sequence
  Synthetic
ggacttgggattatttcctccgacttaaagctggcttagggcttcagattgatttaattgtaatggatatggaag

SEQ ID NO: 355464 - DNA, 75 bp, Artificial Sequence
  Synthetic
taaagctggcttagggcttcagattgatttaattgtaatggatatggaagtgagggattactctgctagtctgaa

SEQ ID NO: 355465 - DNA, 75 bp, Artificial Sequence
  Synthetic
gattgagacgaatgtcagaaattatgtgcaccggattttggatgagcaaggagttttaatctataagacgtatgg

SEQ ID NO: 355466 - DNA, 75 bp, Artificial Sequence
  Synthetic
gtgcaccggattttggatgagcaaggagttttaatctataagacgtatggaacatatatttgtgagagcgagaag

SEQ ID NO: 355467 - DNA, 75 bp, Artificial Sequence
  Synthetic
aacgcagtgacaatccttggtcccatgttcaggacagtcgacttagttcaaacagaatttagtagttctcaaact

SEQ ID NO: 355468 - DNA, 75 bp, Artificial Sequence
  Synthetic
tgttcaggacagtcgacttagttcaaacagaatttagtagttctcaaacttctgaggtatatatggtatgtaaaa

SEQ ID NO: 355469 - DNA, 75 bp, Artificial Sequence
  Synthetic
gtttgaagaaattaattgatgaaccccatcccgattggtcttccgtcaatgaatcttggaaaaatctatacgcat

SEQ ID NO: 355470 - DNA, 75 bp, Artificial Sequence
  Synthetic
ccatcccgattggtcttccgtcaatgaatcttggaaaaatctatacgcattccagtcgtcagaacaagaatttgc

SEQ ID NO: 355471 - DNA, 75 bp, Artificial Sequence
  Synthetic
aggtctacggcaaaaaggatggagtatcctcaatctactggttattcaaagagaggctaaaatcagaaacactgc

SEQ ID NO: 355472 - DNA, 75 bp, Artificial Sequence
  Synthetic
cagagcaaggaaagttagtacatacttcactttgacgggtattccctcccaattcattcctgatccttttgtaaa

SEQ ID NO: 355473 - DNA, 75 bp, Artificial Sequence
  Synthetic
ttcactttgacgggtattccctcccaattcattcctgatccttttgtaaaccttgagactatgctacaaatattc

SEQ ID NO: 355474 - DNA, 75 bp, Artificial Sequence
  Synthetic
aaacgaagaaatcgagaaacgttgtagaattacagggtgctctcaatcaaatggtttctaataatgagaaaatta

SEQ ID NO: 355475 - DNA, 75 bp, Artificial Sequence
  Synthetic
ggagtacccacaggtgtgtcccacgcggccgccttaaaatcatctgatagacctgcagatttattgaccattggc

SEQ ID NO: 355476 - DNA, 75 bp, Artificial Sequence
  Synthetic
cggccgccttaaaatcatctgatagacctgcagatttattgaccattggccttttttatatggcgatcatatcat

SEQ ID NO: 355477 - DNA, 75 bp, Artificial Sequence
  Synthetic
attataatatcaatcatatcagagtaggaccagtccctccgaaccccccatcagatggaactgcacaaaatgtgg

SEQ ID NO: 355478 - DNA, 75 bp, Artificial Sequence
  Synthetic
gaattgctataactggtataagcctttggctgagcttgatggagaaagacattccactatatcaacagtgtttag

SEQ ID NO: 355479 - DNA, 75 bp, Artificial Sequence
  Synthetic
cagttatccagcaatcatttccgattaggtgggaggctgtttcagtaaaaggaggatacaagcagaagtggagta

SEQ ID NO: 355480 - DNA, 75 bp, Artificial Sequence
  Synthetic
ctagaggtgatggactcccgaaagatacccgaatttcagactccttggccccaatcgggaactggattagatctt

SEQ ID NO: 355481 - DNA, 75 bp, Artificial Sequence
  Synthetic
ttcaatcagctatgtcgtacagtggataatcatttgagatggtcaaatttgcgaaaaaacactggaatgattgaa

SEQ ID NO: 355482 - DNA, 75 bp, Artificial Sequence
  Synthetic
atgtctttgtccaggtttttgattagagccttcccagatcccgtgacagaaagtctctcattctggagattcatc

SEQ ID NO: 355483 - DNA, 75 bp, Artificial Sequence
  Synthetic
tgggtcaatagacgaatttcaacagaagaccggtctatactgatattgaagagcgacctacatgaagaaaactct

SEQ ID NO: 355484 - DNA, 75 bp, Artificial Sequence
  Synthetic
aagaccggtctatactgatattgaagagcgacctacatgaagaaaactcttggagagattgaaaaatcatgagga

SEQ ID NO: 355485 - DNA, 75 bp, Artificial Sequence
  Synthetic
gactccaaactttaagtatgaaaaaaactctgatccttaagaccctcttgtggtttttattttttagctggtttt

SEQ ID NO: 355486 - DNA, 75 bp, Artificial Sequence
  Synthetic
ttaagtatgaaaaaaactctgatccttaagaccctcttgtggtttttattttttagctggttttgtggtcttcgt

SEQ ID NO: 355487 - DNA, 75 bp, Artificial Sequence
  Synthetic
aagatccaacctctctgaacatcgctatggggatgagtccagcgaatttgttaaagactgaggttaaaaaatgct

SEQ ID NO: 355488 - DNA, 75 bp, Artificial Sequence
  Synthetic
taatcgaatcaagacaaaccatcaggaatcaggtgattaaggatgcaaccatatatttgtatcatgaagaggatc

SEQ ID NO: 355489 - DNA, 75 bp, Artificial Sequence
  Synthetic
atagggaattggatgatttgattgtgaggagtgaggtatcttctttgacacatttagggaaacttcatctgcgaa

SEQ ID NO: 355490 - DNA, 75 bp, Artificial Sequence
  Synthetic
tttctatccctatgaaaaaaactaacagagatcgatctgtttccttgacaccatgaagtgccttttgtacttagc

SEQ ID NO: 355491 - DNA, 75 bp, Artificial Sequence
  Synthetic
catgacgtctttagttcacggggaccattgcctgcttatctagggtctaaaacatccgaatctacatccattttg

SEQ ID NO: 355492 - DNA, 75 bp, Artificial Sequence
  Synthetic
atgggaatgagtccagcgaacttgttaaagactgaggttaaaaaatgcttatacgaagccaaacaaaccatcagg

SEQ ID NO: 355493 - DNA, 75 bp, Artificial Sequence
  Synthetic
ccaggttgatggcaactacagacactatgagggatctgggagatcagaatttcgacttcttgttccaggcaacgt

SEQ ID NO: 355494 - DNA, 75 bp, Artificial Sequence
  Synthetic
cgaggacagttctctatttcctctatctatacaaagtcgtattagaggtcgaggtttcttaaaagggttgctaga

SEQ ID NO: 355495 - DNA, 75 bp, Artificial Sequence
  Synthetic
caagtaatacaccgaagaagtctggctcatttgaagaggccggccaacgcagtgtacggaggtttgatttacttg

SEQ ID NO: 355496 - DNA, 75 bp, Artificial Sequence
  Synthetic
acctattagagacgaattagaaacgattccccacaagatcccgacatcctatccgacaagcaaccgtgatatggg

SEQ ID NO: 355497 - DNA, 75 bp, Artificial Sequence
  Synthetic
attccccacaagatcccgacatcctatccgacaagcaaccgtgatatgggggtgattgtcagaaattacttcaaa

SEQ ID NO: 355498 - DNA, 75 bp, Artificial Sequence
  Synthetic
gaaaatacagatcacattattcacaattatggttattctcagatgttttgtccatagatttcctcggaccattct

SEQ ID NO: 355499 - DNA, 75 bp, Artificial Sequence
  Synthetic
gcgaaaaaacacaggaatgattgaatggatcaatgggcgaatttcaaaagaagaccggtctatactgatgttgaa

SEQ ID NO: 355500 - DNA, 75 bp, Artificial Sequence
  Synthetic
aggttaggccagttaccaactggcgctcattataaaattcggagtatattacatggaatgggaatccattacagg

SEQ ID NO: 355501 - DNA, 75 bp, Artificial Sequence
  Synthetic
acatggaatgggaatccattacagggacttcttaagttgtggagacggttccggagggatgactgctgcattact

SEQ ID NO: 355502 - DNA, 75 bp, Artificial Sequence
  Synthetic
ccggagggatgactgctgcattactacgagaaaatgtacatagcagaggaatattcaatagtctgttagaattgt

SEQ ID NO: 355503 - DNA, 75 bp, Artificial Sequence
  Synthetic
tcctgagccccccagtgctctagaaactttaggaggagataaatcgagatgtgtaaatggtgaaacatgttggga

SEQ ID NO: 355504 - DNA, 75 bp, Artificial Sequence
  Synthetic
tatccagcaatcatttccgattaggtgggaggctatttcagtcaaaggaggatacaagcagaagtggaatactaa

SEQ ID NO: 355505 - DNA, 75 bp, Artificial Sequence
  Synthetic
gaatgcagtaacaatccttggtcccatgttcaagacggtcgacttagttcaaacagaatttagtagttctcaaac

SEQ ID NO: 355506 - DNA, 75 bp, Artificial Sequence
  Synthetic
aggtgatgggctcccaaaagatacccgaatttcaaactccttggccccaatcgggaactggatcaaatctttgga

SEQ ID NO: 355507 - DNA, 75 bp, Artificial Sequence
  Synthetic
ggtttgaagaaattaatcgatgaacccaatcccgattggtcttccatcaatgaatcttggaaaaacctgtacgca

SEQ ID NO: 355508 - DNA, 75 bp, Artificial Sequence
  Synthetic
atcagtctatttcaaaaatctcgtactattcggaactcctttaagaaaaagaacaaaaggaaatggaatgatttg

SEQ ID NO: 355509 - DNA, 75 bp, Artificial Sequence
  Synthetic
caattcattcctgatccttttgtaaaccttgagactatgctacaaatattcggagtacccacgggtgtgtctcat

SEQ ID NO: 355510 - DNA, 75 bp, Artificial Sequence
  Synthetic
gttcaatcagctatgtcgtacagtggataatcatttgaaatggtcaaatttgcgaaacaacacaggaatgattgc

SEQ ID NO: 355511 - DNA, 75 bp, Artificial Sequence
  Synthetic
attggtccgaaaccaagttcgtctaaatccattcaataagatcttgttcaatcagctatgtcgtacagtggataa

SEQ ID NO: 355512 - DNA, 75 bp, Artificial Sequence
  Synthetic
ccgaatcaattaagatatgagaaattcttctttacagtgaaaatgacggttagatctaatcgtccgttcagaaca

SEQ ID NO: 355513 - DNA, 75 bp, Artificial Sequence
  Synthetic
tggaaaaatgttccttccaattaccattattgcccgtcaagctcagatttaaattggcataatgacttaataggc

SEQ ID NO: 355514 - DNA, 75 bp, Artificial Sequence
  Synthetic
cagaagtaactactttgcttatgaaactggagacaaggcctgcaaaatgcagtactgcaagcattggggagtcag

SEQ ID NO: 355515 - DNA, 75 bp, Artificial Sequence
  Synthetic
agcaaaatcagagcgggtcttcccatctctccagtggatctcagctatcttgctcctaaaaacccaggaaccggt

SEQ ID NO: 355516 - DNA, 75 bp, Artificial Sequence
  Synthetic
aatgatgcttccaggccaagaaattgacaaggccgattcatacatgccttatttgatcgactttggattgtcttc

SEQ ID NO: 355517 - DNA, 75 bp, Artificial Sequence
  Synthetic
aaaggctcaggagaaactttaacagatatcatggataatctcacaaaagttcgtgagtatctcaagtcctactct

SEQ ID NO: 355518 - DNA, 75 bp, Artificial Sequence
  Synthetic
ccaggtgactcctcaccatgtgcttgttgatgaatacacaggagaatgggttgattcacagttcatcaacggaaa

SEQ ID NO: 355519 - DNA, 75 bp, Artificial Sequence
  Synthetic
atgattggacatggtatgttggactccgatcttcatcttagctcaaaggctcaggtgtttgaacatcctcacatt

SEQ ID NO: 355520 - DNA, 75 bp, Artificial Sequence
  Synthetic
tactgggctatccaaaaatccaatcgagtttgtagaaggttggttcagtagttggaagagctctattgcctcttt

SEQ ID NO: 355521 - DNA, 75 bp, Artificial Sequence
  Synthetic
gttggaagagctctattgcctctttttgctttatcatagggttaatcattggactattcttggttctccgagttg

SEQ ID NO: 355522 - DNA, 75 bp, Artificial Sequence
  Synthetic
ttgtgtccagaggaaatcagacatgcttgcaagttcgggattgctaaagataataataaagacatgagctatccc

SEQ ID NO: 355523 - DNA, 75 bp, Artificial Sequence
  Synthetic
cggttggatgtgtcatgcttccaaatgggtcactacttgtgatttccgctggtacggaccgaagtatataacaca

SEQ ID NO: 355524 - DNA, 75 bp, Artificial Sequence
  Synthetic
ggtccagtttcggaataaacatcgggaaggcaggggatacaatcggaatatttgaccttgtatccgtgaaagctc

SEQ ID NO: 355525 - DNA, 75 bp, Artificial Sequence
  Synthetic
taggatcctctgccgacttggcacaacagttttgtgttggagataacaaatacactccagacgacagtaccggag

SEQ ID NO: 355526 - DNA, 75 bp, Artificial Sequence
  Synthetic
tgcgaaaagagcagtcatgtcattgcaaggcctgagggagaaaacaattggcaagtatgctaagtcagaatttga

SEQ ID NO: 355527 - DNA, 75 bp, Artificial Sequence
  Synthetic
aggcagtaggagagatagatgagattgaagcacaacgagatgagaagtccaattatgagttgttccaagaggatg

SEQ ID NO: 355528 - DNA, 75 bp, Artificial Sequence
  Synthetic
gagtggaagagcatgccaagccctcttattttcaagcagcagatgattctgacacagagtctgaaccagaagttg

SEQ ID NO: 355529 - DNA, 75 bp, Artificial Sequence
  Synthetic
ggctttatacaggggcctttagatgactatgcagatgaggaagtggatgttgtattcacttcagactggaaacag

SEQ ID NO: 355530 - DNA, 75 bp, Artificial Sequence
  Synthetic
cctgaacttgaatctgacgagcacggaaagactttacggttgacattgccagagggtttaagtggagagcagaaa

SEQ ID NO: 355531 - DNA, 75 bp, Artificial Sequence
  Synthetic
tcccagtggctttcgacaattaaagcagttgttcagagtgccaaatactggaatctggcagagtgcacctttgaa

SEQ ID NO: 355532 - DNA, 75 bp, Artificial Sequence
  Synthetic
cagttgttcagagtgccaaatactggaatctggcagagtgcacctttgaagcatcaggagaaggggtcattatga

SEQ ID NO: 355533 - DNA, 75 bp, Artificial Sequence
  Synthetic
aagccatcctgctcggtctgaggtacaaaaagttgtacaatcaggcaagagtcaaatattctctatagactatga

SEQ ID NO: 355534 - DNA, 75 bp, Artificial Sequence
  Synthetic
cttatgaagaggacaccagcatggagtatgctccgagtgctccaattgacaaatcctattttggagttgacgaga

SEQ ID NO: 355535 - DNA, 75 bp, Artificial Sequence
  Synthetic
tggacactcatgatccaaatcaattaagatatgagaaattcttctttaccgtgaaaatgacggttagatcgaatc

SEQ ID NO: 355536 - DNA, 75 bp, Artificial Sequence
  Synthetic
aagatatgagaaattcttctttaccgtgaaaatgacggttagatcgaatcgtccgttcagaacatactcggatgt

SEQ ID NO: 355537 - DNA, 75 bp, Artificial Sequence
  Synthetic
ttttttgggttcctctaatctaaaggccactccagcagtgttggcagatcaaggtcaaccagaatatcacgccca

SEQ ID NO: 355538 - DNA, 75 bp, Artificial Sequence
  Synthetic
catagaatggggaagacccctcccatgctcaatgtaccagagcacttcagaagaccgttcaatataggtctttat

SEQ ID NO: 355539 - DNA, 75 bp, Artificial Sequence
  Synthetic
tctaattgtcgagaaaaaggcatctggagcttgggtcctggattctgtcagccacttcaaatgagctagtctagc

SEQ ID NO: 355540 - DNA, 75 bp, Artificial Sequence
  Synthetic
ggagcttgggtcctggattctgtcagccacttcaaatgagctagtctagcttcgatcttccggacaatctccggt

SEQ ID NO: 355541 - DNA, 75 bp, Artificial Sequence
  Synthetic
ttactcagtctctcctaattccaacctttcgaacaactaatatcttttcttttctatccctatgaaaaaaaccta

SEQ ID NO: 355542 - DNA, 75 bp, Artificial Sequence
  Synthetic
ctttcgaacaactaatatcttttcttttctatccctatgaaaaaaacctaacagagatcaatctgtttccttgac

SEQ ID NO: 355543 - DNA, 75 bp, Artificial Sequence
  Synthetic
accatgaagtgccttttgtgcttagcttttttattcattggggtgaattgcaagttcaccatagtatttccacac

SEQ ID NO: 355544 - DNA, 75 bp, Artificial Sequence
  Synthetic
caagttcaccatagtatttccacacaatcaaaaaggaaactggaaaaatgttccttccaattatcattattgccc

SEQ ID NO: 355545 - DNA, 75 bp, Artificial Sequence
  Synthetic
tgtcatgcctctaaatggatcactacttgcgacttccgctggtatggaccaaaatatataacacattccatccaa

SEQ ID NO: 355546 - DNA, 75 bp, Artificial Sequence
  Synthetic
tccttcactccatctgtggaacaatgcaaggaaagcattgaacaaacgaaacaaggaacttggctgaatccaggc

SEQ ID NO: 355547 - DNA, 75 bp, Artificial Sequence
  Synthetic
caactgtgacggatgctgaagcagtgattgtccaggtgactcctcaccatgtgcttgttgatgaatacacaggag

SEQ ID NO: 355548 - DNA, 75 bp, Artificial Sequence
  Synthetic
agtgggttgattcacagttcatcaacggaaaatgcagcaatgacatatgccttactgtccataactccacaacct

SEQ ID NO: 355549 - DNA, 75 bp, Artificial Sequence
  Synthetic
gcattggggagtcagactcccatccggtgtctggttcgagatggctgataaggatctctttgccgcagccaaatt

SEQ ID NO: 355550 - DNA, 75 bp, Artificial Sequence
  Synthetic
ggatctcagctatcttgctcctaaaaacccagggaccggccctgcctttaccataatcaatggtaccctaaaata

SEQ ID NO: 355551 - DNA, 75 bp, Artificial Sequence
  Synthetic
aacccagggaccggccctgcctttaccataatcaatggtaccctaaaatactttgagaccagatatatcagggtc

SEQ ID NO: 355552 - DNA, 75 bp, Artificial Sequence
  Synthetic
gatattgctgctccaatcctctccagaatggtcggaatgatcagcggaactaacacagaaagggaactgtgggaa

SEQ ID NO: 355553 - DNA, 75 bp, Artificial Sequence
  Synthetic
gaatggtcggaatgatcagcggaactaacacagaaagggaactgtgggaagattgggcgccatatgaagacgtag

SEQ ID NO: 355554 - DNA, 75 bp, Artificial Sequence
  Synthetic
aaatcggacccaatggagttcttaggaccagttcagggtataagtttcctttgtatatgattgggcatggtatgt

SEQ ID NO: 355555 - DNA, 75 bp, Artificial Sequence
  Synthetic
gaccagttcagggtataagtttcctttgtatatgattgggcatggtatgttggactccgatctccatctcagctc

SEQ ID NO: 355556 - DNA, 75 bp, Artificial Sequence
  Synthetic
aaaggttcaggtgttcgaacaccctcacatccaagacgctgcttcgcagcttcctgatgatgagactttattttt

SEQ ID NO: 355557 - DNA, 75 bp, Artificial Sequence
  Synthetic
cacatccaagacgctgcttcgcagcttcctgatgatgagactttattttttggtgataccgggctatctaaaaat

SEQ ID NO: 355558 - DNA, 75 bp, Artificial Sequence
  Synthetic
ccaatcgagctcgtagaaggttggttcagtggttggaagagctccattgcctcttttttctttatcatagggtta

SEQ ID NO: 355559 - DNA, 75 bp, Artificial Sequence
  Synthetic
tcagtggttggaagagctccattgcctcttttttctttatcatagggttaatcatcggactattcttggttctcc

SEQ ID NO: 355560 - DNA, 75 bp, Artificial Sequence
  Synthetic
gagttggtatttatctctgcattaaattaaagcacaccaggaaaagaaagatttatgcagacatagagatgaacc

SEQ ID NO: 355561 - DNA, 75 bp, Artificial Sequence
  Synthetic
attaaagcacaccaggaaaagaaagatttatgcagacatagagatgaaccgacttggaaaataactccaatccta

SEQ ID NO: 355562 - DNA, 75 bp, Artificial Sequence
  Synthetic
cacaacagattctccatgtttgaaccaaatcgacttgtgatatcatgctaaaagaggccttaattatattttaat

SEQ ID NO: 355563 - DNA, 75 bp, Artificial Sequence
  Synthetic
ttttatgaaaaaaactaacagtaatcatggaagtccatgattttgagaccgaagaatccaatgatttcaatgaag

SEQ ID NO: 355564 - DNA, 75 bp, Artificial Sequence
  Synthetic
ttgaatcatgctgattacaacttgaattctcctctaattagtgatgatatcgacaatttgatcaggaaattcaat

SEQ ID NO: 355565 - DNA, 75 bp, Artificial Sequence
  Synthetic
tctcttccaattccctcgatgtgggatagtaaaaaatgggatggagttcttgagatgttaacggcatgtcaagcc

SEQ ID NO: 355566 - DNA, 75 bp, Artificial Sequence
  Synthetic
acaaagaggcagaaataacatttgacgtggtggagaccttcatccgcggctggggcaataaacaaattgaataca

SEQ ID NO: 355567 - DNA, 75 bp, Artificial Sequence
  Synthetic
tgaggtggaactgctcaacttggcgaggactttcaaaggcaaagttagaaaaagttctcatggaacaaacatatg

SEQ ID NO: 355568 - DNA, 75 bp, Artificial Sequence
  Synthetic
gtcaaagatgtgattatagggaggatgcaaacggtgttgtccatggtatgtagaatagacaacctgttctcagag

SEQ ID NO: 355569 - DNA, 75 bp, Artificial Sequence
  Synthetic
gacttgattaaaatggtggaaccaatatgcaacttgaagctgatgaaattagccagagaatcaaggcctttagtt

SEQ ID NO: 355570 - DNA, 75 bp, Artificial Sequence
  Synthetic
ccgcaattccctcattttgaaaatcatatcaagacttctgtcgatgaaggggcaaaaattgaccgaggtataaag

SEQ ID NO: 355571 - DNA, 75 bp, Artificial Sequence
  Synthetic
atatcaagacttctgtcgatgaaggggcaaaaattgaccgaggtataaagtttctccatgatcagataatgagtg

SEQ ID NO: 355572 - DNA, 75 bp, Artificial Sequence
  Synthetic
tgaaaacagtggatctcacactagtgatttatggatcattcagacattggggtcatccgtttatagattattacg

SEQ ID NO: 355573 - DNA, 75 bp, Artificial Sequence
  Synthetic
gatttatggatcattcagacattggggtcatccgtttatagattattacgctgggctagaaaaattgcattccca

SEQ ID NO: 355574 - DNA, 75 bp, Artificial Sequence
  Synthetic
ggtgaccatgaagaaagatattgatgtgtcatatgcaaaagcacttgcaagtgatttggctcggattgttctctt

SEQ ID NO: 355575 - DNA, 75 bp, Artificial Sequence
  Synthetic
gtgatttggctcggattgttctcttccaacagttcaatgatcataaaaagtggttcgtgaatggagacttgttac

SEQ ID NO: 355576 - DNA, 75 bp, Artificial Sequence
  Synthetic
acaaaagtcattcaatgaataggtcagaggtgttgaaacacgttagaacgaatccgaacactcctattcctagta

SEQ ID NO: 355577 - DNA, 75 bp, Artificial Sequence
  Synthetic
aaaaggtgttgcagactatgttggacacaaaagcgaccaattggaaagaatttcttaaagagattgatgagaagg

SEQ ID NO: 355578 - DNA, 75 bp, Artificial Sequence
  Synthetic
cacaaaagcgaccaattggaaagaatttcttaaagagattgatgagaagggcttagatgatgatgacttgattat

SEQ ID NO: 355579 - DNA, 75 bp, Artificial Sequence
  Synthetic
tggtctcaaaggaaaggagagggagctgaagttagcaggtagatttttctccctaatgtcttggaaattgcgaga

SEQ ID NO: 355580 - DNA, 75 bp, Artificial Sequence
  Synthetic
atattttgtaattaccgaatatttaataaagactcacttcgtccctatgtttaaaggcttgacaatggcggacga

SEQ ID NO: 355581 - DNA, 75 bp, Artificial Sequence
  Synthetic
tggaagaccagacttgatgcgtgttcacaacaacacactggtcaattcaacctcccaacgagtttgttggcaagg

SEQ ID NO: 355582 - DNA, 75 bp, Artificial Sequence
  Synthetic
ttatttgtacacagtataaaacgaagaaatcgaggaacgtggtagaattacagggtgctctcaatcaaatggttt

SEQ ID NO: 355583 - DNA, 75 bp, Artificial Sequence
  Synthetic
gccaatataatgagctcggtttccacgaatgctctcaccgtagctcattttgctgaaaacccaatcaatgccatg

SEQ ID NO: 355584 - DNA, 75 bp, Artificial Sequence
  Synthetic
tggaaagaattcacgttgacttagatgctgacagcccgtatgtcaagtcgttacagcggagctttccacaatttg

SEQ ID NO: 355585 - DNA, 75 bp, Artificial Sequence
  Synthetic
tgctgacagcccgtatgtcaagtcgttacagcggagctttccacaatttgagatcgaagcaaggcaggtcactga

SEQ ID NO: 355586 - DNA, 75 bp, Artificial Sequence
  Synthetic
tgctggagaacgtcttgaaatgtccatcacgccggcccaaacgaagcattaccgatgacttcacactgaccagtc

SEQ ID NO: 355587 - DNA, 75 bp, Artificial Sequence
  Synthetic
gagaaactttgaaccatctgtggtttaacaaccaaccgtttctctgggcacagttgtgcattcctctggcagcgc

SEQ ID NO: 355588 - DNA, 75 bp, Artificial Sequence
  Synthetic
caatgaccatgccaatgccagagcgttttcgcatgtggcaacaaagctcattgagagcgaagtcgaccgggacca

SEQ ID NO: 355589 - DNA, 75 bp, Artificial Sequence
  Synthetic
gcgttaagaacttcaagagcataagagggagcccaatcaccctctacggctgacctaaataggtgacgtagtaga

SEQ ID NO: 355590 - DNA, 75 bp, Artificial Sequence
  Synthetic
ttttcgcatgtggcaacaaagctcattgagagcgaagtcgaccgggaccaagttatcttggacattggaagtgcg

SEQ ID NO: 355591 - DNA, 75 bp, Artificial Sequence
  Synthetic
acgcggaaaggcgtttatgctgtcaggtacaaagtcaacgagaatccactctactcgcagacttctgagcacgtg

SEQ ID NO: 355592 - DNA, 75 bp, Artificial Sequence
  Synthetic
cccgtcagacatgcacattccaatcaccgctatcattgtatctgccctatgataagcgctgaagacccggacaga

SEQ ID NO: 355593 - DNA, 75 bp, Artificial Sequence
  Synthetic
aacaccatctgtacaggacctaactgcggagtgtgcaaagcctcgtgggctggccgaaataatgcaagacttcaa

SEQ ID NO: 355594 - DNA, 75 bp, Artificial Sequence
  Synthetic
gataagcgctgaagacccggacagactacaacggtatgcagaaagacttaagaaaagtgacattaccgacaagaa

SEQ ID NO: 355595 - DNA, 75 bp, Artificial Sequence
  Synthetic
ggaagtgtagcagtataccaagatgtgtacgcagtccatgcaccgacatcaatctaccaccaggcgcttaaagga

SEQ ID NO: 355596 - DNA, 75 bp, Artificial Sequence
  Synthetic
ctccgtcaatgagggcaagctgtattcatacctggaaggtacacgattccatcagaccgccaaggacattgccga

SEQ ID NO: 355597 - DNA, 75 bp, Artificial Sequence
  Synthetic
ttgacacgaccccttttatgtacaaaaacatggcaggttcctaccctacttacaacacgaactgggctgacgaga

SEQ ID NO: 355598 - DNA, 75 bp, Artificial Sequence
  Synthetic
cattccttcaccacaagttaaatgctgcgggtccctcgagtgcaaggcatcctcaaaggcagattacacatgccg

SEQ ID NO: 355599 - DNA, 75 bp, Artificial Sequence
  Synthetic
agtgtgcggtgcactgtaccgaaaatggccggctgcttttgatagacagccaatagctgtcgggacggctagact

SEQ ID NO: 355600 - DNA, 75 bp, Artificial Sequence
  Synthetic
tgtaccaatctactcgtcaacggtaattaacaggtttacatctgcagaggtcgcggttaaaacgtgcaacttagt

SEQ ID NO: 355601 - DNA, 75 bp, Artificial Sequence
  Synthetic
taagctcgcagctgcctacatgagcatagcgtccatcgtcaacgctgagcggattactaaaatatcagtaccgct

SEQ ID NO: 355602 - DNA, 75 bp, Artificial Sequence
  Synthetic
ttaggaagaagaggctccaacctactaataagatcatattctcggttggttcaacaatctacacagaagatagat

SEQ ID NO: 355603 - DNA, 75 bp, Artificial Sequence
  Synthetic
taataagatcatattctcggttggttcaacaatctacacagaagatagatcactgttacgtagctggcatcttcc

SEQ ID NO: 355604 - DNA, 75 bp, Artificial Sequence
  Synthetic
ggattactaaaatatcagtaccgctactgtcaactggcatctattctggtggcaaagatcgagtgatgcaatcat

SEQ ID NO: 355605 - DNA, 75 bp, Artificial Sequence
  Synthetic
gcttgtttacaactacgacttccctgagtatggagctatgaaaccaggagcgttcggcgatattcaagcatcctc

SEQ ID NO: 355606 - DNA, 75 bp, Artificial Sequence
  Synthetic
aaacgtgttccacttgaaaggaaagtctaacttcacaggtagatgtgggaccattgtcagctgtgaagggtacgt

SEQ ID NO: 355607 - DNA, 75 bp, Artificial Sequence
  Synthetic
ggcaaagatcgagtgatgcaatcattgcatcacctgttcactgctttcgacactacggatgccgatgtcaccata

SEQ ID NO: 355608 - DNA, 75 bp, Artificial Sequence
  Synthetic
tcgtcttggccacaaagggtatttcctgttagctcaatgtcctccaggtgacagtgtaaccgtcagtatcacgag

SEQ ID NO: 355609 - DNA, 75 bp, Artificial Sequence
  Synthetic
ggactatacggtaaagttgagaacttggcgtccacaatgcatcgcgagggtttcttgagttgcaaagtcacagat

SEQ ID NO: 355610 - DNA, 75 bp, Artificial Sequence
  Synthetic
tggcgtccacaatgcatcgcgagggtttcttgagttgcaaagtcacagatacgctgcgcggcgagagggtttctt

SEQ ID NO: 355611 - DNA, 75 bp, Artificial Sequence
  Synthetic
aatatgtgaaccaactgtgccagaacgtatacccagtccggtgatttctagagcaccaagtgcggaatcactgct

SEQ ID NO: 355612 - DNA, 75 bp, Artificial Sequence
  Synthetic
ttgctgtgtgtacgtatgtaccagccacactttgcgatcagatgacagggattctggcaactgacgttagtgtgg

SEQ ID NO: 355613 - DNA, 75 bp, Artificial Sequence
  Synthetic
ttctggcaagaacgtcacctacgaatgtaagtgtggcgactacagcacaggtatcgtgagcacgcgaacgaagat

SEQ ID NO: 355614 - DNA, 75 bp, Artificial Sequence
  Synthetic
cacactttgcgatcagatgacagggattctggcaactgacgttagtgtggatgacgcacaaaaactattggttgg

SEQ ID NO: 355615 - DNA, 75 bp, Artificial Sequence
  Synthetic
caagaaatacgcatgcaatgatgagtattgggatacctttcgcgataaccctattcggctaactacagagaacgt

SEQ ID NO: 355616 - DNA, 75 bp, Artificial Sequence
  Synthetic
gctcaaccaaaggattgtcgtcaatggtaggacgcaaagaaatactaacacaatgcagaactatctattaccagt

SEQ ID NO: 355617 - DNA, 75 bp, Artificial Sequence
  Synthetic
tgtggttacagctgacgtgcatcaagcgaacacgtctacgtggagcatccctagtgctcctggcttggacgtcca

SEQ ID NO: 355618 - DNA, 75 bp, Artificial Sequence
  Synthetic
actcaggacgacccctgcaagaaacagcaccctttggatgtaaaattgaagtggagcctctgcgagcgtctaact

SEQ ID NO: 355619 - DNA, 75 bp, Artificial Sequence
  Synthetic
cactggagtattccaagtgcatcaggctttgaagtgagaacaccatctgtacaggacctaactgcagagtgtgcg

SEQ ID NO: 355620 - DNA, 75 bp, Artificial Sequence
  Synthetic
ggagcgcactcttactatgggctgctgctgggctttcaagacccagaaaatcacatccatctacaagaagcctgg

SEQ ID NO: 355621 - DNA, 75 bp, Artificial Sequence
  Synthetic
tacgcaaacaattaagaaagtacctgccgtctttgactcatttgtgattccacgccttaccagccacgggctcga

SEQ ID NO: 355622 - DNA, 75 bp, Artificial Sequence
  Synthetic
gccgtctttgactcatttgtgattccacgccttaccagccacgggctcgatatgggcttccgccgtaggctcaag

SEQ ID NO: 355623 - DNA, 75 bp, Artificial Sequence
  Synthetic
agaactaagtaccaacaaccaccaggagtcgctagggcgatctcagaagcggagttggacgagtacatacgtcaa

SEQ ID NO: 355624 - DNA, 75 bp, Artificial Sequence
  Synthetic
gatagaggcggcgttcggcaatatcacatctgtgcacctacctacaggaacgaggtttaaatttggtgccatgat

SEQ ID NO: 355625 - DNA, 75 bp, Artificial Sequence
  Synthetic
cccccgaaggttctgaaccgtggtcactagttacagcgctgtgcgtgctttcgaatgtcacgttcccatgcgaca

SEQ ID NO: 355626 - DNA, 75 bp, Artificial Sequence
  Synthetic
aagagaagattgggtcttacgctatactttcaccccaggcggtattgaatagtgaaaaactggcgtgtatccacc

SEQ ID NO: 355627 - DNA, 75 bp, Artificial Sequence
  Synthetic
tgcatggtgtcgtctccgacaccttgatggcggagagatgcgccacttggctgaacatggaagtaaaaatcattg

SEQ ID NO: 355628 - DNA, 75 bp, Artificial Sequence
  Synthetic
tacttaaaaacactatacacactttataaattcttttataattttttcttttgtttttattttgtttttaaaatt

SEQ ID NO: 355629 - DNA, 75 bp, Artificial Sequence
  Synthetic
ctgtgccaaatgttccggggatcccgtataaggcgttggtcgaacgtgcaggttacgcgccacttaacctggaga

SEQ ID NO: 355630 - DNA, 75 bp, Artificial Sequence
  Synthetic
ttgagtgagagcgctacgatcgttttcaacgagagggagttcgtaaacagatacctgcatcacatcgcaatcaac

SEQ ID NO: 355631 - DNA, 75 bp, Artificial Sequence
  Synthetic
ggaggagcgctaaacactgacgaagagtactataagactgtaaagactcaggacacagactcagaatacgtcttc

SEQ ID NO: 355632 - DNA, 75 bp, Artificial Sequence
  Synthetic
tgtatttccgaggaagcacagtgcataatgctgtgcagtgtcacattaatcgtatatcacactacatattaacaa

SEQ ID NO: 355633 - DNA, 75 bp, Artificial Sequence
  Synthetic
agtactataagactgtaaagactcaggacacagactcagaatacgtcttcgacattgacgcacgaaagtgtgtta

SEQ ID NO: 355634 - DNA, 75 bp, Artificial Sequence
  Synthetic
agcgagaagacgcaggtcccttgtgcctaaccggtgatctggtagatccaccatttcacgagtttgcgtacgaga

SEQ ID NO: 355635 - DNA, 75 bp, Artificial Sequence
  Synthetic
cctacagtagccagttattgtataacagatgaatacgatgcgtatcttgacatggtggacggcgcatcgtgctgt

SEQ ID NO: 355636 - DNA, 75 bp, Artificial Sequence
  Synthetic
acttcaagagcataagagggagcccaatcaccctctacggctgacctaaataggtgacgtagtagacacgcacct

SEQ ID NO: 355637 - DNA, 75 bp, Artificial Sequence
  Synthetic
caacttagtcatccaagagaattaccctacagtagccagttattgtataacagatgaatacgatgcgtatcttga

SEQ ID NO: 355638 - DNA, 75 bp, Artificial Sequence
  Synthetic
cactatagatcacgcagtcgcactaaaagttcatacagctgctctgaaagtcggcctgcgtatagtatacggtaa

SEQ ID NO: 355639 - DNA, 75 bp, Artificial Sequence
  Synthetic
ctggaatcatcaaaagcgctgtgactaagaaagatctggttgtgagtgcgaagaaggaaaactgcgcagaaatca

SEQ ID NO: 355640 - DNA, 75 bp, Artificial Sequence
  Synthetic
tatggagtgccaggttcaggtaaatctggaatcatcaaaagcgctgtgactaagaaagatctggttgtgagtgcg

SEQ ID NO: 355641 - DNA, 75 bp, Artificial Sequence
  Synthetic
taggaggtgcacacagactgtaaccgccatcgtctccacgctcttctacgacaagcgaatgaagacggttaaccc

SEQ ID NO: 355642 - DNA, 75 bp, Artificial Sequence
  Synthetic
gttacccaaatgcgagaactacctgtcttagattcggcggcatttaacgttgattgtttcaagaaatacgcatgc

SEQ ID NO: 355643 - DNA, 75 bp, Artificial Sequence
  Synthetic
gattcagtgcttctaaatggggttaagcaccccgttaacactctgtacattgatgaggcatttgcctgccatgca

SEQ ID NO: 355644 - DNA, 75 bp, Artificial Sequence
  Synthetic
agcaccccgttaacactctgtacattgatgaggcatttgcctgccatgcagggacgctgctggcactgattgcca

SEQ ID NO: 355645 - DNA, 75 bp, Artificial Sequence
  Synthetic
tgatgaggcatttgcctgccatgcagggacgctgctggcactgattgccatcgtcaaacctaagaaagtggtatt

SEQ ID NO: 355646 - DNA, 75 bp, Artificial Sequence
  Synthetic
gtgcggggacccaaaacaatgcggcttctttaacatgatgtgcctgaaagtacattttaaccatgacatatgcac

SEQ ID NO: 355647 - DNA, 75 bp, Artificial Sequence
  Synthetic
ccaagggtcaaccaggtacgaggcagggagagccccagcgtacagagtgatcagaggtgacattagcaagagcgc

SEQ ID NO: 355648 - DNA, 75 bp, Artificial Sequence
  Synthetic
gagatgtcaaagttactcccggcacgaaacatacagaggagcggcctaaggtgcaggttattcaggctgcagatc

SEQ ID NO: 355649 - DNA, 75 bp, Artificial Sequence
  Synthetic
aggctgatgaaaccactccacgttgaaggaaaaattgataatgagcaattagcggccgtgaaattgaagaaggct

SEQ ID NO: 355650 - DNA, 75 bp, Artificial Sequence
  Synthetic
caagcgaatgaagacggttaacccatgtgctgacaaaatcatcatagataccacagggaccacaaagccgcacaa

SEQ ID NO: 355651 - DNA, 75 bp, Artificial Sequence
  Synthetic
tctgccacacgctcgtcaaccgcctggagcgactatgacaggcggtttgtggttacagctgatgtgcatcaagcg

SEQ ID NO: 355652 - DNA, 75 bp, Artificial Sequence
  Synthetic
agatgatctgattctaacctgtttcagaggatgggtgaaacagctacagattgactataaaaatcatgaaatcat

SEQ ID NO: 355653 - DNA, 75 bp, Artificial Sequence
  Synthetic
cttgaggacttaggcgtcgaccaaccgctcttagatttgatagaggcggcgttcggcaatatcacatctgtgcac

SEQ ID NO: 355654 - DNA, 75 bp, Artificial Sequence
  Synthetic
gactgcggctgcatcgcaaggacttacgcggaaaggcgtttatgctgtcaggtacaaagtcaacgagaatccact

SEQ ID NO: 355655 - DNA, 75 bp, Artificial Sequence
  Synthetic
cttatagtgttggtctgcagctctatgcttataaacacacgtagatgactgagcgcggacactgacatagcggta

SEQ ID NO: 355656 - DNA, 75 bp, Artificial Sequence
  Synthetic
gtttctttcggactacagaccagtaccggcaccacggagacgccccatcccatcacctagatcgacggcttccgc

SEQ ID NO: 355657 - DNA, 75 bp, Artificial Sequence
  Synthetic
ggatggccgcatgagattatcatccactattatcatcggcatccagtctacaccgtcattgtgctgtgtggtgtc

SEQ ID NO: 355658 - DNA, 75 bp, Artificial Sequence
  Synthetic
tggtgatccctggataaagatacttacagctaaatatcccggggatttcacggcttcattggacgactggcagcg

SEQ ID NO: 355659 - DNA, 75 bp, Artificial Sequence
  Synthetic
ggtgaccgtttgggatccccccgaaggttctgaaccgtggtcactagttacagcgctgtgcgtgctttcgaatgt

SEQ ID NO: 355660 - DNA, 75 bp, Artificial Sequence
  Synthetic
cgaggaagcacagtgcataatgctgtgcagtgtcacattaatcgcatatcacactacatattaacaacactatat

SEQ ID NO: 355661 - DNA, 75 bp, Artificial Sequence
  Synthetic
gttcttgataagccgcagacagctgatgtgttccagaataaggtgaacgtctgctgggcgaaggctttagagcca

SEQ ID NO: 355662 - DNA, 75 bp, Artificial Sequence
  Synthetic
ctgctgggcgaaggctttagagccagtcttggccacggccaacattgtgctgacgagacagcagtgggagacgtt

SEQ ID NO: 355663 - DNA, 75 bp, Artificial Sequence
  Synthetic
accggcacagcctgtagggtcgcagaccctctaaaaaggctttttaagcttggaaaaccattgccagtcgatgac

SEQ ID NO: 355664 - DNA, 75 bp, Artificial Sequence
  Synthetic
gcacccattcaagcatgacagagcgtactcacctgaaatggcactgaacttcttttgcaccaggttctttggagt

SEQ ID NO: 355665 - DNA, 75 bp, Artificial Sequence
  Synthetic
ctcacaaagtcccaaccattggagtctatggagtgccaggttcaggtaaatctggaatcatcaaaagcgctgtga

SEQ ID NO: 355666 - DNA, 75 bp, Artificial Sequence
  Synthetic
tactcacctgaaatggcactgaacttcttttgcaccaggttctttggagtagacctggacagtgggttgttttcc

SEQ ID NO: 355667 - DNA, 75 bp, Artificial Sequence
  Synthetic
agacctggacagtgggttgttttccgctcctaccgtcgcacttacttacagggatcagcactgggataactcgcc

SEQ ID NO: 355668 - DNA, 75 bp, Artificial Sequence
  Synthetic
gcacagcctgtagggtcgcagaccctctaaaaaggctttttaagcttggaaaaccattgccagtcgatgacaccc

SEQ ID NO: 355669 - DNA, 75 bp, Artificial Sequence
  Synthetic
gggatcagcactgggataactcgccagggaagaacatgtatgggcttaatagagaggtagcaaaggagttgtcac

SEQ ID NO: 355670 - DNA, 75 bp, Artificial Sequence
  Synthetic
ctacaatcaggcaggcactgcagatgtcaccaaattccgttacatgtctttcgaccacgaccatgacatcaagga

SEQ ID NO: 355671 - DNA, 75 bp, Artificial Sequence
  Synthetic
agaagaagagtgctcctaagccaaaacctactcagcctaaaaagaagaagcagcaagccaagaggacgaaacgca

SEQ ID NO: 355672 - DNA, 75 bp, Artificial Sequence
  Synthetic
agcacatctggaccctgccgtcgtcttggccacaaagggtatttcctgttagctcaatgtcctccaggtgacagt

SEQ ID NO: 355673 - DNA, 75 bp, Artificial Sequence
  Synthetic
tactttcaccccaggcggttttgaatagtgaaaaactggcgtgtatccacccattggcggaacaagtactggtaa

SEQ ID NO: 355674 - DNA, 75 bp, Artificial Sequence
  Synthetic
ttggtgatcggcgatcctatcagcattccagggaagaaagtagagtccatgggtccattgcccactaataccatc

SEQ ID NO: 355675 - DNA, 75 bp, Artificial Sequence
  Synthetic
ttccagggaagaaagtagagtccatgggtccattgcccactaataccatcaggtgtgatctcgatttgggaatac

SEQ ID NO: 355676 - DNA, 75 bp, Artificial Sequence
  Synthetic
ctgcactatagatcacgcagtcgcactaaaagttcacacagctgctctgaaagtcggcctgcgtatagtatacgg

SEQ ID NO: 355677 - DNA, 75 bp, Artificial Sequence
  Synthetic
gggtccattgcccactaataccatcaggtgtgatctcgatttgggaatacctagccatgtcggtaaatatgacat

SEQ ID NO: 355678 - DNA, 75 bp, Artificial Sequence
  Synthetic
ggtagagaggagtacttgctcccacccatccatggaaagctggtaaagtgccacgtttacgatcacttgaaagag

SEQ ID NO: 355679 - DNA, 75 bp, Artificial Sequence
  Synthetic
tatatttgtcaatgttaggaccccgtacaagaaccatcactaccaacagtgcgaggatcacgctatccaccacag

SEQ ID NO: 355680 - DNA, 75 bp, Artificial Sequence
  Synthetic
cttaactttcaaacaacgagcacctaatccgccgccaggtccaccgccaaagaagaagaagagtgctcctgagcc

SEQ ID NO: 355681 - DNA, 75 bp, Artificial Sequence
  Synthetic
actttcaaacaacgatcacctaatccgccgccaggtccaccgccaaagaagaagaagagtgctcctaagccaaaa

SEQ ID NO: 355682 - DNA, 75 bp, Artificial Sequence
  Synthetic
gcaccgtggagaaaaagatcaggaggaagtttgtcggtagagaggagtacttgttcccacccgtccatggaaagc

SEQ ID NO: 355683 - DNA, 75 bp, Artificial Sequence
  Synthetic
cacctgaacactggcggaacatgtgtggctatagggtatgggcttgctgatcgcgcaaccgagaatatcatcact

SEQ ID NO: 355684 - DNA, 75 bp, Artificial Sequence
  Synthetic
tcgcgcaaccgagaatatcatcactgcggtggcacgctcatttaggtttacccgtgtctgtcagcctaagaacac

SEQ ID NO: 355685 - DNA, 75 bp, Artificial Sequence
  Synthetic
cccgtgtctgtcagcctaagaacactgccgaaaatactgaggttctcttcgtgttcttcggcaaggacaacggca

SEQ ID NO: 355686 - DNA, 75 bp, Artificial Sequence
  Synthetic
tccacttgaaaggaaagtctaacttcacaggtagatgtgggaccattgtcagctgtgaagggtacgtcatcaaaa

SEQ ID NO: 355687 - DNA, 75 bp, Artificial Sequence
  Synthetic
ccactattatcatcggcatccagtctacactgtcattgtgctgtgtggtgtcgctcttgctatcctggtaggcac

SEQ ID NO: 355688 - DNA, 75 bp, Artificial Sequence
  Synthetic
tgctgacaacgagaaaattggggctgcgagcagacgcaacagcagaatggattacagggactacatccaggaatt

SEQ ID NO: 355689 - DNA, 75 bp, Artificial Sequence
  Synthetic
gggagagtatgtccagcatccgctccaaatgcccagtagaggagtcagaggcgtctgctccacctcacacactgc

SEQ ID NO: 355690 - DNA, 75 bp, Artificial Sequence
  Synthetic
atagcaaaggtcaaccaggttccggagtgtgcggtgcactgtaccgaaaatggccggctgcttttgatagacagc

SEQ ID NO: 355691 - DNA, 75 bp, Artificial Sequence
  Synthetic
acgcacctacccaccgccaaaatgtttccataccctcagctgaactttccaccagtttaccctacaaatccgatg

SEQ ID NO: 355692 - DNA, 75 bp, Artificial Sequence
  Synthetic
gtacgtatggggcaaccatgaaccagtcagagtctgggcccaggagtcggcaccaggcgacccacatggatggcc

SEQ ID NO: 355693 - DNA, 75 bp, Artificial Sequence
  Synthetic
tgtgaagcacgaaccgctcatcatacatgctgtaggacccaatttttctaagatgccggaaccggagggcgacct

SEQ ID NO: 355694 - DNA, 75 bp, Artificial Sequence
  Synthetic
actgtcaaccggcatctattctggtggcaaagatcgagtgatgcaatcattgcatcacctgttcactgctttcga

SEQ ID NO: 355695 - DNA, 75 bp, Artificial Sequence
  Synthetic
tgcaccgaacgcaacggtacccacagcattagtggttttgtgctgcattcggccaaccaacgctgaaacacttgg

SEQ ID NO: 355696 - DNA, 75 bp, Artificial Sequence
  Synthetic
acgtggagcatccctagtgctcctggcttggacgtccaaataccttctgacgtcactgattcccactggagtgtt

SEQ ID NO: 355697 - DNA, 75 bp, Artificial Sequence
  Synthetic
gatgacaagccagtagacattgacttggtcagggtccacccaaacagctctttggcaggcagaccaggttactcc

SEQ ID NO: 355698 - DNA, 75 bp, Artificial Sequence
  Synthetic
ctaatcgatccaatatggaaagaattcacgttgacttagatgctgacagcccgtatgtcaagtcgttacagcgga

SEQ ID NO: 355699 - DNA, 75 bp, Artificial Sequence
  Synthetic
tttggcaggcagaccaggttactccgtcaatgagggcaagctgtattcatacctggaaggtacacgattccatca

SEQ ID NO: 355700 - DNA, 75 bp, Artificial Sequence
  Synthetic
ccaagtgcatcaggcttcgaagtgagaacaccatctgtacaggacctaactgcggagtgtgcaaagcctcgtggg

SEQ ID NO: 355701 - DNA, 75 bp, Artificial Sequence
  Synthetic
catgcaatgtggcccaacaaatctgaggctaatgagcagatttgcttgtacatcctgggggagagtatgtccagc

SEQ ID NO: 355702 - DNA, 75 bp, Artificial Sequence
  Synthetic
actgcagatgtcaccaaattccgttacatgtctttcgaccacgaccatgacatcaaggaagacagtatggagaaa

SEQ ID NO: 355703 - DNA, 75 bp, Artificial Sequence
  Synthetic
catcaaggaagacagtatggagaaaatagctattagcacatctggaccctgccgtcgtcttggccacaaagggta

SEQ ID NO: 355704 - DNA, 75 bp, Artificial Sequence
  Synthetic
gctatgacggctgagcgcgtatacaggttgcgctctgcgaagaaagaacagttcgccgtatgctcatcattcctg

SEQ ID NO: 355705 - DNA, 75 bp, Artificial Sequence
  Synthetic
ggtgtgtaccctttcatgtggggaggcgcacaatgcttctgtgacagtgagaacacacaactgagtgaggcatac

SEQ ID NO: 355706 - DNA, 75 bp, Artificial Sequence
  Synthetic
atgcagaaagacttaagaaaagtgacattaccgacaagaacatagcctctaaggcggcagacctgctggaagtca

SEQ ID NO: 355707 - DNA, 75 bp, Artificial Sequence
  Synthetic
gcgcacaatgcttctgtgacagtgagaacacacaactgagtgaggcatacgtcgagttcgctccagactgcacta

SEQ ID NO: 355708 - DNA, 75 bp, Artificial Sequence
  Synthetic
tacttgttcccacctgtccatggaaagctgttaaagtgccacatttacgatcacttgaaggagacgtctgccgga

SEQ ID NO: 355709 - DNA, 75 bp, Artificial Sequence
  Synthetic
agtcctgttttcaggcgtcgtaccaccggctgtacaccccaggaagtacgcggaaataattctagaaacgccacc

SEQ ID NO: 355710 - DNA, 75 bp, Artificial Sequence
  Synthetic
cagcacaggtattgtgagcacgcaaacgaagatgaacggctgcactaaagcaagacagtgcattgcctacacgcg

SEQ ID NO: 355711 - DNA, 75 bp, Artificial Sequence
  Synthetic
tgtgaacccactgtgccagaacgtatacccagtccgatttctagagcaccaagtgcggaatcactgctatcgttt

SEQ ID NO: 355712 - DNA, 75 bp, Artificial Sequence
  Synthetic
gagcgctacgatcgttttcaacgagagggagttcgtaaacagatacctgcaccacatcgcaatcaacggaggagc

SEQ ID NO: 355713 - DNA, 75 bp, Artificial Sequence
  Synthetic
tgtgaacccactgtgccagaacgtatacccagtccggtgatttctagagcaccaagtgcggaatcactgctatct

SEQ ID NO: 355714 - DNA, 75 bp, Artificial Sequence
  Synthetic
ggcggcgtctcgttctctagctctgccacacgctcgtcaaccgcctggagcgactatgacaggcggtttgtggtt

SEQ ID NO: 355715 - DNA, 75 bp, Artificial Sequence
  Synthetic
gcctctaaggcggcagacctgctggaagtcatgtcaacaccagacgcagagactccatctctgtgtatgcacaca

SEQ ID NO: 355716 - DNA, 75 bp, Artificial Sequence
  Synthetic
cttgtttacaactacgacttccctgagtatggtgctatgaaaccaggagcgttcggcgatattcaagcatcctct

SEQ ID NO: 355717 - DNA, 75 bp, Artificial Sequence
  Synthetic
acagctgacgtgcatcaagcgaacacgtctacgtggagcatccctagtgctcctggcttggacgtccagctgcct

SEQ ID NO: 355718 - DNA, 75 bp, Artificial Sequence
  Synthetic
acctccagttccaaagccacgcagaactaagtaccaacaaccaccaggagtcgctagagcgatctcagaagcgga

SEQ ID NO: 355719 - DNA, 75 bp, Artificial Sequence
  Synthetic
tcctggcttggacgtccagctgccttctgacgtcactgattcccactggagtattccaagtgcatcaggctttga

SEQ ID NO: 355720 - DNA, 75 bp, Artificial Sequence
  Synthetic
gtattccaagtgcatcaggctttgaagtgagaacaccatctgtacaggacctaactgcggagtgtgcgaagcctc

SEQ ID NO: 355721 - DNA, 75 bp, Artificial Sequence
  Synthetic
agtgagaacaccatctgtacaggacctaactgcggagtgtgcgaagcctcgtggactggccgaaataatgcaaga

SEQ ID NO: 355722 - DNA, 75 bp, Artificial Sequence
  Synthetic
ggatgtaaaattgaagtggagcctctgcgagcgtctaactgtgcttacgggcacatccctatctcgattgacatc

SEQ ID NO: 355723 - DNA, 75 bp, Artificial Sequence
  Synthetic
cttcaatactgctcctttccagtttctttcggaccacagaccagtaccggcaccacggagacgccccatcccatc

SEQ ID NO: 355724 - DNA, 75 bp, Artificial Sequence
  Synthetic
acacgaactgggctgacgagagagtattggaagcacgtaacattggcctcggtaactcagatcttcaggagagta

SEQ ID NO: 355725 - DNA, 75 bp, Artificial Sequence
  Synthetic
gtggactggccgaaataatgcaagacttcaatactgctcctttccagtttctttcggaccacagaccagtaccgg

SEQ ID NO: 355726 - DNA, 75 bp, Artificial Sequence
  Synthetic
ctttcggaccacagaccagtaccggcaccacggagacgccccatcccatcacctagatcgacggcttccgcacct

SEQ ID NO: 355727 - DNA, 75 bp, Artificial Sequence
  Synthetic
cactgcatcgtcagcagcttgtatcgccaaagcaagaagagactgcctgacgccatacgcgcttgcaccgaacgc

SEQ ID NO: 355728 - DNA, 75 bp, Artificial Sequence
  Synthetic
actgacggtatgaagcgggagcgtatattttctcatcggaaacaggccaaggtcaccttcaacagaaatcagtac

SEQ ID NO: 355729 - DNA, 75 bp, Artificial Sequence
  Synthetic
gaagaaggaaaactgcgcagaaatcatcagggatgtaaggaggatgagacgtatggatgttgctgctaggactgt

SEQ ID NO: 355730 - DNA, 75 bp, Artificial Sequence
  Synthetic
cactattatcatcggcatccagtctacactgtcattgtgctgtgtggtgtcgctcttgctatcctggtaggcact

SEQ ID NO: 355731 - DNA, 75 bp, Artificial Sequence
  Synthetic
tattttctcatcggaaacaggccaaggtcaccttcaacagaaatcagtacgtcaatgtaaactacaagaacctat

SEQ ID NO: 355732 - DNA, 75 bp, Artificial Sequence
  Synthetic
tagtttcgctatgcggcaagaagtccacctgcaatgctgaatgtaaaccaccggccgaccacataattggagaac

SEQ ID NO: 355733 - DNA, 75 bp, Artificial Sequence
  Synthetic
cagaaacatttggagaaactttgaatcatctgtggtttaacaaccaaccgtttctctgggcacagttgtgcatcc

SEQ ID NO: 355734 - DNA, 75 bp, Artificial Sequence
  Synthetic
ccggccgaccacataattggagaaccgcataaagtcgaccaagaattccaagcggcagtttccaaaacatcttgg

SEQ ID NO: 355735 - DNA, 75 bp, Artificial Sequence
  Synthetic
aatagaagcaggtatcaatcacgaaaagtagaaaatatgaaagcaattacagcggagcgactcatttctggattg

SEQ ID NO: 355736 - DNA, 75 bp, Artificial Sequence
  Synthetic
agcggagcgactcatttctggattgggcacatatctatcatcagaagtgaatcctgtcgagtgttacagagtcaa

SEQ ID NO: 355737 - DNA, 75 bp, Artificial Sequence
  Synthetic
ctgaagtgtaccataagagcatctctaggagatgcacacagactgtaaccgccatcgtctccacgctcttctatg

SEQ ID NO: 355738 - DNA, 75 bp, Artificial Sequence
  Synthetic
ttatcctgtaccaatctactcgtcaacggtaattaacaggtttacatctgcagaggtcgcggttaaaacgtgcaa

SEQ ID NO: 355739 - DNA, 75 bp, Artificial Sequence
  Synthetic
agggaagaacatgtatgggcttaacagagaggtagtaaaggagttgtcacggcgatatccgtgcatcacaaaagc

SEQ ID NO: 355740 - DNA, 75 bp, Artificial Sequence
  Synthetic
tcccgtataaggcgttggtcgaacgtgcaggttacgcgccacttaatctggagatcacggtcgtctcatcggaat

SEQ ID NO: 355741 - DNA, 75 bp, Artificial Sequence
  Synthetic
ggtggacggcgcatcgtgctgtctagatacagccactttttgtccggctaaactgagaagctacccaaagaagca

SEQ ID NO: 355742 - DNA, 75 bp, Artificial Sequence
  Synthetic
taacaccctcaactaacaaggagtacgtgacctgcaaattccacacagtcattccttcaccacaagttaaatgct

SEQ ID NO: 355743 - DNA, 75 bp, Artificial Sequence
  Synthetic
aggcagaagtagacctcattatgcaagaggcaggagcaggtagcgtggagacaccacgaggacacatcagggtga

SEQ ID NO: 355744 - DNA, 75 bp, Artificial Sequence
  Synthetic
agatgccggaaccggagggcgaccttaagctcgcagctgcctacatgagcatagcgtccatcgtcaacgctgaac

SEQ ID NO: 355745 - DNA, 75 bp, Artificial Sequence
  Synthetic
tcagccgtcccatcgcctatacagaatacattacaaaatgtattggctgcagctactaaaaggaattgcaacgtt

SEQ ID NO: 355746 - DNA, 75 bp, Artificial Sequence
  Synthetic
cctggataaagacacttacagctaaatatcccggggatttcacggcttcattggacgactggcagcgcgaacacg

SEQ ID NO: 355747 - DNA, 75 bp, Artificial Sequence
  Synthetic
gaacgtgttacttacacgcacagaaaaacgcattgtctggaagacgctagctggtgatccctggataaagacact

SEQ ID NO: 355748 - DNA, 75 bp, Artificial Sequence
  Synthetic
aaaaccattgccagtcgatgacacccaagactgtgaccgccgccgggcactgcatgatgaagcaacacgatggaa

SEQ ID NO: 355749 - DNA, 75 bp, Artificial Sequence
  Synthetic
tcacactacatattaacaacactatatcacttttataagactcactatgggtctctaatatacactacacatatt

SEQ ID NO: 355750 - DNA, 75 bp, Artificial Sequence
  Synthetic
ttgtttcaagaaatacgcatgcaatgatgagtattgggatacctttcgcgataaccctattcggctaactacaga

SEQ ID NO: 355751 - DNA, 75 bp, Artificial Sequence
  Synthetic
ttggacgactggcagcgcgaacacgacgccattatggcacgcgttcttgataagccgcagacagctgatgtattc

SEQ ID NO: 355752 - DNA, 75 bp, Artificial Sequence
  Synthetic
ctgaaagggccgaaagcagcagcattgtttgcgaaaactcacaatctaaaaccgttgcaggagataccaatggat

SEQ ID NO: 355753 - DNA, 75 bp, Artificial Sequence
  Synthetic
gtggagacaccacgaggacacatcagggtgacaagttacccaggcgaagagaagattgggtcttacgctgtactt

SEQ ID NO: 355754 - DNA, 75 bp, Artificial Sequence
  Synthetic
tgtttgcgaaaactcacaatctaaaaccgttgcaggagataccaatggatcaattcgtcatggatctaaaaagag

SEQ ID NO: 355755 - DNA, 75 bp, Artificial Sequence
  Synthetic
cgttacccaaatgcgagaattacctgtcttagattcggcggcatttaacgttgattgtttcaagaaatacgcatg

SEQ ID NO: 355756 - DNA, 75 bp, Artificial Sequence
  Synthetic
ccgtgtatcacaaaagcggtcgacacaggcagggtagctgatataaggaataatactatcaaggactactctcca

SEQ ID NO: 355757 - DNA, 75 bp, Artificial Sequence
  Synthetic
caggttattcaggctgcagacccccttgctaccgcttacctttgcgggatccatcgggaattagtccgtagactg

SEQ ID NO: 355758 - DNA, 75 bp, Artificial Sequence
  Synthetic
aggtcgagccataccacggtaaggtcattgtaccagaagggacggcggtccctgttcaagacttccaggcattga

SEQ ID NO: 355759 - DNA, 75 bp, Artificial Sequence
  Synthetic
gacgttccccagaatatgaaatcagacacgctgcagtacaccagcgacaaaccaccgggcttctacaactggcac

SEQ ID NO: 355760 - DNA, 75 bp, Artificial Sequence
  Synthetic
tgaccacaaaggacagggtgcaactgatcacagcggatttctatctaagatgaagggcaaatctgtgttggtgat

SEQ ID NO: 355761 - DNA, 75 bp, Artificial Sequence
  Synthetic
catttccaccacggcgacccagtattggaaacggacatcgcgtcgtttgataaaagcgaagacgacgctatcgcc

SEQ ID NO: 355762 - DNA, 75 bp, Artificial Sequence
  Synthetic
tataaggaataatactatcaaggactactctccaacaattaatgtggttccattaaatcgccggttgccccactc

SEQ ID NO: 355763 - DNA, 75 bp, Artificial Sequence
  Synthetic
acttaggcgtcgaccaaccgctcttagatttgatagaggcggcgttcggcaatatcacatctgtgcacctaccta

SEQ ID NO: 355764 - DNA, 75 bp, Artificial Sequence
  Synthetic
agaagacgcaggtccgttgtgcctaaccggtgatctggtagatccgccatttcacgagtttgcgtacgagagtct

SEQ ID NO: 355765 - DNA, 75 bp, Artificial Sequence
  Synthetic
gctgttttgaaggaagcgaccacacatgtgactgccacaggcagcataacactgcattttagcacatcgagccca

SEQ ID NO: 355766 - DNA, 75 bp, Artificial Sequence
  Synthetic
gactgcatttattctgcagactttggtggttcgctaacattacagtacaaagctgacagggagggacattgtcca

SEQ ID NO: 355767 - DNA, 75 bp, Artificial Sequence
  Synthetic
acgctgtttgtcaacacactagtcaatatcatgattgctagcagagtactacgtgaacggttaaccacgtcagcg

SEQ ID NO: 355768 - DNA, 75 bp, Artificial Sequence
  Synthetic
acgtgaacggttaaccacgtcagcgtgcgcggcctttatcggcgacgataacatagtgcatggtgtcgtctccga

SEQ ID NO: 355769 - DNA, 75 bp, Artificial Sequence
  Synthetic
acatagtgcatggtgtcgtctccgacaccttgatggcggagagatgcgccacttggctgaacatggaagtaaaaa

SEQ ID NO: 355770 - DNA, 75 bp, Artificial Sequence
  Synthetic
acgctcatttaggtttacccgtgtctgtcagcctaagaacactgccgaaaatactgaggttctcttcgtgttctt

SEQ ID NO: 355771 - DNA, 75 bp, Artificial Sequence
  Synthetic
acttggctgaacatggaagtaaaaattattgatgcagttattggtatcaaagcaccctacttctgcgggggattt

SEQ ID NO: 355772 - DNA, 75 bp, Artificial Sequence
  Synthetic
agcaccctacttctgcgggggatttatcctggtggaccagataacaggcacagcctgcagggtcgcagaccctct

SEQ ID NO: 355773 - DNA, 75 bp, Artificial Sequence
  Synthetic
cgtgttcttcggcaaggacaacggcaaccacacacacgaccaggacagactcagtgtagtgcttgacaacatcta

SEQ ID NO: 355774 - DNA, 75 bp, Artificial Sequence
  Synthetic
acgaatgtaagtgtggcgactacagcacaggtattgtgagcacgcgaacgaagatgaacggctgcactaaagcaa

SEQ ID NO: 355775 - DNA, 75 bp, Artificial Sequence
  Synthetic
gggagagccccagcatacagagtgatcagaggtgacattagcaagagcgctgaccaagctatcgttaatgctgct

SEQ ID NO: 355776 - DNA, 75 bp, Artificial Sequence
  Synthetic
ataatgctgtgcagtgtcacattaatcgtatatcacactacatattaacaacactatatcacttttatgagactc

SEQ ID NO: 355777 - DNA, 75 bp, Artificial Sequence
  Synthetic
ccataccctcagctgaactttccaccagtttaccctacaaatccgatggcttaccgagatccaaaccctcctagg

SEQ ID NO: 355778 - DNA, 75 bp, Artificial Sequence
  Synthetic
gccattatggcacgcgttcttgataagccgcagacagctgatgtgttccagaataaggtgaacgtctgctgggcg

SEQ ID NO: 355779 - DNA, 75 bp, Artificial Sequence
  Synthetic
actaatcgatccaatatggaaagaattcacgttgacttagatgctgacagcccgtatgtcaagtcgttacagcgg

SEQ ID NO: 355780 - DNA, 75 bp, Artificial Sequence
  Synthetic
aaaaacactatacacactttataaattcttttataattttttttcttttgtttttattttgtttttaaaatttca

SEQ ID NO: 355781 - DNA, 75 bp, Artificial Sequence
  Synthetic
tgtatgaagttggagtcggacaagacatttccgatcatgctgaacggccaagtgaatggatacgcttgcgttgtc

SEQ ID NO: 355782 - DNA, 75 bp, Artificial Sequence
  Synthetic
gagtatggcgacgttccccagaatatgaaatcagacacgctgcagtacaccagcgacaaaccaccgggcttctac

SEQ ID NO: 355783 - DNA, 75 bp, Artificial Sequence
  Synthetic
acgttgaaggaaaaattgataatgagcaattagcggccgtgaaattgaagaaggctagcatgtacgacttggagt

SEQ ID NO: 355784 - DNA, 75 bp, Artificial Sequence
  Synthetic
gcaattagcggccgtgaaattgaagaaggctagcatgtacgacttggagtatggcgacgttccccagaatatgaa

SEQ ID NO: 355785 - DNA, 75 bp, Artificial Sequence
  Synthetic
gacaaaccaccgggcttctacaactggcaccacggcgcagtccagtatgagaatgggagattcaccgtaccgaga

SEQ ID NO: 355786 - DNA, 75 bp, Artificial Sequence
  Synthetic
ccaggcgcttaaaggagttaggacaatttactggataggctttgacacgaccccttttatgtacaaaaacatggc

SEQ ID NO: 355787 - DNA, 75 bp, Artificial Sequence
  Synthetic
ggagtgggcgggaaaggcgacagcggaagaccgatcctggacaacagaggcagagttgtggctattgttctagga

SEQ ID NO: 355788 - DNA, 75 bp, Artificial Sequence
  Synthetic
gaagaccgatcctggacaacagaggcagagttgtggctattgttctaggaggtgcaaatgagggcacgcgtacgg

SEQ ID NO: 355789 - DNA, 75 bp, Artificial Sequence
  Synthetic
aactgggctgacgagagagtattggaagcacgtaacattggcctcggtaactcagatcttcaggagagcaggctt

SEQ ID NO: 355790 - DNA, 75 bp, Artificial Sequence
  Synthetic
aagcacgtaacattggcctcggtaactcagatcttcaggagagcaggcttggaaaactctcaatccttaggaaga

SEQ ID NO: 355791 - DNA, 75 bp, Artificial Sequence
  Synthetic
tcgttgaccacaaaggacagggtacaactgatcacagcggattcctatctaagatgaagggcaaatctgtgttgg

SEQ ID NO: 355792 - DNA, 75 bp, Artificial Sequence
  Synthetic
ccacccgtgtgctattcactggcgccagaacgaacactcgacgtgctcgaagagaacgtcgacaatccaaattac

SEQ ID NO: 355793 - DNA, 75 bp, Artificial Sequence
  Synthetic
ccacttgaaaggaaagtctaacttcacaggtagatgtgggaccattgtcagctgtgaagggtacgtcataaaaaa

SEQ ID NO: 355794 - DNA, 75 bp, Artificial Sequence
  Synthetic
cgtattgcagacactcaacgccgtgtttcagcccaataaaaattgagaacgtgtgggacgaatctgatgatggat

SEQ ID NO: 355795 - DNA, 75 bp, Artificial Sequence
  Synthetic
tttcagcccaataaaaattgagaacgtgtgggacgaatctgatgatggatcgattagaatccaggtctcggcaca

SEQ ID NO: 355796 - DNA, 75 bp, Artificial Sequence
  Synthetic
gcaccgtggagagaaagatcaggaggaagtttgtcggtagagaggagtacttgctcccacccatccatggaaagc

SEQ ID NO: 355797 - DNA, 75 bp, Artificial Sequence
  Synthetic
accgcgcacctggatacgttcgtcaacggcgtcacgccaggttcctcacgggacctgaaggtcatagcagggccg

SEQ ID NO: 355798 - DNA, 75 bp, Artificial Sequence
  Synthetic
gtgtgggacgaatctgatgatggatcgattagaatccaggtctcggcacaattcggctacaatcaggcaggcact

SEQ ID NO: 355799 - DNA, 75 bp, Artificial Sequence
  Synthetic
gcagatgtcaccaaattccgttacatgtctttcgaccacgaccatgacatcaaggaagacagcatggagaaaata

SEQ ID NO: 355800 - DNA, 75 bp, Artificial Sequence
  Synthetic
tccaaagccacgcaggactaagtaccaacaaccaccaggagtcgctagagcgatctcagaagcggagttggacga

SEQ ID NO: 355801 - DNA, 75 bp, Artificial Sequence
  Synthetic
actatctattaccagtggtcgcccaggcgttttccaggtgggcgcgtgaacatcgtgccgacttggacgacgaga

SEQ ID NO: 355802 - DNA, 75 bp, Artificial Sequence
  Synthetic
gtcgtcttggccacaaagggtacttcctgttagctcaatgtcctccaggtgacagtgtaaccgtcagtatcacga

SEQ ID NO: 355803 - DNA, 75 bp, Artificial Sequence
  Synthetic
acattttaaccatgacatatgcactgaagtgtaccataaaagcatctctaggaggtgcacacagactgtaaccgc

SEQ ID NO: 355804 - DNA, 75 bp, Artificial Sequence
  Synthetic
ttgaagtgagaacaccatctatacaggacctaactgcggagtgtgcgaagcctcgcggactggccgaaataatgc

SEQ ID NO: 355805 - DNA, 75 bp, Artificial Sequence
  Synthetic
ggacctaactgcggagtgtgcgaagcctcgcggactggccgaaataatgcaagacttcaataccgctcccttcca

SEQ ID NO: 355806 - DNA, 75 bp, Artificial Sequence
  Synthetic
cctgttagctcaatgtcctccaggtgacagtgtaaccgtcagtatcacgagcggagcatctgagaattcatgcac

SEQ ID NO: 355807 - DNA, 75 bp, Artificial Sequence
  Synthetic
tttgtcggtagagaggagtacttgctcccacccgtccatggaaagctggtaaagtgccacgtttacgatcacttg

SEQ ID NO: 355808 - DNA, 75 bp, Artificial Sequence
  Synthetic
tcccacccgtccatggaaagctggtaaagtgccacgtttacgatcacttgaaggagacgtctgccgggtacataa

SEQ ID NO: 355809 - DNA, 75 bp, Artificial Sequence
  Synthetic
aaagtgccacgtttacgatcacttgaaggagacgtctgccgggtacataaccatgcacaggccaggcccacacgc

SEQ ID NO: 355810 - DNA, 75 bp, Artificial Sequence
  Synthetic
ccatgcacaggccaggcccacacgcgtataagtcctatctggaggaagcgtcaggcgaagtgtacattaaaccac

SEQ ID NO: 355811 - DNA, 75 bp, Artificial Sequence
  Synthetic
ccgccgtaggctcaagctgctgcttgaaccaactgtcaaacccgcaccggctattacaatggccgatgtggagca

SEQ ID NO: 355812 - DNA, 75 bp, Artificial Sequence
  Synthetic
tcaggcgaagtgtacattaaaccaccttctggcaagaacgtcacctacgaatgtaagtgtggcgactacagcaca

SEQ ID NO: 355813 - DNA, 75 bp, Artificial Sequence
  Synthetic
atgtaagtgtggcgactacagcacaggtatcgtgagcacgcgaacgaagatgaacggctgcactaaagcaaaaca

SEQ ID NO: 355814 - DNA, 75 bp, Artificial Sequence
  Synthetic
tgaacggctgcactaaagcaaaacagtgcattgcctacaagagcgaccaaacgaaatgggtcttcaactcgccgg

SEQ ID NO: 355815 - DNA, 75 bp, Artificial Sequence
  Synthetic
acgaaatgggtcttcaactcgccggatcttattaggcacacagaccactcagtgcaaggtaaactgcacattcca

SEQ ID NO: 355816 - DNA, 75 bp, Artificial Sequence
  Synthetic
agtgcaaggtaaactgcacattccattccgcttgacaccgacagtctgcccggttccgttagctcacacgcctac

SEQ ID NO: 355817 - DNA, 75 bp, Artificial Sequence
  Synthetic
tacaaagtcgagccataccacggtaaggtcattgtaccagaagggacggcggtccctgttcaagacttccaggca

SEQ ID NO: 355818 - DNA, 75 bp, Artificial Sequence
  Synthetic
ccaggcggtattgaatagtgaaaaactggcgtgtatccacccattggcggaacaagtactggtaatgactcacaa

SEQ ID NO: 355819 - DNA, 75 bp, Artificial Sequence
  Synthetic
agtcacgaagtggttcaaaggcatcaccctccacctgactgcaacgcgaccaacattgctgacaacgagaaaatt

SEQ ID NO: 355820 - DNA, 75 bp, Artificial Sequence
  Synthetic
tggcagctcttattattctgttccgctgcttttcatgctgcatgccttttttattggttgcaggcgtctgcctgg

SEQ ID NO: 355821 - DNA, 75 bp, Artificial Sequence
  Synthetic
ttaacaccctcaactaacaaggagtacgtgacctgcaaattccacacagtcattccttcaccacaagttaaatgc

SEQ ID NO: 355822 - DNA, 75 bp, Artificial Sequence
  Synthetic
gctggagtacgtatggggcaaccatgaaccagtcagagtctgggcccaggagtcggcaccaggcgacccacatgg

SEQ ID NO: 355823 - DNA, 75 bp, Artificial Sequence
  Synthetic
ttacttaaaaacactatacacactttataagttcttttataatttttcttttgtttttattttgtttttaaaatt

SEQ ID NO: 355824 - DNA, 75 bp, Artificial Sequence
  Synthetic
agtcggcaccaggcgacccacatggatggccgcatgagatcatcatccactattatcatcggcatccagtctaca

SEQ ID NO: 355825 - DNA, 75 bp, Artificial Sequence
  Synthetic
tctagaaacgccaccaccgccagtaacgacaaccgtaatatgtgaacccactgtgccagaacgtatacccagtcc

SEQ ID NO: 355826 - DNA, 75 bp, Artificial Sequence
  Synthetic
caagaagagactgcctgacgccatacgcgcttgcaccgaacgcaacggtacccacagcattagcggttttgtgct

SEQ ID NO: 355827 - DNA, 75 bp, Artificial Sequence
  Synthetic
cacgaccagcagcacctcacaaagtcccaaccatcggagtctatggagtgccaggttcaggtaaatctggaatca

SEQ ID NO: 355828 - DNA, 75 bp, Artificial Sequence
  Synthetic
gcattcggccaaccaacgctgaaacatttggagaaactttgaaccatctgtggtttaacaaccaaccgtttctct

SEQ ID NO: 355829 - DNA, 75 bp, Artificial Sequence
  Synthetic
atttggagaaactttgaaccatctgtggtttaacaaccaaccgtttctctgggcacagttgtgcattcctctggc

SEQ ID NO: 355830 - DNA, 75 bp, Artificial Sequence
  Synthetic
aactgcgcagaaatcatcagggatgtaaggaggatgagatgtatggatgttgctgctaggactgtagattcagtg

SEQ ID NO: 355831 - DNA, 75 bp, Artificial Sequence
  Synthetic
ttttcatgctgcatgccttttttattggttgcaggcgtctgcctggggaaggtagacgccttcgaacatgcgacc

SEQ ID NO: 355832 - DNA, 75 bp, Artificial Sequence
  Synthetic
tggttgcaggcgtctgcctggggaaggtagacgccttcgaacatgcgaccactgtgccaaatgttccggggatcc

SEQ ID NO: 355833 - DNA, 75 bp, Artificial Sequence
  Synthetic
actgcccctttccagtttctttcggaccacagaccagtaccggcaccacggagacgccccatcccatcacctaga

SEQ ID NO: 355834 - DNA, 75 bp, Artificial Sequence
  Synthetic
ggatccatcgagaattggtccgtagactgaatgcggtgcttctgccaaatatccatactctcttcgacatgtcag

SEQ ID NO: 355835 - DNA, 75 bp, Artificial Sequence
  Synthetic
actgaatgcggtgcttctgccaaatatccatactctcttcgacatgtcagcggaagattttgatgcgattattgc

SEQ ID NO: 355836 - DNA, 75 bp, Artificial Sequence
  Synthetic
ccttcaccacaagttaaatgctgcgggtccctcgagtgtaaggcatcctcaaaggcggattacacatgccgcgtt

SEQ ID NO: 355837 - DNA, 75 bp, Artificial Sequence
  Synthetic
accatgacatatgcactgaagtgtaccataaaagcatctctaggaggtgcacacagactgtaaccgccatcgtct

SEQ ID NO: 355838 - DNA, 75 bp, Artificial Sequence
  Synthetic
ccacacacatgaccaggacagactcggtgtagtgcttgacaacatctaccaagggtcaaccaggtacgaggcagg

SEQ ID NO: 355839 - DNA, 75 bp, Artificial Sequence
  Synthetic
cgggccgtccatgagaagtattacgccccgcgcctcgatctcgaaagagagaaaatgttacagaagaaactgcaa

SEQ ID NO: 355840 - DNA, 75 bp, Artificial Sequence
  Synthetic
gtcctgttttcaggcgtcgtaccaccggctgtacaccccaggaagtacgcggaaataattctagaaacgccacca

SEQ ID NO: 355841 - DNA, 75 bp, Artificial Sequence
  Synthetic
aaaagttcacacagctgctctgaaagtcggcctgcgtatagtatacggcaataccaccgcgcacctggatacgtt

SEQ ID NO: 355842 - DNA, 75 bp, Artificial Sequence
  Synthetic
gtcggcctgcgtatagtatacggcaataccaccgcgcacctggatacgttcgtcaatggcgtcacgccaggttcc

SEQ ID NO: 355843 - DNA, 75 bp, Artificial Sequence
  Synthetic
tcacgggacctgaaggtcatagcagggccgatatcagccgctttttcaccctttgaccataaggtcgtcatcaga

SEQ ID NO: 355844 - DNA, 75 bp, Artificial Sequence
  Synthetic
aattacggacgagttggtgaaggccgtagaatccagatacgagatcatactggcaggcctgatcatcacgtctct

SEQ ID NO: 355845 - DNA, 75 bp, Artificial Sequence
  Synthetic
tagcccgcactgacatacggctgctgaagccttctgtcaagaacatccacgtcccctacacccaagcagtatcag

SEQ ID NO: 355846 - DNA, 75 bp, Artificial Sequence
  Synthetic
gaagccttctgtcaagaacatccacgtcccctacacccaagcagtatcagggtatgaaatgtggaagaacaactc

SEQ ID NO: 355847 - DNA, 75 bp, Artificial Sequence
  Synthetic
caagactgcgaccgccgccgggcactgcatgatgaagcaatgcgatggaacagaattggaattacggacgagttg

SEQ ID NO: 355848 - DNA, 75 bp, Artificial Sequence
  Synthetic
attgcttggataaacaatgggagaccaggataatcgaggccattcaccgcaaagaaagcgtcgaaatactggatg

SEQ ID NO: 355849 - DNA, 75 bp, Artificial Sequence
  Synthetic
ttgcagccagagataagatcagccgtcccatcgcctatacagaatacattacaaaatgtattggctgcagctact

SEQ ID NO: 355850 - DNA, 75 bp, Artificial Sequence
  Synthetic
aaagaaagcgtcgaaatactggatgatgacaagccagtagacattgacttggtcagggtccacccaaacagctct

SEQ ID NO: 355851 - DNA, 75 bp, Artificial Sequence
  Synthetic
gaaatggcactgaacttcttttgcaccaggttctttggagtagacctggacagtgggttgttttccgctccaacc

SEQ ID NO: 355852 - DNA, 75 bp, Artificial Sequence
  Synthetic
gatcatcagaatcaccaacaattttagaagttagctgcacagtagcagactgcatttattctgcagactttggtg

SEQ ID NO: 355853 - DNA, 75 bp, Artificial Sequence
  Synthetic
tgcatttattctgcagactttggtggttctctaacattacagtacaaagctgacagggagggacattgtccagtt

SEQ ID NO: 355854 - DNA, 75 bp, Artificial Sequence
  Synthetic
tgacagggagggacattgtccagttcactcccactccacgacagctgttttgaaggaagcgaccacacatgtgac

SEQ ID NO: 355855 - DNA, 75 bp, Artificial Sequence
  Synthetic
aggcagggtagctgatataaggaataataccatcaaggactactctccaacaattaatgtggttccattaaatcg

SEQ ID NO: 355856 - DNA, 75 bp, Artificial Sequence
  Synthetic
tgaaggaagcgaccacacatgtgactgccgtaggcagcataacactacattttagcacatcgagcccacaagcaa

SEQ ID NO: 355857 - DNA, 75 bp, Artificial Sequence
  Synthetic
gagaaccacataaagtcgaccaagaattccaggcggcagtttccaaaacatcttggaactggctgcttgcactgt

SEQ ID NO: 355858 - DNA, 75 bp, Artificial Sequence
  Synthetic
attccaggcggcagtttccaaaacatcttggaactggctgcttgcactgtttgggggagcatcatccctcattgt

SEQ ID NO: 355859 - DNA, 75 bp, Artificial Sequence
  Synthetic
gaattagtccgtagactgaatgctgtgcttctgccgaatatccatactctcttcgacatgtcagcggaagatttt

SEQ ID NO: 355860 - DNA, 75 bp, Artificial Sequence
  Synthetic
ttgggggagcatcatccctcattgttgtaggacttatagtgttggtctgcagctctatgcttataaacacacgta

SEQ ID NO: 355861 - DNA, 75 bp, Artificial Sequence
  Synthetic
aggaagcgtggtgcataatgccacgcgccgcttgacactaaaactcgatgtatttccgaggaagcacagtgcata

SEQ ID NO: 355862 - DNA, 75 bp, Artificial Sequence
  Synthetic
acgctatccaccacagcatgctaacgtgtaaggctgtccaccacctgaacactggcggaacatgtgtggctatag

SEQ ID NO: 355863 - DNA, 75 bp, Artificial Sequence
  Synthetic
aaacatacagaggagcggcctaaggtgcaggttattcaggctgcagatccccttgctaccgcttacctttgcggg

SEQ ID NO: 355864 - DNA, 75 bp, Artificial Sequence
  Synthetic
atgggtctctaatatacactacacatattttacttaaaaacactatacacactttataaattcttttataatttt

SEQ ID NO: 355865 - DNA, 75 bp, Artificial Sequence
  Synthetic
cacgtctacgtggagcatccctagtgctcctggcttggacgtccagatgccttctgacgtcactgattcccactg

SEQ ID NO: 355866 - DNA, 75 bp, Artificial Sequence
  Synthetic
cagcgtacagagtgatcagaggtgacattagcaagagcgctgaccaagctatcgttaatgctgctaatagcaaag

SEQ ID NO: 355867 - DNA, 75 bp, Artificial Sequence
  Synthetic
cagagactccatctctgtgtatgcacacagacgccacgtgtaggtactttggaagtgtagcagtataccaagatg

SEQ ID NO: 355868 - DNA, 75 bp, Artificial Sequence
  Synthetic
ctggaagtcatgtcaacaccagacgcagagactccatctctgtgtatgcacacagacgccacgtgtaggtacttt

SEQ ID NO: 355869 - DNA, 75 bp, Artificial Sequence
  Synthetic
actgagtgagagcgccacgatcgttttcaacgagagggagttcgtaaacagatatttgcaccacatcgcaatcaa

SEQ ID NO: 355870 - DNA, 75 bp, Artificial Sequence
  Synthetic
aacgaagcattaccgatgacttcacactgaccagtccctacctggggttctgcccgtattgcagagactcaacgc

SEQ ID NO: 355871 - DNA, 75 bp, Artificial Sequence
  Synthetic
tcctggtggaccagataacaggcacagcctgcagggtcgcagaccctctaaaaaggctttttaagcttggaaaac

SEQ ID NO: 355872 - DNA, 75 bp, Artificial Sequence
  Synthetic
tcgaggccattcaccgcaaagaaagcgtcgaaatactggatgatgacaagccagtagacattgacttggtcaggg

SEQ ID NO: 355873 - DNA, 75 bp, Artificial Sequence
  Synthetic
gatccaaaccctcctaggcgccgctggaggccgtttcggcccccgctggctgctcaaatcgaagatcttaggagg

SEQ ID NO: 355874 - DNA, 75 bp, Artificial Sequence
  Synthetic
caagaagctgaagaagtggctgcagcggaagagatcagagaagccctgccacccttgctccctgaaatagaaaaa

SEQ ID NO: 355875 - DNA, 75 bp, Artificial Sequence
  Synthetic
cgttaagaacttcaagagcataagagggaacccaatcaccctctacggctgacctaaataggtgacgtagtagac

SEQ ID NO: 355876 - DNA, 75 bp, Artificial Sequence
  Synthetic
tagcgtggagacaccacgaggacacatcagggtgacaagttacccaggtgaagagaagattgggtcttacgctat

SEQ ID NO: 355877 - DNA, 75 bp, Artificial Sequence
  Synthetic
gggaaacgacagcgtatgtgtatgaagttggagtcggacaagacatttccgatcatgctgaacggccaagtgaat

SEQ ID NO: 355878 - DNA, 75 bp, Artificial Sequence
  Synthetic
agtgaaaaactggcgtgtatccacccattggcggaacaagtactggtaatgactcacaaaggtagggctgggcga

SEQ ID NO: 355879 - DNA, 75 bp, Artificial Sequence
  Synthetic
ctactcagcctaaaaagaagaagcagcaagccaagaagacgaaacgcaagcctaaaccagggaaacgacagcgta

SEQ ID NO: 355880 - DNA, 75 bp, Artificial Sequence
  Synthetic
ctgcgaagaaagaacagttcgccgtatgctcatcattcctgttgccgaagtacaggatcacaggcgtgcagaagc

SEQ ID NO: 355881 - DNA, 75 bp, Artificial Sequence
  Synthetic
tacaaagtcgagccataccacggtaaggtcattgtaccagaagggacggcggtccctgttcaagactttcaggca

SEQ ID NO: 355882 - DNA, 75 bp, Artificial Sequence
  Synthetic
tcggaggaaggctgatgaaaccactccacgttgaaggaaaaatcgataatgagcaattagcggccgtgaaattga

SEQ ID NO: 355883 - DNA, 75 bp, Artificial Sequence
  Synthetic
cagggaagaacatgtatgggcttaatagagaggtagcaaaggagctgtcacggcgatatccgtgcatcacaaaag

SEQ ID NO: 355884 - DNA, 75 bp, Artificial Sequence
  Synthetic
gtggctattgttctaggaggtgcaaatgagggcacgcgtacggcgctttcagtggtcacttggaaccagaaaggg

SEQ ID NO: 355885 - DNA, 75 bp, Artificial Sequence
  Synthetic
gctgatcgttgaccacaaaggacagggtacaactgatcacagtggatttctatctaagatgaatggcaaatctgt

SEQ ID NO: 355886 - DNA, 75 bp, Artificial Sequence
  Synthetic
gtctcgttctctagctctgccacacgctcgtcaaccgcctggagcgactatgacaggcggtttgtggttacagct

SEQ ID NO: 355887 - DNA, 75 bp, Artificial Sequence
  Synthetic
ttctttaacatgatgtgcctgaaagtacattttaaccatgacatatgcactgaagtgtaccacaaaagcatctct

SEQ ID NO: 355888 - DNA, 75 bp, Artificial Sequence
  Synthetic
agtatattctgcgtgctaatcgttcgacgttagtccgtggagtgagcttctaatagagttgttaacacgtttgaa

SEQ ID NO: 355889 - DNA, 75 bp, Artificial Sequence
  Synthetic
ttttctcatccattgcaaaagctgtgcacacagtctttggtgctgccttccatgcaatttttggtggtctcagtt

SEQ ID NO: 355890 - DNA, 75 bp, Artificial Sequence
  Synthetic
taatttctactgaaaggagtagaagaaaggagattcattcccaatggcaacaaaggggatgaataagtctcgggc

SEQ ID NO: 355891 - DNA, 75 bp, Artificial Sequence
  Synthetic
ggataaccaagatattgattggagggttgctcatctggctgggtctcaactctcggagtagttcaatgtcaatgg

SEQ ID NO: 355892 - DNA, 75 bp, Artificial Sequence
  Synthetic
tcgatcccgaggcgtcaatatggtagcggctagagtgaagaacctagccgttaaagtaaaaaacaaaacaaaaca

SEQ ID NO: 355893 - DNA, 75 bp, Artificial Sequence
  Synthetic
gcttcatatgcattggagccttgctgcttgtgctggccacaggagttggagcagaagtgggttgctccttgagtt

SEQ ID NO: 355894 - DNA, 75 bp, Artificial Sequence
  Synthetic
aagtgcaagaggtttgcgagggttcctcttgtttctagtggcccaaattttctgggctagaaaactaaccccgca

SEQ ID NO: 355895 - DNA, 75 bp, Artificial Sequence
  Synthetic
ggaagcaacgtgaaatgaaatgtggggatggtgtttttgtctttaaggattctgatgattggttttccaaatacc

SEQ ID NO: 355896 - DNA, 75 bp, Artificial Sequence
  Synthetic
ggttaaaagattgtggagaatggtggacaaagtgcaagggctccggatcttgaagaatatcaggaacattgttac

SEQ ID NO: 355897 - DNA, 75 bp, Artificial Sequence
  Synthetic
agtacattccagaagatccaaaaacaatggccaccttgattcatcaagcccaccaggatggactatgtggtttga

SEQ ID NO: 355898 - DNA, 75 bp, Artificial Sequence
  Synthetic
caatctgatgaagggactggctggtcgcaagaagaagcgaagcttgacagtgcccttggttcttctgctggttcc

SEQ ID NO: 355899 - DNA, 75 bp, Artificial Sequence
  Synthetic
gttctgtcagcgacctggaacatcgaatgtggtattctagagtcgacgagataaacgccatcttggatgaaaatg

SEQ ID NO: 355900 - DNA, 75 bp, Artificial Sequence
  Synthetic
actgcttgcctactcagctactgttacccgtcaacgcggattggggcttttgctcaacgtcactttcgctgatgt

SEQ ID NO: 355901 - DNA, 75 bp, Artificial Sequence
  Synthetic
aagtggatctcacagtggttgtccaagaatcagatgccgtgtacctgcgaggatcgcatgctttccctcggccaa

SEQ ID NO: 355902 - DNA, 75 bp, Artificial Sequence
  Synthetic
tgggaaaacctatgaggttgaggggggcaattgctctgtcaacaccttggacgcaggcaaatggtgtgaagacta

SEQ ID NO: 355903 - DNA, 75 bp, Artificial Sequence
  Synthetic
aaagtgaattgaagtatggatggaagacttggggaaaaaacatcatctttaatccatctagaaaaaatggtacat

SEQ ID NO: 355904 - DNA, 75 bp, Artificial Sequence
  Synthetic
tgtggagtatgagtgcgtcactctctctgagggtgaagagcctgatgacctggattgttggtgctacggagtgga

SEQ ID NO: 355905 - DNA, 75 bp, Artificial Sequence
  Synthetic
tcatcattgatggaaaaagtaaagcagaatgccccttcaacaagagagtgtggaactcaatacgggttgaggagt

SEQ ID NO: 355906 - DNA, 75 bp, Artificial Sequence
  Synthetic
caatgttcgtgtcacctacggaagatgcaagagtggtggttcacgaagatcgaggcgttctgccgtcataactcc

SEQ ID NO: 355907 - DNA, 75 bp, Artificial Sequence
  Synthetic
ttggcacaggagtttaccagacaagagtcttcatgagaccggaatttgattacaccaaactgtgtgacacgggaa

SEQ ID NO: 355908 - DNA, 75 bp, Artificial Sequence
  Synthetic
acatgtagacaaaggactcactactagacaggaaaagtggctgcccacaaagattggcgaacagcaactgcagaa

SEQ ID NO: 355909 - DNA, 75 bp, Artificial Sequence
  Synthetic
ctttgggagctgctgttaaaggtagcgtttcagctcacggagaccccatgttctggatggaatcagaagagatca

SEQ ID NO: 355910 - DNA, 75 bp, Artificial Sequence
  Synthetic
agtggaaaagtggattatgagaaatcctctttatgcacttggggcggtggctttagcatattttgttggcacatc

SEQ ID NO: 355911 - DNA, 75 bp, Artificial Sequence
  Synthetic
atggcacatggatgatcacgaccttggaagcattaaattaccgtgagtgtgaatggcctagttcacacacactgg

SEQ ID NO: 355912 - DNA, 75 bp, Artificial Sequence
  Synthetic
aaatgtgcagagggtggttattgccatcctgctgctcggcattggaccagcttattcaacacactgcctgggaat

SEQ ID NO: 355913 - DNA, 75 bp, Artificial Sequence
  Synthetic
atggagcaaaagtggtggaatcagacatgttcatgcccaggagccttgctggacccatcagcaagcacaaccaca

SEQ ID NO: 355914 - DNA, 75 bp, Artificial Sequence
  Synthetic
cccaaaaagagacttcataaggggactcgatggaaacacctgggtgtcagtggtcttagaacagggcagctgcgt

SEQ ID NO: 355915 - DNA, 75 bp, Artificial Sequence
  Synthetic
ttccaggatacaaggtgcaaactagtggcccatggcacaatgtcccacttgaaataaaaagagaagagtgcccag

SEQ ID NO: 355916 - DNA, 75 bp, Artificial Sequence
  Synthetic
gactttgatagccgacaacaagccatcagtggacgtttggctgagttccatagtggttgacacgccaactcttgt

SEQ ID NO: 355917 - DNA, 75 bp, Artificial Sequence
  Synthetic
gcaccactgttgtggtagatgagaagtgcgatgatagagcaaagtcagtaagatcaacaacagatagtggaaaga

SEQ ID NO: 355918 - DNA, 75 bp, Artificial Sequence
  Synthetic
gaggaaagtttgctatgcgagttctgtgactgggtcaaaagcatctggagcctgtccaacgatgggagatgccca

SEQ ID NO: 355919 - DNA, 75 bp, Artificial Sequence
  Synthetic
tcatacctgaatggtgctgccgcagttgcaccatgcctccagtgagtttctgggggcctgacggctgctggtatt

SEQ ID NO: 355920 - DNA, 75 bp, Artificial Sequence
  Synthetic
catgtctgaagaaggaaatgaggaatgggaatgcaaaagatcttactcagaccgaggatggggaaatggttgcgg

SEQ ID NO: 355921 - DNA, 75 bp, Artificial Sequence
  Synthetic
ccatggaagttaggccaaaacacaccaatgaagcacatctggtgaaatcctgggttgttgcttccaaaggagatg

SEQ ID NO: 355922 - DNA, 75 bp, Artificial Sequence
  Synthetic
gctctttggcaaagggagcatcgtggcatgtgctaaattttcatgcacacatgaaatggaggtttatcagataga

SEQ ID NO: 355923 - DNA, 75 bp, Artificial Sequence
  Synthetic
ttgaccctttttctctggggcttctcatgttgtttctctgcagcgacatgttcctgatgaagaggttctccatga

SEQ ID NO: 355924 - DNA, 75 bp, Artificial Sequence
  Synthetic
catgttgtttctctgcagcgacatgttcctgatgaagaggttctccatgagagctattctagttgggagtctggt

SEQ ID NO: 355925 - DNA, 75 bp, Artificial Sequence
  Synthetic
cgccaccaagattgaatacaccatcagcgcccaggtccactcaggagcaaagaaggatgattgggtaaaccacac

SEQ ID NO: 355926 - DNA, 75 bp, Artificial Sequence
  Synthetic
aaaattggtgacctttgttccaactacaggaacatcaactgttgcttttacaggctatggaaattttggcttaga

SEQ ID NO: 355927 - DNA, 75 bp, Artificial Sequence
  Synthetic
catggctgagataaacagtggaggagatgtcacacatctggctctgctagcggtttttcgggtgcgggctggctt

SEQ ID NO: 355928 - DNA, 75 bp, Artificial Sequence
  Synthetic
gtgtcatgtccagatgatggtagacctcagcaattcctatctggtgaaagtaggaactgatgcatggctggtcaa

SEQ ID NO: 355929 - DNA, 75 bp, Artificial Sequence
  Synthetic
tgttagcatgctggccctaaaacgactttggagccctagagagggatttgtggcaacatgtggaattgtcatggt

SEQ ID NO: 355930 - DNA, 75 bp, Artificial Sequence
  Synthetic
caagcaatgggttcacgacatcactctcccttggcagagtggaacaggaggacattggagagacaagcacttcat

SEQ ID NO: 355931 - DNA, 75 bp, Artificial Sequence
  Synthetic
ccagcttgcattaggagacatattgtcaactgacatcatggaatggctgaatgcggccggtatggcagtgctcat

SEQ ID NO: 355932 - DNA, 75 bp, Artificial Sequence
  Synthetic
ggttgattttgaacaaccacatgcagtcactatgaaggctttggtcctgggcagtcaggaaggggctcttagaac

SEQ ID NO: 355933 - DNA, 75 bp, Artificial Sequence
  Synthetic
catcaaatcaattgttgaacctaaacggtgtaatgctgtgttgcctttgctttgcttgctgaccccactgactgt

SEQ ID NO: 355934 - DNA, 75 bp, Artificial Sequence
  Synthetic
agctctgtctggtgcaatggttgtggaactaaactccaatagatattccctcaaaggaggtcatgtgacgtgtaa

SEQ ID NO: 355935 - DNA, 75 bp, Artificial Sequence
  Synthetic
ggccgaaatacaaagggcagtgatgtttgtctgttccattgtgatttttgtcacagtttggcagactgacagcgt

SEQ ID NO: 355936 - DNA, 75 bp, Artificial Sequence
  Synthetic
ggcgtacatgaacaatctcatcttgaaaggttcaacctactcaatgtgcaaaaggggaatgtcctttgccaagca

SEQ ID NO: 355937 - DNA, 75 bp, Artificial Sequence
  Synthetic
ctcaaccagaaaaaccatccccttggttgctctgactgtttgctctttcttcaaatggactagcccctttttagg

SEQ ID NO: 355938 - DNA, 75 bp, Artificial Sequence
  Synthetic
aaaggttcaacctactcaatgtgcaaaaggggaatgtcctttgccaagcaaccagtcgagacagatcatggaaca

SEQ ID NO: 355939 - DNA, 75 bp, Artificial Sequence
  Synthetic
gcagtgatgcagataaaagttacaactggagctccgtgcagaattccagtgattgcagcagattccatggcagga

SEQ ID NO: 355940 - DNA, 75 bp, Artificial Sequence
  Synthetic
gctggttggagtgcttgctggcatgggactgaaggacatgaacggaatgcttggaccagtggccgttggtggagt

SEQ ID NO: 355941 - DNA, 75 bp, Artificial Sequence
  Synthetic
acagagaaccgtgggagcgtcatcacgactaaccctattgctgcgtcaaacaatgatgaagtgctagttgagatt

SEQ ID NO: 355942 - DNA, 75 bp, Artificial Sequence
  Synthetic
gttactaattgtaatgagtctttcaggaaaggttgatgggctggtaatcaagaaagtggctgacgtgacctggga

SEQ ID NO: 355943 - DNA, 75 bp, Artificial Sequence
  Synthetic
agtccaccatttggagaaagttacatcatcgttggtaatggagatgacaaacttacatatcactggcaaagatca

SEQ ID NO: 355944 - DNA, 75 bp, Artificial Sequence
  Synthetic
tcatcgttggtaatggagatgacaaacttacatatcactggcaaagatcaggaagcaccatcgggaacctgttca

SEQ ID NO: 355945 - DNA, 75 bp, Artificial Sequence
  Synthetic
tgaggatgctgagattagtggagcatcacaccgttatgatgtggaacaaactgacacaggtgagttcaagttacg

SEQ ID NO: 355946 - DNA, 75 bp, Artificial Sequence
  Synthetic
cagagacaatgaaaggagcccaacgcatgatcatcacaggtgagcactcgtgggactttggctcaaccggaggat

SEQ ID NO: 355947 - DNA, 75 bp, Artificial Sequence
  Synthetic
aaatgaagaacccgccccctggattcaggtggctgtcttgacaatagctatccttagtgcagccacacatcctgc

SEQ ID NO: 355948 - DNA, 75 bp, Artificial Sequence
  Synthetic
ttttctcatccattgcaaaagctgtacacacagtttttggtgctgccttccatgcaatttttggtggtctcagtt

SEQ ID NO: 355949 - DNA, 75 bp, Artificial Sequence
  Synthetic
ttgtcttgccgtggtcacaattggctggtttgcctggcaaaagacaacaacccgcagcggcgtgctgtgggacat

SEQ ID NO: 355950 - DNA, 75 bp, Artificial Sequence
  Synthetic
ggataaccaagatactgattggagggctgctcatctggctgggtctcaattctcggagcagttcaatgtcaatgg

SEQ ID NO: 355951 - DNA, 75 bp, Artificial Sequence
  Synthetic
accaacagttgtccctccagaggaggtcagttatctggaagatggagtctacactatcaaccaaaacagcttctt

SEQ ID NO: 355952 - DNA, 75 bp, Artificial Sequence
  Synthetic
gcttcatatgcgttggagccttactgctagtgctggccacaggagttggagcagaagtgggttgctccctgagtt

SEQ ID NO: 355953 - DNA, 75 bp, Artificial Sequence
  Synthetic
gggccttgctcagaaaggagtgggtgtggtgaaggatggagtgttccataccatgtggcatgtgacccgtggagc

SEQ ID NO: 355954 - DNA, 75 bp, Artificial Sequence
  Synthetic
ggaagcaacgtgaaatgaagtgtggagatggtgtttttgtctttaaagattctgatgattggttctctaaatacc

SEQ ID NO: 355955 - DNA, 75 bp, Artificial Sequence
  Synthetic
ttttttgctccatgcaggaaaaagaatgactccatcatgggcaaatgtgaaagaggatctcatttcttatggtgg

SEQ ID NO: 355956 - DNA, 75 bp, Artificial Sequence
  Synthetic
aatacatcccagaagatccaaaaacaatggccactctgattcatcaagctcaccaggatggactatgtggcttga

SEQ ID NO: 355957 - DNA, 75 bp, Artificial Sequence
  Synthetic
tggctggaagctagatgccaaatgggacggttctgaagaagtgcagcttatagctgtgtcccctggaaaagttcc

SEQ ID NO: 355958 - DNA, 75 bp, Artificial Sequence
  Synthetic
gttctgtcagcgatctagaacatcgaatgtggtattctagagtcgatgagataaacgccatcttggatgaaaatg

SEQ ID NO: 355959 - DNA, 75 bp, Artificial Sequence
  Synthetic
tgtgaatgtgcaaaccacgcccagtgttttccaactgaaaaacggaaaagaaataggagccgttaatcttgacta

SEQ ID NO: 355960 - DNA, 75 bp, Artificial Sequence
  Synthetic
aagtggatctgacagtggttgtccaagaatcagatgccgtgtatctgcgaggatcgcatgcttttccccggccaa

SEQ ID NO: 355961 - DNA, 75 bp, Artificial Sequence
  Synthetic
tcctagcggtacctctggctcaccaatattaaacaaaaatggagatgtcattggcctatatggaaatggaatatt

SEQ ID NO: 355962 - DNA, 75 bp, Artificial Sequence
  Synthetic
aaagtgaattgaagtatggatggaaaacttggggaaaaaacatcatctttaacccatccaggaaaaatggtacat

SEQ ID NO: 355963 - DNA, 75 bp, Artificial Sequence
  Synthetic
gattggaaataacacctacgtctcggcgattgcacaaagtgacagcgtggaggaagggggaactgaacagctcca

SEQ ID NO: 355964 - DNA, 75 bp, Artificial Sequence
  Synthetic
ttatcattgatggaaaaagcagagcagaatgccccttcaacaagagagtgtggaactcaatacgggttgaggagt

SEQ ID NO: 355965 - DNA, 75 bp, Artificial Sequence
  Synthetic
ttggcacaggggtttatcagacaagagtgttcatgagaccagaatttgattataccaaactgtgtgacacgggaa

SEQ ID NO: 355966 - DNA, 75 bp, Artificial Sequence
  Synthetic
ttaccttccacaaatcttaaaagaatgtgaaaagcttaaattgaagaccttggtattggctcccacacgagtcgt

SEQ ID NO: 355967 - DNA, 75 bp, Artificial Sequence
  Synthetic
ccttgggagccgctgttaaaggcagtgtttcagctcacggagaccccatgttttggatggaatcagaagagatta

SEQ ID NO: 355968 - DNA, 75 bp, Artificial Sequence
  Synthetic
tctcagtgaaatgcgagaggccatgccaaagatgagcatcaagtaccacacgcaagcattctctaacacaagcac

SEQ ID NO: 355969 - DNA, 75 bp, Artificial Sequence
  Synthetic
atggtacatggatgattacaaccctggaagcattaaattaccgtgaatgtgaatggcctagttcacacacattgg

SEQ ID NO: 355970 - DNA, 75 bp, Artificial Sequence
  Synthetic
cggaaaggaaattattgatgccatgtgccatgccactctgacccatcgcatgttagagccaaccagagtcaccaa

SEQ ID NO: 355971 - DNA, 75 bp, Artificial Sequence
  Synthetic
acggagcaaaagttgtagaatcagacatgtttatgcccaggagcctcgctggacccattagtaggcacaatcaca

SEQ ID NO: 355972 - DNA, 75 bp, Artificial Sequence
  Synthetic
ttgggaagtcgtgataatggatgaggcccattttatggacccggccagtattgcagcaagaggttgggcagccca

SEQ ID NO: 355973 - DNA, 75 bp, Artificial Sequence
  Synthetic
tcccaggatacaaagtgcagaccagtggcccatggcataatgttccacttgaaataagaagagaagagtgcccag

SEQ ID NO: 355974 - DNA, 75 bp, Artificial Sequence
  Synthetic
cagatccagggctcgggagtgtgccaccatattcatgtcagctacccctcctgggacaagcaatgaatttccaga

SEQ ID NO: 355975 - DNA, 75 bp, Artificial Sequence
  Synthetic
gtaccactgttgtggtagatgaaaagtgtgatgatagagcaaagtcagtaagatcaacaacagatagtggaaaga

SEQ ID NO: 355976 - DNA, 75 bp, Artificial Sequence
  Synthetic
gtcaaatggcatgattgaagacgtcaagaaagatgttccctctgaaccatggacaaaagggcatgaatggatttt

SEQ ID NO: 355977 - DNA, 75 bp, Artificial Sequence
  Synthetic
tcataccagaatggtgttgccgcagttgcaccatgcctccagtgagcttttgggggcctgacggctgctggtatt

SEQ ID NO: 355978 - DNA, 75 bp, Artificial Sequence
  Synthetic
agaggacagacgccctactgcttggtttctcccctccatcaggatagccaattctatcgcaaactgcctccgtaa

SEQ ID NO: 355979 - DNA, 75 bp, Artificial Sequence
  Synthetic
ccatggaagtcagaccaaaacacactaatgaagcacatttggtgaaatcttgggttgttgcttccaaaggagatg

SEQ ID NO: 355980 - DNA, 75 bp, Artificial Sequence
  Synthetic
ggctgacagaacagtggtggtgctgaatagaaagacctttgaaaaagagtatcccacaataaagtcaaaaaagcc

SEQ ID NO: 355981 - DNA, 75 bp, Artificial Sequence
  Synthetic
ttgaccctttttctctgggccttctcatgctgtttctctgcagcgacatgtttctgatgaagaggttctccatga

SEQ ID NO: 355982 - DNA, 75 bp, Artificial Sequence
  Synthetic
tgacttcatactggccactgatatagctgaaatgggagccaacttgaaagtggagcgagtcatcgactgccgcac

SEQ ID NO: 355983 - DNA, 75 bp, Artificial Sequence
  Synthetic
catgctgtttctctgcagcgacatgtttctgatgaagaggttctccatgagagccattctcgttggaagtctggt

SEQ ID NO: 355984 - DNA, 75 bp, Artificial Sequence
  Synthetic
catgttgggagcgatgacattggggagcctgagttatctggatctcctaaggtatgccataacagttggaatgta

SEQ ID NO: 355985 - DNA, 75 bp, Artificial Sequence
  Synthetic
agcttacaagccaattttggttgatgatgccacgaaagtcatggtcaaagggcccctgcgcatatcagcctcatc

SEQ ID NO: 355986 - DNA, 75 bp, Artificial Sequence
  Synthetic
catggctgagataaacagtggaggagatgtcacacacttggctctgctagcggtttttcgggtgcgggctggctt

SEQ ID NO: 355987 - DNA, 75 bp, Artificial Sequence
  Synthetic
agctgcacagcggcgtggaaggattgggagagatcccaacagagacactgacacctacatttatggagactcaac

SEQ ID NO: 355988 - DNA, 75 bp, Artificial Sequence
  Synthetic
tgttagcatgctggccctaaaacgactctggagccctagagagagatttgtggcaacatgtggaattgtcatggt

SEQ ID NO: 355989 - DNA, 75 bp, Artificial Sequence
  Synthetic
aactgaggacaatgggcactatgtctgttggacagaaggttcaatgctcttggacaatatggaaatcaggaacgg

SEQ ID NO: 355990 - DNA, 75 bp, Artificial Sequence
  Synthetic
ccaacttgcattaggagatctattgtcaactgacatcatggaatggctgaatgcggctggcatggcagtgcttat

SEQ ID NO: 355991 - DNA, 75 bp, Artificial Sequence
  Synthetic
catgatcgccccgttatacggagtggaaggcaccaaaacaacaacaagtccgggagaaacacgactaagagaaga

SEQ ID NO: 355992 - DNA, 75 bp, Artificial Sequence
  Synthetic
catcaagtcaattgttgaacccaaacggtgcaatgctgtgttgcctctgctctgcttgctgaccccactgactat

SEQ ID NO: 355993 - DNA, 75 bp, Artificial Sequence
  Synthetic
ccaacggaaagtgttccgagagctggtcaagagacttgacatgccggtttggttttcatggcaggtcgcgaaggc

SEQ ID NO: 355994 - DNA, 75 bp, Artificial Sequence
  Synthetic
ggtcgagattcagagggcagtgatgtttgtctgttccattgtgatctttgtcacaatttggcagactgacagcgt

SEQ ID NO: 355995 - DNA, 75 bp, Artificial Sequence
  Synthetic
aggtctcaaggtgcaggacagaagctggtgttttgatggtgaggatgacaacaccttacttaatgacaatggaga

SEQ ID NO: 355996 - DNA, 75 bp, Artificial Sequence
  Synthetic
ctcaaccagaaaaaccatccccttggttgctctgactgtttgttccttctttaaatggacaagtccctttttagg

SEQ ID NO: 355997 - DNA, 75 bp, Artificial Sequence
  Synthetic
gccaattttagccagaagcccaggaggagccaaaaaaccgctgaagccccgctgggtcgacaccagggtatgcag

SEQ ID NO: 355998 - DNA, 75 bp, Artificial Sequence
  Synthetic
catagtctgctatcttgcattcacacgccttccccagcgatcttggcctcttggagagaccatggctgctgttgg

SEQ ID NO: 355999 - DNA, 75 bp, Artificial Sequence
  Synthetic
tgacaatgcatcattaattgattttatcaaatttgctgaaggccgacgttctgctagcgggattttgttaggctt

SEQ ID NO: 356000 - DNA, 75 bp, Artificial Sequence
  Synthetic
actggtaggagtgcttgctggcatgggattgaaggatatgaatggaatgcttgggccagtggctgttggtggagt

SEQ ID NO: 356001 - DNA, 75 bp, Artificial Sequence
  Synthetic
gcaaggatttcctgaatttctgtctgggaaaatgcgggaagcgatcgacacagtaacagtcctatacactagtga

SEQ ID NO: 356002 - DNA, 75 bp, Artificial Sequence
  Synthetic
gctactaattgtgatgagcctttcaggaaaggttgacgggctggtaatcaagaaagtggctgatgtaacctggga

SEQ ID NO: 356003 - DNA, 75 bp, Artificial Sequence
  Synthetic
cactggaagtagagcctacaaacacgcactagcaatgatgcccgaagctacaacaattttcctactggtgatgct

SEQ ID NO: 356004 - DNA, 75 bp, Artificial Sequence
  Synthetic
tgaagatgctgagattagtggagcgtcgcaccgttatgatgtggaacaaactgacacaggtgagttcaagttgcg

SEQ ID NO: 356005 - DNA, 75 bp, Artificial Sequence
  Synthetic
ggctatcatttgtacatctggggtcatcatgttttttttggctccaaaaggactaagcaggatgtcaatggcaat

SEQ ID NO: 356006 - DNA, 75 bp, Artificial Sequence
  Synthetic
aaatgaggaacccgccccgtggattcaggtggctgtcttgacgatagccatccttagcgcagccatacatccagc

SEQ ID NO: 356007 - DNA, 75 bp, Artificial Sequence
  Synthetic
gatgacaatgctggtgtctgcctatcttatgtcattgggaggaatgaaccctgtccagatttcttgtgtcatgtt

SEQ ID NO: 356008 - DNA, 75 bp, Artificial Sequence
  Synthetic
ttgtcttgctgtggtcacaattggctggtttgcctggcaaaagacaaccacccgcagcggcgtgctgtgggacat

SEQ ID NO: 356009 - DNA, 75 bp, Artificial Sequence
  Synthetic
ggtatttttcattttcatggtggtgctaattccagaaccgggcacacagagatctacctatgacaatcaaatcat

SEQ ID NO: 356010 - DNA, 75 bp, Artificial Sequence
  Synthetic
accaacagttgtccccccagaggaggtcagttacctggaagatggagtttacactatcaaccaaaacagcttctt

SEQ ID NO: 356011 - DNA, 75 bp, Artificial Sequence
  Synthetic
ctacttgttggtaggggtgctgagcttaattctcttagtggccgcaaatgaaatggaactgctggaaaaaacaaa

SEQ ID NO: 356012 - DNA, 75 bp, Artificial Sequence
  Synthetic
gggccttgctcagaagggagttggagtggtgaaggatggagtgttccacactatgtggcatgtgacccgtggggc

SEQ ID NO: 356013 - DNA, 75 bp, Artificial Sequence
  Synthetic
aagggatatttttggagctgtggtggtcgaggaggctaaaagatggacatttcctgagttcgacctacgcccagg

SEQ ID NO: 356014 - DNA, 75 bp, Artificial Sequence
  Synthetic
tattttgctccatgcaggaaaaagaatgactccatcatgggcaaatgtgaaagaagatctcatctcttatggcgg

SEQ ID NO: 356015 - DNA, 75 bp, Artificial Sequence
  Synthetic
agcagcctggactgtctacgtcgggcttgttactcctggtaaccccatgctccaccattggataaaaattgatta

SEQ ID NO: 356016 - DNA, 75 bp, Artificial Sequence
  Synthetic
cttgttactcctggtaaccccatgctccaccattggataaaaattgattacgggaacatttctctgtctggcata

SEQ ID NO: 356017 - DNA, 75 bp, Artificial Sequence
  Synthetic
tggctggaagctggatgccaaatgggacggttctgaagaggtgcagctcatagctgtatcccctgggaaagtgcc

SEQ ID NO: 356018 - DNA, 75 bp, Artificial Sequence
  Synthetic
tgtgaatgtgcaaaccacgcccagtgtctttcaattgaaaaatggaaaagaaataggagctgtcaatcttgacta

SEQ ID NO: 356019 - DNA, 75 bp, Artificial Sequence
  Synthetic
ctcctcctgagtgcatggaatggaataactctgctaccacttttcgcaggtatgggagcagctgcactccattgg

SEQ ID NO: 356020 - DNA, 75 bp, Artificial Sequence
  Synthetic
tcccagtggttcctctggttcacccattttgaacaaaaatggagatgtcattggcctttatggaaatggaatatt

SEQ ID NO: 356021 - DNA, 75 bp, Artificial Sequence
  Synthetic
ggtttcatcctaccgggactccgagcacaggccgctaaagctgcacaaaaaagagtttaccatggggtggcaaag

SEQ ID NO: 356022 - DNA, 75 bp, Artificial Sequence
  Synthetic
gattggaaacaacacctatgtgtcggccattgcacagagtgacagtgtggaggagggaggaactgaacagctcca

SEQ ID NO: 356023 - DNA, 75 bp, Artificial Sequence
  Synthetic
aatccagtggttgatgggaatccaacagtggatattgatgatgctcctggcatgccggccatgtatgaaaagaaa

SEQ ID NO: 356024 - DNA, 75 bp, Artificial Sequence
  Synthetic
agacattccaacaatgttaaaaaaggggatgctgacagtcctagacttccatccaggagctggcaagacacgcat

SEQ ID NO: 356025 - DNA, 75 bp, Artificial Sequence
  Synthetic
ttggccttggtgattttgctggcgctttcaatcttgaacttggttttgaccagaaccccctttgcaacggctgaa

SEQ ID NO: 356026 - DNA, 75 bp, Artificial Sequence
  Synthetic
ttaccttccacaaatattgaaagaatgtgaaaagcttaaattgaagaccttagtgttggcccccacacgagtcgt

SEQ ID NO: 356027 - DNA, 75 bp, Artificial Sequence
  Synthetic
atggttgtgctaggctcagcggcggtaggaccactcattgagggcgacaccaatgcttattggaatggacctatt

SEQ ID NO: 356028 - DNA, 75 bp, Artificial Sequence
  Synthetic
tctcagtgaaatgcgagaggccatgccaaaaatgagcatcaagtaccatacgcaagcattctctaacacaagcac

SEQ ID NO: 356029 - DNA, 75 bp, Artificial Sequence
  Synthetic
caatgcttattggaatggacctattgctgtagcgttttcaggattgatgagaggaaactactatgcaaccattgg

SEQ ID NO: 356030 - DNA, 75 bp, Artificial Sequence
  Synthetic
tggaaaggaaatcattgatgctatgtgccacgccaccttgacccaccgcatgttagagccaaccagagtcactaa

SEQ ID NO: 356031 - DNA, 75 bp, Artificial Sequence
  Synthetic
ttgggaagttgtgataatggatgaggcccattttatggacccggccagcattgcagcaagaggctgggcagccca

SEQ ID NO: 356032 - DNA, 75 bp, Artificial Sequence
  Synthetic
gaagaggcagctgaacatgttagggaaacaagaatttgagaggtacaaagtgccagacattactgaagtggaccg

SEQ ID NO: 356033 - DNA, 75 bp, Artificial Sequence
  Synthetic
tagatccagggctcgggagtgtgccaccatattcatgtcagccacccctcctgggacaagcaatgaatttccaga

SEQ ID NO: 356034 - DNA, 75 bp, Artificial Sequence
  Synthetic
gaccgcagctaggcgttacctgaaagaaggacgaacagatgtgggaatcagcgtctctcgaggagcagccaaaat

SEQ ID NO: 356035 - DNA, 75 bp, Artificial Sequence
  Synthetic
gtcaaatggcatgatcgaagacatcaagaaagatgtgccatctgaaccatggacaaaaggacatgaatggattct

SEQ ID NO: 356036 - DNA, 75 bp, Artificial Sequence
  Synthetic
cagatggcttcacgagcgcggctacctcagaatcacaggacgtgtcctggaccttggatgcggacgcggtggatg

SEQ ID NO: 356037 - DNA, 75 bp, Artificial Sequence
  Synthetic
agaggacaaacggcccactgcctggtttctcccttccattaggatagctaattccatagcaaattgcctccgcaa

SEQ ID NO: 356038 - DNA, 75 bp, Artificial Sequence
  Synthetic
gtcatattacgctgccgcgcagaaggaagtcatgagcgtcaaaggttacacactaggaattgagggtcatgagaa

SEQ ID NO: 356039 - DNA, 75 bp, Artificial Sequence
  Synthetic
agctgacagaacagttgtggtgttgaatagaaagacctttgaaaaagagtaccccacaataaagtccaaaaagcc

SEQ ID NO: 356040 - DNA, 75 bp, Artificial Sequence
  Synthetic
accaatccacatgcaaacattgggatggaacattgtcaagttcaaagataagtcaaatgtgttcaccatgccaac

SEQ ID NO: 356041 - DNA, 75 bp, Artificial Sequence
  Synthetic
tgacttcatactggccactgacatagctgaaatgggagccaacctgaaggtggaacgagtcatcgactgccgtac

SEQ ID NO: 356042 - DNA, 75 bp, Artificial Sequence
  Synthetic
tgaaccaagtgacaccttactctgtgacataggtgagtcttcatcaaatcccttggttgagagggacaggaccat

SEQ ID NO: 356043 - DNA, 75 bp, Artificial Sequence
  Synthetic
agcttacaagccaattttggttgatgatgccacgaaagtcatggtgaaagggccccttcgcatatcagcttcatc

SEQ ID NO: 356044 - DNA, 75 bp, Artificial Sequence
  Synthetic
gaaagtgttggaaaattttgaacgatggaaacacgtgaacacagaaaatttttgtgtcaaagtgttggctcccta

SEQ ID NO: 356045 - DNA, 75 bp, Artificial Sequence
  Synthetic
agctgcacagcggcgtggacggattgggagagatcccaacagagacactgatacctatatctatggagattcaac

SEQ ID NO: 356046 - DNA, 75 bp, Artificial Sequence
  Synthetic
tcatccagatgtgattgagaagctggaaagactgcaattgaggtttggtggtggaattgtgagggttccattttc

SEQ ID NO: 356047 - DNA, 75 bp, Artificial Sequence
  Synthetic
aactgaggacaatgggcactatgtctgctggacagaaggttcaatgctcttggacaatatggaaatcaggaatgg

SEQ ID NO: 356048 - DNA, 75 bp, Artificial Sequence
  Synthetic
catgatcgctccgttatacggggtagagggcaccaagacaacaacaagtccgggggaaacacgactaagagagga

SEQ ID NO: 356049 - DNA, 75 bp, Artificial Sequence
  Synthetic
aaggagtttgctaagaagaatgactcggcctagtgggaaagccatcatagaaggggacgtgtttcttcccactgg

SEQ ID NO: 356050 - DNA, 75 bp, Artificial Sequence
  Synthetic
ccaacggaaagtgttccgagagctggtcaagagacttgacatgccagtttggctgtcatggcaagttgcgaaagc

SEQ ID NO: 356051 - DNA, 75 bp, Artificial Sequence
  Synthetic
aacgcgaagcgttgccagtgaagcgggcaccatagaccatgaggcgctcaagctcagagttgaccagattaaggc

SEQ ID NO: 356052 - DNA, 75 bp, Artificial Sequence
  Synthetic
aggtctcaaggtgcaggatagaagctggtgctttgatggtgaggatgataacaccctgcttaatgacaatggaga

SEQ ID NO: 356053 - DNA, 75 bp, Artificial Sequence
  Synthetic
agagtactcaaagacttggacacatgattcaaaccacccatatcgaacatggcattatctaggaagttacctatg

SEQ ID NO: 356054 - DNA, 75 bp, Artificial Sequence
  Synthetic
gccaattctagccaggagcccaggaggagccaagaaaccactgaaacctcgctgggttgacaccagggtatgcag

SEQ ID NO: 356055 - DNA, 75 bp, Artificial Sequence
  Synthetic
caaggcaactggcagttcatcttcaatgatcaatggcattgtcaaaatgctgtcgatgccatgggacaaattcga

SEQ ID NO: 356056 - DNA, 75 bp, Artificial Sequence
  Synthetic
tgataatgcatcattaattgatttcatcaaatttgctgaaggcagacgctctgctagcgggatcttgttaggctt

SEQ ID NO: 356057 - DNA, 75 bp, Artificial Sequence
  Synthetic
atctgtgactcttctggccatgactgacacaaccccgtttgggcagcaaagggtgtttaaagagaaagtggacac

SEQ ID NO: 356058 - DNA, 75 bp, Artificial Sequence
  Synthetic
acaaggatttcctgagttcctgtctggaaaaatgcgggaagcgatcgacacagtcacagtcctatacaccagtga

SEQ ID NO: 356059 - DNA, 75 bp, Artificial Sequence
  Synthetic
aaaagccccgcctccacctccaggaacacgtgcgatcatgcgtgttgtcaatgcttggttgttccaacacctcgc

SEQ ID NO: 356060 - DNA, 75 bp, Artificial Sequence
  Synthetic
cactggaagtagagcctataaacatgcactagcaatgatgcctgaagccacgacaatttttttactggtgatgct

SEQ ID NO: 356061 - DNA, 75 bp, Artificial Sequence
  Synthetic
tcgtaagaagaagccccgcatttgcacgcgtgaagagtttgtggccaaagttcgtagccatgccgcccttggagc

SEQ ID NO: 356062 - DNA, 75 bp, Artificial Sequence
  Synthetic
ttcgtagccatgccgcccttggagcgtatctcgaagagcaggacaaatggaagagtgcaagtgaggctgtccagg

SEQ ID NO: 356063 - DNA, 75 bp, Artificial Sequence
  Synthetic
ggctattatatgcacatctggggttatcatgttttttttagctccaaagggactgagcaggatgtcaatggcaat

SEQ ID NO: 356064 - DNA, 75 bp, Artificial Sequence
  Synthetic
gatgacaatgctggtatctgcttatcttatgtcattgggaggaatgaaccctgtccagatttcttgtgtcatgtt

SEQ ID NO: 356065 - DNA, 75 bp, Artificial Sequence
  Synthetic
acatgatggggaaacgtgaaaagaaaccctctgaatttggcaaagcaaagggaagcagggcgatctggtacatgt

SEQ ID NO: 356066 - DNA, 75 bp, Artificial Sequence
  Synthetic
ggtgtttttcattttcatggtggtcctaataccagaaccgggcacacagaggtctacctatgacaatcaaattat

SEQ ID NO: 356067 - DNA, 75 bp, Artificial Sequence
  Synthetic
ggaagcagggcgatctggtacatgtggctaggagctagattccttgagtttgaagcactgggattcttaaatgaa

SEQ ID NO: 356068 - DNA, 75 bp, Artificial Sequence
  Synthetic
ttacttgttggtaggggtgctgagcttaatcctcttggtggctgcaaatgaaatggaactactggaaaaaacaaa

SEQ ID NO: 356069 - DNA, 75 bp, Artificial Sequence
  Synthetic
aagggacatctttggagctgtggtggttgaggaggctaagagatggacattccctgagttcgacctacgcccagg

SEQ ID NO: 356070 - DNA, 75 bp, Artificial Sequence
  Synthetic
agcagcctggactgtttacgtcgggcttgtcactttggtaactcctatgctgcatcattggataaaaattgatta

SEQ ID NO: 356071 - DNA, 75 bp, Artificial Sequence
  Synthetic
cggatgggacacaaggatcacggaagaagacctggaggatgagcaagagattctaaaatacatggatgaaaaaca

SEQ ID NO: 356072 - DNA, 75 bp, Artificial Sequence
  Synthetic
cttgtcactttggtaactcctatgctgcatcattggataaaaattgattacgggaacatttctttgtctggtata

SEQ ID NO: 356073 - DNA, 75 bp, Artificial Sequence
  Synthetic
caaaaaactggcttgggctgtgacggagttggcatacaaaaacaaggtagtcaaagtgatgcgtcctggccctgg

SEQ ID NO: 356074 - DNA, 75 bp, Artificial Sequence
  Synthetic
acacaaaatgcacaagtgctgggactcatggatagaggcatacccttcatcaaaatgaacatgtcagtggtcatt

SEQ ID NO: 356075 - DNA, 75 bp, Artificial Sequence
  Synthetic
agggttgaccttcatggacattatttcaagaagggatcaaagagggtccgggcaagtggtcacttatgccctgaa

SEQ ID NO: 356076 - DNA, 75 bp, Artificial Sequence
  Synthetic
ctccttttgagtgcatggaatggaataactttgcttccactctttgcaggcatgggagcagctgcactccattgg

SEQ ID NO: 356077 - DNA, 75 bp, Artificial Sequence
  Synthetic
caccgtgactaatcttaaggttcaactcatacgcatggcggaggcagagcatgtcattacaaattttgatgttga

SEQ ID NO: 356078 - DNA, 75 bp, Artificial Sequence
  Synthetic
ggtttcatcttacctggactccgggcacaggccgccaaagctgcacagaaaagagtttatcatggtgtggccaag

SEQ ID NO: 356079 - DNA, 75 bp, Artificial Sequence
  Synthetic
cacagttagccagaagaccctgcaggacttgagatgctggcttgacagatttggtgcagatcgcttgtccaggat

SEQ ID NO: 356080 - DNA, 75 bp, Artificial Sequence
  Synthetic
aatccagtagttgatgggaatccaacagtggacattgatgatgctcctggtatgcctgccatgtatgaaaagaaa

SEQ ID NO: 356081 - DNA, 75 bp, Artificial Sequence
  Synthetic
ggcagtcagtggtgatgactgtgtagtgaagcccattgatgaccaattcgccgatgcactgacccacttgaattc

SEQ ID NO: 356082 - DNA, 75 bp, Artificial Sequence
  Synthetic
ttagccttagtgatcttgctagcactgtcaattctgaacttggtcttaaccagaacccccttcgcaacggctgaa

SEQ ID NO: 356083 - DNA, 75 bp, Artificial Sequence
  Synthetic
catgtcaaagattaggaaagatatagatgactggaaaccatcccaaggctgggcctcgtgggaggatgtcccatt

SEQ ID NO: 356084 - DNA, 75 bp, Artificial Sequence
  Synthetic
atggttgtgctcggttcagcagcggtgggaccactcattgaaggcaataccaatgcatattggaatggacccatt

SEQ ID NO: 356085 - DNA, 75 bp, Artificial Sequence
  Synthetic
ctgttcccaccacttccatgaactgatcctaaaggatggacggtcgataatagcaccatgccgtgatcaggatga

SEQ ID NO: 356086 - DNA, 75 bp, Artificial Sequence
  Synthetic
caatgcatattggaatggacccattgctgtggcattttcaggattgatgaggggaaactactatgcaaccattgg

SEQ ID NO: 356087 - DNA, 75 bp, Artificial Sequence
  Synthetic
acttgcttacaatggatggttggccaaacagacaaggagaggcaaagcagctggagtgaccctgggggaagtttg

SEQ ID NO: 356088 - DNA, 75 bp, Artificial Sequence
  Synthetic
gctcatagggagggcccgtgtgtcccctggaaatggatggatgatcagagaaacagcctgccttagcaaggcata

SEQ ID NO: 356089 - DNA, 75 bp, Artificial Sequence
  Synthetic
gaagaggcaactaaacatgttagggaaacaagaatttgagagatacaaagtgtcagacatcactgaagtggaccg

SEQ ID NO: 356090 - DNA, 75 bp, Artificial Sequence
  Synthetic
tgcacaaatgtggctgttgatgtatttccaccgcagagaccttagagttatggccaacgcaatcaactcgaccgt

SEQ ID NO: 356091 - DNA, 75 bp, Artificial Sequence
  Synthetic
gactgcagccaggcgttatctgaaagaaggacgaacagatgtgggaatcagcgtctctcggggagcagccaaaat

SEQ ID NO: 356092 - DNA, 75 bp, Artificial Sequence
  Synthetic
cagatggctccacgagcgcggctacctcagaatcacgggacgtgtcctagaccttgggtgcggacgcggtggatg

SEQ ID NO: 356093 - DNA, 75 bp, Artificial Sequence
  Synthetic
ctgacaaaacaccaatcactgagtggcgagacattccttatctgccaaagtcaattgacaagacatgcaactcac

SEQ ID NO: 356094 - DNA, 75 bp, Artificial Sequence
  Synthetic
gtcatattatgctgccgcgcagaaggaagtcatgagcgtcaaaggctacacactaggaattgagggacatgagaa

SEQ ID NO: 356095 - DNA, 75 bp, Artificial Sequence
  Synthetic
tcgttggaaccacacaacgagcttcctgggctagagatatcaagcacacagtccatagaatccgtggacttgttg

SEQ ID NO: 356096 - DNA, 75 bp, Artificial Sequence
  Synthetic
accaatccacatgcaaacattgggatggaacatcgtcaaattcaaagacaagtcgaatgtgttcaccatgccaac

SEQ ID NO: 356097 - DNA, 75 bp, Artificial Sequence
  Synthetic
gaaatgaaaaatatacagactatctagccactatggacagattcagggaactcgatgagagtggccctggagaag

SEQ ID NO: 356098 - DNA, 75 bp, Artificial Sequence
  Synthetic
cgaaccaagcgataccctattttgtgacataggtgagtcttcatcaaaccccctagttgagagggacagaaccat

SEQ ID NO: 356099 - DNA, 75 bp, Artificial Sequence
  Synthetic
tcttgtggtaaattcaacaaaatttaagaaaccgggatacaaaccacggatccagaaccggactgggtcacctat

SEQ ID NO: 356100 - DNA, 75 bp, Artificial Sequence
  Synthetic
gaaagtgttggaaaattttgaacgctggaaacacgtaaacacagaaaatttttgtgtcaaggtgctggctcctta

SEQ ID NO: 356101 - DNA, 75 bp, Artificial Sequence
  Synthetic
aagaaaccgggatacaaaccacggatccagaaccggactgggtcacctattgaataaaaccgggatataaaccac

SEQ ID NO: 356102 - DNA, 75 bp, Artificial Sequence
  Synthetic
tcatccagatgtgattgaaaagctggaaagactgcaactgaggtttgggggtggaattgtgagagttccattttc

SEQ ID NO: 356103 - DNA, 75 bp, Artificial Sequence
  Synthetic
taaaaccgggatataaacgagcaagcaggaccggacctgcttttagagtcagcccatcatttgatgccatggcta

SEQ ID NO: 356104 - DNA, 75 bp, Artificial Sequence
  Synthetic
cagaaattcgactcatgaaatgtactacatatcaggagcccggaacaacatcactcacatggtcaacacaacatc

SEQ ID NO: 356105 - DNA, 75 bp, Artificial Sequence
  Synthetic
aaggagtttgctaagaagaatgtctcggcctagtgggaaagccgtcatagaaggagacgtgtttcttcccactgg

SEQ ID NO: 356106 - DNA, 75 bp, Artificial Sequence
  Synthetic
aacgcgaagtgtggccagtgaagcgggccccatagaccatgaggcgctcaagcctagagttgaccaaatcaaggc

SEQ ID NO: 356107 - DNA, 75 bp, Artificial Sequence
  Synthetic
agagtactcaaggacttggacacatgattcaaaccacccataccggacatggcattatctagggagttacctatg

SEQ ID NO: 356108 - DNA, 75 bp, Artificial Sequence
  Synthetic
caaggcaactggcagctcatcttcaatgattaatggcattgtcaaaatgttgtctatgccatgggacaaattcga

SEQ ID NO: 356109 - DNA, 75 bp, Artificial Sequence
  Synthetic
gtctgtgactcttctggccatgactgacacgactccgtttgggcagcaaagggtgtttaaagagaaagtggacac

SEQ ID NO: 356110 - DNA, 75 bp, Artificial Sequence
  Synthetic
aaaagccccgcctccacctccaggaacacgtgcaatcatgcgcgtcgttaatgcctggttgtttcaacacttggc

SEQ ID NO: 356111 - DNA, 75 bp, Artificial Sequence
  Synthetic
tcgcaagaagaagccccgcatttgcacacgcgaagagttcgtggctaaggttcgaagccatgccgccctcggagc

SEQ ID NO: 356112 - DNA, 75 bp, Artificial Sequence
  Synthetic
ttcgaagccatgccgccctcggagcgtatctggaagagcaggacaaatggaagagtgcaagtgaggctgttcagg

SEQ ID NO: 356113 - DNA, 75 bp, Artificial Sequence
  Synthetic
atccacagttctggaaactggttgatgatgagaggaaactgcatctgcaaggccaatgccggacatgtgtgtaca

SEQ ID NO: 356114 - DNA, 75 bp, Artificial Sequence
  Synthetic
acatgatgggaaaacgtgaaaagaaaccttctgaatttggcaaagcaaagggaagtagagcaatttggtacatgt

SEQ ID NO: 356115 - DNA, 75 bp, Artificial Sequence
  Synthetic
ggaagtagagcaatttggtacatgtggctaggagctagattcctggaatttgaagcattgggattcctaaatgaa

SEQ ID NO: 356116 - DNA, 75 bp, Artificial Sequence
  Synthetic
gaccactgggtgtcccgagagaactcagggggaggagtggaaggaacaggcttacagtaccttggctacatactg

SEQ ID NO: 356117 - DNA, 75 bp, Artificial Sequence
  Synthetic
cttacagtaccttggctacatactgaaggaactgggtggcaaaacaggaggaaacatgtatgcagatgacacggc

SEQ ID NO: 356118 - DNA, 75 bp, Artificial Sequence
  Synthetic
tggctgggacacaagaatcacggaagaagatctggaggatgagcaagagatcctaaagtacatggatgaaaaaca

SEQ ID NO: 356119 - DNA, 75 bp, Artificial Sequence
  Synthetic
taaaaaactggcttgggctgtgacggagctggcatacaaaaacaaggtggtcaaagtaatgcgacctggccctgg

SEQ ID NO: 356120 - DNA, 75 bp, Artificial Sequence
  Synthetic
ggggttaactttcatggacattatttcaagaagggatcagaggggttctgggcaggtggtcacttatgccctgaa

SEQ ID NO: 356121 - DNA, 75 bp, Artificial Sequence
  Synthetic
caccgtaaccaacctcaaagttcaacttatccgtatggcagaggcagagcatgtcattacaaattttgatgttga

SEQ ID NO: 356122 - DNA, 75 bp, Artificial Sequence
  Synthetic
cacagtcagccagaagaccctgcaggacttgagatgttggcttgacagatttggtgtagatcggctgtccaggat

SEQ ID NO: 356123 - DNA, 75 bp, Artificial Sequence
  Synthetic
ggcagtcagtggtgatgattgtgtggtgaagcctattgatgaccaattcgctgatgcactgacccacttgaactc

SEQ ID NO: 356124 - DNA, 75 bp, Artificial Sequence
  Synthetic
catgtcaaaaattagaaaagacatagatgactggaaaccatcacaaggctgggcctcttgggaggatgtcccatt

SEQ ID NO: 356125 - DNA, 75 bp, Artificial Sequence
  Synthetic
ttgctcccaccacttccatgaactgatcctaaaagatgggcggtcaataatagcaccatgccgtgaccaggatga

SEQ ID NO: 356126 - DNA, 75 bp, Artificial Sequence
  Synthetic
gctcatagggagggctcgcgtgtctcctggaaatggatggatgatcagagaaacggcctgcctcagtaaggctta

SEQ ID NO: 356127 - DNA, 75 bp, Artificial Sequence
  Synthetic
tgcgcaaatgtggctgttgatgtactttcaccgcagagaccttagagtcatggccaatgcaatcaactcgaccgt

SEQ ID NO: 356128 - DNA, 75 bp, Artificial Sequence
  Synthetic
ccctgtggattgggttccaactggaaggacaacatggtctattcatggaaagggagaatggatgaccactgaaga

SEQ ID NO: 356129 - DNA, 75 bp, Artificial Sequence
  Synthetic
agggagaatggatgaccactgaagacatgctgcaggtgtggaacagagtctggatagaagacaatccacatcaga

SEQ ID NO: 356130 - DNA, 75 bp, Artificial Sequence
  Synthetic
ccgacaagacaccagtcattgaatggagagacattccctatctgccaaagtcagttgacaagacatgcaactcac

SEQ ID NO: 356131 - DNA, 75 bp, Artificial Sequence
  Synthetic
tcgttggaactacacaacgagcttcctgggctagagacatcaaacacacagtccacagaatccgtggacttgttg

SEQ ID NO: 356132 - DNA, 75 bp, Artificial Sequence
  Synthetic
gaaatgaaaaatacacagactacctagccaccatggacagattcagggaactcgaggagagtggccctggagaag

SEQ ID NO: 356133 - DNA, 75 bp, Artificial Sequence
  Synthetic
tcttgtggtaaattcaacaaaattcaagaaaccgggatacaaactacggatccagaaccggactggatcacctat

SEQ ID NO: 356134 - DNA, 75 bp, Artificial Sequence
  Synthetic
aagaaaccgggatacaaactacggatccagaaccggactggatcacctattgaataaaaccgggatacaaacaac

SEQ ID NO: 356135 - DNA, 75 bp, Artificial Sequence
  Synthetic
ggagaggaccggacctctcactctgtaaaaccgggatataaacgagcaagcaggaccggacctgctttcagagtc

SEQ ID NO: 356136 - DNA, 75 bp, Artificial Sequence
  Synthetic
taaaaccgggatataaacgagcaagcaggaccggacctgctttcagagtcagcccatcatgtgatgccatggcta

SEQ ID NO: 356137 - DNA, 75 bp, Artificial Sequence
  Synthetic
agctgtgaggccatgctggctgggacagccgcgaccacccgcgtaaaggggttcctggtaggctcaaaccagggt

SEQ ID NO: 356138 - DNA, 75 bp, Artificial Sequence
  Synthetic
aaaaagtattgggagcctccgcccaccgttaccgcgcacggtgggaaagatggggtctagaggttagaggagacc

SEQ ID NO: 356139 - DNA, 75 bp, Artificial Sequence
  Synthetic
cattccctcccgagcacacatagcggaccatattgacgccagggaaagaccggagacactccttgattctcacct

SEQ ID NO: 356140 - DNA, 75 bp, Artificial Sequence
  Synthetic
gattctcacctttctcgccctaaagcacagattgcttgaatgcagggcggggaagttgagaaccaactagtgtct

SEQ ID NO: 356141 - DNA, 75 bp, Artificial Sequence
  Synthetic
agtatattctgcgtgctaatcgttcgacgttagtccgtggagtgagcttctattagagtcgttaacacgtttgaa

SEQ ID NO: 356142 - DNA, 75 bp, Artificial Sequence
  Synthetic
ggttaaaagattgtggagaatggtggacaaagtgcaaggtctccggatcctgaagaacattaggaacatcgttac

SEQ ID NO: 356143 - DNA, 75 bp, Artificial Sequence
  Synthetic
caatctgatgaagggactggctggtcgcaagaaaaagcgaagcttgacagtacccttggtccttttgctgattcc

SEQ ID NO: 356144 - DNA, 75 bp, Artificial Sequence
  Synthetic
actgattgcttactcagctactgtcacccgtcaacgcggattggggcttttgctcaacgtcacttttgctgacgt

SEQ ID NO: 356145 - DNA, 75 bp, Artificial Sequence
  Synthetic
tgggaagacctatgaggttgaggggggcaattgctctgtcaacactttggatgcgggcaaatggtgtgaagatta

SEQ ID NO: 356146 - DNA, 75 bp, Artificial Sequence
  Synthetic
caatgtccgtgtcacctatggaagatgcaagagtggtggttcacgaagatcgaggcgctctgccgtcataactcc

SEQ ID NO: 356147 - DNA, 75 bp, Artificial Sequence
  Synthetic
acatgtagacaaaggacttactactagacaggaaaagtggctgcccacaaagattggagaacagcaactgcagaa

SEQ ID NO: 356148 - DNA, 75 bp, Artificial Sequence
  Synthetic
agtggaaaaatggattatgaggaatcctctctatgcacttggggcggtggctttagcatactttgttggcacatc

SEQ ID NO: 356149 - DNA, 75 bp, Artificial Sequence
  Synthetic
aaatgtgcagagggtagttattgccatcttgcttcttggcattggaccagcttattcaacacactgcttaggaat

SEQ ID NO: 356150 - DNA, 75 bp, Artificial Sequence
  Synthetic
tccaaaaagggacttcataaggggacttgatggaaacacctgggtgtcagtggttttagaacagggcagctgcgt

SEQ ID NO: 356151 - DNA, 75 bp, Artificial Sequence
  Synthetic
gactttgatagccgacaacaagccatcagtagatatttggctgagttccatagtggttgatacgccaactcttgt

SEQ ID NO: 356152 - DNA, 75 bp, Artificial Sequence
  Synthetic
gaggaaagtttgctatgcgagctctgtgactggatcgaaagcaactggagcctgtccaactatgggagacgccca

SEQ ID NO: 356153 - DNA, 75 bp, Artificial Sequence
  Synthetic
catgtctgaagaaggaaatgaagaatgggaatgcaaaagatcatactcggaccgaggatggggtaacggttgtgg

SEQ ID NO: 356154 - DNA, 75 bp, Artificial Sequence
  Synthetic
gctttttggtaaaggaagcattgtggcatgcgcaaaattttcatgcacacatgaaatggaggtttatcagataga

SEQ ID NO: 356155 - DNA, 75 bp, Artificial Sequence
  Synthetic
tgccactaagattgaatataccatcagtgcccaagttcactcgggagccaagaaagatgattgggaaaatcacac

SEQ ID NO: 356156 - DNA, 75 bp, Artificial Sequence
  Synthetic
aaaattggtgacttttgttccgaccacaggaacatcaactgttgcttttacaggctatggaaactttggcttaga

SEQ ID NO: 356157 - DNA, 75 bp, Artificial Sequence
  Synthetic
gtgtcacgttcagatgatggtggacctcagcaattcctatctggtgaaagtaggaactgatgcctggctggtcaa

SEQ ID NO: 356158 - DNA, 75 bp, Artificial Sequence
  Synthetic
caaacaatgggttcacgatattactctcccatggcagagtggaacaggaggacattggagagacaagcatttcat

SEQ ID NO: 356159 - DNA, 75 bp, Artificial Sequence
  Synthetic
ggttgactttgaagaaccacatgcagtcactatgaaggcgttggtcctgggtagccaagaaggggctcttagaac

SEQ ID NO: 356160 - DNA, 75 bp, Artificial Sequence
  Synthetic
agctctgtctggtgcaatggttgtggaactaaattctaatagatattcccttaaaggaggtcatgtgacgtgtaa

SEQ ID NO: 356161 - DNA, 75 bp, Artificial Sequence
  Synthetic
ggcgtacatgaacaatctcatcctgaaaggttcaacctactcaatgtgcaaaagagggatgtcctttgctaagca

SEQ ID NO: 356162 - DNA, 75 bp, Artificial Sequence
  Synthetic
aaaggttcaacctactcaatgtgcaaaagagggatgtcctttgctaagcaaccagttgagacagaccatggaaca

SEQ ID NO: 356163 - DNA, 75 bp, Artificial Sequence
  Synthetic
acagaaaaccgtggaagcgtcatcacaaccaatcctattgctgcgtcaaacaatgatgaagtgttggtggagatc

SEQ ID NO: 356164 - DNA, 75 bp, Artificial Sequence
  Synthetic
agtccaccatttggagagagttacatcatcgttggtaatggagatgataaacttacataccactggcaaagatca

SEQ ID NO: 356165 - DNA, 75 bp, Artificial Sequence
  Synthetic
tcatcgttggtaatggagatgataaacttacataccactggcaaagatcaggaagcaccatcgggaatctgttca

SEQ ID NO: 356166 - DNA, 75 bp, Artificial Sequence
  Synthetic
acgcttaacaacaaaatcttataaggacgagaaaacctcagagggcaaaaaccaatgtaacacccctacaatgga

SEQ ID NO: 356167 - DNA, 75 bp, Artificial Sequence
  Synthetic
ttctgaacacattgtgtttagggtcagaaatgaaatagtgactctcaaacccgaagtgatatccgaccagtatga

SEQ ID NO: 356168 - DNA, 75 bp, Artificial Sequence
  Synthetic
atataaatatcctgccattacagataagaaaaaaccctccataacactcgggagggctcccgatctgagcattgc

SEQ ID NO: 356169 - DNA, 75 bp, Artificial Sequence
  Synthetic
ctacaggtcgattctgtcagggttcaatgctgctaagttggatccagatgatgtgtgctcctatctagcagctgc

SEQ ID NO: 356170 - DNA, 75 bp, Artificial Sequence
  Synthetic
tatgccattgttcgaaggggtttgcccagaggattggatcagttacgggatcattatagcaaggaagggagacaa

SEQ ID NO: 356171 - DNA, 75 bp, Artificial Sequence
  Synthetic
gattaaccctagtcacctggtagatataatgaggacagaagtggaaggtaactggtctcaatctggaggcgctga

SEQ ID NO: 356172 - DNA, 75 bp, Artificial Sequence
  Synthetic
cgtgactagaaatcccaccgttgctgagcatgcctccctggtaggtctcctcctctgcctgtatagattgagcaa

SEQ ID NO: 356173 - DNA, 75 bp, Artificial Sequence
  Synthetic
aatagtgggccaaaatacagccaactacaagacaaatgttgcagacaggatggaacaaatattcgaaacagcccc

SEQ ID NO: 356174 - DNA, 75 bp, Artificial Sequence
  Synthetic
ttttgtcaaaatcatagagcaccacacactgatgacaactcacaagatgtgtgccaattggagtaccattccaaa

SEQ ID NO: 356175 - DNA, 75 bp, Artificial Sequence
  Synthetic
ctttagatttcttgttggaacctatgacatgtttttctcaagaattgaccatttatattctgctttgagggtcgg

SEQ ID NO: 356176 - DNA, 75 bp, Artificial Sequence
  Synthetic
cacagttgtcactgcatatgaagactgtaccgggcttgtatcgttcactgcttttctcaaacagataaacttgtc

SEQ ID NO: 356177 - DNA, 75 bp, Artificial Sequence
  Synthetic
agcaagagatgcaatcctatactttttccataagaattttgaagaagaaatcaggagaatgttccgtcccaatca

SEQ ID NO: 356178 - DNA, 75 bp, Artificial Sequence
  Synthetic
ggagactgctgttccccactcttatttcatccactttagatctttgggtcttagcgggaagtctccatactcctc

SEQ ID NO: 356179 - DNA, 75 bp, Artificial Sequence
  Synthetic
caatgcagtgggtcatgtgttcaacttgattcactttgtgggatgctacatggggcaagtaaggtctctaaatgc

SEQ ID NO: 356180 - DNA, 75 bp, Artificial Sequence
  Synthetic
gacagtcattcagacatgtgccccccacgaaatgtctgttttgggaggttatttgggggaggaattctttggaaa

SEQ ID NO: 356181 - DNA, 75 bp, Artificial Sequence
  Synthetic
aggtacgtttgagagaagattctttagagatgaaagagagttgcaggatcatcttgaggcagaagaggccaagat

SEQ ID NO: 356182 - DNA, 75 bp, Artificial Sequence
  Synthetic
agacattgctctggcagatgacgccacagtagactccggagatgaggatttctacggcggagagtcgaggagccc

SEQ ID NO: 356183 - DNA, 75 bp, Artificial Sequence
  Synthetic
agaggcagtctataatagaatcatcatgaacaaggggagactcaagaagttacacataaagaggtatagatctgt

SEQ ID NO: 356184 - DNA, 75 bp, Artificial Sequence
  Synthetic
gagctctaatcatcaagcccgacccaatacttttgcagagtttctaaataaggtttattcggatgacaattgagt

SEQ ID NO: 356185 - DNA, 75 bp, Artificial Sequence
  Synthetic
taaactgcaagtattgaaatgaaaaaaacatcaacacccctcttccatcttctgtctcgaagatgagcaagagtc

SEQ ID NO: 356186 - DNA, 75 bp, Artificial Sequence
  Synthetic
ttattcaccccagtgatctccgggcaggcttagctgacatagaaatggcagatgagactgtcgatctggtttaca

SEQ ID NO: 356187 - DNA, 75 bp, Artificial Sequence
  Synthetic
agaatctgtcagaaggacaagctcacttgcaaggggaaccctttgatatcaaagaccttccagagggagtctcca

SEQ ID NO: 356188 - DNA, 75 bp, Artificial Sequence
  Synthetic
aattacaaatctcagataatgtgagaagtgacacctcacccaatgaatactcagatgaagacgatgaggaaggag

SEQ ID NO: 356189 - DNA, 75 bp, Artificial Sequence
  Synthetic
aagatgagtacgaagaagtctatgaccctgtgagtgctttccaagattttctagacgagacgggttcgtacctca

SEQ ID NO: 356190 - DNA, 75 bp, Artificial Sequence
  Synthetic
tctctaagctaaagaagggagaaaagatcaagaagacttggtctgaggtctctagagtgatctatagttacgtca

SEQ ID NO: 356191 - DNA, 75 bp, Artificial Sequence
  Synthetic
tgagtaactttcctcctagaccgcctaaaccaacaacaaaagatatcgctgttcaggctgatctcaagaaaccaa

SEQ ID NO: 356192 - DNA, 75 bp, Artificial Sequence
  Synthetic
atgagattcagaagatctccgaacataaatctaagtcagaaccttcacccagagaacctgtagtagagatgcata

SEQ ID NO: 356193 - DNA, 75 bp, Artificial Sequence
  Synthetic
agcatgccactcttgaaaatcctgaggatgatgaaggagctctcgaaagtgaaatagctcaccaagtcgcagaga

SEQ ID NO: 356194 - DNA, 75 bp, Artificial Sequence
  Synthetic
gttactccaaaaagtataagttcccatctaagtcctcaggtatttttctctggaattttgaacaactgaagatga

SEQ ID NO: 356195 - DNA, 75 bp, Artificial Sequence
  Synthetic
acttggatgatattgtccaggttgcaagaggtgttccggggataagtcaaattgttgagaggggtggtaagctcc

SEQ ID NO: 356196 - DNA, 75 bp, Artificial Sequence
  Synthetic
ctttgagatgtatgcttggttatgttggattagaaacttctaagagattcaggtctctggtcaaccaagacaagt

SEQ ID NO: 356197 - DNA, 75 bp, Artificial Sequence
  Synthetic
tgtgtaaactgatgcaagaggatcttaatgcctactcggtctcatccaacaattagaggaatagaaaggattaat

SEQ ID NO: 356198 - DNA, 75 bp, Artificial Sequence
  Synthetic
ttgtaacattgggagatccgcttggtttcaatggaagcaagcaaattcaagaatttcacaactcacaagattgga

SEQ ID NO: 356199 - DNA, 75 bp, Artificial Sequence
  Synthetic
gaagtcttcccataatgaaaaaaactaacacccctcatcatgaatttcctaaggaaaatgatgaaaacatgccgt

SEQ ID NO: 356200 - DNA, 75 bp, Artificial Sequence
  Synthetic
gatgacgagtcttccaagcctttggatccttcagcccctcctgatgacgatgacttgtggcttcctcctccagaa

SEQ ID NO: 356201 - DNA, 75 bp, Artificial Sequence
  Synthetic
tatgttcctcttcatgaaatctcctctaaagggaacacacgcaatttctgcatcagcggagaagttaagatatgt

SEQ ID NO: 356202 - DNA, 75 bp, Artificial Sequence
  Synthetic
agtcccaatggatactccttcaagatcatccgtcacatcctccgatcttttgagagcgtttactctgggaatcga

SEQ ID NO: 356203 - DNA, 75 bp, Artificial Sequence
  Synthetic
aggatgataggtttggtcaaggtggtcatcgggctaaccctgtctgggagtccagtccccgagggcatgaactgg

SEQ ID NO: 356204 - DNA, 75 bp, Artificial Sequence
  Synthetic
gtttataaacttagaaagactcttgtgttccagtggtctaattccagcgggcccttggaaggggaagagttagag

SEQ ID NO: 356205 - DNA, 75 bp, Artificial Sequence
  Synthetic
tactctcaagaaatcacatgggatgatgactctgagtatgtagggctgcagatcagagtcaatgcaaaacaatgc

SEQ ID NO: 356206 - DNA, 75 bp, Artificial Sequence
  Synthetic
cacattgcagggagatcctggtgtgtgaacatgaactcccgtgcctgccaattgtggtctgacatgaccttaaaa

SEQ ID NO: 356207 - DNA, 75 bp, Artificial Sequence
  Synthetic
actcaacaatctgaagaagatgagcacacctcagttctcatagaatgagaatttatcctcacaagcagattatca

SEQ ID NO: 356208 - DNA, 75 bp, Artificial Sequence
  Synthetic
catcctgcaacatcttgagcaatagaacaatttagtaacggtgccctatcatagctgcagatataggagcctacg

SEQ ID NO: 356209 - DNA, 75 bp, Artificial Sequence
  Synthetic
atcaactttttttcttgtgacgatgaactcaactgtgaaaaaaactgactctcagaagctccagcatgaaggact

SEQ ID NO: 356210 - DNA, 75 bp, Artificial Sequence
  Synthetic
taagagacaacatccctcatctcagagaaatggcttcctactttgcgttggtcttgaacgggatctctatggttt

SEQ ID NO: 356211 - DNA, 75 bp, Artificial Sequence
  Synthetic
tcagtcaaggtcttttccccctttacactatccctgaccatctgggaccatggacccccatagatctaagtcacc

SEQ ID NO: 356212 - DNA, 75 bp, Artificial Sequence
  Synthetic
ttcactgcccgaacaatctttatactgatgcctcttattgtacaactgaacaaagcataacctacacagagttga

SEQ ID NO: 356213 - DNA, 75 bp, Artificial Sequence
  Synthetic
aggtcggatcatctgtgtcacaaaaaatccccggatttacatgtacgggggtaagaactgaatctgtaacatata

SEQ ID NO: 356214 - DNA, 75 bp, Artificial Sequence
  Synthetic
ccaactttgttggctatgtgactaccacgttcaagaaaaaacactttcctcctaaatccagggactgtagagagg

SEQ ID NO: 356215 - DNA, 75 bp, Artificial Sequence
  Synthetic
cgtatgagaggaagaaagcaggagatcctagatatgaagagtctttagcccacccatatcctgacaacagttggc

SEQ ID NO: 356216 - DNA, 75 bp, Artificial Sequence
  Synthetic
tgagaacagtgactacaacaaaggattcctgggtgatcatcgagcccagtgtagtggagttagatatatacacaa

SEQ ID NO: 356217 - DNA, 75 bp, Artificial Sequence
  Synthetic
gtgccttgtattcacctcttttcaaggatggaacatgttcaaaatctagaacatattccccctactgtccaacca

SEQ ID NO: 356218 - DNA, 75 bp, Artificial Sequence
  Synthetic
atcatgacttcaccatttggatgccagagagtgaaaacataagatctgcctgtaatctgttttccacaagtagag

SEQ ID NO: 356219 - DNA, 75 bp, Artificial Sequence
  Synthetic
ggaaactagtcaggaaccgcacatccacctgcgggattatcgatgagagagggctgttcagatcagttaaaggag

SEQ ID NO: 356220 - DNA, 75 bp, Artificial Sequence
  Synthetic
catgcaaaatatcaatatgcggtaggcagggaatccgtttagtggatggaacttggatgtcttttagatactcag

SEQ ID NO: 356221 - DNA, 75 bp, Artificial Sequence
  Synthetic
agtacttacctgtgtgttctccatcacagctgatcaacacgcacgacatcaaggtcgatgagctggagaatgcta

SEQ ID NO: 356222 - DNA, 75 bp, Artificial Sequence
  Synthetic
tagttttagacttgattaggaggagagaagaatgtcttgacaccctagaaacaattttgatgtcaggatctgtga

SEQ ID NO: 356223 - DNA, 75 bp, Artificial Sequence
  Synthetic
gtcacaggaggctgagtcatttcagaaagctggttccaggatctgggaaggcttactcttatataaacggcacct

SEQ ID NO: 356224 - DNA, 75 bp, Artificial Sequence
  Synthetic
taatggaatcagatgctcactacatcaaggtagagaattggtcagaggtcatcccacacaaaggatgtctcatgg

SEQ ID NO: 356225 - DNA, 75 bp, Artificial Sequence
  Synthetic
tcgggggcaaatgctatgagccagtcaatgatgtgtatttcaacgggatcattcgggattcaaataatcagatct

SEQ ID NO: 356226 - DNA, 75 bp, Artificial Sequence
  Synthetic
tgatacctgagatgcagtccagtcttctcagagaacatgttgacctgttgaaggctaatatagttccgttcaggc

SEQ ID NO: 356227 - DNA, 75 bp, Artificial Sequence
  Synthetic
atccaatgttacttaggtccttcacatctgacactgaagaagatatcgtcgagtttgtcaaccctcatctccaag

SEQ ID NO: 356228 - DNA, 75 bp, Artificial Sequence
  Synthetic
atacccagaagttggtgtcagatatggatctcgggttatcagactggaagagatatctactaattggatctttgg

SEQ ID NO: 356229 - DNA, 75 bp, Artificial Sequence
  Synthetic
ccgtaggaggagtggtagcaatcttattcatcggaacatgttgtctgagatgtagagcagggagaaacagaagaa

SEQ ID NO: 356230 - DNA, 75 bp, Artificial Sequence
  Synthetic
caatccgatccaatcataggtcattgtcccatgacgtggtgttccataaagataaggataaagtgattacttctt

SEQ ID NO: 356231 - DNA, 75 bp, Artificial Sequence
  Synthetic
gggaatcttacaagggacaaactgcccaataacaaggtattgaattcttcaagggagaatcaagcacctagaaga

SEQ ID NO: 356232 - DNA, 75 bp, Artificial Sequence
  Synthetic
gttataagctctcaagagacatgcgttcttttgagttgtatatcttcttgcaatacaaaatatggaatgcagggt

SEQ ID NO: 356233 - DNA, 75 bp, Artificial Sequence
  Synthetic
actcaatcagataaattcagaatggtgctttgagaggaaacaattatggtagcattacactggacactggagaat

SEQ ID NO: 356234 - DNA, 75 bp, Artificial Sequence
  Synthetic
atctccaaaagcgattgctctctttgataaacatatccatctaggaggaattggtgttttctccgctagtctatt

SEQ ID NO: 356235 - DNA, 75 bp, Artificial Sequence
  Synthetic
tctagctggttcatggtacttttgatgctataacctcgtattataggacctcacagttcggtttactgggactta

SEQ ID NO: 356236 - DNA, 75 bp, Artificial Sequence
  Synthetic
cagataatcatctcatctccttcttaagcatctgctgggattttaatgcatgagggcagtgacagtgtgcaataa

SEQ ID NO: 356237 - DNA, 75 bp, Artificial Sequence
  Synthetic
tgcggatacaatactaactaactggtttgataggacttgtcttgtgtgtttcatttaccctagatgccccatcag

SEQ ID NO: 356238 - DNA, 75 bp, Artificial Sequence
  Synthetic
tagaagcatatatctttgtttagtatcccatgctgttaaatgttggcgccaaagatatcaaggagagagaaaagc

SEQ ID NO: 356239 - DNA, 75 bp, Artificial Sequence
  Synthetic
taactaggcactacaatcgaagtcgacaacccctttgaacaggggacatgaaagcagcatggttgcccctcgagg

SEQ ID NO: 356240 - DNA, 75 bp, Artificial Sequence
  Synthetic
gaactctcctccaatatacaatctgcagtctatactgtatctaacaggttaatgaaaaaaacattaatcagaaac

SEQ ID NO: 356241 - DNA, 75 bp, Artificial Sequence
  Synthetic
tgaagcacccgccagatacaggaccaaatcacagttgtcacatcaggaaattcaccatacacacagacgtgccta

SEQ ID NO: 356242 - DNA, 75 bp, Artificial Sequence
  Synthetic
tccaaggagataacacccctactttcagattattaattaccaagttcttctcgttcttgcttataaaccatgttg

SEQ ID NO: 356243 - DNA, 75 bp, Artificial Sequence
  Synthetic
gagtctaccgaggtgtatgatgatcctcttgatccggttgaacccgaacaagattggaggcctgaagcctctgcc

SEQ ID NO: 356244 - DNA, 75 bp, Artificial Sequence
  Synthetic
cctaacatcttgagaaactctgactataacctgaattcacctctattatctgacccatctgaattgatgatttct

SEQ ID NO: 356245 - DNA, 75 bp, Artificial Sequence
  Synthetic
tggttgcagtctggtcaaaaaccgaacagaattccgttatccgagaatattcgtagatcccagaaaatcttaaag

SEQ ID NO: 356246 - DNA, 75 bp, Artificial Sequence
  Synthetic
ttatccttaaagaaagtggacttagcaacagtgctgactgggggggatagtagcaggtctgtcatggcattatgg

SEQ ID NO: 356247 - DNA, 75 bp, Artificial Sequence
  Synthetic
tgcaataaatcccacctggaatctaccagatcgaggagatgtttgaataatttatctcaattctacaacaagtct

SEQ ID NO: 356248 - DNA, 75 bp, Artificial Sequence
  Synthetic
tctccaatagaagcaatactcaaatactctctagagatcagggggctgcagaatcctagggatggtattttaacc

SEQ ID NO: 356249 - DNA, 75 bp, Artificial Sequence
  Synthetic
agtttggagaaagttaattatgacagctccttcgggcgctatatgggaaacgtgtacgcttcttatttgttattt

SEQ ID NO: 356250 - DNA, 75 bp, Artificial Sequence
  Synthetic
catgtggtgatactgtacatgaatgccttagactgggatgaagaaaaaacaatcatatcattgtggagggacatt

SEQ ID NO: 356251 - DNA, 75 bp, Artificial Sequence
  Synthetic
atccattacgagaccaaagaagaccgtttgaccatcaaggatcagatttggggctccttgttagtcactaaggag

SEQ ID NO: 356252 - DNA, 75 bp, Artificial Sequence
  Synthetic
tttgtatattctagttcgaccagtgcattgtttgataaaaactatgtgctaatgctaaaagacctcttcttgtct

SEQ ID NO: 356253 - DNA, 75 bp, Artificial Sequence
  Synthetic
cgtttcaattcactcatgatcttgatatcccccccagagtcaaaatattcagacaccctaatagaaactttgtgc

SEQ ID NO: 356254 - DNA, 75 bp, Artificial Sequence
  Synthetic
tctttgtatgttgcgggagatcaagtcgttgcacaatgtggaaattcaggatatgatgtaatcaagatgttagag

SEQ ID NO: 356255 - DNA, 75 bp, Artificial Sequence
  Synthetic
ccttgtgtggtgcatgagctggtagaaagggcagaaaaatatagaccactgataacctcattgggagactttcct

SEQ ID NO: 356256 - DNA, 75 bp, Artificial Sequence
  Synthetic
gaattcataagagagaagaaggcccaactgataggaatttttggccctcctgcttcaagatttttctcagttata

SEQ ID NO: 356257 - DNA, 75 bp, Artificial Sequence
  Synthetic
gacaggctagataacattcatgatctagtcttcgtctatggttgttatcgccattgggggcatccttacatagat

SEQ ID NO: 356258 - DNA, 75 bp, Artificial Sequence
  Synthetic
tatcggaaagggttatctaagttgtatgatcaagtccatatgaaaaagttcatagatgagggttatcagaaaagc

SEQ ID NO: 356259 - DNA, 75 bp, Artificial Sequence
  Synthetic
ctagctagtgacttagccaaaagaatactcagatggggctttgacaagtattctaagtggtatttggaccctgcg

SEQ ID NO: 356260 - DNA, 75 bp, Artificial Sequence
  Synthetic
aggatgaggagagatcaccctctccgacagtatgtctccactcaaacctggcccccgaaacatatagtagatcta

SEQ ID NO: 356261 - DNA, 75 bp, Artificial Sequence
  Synthetic
gtaggtgacacctggcatgaacttccaatcacccaaatattcgaaatacctgagtctatggatccttcggagata

SEQ ID NO: 356262 - DNA, 75 bp, Artificial Sequence
  Synthetic
ttggatgataaatctcactccctcacaagatcaaagttagcggggtggcttgctgaaaaccgggggggtccggtt

SEQ ID NO: 356263 - DNA, 75 bp, Artificial Sequence
  Synthetic
ccaagtgagaaagtaatcatcacagccctttcgaaatctcctgtcaatccaagggagtttctcagatcggttgat

SEQ ID NO: 356264 - DNA, 75 bp, Artificial Sequence
  Synthetic
gcccacggtttagatgaggaggaccttatcattggtctaaaacccaaagaaagagaactgaaaattgaaggtaga

SEQ ID NO: 356265 - DNA, 75 bp, Artificial Sequence
  Synthetic
ttcttcgctctcatgtcttggaacctgagactctatttcgtaatcaccgagaaattattagcaaaccatattctg

SEQ ID NO: 356266 - DNA, 75 bp, Artificial Sequence
  Synthetic
cccctcttcgatgcactaaccatgactgacaatttaaacaaggtgttcaagaaattaatagacagagtaaccggt

SEQ ID NO: 356267 - DNA, 75 bp, Artificial Sequence
  Synthetic
cagggtctcatggactactccagagtgacttatgcttttcacttggattatgagaagtggaacaaccaccaaagg

SEQ ID NO: 356268 - DNA, 75 bp, Artificial Sequence
  Synthetic
atggaatctacgaaagatgtgttttctgttctggacaaggtctttgggttggaaagggtattttccaggacacat

SEQ ID NO: 356269 - DNA, 75 bp, Artificial Sequence
  Synthetic
gaattttttcaaaaatcctggatttactactcagaaaggtcagatctcattggaatagctggaggaaacatttac

SEQ ID NO: 356270 - DNA, 75 bp, Artificial Sequence
  Synthetic
tgcctagatatgactggaggccctacatgctggaatggacaggacggtgggttggaaggtctgagacagaagggg

SEQ ID NO: 356271 - DNA, 75 bp, Artificial Sequence
  Synthetic
tggagtatgatcagtctgcttatgatcgaccgagaatctcaaattaggaacacccgaactaaaattctagctcag

SEQ ID NO: 356272 - DNA, 75 bp, Artificial Sequence
  Synthetic
ggagacaatcaggttctttgtcccacctacatggtgtcttctggattatcccaagatggattgaagtatgagtta

SEQ ID NO: 356273 - DNA, 75 bp, Artificial Sequence
  Synthetic
gagaacatctctaagaatgccatgtctatctatagggcaattgaggaaggggcagggagactcgggttaatcatc

SEQ ID NO: 356274 - DNA, 75 bp, Artificial Sequence
  Synthetic
aaaaaagaggaaactatgtgtagttatgacttcttgatttacggtaaaacgccattatttaggggaaacattctt

SEQ ID NO: 356275 - DNA, 75 bp, Artificial Sequence
  Synthetic
gtgccagaatctaaaagatgggcgagagtgtcatgtatatcaaatgaccaaattgtaaatctagctaacattatg

SEQ ID NO: 356276 - DNA, 75 bp, Artificial Sequence
  Synthetic
tccactgtctctacaaatgctttaactgttgctcaacactctcaatctctaatcaaaccaatgagggacttctta

SEQ ID NO: 356277 - DNA, 75 bp, Artificial Sequence
  Synthetic
ctgatgtctgtccaagcaatctatcattatcttttattcagtcccattttgaaggacagagtttacaagattctg

SEQ ID NO: 356278 - DNA, 75 bp, Artificial Sequence
  Synthetic
aatgcgcaaggagaggatttcttgatgtccatggccagaataatttatctagacccatctctggggggagtatca

SEQ ID NO: 356279 - DNA, 75 bp, Artificial Sequence
  Synthetic
gggatgtcactaggtagattccacattcgacagttctctgaccctgtgacagagggattatctttctggaaagaa

SEQ ID NO: 356280 - DNA, 75 bp, Artificial Sequence
  Synthetic
atctgggaagtgtcttctgaagggtggatccattctctctgtcaagaagctggaaacccagatctgggagatagg

SEQ ID NO: 356281 - DNA, 75 bp, Artificial Sequence
  Synthetic
agtctagaaagcttcaccaggttaatcgaggatcctaccactctgaacataagggggggagccagccctaccatc

SEQ ID NO: 356282 - DNA, 75 bp, Artificial Sequence
  Synthetic
ttgctgaaagaggcaatccgaaaagccttgtatgatgaggtggacagagtagagaactcagagtttcgagaggcc

SEQ ID NO: 356283 - DNA, 75 bp, Artificial Sequence
  Synthetic
atattattatccaagactcaccgagataacttcatcctcttcctcaagtcaatagagcctttattcccaaggttt

SEQ ID NO: 356284 - DNA, 75 bp, Artificial Sequence
  Synthetic
ctaagcgagctgttcagttcttcctttttgggaattccagaatcgataatagggttgattcaaaactctcgtact

SEQ ID NO: 356285 - DNA, 75 bp, Artificial Sequence
  Synthetic
ataaggagacagtttagaagaagtctgtctcaatctttagaggagtcatttttcaagtcagagctacacgggttg

SEQ ID NO: 356286 - DNA, 75 bp, Artificial Sequence
  Synthetic
acaagattgactcaagtgcctcagagggttggaagagtatggcgctgttcggcggagagagccgatcagttgagg

SEQ ID NO: 356287 - DNA, 75 bp, Artificial Sequence
  Synthetic
gaaatatcttggggaaagaaggttgttggtactactgtgcctcacccatctgaaatgttgaacctagtacctaag

SEQ ID NO: 356288 - DNA, 75 bp, Artificial Sequence
  Synthetic
tcatcagtctcttgtaattgtggcagaataaaccctgaaagtccgaggatatctgtatctgtcttgccttcattt

SEQ ID NO: 356289 - DNA, 75 bp, Artificial Sequence
  Synthetic
gataactcatttttatccagaggacccttgaaaggttacttggggtcttctacatcagtgactacccagttgttc

SEQ ID NO: 356290 - DNA, 75 bp, Artificial Sequence
  Synthetic
catgcttgggaaaaagtcaccaatattcacgtggttagaagggccctgtctttgaaggaatctatcaactggttc

SEQ ID NO: 356291 - DNA, 75 bp, Artificial Sequence
  Synthetic
atagatcgagattccaatctggccaagacgattattagaaatatactttctttaactggcccagatttcgtgata

SEQ ID NO: 356292 - DNA, 75 bp, Artificial Sequence
  Synthetic
gaggagactccactctttaaaagaactggttctgctttacacagattcaaatctgctagatatagcgaaggaggg

SEQ ID NO: 356293 - DNA, 75 bp, Artificial Sequence
  Synthetic
tactcctcagtttgcccaaacttactgtctcatatctctgtgagtactgacacaatgtctgacttaacacaggac

SEQ ID NO: 356294 - DNA, 75 bp, Artificial Sequence
  Synthetic
ggatcaaacttcgattttatgtttcagcctttgatgttatactcccagacctggacgtccgaaatagttcaaagg

SEQ ID NO: 356295 - DNA, 75 bp, Artificial Sequence
  Synthetic
gatctcagactgagagacacaacctatcattggcatctcaggtgtcagaggtgtataagacctatagaggatatc

SEQ ID NO: 356296 - DNA, 75 bp, Artificial Sequence
  Synthetic
actttagactctccatgctgctttgtttttcctgatatctccaaccgcatttctcgtatggtctctggagccgtt

SEQ ID NO: 356297 - DNA, 75 bp, Artificial Sequence
  Synthetic
cctgaagtaagaaaactaccagaggttgctctcaaggcgggcgacttctccactatctcacctagagagaggtct

SEQ ID NO: 356298 - DNA, 75 bp, Artificial Sequence
  Synthetic
tatcatatagggactgcacagggtttactatattcaatattggtggcaatccacgatcctggatataatgatcac

SEQ ID NO: 356299 - DNA, 75 bp, Artificial Sequence
  Synthetic
gccttatttcctgttaacatctatagtagaatgtctcctcaacattacttgagggggctttccagaggagtttta

SEQ ID NO: 356300 - DNA, 75 bp, Artificial Sequence
  Synthetic
ataggatcttccatctgttttttaactagaatgacaaacatcaatataaacaggcctctagaacttatttctgga

SEQ ID NO: 356301 - DNA, 75 bp, Artificial Sequence
  Synthetic
gtcatttcatatattctactcaagttggacactcacccctctctttatgttatgctaaaggaaccagggatgagg

SEQ ID NO: 356302 - DNA, 75 bp, Artificial Sequence
  Synthetic
tcagaaatcttttcgatacctcaaaagatccctgctgcctatcccaccaccatgaaggaagggaatagagccatt

SEQ ID NO: 356303 - DNA, 75 bp, Artificial Sequence
  Synthetic
ctcagttatttacaatacattctgaggtatcagaaggaggagataacccgttcagagagtagcgatctgttgtgg

SEQ ID NO: 356304 - DNA, 75 bp, Artificial Sequence
  Synthetic
atgttttctgactttaggagcatgaagatgacttatctcaccttgctgacgtttcaaacccatattcttctgcag

SEQ ID NO: 356305 - DNA, 75 bp, Artificial Sequence
  Synthetic
aaaattgggaagagtctttctaaacaaatgaggagtgacttaagacacttaaatactttgatgcgtagagttttg

SEQ ID NO: 356306 - DNA, 75 bp, Artificial Sequence
  Synthetic
ggaggccaaggagaaggtgatctagattctcaagaggacgttggcagacttctgaatgattcggtcagacggaca

SEQ ID NO: 356307 - DNA, 75 bp, Artificial Sequence
  Synthetic
aggtgggtagatcaggaagtaagacatgcagccaaaagtttatgcaaagaacccaaagaacctcttaagacctct

SEQ ID NO: 356308 - DNA, 75 bp, Artificial Sequence
  Synthetic
agacgactctgtcaggtggaatggtcttgctctcttcaacaagtagctatctccacatcttccaatccatcggct

SEQ ID NO: 356309 - DNA, 75 bp, Artificial Sequence
  Synthetic
tacaccgacatggacttaagaatgatatcacggcaaattcagaacccgctaatatctggcctgaggatagttcag

SEQ ID NO: 356310 - DNA, 75 bp, Artificial Sequence
  Synthetic
tgggcgacgggagcccattacaagattaaacctctcctccaaaagctggatcaatgtcctcagatgtgtctagta

SEQ ID NO: 356311 - DNA, 75 bp, Artificial Sequence
  Synthetic
gtgggggatggttcaggaggtatttcaagagctgttttgagggtttttccagatgccaaattgttattcaatagt

SEQ ID NO: 356312 - DNA, 75 bp, Artificial Sequence
  Synthetic
ttgctagaggtcaatgacctgatggctgccggcactcaccctcttcccccttcggcactgatgcatggaggagat

SEQ ID NO: 356313 - DNA, 75 bp, Artificial Sequence
  Synthetic
gaattgaccaaccgggttatagattttgaggccatctgggagaaaccatcggatctccggaatgtgtcaacgtgg

SEQ ID NO: 356314 - DNA, 75 bp, Artificial Sequence
  Synthetic
aaatactttcaatctgtccaggagagatccaagatgtcgttcgatctggtcatatgtgatgcagaagtcactgat

SEQ ID NO: 356315 - DNA, 75 bp, Artificial Sequence
  Synthetic
gtaacatccataaacaaaatatctctcttgatgtctgacttcattatggccatcaagtccccagtcacattgata

SEQ ID NO: 356316 - DNA, 75 bp, Artificial Sequence
  Synthetic
tttaagacctatggcacaatgttgatcaacccagattataaggcattgaggaacctgtctagggcattcccagag

SEQ ID NO: 356317 - DNA, 75 bp, Artificial Sequence
  Synthetic
gtaacagggtatataactcaactgacatcttctttctcctcggaaatttatcttatgttcaagaaacatgggagg

SEQ ID NO: 356318 - DNA, 75 bp, Artificial Sequence
  Synthetic
ttctttaaagaagcagaatcactcacagcttcaactgttcatgaaatgagcttagttctttttaactgtagaact

SEQ ID NO: 356319 - DNA, 75 bp, Artificial Sequence
  Synthetic
cctaagagtgagatgttaagggcgaggtctttgaactactcagatctgattcgaggttttcctgaagaaattata

SEQ ID NO: 356320 - DNA, 75 bp, Artificial Sequence
  Synthetic
tcaaatccgtataacgaaatgattataactttgatagacagtgaaatggagtcatttcttgttcacaaacttgtg

SEQ ID NO: 356321 - DNA, 75 bp, Artificial Sequence
  Synthetic
gatgacttagaactagccagaggatcactctcgaaattgtcgaagatacttgtgatcattatcctttattcaaac

SEQ ID NO: 356322 - DNA, 75 bp, Artificial Sequence
  Synthetic
agggtattcaatgtgtctaaaccaatgagagattcctctttctgtcctccatcagatcccaaacttcttaggcat

SEQ ID NO: 356323 - DNA, 75 bp, Artificial Sequence
  Synthetic
tataacatatgttcaagtacccttctttttttggccactgttctaggtgacacaaacagttttacaaaactgcac

SEQ ID NO: 356324 - DNA, 75 bp, Artificial Sequence
  Synthetic
gaaatgtacaatcagccagtcacatattacttcaagaagagaacaattcgagaaaagatctacttgatgtggagt

SEQ ID NO: 356325 - DNA, 75 bp, Artificial Sequence
  Synthetic
tggtctggaaaaagccctgtcttcaagagggtctcttgcaaccatgccataagtttgtctgctcactggatcagg

SEQ ID NO: 356326 - DNA, 75 bp, Artificial Sequence
  Synthetic
ttattgtacaaaattatcagaacaacgcgggttggtgaatcgggagacataatatctagagcggtaaaaagttgt

SEQ ID NO: 356327 - DNA, 75 bp, Artificial Sequence
  Synthetic
ctcaaaggttataatcgatggattttgatgcgagatattagatcaagaacttcactcctagaatacagttgtttg

SEQ ID NO: 356328 - DNA, 75 bp, Artificial Sequence
  Synthetic
tgattggtttaaagatatgtcgttcttcaactgtgtgagcgctccatatcagtcatgattaatgaaaaaaacaag

SEQ ID NO: 356329 - DNA, 75 bp, Artificial Sequence
  Synthetic
catgattaatgaaaaaaacaagtcataggctttttcgccttcttttcatgcttattcggtttttttgttaagcgt

SEQ ID NO: 356330 - DNA, 75 bp, Artificial Sequence
  Synthetic
ttggattgtatgggaacggcgttatcatgcctaatggttcatacataagcgccattgtgcaaggagagagaatgg

SEQ ID NO: 356331 - DNA, 75 bp, Artificial Sequence
  Synthetic
atgaatgcccagtgctgtcggctggtaatgatccagaagacatcgactgttggtgcacaaagtcagcagtctacg

SEQ ID NO: 356332 - DNA, 75 bp, Artificial Sequence
  Synthetic
atcactgtccttgatctgcaccccggagcaggaaaaacacgcaagatacttccccaaatcatcaaggaggccatc

SEQ ID NO: 356333 - DNA, 75 bp, Artificial Sequence
  Synthetic
ccgacccgagcagtgctggatcgatggagaggtgtgaacaaacaaacagcgatgaaacaccttctgagttttaag

SEQ ID NO: 356334 - DNA, 75 bp, Artificial Sequence
  Synthetic
ggagaggtgtgaacaaacaaacagcgatgaaacaccttctgagttttaagaaggaactagggaccttgaccagtg

SEQ ID NO: 356335 - DNA, 75 bp, Artificial Sequence
  Synthetic
gatgaaacaccttctgagttttaagaaggaactagggaccttgaccagtgctatcaatcggcggagctcaaaaca

SEQ ID NO: 356336 - DNA, 75 bp, Artificial Sequence
  Synthetic
tgagatcgttgatgtcatgtgccatgccaccctcacacataggctgatgtctccacacagagtccccaactacaa

SEQ ID NO: 356337 - DNA, 75 bp, Artificial Sequence
  Synthetic
tggaaagaacctatgcattgtcagagcaatggatgtgggatacatgtgcgatgatactatcacttatgaatgccc

SEQ ID NO: 356338 - DNA, 75 bp, Artificial Sequence
  Synthetic
agtgcaagaacgatgattgggattttgtcatcaccacagacatatcagaaatgggagccaacttcaaggcaagca

SEQ ID NO: 356339 - DNA, 75 bp, Artificial Sequence
  Synthetic
agcgaacaagaagggggcttggatggacagcaccaaggccacaaggtatttggtaaaaacagaatcatggatctt

SEQ ID NO: 356340 - DNA, 75 bp, Artificial Sequence
  Synthetic
gagtgatcgacagccgcaaaagcgtgaaacccaccatcattgaggagggtgatggaagagtcatcctgggggaac

SEQ ID NO: 356341 - DNA, 75 bp, Artificial Sequence
  Synthetic
tggacagaggctcgcatcatgctagacaacatcaacatgccaaatggtttggtggctcaactatatcagcctgag

SEQ ID NO: 356342 - DNA, 75 bp, Artificial Sequence
  Synthetic
gctgcgtgactatcatgtctaaggacaagcctaccatcgatgtgaagatgatgaatatggaggcggccaacctgg

SEQ ID NO: 356343 - DNA, 75 bp, Artificial Sequence
  Synthetic
ggctaccgtcagcgatctctccaccaaagctgcgtgcccgaccatgggagaagctcacaatgacaaacgtgctga

SEQ ID NO: 356344 - DNA, 75 bp, Artificial Sequence
  Synthetic
aatatcataccatgaccggaaatggtgctttgatggacctcgaaccaacacgattcttgaagacaacaatgaagt

SEQ ID NO: 356345 - DNA, 75 bp, Artificial Sequence
  Synthetic
tgaagtcatcacgaagttgggtgagagaaagatcctaagacccaggtgggcagatgctagagtgtactcagacca

SEQ ID NO: 356346 - DNA, 75 bp, Artificial Sequence
  Synthetic
cctgccactcgcaccaccacagagagcggaaagttgataacagattggtgctgcaggagctgcaccttaccacca

SEQ ID NO: 356347 - DNA, 75 bp, Artificial Sequence
  Synthetic
tgtgatgtccctaggtgtgttttttctactcatgcaaaggaaaggcattggcaagattggcttgggaggagtaat

SEQ ID NO: 356348 - DNA, 75 bp, Artificial Sequence
  Synthetic
ctactcatgcaaaggaaaggcattggcaagattggcttgggaggagtaatcttaggagctgccacattcttttgc

SEQ ID NO: 356349 - DNA, 75 bp, Artificial Sequence
  Synthetic
gaagtactgtgtggaggaacagagagacgttaatggagtttgaggaaccacacgccacgaagcagtctgtgatag

SEQ ID NO: 356350 - DNA, 75 bp, Artificial Sequence
  Synthetic
gacgttaatggagtttgaggaaccacacgccacgaagcagtctgtgatagcattgggctcacaagagggagctct

SEQ ID NO: 356351 - DNA, 75 bp, Artificial Sequence
  Synthetic
cacgccacgaagcagtctgtgatagcattgggctcacaagagggagctctgcatcaagctttggctggagccatt

SEQ ID NO: 356352 - DNA, 75 bp, Artificial Sequence
  Synthetic
agcgccgtggctgccaatgaaatgggctggctggacaaaaccaagaatgacattagcagcctgctagggcacaag

SEQ ID NO: 356353 - DNA, 75 bp, Artificial Sequence
  Synthetic
acttcaaagcccaatgtcagaccacgctacggcgtgctactctgcggagggtgctgcctgcgactcaaccccagg

SEQ ID NO: 356354 - DNA, 75 bp, Artificial Sequence
  Synthetic
cccttttgtggatgttggtgtgtcagctctcttgctggcagccgggtgctggggccaggtgactctgactgtgac

SEQ ID NO: 356355 - DNA, 75 bp, Artificial Sequence
  Synthetic
ttggagactcatacatagtggtgggcagaggagaacaacagatcaatcaccattggcacaagtctggaagcagca

SEQ ID NO: 356356 - DNA, 75 bp, Artificial Sequence
  Synthetic
gttagtgcctacactccttgggccatactcccatcagtcgtgggcttttggatcacgctccagtacacaaaaaga

SEQ ID NO: 356357 - DNA, 75 bp, Artificial Sequence
  Synthetic
gatcagttggaggggtgttcacctcagttgggaaggctgtccatcaagtgttcggaggagcattccgctcactgt

SEQ ID NO: 356358 - DNA, 75 bp, Artificial Sequence
  Synthetic
gaatggtgctagttcagtgtggaatgcaacgacagctattggcctttgtcacatcatgcgaggaggatggctctc

SEQ ID NO: 356359 - DNA, 75 bp, Artificial Sequence
  Synthetic
cctgtgtgagctgacaaactttagtagtgttttgtgaggattaacaacaattaacacagtgcgagctgtttctta

SEQ ID NO: 356360 - DNA, 75 bp, Artificial Sequence
  Synthetic
tgaaacgccacaaggcctagccaagatcattcagaaagctcataaggaaggagtgtgcggtctacgatcagtttc

SEQ ID NO: 356361 - DNA, 75 bp, Artificial Sequence
  Synthetic
gagtgtgcggtctacgatcagtttccagactggagcatcaaatgtgggaagcagtgaaggacgagctgaacactc

SEQ ID NO: 356362 - DNA, 75 bp, Artificial Sequence
  Synthetic
ggaatgtacaagtcagcacctaaacgcctcaccgccaccacggaaaaattggaaattggctggaaggcctgggga

SEQ ID NO: 356363 - DNA, 75 bp, Artificial Sequence
  Synthetic
ggctgtcaagaacaacttggcgatccacagtgacctgtcctattggattgaaagcaggctcaatgatacgtggaa

SEQ ID NO: 356364 - DNA, 75 bp, Artificial Sequence
  Synthetic
aaagtgattgagaagatggaaacactccaaaggcgatatggaggtggccttgtaagaaaccccctttcacgcaac

SEQ ID NO: 356365 - DNA, 75 bp, Artificial Sequence
  Synthetic
ttatcactgacggtgaaaaccgagtggttctaggagagccatcagccatcactgcggccagcgccgcgcaaagga

SEQ ID NO: 356366 - DNA, 75 bp, Artificial Sequence
  Synthetic
aatacgtcctcaatgagaccacgaactggctgtgggccttcttagcccgcgataagaaacctaggatgtgttccc

SEQ ID NO: 356367 - DNA, 75 bp, Artificial Sequence
  Synthetic
ttggccacccaggaggtccttcgcaagaggtggacagccaagatcagcatgccagctatactgattgctctgcta

SEQ ID NO: 356368 - DNA, 75 bp, Artificial Sequence
  Synthetic
acactgatgtgttacgctatgtcatcttggtgggggcagctttcgcagaatctaattcgggaggagacgtggtac

SEQ ID NO: 356369 - DNA, 75 bp, Artificial Sequence
  Synthetic
gagcgtgaagcgcatctccgtggagaatgcaacacctgcatctacaacatgatgggaaagagagagaagaagcct

SEQ ID NO: 356370 - DNA, 75 bp, Artificial Sequence
  Synthetic
tcgtttctcaaagcgagatggaccaaccaggagaacattttgttgatgttggcggctgttttctttcaaatggct

SEQ ID NO: 356371 - DNA, 75 bp, Artificial Sequence
  Synthetic
tatcacgatgcccgccaaattctgctctgggagatccctgatgtgttgaattcactggcggtagcttggatgata

SEQ ID NO: 356372 - DNA, 75 bp, Artificial Sequence
  Synthetic
agccctgctaacacccgggctgagatgcttgaatctggatgtgtacaggatactgctgttgatggtcggaatagg

SEQ ID NO: 356373 - DNA, 75 bp, Artificial Sequence
  Synthetic
aacaggacttttcaaccccatgatccttgctgctggactgattgcatgtgatcccaaccgtaaacgcggatggcc

SEQ ID NO: 356374 - DNA, 75 bp, Artificial Sequence
  Synthetic
tttcttagcacgaagatctcgatgtctaagaaaccaggagggcccggcaagaaccgggctgtcaatatgctaaaa

SEQ ID NO: 356375 - DNA, 75 bp, Artificial Sequence
  Synthetic
ctaagaaaccaggagggcccggcaagaaccgggctgtcaatatgctaaaacgcggaatgccccgcgtgttgtcct

SEQ ID NO: 356376 - DNA, 75 bp, Artificial Sequence
  Synthetic
gattgagagaacagcggacatttcctgggaaagtgatgcagaaattacaggctcgagcgaaagagttgatgtgcg

SEQ ID NO: 356377 - DNA, 75 bp, Artificial Sequence
  Synthetic
gctcgagcgaaagagttgatgtgcggcttgatgatgatggaaacttccagctcatgaatgatccaggagcacctt

SEQ ID NO: 356378 - DNA, 75 bp, Artificial Sequence
  Synthetic
tgactggcagcaggtcccattctgttcaaaccattttacggaactgatcatgaaggacggcaggacgctggtggt

SEQ ID NO: 356379 - DNA, 75 bp, Artificial Sequence
  Synthetic
tgattctcagagctataagcttcaccaacacttcaaatgtggtggtgccgctgctggcccttttgacacctggat

SEQ ID NO: 356380 - DNA, 75 bp, Artificial Sequence
  Synthetic
ttggattttggataactctccaatacacaaagagaggaggcgtgttgtgggacactccctcaccaaaggagtaca

SEQ ID NO: 356381 - DNA, 75 bp, Artificial Sequence
  Synthetic
gacactccctcaccaaaggagtacaaaaagggggacacgaccaccggcgtctacaggatcatgactcgtgggctg

SEQ ID NO: 356382 - DNA, 75 bp, Artificial Sequence
  Synthetic
cgcctgcctggcgaagtcatacgcgcagatgtggctgctgctttatttccaccgtagagacctgagattgatggc

SEQ ID NO: 356383 - DNA, 75 bp, Artificial Sequence
  Synthetic
ggaagaaccatcttgaaagagaatatcaagtacgaagtggccatttttgtccatggaccaactactgtggagtcg

SEQ ID NO: 356384 - DNA, 75 bp, Artificial Sequence
  Synthetic
cggcacacgaacccgcgccacttgggctgaaaatatccatgtggcaatcaatcaggtccgttcggtgattggaga

SEQ ID NO: 356385 - DNA, 75 bp, Artificial Sequence
  Synthetic
tgaggaaccctggatatgccctggtggcagctgtcattggttggatgcttggaagcaacaccatgcagcgagttg

SEQ ID NO: 356386 - DNA, 75 bp, Artificial Sequence
  Synthetic
gagctctgcatcaagctttggctggagccattcctgtggaattttcaagcaacactgtcaagttgacgtcgggtc

SEQ ID NO: 356387 - DNA, 75 bp, Artificial Sequence
  Synthetic
ggtcattggattctggataacccttcagtacacaaagagaggaggtgttctttgggacacaccatcacccaagga

SEQ ID NO: 356388 - DNA, 75 bp, Artificial Sequence
  Synthetic
agcgtgaaagaagaccgactctgctatggggggccatggaaactccaacataaatggaatggacatgatgaggtc

SEQ ID NO: 356389 - DNA, 75 bp, Artificial Sequence
  Synthetic
aagaggttacatttccacaaaggtcgagctaggggaggcggcggcaatattcatgacagccaccccaccaggcac

SEQ ID NO: 356390 - DNA, 75 bp, Artificial Sequence
  Synthetic
ttcagatccattcccagagtccaattcaccaatttccgacttacagactgagatcccggatcgagcttggaactc

SEQ ID NO: 356391 - DNA, 75 bp, Artificial Sequence
  Synthetic
aggagccgcaattagtgcaaagctatggctggaacacagtgaccatgaagagtggggtagatgtgtactacaggg

SEQ ID NO: 356392 - DNA, 75 bp, Artificial Sequence
  Synthetic
cttctgctctgcacaaccagccacacggcacagtgcgccgacataggtggctggtggtgctagaacacaggatct

SEQ ID NO: 356393 - DNA, 75 bp, Artificial Sequence
  Synthetic
agaaaaaactttctggaactgttgaggactgcagatctgccagtttggctggcttacaaggttgcagcggctgga

SEQ ID NO: 356394 - DNA, 75 bp, Artificial Sequence
  Synthetic
ggactgcagatctgccagtttggctggcttacaaggttgcagcggctggagtgtcataccacgaccggaggtggt

SEQ ID NO: 356395 - DNA, 75 bp, Artificial Sequence
  Synthetic
gtgtcataccacgaccggaggtggtgctttgatggtcctaggacaaacacaattttagaagacaacaacgaagtg

SEQ ID NO: 356396 - DNA, 75 bp, Artificial Sequence
  Synthetic
gctccgccagttcgctggtcaatggagtggttaggctcctctcaaaaccatgggacaccatcacgaatgttacca

SEQ ID NO: 356397 - DNA, 75 bp, Artificial Sequence
  Synthetic
aggcacatctgcggggggaatgtcacacttgcatctacaacatgatgggaaagagagagaaaaaacccggagagt

SEQ ID NO: 356398 - DNA, 75 bp, Artificial Sequence
  Synthetic
ctgtgacaacagcggtcctcactccactgctaaagcatttgatcacgtcagattacatcaacacctcattgacct

SEQ ID NO: 356399 - DNA, 75 bp, Artificial Sequence
  Synthetic
cgtggccacggacgtcccagaattagagcgcaccacacccatcatgcagaagaaagttggacagatcatgctgat

SEQ ID NO: 356400 - DNA, 75 bp, Artificial Sequence
  Synthetic
agaaagttggacagatcatgctgatcttggtgtctctagctgcagtagtagtgaacccgtctgtgaagacagtac

SEQ ID NO: 356401 - DNA, 75 bp, Artificial Sequence
  Synthetic
gtgaacccgtctgtgaagacagtacgagaagccggaattttgatcacggccgcagcggtgacgctttgggagaat

SEQ ID NO: 356402 - DNA, 75 bp, Artificial Sequence
  Synthetic
gttgtacttccacagaagagatctgagactgatggcgaatgccatctgctcggcggtcccagttagctgggtgcc

SEQ ID NO: 356403 - DNA, 75 bp, Artificial Sequence
  Synthetic
aagaggtggggcaaaaggacgcaccttgggagaggtttggaaagaaagactcaaccagatgacaaaagaagagtt

SEQ ID NO: 356404 - DNA, 75 bp, Artificial Sequence
  Synthetic
cccggacatgaagagccccaactagtgcaaagttatggatggaacattgtcaccatgaagagtggagtggatgtg

SEQ ID NO: 356405 - DNA, 75 bp, Artificial Sequence
  Synthetic
aattaattgtaaatagacaatataagtatgcataaaagtgtagttttatagtagtatttagtggtgttagtgtaa

SEQ ID NO: 356406 - DNA, 75 bp, Artificial Sequence
  Synthetic
ttctacagaccttctgagtgttgtgacaccctcctttgtgacatcggagagtcctcgtcaagtgctgaggttgaa

SEQ ID NO: 356407 - DNA, 75 bp, Artificial Sequence
  Synthetic
aaaccaggggtgttcaaaacacctgaaggagaaatcggggccgtgactttggacttccccactggaacatcaggc

SEQ ID NO: 356408 - DNA, 75 bp, Artificial Sequence
  Synthetic
agggccaagggaattttgcgtgaaggtgctctgcccctacatgccgaaagtcatagagaagatggagctgctcca

SEQ ID NO: 356409 - DNA, 75 bp, Artificial Sequence
  Synthetic
agctctgtggaccgcacaaggcgcagccataaccttggtgaaggtgttagccaaggagaagggactagaggttag

SEQ ID NO: 356410 - DNA, 75 bp, Artificial Sequence
  Synthetic
ccaaggagaagggactagaggttagcggagaccctgcgcatatagaaagagaggcacggcccagcctgacagaag

SEQ ID NO: 356411 - DNA, 75 bp, Artificial Sequence
  Synthetic
agaaacccactctcacggaattccacgcacgagatgtattgggtgagtcgagcttcaggcaatgtggtacattca

SEQ ID NO: 356412 - DNA, 75 bp, Artificial Sequence
  Synthetic
gaggcacggcccagcctgacagaagctgtaagtcaggggaaggactagaggttagaggagaccccgtgcgaaaca

SEQ ID NO: 356413 - DNA, 75 bp, Artificial Sequence
  Synthetic
cggtgggaaaacccctgctcaactcagacaccagtaaaatcaagaacaggattgaacgactcaggcgtgagtaca

SEQ ID NO: 356414 - DNA, 75 bp, Artificial Sequence
  Synthetic
aacgtcccagaatgtgctctcgagaggaattcataagaaaggtcaacagcaatgcagctttgggtgccatgtttg

SEQ ID NO: 356415 - DNA, 75 bp, Artificial Sequence
  Synthetic
gagtgttcaaggaaaaggtggacacaaaggctccagagcctccagaaggagtcaaatacgtcctcaatgagacta

SEQ ID NO: 356416 - DNA, 75 bp, Artificial Sequence
  Synthetic
gattgacaccaatgcatattacgttatgaccgttggaacaaagacgttcttggtccatcgtgagtggtttatgga

SEQ ID NO: 356417 - DNA, 75 bp, Artificial Sequence
  Synthetic
agttcggaaaggccaagggaagcagagccatttggttcatgtggctcggagctcgctttctggagttcgaggctc

SEQ ID NO: 356418 - DNA, 75 bp, Artificial Sequence
  Synthetic
gcttggaagaaagaactcaggaggaggtgtcgagggcttgggcctccaaaaactgggttacatcctgcgtgaagt

SEQ ID NO: 356419 - DNA, 75 bp, Artificial Sequence
  Synthetic
tggatggggaataccggctcagaggagaagagagaaaaaactttctggaactgttgaggactgcagatctgccag

SEQ ID NO: 356420 - DNA, 75 bp, Artificial Sequence
  Synthetic
ctatcgtcacaaagttgtgaaagtgatgcgcccggctgctgatggaagaaccgtcatggatgttatctccagaga

SEQ ID NO: 356421 - DNA, 75 bp, Artificial Sequence
  Synthetic
cgttcttcagattcactgcaattgctccgactcgtgcggtgctggacaggtggagaggcgtcaacaaacaaacag

SEQ ID NO: 356422 - DNA, 75 bp, Artificial Sequence
  Synthetic
tccgactcgtgcggtgctggacaggtggagaggcgtcaacaaacaaacagcaatgaagcatctcttgagtttcaa

SEQ ID NO: 356423 - DNA, 75 bp, Artificial Sequence
  Synthetic
ccaacctggccgtccagctggtgaggatgatggaaggggaaggagtgattggcccagatgatgtggagaaactca

SEQ ID NO: 356424 - DNA, 75 bp, Artificial Sequence
  Synthetic
aaaagaaaagaggaggcacagcaggcttcactatcttgcttgggctgactgcctgcgctggagctgtgaccctct

SEQ ID NO: 356425 - DNA, 75 bp, Artificial Sequence
  Synthetic
gactgttaatgcaactgatgtcaccgacgtgatcaccattccaacagctgccggaaaaaacctgtgcatcgtgag

SEQ ID NO: 356426 - DNA, 75 bp, Artificial Sequence
  Synthetic
gacgtgatcaccattccaacagctgccggaaaaaacctgtgcatcgtgagagcgatggacgtgggatacctctgt

SEQ ID NO: 356427 - DNA, 75 bp, Artificial Sequence
  Synthetic
cggttttagccgctggaaatgaccccgaagatattgactgctggtgcacgaaatcatccgtctacgtgcgatatg

SEQ ID NO: 356428 - DNA, 75 bp, Artificial Sequence
  Synthetic
aaatcatccgtctacgtgcgatatggaagatgcacaaagactcggcattctcgccgaagcagaaggtccttgaca

SEQ ID NO: 356429 - DNA, 75 bp, Artificial Sequence
  Synthetic
ttctgttggatggctgaagttccaggaacgaagatcgccggaatgttgctgctctcccttctcttgatgattgtg

SEQ ID NO: 356430 - DNA, 75 bp, Artificial Sequence
  Synthetic
tgagaaacccgggctacgcccttgtcgcagctgttatcggatggatgctcgggagcaacacaatgcaacgcgtcg

SEQ ID NO: 356431 - DNA, 75 bp, Artificial Sequence
  Synthetic
agcaccagcatacagtttcaattgcctgggaatgagcaacagggacttcctggagggagtgtctggagccacatg

SEQ ID NO: 356432 - DNA, 75 bp, Artificial Sequence
  Synthetic
gagtgacataagcagtttgtttgggcaaagaattgaggtcaaggagaattttagcatgggagagtttcttctgga

SEQ ID NO: 356433 - DNA, 75 bp, Artificial Sequence
  Synthetic
agttgtgtgactataatgtcaaaagataagccaacgattgatgtcaagatgatgaacatggaagcagccaatcta

SEQ ID NO: 356434 - DNA, 75 bp, Artificial Sequence
  Synthetic
ctgtacgctgtgacaacagcggtcctcactccactgctaaagcatttgatcacgtcagattacatcaacacctca

SEQ ID NO: 356435 - DNA, 75 bp, Artificial Sequence
  Synthetic
tagcttcggtcagtgacctatcaacaagagccgcatgcccaaccatgggtgaagcccacaacgagaaaagagctg

SEQ ID NO: 356436 - DNA, 75 bp, Artificial Sequence
  Synthetic
aagagccgcatgcccaaccatgggtgaagcccacaacgagaaaagagctgactccgcctttgtttgcaagcaagg

SEQ ID NO: 356437 - DNA, 75 bp, Artificial Sequence
  Synthetic
aagtatgtggattacatgagttcactaaagagatatgaagacacaactttggttgaggacacagtactgtagata

SEQ ID NO: 356438 - DNA, 75 bp, Artificial Sequence
  Synthetic
ggatgcggattgtttggcaaggggagcatagacacatgtgcaaagttcacctgcacaaccaaggcaactggctgg

SEQ ID NO: 356439 - DNA, 75 bp, Artificial Sequence
  Synthetic
taagtatgcataaaagtgtagttttatagtagtatttagtggtgttagtgtaaatagttaagaaaattttgagga

SEQ ID NO: 356440 - DNA, 75 bp, Artificial Sequence
  Synthetic
gcatagacacatgtgcaaagttcacctgcacaaccaaggcaactggctggatcattcagaaagaaaacatcaagt

SEQ ID NO: 356441 - DNA, 75 bp, Artificial Sequence
  Synthetic
caccggaagttgagtagacggtgctgcctgcgactcaaccccaggaggactgggtgaacaaagccgcgaagtgat

SEQ ID NO: 356442 - DNA, 75 bp, Artificial Sequence
  Synthetic
cccgacgacagtcgactcccatggcaattactcaacacaggtaggagccacccaggccggaagattcagcataac

SEQ ID NO: 356443 - DNA, 75 bp, Artificial Sequence
  Synthetic
aattactcaacacaggtaggagccacccaggccggaagattcagcataaccccatcagcaccgtcttacacgctg

SEQ ID NO: 356444 - DNA, 75 bp, Artificial Sequence
  Synthetic
cttcaaagcccaatgtcagaccacgctacggcgtgctactctgcggagagtgcagtctgcgatagtgccccagga

SEQ ID NO: 356445 - DNA, 75 bp, Artificial Sequence
  Synthetic
cagttgactgtgagccacggtcagggatagacactagcgcctattatgtcatgtcggtcggcgcgaagtcctttc

SEQ ID NO: 356446 - DNA, 75 bp, Artificial Sequence
  Synthetic
gatagacactagcgcctattatgtcatgtcggtcggcgcgaagtcctttctagtccaccgagaatggttcatgga

SEQ ID NO: 356447 - DNA, 75 bp, Artificial Sequence
  Synthetic
gaggtttctcgaaccggtcggaaaagtgattgaccttggatgtggaagaggcggttggtgttactatatggcaac

SEQ ID NO: 356448 - DNA, 75 bp, Artificial Sequence
  Synthetic
ggaggtactacgtggaggaaccgggaagcactgatggaatttgaagaacctcatgctaccaaacagtctgtcgta

SEQ ID NO: 356449 - DNA, 75 bp, Artificial Sequence
  Synthetic
aagcactgatggaatttgaagaacctcatgctaccaaacagtctgtcgtagccttaggatcgcaagaaggtgctt

SEQ ID NO: 356450 - DNA, 75 bp, Artificial Sequence
  Synthetic
ctgaagctgtaggtcaggggaaggactagaggttagtggagaccccgtgccacaaaacaccacaacaaaacagca

SEQ ID NO: 356451 - DNA, 75 bp, Artificial Sequence
  Synthetic
ctagaggttagtggagaccccgtgccacaaaacaccacaacaaaacagcatattgacacctgggatagactagga

SEQ ID NO: 356452 - DNA, 75 bp, Artificial Sequence
  Synthetic
tcccgttgcgttctcaagcaacactgtgaagttgacatcagggcacttgaagtgtagagtaaaaatggagaaact

SEQ ID NO: 356453 - DNA, 75 bp, Artificial Sequence
  Synthetic
gtgaagttgacatcagggcacttgaagtgtagagtaaaaatggagaaactgcagctgaagggaacgacatatggg

SEQ ID NO: 356454 - DNA, 75 bp, Artificial Sequence
  Synthetic
ttgggacccccgctgacactggccatggaacagtggtgttggagctgcagtacaccgggaaagacgggccctgta

SEQ ID NO: 356455 - DNA, 75 bp, Artificial Sequence
  Synthetic
tggaacagtggtgttggagctgcagtacaccgggaaagacgggccctgtaaagtgcccatttcttccgtggcttc

SEQ ID NO: 356456 - DNA, 75 bp, Artificial Sequence
  Synthetic
aggctggtgaccgtgaatccctttgtgtccgtggctacggccaactcaaagattttgattgaaatcgaacctccg

SEQ ID NO: 356457 - DNA, 75 bp, Artificial Sequence
  Synthetic
tgtccgtggctacggccaactcaaagattttgattgaaatcgaacctccgtttggtgactcttacatcgtggtgg

SEQ ID NO: 356458 - DNA, 75 bp, Artificial Sequence
  Synthetic
acctgagatgctgaggaaaaaacagatcactgttctggatcttcatcccggtgccggtaagacaaggaggattct

SEQ ID NO: 356459 - DNA, 75 bp, Artificial Sequence
  Synthetic
gacggtgctgcctgcgactcaaccccaggaggactgggtgaacaaagccgcgaagtgatccatgtaagccctcag

SEQ ID NO: 356460 - DNA, 75 bp, Artificial Sequence
  Synthetic
ccactggcacaaatccgggagtagcataggaaaggctttcaccaccactcttagaggagcgcaacggcttgcagc

SEQ ID NO: 356461 - DNA, 75 bp, Artificial Sequence
  Synthetic
ataggaaaggctttcaccaccactcttagaggagcgcaacggcttgcagcccttggagacactgcctgggacttc

SEQ ID NO: 356462 - DNA, 75 bp, Artificial Sequence
  Synthetic
gtctcggaaggaggaccccacatgttgaacaaagccgcgaagtgatccatgtaagccctcagaaccgtctcggaa

SEQ ID NO: 356463 - DNA, 75 bp, Artificial Sequence
  Synthetic
cggttgggaaagctatacaccaggtctttggaggagcttttagatcactttttggagggatgtcctggattacac

SEQ ID NO: 356464 - DNA, 75 bp, Artificial Sequence
  Synthetic
cggttggaggagttctgctcttcctctcggtcaatgtccacgctgacacaggttgtgccattgacattggtaggc

SEQ ID NO: 356465 - DNA, 75 bp, Artificial Sequence
  Synthetic
tggatggatcgctacaagttctacccggagacgccacaaggcttagcaaaaatcattcagaaagcacatgctgaa

SEQ ID NO: 356466 - DNA, 75 bp, Artificial Sequence
  Synthetic
gtgcagacacacggagaaagcactctagcgaacaagaagggggcttggatggacagcaccaaggccacaaggtat

SEQ ID NO: 356467 - DNA, 75 bp, Artificial Sequence
  Synthetic
acatctcctgggaaagtgatgcagaaattacaggctcgagcgaaagagttgatgtgcggcttgatgatgatggaa

SEQ ID NO: 356468 - DNA, 75 bp, Artificial Sequence
  Synthetic
ccagactcgagcaccaaatgtgggaggccatcaaggatgagttgaacactctgttgaaagagaatggagtcgacc

SEQ ID NO: 356469 - DNA, 75 bp, Artificial Sequence
  Synthetic
ctgttgaaagagaatggagtcgacctaagcatcgtggtagaaaaacagaatgggatgtacaaagcagcgccaaaa

SEQ ID NO: 356470 - DNA, 75 bp, Artificial Sequence
  Synthetic
ctagctaacaacacttttgtcatcgacggtcctgagaccgaggaatgcccgacgaccaaccgagcatggaacagc

SEQ ID NO: 356471 - DNA, 75 bp, Artificial Sequence
  Synthetic
gactgacgagcactcgcatattcctgaagatccgggaaacgaacacaacggagtgcgactcgaagatcataggga

SEQ ID NO: 356472 - DNA, 75 bp, Artificial Sequence
  Synthetic
gaagatccgggaaacgaacacaacggagtgcgactcgaagatcatagggaccgccgttaagaataacatggctgt

SEQ ID NO: 356473 - DNA, 75 bp, Artificial Sequence
  Synthetic
gaaagtggactcaacgacacctggaagcttgagagagcggtcttaggagaggtcaaatcatgcacctggcccgag

SEQ ID NO: 356474 - DNA, 75 bp, Artificial Sequence
  Synthetic
ggctgcggactatttggcaaaggaagcattgacacatgcgccaaatttgcctgctctaccaaggcaataggaaga

SEQ ID NO: 356475 - DNA, 75 bp, Artificial Sequence
  Synthetic
ttttggaaagtgatctcattatacccattaccttagcagggcctagaagcaaccacaacaggagaccgggatata

SEQ ID NO: 356476 - DNA, 75 bp, Artificial Sequence
  Synthetic
gactactgtccaggaacaactgtaaccctaagtgacagttgcggacaccgtgggcccgcggcacgcacgaccacc

SEQ ID NO: 356477 - DNA, 75 bp, Artificial Sequence
  Synthetic
ggtgctgcagaagctgcaccctccctcctctgcgcttccaaactgaaaatggttgttggtatggaatggaaattc

SEQ ID NO: 356478 - DNA, 75 bp, Artificial Sequence
  Synthetic
agcaaactcaggcggagatgtcgtgcacttagcgcttatggccacattcaaaatccagccagtcttcctggttgc

SEQ ID NO: 356479 - DNA, 75 bp, Artificial Sequence
  Synthetic
cacttagcgcttatggccacattcaaaatccagccagtcttcctggttgcttccttcttgaaagcaagatggacc

SEQ ID NO: 356480 - DNA, 75 bp, Artificial Sequence
  Synthetic
cctgaatgacctcacacctgttggaaggttggtgaccgtgaatccatttgtgtctgtggccacggctaactcgaa

SEQ ID NO: 356481 - DNA, 75 bp, Artificial Sequence
  Synthetic
ttgcagccacttttttccaaatggcttattatgatgccaggaatgttctggcatgggaaatgcctgatgtcctaa

SEQ ID NO: 356482 - DNA, 75 bp, Artificial Sequence
  Synthetic
ttattatgatgccaggaatgttctggcatgggaaatgcctgatgtcctaaattctctttccgtcgcgtggatgat

SEQ ID NO: 356483 - DNA, 75 bp, Artificial Sequence
  Synthetic
acttcaaacgtggtggtgccgctgttggcccttttgacacctgggttaaaatgcttaaatctggatgtgtacagg

SEQ ID NO: 356484 - DNA, 75 bp, Artificial Sequence
  Synthetic
gattgaacgactcaggtgtgagtacagttctacgtggcaccccgatgagaaccacccatatagaacctggaacta

SEQ ID NO: 356485 - DNA, 75 bp, Artificial Sequence
  Synthetic
gagttcggaaaggccaaggggagcagagccatatggtttatgtggctcggagctcgctttttggagttcgaagct

SEQ ID NO: 356486 - DNA, 75 bp, Artificial Sequence
  Synthetic
ctatggctatccccatgaccattgccggactcatgtttgtggcatttgtcatttctgggaaatcaacagacatgt

SEQ ID NO: 356487 - DNA, 75 bp, Artificial Sequence
  Synthetic
ttgggagagtgatgctgaaatcacaggttctagcgagagagtggatgttaggctggatgatgatgggaattttca

SEQ ID NO: 356488 - DNA, 75 bp, Artificial Sequence
  Synthetic
ggttctagcgagagagtggatgttaggctggatgatgatgggaattttcaattgatgaacgatccaggagcgcca

SEQ ID NO: 356489 - DNA, 75 bp, Artificial Sequence
  Synthetic
cctgcttggcaataagtgcctacacaccttgggccatcctcccttcagtcattggattctggataacccttcaat

SEQ ID NO: 356490 - DNA, 75 bp, Artificial Sequence
  Synthetic
attggattctggataacccttcaatacacaaagcgaggaggtgtcctatgggacacaccatcgcccaaagagtac

SEQ ID NO: 356491 - DNA, 75 bp, Artificial Sequence
  Synthetic
gctcggcagctaccaggctggagccggagtgatggtagagggagtgttccacacattatggcacaccaccaaggg

SEQ ID NO: 356492 - DNA, 75 bp, Artificial Sequence
  Synthetic
cgcctggatccctactgggggagcgtgaaagaggaccgactgtgctatggagggccttggaaactccaacaaaag

SEQ ID NO: 356493 - DNA, 75 bp, Artificial Sequence
  Synthetic
tgaaagaggaccgactgtgctatggagggccttggaaactccaacaaaagtggaatgggcacgatgaggtccaaa

SEQ ID NO: 356494 - DNA, 75 bp, Artificial Sequence
  Synthetic
ccacagtgacctgtcctattggattgaaagcaggctcaatgatacgtggaagcttgaaagggcagttctgggtga

SEQ ID NO: 356495 - DNA, 75 bp, Artificial Sequence
  Synthetic
cgtgaaaaacgtccagacaaaacccggagtgttcaaaacaccagaaggagaaattggagcagtcacgttagacta

SEQ ID NO: 356496 - DNA, 75 bp, Artificial Sequence
  Synthetic
tggttgaggacacagtactgtaaatatttcattaattgtaaacagacaatataagcatgtgtaaaagtatagttt

SEQ ID NO: 356497 - DNA, 75 bp, Artificial Sequence
  Synthetic
ggagtgttcaaaacaccagaaggagaaattggagcagtcacgttagactaccccaccggaacgtcaggttccccc

SEQ ID NO: 356498 - DNA, 75 bp, Artificial Sequence
  Synthetic
ttgggttgtatggaaacggcgtcatcatgccgaatggctcgtacataagcgccattgtgcaaggagagagaatgg

SEQ ID NO: 356499 - DNA, 75 bp, Artificial Sequence
  Synthetic
tccatgtaagccctcagaaccgtctcggaaggaggaccccacatgttgtagcttcaaagcccaatgtcagaccac

SEQ ID NO: 356500 - DNA, 75 bp, Artificial Sequence
  Synthetic
catgccgaatggctcgtacataagcgccattgtgcaaggagagagaatggaagaaccagcgccggctggtttcga

SEQ ID NO: 356501 - DNA, 75 bp, Artificial Sequence
  Synthetic
gagatcttctgctctcgcacaaccagccaccattgacggcgcactgtgccgacaattgtggctggttgtgcgaga

SEQ ID NO: 356502 - DNA, 75 bp, Artificial Sequence
  Synthetic
atttctgtccttgacctgcaccctggagcaggaaaaacacgcaaaatacttccccaaattatcaaagaggccatc

SEQ ID NO: 356503 - DNA, 75 bp, Artificial Sequence
  Synthetic
tggcacccaccagggtcgttgctgctgagatggctgaggccttgagagggctccccatccggtaccaaacctcag

SEQ ID NO: 356504 - DNA, 75 bp, Artificial Sequence
  Synthetic
gccaccctcacacataggctgatgtctccacacagagttcccaattacaatctgttcataatggatgaagcccac

SEQ ID NO: 356505 - DNA, 75 bp, Artificial Sequence
  Synthetic
ctagaggatacatagcaaccaaggttgagttgggcgaagccgctgcgattttcatgacggcgacgccacccggga

SEQ ID NO: 356506 - DNA, 75 bp, Artificial Sequence
  Synthetic
tgagttgggcgaagccgctgcgattttcatgacggcgacgccacccgggacttcggacccctttccagagtctaa

SEQ ID NO: 356507 - DNA, 75 bp, Artificial Sequence
  Synthetic
gagatcccagatagagcttggaacactggatacgagtggataaccgagtacgtcggaaagactgtttggttcgtt

SEQ ID NO: 356508 - DNA, 75 bp, Artificial Sequence
  Synthetic
ctggatacgagtggataaccgagtacgtcggaaagactgtttggttcgttccaagtgttaaaatgggaaatgaaa

SEQ ID NO: 356509 - DNA, 75 bp, Artificial Sequence
  Synthetic
gaagaaggtaatccagctgaacaggaagtcttatgagacagaataccccaagtgtaaaaacgacgattgggactt

SEQ ID NO: 356510 - DNA, 75 bp, Artificial Sequence
  Synthetic
atgggagccaacttcaaggccaacagagtgatcgatagccggaaaagcgtgaaacccactattgttgaggaaggt

SEQ ID NO: 356511 - DNA, 75 bp, Artificial Sequence
  Synthetic
gagtgatcgatagccggaaaagcgtgaaacccactattgttgaggaaggtgatggaagagtcattctgggagaac

SEQ ID NO: 356512 - DNA, 75 bp, Artificial Sequence
  Synthetic
agaaacccatcacaagtcggcgatgagtactgctatggagggcacacaaatgaggacgactctaactttgcccat

SEQ ID NO: 356513 - DNA, 75 bp, Artificial Sequence
  Synthetic
ataatatcaacatgccaaatggtttggtggcccagttgtatcatcctgagcgagagaaagtgtacaccatggacg

SEQ ID NO: 356514 - DNA, 75 bp, Artificial Sequence
  Synthetic
ggtggcccagttgtatcatcctgagcgagagaaagtgtacaccatggacggggagtacagactcagaggggaaga

SEQ ID NO: 356515 - DNA, 75 bp, Artificial Sequence
  Synthetic
agaacagctgatctaccagtctggctcgcttataaagtggcagcggcaggaatatcatatcatgatcggaaatgg

SEQ ID NO: 356516 - DNA, 75 bp, Artificial Sequence
  Synthetic
tcgcttataaagtggcagcggcaggaatatcatatcatgatcggaaatggtgctttgacggaccccgaactaaca

SEQ ID NO: 356517 - DNA, 75 bp, Artificial Sequence
  Synthetic
cgaagtcatcacgaagctaggtgagaggaagattctgcgacccaggtgggtagatgccagagtgtattcagacca

SEQ ID NO: 356518 - DNA, 75 bp, Artificial Sequence
  Synthetic
aggaagattctgcgacccaggtgggtagatgccagagtgtattcagaccaccaggctctgaagtccttcaaagat

SEQ ID NO: 356519 - DNA, 75 bp, Artificial Sequence
  Synthetic
agcgccgtggctgccaatgaaatgggttggctggacaagaccaagaatgacattggcagcctgttgggacacaag

SEQ ID NO: 356520 - DNA, 75 bp, Artificial Sequence
  Synthetic
tcgggcttgtcgaggtgctcgggagaatgcccgaacactttatggggaaaacttgggaggctttggatacgatgt

SEQ ID NO: 356521 - DNA, 75 bp, Artificial Sequence
  Synthetic
aatgcccgaacactttatggggaaaacttgggaggctttggatacgatgtatgtggtagcaactgctgaaaaagg

SEQ ID NO: 356522 - DNA, 75 bp, Artificial Sequence
  Synthetic
gaggaactcccggacgcccttcagacaatagctttgatcgcgctcttgagtgtgatgtccttgggcgtgttcttc

SEQ ID NO: 356523 - DNA, 75 bp, Artificial Sequence
  Synthetic
caatagctttgatcgcgctcttgagtgtgatgtccttgggcgtgttcttcctgctcatgcaaaggaaaggcattg

SEQ ID NO: 356524 - DNA, 75 bp, Artificial Sequence
  Synthetic
tctaggagctgccacattcttttgttggatggctgatgttccgggaacgaaaatagcgggcatgcttttgctgtc

SEQ ID NO: 356525 - DNA, 75 bp, Artificial Sequence
  Synthetic
tggatggctgatgttccgggaacgaaaatagcgggcatgcttttgctgtccttactgctcatgattgttctgatt

SEQ ID NO: 356526 - DNA, 75 bp, Artificial Sequence
  Synthetic
agactgacaaccagcttgctgtgtttctgatctgtgtgctcacgctggtcagcgccgtggccgccaatgagatgg

SEQ ID NO: 356527 - DNA, 75 bp, Artificial Sequence
  Synthetic
tctgatctgtgtgctcacgctggtcagcgccgtggccgccaatgagatgggttggctggataagacaaaaaatga

SEQ ID NO: 356528 - DNA, 75 bp, Artificial Sequence
  Synthetic
gtagaagctagagaaacaactttgggggttgagagcttcttgcttgatttgcggccggccacggcatggtcactt

SEQ ID NO: 356529 - DNA, 75 bp, Artificial Sequence
  Synthetic
tatgccgtgacaacagccgttctcacccctcttctgaagcacttgatcacgtcggactacatcaacacttcgttg

SEQ ID NO: 356530 - DNA, 75 bp, Artificial Sequence
  Synthetic
agcagtgaaggacgagctgaacactcttttgaaagagaatggtgtggaccttagtgtcgtggttgagaaacagga

SEQ ID NO: 356531 - DNA, 75 bp, Artificial Sequence
  Synthetic
gctctcttgctggcggctgggtgctggggccaggtgactttgacagtgaccgtaaccgcagccactctgcttttt

SEQ ID NO: 356532 - DNA, 75 bp, Artificial Sequence
  Synthetic
gctggcaagcagaggctatgcgatctgcccagcggcggacagctgccggcatcatgaagaatgcagtggtggatg

SEQ ID NO: 356533 - DNA, 75 bp, Artificial Sequence
  Synthetic
tgcccagcggcggacagctgccggcatcatgaagaatgcagtggtggatggaatcgtggctactgatgtgcctga

SEQ ID NO: 356534 - DNA, 75 bp, Artificial Sequence
  Synthetic
ggaccccacatgtaagccctcagaaccgtctcggaaggaggaccccacatgtaagccctcagaaccgtctcggaa

SEQ ID NO: 356535 - DNA, 75 bp, Artificial Sequence
  Synthetic
cagaaaaaagttggacagatcatgctgattttggtgtcaatggccgcggtggtcgtgaatccatcagtgaggacc

SEQ ID NO: 356536 - DNA, 75 bp, Artificial Sequence
  Synthetic
tgattttggtgtcaatggccgcggtggtcgtgaatccatcagtgaggaccgtcagagaggctggaatcctgacca

SEQ ID NO: 356537 - DNA, 75 bp, Artificial Sequence
  Synthetic
gaatggcgctagttcagtgtggaacgcaacaacagccattggcctttgtcatattatgcgagggggatggctctc

SEQ ID NO: 356538 - DNA, 75 bp, Artificial Sequence
  Synthetic
gcaacaacagccattggcctttgtcatattatgcgagggggatggctctcgtgtctctccatcacgtggactctc

SEQ ID NO: 356539 - DNA, 75 bp, Artificial Sequence
  Synthetic
tcaagaggggcggagccaagggacgcacactaggagaagtctggaaggagaggctcaaccatatgacgaaggaag

SEQ ID NO: 356540 - DNA, 75 bp, Artificial Sequence
  Synthetic
cacactaggagaagtctggaaggagaggctcaaccatatgacgaaggaagagttcaccagatataggaaggaagc

SEQ ID NO: 356541 - DNA, 75 bp, Artificial Sequence
  Synthetic
gcaagacatgccaggagagaaggaaacatcactggaggccacccagtttcgcggggaactgctaaattacggtgg

SEQ ID NO: 356542 - DNA, 75 bp, Artificial Sequence
  Synthetic
acatcactggaggccacccagtttcgcggggaactgctaaattacggtggctagtggaaaggcgatttctcgagc

SEQ ID NO: 356543 - DNA, 75 bp, Artificial Sequence
  Synthetic
gtgtggcagaggcggctggtgctattacatggctacccagaagagagtgcaggaagtaaaagggtacacgaaagg

SEQ ID NO: 356544 - DNA, 75 bp, Artificial Sequence
  Synthetic
tacatggctacccagaagagagtgcaggaagtaaaagggtacacgaaagggggtcctggtcatgaggaaccacaa

SEQ ID NO: 356545 - DNA, 75 bp, Artificial Sequence
  Synthetic
ttggactgaagagggctatgttgagcctgatcgacggcaaggggccaatacgatttgtgttggctctcttggcgt

SEQ ID NO: 356546 - DNA, 75 bp, Artificial Sequence
  Synthetic
gatcgctcaattttaccaaccagagcgtgagaaggtatataccatggatggggaataccggctcagaggagaaga

SEQ ID NO: 356547 - DNA, 75 bp, Artificial Sequence
  Synthetic
caaagctgcgtgcccgactatgggagaagctcacaatgacaaacgtgctgacccagcttttgtgtgtaaacaagg

SEQ ID NO: 356548 - DNA, 75 bp, Artificial Sequence
  Synthetic
tcgtcaccatgaaaagtggagtcgatgtcttctacagaccatcagaagtgagtgacaccctgctctgtgacatcg

SEQ ID NO: 356549 - DNA, 75 bp, Artificial Sequence
  Synthetic
tgtcttctacagaccatcagaagtgagtgacaccctgctctgtgacatcggagagtcatcatcaagtgcagaggt

SEQ ID NO: 356550 - DNA, 75 bp, Artificial Sequence
  Synthetic
gcattgacacatgcgccaaatttgcctgttctaccaaggcaacaggaagaaccattctgaaagagaacatcaagt

SEQ ID NO: 356551 - DNA, 75 bp, Artificial Sequence
  Synthetic
ccagaagacattgactgttggtgcacaaagtcagcagtctacgtcaggtatggaagatgcaccaagacacgccac

SEQ ID NO: 356552 - DNA, 75 bp, Artificial Sequence
  Synthetic
ttggagatggtggaagactggctgcacagaggaccgaaggagttctgcatcaaggtgctctgtccctacatgccc

SEQ ID NO: 356553 - DNA, 75 bp, Artificial Sequence
  Synthetic
acagaggaccgaaggagttctgcatcaaggtgctctgtccctacatgcccaaagtgattgagaagatggaagcac

SEQ ID NO: 356554 - DNA, 75 bp, Artificial Sequence
  Synthetic
ggctgtccatcaagtgttcggaggagcattccgctcactgttcggaggtatgtcctggataacgcaaggattgct

SEQ ID NO: 356555 - DNA, 75 bp, Artificial Sequence
  Synthetic
tgtgagaaatcctctctcacgcaactccacccatgagatgtattgggtgagccacgcaacaggcaacatcgtcca

SEQ ID NO: 356556 - DNA, 75 bp, Artificial Sequence
  Synthetic
tccacccatgagatgtattgggtgagccacgcaacaggcaacatcgtccactctgtcaacatgacaagccaagtg

SEQ ID NO: 356557 - DNA, 75 bp, Artificial Sequence
  Synthetic
cgtggaaggggccccagtatgaggaagatgtcaacttgggaagtggaacgcgagcagtagggaagcctctcctca

SEQ ID NO: 356558 - DNA, 75 bp, Artificial Sequence
  Synthetic
agatgtcaacttgggaagtggaacgcgagcagtagggaagcctctcctcaactctgacactagcaaaatcagaaa

SEQ ID NO: 356559 - DNA, 75 bp, Artificial Sequence
  Synthetic
tgaaccatccttacaggacctggaactaccatggaagctacgaagtgaaaccaaccggctcagctagctctcttg

SEQ ID NO: 356560 - DNA, 75 bp, Artificial Sequence
  Synthetic
ccaaccggctcagctagctctcttgtgaacggggtggtcagactgctatcaaaaccatgggatgccattaccaat

SEQ ID NO: 356561 - DNA, 75 bp, Artificial Sequence
  Synthetic
gctgagatgtggaagtggagtgttcatacacaatgatgtggaggcttggatggaccggtacaagtattaccctga

SEQ ID NO: 356562 - DNA, 75 bp, Artificial Sequence
  Synthetic
gttcaaggaaaaggtggatacgaaggctccagagccttcagaaggggtcaaatatgtccttaatgagaccacaaa

SEQ ID NO: 356563 - DNA, 75 bp, Artificial Sequence
  Synthetic
gagaagaagcccaggatgtgctcccgggaggagttcattaataaagtcaacagcaacgctgctctcggagcaatg

SEQ ID NO: 356564 - DNA, 75 bp, Artificial Sequence
  Synthetic
acgccagagaagctgtagaggatccaaagttctgggaaatggttgatgaggaacgtgaggcacatctccgtggag

SEQ ID NO: 356565 - DNA, 75 bp, Artificial Sequence
  Synthetic
agagccataacattcacaacgacatcaaacgtggttgttccgctgctagccctgctaacacccgggctgagatgc

SEQ ID NO: 356566 - DNA, 75 bp, Artificial Sequence
  Synthetic
aaggattgctgggggctctgctgttgtggatgggcatcaatgctcgtgacaggtccatagctctcacgtttctcg

SEQ ID NO: 356567 - DNA, 75 bp, Artificial Sequence
  Synthetic
gatgggcaagagagagaagaaacctggagagtttggcaaagccaaaggcagcagagccatttggtttatgtggct

SEQ ID NO: 356568 - DNA, 75 bp, Artificial Sequence
  Synthetic
ggagagtttggcaaagccaaaggcagcagagccatttggtttatgtggctgggggctcgctttctagaatttgaa

SEQ ID NO: 356569 - DNA, 75 bp, Artificial Sequence
  Synthetic
ctccgtgaacgtgcacgctgacactggatgtgccatagacatcagccggcaggagctgagatgtggaagtggagt

SEQ ID NO: 356570 - DNA, 75 bp, Artificial Sequence
  Synthetic
actggctgggcagaaagaactcaggaggcggagttgaaggcttggggcttcagaagcttgggtacatcctgaagg

SEQ ID NO: 356571 - DNA, 75 bp, Artificial Sequence
  Synthetic
aggcggagttgaaggcttggggcttcagaagcttgggtacatcctgaaggaagttgggacaaaaccaggaggaag

SEQ ID NO: 356572 - DNA, 75 bp, Artificial Sequence
  Synthetic
ggagtgtgcggtctacggtcggtttccagactggagcaccaaatgtgggaagcggtgaaggacgagctaaacact

SEQ ID NO: 356573 - DNA, 75 bp, Artificial Sequence
  Synthetic
tgggacacgcgcatcaccaaagccgacctcgagaatgaagcgaaggtccttgaactgctggacggagaacatcgg

SEQ ID NO: 356574 - DNA, 75 bp, Artificial Sequence
  Synthetic
acctcgagaatgaagcgaaggtccttgaactgctggacggagaacatcggcgtttagcgcggtccatcatcgagc

SEQ ID NO: 356575 - DNA, 75 bp, Artificial Sequence
  Synthetic
tggagcaagctctgtttggaacgcaacaactgccatcggactctgccacatcatgcgtgggggttggttgtcatg

SEQ ID NO: 356576 - DNA, 75 bp, Artificial Sequence
  Synthetic
cgtctcaccgctaccacggaaaaattggaaataggctggaaggcctggggaaagagcatcctattcgcaccagaa

SEQ ID NO: 356577 - DNA, 75 bp, Artificial Sequence
  Synthetic
agtgatgagaccagcggccgacggaaagacagtcatggatgtcatctctagagaggaccagagaggaagtggcca

SEQ ID NO: 356578 - DNA, 75 bp, Artificial Sequence
  Synthetic
gagaggaccagagaggaagtggccaagtggtgacttacgctctgaacaccttcaccaatctagcagtccagctgg

SEQ ID NO: 356579 - DNA, 75 bp, Artificial Sequence
  Synthetic
tggaatgggcaggatgaggtgcagatgattgtggtggaacctggcaagaacgttaagaacgtccagacgaaacca

SEQ ID NO: 356580 - DNA, 75 bp, Artificial Sequence
  Synthetic
ctgggaaagggaaaaggccctaaggtcagaacctggctgtttgagaatggcgaagagcgcctcagtcgcatggct

SEQ ID NO: 356581 - DNA, 75 bp, Artificial Sequence
  Synthetic
tcactggagggcatccagtctctaggggcacagcaaaactgagatggctggtcgaacggaggtttctcgaaccgg

SEQ ID NO: 356582 - DNA, 75 bp, Artificial Sequence
  Synthetic
agcctttggacgaccggtttgccacatcactacacttcctaaacgccatgtcaaaagtccgcaaagacatccagg

SEQ ID NO: 356583 - DNA, 75 bp, Artificial Sequence
  Synthetic
gaaagcaggcttaatgatacgtggaagcttgaaagggcggtcctgggtgaagttaaatcatgcacttggcctgaa

SEQ ID NO: 356584 - DNA, 75 bp, Artificial Sequence
  Synthetic
atcactacacttcctaaacgccatgtcaaaagtccgcaaagacatccaggaatggaagccctcgacaggatggta

SEQ ID NO: 356585 - DNA, 75 bp, Artificial Sequence
  Synthetic
tcgaaccatttcacggagctgatcatgaaggacggcaggacgctggtggtcccgtgtcgcggacaggatgagctg

SEQ ID NO: 356586 - DNA, 75 bp, Artificial Sequence
  Synthetic
tgaaggacggcaggacgctggtggtcccgtgtcgcggacaggatgagctgattggacgtgccaggatttccccag

SEQ ID NO: 356587 - DNA, 75 bp, Artificial Sequence
  Synthetic
gagtgcagtctgcgatagtgccccaggaggactgggttaacaaaggcaaaccaacgccccacgcggccctagccc

SEQ ID NO: 356588 - DNA, 75 bp, Artificial Sequence
  Synthetic
cgcctgtctggcgaaatcatacgcccagatgtggctgctgctctacttccaccgcagggacttgagactgatggc

SEQ ID NO: 356589 - DNA, 75 bp, Artificial Sequence
  Synthetic
cagatgtggctgctgctctacttccaccgcagggacttgagactgatggccaatgccatttgttctgcagtgccc

SEQ ID NO: 356590 - DNA, 75 bp, Artificial Sequence
  Synthetic
aggagacacagcttgggactttggatcagttggaggggtgttcacctcagttgggaaggctgtccatcaagtgtt

SEQ ID NO: 356591 - DNA, 75 bp, Artificial Sequence
  Synthetic
ccacctggtcaatccacgcaaaaggggaatggatgacaacagaggacatgctcgcagtttggaacagggtttgga

SEQ ID NO: 356592 - DNA, 75 bp, Artificial Sequence
  Synthetic
gacgttccatactctgggaagagagaagacatctggtgtggcagcttgattggcacgcgagcccgtgccacttgg

SEQ ID NO: 356593 - DNA, 75 bp, Artificial Sequence
  Synthetic
atcaggttcgctcggtgattggggaagagaagtatgtggactacatgggttccctaaggagatacgaagacacta

SEQ ID NO: 356594 - DNA, 75 bp, Artificial Sequence
  Synthetic
agagaagtatgtggactacatgggttccctaaggagatacgaagacactatcatagtggaggacactgttttgta

SEQ ID NO: 356595 - DNA, 75 bp, Artificial Sequence
  Synthetic
aaccaggagaatatcttgttgatgttggcggctgttttctttcaaatggcttaccatgacgctcgccaaattctg

SEQ ID NO: 356596 - DNA, 75 bp, Artificial Sequence
  Synthetic
gtattattgtagtttagttgatttagtactaatagcaatttgaattatgattaattattttagatttaagatagc

SEQ ID NO: 356597 - DNA, 75 bp, Artificial Sequence
  Synthetic
gtactaatagcaatttgaattatgattaattattttagatttaagatagcactatagttagtttagtgtaaatag

SEQ ID NO: 356598 - DNA, 75 bp, Artificial Sequence
  Synthetic
attcattggcagtagcttggatgatactgagagccataacctttacaacaacatcaaacgtggttgttccgctgc

SEQ ID NO: 356599 - DNA, 75 bp, Artificial Sequence
  Synthetic
tagctctgttaacacccggactgagatgcttgaatctggatgtgtacaggatcctgctattgatggtcggaatag

SEQ ID NO: 356600 - DNA, 75 bp, Artificial Sequence
  Synthetic
ctcagaaccgtttcggaaggaggaccccacgtgctttagcctcaaagcccaatgtcagaccacaccttggtgtgc

SEQ ID NO: 356601 - DNA, 75 bp, Artificial Sequence
  Synthetic
cctcgccgctggactcattgcatgtgatcccaaccgtaaacgaggatggcccgcaactgaagtgatgactgctgt

SEQ ID NO: 356602 - DNA, 75 bp, Artificial Sequence
  Synthetic
acagtgccccaggaggactgggtcaacaaaggcaaaacatcgccccgcgcggccataaccctggccatggtgtta

SEQ ID NO: 356603 - DNA, 75 bp, Artificial Sequence
  Synthetic
gtttgtgaggattaacaacaattaacacagtgcgagctgtttcttagcacgaagatctcgatgtctaagaaacca

SEQ ID NO: 356604 - DNA, 75 bp, Artificial Sequence
  Synthetic
gggctggcagagcttgacattgactccatggccattccaatgaccatcgcagggctcatgtttgctgccttcgtg

SEQ ID NO: 356605 - DNA, 75 bp, Artificial Sequence
  Synthetic
gcagttggaggagttctgctcttcctctccgtgaacgtgcacgctgacactgggtgtgccatagacatcagccgg

SEQ ID NO: 356606 - DNA, 75 bp, Artificial Sequence
  Synthetic
gttggattttggataactctccaatacacaaagagaggaggtgtgctgtgggacactccctcaccaaaggagtac

SEQ ID NO: 356607 - DNA, 75 bp, Artificial Sequence
  Synthetic
cttgccagggccatcattgagctcacctatcgtcacaaagttgtgaaagtgatgcgcccggctgctgatggaaga

SEQ ID NO: 356608 - DNA, 75 bp, Artificial Sequence
  Synthetic
ggcgtgatggttgaaggggttttccacaccctttggcatacaacaaaaggagccgctctgatgagcggggaaggc

SEQ ID NO: 356609 - DNA, 75 bp, Artificial Sequence
  Synthetic
tcaaagaggatcgactttgctacggaggaccctggaaattgcagcacaagtggaatgggcaggatgaggtgcaaa

SEQ ID NO: 356610 - DNA, 75 bp, Artificial Sequence
  Synthetic
atgagccgatcccagccggattcgaacctgagatgctgaggaaaaaacagatcacagttctggaccttcatcccg

SEQ ID NO: 356611 - DNA, 75 bp, Artificial Sequence
  Synthetic
gccacagatcatcaaagaggccataaatagaagattgagaacggccgtgctagcaccaactagggttgtagccgc

SEQ ID NO: 356612 - DNA, 75 bp, Artificial Sequence
  Synthetic
aaccccagtggagaaatggagtgacgtcccatactcaggaaaacgagaggacatctggtgtggcagcctgattgg

SEQ ID NO: 356613 - DNA, 75 bp, Artificial Sequence
  Synthetic
gggtgattgacagcaggaagagtgtgaaaccaaccatcatcacggaaggagaagggagggtgatcctgggagaac

SEQ ID NO: 356614 - DNA, 75 bp, Artificial Sequence
  Synthetic
tgcctgcgactcaaccccaggaggactgggtgaacaaagccgcgaagtgatccatgtaagccctcagaaccgtct

SEQ ID NO: 356615 - DNA, 75 bp, Artificial Sequence
  Synthetic
aggaatccatcgcaagttggtgatgagtactgctatggggggcacacgaatgaagacgactcgaacttcgcccat

SEQ ID NO: 356616 - DNA, 75 bp, Artificial Sequence
  Synthetic
ctggacccatactggggcagtgtcaaggaggatcgactttgttacggaggaccctggaaattgcagcacaagtgg

SEQ ID NO: 356617 - DNA, 75 bp, Artificial Sequence
  Synthetic
gatgcctgagcacttcatggggaagacatgggaagcacttgacaccatgtatgttgtggccaccgcagagaaagg

SEQ ID NO: 356618 - DNA, 75 bp, Artificial Sequence
  Synthetic
tcccctgtgtgccttgcctatcccctgttgcgtgtcttagtcgcctgtgtgagctgacaaacttagtagtgtttg

SEQ ID NO: 356619 - DNA, 75 bp, Artificial Sequence
  Synthetic
ggaagcaacaccatgcagcgagttgtgtttgtcgtgctattgctcttggtggctccagcctacagctttaactgc

SEQ ID NO: 356620 - DNA, 75 bp, Artificial Sequence
  Synthetic
cacaggtcacggcactgtggtgttggaattgcagtacactggcacggatggaccttgcaaagttcccatctcgtc

SEQ ID NO: 356621 - DNA, 75 bp, Artificial Sequence
  Synthetic
agcgcagtggcagccaacgaaatgggttggctggacaagaccaagaatgatataagcagtttgtttgggcaaaga

SEQ ID NO: 356622 - DNA, 75 bp, Artificial Sequence
  Synthetic
gttggctggacaagaccaagaatgatataagcagtttgtttgggcaaagaattgaggccaaggagaatttcagta

SEQ ID NO: 356623 - DNA, 75 bp, Artificial Sequence
  Synthetic
ggctgtggactatttggcaaaggaagcattgacacatgcgccaaatttgcctgttccaccaaggcaacaggaaga

SEQ ID NO: 356624 - DNA, 75 bp, Artificial Sequence
  Synthetic
ggaagtcatcacgaagcttggtgaaaggaagattctgaggccgcgctggattgacgccagggtgtactcggatca

SEQ ID NO: 356625 - DNA, 75 bp, Artificial Sequence
  Synthetic
gtgcaaagttatggatggaacattgtcaccatgaagagcggagtggatgtgttctacagaccttctgagtgctgc

SEQ ID NO: 356626 - DNA, 75 bp, Artificial Sequence
  Synthetic
agtcttcatcaagtgctgaggttgaagagcataggacgatccgggtccttgaaatggttgaggactggctgcacc

SEQ ID NO: 356627 - DNA, 75 bp, Artificial Sequence
  Synthetic
gataggcaacttcaaagcccaatgtcagaccacgctacggacgtggctacgtctaggcggagagtggcaggtctg

SEQ ID NO: 356628 - DNA, 75 bp, Artificial Sequence
  Synthetic
gaggaccccacatgttgtaacttcaaagcccaatgctgagacacgcaacaggggataggcaaggcacacagggga

SEQ ID NO: 356629 - DNA, 75 bp, Artificial Sequence
  Synthetic
ttttgtttcagtggccacggccaatgccaaggtcctgattgaactggaaccaccctttggagactcatacatagt

SEQ ID NO: 356630 - DNA, 75 bp, Artificial Sequence
  Synthetic
aaacgtcccagaatgtgctctcgagaggaattcataaaaaaggtcaatagcaatgcagctctgggtgccatgttt

SEQ ID NO: 356631 - DNA, 75 bp, Artificial Sequence
  Synthetic
aacgccccacgcggccctagccctggtaatggtgttaaccagggcgaaaggactagaggttagaggagaccccgc

SEQ ID NO: 356632 - DNA, 75 bp, Artificial Sequence
  Synthetic
cgcctgtgtgagctgacaaacttagtagtgtttgtgaggattaacaacaattaacacagtgcgagctgtttctta

SEQ ID NO: 356633 - DNA, 75 bp, Artificial Sequence
  Synthetic
gcacgaagatctcgatgtctaagaaaccaggagggcccggcaagagccgggctgtcaatatgctaaaacgcggaa

SEQ ID NO: 356634 - DNA, 75 bp, Artificial Sequence
  Synthetic
gctgtcaatatgctaaaacgcggaatgccccgcgtgttgtccttgattggactgaagagggctatgttgagcctg

SEQ ID NO: 356635 - DNA, 75 bp, Artificial Sequence
  Synthetic
acatcaaacgtggttgttccgctgctagccctgttaacacccgggctgagatgcttgaatctggatgtgtacagg

SEQ ID NO: 356636 - DNA, 75 bp, Artificial Sequence
  Synthetic
ggacactgttttgtaaataataaagctgtattgagtagttgcatagttgtagtgtttatagcaatttgaattatg

SEQ ID NO: 356637 - DNA, 75 bp, Artificial Sequence
  Synthetic
cctcgctgctggactcattgcgtgtgatcccaaccgtaaacgagggtggcccgcgactgaagtgatgactgctgc

SEQ ID NO: 356638 - DNA, 75 bp, Artificial Sequence
  Synthetic
aagatcagagggggagtggacaagttgtcacctacgctctaaacaccttcaccaacctggccgtccagttggtga

SEQ ID NO: 356639 - DNA, 75 bp, Artificial Sequence
  Synthetic
agggctcatgtttgctgcctttgtgatttctgggaaatcaacagatatgtggatcgagaggacggcggatatctc

SEQ ID NO: 356640 - DNA, 75 bp, Artificial Sequence
  Synthetic
ccacatgttgtaactacaaagccgcgaagtgatccatgtaagccctcagaaccggtctcgggaaggaggaccccc

SEQ ID NO: 356641 - DNA, 75 bp, Artificial Sequence
  Synthetic
accggtctcgggaaggaggacccccacatgttgtaactacaaagccgcgaagtgatccatgtaagccctcagaac

SEQ ID NO: 356642 - DNA, 75 bp, Artificial Sequence
  Synthetic
atgtggctgcttctgtacttccacagaagagacctgcggctaatggccaacgccatttgctccgctgtccctgtg

SEQ ID NO: 356643 - DNA, 75 bp, Artificial Sequence
  Synthetic
cctatcccctgtgtgcctttgcctagcctatcccctgttgcgtgtctcaggtagttcgcctgtgtgagctgacaa

SEQ ID NO: 356644 - DNA, 75 bp, Artificial Sequence
  Synthetic
gcctatcccctgttgcgtgtctcaggtagttcgcctgtgtgagctgacaaacttagtagtgtttgtgaggattaa

SEQ ID NO: 356645 - DNA, 75 bp, Artificial Sequence
  Synthetic
gaaaacatccaggtagccatcaaccaagtcagagcaatcattggagatgagaagtatgtggattacatgagttca

SEQ ID NO: 356646 - DNA, 75 bp, Artificial Sequence
  Synthetic
ttaaagagatatgaagacacgactttggttgaggacacagtactgtaaatactttattaattgtaaatagacaat

SEQ ID NO: 356647 - DNA, 75 bp, Artificial Sequence
  Synthetic
ttcatgacagccaccccaccaggcacttcagacccattcccagagtccaattcacctatttctgacttacagact

SEQ ID NO: 356648 - DNA, 75 bp, Artificial Sequence
  Synthetic
catcgggaaaacggtttggtttgtgcctagtgtgaaaatggggaatgagattgccctttgtctacaacgtgccgg

SEQ ID NO: 356649 - DNA, 75 bp, Artificial Sequence
  Synthetic
aagtcgtatgagacggagtacccaaagtgcaagaacgatgattgggactttgttattacaacagacatatctgaa

SEQ ID NO: 356650 - DNA, 75 bp, Artificial Sequence
  Synthetic
gggtgattgacagccggaagagtgtgaaaccaaccatcatcacagaaggagaagggagggtgatcctgggagaac

SEQ ID NO: 356651 - DNA, 75 bp, Artificial Sequence
  Synthetic
gaaaccaaccatcatcacagaaggagaagggagggtgatcctgggagaaccatccgctgtgacagcagctagtgc

SEQ ID NO: 356652 - DNA, 75 bp, Artificial Sequence
  Synthetic
agtgaagatggaaaaattgcagttgaagggaacaacctatggcgtctgttcaaaggctttcaagtttcttgggac

SEQ ID NO: 356653 - DNA, 75 bp, Artificial Sequence
  Synthetic
cagtagttggattttggataactctccaatacacaaagagaggaggcgtgctgtgggacactccctcaccaaagg

SEQ ID NO: 356654 - DNA, 75 bp, Artificial Sequence
  Synthetic
ttgacgccagggtgtactcggaccatcaggcattgaaggcgttcaaggactttgcctcgggaaagcgttctcaga

SEQ ID NO: 356655 - DNA, 75 bp, Artificial Sequence
  Synthetic
gctgctttcgtgatttctgggaaatcaacagatatgtggatcgagagaacggcggacatttcctgggaaagtgat

SEQ ID NO: 356656 - DNA, 75 bp, Artificial Sequence
  Synthetic
gcttcaactgccttggaatgagcaacagagacttcttggaaggagtgtctggagcaacatgggtggatttggttc

SEQ ID NO: 356657 - DNA, 75 bp, Artificial Sequence
  Synthetic
ctgggctttctcaacgaagaccactggcttggaagaaagaactcaggaggcggggtcgagggcttgggcctccaa

SEQ ID NO: 356658 - DNA, 75 bp, Artificial Sequence
  Synthetic
ctggggacaagtcaccctcaccgtgacggtgacagcggcaacacttctgttctgccactatgcctacatggttcc

SEQ ID NO: 356659 - DNA, 75 bp, Artificial Sequence
  Synthetic
tctccacttcctcaacgccatgtcaaaggttcgcaaagacatccaggagtggaaaccatcaactggatggtatga

SEQ ID NO: 356660 - DNA, 75 bp, Artificial Sequence
  Synthetic
aaccatttcactgaattgatcatgaaagatggaagaacactggtggttccatgccgaggacaggacgaactggta

SEQ ID NO: 356661 - DNA, 75 bp, Artificial Sequence
  Synthetic
ttcggaggcatgtcctggataacgcaaggattgctgggggctctcctgttgtggatgggcatcaatgctcgtgac

SEQ ID NO: 356662 - DNA, 75 bp, Artificial Sequence
  Synthetic
acaaaaacggtgatgtgattgggctttatggcaatggagtcataatgcccaacggctcatacataagcgcgatag

SEQ ID NO: 356663 - DNA, 75 bp, Artificial Sequence
  Synthetic
gtaagcatgtgtaaaagtataggtttatagtagcatttagtgatgttagtgtaaatagtcaagaaaatttaaatg

SEQ ID NO: 356664 - DNA, 75 bp, Artificial Sequence
  Synthetic
gctgaagcactgagaggactgcccatccggtaccagacatccgcagtgcccagagaacataatggaaatgagatt

SEQ ID NO: 356665 - DNA, 75 bp, Artificial Sequence
  Synthetic
aagacggtttggtttgtgcctagtgtcaagatggggaatgagattgccctttgcctacaacgtgctggaaagaaa

SEQ ID NO: 356666 - DNA, 75 bp, Artificial Sequence
  Synthetic
gcattgacacatgcgccaaatttgcctgctccaccaaggcaataggaagaaccatcttgaaagagaatatcaagt

SEQ ID NO: 356667 - DNA, 75 bp, Artificial Sequence
  Synthetic
gaacgatgattgggactttgttatcacaacagacatatctgaaatgggggctaacttcaaggcgagcagggtgat

SEQ ID NO: 356668 - DNA, 75 bp, Artificial Sequence
  Synthetic
gactcgaacttcgcccattggactgaggcacgaatcatgctggacaacatcaacatgccaaacggactgatcgct

SEQ ID NO: 356669 - DNA, 75 bp, Artificial Sequence
  Synthetic
ttgataataccagtcacactggcgggaccacgaagcaatcacaatcggagacctgggtacaagacacaaaaccag

SEQ ID NO: 356670 - DNA, 75 bp, Artificial Sequence
  Synthetic
acctgggtacaagacacaaaaccagggcccatgggacgaaggccgggtagagattgacttcgattactgcccagg

SEQ ID NO: 356671 - DNA, 75 bp, Artificial Sequence
  Synthetic
caagatcagcatgccagctatactgattgctctgctagtcctggtgtttgggggcattacttacactgatgtgtt

SEQ ID NO: 356672 - DNA, 75 bp, Artificial Sequence
  Synthetic
tgcagcggaagggcattggaaagataggtttgggaggcgctgtcttgggagtcgcgacctttttctgttggatgg

SEQ ID NO: 356673 - DNA, 75 bp, Artificial Sequence
  Synthetic
tgatgtgttgaattcactggcggtagcttggatgatactgagagccataacattcacaacgacatcaaacgtggt

SEQ ID NO: 356674 - DNA, 75 bp, Artificial Sequence
  Synthetic
atgtgtacaggatactgctgttgatggtcggaataggcagcttgatcagggagaagaggagtgcagctgcaaaaa

SEQ ID NO: 356675 - DNA, 75 bp, Artificial Sequence
  Synthetic
ggaccccacatgttgaacaaagccgcgaagtgatccatgtaagccctcagaaccgtctcggaaggaggaccccac

SEQ ID NO: 356676 - DNA, 75 bp, Artificial Sequence
  Synthetic
atgttgaacaaagccgcgaagtgatccatcgtaaagccctcagaaaccgggtctcgggaaggaggacccccacat

SEQ ID NO: 356677 - DNA, 75 bp, Artificial Sequence
  Synthetic
cggacagcggccggaatcatgaagaacgctgtagtggatggcatcgtggccacggacgtcccagaattagagcgc

SEQ ID NO: 356678 - DNA, 75 bp, Artificial Sequence
  Synthetic
acgctgtagtggatggcatcgtggccacggacgtcccagaattagagcgcaccacacccatcatgcagaagaaag

SEQ ID NO: 356679 - DNA, 75 bp, Artificial Sequence
  Synthetic
tgatccatgtaagccctcagaaccgtctcggaaggaggaccccacatgttgaacaaagccgcgaagtgatccatg

SEQ ID NO: 356680 - DNA, 75 bp, Artificial Sequence
  Synthetic
agttgatgtgcggcttgatgatgatggaaacttccagctcatgaatgatccaggagcaccttggaagatatggat

SEQ ID NO: 356681 - DNA, 75 bp, Artificial Sequence
  Synthetic
gtcaagtgctgaggttgaagagcataggacgattcgggtccttgaaatggttgaggactggctgcaccgagggcc

SEQ ID NO: 356682 - DNA, 75 bp, Artificial Sequence
  Synthetic
gtatggggggggactggtcagaaacccactctcacggaattccacgcacgagatgtattgggtgagtcgagcttc

SEQ ID NO: 356683 - DNA, 75 bp, Artificial Sequence
  Synthetic
ccccaggaggactgggttaacaaaggcaaaccaacgccccacgcggccctagccctggtaatggtgttaaccagg

SEQ ID NO: 356684 - DNA, 75 bp, Artificial Sequence
  Synthetic
ggagtacccaaaatgtaagaacgatgattgggactttgttatcacaacagacatatctgaaatgggggctaactt

SEQ ID NO: 356685 - DNA, 75 bp, Artificial Sequence
  Synthetic
gggcacacgaatgaagacgactcgaacttcgcccattggactgaggcacgaatcatgctggacaacatcaacatg

SEQ ID NO: 356686 - DNA, 75 bp, Artificial Sequence
  Synthetic
aagaaagaactcaggaggaggtgtcgagggcttgggcctccaaaaactgggttacatcctgcgtgaagttggcac

SEQ ID NO: 356687 - DNA, 75 bp, Artificial Sequence
  Synthetic
tcagaggagctcaacgactcgcagctcttggagatactgcttgggattttgggtcagttggaggggttttcacct

SEQ ID NO: 356688 - DNA, 75 bp, Artificial Sequence
  Synthetic
aggtcaattgctatgacgtttcttgcggttggaggagttttgctcttcctttcggtcaacgtccatgctgacaca

SEQ ID NO: 356689 - DNA, 75 bp, Artificial Sequence
  Synthetic
gccttattgagtgtgatgaccatgggagtattcttcctcctcatgcagcggaagggcattggaaagataggtttg

SEQ ID NO: 356690 - DNA, 75 bp, Artificial Sequence
  Synthetic
aagaacactggtggttccatgccgaggacaggatgaattggtaggcagagctcgcatatctccaggggccggatg

SEQ ID NO: 356691 - DNA, 75 bp, Artificial Sequence
  Synthetic
ggaaccgtgtttggatagaggagaatgaatggatggaagacaaaaccccagtggagaaatggagtgacgtcccat

SEQ ID NO: 356692 - DNA, 75 bp, Artificial Sequence
  Synthetic
agtagttcgcctgtgtgagctgacaaacttagtagtgtttgtgaggattatgaacaattaacacagtgtgagctg

SEQ ID NO: 356693 - DNA, 75 bp, Artificial Sequence
  Synthetic
gaaccgggccgtcaatatgctaaaacgcggaatgccccgcgtgatgtccttgataggactaaagagggctatgtt

SEQ ID NO: 356694 - DNA, 75 bp, Artificial Sequence
  Synthetic
atacgtttcgtgttggcactcttggcctttttcaagttcacagcaattgctccgactcgggcattgttggacaga

SEQ ID NO: 356695 - DNA, 75 bp, Artificial Sequence
  Synthetic
cctttttcaagttcacagcaattgctccgactcgggcattgttggacagatggagaggcgtcaataaacaaacag

SEQ ID NO: 356696 - DNA, 75 bp, Artificial Sequence
  Synthetic
gaaggaactaggcaccctgaccaacgccatgaatagacggagcacaaaacagaagaaaagagggggagtcgtagg

SEQ ID NO: 356697 - DNA, 75 bp, Artificial Sequence
  Synthetic
gccatgaatagacggagcacaaaacagaagaaaagagggggagtcgtaggagtcatggctgtcttaggactagta

SEQ ID NO: 356698 - DNA, 75 bp, Artificial Sequence
  Synthetic
caaactttcagggaaaggtgatgatgaccgtcaatgctactgatgttgccaacattatcactattccaacagcgt

SEQ ID NO: 356699 - DNA, 75 bp, Artificial Sequence
  Synthetic
aacattatcactattccaacagcgtcagggaagaacttatgcacggtgagagcaatggacgtggggttcatgtgt

SEQ ID NO: 356700 - DNA, 75 bp, Artificial Sequence
  Synthetic
gaagctcacaatgacaaacgtgctgacccagcttttgtgtgcagacaaggagtggtggacaggggttggggcaac

SEQ ID NO: 356701 - DNA, 75 bp, Artificial Sequence
  Synthetic
gatgacaccatcacatatgaatgcccggccctggctgcaggtaatgacccagaagacatcgactgctggtgcact

SEQ ID NO: 356702 - DNA, 75 bp, Artificial Sequence
  Synthetic
cggccctggctgcaggtaatgacccagaagacatcgactgctggtgcactaaagctgctgtctatgtcagatatg

SEQ ID NO: 356703 - DNA, 75 bp, Artificial Sequence
  Synthetic
ccggcggagtcgccgctctcttactgtgcaagcacatggggagagcactctggcaaacaagaagggagcttggct

SEQ ID NO: 356704 - DNA, 75 bp, Artificial Sequence
  Synthetic
gtgcaagcacatggggagagcactctggcaaacaagaagggagcttggctggacagcacgaaagctactcgctac

SEQ ID NO: 356705 - DNA, 75 bp, Artificial Sequence
  Synthetic
tcaggaatccaggctatgccctcgtggcggttgtgattggatggatgttgggaagtaacaacatgcagcgtgttg

SEQ ID NO: 356706 - DNA, 75 bp, Artificial Sequence
  Synthetic
ggaagtaacaacatgcagcgtgttgtgttcgtcgtgcttcttcttttggttgcaccagcatacagcttcaattgc

SEQ ID NO: 356707 - DNA, 75 bp, Artificial Sequence
  Synthetic
tagaaggagtgacaggggcgacctggctcgacttagtgctggaaggtgacagctgtgtgaccataatgtcgaaag

SEQ ID NO: 356708 - DNA, 75 bp, Artificial Sequence
  Synthetic
gctcgacttagtgctggaaggtgacagctgtgtgaccataatgtcgaaagacaagcccaccattgatgtgaagat

SEQ ID NO: 356709 - DNA, 75 bp, Artificial Sequence
  Synthetic
gctgaggtgcgcagttactgctacgcagcgactgttagtgacctttccacgaaggcggcctgccccacgatgggg

SEQ ID NO: 356710 - DNA, 75 bp, Artificial Sequence
  Synthetic
cagcgactgttagtgacctttccacgaaggcggcctgccccacgatgggggaagcccacaatgacaagcgggctg

SEQ ID NO: 356711 - DNA, 75 bp, Artificial Sequence
  Synthetic
cgttgtggacagaggctggggaaatggatgtggattatttggaaaaggaagtattgacacatgtgccaggttcgc

SEQ ID NO: 356712 - DNA, 75 bp, Artificial Sequence
  Synthetic
ggatgtggattatttggaaaaggaagtattgacacatgtgccaggttcgcctgttcaacgaaggctacggggagg

SEQ ID NO: 356713 - DNA, 75 bp, Artificial Sequence
  Synthetic
gattgttgatgtcatgtgtcatgctaccctcacccacaggctgatgtctcctcacagggtgccgaactacaacct

SEQ ID NO: 356714 - DNA, 75 bp, Artificial Sequence
  Synthetic
aaggtcaacagcaatgcagctttgggtgccatgtttgaagagcagaatcaatggaggagcgccagagaagcagtt

SEQ ID NO: 356715 - DNA, 75 bp, Artificial Sequence
  Synthetic
atgaggtggccatttttgttcatggaccgactacagtcgaatcgcatggcaactacgcaacacagcaaggagcca

SEQ ID NO: 356716 - DNA, 75 bp, Artificial Sequence
  Synthetic
ctcaagcaggtcggttcagcataactccagccgcgccatcatacactcttaagcttggggaatatggagaagtca

SEQ ID NO: 356717 - DNA, 75 bp, Artificial Sequence
  Synthetic
aagcttggggaatatggagaagtcactgtggactgtgagccccgctcgggcatagacacaaacgcgtactatgtg

SEQ ID NO: 356718 - DNA, 75 bp, Artificial Sequence
  Synthetic
ctgtggactgtgagccccgctcgggcatagacacaaacgcgtactatgtgatgacagttgggaagaagacgtttc

SEQ ID NO: 356719 - DNA, 75 bp, Artificial Sequence
  Synthetic
cctcaaccttccatggagtagcgctggaggcaacgtgtggagaaacagggaaactttggtagaatttgaagaacc

SEQ ID NO: 356720 - DNA, 75 bp, Artificial Sequence
  Synthetic
ggaggcaacgtgtggagaaacagggaaactttggtagaatttgaagaaccacatgccacaaaacaatcagtggta

SEQ ID NO: 356721 - DNA, 75 bp, Artificial Sequence
  Synthetic
tgcaccaagctctggctggagccatcccggtggaattctcaagcaacacagtcaagctgacttcaggtcacctga

SEQ ID NO: 356722 - DNA, 75 bp, Artificial Sequence
  Synthetic
cccggtggaattctcaagcaacacagtcaagctgacttcaggtcacctgaagtgtagagtcaagatggaaaaact

SEQ ID NO: 356723 - DNA, 75 bp, Artificial Sequence
  Synthetic
gtctgctcgaaggcttttaagtttgtcggaacgccagccgacacaggtcacggaacagtagtcttggaactgcag

SEQ ID NO: 356724 - DNA, 75 bp, Artificial Sequence
  Synthetic
tcggaacgccagccgacacaggtcacggaacagtagtcttggaactgcagtatacaggaactgatggaccgtgta

SEQ ID NO: 356725 - DNA, 75 bp, Artificial Sequence
  Synthetic
tctaaatgatctcacgcctgttggtagactggtcactgttaaccccttcgtgtcggtagcgacagccaacgctaa

SEQ ID NO: 356726 - DNA, 75 bp, Artificial Sequence
  Synthetic
agactggtcactgttaaccccttcgtgtcggtagcgacagccaacgctaaagtgttgattgaactagaaccgcct

SEQ ID NO: 356727 - DNA, 75 bp, Artificial Sequence
  Synthetic
gtagaggagaacaacagattaatcaccattggcacaagtcaggaagtagcattggcaaagcattcaccacgaccc

SEQ ID NO: 356728 - DNA, 75 bp, Artificial Sequence
  Synthetic
ccattggcacaagtcaggaagtagcattggcaaagcattcaccacgaccctcaaaggggcgcagagactggctgc

SEQ ID NO: 356729 - DNA, 75 bp, Artificial Sequence
  Synthetic
ggttctgtgggaggagtgctcacgtccgtggggcaggctatacatcaagtgtttggaggagcatttagatcattg

SEQ ID NO: 356730 - DNA, 75 bp, Artificial Sequence
  Synthetic
ccgtggggcaggctatacatcaagtgtttggaggagcatttagatcattgttcgggggaatgtcttggatcaccc

SEQ ID NO: 356731 - DNA, 75 bp, Artificial Sequence
  Synthetic
gtggatgggcatcagtgcgcgagacagatccatagctctgaccttcctcgccataggtggggtgctcctgttcct

SEQ ID NO: 356732 - DNA, 75 bp, Artificial Sequence
  Synthetic
agatccatagctctgaccttcctcgccataggtggggtgctcctgttcctttccatcaacgtccacgcagacacc

SEQ ID NO: 356733 - DNA, 75 bp, Artificial Sequence
  Synthetic
aagagctaaggtgtggaagcggcgttttcatccacaacgacgttgaagcctggatggaccgttacaaatactacc

SEQ ID NO: 356734 - DNA, 75 bp, Artificial Sequence
  Synthetic
gagaggaccagagaggaagcggtcaggtagtgacttacgccctgaaccccttcactaatctagcatttcaactgg

SEQ ID NO: 356735 - DNA, 75 bp, Artificial Sequence
  Synthetic
tttcatccacaacgacgttgaagcctggatggaccgttacaaatactaccccgagacgccgcaaggacttgccaa

SEQ ID NO: 356736 - DNA, 75 bp, Artificial Sequence
  Synthetic
ggagtctgtggcctccggtcagtgtctagattggagcaccaaatgtgggactcggtcaaggatgagctcaacacc

SEQ ID NO: 356737 - DNA, 75 bp, Artificial Sequence
  Synthetic
ctagattggagcaccaaatgtgggactcggtcaaggatgagctcaacaccttgctgaaggagaatggcgtggatc

SEQ ID NO: 356738 - DNA, 75 bp, Artificial Sequence
  Synthetic
aaaacgagaggacatctggtgtggcagcctgattggcacaagagcccgagccacgtgggcagaaaacatccaggt

SEQ ID NO: 356739 - DNA, 75 bp, Artificial Sequence
  Synthetic
ggggatgtacaaagccgctcccaagagactgaaagcaacgacagagaagctcgagatgggatggaaagcctgggg

SEQ ID NO: 356740 - DNA, 75 bp, Artificial Sequence
  Synthetic
agactgaaagcaacgacagagaagctcgagatgggatggaaagcctgggggaaaagcattatcttcgcacctgag

SEQ ID NO: 356741 - DNA, 75 bp, Artificial Sequence
  Synthetic
acatgagttcactaaagagatatgaagacacaactttggttgaggacacagtactgtagatatttaattaattgt

SEQ ID NO: 356742 - DNA, 75 bp, Artificial Sequence
  Synthetic
acggtccagaaacagaggaatgcccatcgcagagtcgcgcctggaatagtatggaggtggaagactttgggtttg

SEQ ID NO: 356743 - DNA, 75 bp, Artificial Sequence
  Synthetic
atcgcagagtcgcgcctggaatagtatggaggtggaagactttgggtttggtctcaccagtactcgcatgttcct

SEQ ID NO: 356744 - DNA, 75 bp, Artificial Sequence
  Synthetic
agagaagtatgtggattacatgagctccctgaggaggtatgaagacaccattgtagtggaggacactgttttgta

SEQ ID NO: 356745 - DNA, 75 bp, Artificial Sequence
  Synthetic
gagtgcgacgccaaaatcatcggaacggcagtgaagaacaaccttgcgatccacagcgacctgtcctactggatt

SEQ ID NO: 356746 - DNA, 75 bp, Artificial Sequence
  Synthetic
cggcagtgaagaacaaccttgcgatccacagcgacctgtcctactggattgaaagcgggttcaacgagacatgga

SEQ ID NO: 356747 - DNA, 75 bp, Artificial Sequence
  Synthetic
agtcaagtcctgcacgtggccggaaacacacactctatggggtgatggagttgttgaaagtgatttgatcatacc

SEQ ID NO: 356748 - DNA, 75 bp, Artificial Sequence
  Synthetic
acacacactctatggggtgatggagttgttgaaagtgatttgatcataccagtcaccctggcggggcctcggagc

SEQ ID NO: 356749 - DNA, 75 bp, Artificial Sequence
  Synthetic
gaaggaggaccccacgtgctttagcctcaaagcccagtgtcagaccacactttagtgtgccactctgcggagagt

SEQ ID NO: 356750 - DNA, 75 bp, Artificial Sequence
  Synthetic
agatgcagaatcaaggaccctgggatgagggacgcgtggagcttgactttgattattgccctgggaccactgtca

SEQ ID NO: 356751 - DNA, 75 bp, Artificial Sequence
  Synthetic
tgagggacgcgtggagcttgactttgattattgccctgggaccactgtcacagtgagtgagagctgtggacaccg

SEQ ID NO: 356752 - DNA, 75 bp, Artificial Sequence
  Synthetic
gacagtgggaaattgatcacggattggtgttgcagaagctgcacactcccaccattacgcttccaaaccagaagt

SEQ ID NO: 356753 - DNA, 75 bp, Artificial Sequence
  Synthetic
ggatgttggtatggcatggagatcaggccacagaagcatgatgaaagaactctcgttcagtcacaggtgaatgct

SEQ ID NO: 356754 - DNA, 75 bp, Artificial Sequence
  Synthetic
gaccagctatcatgatcgctctgctggttctagtgcttgggggcattacctacactgatgtgctacgatacgtca

SEQ ID NO: 356755 - DNA, 75 bp, Artificial Sequence
  Synthetic
gtcaaattctggaggggatgtcgtccacctggctttgatggctacatttaagatccagccagttttcatggttgc

SEQ ID NO: 356756 - DNA, 75 bp, Artificial Sequence
  Synthetic
cacctggctttgatggctacatttaagatccagccagttttcatggttgcgacgttcgtgaaggctaggtggacg

SEQ ID NO: 356757 - DNA, 75 bp, Artificial Sequence
  Synthetic
tggcggctgtgtttttccagatggcttaccacgatgcccgccacattctgcaatggggaatcccggatgtgttga

SEQ ID NO: 356758 - DNA, 75 bp, Artificial Sequence
  Synthetic
ttaccacgatgcccgccacattctgcaatggggaatcccggatgtgttgaactcactagcggtggcgtggatgat

SEQ ID NO: 356759 - DNA, 75 bp, Artificial Sequence
  Synthetic
gcagctgcaaaaaagaaaggagcaagtctgctatgcttggctctagcctcaacaggacttttcaaccccatgatc

SEQ ID NO: 356760 - DNA, 75 bp, Artificial Sequence
  Synthetic
acttcgaacgtagtggttccactcttggccttgttgacgccaggcttgaaatgcctgaacctggatgtgtacaga

SEQ ID NO: 356761 - DNA, 75 bp, Artificial Sequence
  Synthetic
tggccttgttgacgccaggcttgaaatgcctgaacctggatgtgtacagaatcttactgctcatgattggaattg

SEQ ID NO: 356762 - DNA, 75 bp, Artificial Sequence
  Synthetic
tgctgcagcgaaaaagaaaggagctagcctcatctgtttggcattagcctccactgggtctttcaaccccatgat

SEQ ID NO: 356763 - DNA, 75 bp, Artificial Sequence
  Synthetic
agcctcatctgtttggcattagcctccactgggtctttcaaccccatgattcttgcggctggactcatcgcttgt

SEQ ID NO: 356764 - DNA, 75 bp, Artificial Sequence
  Synthetic
tgtgagctgacaaacttagtagtgtttgtgaggattaataacaattaacacagtgcgagctgtttcttagcacga

SEQ ID NO: 356765 - DNA, 75 bp, Artificial Sequence
  Synthetic
cggccacggaagtcatgacagcggtagggctgatgttcgctatagtgggaggcctcgctgagttggacatggatt

SEQ ID NO: 356766 - DNA, 75 bp, Artificial Sequence
  Synthetic
agggctgatgttcgctatagtgggaggcctcgctgagttggacatggattccatggccatcccgatgaccatagc

SEQ ID NO: 356767 - DNA, 75 bp, Artificial Sequence
  Synthetic
atttctggaaagtcgactgacatgtggattgaaagagtggctgacatctcgtgggagaacgatgcagagatcaca

SEQ ID NO: 356768 - DNA, 75 bp, Artificial Sequence
  Synthetic
ggattgaaagagtggctgacatctcgtgggagaacgatgcagagatcacaggctccagtgagagagtggacgtgc

SEQ ID NO: 356769 - DNA, 75 bp, Artificial Sequence
  Synthetic
gtgctggacagatggagaggcgtcaacaaacaaacagcgatgaagcatctcttgagtttcaagaaagaactagga

SEQ ID NO: 356770 - DNA, 75 bp, Artificial Sequence
  Synthetic
gctcatgaatgatcctggtgccccctggaaactttggatgctacgaatggcttgcttagcaataagtgcctacac

SEQ ID NO: 356771 - DNA, 75 bp, Artificial Sequence
  Synthetic
cccttgggccattctgccatcggttattgggttttggatcactctccagtacactaagagaggaggggtcctttg

SEQ ID NO: 356772 - DNA, 75 bp, Artificial Sequence
  Synthetic
aaaaaaggagacacgaccaccggggtctaccggatcatgacgcgaggaatactaggcagctaccaagcgggagct

SEQ ID NO: 356773 - DNA, 75 bp, Artificial Sequence
  Synthetic
tctaccggatcatgacgcgaggaatactaggcagctaccaagcgggagctggcgtcatggttgagggagtgttcc

SEQ ID NO: 356774 - DNA, 75 bp, Artificial Sequence
  Synthetic
ctccacttcctcaatgccatgtcaaaggttcgcaaagacatccaagagtggaaaccgtcaactggatggtatgat

SEQ ID NO: 356775 - DNA, 75 bp, Artificial Sequence
  Synthetic
ggcggctttgatgagtggagaagggagactagatccatactggggtagcgtcaaggaagatcggctctgctatgg

SEQ ID NO: 356776 - DNA, 75 bp, Artificial Sequence
  Synthetic
agactagatccatactggggtagcgtcaaggaagatcggctctgctatggaggtccatggaagctgcagcacaag

SEQ ID NO: 356777 - DNA, 75 bp, Artificial Sequence
  Synthetic
tgatagtggtgaagccaggagaaagcgtcaagaatgtgcagaccaagccgggggtttttaaaacgccagagggag

SEQ ID NO: 356778 - DNA, 75 bp, Artificial Sequence
  Synthetic
cgtcaagaatgtgcagaccaagccgggggtttttaaaacgccagagggagagatcggagcggtgacccttgactt

SEQ ID NO: 356779 - DNA, 75 bp, Artificial Sequence
  Synthetic
atcgtggacaagaatggggacgtgattgggctatatggtaatggagtgatcatgccaaacggtgcgtacatcagc

SEQ ID NO: 356780 - DNA, 75 bp, Artificial Sequence
  Synthetic
ttgggctatatggtaatggagtgatcatgccaaacggtgcgtacatcagcgccatcgtccagggagaaagaatgg

SEQ ID NO: 356781 - DNA, 75 bp, Artificial Sequence
  Synthetic
atagttaagaaaattttgaggagaaagtcaggccgggaagttccgccaccggaagttgagtagacggtgctgcct

SEQ ID NO: 356782 - DNA, 75 bp, Artificial Sequence
  Synthetic
gcctgacatgttgaggaagaagcagatatcagttcttgatctgcatccaggtgcggggaaaaccaggaaaatatt

SEQ ID NO: 356783 - DNA, 75 bp, Artificial Sequence
  Synthetic
gcctcaaatcataagagaagccatcaatagaagactgagaaccgccatactggcgcctaccagagttgttgcagc

SEQ ID NO: 356784 - DNA, 75 bp, Artificial Sequence
  Synthetic
tggcgcctaccagagttgttgcagccgagatggccgaggctttgcgaggattgccgatccggtaccaaacctcag

SEQ ID NO: 356785 - DNA, 75 bp, Artificial Sequence
  Synthetic
cgagatggccgaggctttgcgaggattgccgatccggtaccaaacctcagcggtgactagagaacacagtgggaa

SEQ ID NO: 356786 - DNA, 75 bp, Artificial Sequence
  Synthetic
gccaccctcactcatagactgatgtctcctcacagagtcccaaactacaacctatttgtcatggacgaagcgcac

SEQ ID NO: 356787 - DNA, 75 bp, Artificial Sequence
  Synthetic
ctcctcacagagtcccaaactacaacctatttgtcatggacgaagcgcacttcacggatccagccagcatcgcag

SEQ ID NO: 356788 - DNA, 75 bp, Artificial Sequence
  Synthetic
ggagttgggggaagctgccgcgatctttatgaccgctacgcctccaggtacccatgatccatttcccgaatcaaa

SEQ ID NO: 356789 - DNA, 75 bp, Artificial Sequence
  Synthetic
tttatgaccgctacgcctccaggtacccatgatccatttcccgaatcaaacgcgcccatagccgacatgcaaact

SEQ ID NO: 356790 - DNA, 75 bp, Artificial Sequence
  Synthetic
ctggttatgaatggattacagagtacacaggaaagacggtctggtttgtgccaagcgtgaagatgggaaatgaaa

SEQ ID NO: 356791 - DNA, 75 bp, Artificial Sequence
  Synthetic
cacaggaaagacggtctggtttgtgccaagcgtgaagatgggaaatgaaatagctttgtgtttacagcgtgctgg

SEQ ID NO: 356792 - DNA, 75 bp, Artificial Sequence
  Synthetic
aaatcatatgaaacggagtacccgaagtgcaagaatgatgattgggattttgtggtcacaacagacatatctgaa

SEQ ID NO: 356793 - DNA, 75 bp, Artificial Sequence
  Synthetic
agtgcaagaatgatgattgggattttgtggtcacaacagacatatctgaaatgggagccaacttcagagctagca

SEQ ID NO: 356794 - DNA, 75 bp, Artificial Sequence
  Synthetic
gaagccaaccatcataactgacggtgaagggaaggtggtcttaagtgaaccctcagccatcacagcagcaagtgc

SEQ ID NO: 356795 - DNA, 75 bp, Artificial Sequence
  Synthetic
gaagggaaggtggtcttaagtgaaccctcagccatcacagcagcaagtgcagcccagcggcgtggccgcattggg

SEQ ID NO: 356796 - DNA, 75 bp, Artificial Sequence
  Synthetic
agtattgctatggcggacacacgaatgaggatgactccaactttgctcattggactgaagcccgcatcatgcttg

SEQ ID NO: 356797 - DNA, 75 bp, Artificial Sequence
  Synthetic
tggactgaagcccgcatcatgcttgacaatataaacatgcccaatggactgatagcccagctctaccaaccagag

SEQ ID NO: 356798 - DNA, 75 bp, Artificial Sequence
  Synthetic
gggagtacaggcttaggggggaagaacggaaaaacttcctagagctgctgaggacagctgacttaccagtctggc

SEQ ID NO: 356799 - DNA, 75 bp, Artificial Sequence
  Synthetic
tcttctgctctgcacaaccagccacaacggcacagtgcgccgacaatggtggctggtggtgcgagaacacaggat

SEQ ID NO: 356800 - DNA, 75 bp, Artificial Sequence
  Synthetic
catgtaagccctcagaaccgtctcggaaggaggaccccacatgttgatccatgtaagccctcagaaccgtctcgg

SEQ ID NO: 356801 - DNA, 75 bp, Artificial Sequence
  Synthetic
catctcttaccacgatcggaagtggtgttttgatggtccaaggacaaacaccatactggaagacaacaacgaagt

SEQ ID NO: 356802 - DNA, 75 bp, Artificial Sequence
  Synthetic
atgtaagccctcagaaccgtctcggaaggaggacccacatgtaagccctcagaaccgtctcggaaggaggacccc

SEQ ID NO: 356803 - DNA, 75 bp, Artificial Sequence
  Synthetic
tgttttgatggtccaaggacaaacaccatactggaagacaacaacgaagtggaagtcattacgaagcttggtgaa

SEQ ID NO: 356804 - DNA, 75 bp, Artificial Sequence
  Synthetic
cagatgcaagagtctattcagaccaccaggccttgaaggcgttcaaagattttgcttccggaaagcgctcccaag

SEQ ID NO: 356805 - DNA, 75 bp, Artificial Sequence
  Synthetic
ccaggccttgaaggcgttcaaagattttgcttccggaaagcgctcccaagtaggactgattgaggtcctaggaag

SEQ ID NO: 356806 - DNA, 75 bp, Artificial Sequence
  Synthetic
catacaccaagtctttggaggagcttttagatcactctttggagggatgtcctggatcacacagggacttctagg

SEQ ID NO: 356807 - DNA, 75 bp, Artificial Sequence
  Synthetic
acatgggaggcactcgacaccatgtacgtcgtggcgacggctgaaaagggggggagagctcacaggatggcgctg

SEQ ID NO: 356808 - DNA, 75 bp, Artificial Sequence
  Synthetic
acgtcgtggcgacggctgaaaagggggggagagctcacaggatggcgctggaagagctcccggacgcgctacaga

SEQ ID NO: 356809 - DNA, 75 bp, Artificial Sequence
  Synthetic
agtgatgacgatgggcgtgttcttcctcctcatgcaaaggaaagggattggcaagattggcctcggtggagtcat

SEQ ID NO: 356810 - DNA, 75 bp, Artificial Sequence
  Synthetic
tgagaggacttcccatccggtaccaaacctcagcagtgcacagagagcacagtggaaatgagatcgttgatgtca

SEQ ID NO: 356811 - DNA, 75 bp, Artificial Sequence
  Synthetic
agatcgctggaatgttgctgctttctttgcttctcatgatagtccttattcctgaaccggagaagcagcgttcac

SEQ ID NO: 356812 - DNA, 75 bp, Artificial Sequence
  Synthetic
tggatggctgaagtgcctggaacaaagatcgctggaatgttgctgctttctttgcttctcatgatagtccttatt

SEQ ID NO: 356813 - DNA, 75 bp, Artificial Sequence
  Synthetic
tttgcttctcatgatagtccttattcctgaaccggagaagcagcgttcacagaccgacaaccaactcgcagtctt

SEQ ID NO: 356814 - DNA, 75 bp, Artificial Sequence
  Synthetic
atggcttgcgaccccaaccgcaagcggggctggcctgccacagaagtgatgactgcagttggactcatgtttgcc

SEQ ID NO: 356815 - DNA, 75 bp, Artificial Sequence
  Synthetic
ggcgcagtcgcggcgaatgagatgggatggcttgacaagaccaagagtgacattggaagcctgtttgggcagaag

SEQ ID NO: 356816 - DNA, 75 bp, Artificial Sequence
  Synthetic
gatggcttgacaagaccaagagtgacattggaagcctgtttgggcagaagcttgaagcgaaggagagcttcagcg

SEQ ID NO: 356817 - DNA, 75 bp, Artificial Sequence
  Synthetic
acccgctacagcgtggtcactctatgccgtcaccacagcattcctgacccctttgctaaaacatctgatcacttc

SEQ ID NO: 356818 - DNA, 75 bp, Artificial Sequence
  Synthetic
gccgtcaccacagcattcctgacccctttgctaaaacatctgatcacttcggactacatcaacacctcactgacg

SEQ ID NO: 356819 - DNA, 75 bp, Artificial Sequence
  Synthetic
tattcacactagcgcggggtttccctttcgttgatgtggggatatctgccttgctgctggcggccggatgttggg

SEQ ID NO: 356820 - DNA, 75 bp, Artificial Sequence
  Synthetic
tttcgttgatgtggggatatctgccttgctgctggcggccggatgttggggccaggtgactctcacggtgacggt

SEQ ID NO: 356821 - DNA, 75 bp, Artificial Sequence
  Synthetic
actgaagctgtaggtcaggggaaggactagaggttagtggagaccccgtgccacagaacaccacaacaaacagca

SEQ ID NO: 356822 - DNA, 75 bp, Artificial Sequence
  Synthetic
cactacgcttatatgattccaggatggcaggctgaagcgatgcgatcggcacaacgcaggacagcagctgggatc

SEQ ID NO: 356823 - DNA, 75 bp, Artificial Sequence
  Synthetic
ggcaggctgaagcgatgcgatcggcacaacgcaggacagcagctgggatcatgaagaatgcagtggtagacggga

SEQ ID NO: 356824 - DNA, 75 bp, Artificial Sequence
  Synthetic
tgagcgagctacccccatgatgcaaaagaaagttggacaagtcatgttgattctggtctcattggccgcggtggt

SEQ ID NO: 356825 - DNA, 75 bp, Artificial Sequence
  Synthetic
aagaaagttggacaagtcatgttgattctggtctcattggccgcggtggtagtaaatccgtcagtaaggaccgtc

SEQ ID NO: 356826 - DNA, 75 bp, Artificial Sequence
  Synthetic
cagcggctgtgactctttgggagaacggagccagttccgtgtggaacgcaacaacggcaatcggactctgccaca

SEQ ID NO: 356827 - DNA, 75 bp, Artificial Sequence
  Synthetic
acaacggcaatcggactctgccacatcatgcgagaaggatggctatcgtgcctctcgataacctggactctcata

SEQ ID NO: 356828 - DNA, 75 bp, Artificial Sequence
  Synthetic
aaagaggaggagcgaagggccgcacgttgggtgaagtttggaaggaaaagctcaatcagatgtcaaaagaggagt

SEQ ID NO: 356829 - DNA, 75 bp, Artificial Sequence
  Synthetic
gttgggtgaagtttggaaggaaaagctcaatcagatgtcaaaagaggagttttccagatatcgcaaggaggcaat

SEQ ID NO: 356830 - DNA, 75 bp, Artificial Sequence
  Synthetic
aaacacgccaggagagaagggaacataacgggaggccaccccgtttccagagggtcagccaagctgaggtggtta

SEQ ID NO: 356831 - DNA, 75 bp, Artificial Sequence
  Synthetic
taacgggaggccaccccgtttccagagggtcagccaagctgaggtggttagtggaaagaaaatttgttgaaccgg

SEQ ID NO: 356832 - DNA, 75 bp, Artificial Sequence
  Synthetic
tggtagaggtggatggtgttactacatggctacccagaagagagtccaagaggtccgagggtacacaaaaagagg

SEQ ID NO: 356833 - DNA, 75 bp, Artificial Sequence
  Synthetic
aggtccgagggtacacaaaaagaggacctggccatgaagaaccccaattggtgcagagctacggatggaacatcg

SEQ ID NO: 356834 - DNA, 75 bp, Artificial Sequence
  Synthetic
cttctacagaccttctgagagctgtgacaccttgctctgtgacattggggagtcatcatcgagcgctgaagttga

SEQ ID NO: 356835 - DNA, 75 bp, Artificial Sequence
  Synthetic
gacaccttgctctgtgacattggggagtcatcatcgagcgctgaagttgaggagcacaggacccttcgagtcctt

SEQ ID NO: 356836 - DNA, 75 bp, Artificial Sequence
  Synthetic
gagggcccaaggaattctgtgtgaaagttttgtgcccctacatgcccaaagttgttgaaaagatggaggtcctcc

SEQ ID NO: 356837 - DNA, 75 bp, Artificial Sequence
  Synthetic
aaccaaggttgaattgggcgaagccgccgcgattttcatgacggcaacgccacccgggacttctgacccctttcc

SEQ ID NO: 356838 - DNA, 75 bp, Artificial Sequence
  Synthetic
agttttgtgcccctacatgcccaaagttgttgaaaagatggaggtcctccagcgacgttacggaggaggattggt

SEQ ID NO: 356839 - DNA, 75 bp, Artificial Sequence
  Synthetic
acacatgagatgtactgggttagccaggcctctggtaacattgtgcatgcagtaaacatgaccagtcaagtgcta

SEQ ID NO: 356840 - DNA, 75 bp, Artificial Sequence
  Synthetic
aggcctctggtaacattgtgcatgcagtaaacatgaccagtcaagtgctactagggagaatggaaaaaagaacct

SEQ ID NO: 356841 - DNA, 75 bp, Artificial Sequence
  Synthetic
tgtgaacctcggtagtggcacaagagcagtggggaaacctctgctgaattctgataccagcaagataaagaaccg

SEQ ID NO: 356842 - DNA, 75 bp, Artificial Sequence
  Synthetic
ggctcaacatggcaccatgatgaaaaccacccctacaggacttggaactaccatggaagctatgaggtaaaccct

SEQ ID NO: 356843 - DNA, 75 bp, Artificial Sequence
  Synthetic
atggcgtggtcaggctcctttcaaagccgtgggataccattaccaacgtcaccactatggctatgacagacacca

SEQ ID NO: 356844 - DNA, 75 bp, Artificial Sequence
  Synthetic
gccgtgggataccattaccaacgtcaccactatggctatgacagacaccaccccgttcggccagcaaagagtctt

SEQ ID NO: 356845 - DNA, 75 bp, Artificial Sequence
  Synthetic
agtagttcacctgtgtgagctgacaaacttagtagtgtttgtgaggattgtgaacaattaacacagtgtgagctg

SEQ ID NO: 356846 - DNA, 75 bp, Artificial Sequence
  Synthetic
ccagaacctcccgagggagtgagaagcgtcctcaatgagaccaccaactggctgtgggcctttctttcccgggac

SEQ ID NO: 356847 - DNA, 75 bp, Artificial Sequence
  Synthetic
gcgtcctcaatgagaccaccaactggctgtgggcctttctttcccgggacaaacggccacgtttgtgttctagag

SEQ ID NO: 356848 - DNA, 75 bp, Artificial Sequence
  Synthetic
caacgcagccttgggcgcaatgtttgaggagcagaaccagtggaagagcgcaagagaagcagttgaagatccaaa

SEQ ID NO: 356849 - DNA, 75 bp, Artificial Sequence
  Synthetic
caagagaagcagttgaagatccaaaattctgggagatggttgatgaggagcgtgaggctcacttgcgcggcgaat

SEQ ID NO: 356850 - DNA, 75 bp, Artificial Sequence
  Synthetic
tgattggactgaagagggctatgctgagtctgattgacgggaagggcccaatacgtttcgtgttggctcttctgg

SEQ ID NO: 356851 - DNA, 75 bp, Artificial Sequence
  Synthetic
gggtaagagagagaaaaaacctggtgaatttggaaaagcgaaaggaagccgagccatatggttcatgtggctggg

SEQ ID NO: 356852 - DNA, 75 bp, Artificial Sequence
  Synthetic
gaatttggaaaagcgaaaggaagccgagccatatggttcatgtggctgggggcgcgatttctggagttcgaggcc

SEQ ID NO: 356853 - DNA, 75 bp, Artificial Sequence
  Synthetic
ggcttggcagagaaaattcaggaggcggagtggaaggattgggcttgcaaaaactcggttacattctccgtgagg

SEQ ID NO: 356854 - DNA, 75 bp, Artificial Sequence
  Synthetic
cggagtggaaggattgggcttgcaaaaactcggttacattctccgtgaggtaggcacccgaacgggagggaagat

SEQ ID NO: 356855 - DNA, 75 bp, Artificial Sequence
  Synthetic
gacacacgaatcaccatgactgaccttgagaacgaagcgaaggttttggaattgctcgacggagaacatcgtcgc

SEQ ID NO: 356856 - DNA, 75 bp, Artificial Sequence
  Synthetic
gacgcgattaccatcccaacagctgccgggaaaaacctgtgcatcgtgagggcaatggacgtaggatatctctgc

SEQ ID NO: 356857 - DNA, 75 bp, Artificial Sequence
  Synthetic
ttgagaacgaagcgaaggttttggaattgctcgacggagaacatcgtcgcttggccagatccatcattgagctca

SEQ ID NO: 356858 - DNA, 75 bp, Artificial Sequence
  Synthetic
gatgcgccccgccgctgatggaaaaacagtcatggacgtcatttctagggaagatcagagggggagcggacaagt

SEQ ID NO: 356859 - DNA, 75 bp, Artificial Sequence
  Synthetic
acagtcatggacgtcatttctagggaagatcagagggggagcggacaagttgtcacttacgcgctgaacaccttt

SEQ ID NO: 356860 - DNA, 75 bp, Artificial Sequence
  Synthetic
cctgctttccctgctgctcatgattgttttgattccggagccggaaaagcagcgctcacagactgacaaccagct

SEQ ID NO: 356861 - DNA, 75 bp, Artificial Sequence
  Synthetic
gaatgatggaaggggaaggagtcataactccagatgacgttgaaaagcttggtagaggaaaaggccctaaagtga

SEQ ID NO: 356862 - DNA, 75 bp, Artificial Sequence
  Synthetic
agagagacttggacgcatggctgttagtggggatgattgtgtggttaaaccactggatgatcgatttgcctcgtc

SEQ ID NO: 356863 - DNA, 75 bp, Artificial Sequence
  Synthetic
ggaagtaacacaatgcaacgcgtcgtgtttgctatcctactgcttttggtggcaccagcatacagcttcaactgc

SEQ ID NO: 356864 - DNA, 75 bp, Artificial Sequence
  Synthetic
cactggatgatcgatttgcctcgtcactccacttcctcaacgcgatgtcaaaggtccggaaagacatccaagagt

SEQ ID NO: 356865 - DNA, 75 bp, Artificial Sequence
  Synthetic
ttggcagcaagtccccttctgctcaaaccatttcactgaactagtcatgaaagatggcagaacactggtggtccc

SEQ ID NO: 356866 - DNA, 75 bp, Artificial Sequence
  Synthetic
aaccatttcactgaactagtcatgaaagatggcagaacactggtggtcccgtgcaggggccaggatgagttgatt

SEQ ID NO: 356867 - DNA, 75 bp, Artificial Sequence
  Synthetic
tagcttcggtcagtgatctgtcaacaaaagccgcgtgtccaaccatgggtgaagctcacaacgagaaaagagccg

SEQ ID NO: 356868 - DNA, 75 bp, Artificial Sequence
  Synthetic
ctggatggaacgtgcgggatactgcctgcctggcgaagtcctacgctcaaatgtggctcctcctgtacttccata

SEQ ID NO: 356869 - DNA, 75 bp, Artificial Sequence
  Synthetic
ctgcctggcgaagtcctacgctcaaatgtggctcctcctgtacttccatagaagagatctccggctgatggccaa

SEQ ID NO: 356870 - DNA, 75 bp, Artificial Sequence
  Synthetic
aaaagccgcgtgtccaaccatgggtgaagctcacaacgagaaaagagccgaccctgcctttgtttgcaagcaagg

SEQ ID NO: 356871 - DNA, 75 bp, Artificial Sequence
  Synthetic
gtagaggagatcagcagataaaccaccactggcacaagtcagggagtagcattggcaaggcatttaccacgaccc

SEQ ID NO: 356872 - DNA, 75 bp, Artificial Sequence
  Synthetic
agactggtcactgttaaccccttcgtatcggtggcgacagccaacgctaaagtgttgattgaactagagccgcct

SEQ ID NO: 356873 - DNA, 75 bp, Artificial Sequence
  Synthetic
gactgggttcctacgggaaggaccacctggtctatccacgcacgtggggagtggatgacaacagaagacatgctt

SEQ ID NO: 356874 - DNA, 75 bp, Artificial Sequence
  Synthetic
cctggtctatccacgcacgtggggagtggatgacaacagaagacatgcttgaggtgtggaaccgcgtctggattg

SEQ ID NO: 356875 - DNA, 75 bp, Artificial Sequence
  Synthetic
gcattgacacatgtgcaaagtttgcctgtacaaccaaggcaactggttggattatccagaaggaaaacatcaagt

SEQ ID NO: 356876 - DNA, 75 bp, Artificial Sequence
  Synthetic
ccactggcacaagtcagggagtagcattggcaaggcatttaccacgaccctcaagggggcgcagagactggctgc

SEQ ID NO: 356877 - DNA, 75 bp, Artificial Sequence
  Synthetic
cccgacgactgtcgaatcacatggcaattattcaacacagataggggctacccaagcaggaaggttcagcataac

SEQ ID NO: 356878 - DNA, 75 bp, Artificial Sequence
  Synthetic
gactccagttgagagatggagcgatgtgccatactcaggcaagcgtgaagacatctggtgtgggagcctcatcgg

SEQ ID NO: 356879 - DNA, 75 bp, Artificial Sequence
  Synthetic
gtgccatactcaggcaagcgtgaagacatctggtgtgggagcctcatcggcaccagagcccgcgccacttgggct

SEQ ID NO: 356880 - DNA, 75 bp, Artificial Sequence
  Synthetic
aattattcaacacagataggggctacccaagcaggaaggttcagcataactccatcggcaccatcctacacgctg

SEQ ID NO: 356881 - DNA, 75 bp, Artificial Sequence
  Synthetic
cagttgactgtgagccacggtcaggaatagacactagcgcttactacgttatgtcagtgggtgcgaagtccttct

SEQ ID NO: 356882 - DNA, 75 bp, Artificial Sequence
  Synthetic
aggtccgagcaatcataggagaagagaagtatgtggactacatgagttcattgaggagatatgaagaagtcacat

SEQ ID NO: 356883 - DNA, 75 bp, Artificial Sequence
  Synthetic
aatagacactagcgcttactacgttatgtcagtgggtgcgaagtccttcttggttcaccgagaatggtttatgga

SEQ ID NO: 356884 - DNA, 75 bp, Artificial Sequence
  Synthetic
ttgaggagatatgaagaagtcacattagtggaggactcagtgttgtaaatagtaacagttaaggtatgtgtatag

SEQ ID NO: 356885 - DNA, 75 bp, Artificial Sequence
  Synthetic
aaagtatgcatgtaggttagtgttgagaattttgttagaggaagtcaggccggagcatttccgccaccggatgtt

SEQ ID NO: 356886 - DNA, 75 bp, Artificial Sequence
  Synthetic
aaccccaggaggactgggtgaacaaagctgcggagcgatccatgtaagccctcagaaccgcctcggaagtaggac

SEQ ID NO: 356887 - DNA, 75 bp, Artificial Sequence
  Synthetic
agtgtagggtaaagatggagaagttgcagctgaagggaacaacatatggtgtatgctcaaaagcattcaaattcg

SEQ ID NO: 356888 - DNA, 75 bp, Artificial Sequence
  Synthetic
accgtcagaccacaccgaggtgtgccactcagcggagagtgcggtttgcgcagcccaggaggactgggttaacaa

SEQ ID NO: 356889 - DNA, 75 bp, Artificial Sequence
  Synthetic
tggaacggtggtgctggaactgcagtataccggaaaagacgggccttgcaaagtgcccatttcttctgtggcttc

SEQ ID NO: 356890 - DNA, 75 bp, Artificial Sequence
  Synthetic
cactcagcggagagtgcggtttgcgcagcccaggaggactgggttaacaaaggcacggcaacgccccacgcggcc

SEQ ID NO: 356891 - DNA, 75 bp, Artificial Sequence
  Synthetic
aagtgcccatttcttctgtggcttccctgaacgaccttacacccgttggaaggctggtgactgtgaatccatttg

SEQ ID NO: 356892 - DNA, 75 bp, Artificial Sequence
  Synthetic
agggtggaaggactagaggttagaggagaccccgcgttgaacagagcacggcccaacctgattgaagctgtagat

SEQ ID NO: 356893 - DNA, 75 bp, Artificial Sequence
  Synthetic
gagaccccgcgttgaacagagcacggcccaacctgattgaagctgtagatcaggggaaggactagaggttagtgg

SEQ ID NO: 356894 - DNA, 75 bp, Artificial Sequence
  Synthetic
ggagaggagaacagcagataaaccaccactggcacaaatctgggagcagtattggaaaggctttcaccactacac

SEQ ID NO: 356895 - DNA, 75 bp, Artificial Sequence
  Synthetic
acagactaggagatcttctgctcttcacaaccagccacacggcacagtgcgccgaaagtggtggctggtggtgcg

SEQ ID NO: 356896 - DNA, 75 bp, Artificial Sequence
  Synthetic
tcttggagacactgcctgggattttggatcagtcggaggggttttcacctcggtagggaaagccatacaccaagt

SEQ ID NO: 356897 - DNA, 75 bp, Artificial Sequence
  Synthetic
ggatcagtcggaggggttttcacctcggtagggaaagccatacaccaagtttttggaggagcctttagatcactc

SEQ ID NO: 356898 - DNA, 75 bp, Artificial Sequence
  Synthetic
ctaagaaaccaggagggcccggtaaaaaccgggctgtcaatatgctaaaacgcggtatgccccgcggattgtcct

SEQ ID NO: 356899 - DNA, 75 bp, Artificial Sequence
  Synthetic
aaaccgggctgtcaatatgctaaaacgcggtatgccccgcggattgtccttgataggactgaagagggctatgct

SEQ ID NO: 356900 - DNA, 75 bp, Artificial Sequence
  Synthetic
aggggcttctgggagctcttctgctgtggatgggaattaacgcccgtgacaggtcaattgctatgacgttccttg

SEQ ID NO: 356901 - DNA, 75 bp, Artificial Sequence
  Synthetic
atacgtttcgtgttggctcttttggcgtttttcagattcactgcaatcgctccgactcgtgcggtgctggacaga

SEQ ID NO: 356902 - DNA, 75 bp, Artificial Sequence
  Synthetic
gcatggtcgctctatgccgtaacgacagccgttcttacccctttgctgaaacatctaatcacgtcagactacatc

SEQ ID NO: 356903 - DNA, 75 bp, Artificial Sequence
  Synthetic
cggttggaggagtcttgctcttcctatcggtcaacgttcatgctgatacaggctgtgccattgatgttggtaggc

SEQ ID NO: 356904 - DNA, 75 bp, Artificial Sequence
  Synthetic
gtttatccacaatgatgtggaagcctggatggatcgctacaagttctacccggagacgccacaaggcctagcaaa

SEQ ID NO: 356905 - DNA, 75 bp, Artificial Sequence
  Synthetic
ggctgttggtatggtatggagattagaccacagagacatgatgaaaagacccttgtgcagtcacaagtgaatgct

SEQ ID NO: 356906 - DNA, 75 bp, Artificial Sequence
  Synthetic
cggccgggtgctggggccaagtgaccctgactgtgactgtgactgcagctgccctgctcttttgccactatgctt

SEQ ID NO: 356907 - DNA, 75 bp, Artificial Sequence
  Synthetic
cggagacgccacaaggcctagcaaagattatccagaaagcacatgcggaaggagtctgtggcctgcgctccgttt

SEQ ID NO: 356908 - DNA, 75 bp, Artificial Sequence
  Synthetic
tgggatgcacaaagcggcaccaaggcgtttggctgccaccactgaaaaattggagatgggttggaaggcctgggg

SEQ ID NO: 356909 - DNA, 75 bp, Artificial Sequence
  Synthetic
aaatcatctgtttacgtgcgctatggaagatgcacaaaaactcggcattcccgtcgaagcagaaggtctctgact

SEQ ID NO: 356910 - DNA, 75 bp, Artificial Sequence
  Synthetic
acggtcctgagactgaggaatgcccaacggccaaccgagcatggaacagcatggaggtggaagacttcggatttg

SEQ ID NO: 356911 - DNA, 75 bp, Artificial Sequence
  Synthetic
gaagattcgggagacgaacacaacggaatgtgactcgaaaatcatcggaaccgccgtcaagaacaacatggccgt

SEQ ID NO: 356912 - DNA, 75 bp, Artificial Sequence
  Synthetic
gaatgtgactcgaaaatcatcggaaccgccgtcaagaacaacatggccgtgcacagtgacttgtcatactggata

SEQ ID NO: 356913 - DNA, 75 bp, Artificial Sequence
  Synthetic
agctcgagagggcggttttaggagaggtcaaatcatgtacctggccagaaacccacactctgtggggtgatggag

SEQ ID NO: 356914 - DNA, 75 bp, Artificial Sequence
  Synthetic
ttttggaaagtgatctcatcatacccatcactttggcaggccctagaagtaaccacaacaggagaccagggtata

SEQ ID NO: 356915 - DNA, 75 bp, Artificial Sequence
  Synthetic
tgttttgatggtccaaggacaaacaccatactggaggacaacaatgaagtggaggtgatcacaaagctcggtgag

SEQ ID NO: 356916 - DNA, 75 bp, Artificial Sequence
  Synthetic
tgaggggcgtgttgagattgactttgactactgtccaggaacaacagtaaccataagtgacagttgcggacaccg

SEQ ID NO: 356917 - DNA, 75 bp, Artificial Sequence
  Synthetic
tttagaatatggcccccccggctctggcggggccctcctggtttcttagacatcgagatcttcgtgctaagaaac

SEQ ID NO: 356918 - DNA, 75 bp, Artificial Sequence
  Synthetic
gactactgtccaggaacaacagtaaccataagtgacagttgcggacaccgtggacccgcagcacgcacgaccact

SEQ ID NO: 356919 - DNA, 75 bp, Artificial Sequence
  Synthetic
gaacaccccgggggccttcccgttttttagaatatggcccccccggctctggcggggccctcctggtttcttaga

SEQ ID NO: 356920 - DNA, 75 bp, Artificial Sequence
  Synthetic
ggtgctgcagaagttgcaccctccccccactgcgtttcaaaactgagaatggctgttggtatggaatggaaattc

SEQ ID NO: 356921 - DNA, 75 bp, Artificial Sequence
  Synthetic
gctgggattggctcaagcactgagaggactgcccatccggtaccagacatccgcagtgcccagagaacataatgg

SEQ ID NO: 356922 - DNA, 75 bp, Artificial Sequence
  Synthetic
cccaggctggaagattcagtataactccatcggcgccatcttacacgctaaagttgggtgagtatggtgaggtca

SEQ ID NO: 356923 - DNA, 75 bp, Artificial Sequence
  Synthetic
cggttgactgtgagccacggtcaggaatagacactagcgcttattacgttatgtcagttggtgcgaagtccttcc

SEQ ID NO: 356924 - DNA, 75 bp, Artificial Sequence
  Synthetic
agcgaactcaggaggagatgttgtgcacttggcgctcatggccacattcaagatccaaccagtctttctagtggc

SEQ ID NO: 356925 - DNA, 75 bp, Artificial Sequence
  Synthetic
aaccaagagagtattctgcttatgcttgcagccgcttttttccaaatggcttattatgatgccaagaatgttttg

SEQ ID NO: 356926 - DNA, 75 bp, Artificial Sequence
  Synthetic
ttgcagccgcttttttccaaatggcttattatgatgccaagaatgttttggcatgggaaatgcctgatgtcttga

SEQ ID NO: 356927 - DNA, 75 bp, Artificial Sequence
  Synthetic
gccttgcctatcccctgttgcgtgtctcaggttcgcctgtgtgagctgacaaacttagtagtgtttgtgaggatt

SEQ ID NO: 356928 - DNA, 75 bp, Artificial Sequence
  Synthetic
tggcccttttgacacctggattaaaatgcttaaatttggatgtgtacagaattttgctgctcatggttggagttg

SEQ ID NO: 356929 - DNA, 75 bp, Artificial Sequence
  Synthetic
actatcaccaatgtgaccacgatggccatgacagacaccactcctttcggtcaacaacgagtgttcaaggaaaag

SEQ ID NO: 356930 - DNA, 75 bp, Artificial Sequence
  Synthetic
gagtgtggattgaggagaatgagtggatggaagacaaaacaccagttgagaggtggagtgatgttccatactctg

SEQ ID NO: 356931 - DNA, 75 bp, Artificial Sequence
  Synthetic
ttccgcagcaaaaaagaaaggagcctgcctcatctgcctagcattggcgtctacaggagtgttcaatccaatgat

SEQ ID NO: 356932 - DNA, 75 bp, Artificial Sequence
  Synthetic
agatgtcatcacgattccaacagctgctggaaagaacctatgcattgtcagagcaatggatgtgggatacatgtg

SEQ ID NO: 356933 - DNA, 75 bp, Artificial Sequence
  Synthetic
cggacttatgttcgtggcattcgtcatctctggaaagtcaacagatatgtggattgagaggacggccgacatcac

SEQ ID NO: 356934 - DNA, 75 bp, Artificial Sequence
  Synthetic
tgttttgtaaataataaagctgtattgagtagttgtatagttgtagtgtttatagcaatttgaattatgattaat

SEQ ID NO: 356935 - DNA, 75 bp, Artificial Sequence
  Synthetic
tttacagaatcatgactcgaggtctgcttggcagctaccaagctggagccggagtgatggtagagggagtgttcc

SEQ ID NO: 356936 - DNA, 75 bp, Artificial Sequence
  Synthetic
aagagctccggtgtggaagtggagtgtttatccacaacgatgtggaagcctggatggatcgttacaagttctacc

SEQ ID NO: 356937 - DNA, 75 bp, Artificial Sequence
  Synthetic
aattattcagaaagcacatgcagaaggagtctgcggcttgcgttccgtttccagactcgagcaccaaatgtggga

SEQ ID NO: 356938 - DNA, 75 bp, Artificial Sequence
  Synthetic
tgaaagaggaccgactctgctatggggggccatggaaactccagcataaatggaatgggcatgatgaggtccaaa

SEQ ID NO: 356939 - DNA, 75 bp, Artificial Sequence
  Synthetic
cctatcccctgtgtgccttggagtctcagcctgtgtgagctgacaaacttagtagtgtttgtgaggattaacaac

SEQ ID NO: 356940 - DNA, 75 bp, Artificial Sequence
  Synthetic
atcactgtccttgatttgcaccccggagcaggaaagacacgcaagatacttccccagatcatcaaggaggccatt

SEQ ID NO: 356941 - DNA, 75 bp, Artificial Sequence
  Synthetic
cactggatgatcgctttgcctcatccctccacttcctcaacgcgatgtcaaaggtccggaaagacatccaagagt

SEQ ID NO: 356942 - DNA, 75 bp, Artificial Sequence
  Synthetic
tgagattgttgatgtcatgtgtcatgccaccctcacacacaggctgatgtctccacacagagttcccaactacaa

SEQ ID NO: 356943 - DNA, 75 bp, Artificial Sequence
  Synthetic
cctgtttataatggatgaagcccacttcacggatccagcgagcatcgctgctagaggatacatagcaaccaaggt

SEQ ID NO: 356944 - DNA, 75 bp, Artificial Sequence
  Synthetic
cccccacacatgtaagcccctcagaacccgtctcggaaggaggacccccacacatgtaagcccctcagaacccgt

SEQ ID NO: 356945 - DNA, 75 bp, Artificial Sequence
  Synthetic
gactattgcccaggaacaacagtaactataagtgatagttgcggacaccgtggacctgcggcacgcacaaccact

SEQ ID NO: 356946 - DNA, 75 bp, Artificial Sequence
  Synthetic
acccgtctcggaaggaggacccccacacatgtaagcccctcagaacccgtcctcggaaggaggaccccccacatg

SEQ ID NO: 356947 - DNA, 75 bp, Artificial Sequence
  Synthetic
ggtgctgcagaagctgcaccctccctccactgcgcttccagactgagaatggctgttggtatggaatggaaattc

SEQ ID NO: 356948 - DNA, 75 bp, Artificial Sequence
  Synthetic
aaggaggaccccccacatgtaagcccctcagaacccgtctcggaaggaggacccccacatgtaagcccctcagaa

SEQ ID NO: 356949 - DNA, 75 bp, Artificial Sequence
  Synthetic
cctcagaacccgtctcggaaggaggacccccacatgtaagcccctcagaacccgtctcggaaggaggacccccac

SEQ ID NO: 356950 - DNA, 75 bp, Artificial Sequence
  Synthetic
aagtcctatgagacggagtaccccaagtgcaagaacgatgattgggattttgtcatcactacggacatatcagaa

SEQ ID NO: 356951 - DNA, 75 bp, Artificial Sequence
  Synthetic
cctcagaaccgtctcggaaggaggaccccacatgtaagccctcacgaaccgtctcggaaggaggacccccacatg

SEQ ID NO: 356952 - DNA, 75 bp, Artificial Sequence
  Synthetic
accgtcagaccacaccgaggtgtgccactcagcggagagtgcggtctgcgcagccccaggaggactgggttaaca

SEQ ID NO: 356953 - DNA, 75 bp, Artificial Sequence
  Synthetic
cactcagcggagagtgcggtctgcgcagccccaggaggactgggttaacaaaggcacggcaacgccccacgcggc

SEQ ID NO: 356954 - DNA, 75 bp, Artificial Sequence
  Synthetic
agattcaaccagtctttctggtggcttcctttttgaaggcaaggtggaccaaccaagagagtattttgctcatgc

SEQ ID NO: 356955 - DNA, 75 bp, Artificial Sequence
  Synthetic
tgctcagcggagaggacgcataggaagaaacccatcacaagttggcgatgagtactgctatggagggcacacaaa

SEQ ID NO: 356956 - DNA, 75 bp, Artificial Sequence
  Synthetic
tgaggatgattccaactttgctcactggacagaagcccgtatcatgctagacaacatcaacatgccaaatggcct

SEQ ID NO: 356957 - DNA, 75 bp, Artificial Sequence
  Synthetic
tcatgggaagtgcctgacgttttgaactctctctccgttgcgtggatgattctcagagctataagcttcaccaac

SEQ ID NO: 356958 - DNA, 75 bp, Artificial Sequence
  Synthetic
actctctctccgttgcgtggatgattctcagagctataagcttcaccaacacttcaaatgtggtggtgccgctgc

SEQ ID NO: 356959 - DNA, 75 bp, Artificial Sequence
  Synthetic
gcccaacctgaatgaagctgtagatcaggggaaggactagaggttagtggagaccccgtgcgaagagaacaccac

SEQ ID NO: 356960 - DNA, 75 bp, Artificial Sequence
  Synthetic
gcccaacctgattgaagctgtagatcaggggaaggactagaggttagtggagaccccgtgcgaagagaacaccac

SEQ ID NO: 356961 - DNA, 75 bp, Artificial Sequence
  Synthetic
gcccaacctgactgaagctgtagatcaggggaaggactagaggttagtggagaccccgtgcgaagagaacaccac

SEQ ID NO: 356962 - DNA, 75 bp, Artificial Sequence
  Synthetic
gcccaacctgagtgaagctgtagatcaggggaaggactagaggttagtggagaccccgtgcgaagagaacaccac

SEQ ID NO: 356963 - DNA, 75 bp, Artificial Sequence
  Synthetic
gaccccaaccgcaagcggggctggcctgccacagaagtgatgactgcagttggactcatgtttgccatcgttggg

SEQ ID NO: 356964 - DNA, 75 bp, Artificial Sequence
  Synthetic
gcgcgatagtgcagggtgaaaggatggatgagccaatcccagccggattcgaacctgagatgctgaggaaaaaac

SEQ ID NO: 356965 - DNA, 75 bp, Artificial Sequence
  Synthetic
ctatggctatccccatgaccattgccggactcatgttcgtggcatttgtcatctctggaaagtcaacagacatgt

SEQ ID NO: 356966 - DNA, 75 bp, Artificial Sequence
  Synthetic
atgtggtggcaactgctgaaaagggaggccgagctcataggatggcccttgaggagcttccggacgcccttcaga

SEQ ID NO: 356967 - DNA, 75 bp, Artificial Sequence
  Synthetic
actgggtgaacaaagccgcgaagtgatccatgtaagccctcagaaccctgagacacgcaacaggggataggcaag

SEQ ID NO: 356968 - DNA, 75 bp, Artificial Sequence
  Synthetic
ttaggaatgagtaacagagacttcctggagggagtgtctggagctacatgggttgatctggtactggaaggcgac

SEQ ID NO: 356969 - DNA, 75 bp, Artificial Sequence
  Synthetic
agttgtgtgaccataatgtcaaaagacaagccaaccattgatgtcaaaatgatgaacatggaagcagccaatctc

SEQ ID NO: 356970 - DNA, 75 bp, Artificial Sequence
  Synthetic
acaagccaaccattgatgtcaaaatgatgaacatggaagcagccaatctcgcagatgtgcgcagttactgttacc

SEQ ID NO: 356971 - DNA, 75 bp, Artificial Sequence
  Synthetic
gtctcctcacagggtgccgaactacaatctgttcgtgatggatgaggctcatttcaccgacccagctagcattgc

SEQ ID NO: 356972 - DNA, 75 bp, Artificial Sequence
  Synthetic
tggatggctgaagtcccaggaacgaagatagcgggcatgcttctgctctccttgttgcttatgattgtcctgatt

SEQ ID NO: 356973 - DNA, 75 bp, Artificial Sequence
  Synthetic
tttacagaatcatgactcgaggtctgcttggcagttaccaagctggagccggagtgatggtagagggagtgttcc

SEQ ID NO: 356974 - DNA, 75 bp, Artificial Sequence
  Synthetic
tttgatctgtgtgctcacactagtcagcgccgtggctgctaatgaaatgggctggctagacaaaaccaagagtga

SEQ ID NO: 356975 - DNA, 75 bp, Artificial Sequence
  Synthetic
ggagtgatggtagagggagtgttccacacactatggcacaccactaagggagctgctctcatgagtggtgaagga

SEQ ID NO: 356976 - DNA, 75 bp, Artificial Sequence
  Synthetic
acacactatggcacaccactaagggagctgctctcatgagtggtgaaggacgtctggatccctattgggggagcg

SEQ ID NO: 356977 - DNA, 75 bp, Artificial Sequence
  Synthetic
ccagaagctagggagacgaccctgggagttgagagctttttacttgacttacggccggctacggcatggtcgctc

SEQ ID NO: 356978 - DNA, 75 bp, Artificial Sequence
  Synthetic
gagttgagagctttttacttgacttacggccggctacggcatggtcgctctacgccgtaacgacagccgttctca

SEQ ID NO: 356979 - DNA, 75 bp, Artificial Sequence
  Synthetic
ggggccatggaaactccaacataaatggaatggacatgatgaggtccaaatgattgttgtggagccaggaaaaaa

SEQ ID NO: 356980 - DNA, 75 bp, Artificial Sequence
  Synthetic
gtcagactacatcaacacttcgctgacttcaataaacgtccaagctagcgcgttgttcaccctggccagaggctt

SEQ ID NO: 356981 - DNA, 75 bp, Artificial Sequence
  Synthetic
acttcaataaacgtccaagctagcgcgttgttcaccctggccagaggctttcctttcgtggacgttggtgtgtca

SEQ ID NO: 356982 - DNA, 75 bp, Artificial Sequence
  Synthetic
gctggcaagcggaagccatgcgatctgcccagcggcggactgccgccggtatcatgaaaaatgcagttgtggatg

SEQ ID NO: 356983 - DNA, 75 bp, Artificial Sequence
  Synthetic
cagaaaaaggttggacagatcatgctgatcttggtgtcaatggctgcggtggtcgtcaatccatcagtgagaact

SEQ ID NO: 356984 - DNA, 75 bp, Artificial Sequence
  Synthetic
cagcggcagcggtcaccctatgggagaatggcgctagttcagtgtggaatgcaacaacagccattggtctttgtc

SEQ ID NO: 356985 - DNA, 75 bp, Artificial Sequence
  Synthetic
gaatggcgctagttcagtgtggaatgcaacaacagccattggtctttgtcacatcatgcgaggaggatggctctc

SEQ ID NO: 356986 - DNA, 75 bp, Artificial Sequence
  Synthetic
atcaaaagcatggagaagcctgtcctcaagaggggcggagccaaaggacgcacgctgggagaagtctggaaggag

SEQ ID NO: 356987 - DNA, 75 bp, Artificial Sequence
  Synthetic
ttcacggatccagcgagcatcgcagctagaggatacatagcaaccaaggttgaattgggcgaagccgccgcgatt

SEQ ID NO: 356988 - DNA, 75 bp, Artificial Sequence
  Synthetic
tcaagaggggcggagccaaaggacgcacgctgggagaagtctggaaggagagactcaaccacatgacgaaggaag

SEQ ID NO: 356989 - DNA, 75 bp, Artificial Sequence
  Synthetic
catcaccgaggttgaccgctccgctgcaaaacatgctaggagagagggaaacattactggaggccacccagtctc

SEQ ID NO: 356990 - DNA, 75 bp, Artificial Sequence
  Synthetic
gcaaaacatgctaggagagagggaaacattactggaggccacccagtctcacgaggaaccgcgaaattacggtgg

SEQ ID NO: 356991 - DNA, 75 bp, Artificial Sequence
  Synthetic
gagatcccagacagagcctggaacactggatatgaatggataactgagtatgttggaaagaccgtttggtttgtt

SEQ ID NO: 356992 - DNA, 75 bp, Artificial Sequence
  Synthetic
tgttggaaagaccgtttggtttgttccaagtgtgaaaatgggaaatgagattgccctctgtctgcaacgggcggg

SEQ ID NO: 356993 - DNA, 75 bp, Artificial Sequence
  Synthetic
cagtggggaaggttgtggatctcgggtgtggcagaggcggctggtgctactacatggccacccagaagagggtgc

SEQ ID NO: 356994 - DNA, 75 bp, Artificial Sequence
  Synthetic
ttgccctctgtctgcaacgggcggggaagaaggttatccagctgaacagaaagtcctatgagacagagtacccca

SEQ ID NO: 356995 - DNA, 75 bp, Artificial Sequence
  Synthetic
agggcccggtcatgaggaaccacaactggtgcagagctatggttggaacattgtcaccatgaagagtggagtcga

SEQ ID NO: 356996 - DNA, 75 bp, Artificial Sequence
  Synthetic
gagtgatcgacagccgcaaaagcgtgaaacccaccatcattgaggaaggtgatggaagagtcatcctgggggaac

SEQ ID NO: 356997 - DNA, 75 bp, Artificial Sequence
  Synthetic
tgctcagcggagaggacgcataggaagaaacccatcacaagttggtgatgagtattgctatggagggcacacaaa

SEQ ID NO: 356998 - DNA, 75 bp, Artificial Sequence
  Synthetic
tccaaaggcgatatggaggtggccttgtgaggaaccccctttcacgcaactccactcatgagatgtattgggtga

SEQ ID NO: 356999 - DNA, 75 bp, Artificial Sequence
  Synthetic
acaacatcaacatgccgaatggtctggtggcccaactatatcagcctgagcgcgagaaggtgtacaccatggacg

SEQ ID NO: 357000 - DNA, 75 bp, Artificial Sequence
  Synthetic
aaagtgtagttttatagtagtatttagtggtggtgcgtaaatagttaagaaaattttgaggagaaagtcaggccg

SEQ ID NO: 357001 - DNA, 75 bp, Artificial Sequence
  Synthetic
ctccatcaacatgacaagccaggtacttctggggagaatggaaaagaaaacatggaagggaccccagtatgagga

SEQ ID NO: 357002 - DNA, 75 bp, Artificial Sequence
  Synthetic
acggaagaacttccttgaattcctgagaacagctgatctaccagtctggctcgcttacaaagtggcagcagcagg

SEQ ID NO: 357003 - DNA, 75 bp, Artificial Sequence
  Synthetic
cttctggggagaatggaaaagaaaacatggaagggaccccagtatgaggaagatgtcaatttaggaagtggaacg

SEQ ID NO: 357004 - DNA, 75 bp, Artificial Sequence
  Synthetic
attctgacactagtaagatcaagaatcgaattgaaaggctgaagaaagaatataactctacatggcaccaggacg

SEQ ID NO: 357005 - DNA, 75 bp, Artificial Sequence
  Synthetic
cgattcttgaagacaacaatgaagttgaagtcatcacgaagttgggtgagagaaagatcctaagacccaggtggg

SEQ ID NO: 357006 - DNA, 75 bp, Artificial Sequence
  Synthetic
tcgaattgaaaggctgaagaaagaatataactctacatggcaccaggacgtgaaccacccatacagaacctggaa

SEQ ID NO: 357007 - DNA, 75 bp, Artificial Sequence
  Synthetic
ccaaccggctcagctagttctcttgtgaatggggtagtcagattgctttcaaaaccatgggacactattaccaat

SEQ ID NO: 357008 - DNA, 75 bp, Artificial Sequence
  Synthetic
ccaagctctaaagtccttcaaagattttgcatcagggaaacgatcacaaatcgggctcgttgaggtgctcgggag

SEQ ID NO: 357009 - DNA, 75 bp, Artificial Sequence
  Synthetic
agctaactcaggaggagacgtcgtgcacttggcgctcatggctacgtttaagattcaaccagtctttcttgtggc

SEQ ID NO: 357010 - DNA, 75 bp, Artificial Sequence
  Synthetic
tgaatggggtagtcagattgctttcaaaaccatgggacactattaccaatgtgaccacgatggccatgacagaca

SEQ ID NO: 357011 - DNA, 75 bp, Artificial Sequence
  Synthetic
gctccagagcctccagaaggagtcaaatacgtcctcaatgagactacaaattggctatgggcctttttggcccgt

SEQ ID NO: 357012 - DNA, 75 bp, Artificial Sequence
  Synthetic
cagtaatgccgccctaggagcgatgtttgaagaacagaaccaatggaagaacgcccgagaagctgtagaggaccc

SEQ ID NO: 357013 - DNA, 75 bp, Artificial Sequence
  Synthetic
gatgggaaagagagagaagaaacccggagagttcggtaaagctaaaggtagtagagccatctggttcatgtggct

SEQ ID NO: 357014 - DNA, 75 bp, Artificial Sequence
  Synthetic
cattagcagcctgttgggacacaagccagaaactagagagacgaccctgggagttgagaacttcttgcttgatct

SEQ ID NO: 357015 - DNA, 75 bp, Artificial Sequence
  Synthetic
aggaggagttgaaggcttgggactgcagaagcttgggtacatcttgaaggaagttgggacaaagcccggaggaaa

SEQ ID NO: 357016 - DNA, 75 bp, Artificial Sequence
  Synthetic
tgggacacacgcatcaccaaagctgaccttgaaaatgaagcgaaggttcttgaattgttggatggagaacatcgg

SEQ ID NO: 357017 - DNA, 75 bp, Artificial Sequence
  Synthetic
accttgaaaatgaagcgaaggttcttgaattgttggatggagaacatcggcggttagcgcggtccatcatcgagc

SEQ ID NO: 357018 - DNA, 75 bp, Artificial Sequence
  Synthetic
agtgatgagaccagcggccgacgggaaaacagtgatggacgtcatctctagagaggatcagaggggaagtggtca

SEQ ID NO: 357019 - DNA, 75 bp, Artificial Sequence
  Synthetic
ggtggtgacctacgccctgaacaccttcaccaatctagcagtccagctggtgagaatgatggagggggaaggtgt

SEQ ID NO: 357020 - DNA, 75 bp, Artificial Sequence
  Synthetic
tggagcaacatgggtggatttggttctcgaaggcgacagctgcgtgactatcatgtctaaggacaagcctaccat

SEQ ID NO: 357021 - DNA, 75 bp, Artificial Sequence
  Synthetic
acttgagcgaacaactccagtcatgcagaaaaaagttggacagatcatgctgatcttggtgtcaatggccgcggt

SEQ ID NO: 357022 - DNA, 75 bp, Artificial Sequence
  Synthetic
tgatcttggtgtcaatggccgcggttgtcgtcaatccatcagtgagaactgtcagagaggctggaattctgacta

SEQ ID NO: 357023 - DNA, 75 bp, Artificial Sequence
  Synthetic
gtcagagaggctggaattctgactacagcagcagcagtcaccttatgggagaatggtgctagttcagtgtggaat

SEQ ID NO: 357024 - DNA, 75 bp, Artificial Sequence
  Synthetic
gatatgaagacacaactttggttgaggacacagtactgtagatatttaattaattgtaaatagacaatataagta

SEQ ID NO: 357025 - DNA, 75 bp, Artificial Sequence
  Synthetic
tcaaaccatttcacggaactgatcatgaaggatggcaggacgctggtggtcccgtgccgcggacaagacgagctg

SEQ ID NO: 357026 - DNA, 75 bp, Artificial Sequence
  Synthetic
tgaaggatggcaggacgctggtggtcccgtgccgcggacaagacgagctgattggacgtgccagaatctctccag

SEQ ID NO: 357027 - DNA, 75 bp, Artificial Sequence
  Synthetic
tcaagaggggtggagccaagggacgcacgctaggggaagtttggaaggagagactcaaccacatgacgaaggaag

SEQ ID NO: 357028 - DNA, 75 bp, Artificial Sequence
  Synthetic
ttttgtccatggaccaactactgtggagtcgcacggaaactactccacacaggctggagccactcaggcagggag

SEQ ID NO: 357029 - DNA, 75 bp, Artificial Sequence
  Synthetic
ccacaggttctgccagttcgctggtcaatggagtggttagactcctctcaaaaccatgggacaccatcacgaacg

SEQ ID NO: 357030 - DNA, 75 bp, Artificial Sequence
  Synthetic
cgcctgcctggcaaagtcatatgcgcagatgtggctgttgctctacttccaccgcagagatctgagattaatggc

SEQ ID NO: 357031 - DNA, 75 bp, Artificial Sequence
  Synthetic
gtcaactgggttcccacagggcgcaccacctggtcgatccacgcaaaaggagaatggatgacgactgaggatatg

SEQ ID NO: 357032 - DNA, 75 bp, Artificial Sequence
  Synthetic
tacatggctacccagaagagggtacaggaagtgaaagggtacacgaaaggaggacctggccatgaagagccacaa

SEQ ID NO: 357033 - DNA, 75 bp, Artificial Sequence
  Synthetic
cacagtgcgagctgtttcttagcacgaagatctcgatgtctaagaaaccaggagggcccggcaaaagccgggctg

SEQ ID NO: 357034 - DNA, 75 bp, Artificial Sequence
  Synthetic
aggacctggccatgaagagccacaactggtgcagagctatggttggaatattgttaccatgaagagcggagtcga

SEQ ID NO: 357035 - DNA, 75 bp, Artificial Sequence
  Synthetic
atcaggtccgttcggtgattggagaagagaagtatgtggactacatgggctccttaaggagatatgaagacacca

SEQ ID NO: 357036 - DNA, 75 bp, Artificial Sequence
  Synthetic
aataatgaagctgtattaaatagttgtatggttgtaattatgctgatttagtgtttatagtaatttgaattaatt

SEQ ID NO: 357037 - DNA, 75 bp, Artificial Sequence
  Synthetic
gtatggttgtaattatgctgatttagtgtttatagtaatttgaattaattatttaggcttaagatagtattatag

SEQ ID NO: 357038 - DNA, 75 bp, Artificial Sequence
  Synthetic
cttctggggaggatggaaaagaaaacatggaagggaccccagtttgaggaagatgtcaacttgggaagtggaacg

SEQ ID NO: 357039 - DNA, 75 bp, Artificial Sequence
  Synthetic
attctgatactagcaagatcaagaaccgaattgagaggctgaagaaagaatacagctccacatggcaccaggatg

SEQ ID NO: 357040 - DNA, 75 bp, Artificial Sequence
  Synthetic
tacagctccacatggcaccaggatgcgaatcacccctacaggacctggaactaccacggaagctatgaagtgaaa

SEQ ID NO: 357041 - DNA, 75 bp, Artificial Sequence
  Synthetic
ggctctcctgttgtggatgggcatcaatgctcgtgataggtccatagctctcacgtttctcgcagttggaggagt

SEQ ID NO: 357042 - DNA, 75 bp, Artificial Sequence
  Synthetic
ccactcctttcggtcaacaacgagtgttcaaggaaaaggtggatacgaaggctccagagcctccagaaggggtca

SEQ ID NO: 357043 - DNA, 75 bp, Artificial Sequence
  Synthetic
gggaggaattcattggaaaagtcaacagtaatgccgccctaggagcgatgtttgaagaacagaaccaatggaaga

SEQ ID NO: 357044 - DNA, 75 bp, Artificial Sequence
  Synthetic
agactgacaaccagctcgctgtgtttttgatctgtgtgctcacactggtcagcgccgtggctgccaatgaaatgg

SEQ ID NO: 357045 - DNA, 75 bp, Artificial Sequence
  Synthetic
gtcagactacatcaacacttcgttgacctcaataaacgtccaagccagcgcattgttcaccttggccagaggctt

SEQ ID NO: 357046 - DNA, 75 bp, Artificial Sequence
  Synthetic
atctttgtccatggaccaaccactgtggagtcgcatggaaactactccacacagattggggccactcaggcaggg

SEQ ID NO: 357047 - DNA, 75 bp, Artificial Sequence
  Synthetic
ggggccaggtgactctgactgtgactgtgactgcagctgccctgctcttttgccactatgcttacatggtgccag

SEQ ID NO: 357048 - DNA, 75 bp, Artificial Sequence
  Synthetic
tggagtcgcatggaaactactccacacagattggggccactcaggcagggagattcagcatcactcctgcggcgc

SEQ ID NO: 357049 - DNA, 75 bp, Artificial Sequence
  Synthetic
atcactacacttcctaaatgccatgtcaaaggtccgcaaagacatccaggaatggaaaccctcgacagggtggta

SEQ ID NO: 357050 - DNA, 75 bp, Artificial Sequence
  Synthetic
gtcaactgggttcccacagggcgtaccacctggtcgatccacgcaaaaggagaatggatgacgacagaagacatg

SEQ ID NO: 357051 - DNA, 75 bp, Artificial Sequence
  Synthetic
gtttatggtggcatcgtttctcaaagcgagatggaccaaccaggagaacattttgttgatgttggcggctgtttt

SEQ ID NO: 357052 - DNA, 75 bp, Artificial Sequence
  Synthetic
cagagattagccgctctaggagacacagcttgggactttggatcagttggaggggtgttcacctcagtagggaag

SEQ ID NO: 357053 - DNA, 75 bp, Artificial Sequence
  Synthetic
ttgaattatgattgattatttaggcttaagatagtattatagttagtttagtgtaaataggttttattgagaatg

SEQ ID NO: 357054 - DNA, 75 bp, Artificial Sequence
  Synthetic
accggaagttgagtagacggtgctgcctgcggctcaaccccaggaggactgggtgaccaaagctgcgaggtgatc

SEQ ID NO: 357055 - DNA, 75 bp, Artificial Sequence
  Synthetic
gactgggttaacaaaggcaaaacatcgccccacgcggccataaccctggctatggtgttaaccagggagaaggga

SEQ ID NO: 357056 - DNA, 75 bp, Artificial Sequence
  Synthetic
cgccccacgcggccataaccctggctatggtgttaaccagggagaagggactagaggttagaggagaccccgcgt

SEQ ID NO: 357057 - DNA, 75 bp, Artificial Sequence
  Synthetic
tgatgatgacggtgaacgccactgacgtcgcagacattatcacgataccaacggccgctggaaagaacctgtgca

SEQ ID NO: 357058 - DNA, 75 bp, Artificial Sequence
  Synthetic
tagtgcgtacaccccctgggcaatcttgccctcagtagttggattttggataactctccaatacacaaagagagg

SEQ ID NO: 357059 - DNA, 75 bp, Artificial Sequence
  Synthetic
tgaagctgtaagccaagggaaggactagaggttagaggagaccccgtgccaaaaacaccaaaagaaacagcatat

SEQ ID NO: 357060 - DNA, 75 bp, Artificial Sequence
  Synthetic
tagaggttagaggagaccccgtgccaaaaacaccaaaagaaacagcatattgacacctgggatagactaggggat

SEQ ID NO: 357061 - DNA, 75 bp, Artificial Sequence
  Synthetic
caaaaagtgcacggcccaacttggctgaagctgtaagccaagggaaggactagaggttagaggagaccccgtgcc

SEQ ID NO: 357062 - DNA, 75 bp, Artificial Sequence
  Synthetic
cttctggtcgtgttcttggccacccaggaggtccttcgcaagaggtggacagccaagatcagcatgccagctata

SEQ ID NO: 357063 - DNA, 75 bp, Artificial Sequence
  Synthetic
tggttgaggacacagtactgtagatatttaattaattgtaaatagacaatataagtatgtataaaagtgtagttt

SEQ ID NO: 357064 - DNA, 75 bp, Artificial Sequence
  Synthetic
tggatgtgtacaggatcctgctgttgatggtcggaataggcagtttgatcagggagaagagaagtgcagctgcaa

SEQ ID NO: 357065 - DNA, 75 bp, Artificial Sequence
  Synthetic
atcaagcaggagcgggcgtgatggttgaaggcgttttccacaccctttggcatacaacaaaaggagccgctttga

SEQ ID NO: 357066 - DNA, 75 bp, Artificial Sequence
  Synthetic
ggatgaggtgcagatgattgtggtggaacctggcaagaacgtcaaaaacgtccagacgaaaccaggggtgttcaa

SEQ ID NO: 357067 - DNA, 75 bp, Artificial Sequence
  Synthetic
gaacctggcaagaacgtcaaaaacgtccagacgaaaccaggggtgttcaaaacacctgaaggagaaattggggcc

SEQ ID NO: 357068 - DNA, 75 bp, Artificial Sequence
  Synthetic
gctagtgccgcccagagacgtggacgcatcggcagaaatccgtcgcaagttggtgatgagtactgttatggaggg

SEQ ID NO: 357069 - DNA, 75 bp, Artificial Sequence
  Synthetic
aagttcccatctcgtcagtggcttcattgaacgacctaacgccagtgggcagattggtcactgtcaacccttttg

SEQ ID NO: 357070 - DNA, 75 bp, Artificial Sequence
  Synthetic
atggtaaaggccctcagaaccgtctcggaaggaggaccccacatgtaagccctcagaaccgtctcggaaggagga

SEQ ID NO: 357071 - DNA, 75 bp, Artificial Sequence
  Synthetic
ggactggctgcaccgagggccaagggaattttgtgtgaaggtgctctgcccctacatgccgaaagtcatagagaa

SEQ ID NO: 357072 - DNA, 75 bp, Artificial Sequence
  Synthetic
gatggagctactccagcgccggtatgggggaggactggtcagaaacccactctcacggaattccacgcacgagat

SEQ ID NO: 357073 - DNA, 75 bp, Artificial Sequence
  Synthetic
aatgtggtacactcagtgaacatgactagccaggtgcttctgggaaggatggagaagaggacctggaagggaccc

SEQ ID NO: 357074 - DNA, 75 bp, Artificial Sequence
  Synthetic
atgattgtgctaattcctgagccagagaagcaacgttcgcagacagacaaccagctagccgtgttcctgatttgt

SEQ ID NO: 357075 - DNA, 75 bp, Artificial Sequence
  Synthetic
tgcttctgtacttccacagaagagacctgcggctcatggccaacgccatctgctccgctgtccctgtgaattggg

SEQ ID NO: 357076 - DNA, 75 bp, Artificial Sequence
  Synthetic
ctgtgtggtaaagcctctggatgatcgctttgccacttcgctccactttctcaacgccatgtcaaaggtccgcaa

SEQ ID NO: 357077 - DNA, 75 bp, Artificial Sequence
  Synthetic
tgaagacacaactttggttgaggacacagtactgtaaatattttatcaattgtaaatagacaatataagcatgta

SEQ ID NO: 357078 - DNA, 75 bp, Artificial Sequence
  Synthetic
cggaaggaggaccccacatgttgtaacttcaaagccgcgaagtgatccatgtaagccctcagaaccgtctcggaa

SEQ ID NO: 357079 - DNA, 75 bp, Artificial Sequence
  Synthetic
acaaaggcaaaccaacgccccacgcggccctagccctggtaatggtgttaaccagggcgaaaggactagaggtta

SEQ ID NO: 357080 - DNA, 75 bp, Artificial Sequence
  Synthetic
gctgcctgcgactcaaccccaggaggactgggtgaacaaagccgcgaagtgatccatgtaagccctcagaaccgt

SEQ ID NO: 357081 - DNA, 75 bp, Artificial Sequence
  Synthetic
cggcattcccgtcgaagcagaaggtctctgactgtccagacacatggagaaagtacactggccaacaagaaagga

SEQ ID NO: 357082 - DNA, 75 bp, Artificial Sequence
  Synthetic
gtcaggacctggctgtttgagaatggggaagaaagactcagccgcatggctgtcagtggagatgactgtgtggta

SEQ ID NO: 357083 - DNA, 75 bp, Artificial Sequence
  Synthetic
ctgatttgtgtcatgacccttgtgagcgcagtggcagccaacgagatgggttggctagacaagaccaagagtgac

SEQ ID NO: 357084 - DNA, 75 bp, Artificial Sequence
  Synthetic
gtggttgttccgctgctagccctgctaacacccgggctgagatgcctgaatctggatgtgtacaggatactgctg

SEQ ID NO: 357085 - DNA, 75 bp, Artificial Sequence
  Synthetic
gctgacaaacttagtagtgtttgtgaggattaacaacaattaacacagtgcgagctgtttcttagcacgaagatc

SEQ ID NO: 357086 - DNA, 75 bp, Artificial Sequence
  Synthetic
cggaggtcactgacagtgcagacacacggagaaagcactctagcgaacaagaagggggcttggatggacagcacc

SEQ ID NO: 357087 - DNA, 75 bp, Artificial Sequence
  Synthetic
acccacaggctgatgtctcctcacagggtgccgaactacaacctgtttgtgatggatgaggctcatttcaccgac

SEQ ID NO: 357088 - DNA, 75 bp, Artificial Sequence
  Synthetic
gaccagtgctatcaatcggcggagctcaaaacaaaagaaaagaggaggaaagaccggaattgcagtcatgattgg

SEQ ID NO: 357089 - DNA, 75 bp, Artificial Sequence
  Synthetic
tcaatatgctaaaacgcggtatgccccgcggattgtccttgataggactgaagagggctatgctgagtctgattg

SEQ ID NO: 357090 - DNA, 75 bp, Artificial Sequence
  Synthetic
ggcaaagtgatgatgacagtcaatgcaaccgatgttactgacgtgattaccatcccaacagctgctgggaaaaac

SEQ ID NO: 357091 - DNA, 75 bp, Artificial Sequence
  Synthetic
catcccaacagctgctgggaaaaacctgtgcattgtgagggctatggacgtgggatacctttgtgaggatactat

SEQ ID NO: 357092 - DNA, 75 bp, Artificial Sequence
  Synthetic
aatgcatactacgtgatgactgttggaacaaagacgttcttggtccatcgtgagtggttcatggacctcaacctc

SEQ ID NO: 357093 - DNA, 75 bp, Artificial Sequence
  Synthetic
gctggaaatgaccctgaagacattgactgctggtgcacgaaatcatctgtttacgtgcgctatggaagatgcaca

SEQ ID NO: 357094 - DNA, 75 bp, Artificial Sequence
  Synthetic
gccattaaccgccggagcacaaaacaaaagaaaagaggaggtccagcaggcttgaccatcctgtttgggctgatg

SEQ ID NO: 357095 - DNA, 75 bp, Artificial Sequence
  Synthetic
aaaggagcttggttggacagcacaaaagccacgagatatctggtgaagacagaatcatggatactgagaaacccg

SEQ ID NO: 357096 - DNA, 75 bp, Artificial Sequence
  Synthetic
aaaagaaaagaggaggtccagcaggcttgaccatcctgtttgggctgatgtcttgcgctggagccgtgatcctat

SEQ ID NO: 357097 - DNA, 75 bp, Artificial Sequence
  Synthetic
gaccgtcaatgcaaccgatgtcaccgacgtgatcaccattccaacagccgccgggaaaaacctgtgcatcgttag

SEQ ID NO: 357098 - DNA, 75 bp, Artificial Sequence
  Synthetic
gacgtgatcaccattccaacagccgccgggaaaaacctgtgcatcgttagagcgatggatgtgggatacctctgt

SEQ ID NO: 357099 - DNA, 75 bp, Artificial Sequence
  Synthetic
cggttctagctgctggaaacgaccctgaggacattgactgctggtgcacgaaatcatccgtctatgtgcgatatg

SEQ ID NO: 357100 - DNA, 75 bp, Artificial Sequence
  Synthetic
gaagatgtacgaagacccggcattcccgccgcagcagaaggtctttgacagtccagacacatggagaaagcacat

SEQ ID NO: 357101 - DNA, 75 bp, Artificial Sequence
  Synthetic
tgagaaaccctggctacgccctcgtcgcagctgttattggatggatgctagggagcaacacaatgcagcgcgtcg

SEQ ID NO: 357102 - DNA, 75 bp, Artificial Sequence
  Synthetic
agttgtgtgaccataatgtcaaaagacaaaccaacaattgatgtcaagatgatgaaaatggaagcggccaatctt

SEQ ID NO: 357103 - DNA, 75 bp, Artificial Sequence
  Synthetic
ggtaaaaacagaatcatggatcttgaggaaccctggatatgccctggtggcagccgtcattggttggatgcttgg

SEQ ID NO: 357104 - DNA, 75 bp, Artificial Sequence
  Synthetic
ggcaagtgcactattcacactcgcgcgaggcttccccttcgtcgatgttggagtgtcggctctcctgctagcagc

SEQ ID NO: 357105 - DNA, 75 bp, Artificial Sequence
  Synthetic
cgaggcttccccttcgtcgatgttggagtgtcggctctcctgctagcagccggatgctggggacaagtcaccctc

SEQ ID NO: 357106 - DNA, 75 bp, Artificial Sequence
  Synthetic
ggatgtggattgtttggaaagggtagcattgacacatgcgcaaagtttgcttgcacaaccaaggcgactggctgg

SEQ ID NO: 357107 - DNA, 75 bp, Artificial Sequence
  Synthetic
gagtttgaagaacctcatgccaccaaacaatctgttgtggctctagggtcgcaggaaggtgcattgcaccaagct

SEQ ID NO: 357108 - DNA, 75 bp, Artificial Sequence
  Synthetic
gcattgacacatgcgcaaagtttgcttgcacaaccaaggcgactggctggatcattcagaaggaaaacatcaagt

SEQ ID NO: 357109 - DNA, 75 bp, Artificial Sequence
  Synthetic
caaatggcttactatgacgccaagaatgttttgtcatgggaagtgcctgacgttttgaactctctctccgttgcg

SEQ ID NO: 357110 - DNA, 75 bp, Artificial Sequence
  Synthetic
ccccacgactgtcgaatctcatggcaattattcaacacaagtgggagccactcaggctggaagattcagtataac

SEQ ID NO: 357111 - DNA, 75 bp, Artificial Sequence
  Synthetic
aattattcaacacaagtgggagccactcaggctggaagattcagtataaccccgtcggcaccatcttacacgctg

SEQ ID NO: 357112 - DNA, 75 bp, Artificial Sequence
  Synthetic
gctgacactggccatggaacggtggtgttggaactgcaatacaccggaacagacggtccctgcaaagtgcccatt

SEQ ID NO: 357113 - DNA, 75 bp, Artificial Sequence
  Synthetic
cggttgactgtgagccacggtcagggatagacatcagcctacatgtcatgtcagttggtgctaagtcttttctgg

SEQ ID NO: 357114 - DNA, 75 bp, Artificial Sequence
  Synthetic
gatagacatcagcctacatgtcatgtcagttggtgctaagtcttttctggttcatcgagaatggttcatggacct

SEQ ID NO: 357115 - DNA, 75 bp, Artificial Sequence
  Synthetic
ggcactacgtggagaaaccgggaagctctgatggaatttgaagaacctcatgccactaaacagtctgttgtagcc

SEQ ID NO: 357116 - DNA, 75 bp, Artificial Sequence
  Synthetic
ctctgatggaatttgaagaacctcatgccactaaacagtctgttgtagccttgggatcgcaagaaggtgctctgc

SEQ ID NO: 357117 - DNA, 75 bp, Artificial Sequence
  Synthetic
cgttgagttctcaagtaacactgtgaagttgacatcagggcatttgaagtgcagggtgaagatggagaagctgca

SEQ ID NO: 357118 - DNA, 75 bp, Artificial Sequence
  Synthetic
aagttgacatcagggcatttgaagtgcagggtgaagatggagaagctgcaactgaagggaacgacatatggagtg

SEQ ID NO: 357119 - DNA, 75 bp, Artificial Sequence
  Synthetic
ggactcccgctgacactggacatgggacggtggtgctggaactgcagtacactgggacagatgggccctgcaaag

SEQ ID NO: 357120 - DNA, 75 bp, Artificial Sequence
  Synthetic
gacggtggtgctggaactgcagtacactgggacagatgggccctgcaaagtgcccatctcttccgtggcttctct

SEQ ID NO: 357121 - DNA, 75 bp, Artificial Sequence
  Synthetic
ttggtgactgtgaatccttttgtgtctgtggccacggccaactcaaagatcttgattgaaattgaacccccattt

SEQ ID NO: 357122 - DNA, 75 bp, Artificial Sequence
  Synthetic
ctgtggccacggccaactcaaagatcttgattgaaattgaacccccatttggtgactcttatattgtggtaggga

SEQ ID NO: 357123 - DNA, 75 bp, Artificial Sequence
  Synthetic
ttggcacaaatctggaagcagcattggaaaagccttcacgactactctgagaggagcgcaacgacttgcagcgct

SEQ ID NO: 357124 - DNA, 75 bp, Artificial Sequence
  Synthetic
ggaaaagccttcacgactactctgagaggagcgcaacgacttgcagcgcttggagacacagcttgggacttcgga

SEQ ID NO: 357125 - DNA, 75 bp, Artificial Sequence
  Synthetic
cttgcgttccgtttccagactcgagcaccaaatgtgggaagccattaaggatgagctgaacaccctgttgaaaga

SEQ ID NO: 357126 - DNA, 75 bp, Artificial Sequence
  Synthetic
acggcccagcctggctgaagctgtaggtcaggggaaggactagaggttagtggagaccccgtgccacaaaacacc

SEQ ID NO: 357127 - DNA, 75 bp, Artificial Sequence
  Synthetic
tgctatggggggccatggaaactccaacataaatggaatggacatgatgaggtccaaatgattgtcgtggagcca

SEQ ID NO: 357128 - DNA, 75 bp, Artificial Sequence
  Synthetic
tcaattgctatgacgttccttgcggttggaggagttttgctcttcctctcggttaacgtccacgctgacacgggc

SEQ ID NO: 357129 - DNA, 75 bp, Artificial Sequence
  Synthetic
tggaaggcttggggcaagagcatcatctttgctccagaactagctaacaacacctttgtcatcgacggtcctgag

SEQ ID NO: 357130 - DNA, 75 bp, Artificial Sequence
  Synthetic
ttggaggagttttgctcttcctctcggttaacgtccacgctgacacgggctgtgccatcgatcttggtaggcaag

SEQ ID NO: 357131 - DNA, 75 bp, Artificial Sequence
  Synthetic
tttctttcaaatggcttatcacgatgcccgccaaattctgctctgggagatccctgatgtgttgaattcactggc

SEQ ID NO: 357132 - DNA, 75 bp, Artificial Sequence
  Synthetic
tgttcacaatgatgtggaagcttggatggatcgctacaaattctacccggagacgccacaaggcttagcaaaaat

SEQ ID NO: 357133 - DNA, 75 bp, Artificial Sequence
  Synthetic
atggatcgctacaaattctacccggagacgccacaaggcttagcaaaaattatccagaaagcacgtgcagaagga

SEQ ID NO: 357134 - DNA, 75 bp, Artificial Sequence
  Synthetic
gactcgaacaccagatgtgggaggccatcaaggatgagttgaacaccctgctgaaagagaacggagttgacttaa

SEQ ID NO: 357135 - DNA, 75 bp, Artificial Sequence
  Synthetic
catcaaggatgagttgaacaccctgctgaaagagaacggagttgacttaagtgtcgtggttgaaaaacagaatgg

SEQ ID NO: 357136 - DNA, 75 bp, Artificial Sequence
  Synthetic
ctggccgccaccaccgagaaactggagatgggctggaaagcttggggcaagagcatcatcttcgctccagaacta

SEQ ID NO: 357137 - DNA, 75 bp, Artificial Sequence
  Synthetic
agatgggctggaaagcttggggcaagagcatcatcttcgctccagaactagctaacaacacctttgtcattgatg

SEQ ID NO: 357138 - DNA, 75 bp, Artificial Sequence
  Synthetic
agctagccgagcatggaacagcatggaggtggaggattttgggtttggactgacgagcacccggatgttcctgaa

SEQ ID NO: 357139 - DNA, 75 bp, Artificial Sequence
  Synthetic
tgacgagcacccggatgttcctgaagatccgggagacgaacacgacggagtgcgactcgaagatcattggaaccg

SEQ ID NO: 357140 - DNA, 75 bp, Artificial Sequence
  Synthetic
cagtgacctgtcatactggatagaaagtggactcaatgacacctggaagcttgagagagcggttctaggagaggt

SEQ ID NO: 357141 - DNA, 75 bp, Artificial Sequence
  Synthetic
tccagactgagaatggctgttggtatggaatggaaattcgacccacgcggcacgacgaaaagaccctcgtgcaat

SEQ ID NO: 357142 - DNA, 75 bp, Artificial Sequence
  Synthetic
agtggactcaatgacacctggaagcttgagagagcggttctaggagaggtcaaatcatgcacctggcctgagacc

SEQ ID NO: 357143 - DNA, 75 bp, Artificial Sequence
  Synthetic
tagaaagtgatctcatcatacccattaccttagcagggcccaggagcaaccacaacagaagaccagggtacaaaa

SEQ ID NO: 357144 - DNA, 75 bp, Artificial Sequence
  Synthetic
taccttagcagggcccaggagcaaccacaacagaagaccagggtacaaaactcagaatcaaggcccatgggatga

SEQ ID NO: 357145 - DNA, 75 bp, Artificial Sequence
  Synthetic
ggccaagatcagcattccagctatcatgcttgcactcctagtcctagtgtttgggggtattacgtacactgatgt

SEQ ID NO: 357146 - DNA, 75 bp, Artificial Sequence
  Synthetic
tctcggaaggaggaccccacatgtaagccctcagaaccgtctcggaaggaggacccccacatggtaagccccctc

SEQ ID NO: 357147 - DNA, 75 bp, Artificial Sequence
  Synthetic
ttgggggtattacgtacactgatgtcctgcgatatgtcattctcgtcggcgccgcgtttgctgaagcaaactcag

SEQ ID NO: 357148 - DNA, 75 bp, Artificial Sequence
  Synthetic
tattgcccaggaacaacagtaaccttaagtgacagttgtggacaccgtggacccgcggcacgcacgaccaccgag

SEQ ID NO: 357149 - DNA, 75 bp, Artificial Sequence
  Synthetic
taagtgacagttgtggacaccgtggacccgcggcacgcacgaccaccgagagtgggaagctcattaccgattggt

SEQ ID NO: 357150 - DNA, 75 bp, Artificial Sequence
  Synthetic
cacatggtaagccccctcaggaaccgtctcggaaggaggacccccacatggtaagccctcagaaccgtctcggaa

SEQ ID NO: 357151 - DNA, 75 bp, Artificial Sequence
  Synthetic
attacggttcagaaccgaaaatgggtgttggtatggaatggaaattcgccctctgcgacacgatgaaaagaccct

SEQ ID NO: 357152 - DNA, 75 bp, Artificial Sequence
  Synthetic
tcagaaccgtctcggaaggaggacccccacatggtaagccctcagaaccgtctcggaaggaggacccccacatgt

SEQ ID NO: 357153 - DNA, 75 bp, Artificial Sequence
  Synthetic
ggccacccaggaggtccttcgcaagaggtggacggccaagatcagcattccggctattctgcttgcgctcgtggt

SEQ ID NO: 357154 - DNA, 75 bp, Artificial Sequence
  Synthetic
actgatgttttgaggtatgtcattcttgttggagccgcgtttgctgaagcaaactcaggcggagatgttgtgcat

SEQ ID NO: 357155 - DNA, 75 bp, Artificial Sequence
  Synthetic
ttgttggagccgcgtttgctgaagcaaactcaggcggagatgttgtgcatttggcgcttatggccacattcaaaa

SEQ ID NO: 357156 - DNA, 75 bp, Artificial Sequence
  Synthetic
tttcttaaaagcaaggtggaccaaccaagagagcattttgcttatgcttgcggctgcctttttccaaatggctta

SEQ ID NO: 357157 - DNA, 75 bp, Artificial Sequence
  Synthetic
caagagagcattttgcttatgcttgcggctgcctttttccaaatggcttattatgatgccaggaacgtcttggca

SEQ ID NO: 357158 - DNA, 75 bp, Artificial Sequence
  Synthetic
ccctttccgtcgcctggatgattctcagggccataagctttaccaacacctcaaatgtggtggtgccgctactgg

SEQ ID NO: 357159 - DNA, 75 bp, Artificial Sequence
  Synthetic
cagggccataagctttaccaacacctcaaatgtggtggtgccgctactggcccttttgacacctgggttaaaatg

SEQ ID NO: 357160 - DNA, 75 bp, Artificial Sequence
  Synthetic
ttgctgcttatggttggagttggaagcctcataaaagaaaagaggagctctgcagcaaaaaagaaaggagcctgc

SEQ ID NO: 357161 - DNA, 75 bp, Artificial Sequence
  Synthetic
cagaggtgttcaatccaatgatactagcagctgggctgatggcttgcgatcccaatcgcaagcgaggctggcctg

SEQ ID NO: 357162 - DNA, 75 bp, Artificial Sequence
  Synthetic
gataacccttcagtacacaaagagaggaggtgtcctttgggacacaccatcacccagggagtacaagaagggtga

SEQ ID NO: 357163 - DNA, 75 bp, Artificial Sequence
  Synthetic
ctagcagaacttgacatagattctatggctatccccatgaccatcgccggacttatgtttgtggcatttgtcatc

SEQ ID NO: 357164 - DNA, 75 bp, Artificial Sequence
  Synthetic
atgactcgaggtctgcttggcagttaccaagctggagccggagtgatggtagagggagtgttccacacactatgg

SEQ ID NO: 357165 - DNA, 75 bp, Artificial Sequence
  Synthetic
accaagctggagccggagtgatggtagagggagtgttccacacactatggcacaccaccaagggagctgctctca

SEQ ID NO: 357166 - DNA, 75 bp, Artificial Sequence
  Synthetic
acggaactgatcatgaaggacggcaggacgttggtggtcccgtgtcgtggacaagacgagttgattggacgggcc

SEQ ID NO: 357167 - DNA, 75 bp, Artificial Sequence
  Synthetic
tcgtgagggcggccgacatcacttgggagagcgacgctgaaatcacaggttctagcgagagagtggatgttaggt

SEQ ID NO: 357168 - DNA, 75 bp, Artificial Sequence
  Synthetic
ggagagcgacgctgaaatcacaggttctagcgagagagtggatgttaggttggatgatgatgggaacttccagtt

SEQ ID NO: 357169 - DNA, 75 bp, Artificial Sequence
  Synthetic
aaaatctggatgctcagaatggcctgcttggcaataagtgcctacacaccctgggccatactcccctcagtcatt

SEQ ID NO: 357170 - DNA, 75 bp, Artificial Sequence
  Synthetic
gcttggcaataagtgcctacacaccctgggccatactcccctcagtcattggattttggataacccttcaataca

SEQ ID NO: 357171 - DNA, 75 bp, Artificial Sequence
  Synthetic
tccagactaagcccggagtgtttaagacaccagaaggagaaattggggcagttacgctagactatcccactggaa

SEQ ID NO: 357172 - DNA, 75 bp, Artificial Sequence
  Synthetic
cacaccatcgcccaaagagtacaagaagggtgacaccactaccggcgtctacaggatcatgacccgaggtctgct

SEQ ID NO: 357173 - DNA, 75 bp, Artificial Sequence
  Synthetic
aagggtgacaccactaccggcgtctacaggatcatgacccgaggtctgctcggaagttaccaggctggagccggt

SEQ ID NO: 357174 - DNA, 75 bp, Artificial Sequence
  Synthetic
cactgtggcacaccaccaaaggagcagctctcatgagcggcgaagggagtctagatccctattgggggagcgtga

SEQ ID NO: 357175 - DNA, 75 bp, Artificial Sequence
  Synthetic
agctctcatgagcggcgaagggagtctagatccctattgggggagcgtgaaagaagaccgactgtgctatggagg

SEQ ID NO: 357176 - DNA, 75 bp, Artificial Sequence
  Synthetic
aatggacatgatgaggttcaaatgattgtcgtgaaaccaggagaaaacgtgaggaacgttcaaacaaaacccgga

SEQ ID NO: 357177 - DNA, 75 bp, Artificial Sequence
  Synthetic
ttgtcgtgaaaccaggagaaaacgtgaggaacgttcaaacaaaacccggagtgtttaagacaccagaaggagaga

SEQ ID NO: 357178 - DNA, 75 bp, Artificial Sequence
  Synthetic
agctgcgaggtgatccacgtaagccctcagaaccgtctcggaaggaggaccccacgtgctttagcctcaaagccc

SEQ ID NO: 357179 - DNA, 75 bp, Artificial Sequence
  Synthetic
agacaacaacgaagtggaagtcatcacgaagcttggtgaaaggaagattctgaggccgcgctggattgacgccag

SEQ ID NO: 357180 - DNA, 75 bp, Artificial Sequence
  Synthetic
caccggaacgtcaggctctcccattgtggacaaaaatggggacgtgattgggctgtatgggaacggcgtcatcat

SEQ ID NO: 357181 - DNA, 75 bp, Artificial Sequence
  Synthetic
gtggacaaaaatggggacgtgattgggctgtatgggaacggcgtcatcatgccgaatggcgcgtacatgagcgcc

SEQ ID NO: 357182 - DNA, 75 bp, Artificial Sequence
  Synthetic
aaccggcgccagctggttttgagcctgaaatgctgaggaagaaacaaatttctgtccttgacctgcaccccggat

SEQ ID NO: 357183 - DNA, 75 bp, Artificial Sequence
  Synthetic
tgaaatgctgaggaagaaacaaatttctgtccttgacctgcaccccggatcaggaaagacacgcaaaatacttcc

SEQ ID NO: 357184 - DNA, 75 bp, Artificial Sequence
  Synthetic
cagatgctcttcagacaattgccttgattgccttattgagtgtgatgaccatgggagtattcttcctcctcatgc

SEQ ID NO: 357185 - DNA, 75 bp, Artificial Sequence
  Synthetic
aagagactgaggacggccgtgctcgcaccaaccagggtcgttgccgctgagatggctgaggccttgagaggactc

SEQ ID NO: 357186 - DNA, 75 bp, Artificial Sequence
  Synthetic
gggctttatggcaatggagtcataatgcccaacggctcatacataagcgcgatagtgcagggtgaaaggatggat

SEQ ID NO: 357187 - DNA, 75 bp, Artificial Sequence
  Synthetic
caccaaccagggtcgttgccgctgagatggctgaggccttgagaggactccccattcgataccaaacctcagcgg

SEQ ID NO: 357188 - DNA, 75 bp, Artificial Sequence
  Synthetic
aatcgttgatgtgatgtgccgccccctcacgcacaggttgatgtctccacacagagttcccaattacaatctgtt

SEQ ID NO: 357189 - DNA, 75 bp, Artificial Sequence
  Synthetic
ctcacgcacaggttgatgtctccacacagagttcccaattacaatctgtttgtaatggatgaggcccatttcacg

SEQ ID NO: 357190 - DNA, 75 bp, Artificial Sequence
  Synthetic
tccagctgaacagaaagtcctatgagacagagtaccccaagtgcaagaacgatgattgggattttgtcatcacca

SEQ ID NO: 357191 - DNA, 75 bp, Artificial Sequence
  Synthetic
gatacatagcaaccaaggttgaactgggcgaagccgccgcgatcttcatgacggcgacgccgcccgggacctcag

SEQ ID NO: 357192 - DNA, 75 bp, Artificial Sequence
  Synthetic
gggcgaagccgccgcgatcttcatgacggcgacgccgcccgggacctcagaccccttcccagagtccaatgcccc

SEQ ID NO: 357193 - DNA, 75 bp, Artificial Sequence
  Synthetic
ccagatagagcttggaacaccggatatgaatggataaccgaatacatcggaaagaccgtctggttcgttccaagt

SEQ ID NO: 357194 - DNA, 75 bp, Artificial Sequence
  Synthetic
aggagaattttagcatgggagagtttcttctggacttgaggccggcaacagcctggtcactgtacgctgtgacaa

SEQ ID NO: 357195 - DNA, 75 bp, Artificial Sequence
  Synthetic
atgaatggataaccgaatacatcggaaagaccgtctggttcgttccaagtgttaagatgggaaatgaaattgctc

SEQ ID NO: 357196 - DNA, 75 bp, Artificial Sequence
  Synthetic
agtgatccagctgaacagaaagtcctatgagacagagtatcccaagtgtaaaaacgatgattgggactttgttgt

SEQ ID NO: 357197 - DNA, 75 bp, Artificial Sequence
  Synthetic
tatgagacagagtatcccaagtgtaaaaacgatgattgggactttgttgtcaccacggatatatcagaaatggga

SEQ ID NO: 357198 - DNA, 75 bp, Artificial Sequence
  Synthetic
ctgtacaaccaaagcaactggatggatcatccagaaggaaaacatcaagtatgaggtcgccatatttgtgcatgg

SEQ ID NO: 357199 - DNA, 75 bp, Artificial Sequence
  Synthetic
ttgatagtcgcaagagcgtgaaacccactatcattgaggaaggcgatgggagagtcattctgggagaaccctcag

SEQ ID NO: 357200 - DNA, 75 bp, Artificial Sequence
  Synthetic
cactatcattgaggaaggcgatgggagagtcattctgggagaaccctcagctattacagctgctagtgcagccca

SEQ ID NO: 357201 - DNA, 75 bp, Artificial Sequence
  Synthetic
ccatcacaagttggcgatgagtattgctatggagggcacacaaatgaagatgactccaactttgctcattggaca

SEQ ID NO: 357202 - DNA, 75 bp, Artificial Sequence
  Synthetic
gctatggagggcacacaaatgaagatgactccaactttgctcattggacagaggcccgcatcatgctagacaata

SEQ ID NO: 357203 - DNA, 75 bp, Artificial Sequence
  Synthetic
ccagctataccagcctgagcgagagaaagtgtacaccatggacggggagtacaggctaagaggggaagaacggaa

SEQ ID NO: 357204 - DNA, 75 bp, Artificial Sequence
  Synthetic
aaagtgtacaccatggacggggagtacaggctaagaggggaagaacggaagaacttccttgagttcctaagaaca

SEQ ID NO: 357205 - DNA, 75 bp, Artificial Sequence
  Synthetic
accgctgaaaaaggaggccgagctcacaggatggctcttgaggagctaccggacgcccttcagacaatagctttg

SEQ ID NO: 357206 - DNA, 75 bp, Artificial Sequence
  Synthetic
ggacgcccttcagacaatagctttgattgcactattgagtgtgatgtccttaggcgtgttttttctactcatgca

SEQ ID NO: 357207 - DNA, 75 bp, Artificial Sequence
  Synthetic
acaaagtggcggcggcaggaatatcatatcacgatcgaaagtggtgctttgatggaccccgaaccaacacgattc

SEQ ID NO: 357208 - DNA, 75 bp, Artificial Sequence
  Synthetic
atatcacgatcgaaagtggtgctttgatggaccccgaaccaacacgattctggaagataacaccgaagtggaagt

SEQ ID NO: 357209 - DNA, 75 bp, Artificial Sequence
  Synthetic
atcttaagacccaggtgggcagatgccagagtgtactcggaccaccaagccctaaagtcttttaaggattttgca

SEQ ID NO: 357210 - DNA, 75 bp, Artificial Sequence
  Synthetic
tcagggaaacgatcgcagatcgggcttattgaggtgcttgggaggatgcccgaacactttatggggaaaacttgg

SEQ ID NO: 357211 - DNA, 75 bp, Artificial Sequence
  Synthetic
tgctcacactggtcagcgccgtggctgccaatgaaatgggttggctggacaagaccaagaatgacattagcagcc

SEQ ID NO: 357212 - DNA, 75 bp, Artificial Sequence
  Synthetic
agctcacaggatggctcttgaggagcttccggacgcccttcagacaatagctttgatcacgctcttgagtgtgat

SEQ ID NO: 357213 - DNA, 75 bp, Artificial Sequence
  Synthetic
agatcattcaaaaagcccataaggaaggagtgtgcggtctacggtcagtttccagactggagcatcaaatgtggg

SEQ ID NO: 357214 - DNA, 75 bp, Artificial Sequence
  Synthetic
atgcaaaggaaaggcataggcaagattggcttgggaggagtgatcctaggagcggccacattcttttgctggatg

SEQ ID NO: 357215 - DNA, 75 bp, Artificial Sequence
  Synthetic
ttggcttgggaggagtgatcctaggagcggccacattcttttgctggatggctgacgtcccgggaacgaaaatag

SEQ ID NO: 357216 - DNA, 75 bp, Artificial Sequence
  Synthetic
gctcatgattgttttgattccagagccagaaaagcagcgctcacagactgacaatcagcttgctgtgtttttgat

SEQ ID NO: 357217 - DNA, 75 bp, Artificial Sequence
  Synthetic
ccagaaaagcagcgctcacagactgacaatcagcttgctgtgtttttgatctgtgtgctcacactggtcagcgcc

SEQ ID NO: 357218 - DNA, 75 bp, Artificial Sequence
  Synthetic
tggacaaaacaaagaatgacattagcagcctgttggggtacaagtcagaagccagagaaacaactctgggagttg

SEQ ID NO: 357219 - DNA, 75 bp, Artificial Sequence
  Synthetic
cagcctgttggggtacaagtcagaagccagagaaacaactctgggagttgaaagcttcttgcttgatctgcggcc

SEQ ID NO: 357220 - DNA, 75 bp, Artificial Sequence
  Synthetic
gtgacaacagccgttctcacccctctgctgaagcatctaatcacgtcagactacattaacacttcgttgacttca

SEQ ID NO: 357221 - DNA, 75 bp, Artificial Sequence
  Synthetic
tgctgaagcatctaatcacgtcagactacattaacacttcgttgacttcaataaacgtccaagccagcgcgttgt

SEQ ID NO: 357222 - DNA, 75 bp, Artificial Sequence
  Synthetic
tgtggatgttggtgtctcagctctcttgttggcggctgggtgttggggtcaggtaacactgacagtgacagtgac

SEQ ID NO: 357223 - DNA, 75 bp, Artificial Sequence
  Synthetic
gttcagtgtggaatgcaacgacagctattgggctttgtcacatcatgcgaggaggatggctctcatgtctctcca

SEQ ID NO: 357224 - DNA, 75 bp, Artificial Sequence
  Synthetic
ttgttggcggctgggtgttggggtcaggtaacactgacagtgacagtgaccgcagcttctctgcttttttgccac

SEQ ID NO: 357225 - DNA, 75 bp, Artificial Sequence
  Synthetic
aagcagaagctatgcgatccgctcagcggcgtactgctgccggtatcatgaagaatgcagtggtggatgggatcg

SEQ ID NO: 357226 - DNA, 75 bp, Artificial Sequence
  Synthetic
aagtttggaaggagagactcaaccacatgacgaaggaagaatttaccagatacagaaaagaagccatcactgaag

SEQ ID NO: 357227 - DNA, 75 bp, Artificial Sequence
  Synthetic
gcggcgtactgctgccggtatcatgaagaatgcagtggtggatgggatcgtggccactgatgtgcctgaacttga

SEQ ID NO: 357228 - DNA, 75 bp, Artificial Sequence
  Synthetic
aaagttggacagatcatgctgatcttggtgtcagtggccgcagtggtcgtcaatccatcagtgaggaccgttaga

SEQ ID NO: 357229 - DNA, 75 bp, Artificial Sequence
  Synthetic
tggtgtcagtggccgcagtggtcgtcaatccatcagtgaggaccgttagagaggctggaatcttgaccacagcag

SEQ ID NO: 357230 - DNA, 75 bp, Artificial Sequence
  Synthetic
tgccagttcagtgtggaatgcaacaacagccattggcctttgccatattatgcgagggggaatactatcgtgtct

SEQ ID NO: 357231 - DNA, 75 bp, Artificial Sequence
  Synthetic
acagccattggcctttgccatattatgcgagggggaatactatcgtgtctttccatcacgtggactctcatcaaa

SEQ ID NO: 357232 - DNA, 75 bp, Artificial Sequence
  Synthetic
ggggaggagccaaggggcgcacactaggagaagtttggaaggagaggctcaaccacatgacaaaggaagagttca

SEQ ID NO: 357233 - DNA, 75 bp, Artificial Sequence
  Synthetic
aggagaagtttggaaggagaggctcaaccacatgacaaaggaagagttcaccagatacaggaaagaagccatcac

SEQ ID NO: 357234 - DNA, 75 bp, Artificial Sequence
  Synthetic
gctctgtgacattggagagtcatcgtcaagtgccgaggtagaagaacaccgcaccgtccgtgtcttggagatggt

SEQ ID NO: 357235 - DNA, 75 bp, Artificial Sequence
  Synthetic
catgctagaaaagaaggaaacattactggaggccacccggtttcgcggggaaccgcgaagttacggtggctagtg

SEQ ID NO: 357236 - DNA, 75 bp, Artificial Sequence
  Synthetic
ctggaggccacccggtttcgcggggaaccgcgaagttacggtggctagtggaaaggagattcctcgagccagtgg

SEQ ID NO: 357237 - DNA, 75 bp, Artificial Sequence
  Synthetic
tatggaggtggccttgtgagaaaccccctttcacgcaactctacccatgagatgtactgggtgagccacgcttca

SEQ ID NO: 357238 - DNA, 75 bp, Artificial Sequence
  Synthetic
cagaggcggttggtgctattacatggccacccagaagagggtgcaggaagtaaaagggtacacgaaaggggggcc

SEQ ID NO: 357239 - DNA, 75 bp, Artificial Sequence
  Synthetic
gccacccagaagagggtgcaggaagtaaaagggtacacgaaaggggggcctggccatgaagagccacaactggtg

SEQ ID NO: 357240 - DNA, 75 bp, Artificial Sequence
  Synthetic
ccatgaaaagtggagttgatgtgttttacagaccatcagaagtgagtgacacactgctctgtgacattggagagt

SEQ ID NO: 357241 - DNA, 75 bp, Artificial Sequence
  Synthetic
ttacagaccatcagaagtgagtgacacactgctctgtgacattggagagtcatcatcaagtgccgaggtggaaga

SEQ ID NO: 357242 - DNA, 75 bp, Artificial Sequence
  Synthetic
atggtggaagattggttgcacagaggaccgaaggagttttgcatcaaggtgctctgtccttacatgcctaaagtg

SEQ ID NO: 357243 - DNA, 75 bp, Artificial Sequence
  Synthetic
gaccgaaggagttttgcatcaaggtgctctgtccttacatgcctaaagtgattgagaagatggaaacacttcaaa

SEQ ID NO: 357244 - DNA, 75 bp, Artificial Sequence
  Synthetic
gaaccctctctcacgtaactccacccatgagatgtactgggtgagccgtgcgtcaggcaacatcgtccactccgt

SEQ ID NO: 357245 - DNA, 75 bp, Artificial Sequence
  Synthetic
catgagatgtactgggtgagccgtgcgtcaggcaacatcgtccactccgtcaacatgacgagtcaggtgctctta

SEQ ID NO: 357246 - DNA, 75 bp, Artificial Sequence
  Synthetic
aagggccccagtatgaggaagatgttaatctgggaagtggaacgcgagccgtagggaagcctctccttaattctg

SEQ ID NO: 357247 - DNA, 75 bp, Artificial Sequence
  Synthetic
taatctgggaagtggaacgcgagccgtagggaagcctctccttaattctgataccagcaaaatcaagaatcgaat

SEQ ID NO: 357248 - DNA, 75 bp, Artificial Sequence
  Synthetic
tccacgtggcaccaagacgtgaaccatccttacaggacctggaactaccatggaagttacgaagtgaaaccaacc

SEQ ID NO: 357249 - DNA, 75 bp, Artificial Sequence
  Synthetic
tggcacccaccagggtcgttgctgctgagatgtctgaggccctgagaggacttcccattcggtaccaaacctcag

SEQ ID NO: 357250 - DNA, 75 bp, Artificial Sequence
  Synthetic
gcatctccgtggagaatgcaacacctgcatctacaacatgatgggaaagagagagaagaagcctggagagttcgg

SEQ ID NO: 357251 - DNA, 75 bp, Artificial Sequence
  Synthetic
tggaagttacgaagtgaaaccaaccggctcagctagctcccttgtgaatggggtagtcagactgctatcaaaacc

SEQ ID NO: 357252 - DNA, 75 bp, Artificial Sequence
  Synthetic
acgatggctatgactgataccaccccttttggtcagcaacgagtgttcaaggagaaggtggacacgaaagctcca

SEQ ID NO: 357253 - DNA, 75 bp, Artificial Sequence
  Synthetic
cttttggtcagcaacgagtgttcaaggagaaggtggacacgaaagctccagagcctccggaaggagtcaaacatg

SEQ ID NO: 357254 - DNA, 75 bp, Artificial Sequence
  Synthetic
cctcaatgaagaccactggctgggtaggaagaactcaggaggaggagttgaaggcttaggactgcagaagcttgg

SEQ ID NO: 357255 - DNA, 75 bp, Artificial Sequence
  Synthetic
gtgggcctttttggctcgtgagaagaagcccaggatgtgttcgcgagaggaattcattgccaaagtcaacagcaa

SEQ ID NO: 357256 - DNA, 75 bp, Artificial Sequence
  Synthetic
gaacagaaccaatggaagaacgccagagaagccgtaaatgacccaaagttctgggaaatggttgatgaggaacgt

SEQ ID NO: 357257 - DNA, 75 bp, Artificial Sequence
  Synthetic
aggtggctatcaaccaagtcagagcaatcatcggagatgagaagtatgtggattacatgagttcactaaagagat

SEQ ID NO: 357258 - DNA, 75 bp, Artificial Sequence
  Synthetic
gagaagccgtaaatgacccaaagttctgggaaatggttgatgaggaacgtgaggcgcaccttcgcggggaatgca

SEQ ID NO: 357259 - DNA, 75 bp, Artificial Sequence
  Synthetic
tgttatcacaacagacatatctgaaatgggggctaacttcaaggcgagcagggtgatcgacagccggaagagtgt

SEQ ID NO: 357260 - DNA, 75 bp, Artificial Sequence
  Synthetic
gtccatcattgagctcacataccgacacaaagtcgtgaaagtgatgaggccagcggccgacgggaaaactgtgat

SEQ ID NO: 357261 - DNA, 75 bp, Artificial Sequence
  Synthetic
tttggtaaagccaaaggcagcagagccatttggttcatgtggctaggggctcgctttttagagtttgaagctctt

SEQ ID NO: 357262 - DNA, 75 bp, Artificial Sequence
  Synthetic
taggcagaaagaactcaggaggcggagttgaaggcctggggctccagaagcttggttacatcttgaaagcggtcg

SEQ ID NO: 357263 - DNA, 75 bp, Artificial Sequence
  Synthetic
agttgaaggcctggggctccagaagcttggttacatcttgaaagcggtcgggacaaaacctggaggaaagatcta

SEQ ID NO: 357264 - DNA, 75 bp, Artificial Sequence
  Synthetic
acacgcatcaccaaagctgacctcgaaaatgaagcgaaggtccttgaattgctggatggggaacatcggcgctta

SEQ ID NO: 357265 - DNA, 75 bp, Artificial Sequence
  Synthetic
aaaatgaagcgaaggtccttgaattgctggatggggaacatcggcgcttagcacggtccatcattgagctaactt

SEQ ID NO: 357266 - DNA, 75 bp, Artificial Sequence
  Synthetic
gagaccagcggccgacggaaagactgtgatggacgttatctctagagaggaccagagaggaagcggccaagtggt

SEQ ID NO: 357267 - DNA, 75 bp, Artificial Sequence
  Synthetic
gtgatggacgttatctctagagaggaccagagaggaagcggccaagtggttacctacgctctgaacaccttcacc

SEQ ID NO: 357268 - DNA, 75 bp, Artificial Sequence
  Synthetic
cagaatctctccaggggctggatggaatgtgcgcgacaccgcctgcctggcgaagtcatacgcgcagatgtggct

SEQ ID NO: 357269 - DNA, 75 bp, Artificial Sequence
  Synthetic
tgatggaaggggaaggagtcataggacctgatgacgttgaaaaactgggaaagggaaaagggcccaaggtcagaa

SEQ ID NO: 357270 - DNA, 75 bp, Artificial Sequence
  Synthetic
ccgagccacgtgggcagaaaacatccaggtggctatcaaccaagtcagagcaatcattggagatgagaagtatgt

SEQ ID NO: 357271 - DNA, 75 bp, Artificial Sequence
  Synthetic
acctgatgacgttgaaaaactgggaaagggaaaagggcccaaggtcagaacctggctgtttgagaatggcgagga

SEQ ID NO: 357272 - DNA, 75 bp, Artificial Sequence
  Synthetic
ggtgatgattgcgtggtgaagcctttggacgaccggtttgccacgtcactgcacttccttaacgctatgtcaaag

SEQ ID NO: 357273 - DNA, 75 bp, Artificial Sequence
  Synthetic
tggacgaccggtttgccacgtcactgcacttccttaacgctatgtcaaaggtccggaaagatatccaggaatgga

SEQ ID NO: 357274 - DNA, 75 bp, Artificial Sequence
  Synthetic
gcagcaggttccattttgctcgaaccatttcacggaactgatcatgaaggacggcaggacgctgatcgtcccatg

SEQ ID NO: 357275 - DNA, 75 bp, Artificial Sequence
  Synthetic
taagccctcagaaccgtctcggaagaggacccccagatgttgtgatccatgtaagccctcagaaccgtctacgga

SEQ ID NO: 357276 - DNA, 75 bp, Artificial Sequence
  Synthetic
catttcacggaactgatcatgaaggacggcaggacgctgatcgtcccatgtcgtggacaggacgagctgattgga

SEQ ID NO: 357277 - DNA, 75 bp, Artificial Sequence
  Synthetic
gatggaacgtgcgcgacactgcctgcttggcgaaatcatacgctcagatgtggctgctgctctacttccaccgcc

SEQ ID NO: 357278 - DNA, 75 bp, Artificial Sequence
  Synthetic
cttggcgaaatcatacgctcagatgtggctgctgctctacttccaccgccgtgacttgagactgatggccaatgc

SEQ ID NO: 357279 - DNA, 75 bp, Artificial Sequence
  Synthetic
tgggttcccacagggcgcaccacctggtcgatccatgcaaaaggggaatggatgacaacagaggacatgcttgca

SEQ ID NO: 357280 - DNA, 75 bp, Artificial Sequence
  Synthetic
ggtcgatccatgcaaaaggggaatggatgacaacagaggacatgcttgcagtctggaatagggtgtggattgagg

SEQ ID NO: 357281 - DNA, 75 bp, Artificial Sequence
  Synthetic
gaggactgcagatctgccagtttggctggcttacaaggtggcagcggctggagtgtcataccacgatcggaggtg

SEQ ID NO: 357282 - DNA, 75 bp, Artificial Sequence
  Synthetic
gccagttgagaagtggagtgatgttccatactctgggaagagagaagacatctggtgtggcagcctgattggcac

SEQ ID NO: 357283 - DNA, 75 bp, Artificial Sequence
  Synthetic
ccatactctgggaagagagaagacatctggtgtggcagcctgattggcacgcgaatccgtgccacttgggctgaa

SEQ ID NO: 357284 - DNA, 75 bp, Artificial Sequence
  Synthetic
tccgcgcggtgattggggaagagaaatatgtggactacatgagctctttgaggagatatgaagacaccattatag

SEQ ID NO: 357285 - DNA, 75 bp, Artificial Sequence
  Synthetic
gaagttgagatgaatagtttgtgattgtagtttagttaattttataataatagtcatttggattatgattagaca

SEQ ID NO: 357286 - DNA, 75 bp, Artificial Sequence
  Synthetic
tgtagtttagttaattttataataatagtcatttggattatgattagacatgtaggtgtaggatagtgttatagt

SEQ ID NO: 357287 - DNA, 75 bp, Artificial Sequence
  Synthetic
cggcccaacttggctgaagctgtaagccaagggaaggactagaggttagaggagaccccgtgccaaaaacaccaa

SEQ ID NO: 357288 - DNA, 75 bp, Artificial Sequence
  Synthetic
ctaaagagatatgaagacacaactttggttgaggacacagtactgtaaatattttattaattgcaaatagacaat

SEQ ID NO: 357289 - DNA, 75 bp, Artificial Sequence
  Synthetic
ccccgcgttaaaaagtgcacggcccaatcttggctgaagctgtaagccaagggaaggatctagaggttagaggag

SEQ ID NO: 357290 - DNA, 75 bp, Artificial Sequence
  Synthetic
gatcgcctgtgctggagctgtgaccctctcgaacttccagggcaaagtgatgatgacagtcaatgcaaccgatgt

SEQ ID NO: 357291 - DNA, 75 bp, Artificial Sequence
  Synthetic
tcaaaccatttcacggaactgatcatgaaggacggcaggacgctggtggtcccgtgtcgtggacaagacgagttg

SEQ ID NO: 357292 - DNA, 75 bp, Artificial Sequence
  Synthetic
ttaagatagtattatagttagtttagtgtaaataggatttattgagaatggaagtcaggccagattaatgctgcc

SEQ ID NO: 357293 - DNA, 75 bp, Artificial Sequence
  Synthetic
gtaaatagttaagaaaattttgaggtagaaagtcaggccgggaagttcccgccaccggaagttgagtagacggtg

SEQ ID NO: 357294 - DNA, 75 bp, Artificial Sequence
  Synthetic
aaaggctttcaagtttcttgggactcccgcagacacaggtcacggcactgtggtgttggaattgcagtacactgg

SEQ ID NO: 357295 - DNA, 75 bp, Artificial Sequence
  Synthetic
tgctggaagcaccacgtggaggaaccgggaaacactgatggagtttgaagaacctcatgccaccaaacaatctgt

SEQ ID NO: 357296 - DNA, 75 bp, Artificial Sequence
  Synthetic
agtagttcgcctgtgtgagctgacaaacttagtagtgttgtgaggattaacaacaattaacacagtgcgagctgt

SEQ ID NO: 357297 - DNA, 75 bp, Artificial Sequence
  Synthetic
cagtatggaggtagaggactttggatttggactgacaagcactcgcatgttcctgaggattcgggaaacgaacac

SEQ ID NO: 357298 - DNA, 75 bp, Artificial Sequence
  Synthetic
agaaacccacactctgtggggtgatggagttctggaaagtgatctcatcatacccatcaccttggcaggacccag

SEQ ID NO: 357299 - DNA, 75 bp, Artificial Sequence
  Synthetic
actaaagagatatgaagacacaactttggttgaggacacagtactgtaaatactttattaattgtaaatagacaa

SEQ ID NO: 357300 - DNA, 75 bp, Artificial Sequence
  Synthetic
ctggtgaagacagaatcatggatactgagaaacccgggctacgccctcgttgcagctgtcattggatggatgcta

SEQ ID NO: 357301 - DNA, 75 bp, Artificial Sequence
  Synthetic
gacaccgcgggggccttcccgctttttagaatatggcccccccgcctcttgcggggccctcctggtttcttagac

SEQ ID NO: 357302 - DNA, 75 bp, Artificial Sequence
  Synthetic
ggttgatctggtactggaaggcgatagttgtgtgaccataatgtcaaaagacaagccaaccattgatgtcaaaat

SEQ ID NO: 357303 - DNA, 75 bp, Artificial Sequence
  Synthetic
gctacggcgtgctactctgcggagagtgcagtctgcgatagtgccccaggaggactgggttaacaaaggcaaatc

SEQ ID NO: 357304 - DNA, 75 bp, Artificial Sequence
  Synthetic
acaagccaaccattgatgtcaaaatgatgaacatggaagcagccaacctcgcagatgtgcgcagttactgttacc

SEQ ID NO: 357305 - DNA, 75 bp, Artificial Sequence
  Synthetic
gatgaacatggaagcagccaacctcgcagatgtgcgcagttactgttacctagcttcggtcagtgacttgtcaac

SEQ ID NO: 357306 - DNA, 75 bp, Artificial Sequence
  Synthetic
ttctgctctgcacaaccagccacacggcacagtgcgccgacaatggtggctggtggtgcgagaacacaggatcaa

SEQ ID NO: 357307 - DNA, 75 bp, Artificial Sequence
  Synthetic
caagaagatttcaatgtctaagaaaccaggagggcccggaaaaaaccgggctgtcaatatgcaaaaacgcggaat

SEQ ID NO: 357308 - DNA, 75 bp, Artificial Sequence
  Synthetic
gccctcagaaccgtacctacctagttaaggtaacccgtccctacgaaaccggaacccgtcgtaggaacgtacgtc

SEQ ID NO: 357309 - DNA, 75 bp, Artificial Sequence
  Synthetic
aagctactggattaaccatacagcgggagaacgtgaagtatgaagtggcagcttttgtccatgggccaacgaccg

SEQ ID NO: 357310 - DNA, 75 bp, Artificial Sequence
  Synthetic
gagtggttcatggatttaaatctgccatggtccagccccggaaacacgaactggaggaacagggaggccctggtt

SEQ ID NO: 357311 - DNA, 75 bp, Artificial Sequence
  Synthetic
gcagggtgaaaggatggatgagccaatcccagccggattcgaacctgagatgctgaggaaaaaacagatcactgt

SEQ ID NO: 357312 - DNA, 75 bp, Artificial Sequence
  Synthetic
ctcgcatgttcctgaggattcgggaaacgaacacaacggaatgcgactcgaagatcataggaaccgccgtcaaga

SEQ ID NO: 357313 - DNA, 75 bp, Artificial Sequence
  Synthetic
tggggtgatggagttctggaaagtgatctcatcatacccatcaccttggcaggacccagaagcaaccacaacagg

SEQ ID NO: 357314 - DNA, 75 bp, Artificial Sequence
  Synthetic
atctcatcatacccatcaccttggcaggacccagaagcaaccacaacaggagaccagggtacaaaactcagaacc

SEQ ID NO: 357315 - DNA, 75 bp, Artificial Sequence
  Synthetic
agattttgcatcggggaaacgatcacaaatcgggctcgttgaggtgctcgggagaatgcctgagcacttcatggg

SEQ ID NO: 357316 - DNA, 75 bp, Artificial Sequence
  Synthetic
ccgcgtttgctgaagcaaactcaggaggagacgtcgtgcacttggcacttatggctacattcaagattcaaccag

SEQ ID NO: 357317 - DNA, 75 bp, Artificial Sequence
  Synthetic
aagcttcaccaacacttcaaatgtggtggtgccgctgctggcccttttgacacctggattgaaatgcttaaacct

SEQ ID NO: 357318 - DNA, 75 bp, Artificial Sequence
  Synthetic
atggttggagttggaagcctcatcaaagaaaaaaggagctctgcagcaaaaaagaaaggagcttgcctcatctgc

SEQ ID NO: 357319 - DNA, 75 bp, Artificial Sequence
  Synthetic
ctagcgctggcgtctacaggagtgttcaatccaatgatacttgcagctgggctaatggcttgcgaccccaaccgc

SEQ ID NO: 357320 - DNA, 75 bp, Artificial Sequence
  Synthetic
gatggcgacctttaagatccaaccggcgtttatggtggcctcatttcttaaaacgagatggacaaaccaagagag

SEQ ID NO: 357321 - DNA, 75 bp, Artificial Sequence
  Synthetic
tgccatcgttgggggtctggcagaacttgacatagattctatggctatccccatgaccatcgccggacttatgtt

SEQ ID NO: 357322 - DNA, 75 bp, Artificial Sequence
  Synthetic
ccatgaccatcgccggacttatgttcgtggcatttgtcatctctggaaagtcaacagacatgtggattgagagga

SEQ ID NO: 357323 - DNA, 75 bp, Artificial Sequence
  Synthetic
tgactgtgactgcagctgccctgctcttttgccactatgcttacatggtgccaggctggcaagcggaagctatgc

SEQ ID NO: 357324 - DNA, 75 bp, Artificial Sequence
  Synthetic
ggaaagaaagtagtccaattgaacagaaagtcgtacgagacggagtacccaaaatgtaagaacgatgattgggac

SEQ ID NO: 357325 - DNA, 75 bp, Artificial Sequence
  Synthetic
agagtagatgttaggctggatgatgatggaaattttcaactgatgaatgaccccggggcaccatggaaaatttgg

SEQ ID NO: 357326 - DNA, 75 bp, Artificial Sequence
  Synthetic
gatgggatcgtggccactgatgtacctgaacttgagcgaacaactccagtcatgcagaaaaaagttggacagatc

SEQ ID NO: 357327 - DNA, 75 bp, Artificial Sequence
  Synthetic
catgcagaaaaaagttggacagatcatgttgatcttggtgtcaatggccgcggttgtcgtcaatccatcagtgag

SEQ ID NO: 357328 - DNA, 75 bp, Artificial Sequence
  Synthetic
accggaagttgagtagacggtgctgcctgcgactcaaccccaaggaggactgggtgaacaaagccgcgaagtgat

SEQ ID NO: 357329 - DNA, 75 bp, Artificial Sequence
  Synthetic
caccgagggagtacagaaaaggggacaccaccacaggagtataccgaatcatgacgcgagggatactcggtagct

SEQ ID NO: 357330 - DNA, 75 bp, Artificial Sequence
  Synthetic
ggagggggtgttccacaccttgtggcacacgacgaaaggagctgccttgatgagcggaacgggacgactggaccc

SEQ ID NO: 357331 - DNA, 75 bp, Artificial Sequence
  Synthetic
cacacgacgaaaggagctgccttgatgagcggaacgggacgactggacccttactggggtagcgtccgggaggac

SEQ ID NO: 357332 - DNA, 75 bp, Artificial Sequence
  Synthetic
caaggaggccatcaacaaaagattgaggacggctgtgctggcacccaccagggtcgttgctgctgagatgtctga

SEQ ID NO: 357333 - DNA, 75 bp, Artificial Sequence
  Synthetic
agcacagtggaaatgagatcgttgatgtcatgtgccatgccaccctcacacacaggctgatgtctccacacagag

SEQ ID NO: 357334 - DNA, 75 bp, Artificial Sequence
  Synthetic
cacaggctgatgtctccacacagagtccccaactacaacctgttcataatggatgaagcccatttcacggatcca

SEQ ID NO: 357335 - DNA, 75 bp, Artificial Sequence
  Synthetic
caactctacccatgagatgtactgggtgagccatgcttcaggcaacattgtccactccgtcaacatgacaagcca

SEQ ID NO: 357336 - DNA, 75 bp, Artificial Sequence
  Synthetic
gggttggctagataagaccaagagtgacataagcagtttgtttgggcaaagaattgaggtcaaggagaatttcag

SEQ ID NO: 357337 - DNA, 75 bp, Artificial Sequence
  Synthetic
tcaccggttaatgtctccacaccgagtccccaactacaacctatttgtgatggatgaagcccactttactgaccc

SEQ ID NO: 357338 - DNA, 75 bp, Artificial Sequence
  Synthetic
tcaacagtaatgccgccctaggagcgatgtttgaagaacagaaccaatggaagaacgcccgggaagctgtagagg

SEQ ID NO: 357339 - DNA, 75 bp, Artificial Sequence
  Synthetic
gtggcaccacgatgagaaccacccatatagaacctggaactatcacggcagttatgatgtgaagcccacaggctc

SEQ ID NO: 357340 - DNA, 75 bp, Artificial Sequence
  Synthetic
agccggaagagtgtgaaacctacgattatcactgacggtgaaaaccgggtggttctgggagagccatcagccatc

SEQ ID NO: 357341 - DNA, 75 bp, Artificial Sequence
  Synthetic
tacaccatggacggggaatacaggctcagaggggaagaacggaagaacttccttgaattcctgagaacagctgat

SEQ ID NO: 357342 - DNA, 75 bp, Artificial Sequence
  Synthetic
gtccttcaaagattttgcatcggggaaacgatcacaaatcgggctcgttgaggtgctcgggagaatgcctgaaca

SEQ ID NO: 357343 - DNA, 75 bp, Artificial Sequence
  Synthetic
aggtgtgttttttctactcatgcaaaggaaaggcattggtaagattggcttgggaggagtaatcttaggagctgc

SEQ ID NO: 357344 - DNA, 75 bp, Artificial Sequence
  Synthetic
gctcacactggtcagcgccgtggctgccaatgaaatgggctggctggacaagaccaagaatgacattggcagcct

SEQ ID NO: 357345 - DNA, 75 bp, Artificial Sequence
  Synthetic
tgattggcacacgaacccgcgccacttgggctgaaaatatccatgtggcaatcaatcaggtccgttcggtgattg

SEQ ID NO: 357346 - DNA, 75 bp, Artificial Sequence
  Synthetic
tggccagaggcttcccttttgtggacgttggtgtgtcagctctcttgctggcggccgggtgctggggccaggtga

SEQ ID NO: 357347 - DNA, 75 bp, Artificial Sequence
  Synthetic
tacatggtgccaggctggcaagcggaagccatgcgatctgcccagcggcggacagctgctggcatcatgaaaaat

SEQ ID NO: 357348 - DNA, 75 bp, Artificial Sequence
  Synthetic
tcaactggatggtatgattggcagcaggttccattttgctcaaaccatttcactgaattgatcatgaaagatgga

SEQ ID NO: 357349 - DNA, 75 bp, Artificial Sequence
  Synthetic
ggacagatcatgttgatcttggtgtcaatggccgcggtggtcgtcaatccatcagtgagaaccgtcagagaggcc

SEQ ID NO: 357350 - DNA, 75 bp, Artificial Sequence
  Synthetic
atcgctccgcggcacgtcacgcgcggagagaaggaaacattacaggtggccatcccgtctcgcgaggcacagcaa

SEQ ID NO: 357351 - DNA, 75 bp, Artificial Sequence
  Synthetic
tcaccctatgggagaatggtgctagttcagtgtggaatgcaacgacagctattggcctttgtcacatcatgcgag

SEQ ID NO: 357352 - DNA, 75 bp, Artificial Sequence
  Synthetic
ggatcagttggaggggtgttcacctcagtagggaaggctgtccatcaagtgttcggtggagcattccgctcactg

SEQ ID NO: 357353 - DNA, 75 bp, Artificial Sequence
  Synthetic
atttcttgaccccatcgggaaggtggtggacctggggtgtggaagaggaggctggtgctactacatggcgacaca

SEQ ID NO: 357354 - DNA, 75 bp, Artificial Sequence
  Synthetic
gagaaaccaggcctcaagaggggtggagccaaaggacgcacgctaggggaagtttggaaggagagactcaaccac

SEQ ID NO: 357355 - DNA, 75 bp, Artificial Sequence
  Synthetic
acagaaaagaagccatcactgaagttgaccgctccgcagcaaaacatgctaggagagagggaaacatcactggag

SEQ ID NO: 357356 - DNA, 75 bp, Artificial Sequence
  Synthetic
agaagatcagagggggagtggacaagttgtcacctacgccctaaacactttcaccaacctggccgtccagctggt

SEQ ID NO: 357357 - DNA, 75 bp, Artificial Sequence
  Synthetic
tgaccgctccgcagcaaaacatgctaggagagagggaaacatcactggaggccacccagtctcacggggaaccgc

SEQ ID NO: 357358 - DNA, 75 bp, Artificial Sequence
  Synthetic
caactgccttggaatgagcaacagagacttcttggagggagtgtctggagcaacatgggtggatttggttctcga

SEQ ID NO: 357359 - DNA, 75 bp, Artificial Sequence
  Synthetic
aattgtaaatagacaatataagtatgcataaaagtgtagttttatagtagtatttagtggtgttagtgtaaatag

SEQ ID NO: 357360 - DNA, 75 bp, Artificial Sequence
  Synthetic
agagtggagtcgacgtcttctacagaccatcagaagcgagcgacacactgctctgtgacattggagagtcatcgt

SEQ ID NO: 357361 - DNA, 75 bp, Artificial Sequence
  Synthetic
catgactgacaccacccctttcgggcagcagcgtgtgttcaaagaaaaagtcgacactaaggcacccgaaccagc

SEQ ID NO: 357362 - DNA, 75 bp, Artificial Sequence
  Synthetic
atggaggtggccttgtaagaaaccccctttcacgcaactctacccatgagatgtactgggtgagccacgcttcag

SEQ ID NO: 357363 - DNA, 75 bp, Artificial Sequence
  Synthetic
gctgaagaaagaatacagctccacatggcaccaggatgcgaaccacccctacaggacctggaactaccacggaag

SEQ ID NO: 357364 - DNA, 75 bp, Artificial Sequence
  Synthetic
ccttttgtttcagtggccacggccaatgccaaggtcctgattgaattggaaccaccctttggagactcatacata

SEQ ID NO: 357365 - DNA, 75 bp, Artificial Sequence
  Synthetic
ccagaaggagtcaaatacgtcctcaatgagaccacgaactggctgtgggcttttttagcccgcgataagaaaccc

SEQ ID NO: 357366 - DNA, 75 bp, Artificial Sequence
  Synthetic
gatggtggatgaggagcgtgaagcgcatctccgtggagaatgcaacacctgcatctacaacatgatgggaaagag

SEQ ID NO: 357367 - DNA, 75 bp, Artificial Sequence
  Synthetic
gctcatgaatgatccaggagcaccttggaagatatggatgctcagaatggtctgcctcgcgattagtgcgtacac

SEQ ID NO: 357368 - DNA, 75 bp, Artificial Sequence
  Synthetic
tgataccgcaggctgggacacacgcatcaccaaagctgacctcgagaatgaagcgaaggttcttgaactgctgga

SEQ ID NO: 357369 - DNA, 75 bp, Artificial Sequence
  Synthetic
cgccctgaacaccttcaccaatctagcagttcagctggtcagaatgatggagggggagggggtcattggacccga

SEQ ID NO: 357370 - DNA, 75 bp, Artificial Sequence
  Synthetic
tgatgttgaaaaactgggaaaaggaaaaggccctaaggtcagaacctggctgtttgagaatggcgaggagcgtct

SEQ ID NO: 357371 - DNA, 75 bp, Artificial Sequence
  Synthetic
gggtggcccgcaactgaagtgatgactgctgtcggcttgatgtttgccattgtcggagggctggcagagcttgac

SEQ ID NO: 357372 - DNA, 75 bp, Artificial Sequence
  Synthetic
gtgctgcaggagctgcaccttaccaccattgcgctaccagacggacagcggctgttggtatggcatggagattag

SEQ ID NO: 357373 - DNA, 75 bp, Artificial Sequence
  Synthetic
cccacagggcgtaccacttggtcgatccacgcaaaaggagaatggatgacgacggaagacatgctcgcagtctgg

SEQ ID NO: 357374 - DNA, 75 bp, Artificial Sequence
  Synthetic
tggagcaagctctgtttggaacgcaacaactgccatcggactctgccacattatgcgtgggggttggttgtcatg

SEQ ID NO: 357375 - DNA, 75 bp, Artificial Sequence
  Synthetic
gcagctgcaaaaaagaaaggagcaagtctgttatgcttggctctagcctcaacaggacttttcaaccccatgatc

SEQ ID NO: 357376 - DNA, 75 bp, Artificial Sequence
  Synthetic
atggaaatgagattgttgatgtcatgtgccatgccaccctcactcacaggctgatgtctcctcacagggtgccta

SEQ ID NO: 357377 - DNA, 75 bp, Artificial Sequence
  Synthetic
ttcgcctgtgtgagctgacaaacttagtagtgtttgtgaggatttacgaggattaatacagtacgagctgttttt

SEQ ID NO: 357378 - DNA, 75 bp, Artificial Sequence
  Synthetic
ggactgaagagggctatgctgagcctgattgacggaagaggaccgatacggtttgtgttggccttgttgacgttt

SEQ ID NO: 357379 - DNA, 75 bp, Artificial Sequence
  Synthetic
tgatcatgaaggacggcaggacgttggtggtcccgtgtcgtggacaagacgagttgattggacgggccagaatct

SEQ ID NO: 357380 - DNA, 75 bp, Artificial Sequence
  Synthetic
ttcaggttcacagctatcgctccgacaagagcgttgttggacagatggagaggtgtgagaaaacaaacagcgatg

SEQ ID NO: 357381 - DNA, 75 bp, Artificial Sequence
  Synthetic
caagagcgttgttggacagatggagaggtgtgagaaaacaaacagcgatgaaacatctcttgagcttcaagaagg

SEQ ID NO: 357382 - DNA, 75 bp, Artificial Sequence
  Synthetic
gaataaacggagcggaaaacaaaaaagaggaggaacagttggggtggcagccatcatgggcttaattgcctgtgc

SEQ ID NO: 357383 - DNA, 75 bp, Artificial Sequence
  Synthetic
ccatcatgggcttaattgcctgtgccagcgcgctaaccctgtcaaactttcaaggaaagttgatgatgaccataa

SEQ ID NO: 357384 - DNA, 75 bp, Artificial Sequence
  Synthetic
tacgatccccacggcagcaggcaaaaatctttgcaccatcagagcgatggacgtgggattcatgtgtgatgacac

SEQ ID NO: 357385 - DNA, 75 bp, Artificial Sequence
  Synthetic
aatctttgcaccatcagagcgatggacgtgggattcatgtgtgatgacactattgcatacgagtgtcctgcactc

SEQ ID NO: 357386 - DNA, 75 bp, Artificial Sequence
  Synthetic
ttgactgctggtgcaccaagtcagccgtgtttgtaagatacgggaggtgcacaaggactcgaaactcacggcgta

SEQ ID NO: 357387 - DNA, 75 bp, Artificial Sequence
  Synthetic
cgtgtttgtaagatacgggaggtgcacaaggactcgaaactcacggcgtagccgtaggtcactcaatgtccaagt

SEQ ID NO: 357388 - DNA, 75 bp, Artificial Sequence
  Synthetic
accccggggggcttcccgttttttagcatattgaccccccggctcttgcgggcccctcctggtttcttagacatc

SEQ ID NO: 357389 - DNA, 75 bp, Artificial Sequence
  Synthetic
aggaaaggagcttggctagatagcaccaaagcgtcacgatacctaatgaaggctgagtcatggatcttgagaaac

SEQ ID NO: 357390 - DNA, 75 bp, Artificial Sequence
  Synthetic
ccaaagcgtcacgatacctaatgaaggctgagtcatggatcttgagaaaccctggatacgcattggtggctgctg

SEQ ID NO: 357391 - DNA, 75 bp, Artificial Sequence
  Synthetic
cacaacacagagagtggtgttcatgattctgctcctcctagttgctccagcctatagctttaattgcttgggtat

SEQ ID NO: 357392 - DNA, 75 bp, Artificial Sequence
  Synthetic
attctgctcctcctagttgctccagcctatagctttaattgcttgggtatgagcaacagagacttcatagaaggc

SEQ ID NO: 357393 - DNA, 75 bp, Artificial Sequence
  Synthetic
tagtgctggaaggagacagttgcgtgaccataatggccaaagacagaccgacaattgacgtgaagatggtcacca

SEQ ID NO: 357394 - DNA, 75 bp, Artificial Sequence
  Synthetic
gaccataatggccaaagacagaccgacaattgacgtgaagatggtcaccatgggagcaagcaatatggcggaggt

SEQ ID NO: 357395 - DNA, 75 bp, Artificial Sequence
  Synthetic
gccacagagatatccagtagtgcggcttgccctacgatgggggaggcacacaatgagaagagaacggactcaaac

SEQ ID NO: 357396 - DNA, 75 bp, Artificial Sequence
  Synthetic
cttgccctacgatgggggaggcacacaatgagaagagaacggactcaaacttcgtgtgtaaacaaggagttgttg

SEQ ID NO: 357397 - DNA, 75 bp, Artificial Sequence
  Synthetic
cctctttggaaaaggaagcatagacacctgtgcgaagttcacttgctccaacaaagctactggattaaccataca

SEQ ID NO: 357398 - DNA, 75 bp, Artificial Sequence
  Synthetic
ggactgaggcacgaatcatgctggacaacatcaacatgccaaacggactgattgctcaattctaccaaccagagc

SEQ ID NO: 357399 - DNA, 75 bp, Artificial Sequence
  Synthetic
gaatgcagccgtgcaagctggaaggttcagtgtgtctccagcagcccccacccacacgttgactttgggagatta

SEQ ID NO: 357400 - DNA, 75 bp, Artificial Sequence
  Synthetic
cggagaagtcacctttgattgtgaacccaggtcaggcgttgatgtggacgccttctacgtgatgacggtgggaac

SEQ ID NO: 357401 - DNA, 75 bp, Artificial Sequence
  Synthetic
ccttctacgtgatgacggtgggaacaaaatccttcctggtgcacagagagtggttcatggatttaaatctgccat

SEQ ID NO: 357402 - DNA, 75 bp, Artificial Sequence
  Synthetic
aatcggttgttgccctgggctcacaagaaggcgctctccaccaggccctggccggagcaatcccggtggactata

SEQ ID NO: 357403 - DNA, 75 bp, Artificial Sequence
  Synthetic
agggcacttgaaatgtagggttaagatggaaaagctgaagttgaaaggcacgacttacggagtgtgtgcaaaggc

SEQ ID NO: 357404 - DNA, 75 bp, Artificial Sequence
  Synthetic
atggaaaagctgaagttgaaaggcacgacttacggagtgtgtgcaaaggcattcagattctcaaacactccggct

SEQ ID NO: 357405 - DNA, 75 bp, Artificial Sequence
  Synthetic
gacacgggccatggaacggtggtgatggaactccaatacacaggaacggacggtccctgcaagattcccatcact

SEQ ID NO: 357406 - DNA, 75 bp, Artificial Sequence
  Synthetic
agtactgtagatatttaattaattgtaaatagacaatataagtatgcataaaagtgtagttttatagtagtattt

SEQ ID NO: 357407 - DNA, 75 bp, Artificial Sequence
  Synthetic
gagggcacacaaatgaggatgattccaactttgctcactggacagaggctcgcatcatgctagacaacatcaaca

SEQ ID NO: 357408 - DNA, 75 bp, Artificial Sequence
  Synthetic
cgcatcatgctagacaacatcaacatgccgaatggtctggtggctcaactatatcagcctgagcgcgagaaggtg

SEQ ID NO: 357409 - DNA, 75 bp, Artificial Sequence
  Synthetic
ctccagttggaagactcgtaacggtgaacccatacgtgtcagtagccacagccaacgccaaaatcttggtggagc

SEQ ID NO: 357410 - DNA, 75 bp, Artificial Sequence
  Synthetic
gccaacgccaaaatcttggtggagctggaacctccatttggcgattcatacatcgtaatcggaaaaggtgaccaa

SEQ ID NO: 357411 - DNA, 75 bp, Artificial Sequence
  Synthetic
ccgggagtagcatagggaaggcttttgccaccactttgcaaggcgctcaacgcctcgtgtcgctaggagacaccg

SEQ ID NO: 357412 - DNA, 75 bp, Artificial Sequence
  Synthetic
tgccaccactttgcaaggcgctcaacgcctcgtgtcgctaggagacaccgcgtgggactttggctccgtcggcgg

SEQ ID NO: 357413 - DNA, 75 bp, Artificial Sequence
  Synthetic
gttcaccaactatttggaggagcattccgctccttgttcggtggcatgtcatggataacacaaggactcttaggg

SEQ ID NO: 357414 - DNA, 75 bp, Artificial Sequence
  Synthetic
tccgctccttgttcggtggcatgtcatggataacacaaggactcttaggggccttgcttctgtggatgggcatca

SEQ ID NO: 357415 - DNA, 75 bp, Artificial Sequence
  Synthetic
actcacgcgaccgctctatagccatgactttcttggctgttggcggagtcctgctcttcctttctgtgaacgtcc

SEQ ID NO: 357416 - DNA, 75 bp, Artificial Sequence
  Synthetic
gactttcttggctgttggcggagtcctgctcttcctttctgtgaacgtccacgctgacaccgggtgtgcaattga

SEQ ID NO: 357417 - DNA, 75 bp, Artificial Sequence
  Synthetic
ctgctcttcctttctgtgaacgtccacgctgacaccgggtgtgcaattgatctcaaaagacaagagctcaggtgt

SEQ ID NO: 357418 - DNA, 75 bp, Artificial Sequence
  Synthetic
aggaattctgcatcaaagtgctatgcccttacatgcccaaagtgattgagaagatggaaacactccaaaggcgat

SEQ ID NO: 357419 - DNA, 75 bp, Artificial Sequence
  Synthetic
acgttgaggcatgggtggatcgttaccgctaccatcctgagaccccccaaggtttggcgaagataattcacaatg

SEQ ID NO: 357420 - DNA, 75 bp, Artificial Sequence
  Synthetic
ggtttggcgaagataattcacaatgcccacaaagaaggagtctgtggcgtaaggtcggtctctagactagagcac

SEQ ID NO: 357421 - DNA, 75 bp, Artificial Sequence
  Synthetic
ggttcatgtggctgggggcccgcttcctggagtttgaagctctcggattcctcaatgaagaccactggctgggta

SEQ ID NO: 357422 - DNA, 75 bp, Artificial Sequence
  Synthetic
agctcaacaccctgctcaaagaaaacggaattgatctaagcattgttgtggagaagcagagtggcctgtacaaat

SEQ ID NO: 357423 - DNA, 75 bp, Artificial Sequence
  Synthetic
cggaattgatctaagcattgttgtggagaagcagagtggcctgtacaaatcagccccaaggcggctggccgctac

SEQ ID NO: 357424 - DNA, 75 bp, Artificial Sequence
  Synthetic
aaagcatggggaaagagcatcatttttgctcccgaactagcgaaccacacgttcgtcatagacggtccagagaca

SEQ ID NO: 357425 - DNA, 75 bp, Artificial Sequence
  Synthetic
gttcgtcatagacggtccagagacaaaggaatgtccgtccgccgacagagcgtggaacagtttggaagtggaaga

SEQ ID NO: 357426 - DNA, 75 bp, Artificial Sequence
  Synthetic
cgaatgttcctgcgggtgagagaaagcaacaccactgagtgtgacaccaaaatcattggaacggccgttaaaaat

SEQ ID NO: 357427 - DNA, 75 bp, Artificial Sequence
  Synthetic
aatcattggaacggccgttaaaaataacatggcagttcacagtgatctctcctactggattgagagtggacttaa

SEQ ID NO: 357428 - DNA, 75 bp, Artificial Sequence
  Synthetic
tatagttagtttagtgtaaataggatttattgagaatggaagtcaggccagattaatgctgccaccggaagttga

SEQ ID NO: 357429 - DNA, 75 bp, Artificial Sequence
  Synthetic
gtgttgggagaagtgaagtcatgcacctggccggagacacacacgttgtggggtgagggggtccaagaaagcgac

SEQ ID NO: 357430 - DNA, 75 bp, Artificial Sequence
  Synthetic
cctggccggagacacacacgttgtggggtgagggggtccaagaaagcgacctcatcattcccgtcaccctggcag

SEQ ID NO: 357431 - DNA, 75 bp, Artificial Sequence
  Synthetic
acctggatacaagacgcaaaaccaagggccatgggacgaaggtagagttgaattagattttgactactgccccgg

SEQ ID NO: 357432 - DNA, 75 bp, Artificial Sequence
  Synthetic
tgcggacaccgcggacccgcggcacgcaccactacggagagcgggaagctgatctctgattggtgctgccgtagc

SEQ ID NO: 357433 - DNA, 75 bp, Artificial Sequence
  Synthetic
gcaccactacggagagcgggaagctgatctctgattggtgctgccgtagctgtaccctgccaccattgcgctacc

SEQ ID NO: 357434 - DNA, 75 bp, Artificial Sequence
  Synthetic
ggactgaatcgggttgttggtatgggatggagatacgcccacttcgccacgatgagaaaaccctggtgcaatcaa

SEQ ID NO: 357435 - DNA, 75 bp, Artificial Sequence
  Synthetic
gattgatccttttcagctgggccttctggtagtgttcttggccacccaggaggtccttcgcaagaggtggacggc

SEQ ID NO: 357436 - DNA, 75 bp, Artificial Sequence
  Synthetic
tgttgtaacttcaaagcccaatgtcagaccacgctacggcgtgccactctgcggagagtgcagtctgcgatagtg

SEQ ID NO: 357437 - DNA, 75 bp, Artificial Sequence
  Synthetic
ggggcgtgacttacactgatttgattcggtacgtgatacttgttggagcagcatttgcagagtcaaactcaggag

SEQ ID NO: 357438 - DNA, 75 bp, Artificial Sequence
  Synthetic
tggttgaggacacagtactgtagatatttaatcaattgtaaatagacaatataagtatgcataaagtgtagttat

SEQ ID NO: 357439 - DNA, 75 bp, Artificial Sequence
  Synthetic
tttcaaatggcttacattgattcccaactcactttcaattggaacatcccagatgtgctcaattccttgtcggtt

SEQ ID NO: 357440 - DNA, 75 bp, Artificial Sequence
  Synthetic
agatgtgctcaattccttgtcggttgcgtggatgatactaagggcgattagctttacaaccacttcaaacgtggc

SEQ ID NO: 357441 - DNA, 75 bp, Artificial Sequence
  Synthetic
acttcaaagccgcgaagtgatccatgtaagccctcagaaccgtctcggaacggaggaccccacatgtgtaacttc

SEQ ID NO: 357442 - DNA, 75 bp, Artificial Sequence
  Synthetic
ccaggactgaagtgtttacatttagacatatatcgcattttactgctcatggtaggagtgggaagcttggtcaag

SEQ ID NO: 357443 - DNA, 75 bp, Artificial Sequence
  Synthetic
ggcgtgctactctgcggagagtgcagtctcgcgatgagtgccccaggaggactggagttaacaaagccgcgaagt

SEQ ID NO: 357444 - DNA, 75 bp, Artificial Sequence
  Synthetic
ggtaggagtgggaagcttggtcaaggaaaggcggagtgcagtggcaaaaaagaaaggagccagtctcatttgtct

SEQ ID NO: 357445 - DNA, 75 bp, Artificial Sequence
  Synthetic
gtctcgcgatgagtgccccaggaggactggagttaacaaagccgcgaagtgatccatgtaagccctcagaaccgg

SEQ ID NO: 357446 - DNA, 75 bp, Artificial Sequence
  Synthetic
aatcccctcattttggtggcgggattactagcctgcgaccctaacaggaagagaggatggccagccacagaggtc

SEQ ID NO: 357447 - DNA, 75 bp, Artificial Sequence
  Synthetic
tactagcctgcgaccctaacaggaagagaggatggccagccacagaggtcatgactgcggtgggtttaatgtttg

SEQ ID NO: 357448 - DNA, 75 bp, Artificial Sequence
  Synthetic
ggaaagagagagaaaaaaccaggagagtttggaaaggccaagggaagcagagccatatggttcatgtggctcgga

SEQ ID NO: 357449 - DNA, 75 bp, Artificial Sequence
  Synthetic
gtaacttcaaagccgcgaagtgatccatgtaagccctcagaaccggtctcgggaaggaggaccccacatgttgta

SEQ ID NO: 357450 - DNA, 75 bp, Artificial Sequence
  Synthetic
ggacatagattcaatggcgatccctatgaccatagccggcttgatgttcgcagcgtacgtgataacagggaggtc

SEQ ID NO: 357451 - DNA, 75 bp, Artificial Sequence
  Synthetic
atgaccatagccggcttgatgttcgcagcgtacgtgataacagggaggtctacagacatgtggattgaaaggaca

SEQ ID NO: 357452 - DNA, 75 bp, Artificial Sequence
  Synthetic
ctgagatcaccggaactagtgatagagttgacgtgaaacttgatgatgacggaaacttccaacttatgaacgacc

SEQ ID NO: 357453 - DNA, 75 bp, Artificial Sequence
  Synthetic
agttgacgtgaaacttgatgatgacggaaacttccaacttatgaacgaccctggagcaccatggaagatctggat

SEQ ID NO: 357454 - DNA, 75 bp, Artificial Sequence
  Synthetic
ggcagagcttgacattgactccatggccattccaatgactatcgcggggctcatgtttgctgctttcgtgatttc

SEQ ID NO: 357455 - DNA, 75 bp, Artificial Sequence
  Synthetic
tcccatcagtcgtgggcttttggatcacgctccagtacacaaaaagagggggtgtcctatgggacactccgtcac

SEQ ID NO: 357456 - DNA, 75 bp, Artificial Sequence
  Synthetic
caccacaggagtataccgaatcatgacgcgaggaatacttggcagctaccaggctggagttggagttatggtaga

SEQ ID NO: 357457 - DNA, 75 bp, Artificial Sequence
  Synthetic
ctggggtagcgtccgggaggaccggctctgttacggagggccatggaagttgcaacggaagtggaacgggcttga

SEQ ID NO: 357458 - DNA, 75 bp, Artificial Sequence
  Synthetic
ctctgttacggagggccatggaagttgcaacggaagtggaacgggcttgacgaagtccagatgattgtagctgaa

SEQ ID NO: 357459 - DNA, 75 bp, Artificial Sequence
  Synthetic
aaacgaagcccggagtgtttaagacccccgatggggagataggggccgtcacactggattaccccacaggaacgt

SEQ ID NO: 357460 - DNA, 75 bp, Artificial Sequence
  Synthetic
ccccgatggggagataggggccgtcacactggattaccccacaggaacgtctggatctcccatagttgacaagaa

SEQ ID NO: 357461 - DNA, 75 bp, Artificial Sequence
  Synthetic
aagagacctgcggctcatggccaacgccatttgctccgctgtccctgtgaactgggtccctaccggaagaaccac

SEQ ID NO: 357462 - DNA, 75 bp, Artificial Sequence
  Synthetic
aatggcgtcatcatgcctaacggttcgtacatcagcgccatcgtgcaaggtgagagaatggaagaaccggcacca

SEQ ID NO: 357463 - DNA, 75 bp, Artificial Sequence
  Synthetic
tgagagaatggaagaaccggcaccagcaggctttgaaccagacatgctcaggaagaagcagatcacggtcctgga

SEQ ID NO: 357464 - DNA, 75 bp, Artificial Sequence
  Synthetic
aggaaaattttgccacagatcattaaagaagccatcaataagaggcttcgcacggcaatactggctcctacacgc

SEQ ID NO: 357465 - DNA, 75 bp, Artificial Sequence
  Synthetic
aagaagccatcaataagaggcttcgcacggcaatactggctcctacacgcgtggtggcctccgaaatggctgaag

SEQ ID NO: 357466 - DNA, 75 bp, Artificial Sequence
  Synthetic
ccagacttcggcagtcacacgggagcacacagggaatgagatagtcgacgtgatgtgccacgctacgttgactca

SEQ ID NO: 357467 - DNA, 75 bp, Artificial Sequence
  Synthetic
aagtatgtggattacatgagttcactaaagagatatgaagacacaactttggttgaggacacagtactgtaaata

SEQ ID NO: 357468 - DNA, 75 bp, Artificial Sequence
  Synthetic
tcgacgagagtggaactaggggaagcagcggcaatcttcatgactgccacaccccccggaacctcagaccccttt

SEQ ID NO: 357469 - DNA, 75 bp, Artificial Sequence
  Synthetic
cagcggcaatcttcatgactgccacaccccccggaacctcagacccctttcctgaatccaatgcacccgtggcag

SEQ ID NO: 357470 - DNA, 75 bp, Artificial Sequence
  Synthetic
taaatagttaagaaaattttaaagaggaagtcaggccggaaaatttccgccaccggaagttgagtagacggtgct

SEQ ID NO: 357471 - DNA, 75 bp, Artificial Sequence
  Synthetic
agcctggaactcagggtacgaatggatcactgagtacgtagggaaaactgtctggtttgtgcccagcgtgcgcat

SEQ ID NO: 357472 - DNA, 75 bp, Artificial Sequence
  Synthetic
gggaaacgagatggcgcagtgcctgcaaagagcagggaagaaagtgattcaactaaaccggaagtcgtatgagac

SEQ ID NO: 357473 - DNA, 75 bp, Artificial Sequence
  Synthetic
gtccttgaaatggttgaggactggctgcaccgagggccaagggaattttgtgtgaaggtgctctgcccctacatg

SEQ ID NO: 357474 - DNA, 75 bp, Artificial Sequence
  Synthetic
gactgggacttcgtgatcacaactgacatctcagagatgggagccaacttcaaggctagccgtgtgatcgacagc

SEQ ID NO: 357475 - DNA, 75 bp, Artificial Sequence
  Synthetic
tgtcaagatggggaatgagattgccctttgcctacaacgtgctggaaagaaagtagtccaattgaacagaaagtc

SEQ ID NO: 357476 - DNA, 75 bp, Artificial Sequence
  Synthetic
gacgtatcggaagaaacccttcacaggtgggagatgagtactgctacggaggacacacgaacgaagatgattcca

SEQ ID NO: 357477 - DNA, 75 bp, Artificial Sequence
  Synthetic
ggtgggagatgagtactgctacggaggacacacgaacgaagatgattccaaccacgctcactggacggaggctag

SEQ ID NO: 357478 - DNA, 75 bp, Artificial Sequence
  Synthetic
ccaaacggattggtcgcgcagctttatcagccagagcgcgaaaaggtctacaccatggatggggagtacaaactt

SEQ ID NO: 357479 - DNA, 75 bp, Artificial Sequence
  Synthetic
tggaactgctcagaaccgctgacttaccagtatggctagcttaccaagtcgcagcagcaggaatttcttaccatg

SEQ ID NO: 357480 - DNA, 75 bp, Artificial Sequence
  Synthetic
gcagcagcaggaatttcttaccatgatcggaggtggtgctttgacggcccacgcacgaacacggttctggaggag

SEQ ID NO: 357481 - DNA, 75 bp, Artificial Sequence
  Synthetic
atcggaggtggtgctttgacggcccacgcacgaacacggttctggaggagaacacggaagtagaaatagtgacga

SEQ ID NO: 357482 - DNA, 75 bp, Artificial Sequence
  Synthetic
accccgctgggcagacgcgagagtgtactcagaccatcaggctctaaagctgttcaaggacttcgcggctgggcg

SEQ ID NO: 357483 - DNA, 75 bp, Artificial Sequence
  Synthetic
tactcagaccatcaggctctaaagctgttcaaggacttcgcggctgggcggagatcacagataggattggtggaa

SEQ ID NO: 357484 - DNA, 75 bp, Artificial Sequence
  Synthetic
tcgtggggaagacctgggaggccttggacaccatgtatgtcgtggccaccgcggaaaaaggtggacgagcccaca

SEQ ID NO: 357485 - DNA, 75 bp, Artificial Sequence
  Synthetic
ggacaccatgtatgtcgtggccaccgcggaaaaaggtggacgagcccacaggacggcattggaggaactgccaga

SEQ ID NO: 357486 - DNA, 75 bp, Artificial Sequence
  Synthetic
acactgttgagcgtcatgactctcggggtgttctgcctccttatgcaaaggaaaggtgtgagcaaaatcggactg

SEQ ID NO: 357487 - DNA, 75 bp, Artificial Sequence
  Synthetic
gggtgttctgcctccttatgcaaaggaaaggtgtgagcaaaatcggactggcaggagtcacactcggcctagcca

SEQ ID NO: 357488 - DNA, 75 bp, Artificial Sequence
  Synthetic
ccctgggacaaaaatagctggcatgctcttgctatctctgctcatgatgatcgttttgattcctgagcctgagaa

SEQ ID NO: 357489 - DNA, 75 bp, Artificial Sequence
  Synthetic
ctcgcggtgttccttatttgcgttctgacgctagtagggactgttgccgccaatgaaatggggtggcttgacaga

SEQ ID NO: 357490 - DNA, 75 bp, Artificial Sequence
  Synthetic
ggggccagagaacggagtcgagagaaagttttggggtggagagcttccttcttgatttgaaaccggcgacggcgt

SEQ ID NO: 357491 - DNA, 75 bp, Artificial Sequence
  Synthetic
aagttttggggtggagagcttccttcttgatttgaaaccggcgacggcgtggtcactgtacgcggtatccaccgc

SEQ ID NO: 357492 - DNA, 75 bp, Artificial Sequence
  Synthetic
gtgatcacttcggattacatcaacacttcactgacgtcaatcaacgtgcaggcgagcgcgctctactccttggcc

SEQ ID NO: 357493 - DNA, 75 bp, Artificial Sequence
  Synthetic
cttcactgacgtcaatcaacgtgcaggcgagcgcgctctactccttggccagaggatttccattcgtggatgtgg

SEQ ID NO: 357494 - DNA, 75 bp, Artificial Sequence
  Synthetic
aggatgttgggggcaagtcacgctgactgtgactgtcacggcagcagccctgctattctgtcactatgcttacat

SEQ ID NO: 357495 - DNA, 75 bp, Artificial Sequence
  Synthetic
actgtgactgtcacggcagcagccctgctattctgtcactatgcttacatggttccaggctggcaggctgaagcg

SEQ ID NO: 357496 - DNA, 75 bp, Artificial Sequence
  Synthetic
agaaagtcaggcgggaagtcccgccaccggaagttgagtagacggtgctgcctgcgactcaaccccaggaggact

SEQ ID NO: 357497 - DNA, 75 bp, Artificial Sequence
  Synthetic
cggcaggcatcatgaaaaatgcggttatcgacggcatggtggccaccgatgtccccgagctggagcggacgacac

SEQ ID NO: 357498 - DNA, 75 bp, Artificial Sequence
  Synthetic
tatcgacggcatggtggccaccgatgtccccgagctggagcggacgacacccgtgatgcagaagaaggtcggaca

SEQ ID NO: 357499 - DNA, 75 bp, Artificial Sequence
  Synthetic
gcagcggtagtcgtaaacccctctgtgaagacagtcagagaagccggcattctcgtgaccgcggcagcggtcaca

SEQ ID NO: 357500 - DNA, 75 bp, Artificial Sequence
  Synthetic
tgaagacagtcagagaagccggcattctcgtgaccgcggcagcggtcacattgtgggagaatggggccagttccg

SEQ ID NO: 357501 - DNA, 75 bp, Artificial Sequence
  Synthetic
gtggttgagaaacaggagggaatgtacaagtcagcacctaaacgtctcaccgccaccacggaaaaattggaaatt

SEQ ID NO: 357502 - DNA, 75 bp, Artificial Sequence
  Synthetic
actctgccacgtcatgcgcggaggctggctatcatgtctgtccatcacttggactttggtgaagaacatggaaaa

SEQ ID NO: 357503 - DNA, 75 bp, Artificial Sequence
  Synthetic
tggctatcatgtctgtccatcacttggactttggtgaagaacatggaaaagcccgggttgaagcgtggaggagcg

SEQ ID NO: 357504 - DNA, 75 bp, Artificial Sequence
  Synthetic
ggaaggatagactcaatcggttgacgaaagaagagttcaccaggtaccggaaagaagccataatcgaggttgatc

SEQ ID NO: 357505 - DNA, 75 bp, Artificial Sequence
  Synthetic
agaaggaaacattacaggtggccatcccgtctcgcgaggcacagcaaaactcaggtggctcgtagaaagaagatt

SEQ ID NO: 357506 - DNA, 75 bp, Artificial Sequence
  Synthetic
gacctggggtgtggaagaggaggctggtgctactacatggcgacacagaagcgagtccaagaggtaaaggggtac

SEQ ID NO: 357507 - DNA, 75 bp, Artificial Sequence
  Synthetic
tgatattggagaatcggcctcgagcgcggaagtggaggagcacagaaccgtgcgcgtccttgagatggtggaaga

SEQ ID NO: 357508 - DNA, 75 bp, Artificial Sequence
  Synthetic
tgcgcgtccttgagatggtggaagattggctgcaccgcggcccaaaagagttttgtatcaaggtgctgtgcccat

SEQ ID NO: 357509 - DNA, 75 bp, Artificial Sequence
  Synthetic
ggaggttctgcaacgtcggtacggagggggactggtgcggaacccactgtcacgcaattcgacacatgagatgta

SEQ ID NO: 357510 - DNA, 75 bp, Artificial Sequence
  Synthetic
gggggactggtgcggaacccactgtcacgcaattcgacacatgagatgtactgggtaagccgagcatcggggaac

SEQ ID NO: 357511 - DNA, 75 bp, Artificial Sequence
  Synthetic
gccaggttctcctcggacgcatggagaaaaagacttggaagggtgcccactacgaggaagacgtcaacttgggca

SEQ ID NO: 357512 - DNA, 75 bp, Artificial Sequence
  Synthetic
gaaaaagacttggaagggtgcccactacgaggaagacgtcaacttgggcagtgggactagggccgttggaaagcc

SEQ ID NO: 357513 - DNA, 75 bp, Artificial Sequence
  Synthetic
atccgcaaccggattgagcgattgaaaaaagaatacagctccacttggcatcaggatgacaaccacccgtacaga

SEQ ID NO: 357514 - DNA, 75 bp, Artificial Sequence
  Synthetic
aaaaagaatacagctccacttggcatcaggatgacaaccacccgtacagaacctggaactaccacgggagctacg

SEQ ID NO: 357515 - DNA, 75 bp, Artificial Sequence
  Synthetic
ctcattggtgaatggcgttgtgcgcctgttgtcgaagccatgggacacaataacaaacgtcaccaccatggccat

SEQ ID NO: 357516 - DNA, 75 bp, Artificial Sequence
  Synthetic
aagaatggaaaaaaggacctggaagggaccccaatatgaggaagatgtaaacttgggaagtggaaccagggcggt

SEQ ID NO: 357517 - DNA, 75 bp, Artificial Sequence
  Synthetic
accacaaactggctgtggaccttcttggcaagaaacaagcgaccacgcatgtgcaccagagaggaattcattagc

SEQ ID NO: 357518 - DNA, 75 bp, Artificial Sequence
  Synthetic
gagccatgttcgaagaacaaaaccaatggtcgaacgctcgcgaggcggtggaagaccccaagttctgggaaatgg

SEQ ID NO: 357519 - DNA, 75 bp, Artificial Sequence
  Synthetic
atggtcgaacgctcgcgaggcggtggaagaccccaagttctgggaaatggttgacgatgagcgtgaggcacatct

SEQ ID NO: 357520 - DNA, 75 bp, Artificial Sequence
  Synthetic
gaagaccccaagttctgggaaatggttgacgatgagcgtgaggcacatctccgtggcgaatgctacacctgcatt

SEQ ID NO: 357521 - DNA, 75 bp, Artificial Sequence
  Synthetic
agaaacccggggagtttggaaaagcgaaaggaagccgagccatatggttcatgtggctaggagcccgctttctgg

SEQ ID NO: 357522 - DNA, 75 bp, Artificial Sequence
  Synthetic
gaaaggaagccgagccatatggttcatgtggctaggagcccgctttctggagttcgaggctctggggtttttgaa

SEQ ID NO: 357523 - DNA, 75 bp, Artificial Sequence
  Synthetic
attgcagtacactggcacggatggaccttgcaaagttcccatctcgtcagtggcttcattgaacgacctaacacc

SEQ ID NO: 357524 - DNA, 75 bp, Artificial Sequence
  Synthetic
aattctggaggaggtgttgagggactcggtctgcaaaagcttggctacgttctcagggaagtggggacgaagcct

SEQ ID NO: 357525 - DNA, 75 bp, Artificial Sequence
  Synthetic
tcggtctgcaaaagcttggctacgttctcagggaagtggggacgaagcctggaggaaagatgtacgctgacgaca

SEQ ID NO: 357526 - DNA, 75 bp, Artificial Sequence
  Synthetic
taaagctgacctggaaaatgaagcaaaagtgttggagtttctcgatggcgagcatcgccgtctagccagatccgt

SEQ ID NO: 357527 - DNA, 75 bp, Artificial Sequence
  Synthetic
aaagtgttggagtttctcgatggcgagcatcgccgtctagccagatccgtgattgagctcacataccgccacaag

SEQ ID NO: 357528 - DNA, 75 bp, Artificial Sequence
  Synthetic
tcggaggaaagactgtgatggacataatctcacgggaggaccaaagaggcagcgggcaagttgtgacctacgccc

SEQ ID NO: 357529 - DNA, 75 bp, Artificial Sequence
  Synthetic
acagctcgtgaggatgatggaaggcgaaggggtgattggacctgacgatgtggagaagctggggaaaggcaaagg

SEQ ID NO: 357530 - DNA, 75 bp, Artificial Sequence
  Synthetic
ataacgcagggattgctgggggctcttctgttgtggatgggcatcaatgctcgtgacaggtccatagctctcacg

SEQ ID NO: 357531 - DNA, 75 bp, Artificial Sequence
  Synthetic
gagaatggtgaggaaagactcagtcgcatggccgtcagcggagacgattgtgtggtgaagccactcgatgatcgg

SEQ ID NO: 357532 - DNA, 75 bp, Artificial Sequence
  Synthetic
gcatggccgtcagcggagacgattgtgtggtgaagccactcgatgatcggttcgcaacctcgctccattttctaa

SEQ ID NO: 357533 - DNA, 75 bp, Artificial Sequence
  Synthetic
tatccaggagtggaaaccttctactggctggtatgactggcagcaggtccccttttgctccaaccacttcacgga

SEQ ID NO: 357534 - DNA, 75 bp, Artificial Sequence
  Synthetic
ccttttgctccaaccacttcacggaactgatcatgaaagatggccggaccctggtggtcccctgccgtggacagg

SEQ ID NO: 357535 - DNA, 75 bp, Artificial Sequence
  Synthetic
ctcccctggtgcgggttggaacgttcgtgacacagcatgtctagcgaagtcgtacgcacaaatgtggcagctgtt

SEQ ID NO: 357536 - DNA, 75 bp, Artificial Sequence
  Synthetic
gcgagaggcgagtggatgaccacagcagacatgctgggcgtgtggaatcgagtctggatagaagaaaatgaatgg

SEQ ID NO: 357537 - DNA, 75 bp, Artificial Sequence
  Synthetic
atggaagacaagacacccgtcgaaaggtggtcagacgttccatactcggggaaacgtgaagacatctggtgcgga

SEQ ID NO: 357538 - DNA, 75 bp, Artificial Sequence
  Synthetic
agccgcgtgtccaaccatgggtgaagcccacaacgagaaaagagctgaccccgccttcgtttgcaagcaaggcgt

SEQ ID NO: 357539 - DNA, 75 bp, Artificial Sequence
  Synthetic
cgacatgggctgagaacatccaggtggccatcaaccaggtccgcgcagtgataggcgaggagaaatatgtcgatt

SEQ ID NO: 357540 - DNA, 75 bp, Artificial Sequence
  Synthetic
ggagcctaccccggaagaagattcagtgttgtgaagctaacacacacacaccccatgtacatactctgcaaataa

SEQ ID NO: 357541 - DNA, 75 bp, Artificial Sequence
  Synthetic
ccaaacaatctgttgtggctctagggtcgcaggaaggtgctttgcaccaagctctggccggagcgattcctgttg

SEQ ID NO: 357542 - DNA, 75 bp, Artificial Sequence
  Synthetic
tgtagtcaggccggcaaacgccgccaccggaagttgggtatacggtgctgcctgtgacccaaccccaggaggact

SEQ ID NO: 357543 - DNA, 75 bp, Artificial Sequence
  Synthetic
gggatatcaaagccatggagcgatccacgtaagccctcaataccgtttcggaacgaggaccccacgtgttgtagc

SEQ ID NO: 357544 - DNA, 75 bp, Artificial Sequence
  Synthetic
cacgtaagccctcaataccgtttcggaacgaggaccccacgtgttgtagctctgtggaccgcacaaggcgcacat

SEQ ID NO: 357545 - DNA, 75 bp, Artificial Sequence
  Synthetic
gagaagggactagaggttagcggagaccctgcgcatatagaaagagaggcacggcccagcctgacagaagctgta

SEQ ID NO: 357546 - DNA, 75 bp, Artificial Sequence
  Synthetic
ggcctttaccaccacactcagaggagctcaacgactcgcagctcttggagacactgcttgggattttggatcagt

SEQ ID NO: 357547 - DNA, 75 bp, Artificial Sequence
  Synthetic
gaggttagaggagaccccgcggtttaaagtgcacggcccagcctggctgaagctgtaggtcaggggaaggactag

SEQ ID NO: 357548 - DNA, 75 bp, Artificial Sequence
  Synthetic
cattgatattggcaggcaagagctccggtgcggaagtggagtgtttatccacaacgatgtggaagcctggatgga

SEQ ID NO: 357549 - DNA, 75 bp, Artificial Sequence
  Synthetic
tttcgtgatttctgggaaatcaacagacatgtggatcgagaggacggcggacatctcctgggaaagtgatgcaga

SEQ ID NO: 357550 - DNA, 75 bp, Artificial Sequence
  Synthetic
gaggatactatcacttatgaatgtccggtcctagctgctggaaatgaccctgaagacattgactgctggtgcacg

SEQ ID NO: 357551 - DNA, 75 bp, Artificial Sequence
  Synthetic
gtccagacacatggagaaagtacactggccaacaaaaaaggagcttggctggacagcacaaaagccacgagatat

SEQ ID NO: 357552 - DNA, 75 bp, Artificial Sequence
  Synthetic
agaagggagagtgatcctgggagaaccatctgcagtgacagcagctagtgccgcccagagacgtggacgtatcgg

SEQ ID NO: 357553 - DNA, 75 bp, Artificial Sequence
  Synthetic
gacatgggaagcacttgacaccatgtacgttgtggccactgcagagaaaggaggaagagctcacagaatggccct

SEQ ID NO: 357554 - DNA, 75 bp, Artificial Sequence
  Synthetic
ctcccgcagacacaggccacggcactgtagtgttggaattgcagtacactggcacggatggaccttgcaaagttc

SEQ ID NO: 357555 - DNA, 75 bp, Artificial Sequence
  Synthetic
accttgatgtgtacagaattttgctactcatggttggagttggaagcctcatcaaagaaaaaaggagctctgcag

SEQ ID NO: 357556 - DNA, 75 bp, Artificial Sequence
  Synthetic
gttctttagattcactgcaattgctccgactcgtgcggtattggacaggtggagaggcgttaacaaacaaacagc

SEQ ID NO: 357557 - DNA, 75 bp, Artificial Sequence
  Synthetic
ccgactcgtgcggtattggacaggtggagaggcgttaacaaacaaacagcaatgaagcatctcttgagtttcaag

SEQ ID NO: 357558 - DNA, 75 bp, Artificial Sequence
  Synthetic
ccatcaaccgtcggagcgcaaaacaaaagaaaagaggaggtacagcggggttttccatcttgcttgggctgatcg

SEQ ID NO: 357559 - DNA, 75 bp, Artificial Sequence
  Synthetic
aaagaaaagaggaggtacagcggggttttccatcttgcttgggctgatcgcctgcgcaggcgctgttactctctc

SEQ ID NO: 357560 - DNA, 75 bp, Artificial Sequence
  Synthetic
gcaataagtgcctacacaccttgggcaattctcccctcggtcattggattctggataacccttcagtacacaaag

SEQ ID NO: 357561 - DNA, 75 bp, Artificial Sequence
  Synthetic
actgtcaatgcaaccgacatcactgatgtgataaccattccaacagccgccgggaaaaacctatgcatcgtgagg

SEQ ID NO: 357562 - DNA, 75 bp, Artificial Sequence
  Synthetic
atgtgataaccattccaacagccgccgggaaaaacctatgcatcgtgagggccatggacgtgggatacctctgtg

SEQ ID NO: 357563 - DNA, 75 bp, Artificial Sequence
  Synthetic
ttgagaggacggctgatattacttgggaaagtgacgctgaaatcacaggctctagtgaaagagtagatgttaggc

SEQ ID NO: 357564 - DNA, 75 bp, Artificial Sequence
  Synthetic
tgtcttggctgctggaaatgatcctgaagacatagactgctggtgcaccaagtcatccgtctatgtacgctacgg

SEQ ID NO: 357565 - DNA, 75 bp, Artificial Sequence
  Synthetic
gaagacatagactgctggtgcaccaagtcatccgtctatgtacgctacgggaggtgcactaagacccgacattct

SEQ ID NO: 357566 - DNA, 75 bp, Artificial Sequence
  Synthetic
tccaaacccacggtgagagcacactggctaacaagaaaggagcctggctggacagcactaaagctacaagatacc

SEQ ID NO: 357567 - DNA, 75 bp, Artificial Sequence
  Synthetic
ggctaacaagaaaggagcctggctggacagcactaaagctacaagatacctggtcaagacagagtcatggatatt

SEQ ID NO: 357568 - DNA, 75 bp, Artificial Sequence
  Synthetic
gcggcagtcataggatggatgctaggcagcaacacgatgcagcgagttgtgttcgtggtactgttgcttttagta

SEQ ID NO: 357569 - DNA, 75 bp, Artificial Sequence
  Synthetic
gcagcaacacgatgcagcgagttgtgttcgtggtactgttgcttttagtagcgccggcatacagtttcaattgtt

SEQ ID NO: 357570 - DNA, 75 bp, Artificial Sequence
  Synthetic
ggaaggggtatccggggcgacatgggttgatctggtgctggaaggcgacagttgcgtaaccataatgtcaaagga

SEQ ID NO: 357571 - DNA, 75 bp, Artificial Sequence
  Synthetic
gttgatctggtgctggaaggcgacagttgcgtaaccataatgtcaaaggataaaccaaccatcgacgttaagatg

SEQ ID NO: 357572 - DNA, 75 bp, Artificial Sequence
  Synthetic
cagacgtgcgccattattgttatctggcctcagtcagtgagttatcaacaagagccgcatgcccaaccatgggag

SEQ ID NO: 357573 - DNA, 75 bp, Artificial Sequence
  Synthetic
ggcctcagtcagtgagttatcaacaagagccgcatgcccaaccatgggagaagcccataatgagaaaagagctga

SEQ ID NO: 357574 - DNA, 75 bp, Artificial Sequence
  Synthetic
gttgtggacagaggatggggaaacggatgtggactgtttgggaaaggcagcatcgacacatgcgcgaagtttgcc

SEQ ID NO: 357575 - DNA, 75 bp, Artificial Sequence
  Synthetic
gatgtggactgtttgggaaaggcagcatcgacacatgcgcgaagtttgcctgtacaactaaagcgaccggctgga

SEQ ID NO: 357576 - DNA, 75 bp, Artificial Sequence
  Synthetic
tgaagtagccattttcgtccacggaccgacaactgttgaatcccatggtaactacccaacgcaggttggagccac

SEQ ID NO: 357577 - DNA, 75 bp, Artificial Sequence
  Synthetic
ccgacaactgttgaatcccatggtaactacccaacgcaggttggagccactcaagctggaagattcagtatcact

SEQ ID NO: 357578 - DNA, 75 bp, Artificial Sequence
  Synthetic
acggggaaccgcaaaattacggtggttagtggaaaggcgtttcctcgagccagtgggaaaggttgtggatctcgg

SEQ ID NO: 357579 - DNA, 75 bp, Artificial Sequence
  Synthetic
agctgggtgactacggcgaagtaacaattgactgtgagccacgatctggaattgacactggtgcctactacgtaa

SEQ ID NO: 357580 - DNA, 75 bp, Artificial Sequence
  Synthetic
aattgactgtgagccacgatctggaattgacactggtgcctactacgtaatgtcagtaggggcaaagtccttctt

SEQ ID NO: 357581 - DNA, 75 bp, Artificial Sequence
  Synthetic
agaccgtttggttcgttccaagtgtgaaaatgggaaatgaaattgccctctgtctgcaacgggcggggaagaagg

SEQ ID NO: 357582 - DNA, 75 bp, Artificial Sequence
  Synthetic
ctgaacctgccatggagcagtgctggaggcaccacatggagaaatcgagaaacgttgatggaatttgaagagcct

SEQ ID NO: 357583 - DNA, 75 bp, Artificial Sequence
  Synthetic
tcctgaaccgccagaaggagtgaagtacgtgctcaacgagaccaccaactggttgtgggcgtttttggccagaga

SEQ ID NO: 357584 - DNA, 75 bp, Artificial Sequence
  Synthetic
gaggcaccacatggagaaatcgagaaacgttgatggaatttgaagagcctcatgctaccaaacaatctgtagtgg

SEQ ID NO: 357585 - DNA, 75 bp, Artificial Sequence
  Synthetic
acatcaagccttggctggagcaatccctgttgagttttcaagcaacaccgtcactctgacgtcaggacatctcaa

SEQ ID NO: 357586 - DNA, 75 bp, Artificial Sequence
  Synthetic
cctgttgagttttcaagcaacaccgtcactctgacgtcaggacatctcaaatgtagggtgaggatggagaagttg

SEQ ID NO: 357587 - DNA, 75 bp, Artificial Sequence
  Synthetic
aggccatcatcgaagtcgatcgctcagcagcaaaacacgccaggaaagaaggcaatgtcaccggagggcatccag

SEQ ID NO: 357588 - DNA, 75 bp, Artificial Sequence
  Synthetic
tgtgctcaaaagcattcaaatttgttggcactcctgctgacactggccatggcacagttgtgctggagctgcagt

SEQ ID NO: 357589 - DNA, 75 bp, Artificial Sequence
  Synthetic
gctgcctgcgactcaaccccaggaggactgggtgaacaaaagccgcgaagtgatccatgtaagccctcagaaccg

SEQ ID NO: 357590 - DNA, 75 bp, Artificial Sequence
  Synthetic
tggcactcctgctgacactggccatggcacagttgtgctggagctgcagtacactggaacagacgggccctgtaa

SEQ ID NO: 357591 - DNA, 75 bp, Artificial Sequence
  Synthetic
ttgaatgatctcacacctgttgggagactggtaactgtgaatccattcgtgtctgtagctacggctaattcgaag

SEQ ID NO: 357592 - DNA, 75 bp, Artificial Sequence
  Synthetic
actggctgggtaggaagaactcaggaggaggagttgaaggcttaggactgcagaagcttgggtacatcttgaagg

SEQ ID NO: 357593 - DNA, 75 bp, Artificial Sequence
  Synthetic
gactggtaactgtgaatccattcgtgtctgtagctacggctaattcgaaggttttgattgagctagaacctccgt

SEQ ID NO: 357594 - DNA, 75 bp, Artificial Sequence
  Synthetic
ggaagagtcatcctgggggaaccctcagccatcacggctgccagcgctgctcagcggagaggacgcataggaaga

SEQ ID NO: 357595 - DNA, 75 bp, Artificial Sequence
  Synthetic
aagaggtgagcaacaaataaatcaccattggcacaagtctgggagtagcattggaaaggctttcaccaccaccct

SEQ ID NO: 357596 - DNA, 75 bp, Artificial Sequence
  Synthetic
cattggcacaagtctgggagtagcattggaaaggctttcaccaccacccttagaggagcacaacgactggcagcc

SEQ ID NO: 357597 - DNA, 75 bp, Artificial Sequence
  Synthetic
gatctgtaggaggagttttcacctcagtgggaaaagctatccaccaagtttttggaggagcctttagatcgctct

SEQ ID NO: 357598 - DNA, 75 bp, Artificial Sequence
  Synthetic
agtgggaaaagctatccaccaagtttttggaggagcctttagatcgctctttggaggaatgtcttggatcacgca

SEQ ID NO: 357599 - DNA, 75 bp, Artificial Sequence
  Synthetic
gattgctggcgtgggagcagtcactctctccaactttcaagggaaggtgatgatgacggtgaacgctactgacgt

SEQ ID NO: 357600 - DNA, 75 bp, Artificial Sequence
  Synthetic
tggatgggaatcaacgcccgtgacaggtcaattgctatgacgttccttgctgtgggaggaatcctactctttctc

SEQ ID NO: 357601 - DNA, 75 bp, Artificial Sequence
  Synthetic
ggtcaattgctatgacgttccttgctgtgggaggaatcctactctttctctcagttaacgtccatgcggacacag

SEQ ID NO: 357602 - DNA, 75 bp, Artificial Sequence
  Synthetic
agaactccgctgtgggagtggagtgttcatccacaatgatgtggaagcgtggatcgatcgctacaagttttaccc

SEQ ID NO: 357603 - DNA, 75 bp, Artificial Sequence
  Synthetic
ttcatccacaatgatgtggaagcgtggatcgatcgctacaagttttacccggagactccacaaggcttggcgaaa

SEQ ID NO: 357604 - DNA, 75 bp, Artificial Sequence
  Synthetic
gaatttgcggcctgcgatcagtctcaagactggagcaccagatgtgggaagccatcaaggatgagttgaacacct

SEQ ID NO: 357605 - DNA, 75 bp, Artificial Sequence
  Synthetic
tgagtacagttcaacgtggcatcacgatgagaaccacccatacagaacctggaactatcacggcagttatgacgt

SEQ ID NO: 357606 - DNA, 75 bp, Artificial Sequence
  Synthetic
aagactggagcaccagatgtgggaagccatcaaggatgagttgaacaccttgctcaaagagaacggagttgactt

SEQ ID NO: 357607 - DNA, 75 bp, Artificial Sequence
  Synthetic
ggatggacagcaccaaggctacaaggtacttggtaaaaacagaatcatggatcttgagaaaccctggatatgcct

SEQ ID NO: 357608 - DNA, 75 bp, Artificial Sequence
  Synthetic
gggctgtataaggctgcccctagacgattgactgccaccactgagaaacttgagatgggttggaaggcttgggga

SEQ ID NO: 357609 - DNA, 75 bp, Artificial Sequence
  Synthetic
gattgactgccaccactgagaaacttgagatgggttggaaggcttggggaaagagcattatctttgctccggagt

SEQ ID NO: 357610 - DNA, 75 bp, Artificial Sequence
  Synthetic
gtgtgctcacactggtcagcgccgtggctgccaatgaaatgggctggctggacaaaaccaagaatgacattagca

SEQ ID NO: 357611 - DNA, 75 bp, Artificial Sequence
  Synthetic
tggccctgagactgaagaatgtccaacaaccagccgcgcttggaacagtatggaggttgaagactttgggtttgg

SEQ ID NO: 357612 - DNA, 75 bp, Artificial Sequence
  Synthetic
acaaccagccgcgcttggaacagtatggaggttgaagactttgggtttgggctaacgagcacacgcatgttcctt

SEQ ID NO: 357613 - DNA, 75 bp, Artificial Sequence
  Synthetic
aatgtgactcgaagatcataggaactgccgttaagaacaacatggccgtgcatagtgatctgtcatattggatag

SEQ ID NO: 357614 - DNA, 75 bp, Artificial Sequence
  Synthetic
tgccgttaagaacaacatggccgtgcatagtgatctgtcatattggatagaaagtgggtttaatgagacctggaa

SEQ ID NO: 357615 - DNA, 75 bp, Artificial Sequence
  Synthetic
gtcaaatcatgcacctggccagagacccataccctgtggggtgatggagtcttggaaagtgagctcattatacca

SEQ ID NO: 357616 - DNA, 75 bp, Artificial Sequence
  Synthetic
acccggagagttcggaaaggccaagggaagcagagccatatggttcatgtggctcggagctcgctttctggagtt

SEQ ID NO: 357617 - DNA, 75 bp, Artificial Sequence
  Synthetic
gaaactagagagacgaccctgggagttgagaactttttgcttgatttgcggccggctacggcatggtcgctctat

SEQ ID NO: 357618 - DNA, 75 bp, Artificial Sequence
  Synthetic
cccataccctgtggggtgatggagtcttggaaagtgagctcattataccaatcactctagcgggacccaggagca

SEQ ID NO: 357619 - DNA, 75 bp, Artificial Sequence
  Synthetic
gactcagaaccaaggtccatgggatgaaggtcgcattgagattgactttgactattgcccagggactacagtgac

SEQ ID NO: 357620 - DNA, 75 bp, Artificial Sequence
  Synthetic
gaaggtcgcattgagattgactttgactattgcccagggactacagtgaccataagtgccagttgtgggcatcgc

SEQ ID NO: 357621 - DNA, 75 bp, Artificial Sequence
  Synthetic
agagtgggaaactcatcactgattggtgttgtagaagctgcactcttccccccctgcgttacaccactgagagcg

SEQ ID NO: 357622 - DNA, 75 bp, Artificial Sequence
  Synthetic
cccctgcgttacaccactgagagcggatgttggtatggaatggaaattagaccgctaaggcatgatgagaaaact

SEQ ID NO: 357623 - DNA, 75 bp, Artificial Sequence
  Synthetic
actgggtgaacaaagccgcgaagtgatccatgtaagccctcagaaccgtctcggaaggaggaccccacatgttgt

SEQ ID NO: 357624 - DNA, 75 bp, Artificial Sequence
  Synthetic
ttggccacccaggaggtccttcgcaagaggtggacggccaagatcagcgttccagccatcctgcttgctctctta

SEQ ID NO: 357625 - DNA, 75 bp, Artificial Sequence
  Synthetic
ggactagaggttagaggagaccccgcggtttaaagtgcacggcccagcctggctgaagctgtaggtcaggggaag

SEQ ID NO: 357626 - DNA, 75 bp, Artificial Sequence
  Synthetic
acactgatgttttgagatatgtgatccttgttggagccgcgttcgctgaggcgaactcgggcggagacgttgtgc

SEQ ID NO: 357627 - DNA, 75 bp, Artificial Sequence
  Synthetic
ccttgttggagccgcgttcgctgaggcgaactcgggcggagacgttgtgcatctggcgctcatggccacattcag

SEQ ID NO: 357628 - DNA, 75 bp, Artificial Sequence
  Synthetic
tcctttttgaaggcgagatggaccaaccaagagaacatcttactcatgcttgccgctgcctttttccagatgggg

SEQ ID NO: 357629 - DNA, 75 bp, Artificial Sequence
  Synthetic
accaagagaacatcttactcatgcttgccgctgcctttttccagatggggttctacgacgctaagcaagtcttgg

SEQ ID NO: 357630 - DNA, 75 bp, Artificial Sequence
  Synthetic
ttcgctttctgtggcatggatgatcctcagggccataagcttcaccaacacttccaatgtggtggtgccactgtt

SEQ ID NO: 357631 - DNA, 75 bp, Artificial Sequence
  Synthetic
ctcagggccataagcttcaccaacacttccaatgtggtggtgccactgttggccttgttgacacccggattgaga

SEQ ID NO: 357632 - DNA, 75 bp, Artificial Sequence
  Synthetic
ttgtgttgctcatgattggcattgggagcttgatcaaggaaaagaagaattctgcagcaaaaaagaaaggagcta

SEQ ID NO: 357633 - DNA, 75 bp, Artificial Sequence
  Synthetic
gagcttgatcaaggaaaagaagaattctgcagcaaaaaagaaaggagctagcctcatctgcttggcattggcttc

SEQ ID NO: 357634 - DNA, 75 bp, Artificial Sequence
  Synthetic
cttgcagctggattgattgcgtgtgaccctaaccgcaagcggggatggcctgctacagaagtcatgactgctgtt

SEQ ID NO: 357635 - DNA, 75 bp, Artificial Sequence
  Synthetic
accctaaccgcaagcggggatggcctgctacagaagtcatgactgctgttggacttatgtttgccatcgttggag

SEQ ID NO: 357636 - DNA, 75 bp, Artificial Sequence
  Synthetic
catggctattcctatgaccatagctggcctcatgtttgtggcgtttgtcatctcaggaaaatcaacagatatgtg

SEQ ID NO: 357637 - DNA, 75 bp, Artificial Sequence
  Synthetic
ggcctcatgtttgtggcgtttgtcatctcaggaaaatcaacagatatgtggatagaaaggacagcagatatcacc

SEQ ID NO: 357638 - DNA, 75 bp, Artificial Sequence
  Synthetic
gctcaagtgaaagagttgatgtgcgacttgatgatgatgggaacttccagctgatgaacgatcctggagcaccgt

SEQ ID NO: 357639 - DNA, 75 bp, Artificial Sequence
  Synthetic
agacaacacaagcatgtatgtaggtataggtttatagtggcatttaatgatgttagtgtaaataggtaagaaaat

SEQ ID NO: 357640 - DNA, 75 bp, Artificial Sequence
  Synthetic
acttgatgatgatgggaacttccagctgatgaacgatcctggagcaccgtggaaaatctggatgctcaggatggc

SEQ ID NO: 357641 - DNA, 75 bp, Artificial Sequence
  Synthetic
ccctgggctatcctcccttcagttattgggttttggattacccttcaatacacgaaacgtggtggtgtcttgtgg

SEQ ID NO: 357642 - DNA, 75 bp, Artificial Sequence
  Synthetic
gtcaaggagaatttcagcatgggagagtttcttctggacttgagaccggcaacagcctggtcactgtacgctgtg

SEQ ID NO: 357643 - DNA, 75 bp, Artificial Sequence
  Synthetic
gcagaggagaacaacagattaatcaccattggcacaagtctggaagcagcattggcaaagcctttacaaccaccc

SEQ ID NO: 357644 - DNA, 75 bp, Artificial Sequence
  Synthetic
ttgggttttggattacccttcaatacacgaaacgtggtggtgtcttgtgggacacgccatcccccaaggagtaca

SEQ ID NO: 357645 - DNA, 75 bp, Artificial Sequence
  Synthetic
tttggagactcatacatagtggtgggcagaggagaacaacagattaatcaccattggcacaagtctggaagcagc

SEQ ID NO: 357646 - DNA, 75 bp, Artificial Sequence
  Synthetic
ctacaggataatgacccgtggactgcttggaagctatcaggctggagcaggggtgatggtagaaggagttttcca

SEQ ID NO: 357647 - DNA, 75 bp, Artificial Sequence
  Synthetic
cttggaagctatcaggctggagcaggggtgatggtagaaggagttttccatacactgtggcacacaaccaaggga

SEQ ID NO: 357648 - DNA, 75 bp, Artificial Sequence
  Synthetic
ggctagatccttactggggaagtgtaaaggaggaccgactttgctacggaggaccatggaagctccaacacaaat

SEQ ID NO: 357649 - DNA, 75 bp, Artificial Sequence
  Synthetic
aaaggaggaccgactttgctacggaggaccatggaagctccaacacaaatggaatgggcacgacgaggtccaaat

SEQ ID NO: 357650 - DNA, 75 bp, Artificial Sequence
  Synthetic
gtgaagaacgttcaaaccaagcccggagtgtttaagacaccggaaggagagattggagccgtgacactggattat

SEQ ID NO: 357651 - DNA, 75 bp, Artificial Sequence
  Synthetic
gagtgtttaagacaccggaaggagagattggagccgtgacactggattatcccactgggacatcaggatctccca

SEQ ID NO: 357652 - DNA, 75 bp, Artificial Sequence
  Synthetic
aagaaacccaggatgtgttcccgggaggaattcattggaaaagtcaacagtaatgccgccctaggagcgatgttt

SEQ ID NO: 357653 - DNA, 75 bp, Artificial Sequence
  Synthetic
tgggttgtatggcaacggcgtcatcatgccaaatggttcgtacataagtgccattgtccagggtgagagaatgga

SEQ ID NO: 357654 - DNA, 75 bp, Artificial Sequence
  Synthetic
ggggtccttgagagtgacctaataataccaatcacgctagcgggaccgcgaagcaaccacaaccggaggcctggg

SEQ ID NO: 357655 - DNA, 75 bp, Artificial Sequence
  Synthetic
atgccaaatggttcgtacataagtgccattgtccagggtgagagaatggaagaaccagcgccagcaggctttgaa

SEQ ID NO: 357656 - DNA, 75 bp, Artificial Sequence
  Synthetic
tataaaacacaaagccagggtccatgggatgaaggtcgagtggagattgactttgattactgtccagggacaacg

SEQ ID NO: 357657 - DNA, 75 bp, Artificial Sequence
  Synthetic
tcactgttctcgacttgcatcctggagctggaaagacacgtaaaatattacctcaaattattagagaagctatta

SEQ ID NO: 357658 - DNA, 75 bp, Artificial Sequence
  Synthetic
agctggaaagacacgtaaaatattacctcaaattattagagaagctattaacagaaggctgagaacagcagtgct

SEQ ID NO: 357659 - DNA, 75 bp, Artificial Sequence
  Synthetic
gaaatggctgaagctttgagaggacttcctatccggtatcaaacctccgcggtgcacagggagcacaatgggagc

SEQ ID NO: 357660 - DNA, 75 bp, Artificial Sequence
  Synthetic
ttcctatccggtatcaaacctccgcggtgcacagggagcacaatgggagcgagattgttgatgtaatgtgccatg

SEQ ID NO: 357661 - DNA, 75 bp, Artificial Sequence
  Synthetic
cccccacagagttcccaactacaacttgttcataatggatgaagcccacttcaccgacccggcgagcattgcggc

SEQ ID NO: 357662 - DNA, 75 bp, Artificial Sequence
  Synthetic
ttgttcataatggatgaagcccacttcaccgacccggcgagcattgcggctaggggatacatagcaaccagagtt

SEQ ID NO: 357663 - DNA, 75 bp, Artificial Sequence
  Synthetic
ttatgacagcgacacctccaggaacctcagacccctttccagagtcaaacgctcccatctcagacatgcaaacag

SEQ ID NO: 357664 - DNA, 75 bp, Artificial Sequence
  Synthetic
ctcagacccctttccagagtcaaacgctcccatctcagacatgcaaacagaaattcctgacagagcttggaattc

SEQ ID NO: 357665 - DNA, 75 bp, Artificial Sequence
  Synthetic
ggctggtaatgatccagaagacatcgactgttggtgcacaaagtcagcagtctacgtcaggtatggaagatgcac

SEQ ID NO: 357666 - DNA, 75 bp, Artificial Sequence
  Synthetic
gtcgggaaaactgtgtggtttgttccaagtgtgaagatggggaatgagatcgctctttgcctgcagcgggcagga

SEQ ID NO: 357667 - DNA, 75 bp, Artificial Sequence
  Synthetic
caagtgtgaagatggggaatgagatcgctctttgcctgcagcgggcaggaaagagagtcatacagctgaacagga

SEQ ID NO: 357668 - DNA, 75 bp, Artificial Sequence
  Synthetic
ttttacggaactgatcatgaaggacggcaggacgctggtggtcccgtgtcgtggacaagacgagttgattggacg

SEQ ID NO: 357669 - DNA, 75 bp, Artificial Sequence
  Synthetic
gtgtaagaatgatgactgggattttgtcatcaccacagacatatctgaaatgggggccaacttcaaagccaatag

SEQ ID NO: 357670 - DNA, 75 bp, Artificial Sequence
  Synthetic
gtcatcaccacagacatatctgaaatgggggccaacttcaaagccaatagagtgattgacagccgcaagagcgtg

SEQ ID NO: 357671 - DNA, 75 bp, Artificial Sequence
  Synthetic
acggaagagtcatcttgggcgagccctccgccatcacggccgctagcgccgcccagcggagggggcgcataggga

SEQ ID NO: 357672 - DNA, 75 bp, Artificial Sequence
  Synthetic
ctccgccatcacggccgctagcgccgcccagcggagggggcgcatagggagaaatccatcgcaggttggtgatga

SEQ ID NO: 357673 - DNA, 75 bp, Artificial Sequence
  Synthetic
ccctggtggcagccgtcattggttggatgcttgggagcaacaccatgcagagagttgtgtttgtcgtgctattgc

SEQ ID NO: 357674 - DNA, 75 bp, Artificial Sequence
  Synthetic
gaagatgattccaattttgctcactggacggaggctcgtataatgcttgacaatatcaacatgccaaacggtctt

SEQ ID NO: 357675 - DNA, 75 bp, Artificial Sequence
  Synthetic
ggacggaggctcgtataatgcttgacaatatcaacatgccaaacggtcttgtggcccagctgtaccaacctgagc

SEQ ID NO: 357676 - DNA, 75 bp, Artificial Sequence
  Synthetic
aggacggcaggacgttggtggtcccgtgtcgtggacaagacgagttgattggacgggccagaatctctccagggg

SEQ ID NO: 357677 - DNA, 75 bp, Artificial Sequence
  Synthetic
ggaatacagacttaggggtgaggaaaggaagaattttctcgaattcctgaggaccgcagaccttccagtttggtt

SEQ ID NO: 357678 - DNA, 75 bp, Artificial Sequence
  Synthetic
cgccatctgttccgctgtgcctgtcaactgggttcccacagggcgtaccacctggtcgatccacgcaaaaggaga

SEQ ID NO: 357679 - DNA, 75 bp, Artificial Sequence
  Synthetic
aactgggttcccacagggcgtaccacctggtcgatccacgcaaaaggagaatggatgacgacagaagacatgctc

SEQ ID NO: 357680 - DNA, 75 bp, Artificial Sequence
  Synthetic
aggaagaattttctcgaattcctgaggaccgcagaccttccagtttggttggcttacaaagtggcagcggctgga

SEQ ID NO: 357681 - DNA, 75 bp, Artificial Sequence
  Synthetic
gaggtatgaagacaccattgtagtggaggacactgttttgtaaataataaagctgtgttgagtagttgtatagtt

SEQ ID NO: 357682 - DNA, 75 bp, Artificial Sequence
  Synthetic
gctttgatggaccccgaaccaacaccattcttgaagacaacaacgaggttgaagtcatcacaaagttgggtgaga

SEQ ID NO: 357683 - DNA, 75 bp, Artificial Sequence
  Synthetic
ggcgtttctggccagagaaaaacgtcccagaatgtgctctcgagaggaattcataagaaaggtcaacagcaatgc

SEQ ID NO: 357684 - DNA, 75 bp, Artificial Sequence
  Synthetic
cattcttgaagacaacaacgaggttgaagtcatcacaaagttgggtgagaggaaaattctaagacccagatgggc

SEQ ID NO: 357685 - DNA, 75 bp, Artificial Sequence
  Synthetic
caagccttgaagtccttcaaagactttgcatcggggaaacgctcacaaattgggcttgttgaagtacttggaaga

SEQ ID NO: 357686 - DNA, 75 bp, Artificial Sequence
  Synthetic
ttgcatcggggaaacgctcacaaattgggcttgttgaagtacttggaagaatgccagaacacttcatggggaaga

SEQ ID NO: 357687 - DNA, 75 bp, Artificial Sequence
  Synthetic
tgtggttgccaccgcggaaaaggggggtcgggctcacaggatggctcttgaggaacttccagacgcactccagac

SEQ ID NO: 357688 - DNA, 75 bp, Artificial Sequence
  Synthetic
ggtcgggctcacaggatggctcttgaggaacttccagacgcactccagacaatagctttgatcgcgctgctaagc

SEQ ID NO: 357689 - DNA, 75 bp, Artificial Sequence
  Synthetic
gccactctgcggagagtgcagtctgcgatagtgccccaggtggactgggttaacaaaggcaaaacatcgccccac

SEQ ID NO: 357690 - DNA, 75 bp, Artificial Sequence
  Synthetic
tgctcatgcagagaaaaggcatcggcaagattggtttgggaggagtgatcttaggagctgccacgttcttttgct

SEQ ID NO: 357691 - DNA, 75 bp, Artificial Sequence
  Synthetic
caagattggtttgggaggagtgatcttaggagctgccacgttcttttgctggatggctgatgtacctggaacaaa

SEQ ID NO: 357692 - DNA, 75 bp, Artificial Sequence
  Synthetic
gcacggcccaacttggctgaagctgtaagccaagggaaggactagaggttagaggagaccccgtgccaaaaacac

SEQ ID NO: 357693 - DNA, 75 bp, Artificial Sequence
  Synthetic
ctgttgctcatgattgttctgattccagaacctgaaaagcagcgctcacagactgataaccagcttgccgtgttc

SEQ ID NO: 357694 - DNA, 75 bp, Artificial Sequence
  Synthetic
gattgaccttggatgtggaagaggcggttggtgttactatatggcaacccaaaaaagagtccaagaagtcagagg

SEQ ID NO: 357695 - DNA, 75 bp, Artificial Sequence
  Synthetic
cagaacctgaaaagcagcgctcacagactgataaccagcttgccgtgttcttgatatgtgtgctcacgctggtaa

SEQ ID NO: 357696 - DNA, 75 bp, Artificial Sequence
  Synthetic
atggttggacaagaccaagaatgacattggccgcctgctcggctacaaattggaagtaaaagagacaggtcttgg

SEQ ID NO: 357697 - DNA, 75 bp, Artificial Sequence
  Synthetic
attggccgcctgctcggctacaaattggaagtaaaagagacaggtcttgggattgagagttttttgctcgacttg

SEQ ID NO: 357698 - DNA, 75 bp, Artificial Sequence
  Synthetic
acgccgtggccacggctgtactcactccgctgctgaagcacctgatcacatcagattacatcaatacctcgctga

SEQ ID NO: 357699 - DNA, 75 bp, Artificial Sequence
  Synthetic
tccgctgctgaagcacctgatcacatcagattacatcaatacctcgctgacctcgatcaatgtccaagctagtgc

SEQ ID NO: 357700 - DNA, 75 bp, Artificial Sequence
  Synthetic
ccctttgtagacgtcggtgtgtcagctctcttgctggcagctgggtgttgggggcaggtaactctgaccgtgact

SEQ ID NO: 357701 - DNA, 75 bp, Artificial Sequence
  Synthetic
ctctcttgctggcagctgggtgttgggggcaggtaactctgaccgtgactgtgactgcggccatcttgctcttct

SEQ ID NO: 357702 - DNA, 75 bp, Artificial Sequence
  Synthetic
tcaaccccaggaggactgggtgaacaaagccgcgaagtgatccatgtaagccctcaggataacgaactgagtcgg

SEQ ID NO: 357703 - DNA, 75 bp, Artificial Sequence
  Synthetic
ttggcaggcggaagccatgcgatctgcgcagcgacgcactgccgccggaattatgaagaatgcggtcgtggatgg

SEQ ID NO: 357704 - DNA, 75 bp, Artificial Sequence
  Synthetic
gcgcagcgacgcactgccgccggaattatgaagaatgcggtcgtggatggaattgtggccactgatgtgcctgaa

SEQ ID NO: 357705 - DNA, 75 bp, Artificial Sequence
  Synthetic
agaaaaaggttgggcaaatcatgctgattctggtgtcagtggcggcagttgtcgtcaacccgtcggtgagaactg

SEQ ID NO: 357706 - DNA, 75 bp, Artificial Sequence
  Synthetic
gattctggtgtcagtggcggcagttgtcgtcaacccgtcggtgagaactgtcagggaagccggaatcttgacatc

SEQ ID NO: 357707 - DNA, 75 bp, Artificial Sequence
  Synthetic
aatggagctagctcagtgtggaacgcaacaacagccatcggtctctgtcacgtcatgaggggaggatggctttcg

SEQ ID NO: 357708 - DNA, 75 bp, Artificial Sequence
  Synthetic
caacaacagccatcggtctctgtcacgtcatgaggggaggatggctttcgtgcttttccatcacatggaccctca

SEQ ID NO: 357709 - DNA, 75 bp, Artificial Sequence
  Synthetic
cttgattgccttattgagtgtgatgaccatgggagtattctttctcctcatgcagcggaagggcattggaaagat

SEQ ID NO: 357710 - DNA, 75 bp, Artificial Sequence
  Synthetic
gaagagaggtggggccaaaggacgcacactgggtgaggtctggaaggaaaggcttaaccacatgacgaaggaaga

SEQ ID NO: 357711 - DNA, 75 bp, Artificial Sequence
  Synthetic
acactgggtgaggtctggaaggaaaggcttaaccacatgacgaaggaagaatttaccaggtataggagagaagcc

SEQ ID NO: 357712 - DNA, 75 bp, Artificial Sequence
  Synthetic
taaggaaggagtgtgcggtctacgatcagtttccagactggagcatcaaatgtgggaagcagtgaaggacgagct

SEQ ID NO: 357713 - DNA, 75 bp, Artificial Sequence
  Synthetic
cgaaacatgccagaaaagaaggtaacatcactggagggcacccagtctcacgaggcactgcaaaactacgatggc

SEQ ID NO: 357714 - DNA, 75 bp, Artificial Sequence
  Synthetic
catcactggagggcacccagtctcacgaggcactgcaaaactacgatggctggtggaaaggcggtttcttgagcc

SEQ ID NO: 357715 - DNA, 75 bp, Artificial Sequence
  Synthetic
atgtatataggtataggtttatagtggtattcaatgatgctagtgtaaatagttaagaaaattttaaagaggaag

SEQ ID NO: 357716 - DNA, 75 bp, Artificial Sequence
  Synthetic
tgtggtagaggtggctggtgttattatatggctactcagaagaaggtacaggaagtgaaagggtatacaaaagga

SEQ ID NO: 357717 - DNA, 75 bp, Artificial Sequence
  Synthetic
atatggctactcagaagaaggtacaggaagtgaaagggtatacaaaaggaggccccggccatgaagaaccacaat

SEQ ID NO: 357718 - DNA, 75 bp, Artificial Sequence
  Synthetic
gatgctgaggaaaaaacagatcactgtactggatctccatcccggcgccggtaaaacaaggaggattctgccaca

SEQ ID NO: 357719 - DNA, 75 bp, Artificial Sequence
  Synthetic
tgtcacgatgaaaagtggggttgatgtcttctacagaccgtcagaagtgagcgacacactactctgtgatattgg

SEQ ID NO: 357720 - DNA, 75 bp, Artificial Sequence
  Synthetic
gtcttctacagaccgtcagaagtgagcgacacactactctgtgatattggagagtcatcttcgagcgctgaagta

SEQ ID NO: 357721 - DNA, 75 bp, Artificial Sequence
  Synthetic
tggagatggttgaggattggttacacagaggcccaaaagagttctgcatcaaggtgctatgcccttacatgccaa

SEQ ID NO: 357722 - DNA, 75 bp, Artificial Sequence
  Synthetic
cagaggcccaaaagagttctgcatcaaggtgctatgcccttacatgccaaaggtgattgagaagatggagacact

SEQ ID NO: 357723 - DNA, 75 bp, Artificial Sequence
  Synthetic
gtgagaaatcccctctcacgcaattccactcatgaaatgtactgggtgagccacgcctcaggtaacattgtccac

SEQ ID NO: 357724 - DNA, 75 bp, Artificial Sequence
  Synthetic
ccactcatgaaatgtactgggtgagccacgcctcaggtaacattgtccactccgtcaacatgacgagccaagtac

SEQ ID NO: 357725 - DNA, 75 bp, Artificial Sequence
  Synthetic
ctggaagggacctcagtatgaagaagatgccaatttagggagcggaacacgagcggtggggaagcctctactcaa

SEQ ID NO: 357726 - DNA, 75 bp, Artificial Sequence
  Synthetic
tggacctgcggcacgcacaaccactgagagtgggaagctcatcacagactggtgctgcagaagctgcaccctccc

SEQ ID NO: 357727 - DNA, 75 bp, Artificial Sequence
  Synthetic
gatgccaatttagggagcggaacacgagcggtggggaagcctctactcaattccgacaccagcaagatcaagaat

SEQ ID NO: 357728 - DNA, 75 bp, Artificial Sequence
  Synthetic
acggttccacttggcatcaagatgaaaaccacccatacaggacctggaattaccatgggagctatgaggtgaaac

SEQ ID NO: 357729 - DNA, 75 bp, Artificial Sequence
  Synthetic
aaaccacccatacaggacctggaattaccatgggagctatgaggtgaaaccgacaggctcagccagttcccttgt

SEQ ID NO: 357730 - DNA, 75 bp, Artificial Sequence
  Synthetic
aagccatgggacgtaatcaccaacgtgactacgatggccatgactgacaccactccttttggccagcagcgagtg

SEQ ID NO: 357731 - DNA, 75 bp, Artificial Sequence
  Synthetic
ttcatttttgaaggaaaagtggacgaaccaagagagtattatgctcatgctcgcagctgctttctttcaaatggc

SEQ ID NO: 357732 - DNA, 75 bp, Artificial Sequence
  Synthetic
ttcatttttgaaggaaaagtggacgaaccaagagagtattttgctcatgctcgcagctgctttctttcaaatggc

SEQ ID NO: 357733 - DNA, 75 bp, Artificial Sequence
  Synthetic
ttcatttttgaaggaaaagtggacgaaccaagagagtattctgctcatgctcgcagctgctttctttcaaatggc

SEQ ID NO: 357734 - DNA, 75 bp, Artificial Sequence
  Synthetic
ttcatttttgaaggaaaagtggacgaaccaagagagtattgtgctcatgctcgcagctgctttctttcaaatggc

SEQ ID NO: 357735 - DNA, 75 bp, Artificial Sequence
  Synthetic
ttcatttttgaaggtaaagtggacgaaccaagagagtattatgctcatgctcgcagctgctttctttcaaatggc

SEQ ID NO: 357736 - DNA, 75 bp, Artificial Sequence
  Synthetic
ttcatttttgaaggtaaagtggacgaaccaagagagtattttgctcatgctcgcagctgctttctttcaaatggc

SEQ ID NO: 357737 - DNA, 75 bp, Artificial Sequence
  Synthetic
ttcatttttgaaggtaaagtggacgaaccaagagagtattctgctcatgctcgcagctgctttctttcaaatggc

SEQ ID NO: 357738 - DNA, 75 bp, Artificial Sequence
  Synthetic
ttcatttttgaaggtaaagtggacgaaccaagagagtattgtgctcatgctcgcagctgctttctttcaaatggc

SEQ ID NO: 357739 - DNA, 75 bp, Artificial Sequence
  Synthetic
ttcatttttgaaggcaaagtggacgaaccaagagagtattatgctcatgctcgcagctgctttctttcaaatggc

SEQ ID NO: 357740 - DNA, 75 bp, Artificial Sequence
  Synthetic
ttcatttttgaaggcaaagtggacgaaccaagagagtattttgctcatgctcgcagctgctttctttcaaatggc

SEQ ID NO: 357741 - DNA, 75 bp, Artificial Sequence
  Synthetic
ttcatttttgaaggcaaagtggacgaaccaagagagtattctgctcatgctcgcagctgctttctttcaaatggc

SEQ ID NO: 357742 - DNA, 75 bp, Artificial Sequence
  Synthetic
ttcatttttgaaggcaaagtggacgaaccaagagagtattgtgctcatgctcgcagctgctttctttcaaatggc

SEQ ID NO: 357743 - DNA, 75 bp, Artificial Sequence
  Synthetic
ttcatttttgaagggaaagtggacgaaccaagagagtattatgctcatgctcgcagctgctttctttcaaatggc

SEQ ID NO: 357744 - DNA, 75 bp, Artificial Sequence
  Synthetic
ttcatttttgaagggaaagtggacgaaccaagagagtattttgctcatgctcgcagctgctttctttcaaatggc

SEQ ID NO: 357745 - DNA, 75 bp, Artificial Sequence
  Synthetic
ttcatttttgaagggaaagtggacgaaccaagagagtattctgctcatgctcgcagctgctttctttcaaatggc

SEQ ID NO: 357746 - DNA, 75 bp, Artificial Sequence
  Synthetic
ttcatttttgaagggaaagtggacgaaccaagagagtattgtgctcatgctcgcagctgctttctttcaaatggc

SEQ ID NO: 357747 - DNA, 75 bp, Artificial Sequence
  Synthetic
ttcttttttgaaggaaaagtggacgaaccaagagagtattatgctcatgctcgcagctgctttctttcaaatggc

SEQ ID NO: 357748 - DNA, 75 bp, Artificial Sequence
  Synthetic
ttcttttttgaaggaaaagtggacgaaccaagagagtattttgctcatgctcgcagctgctttctttcaaatggc

SEQ ID NO: 357749 - DNA, 75 bp, Artificial Sequence
  Synthetic
ttcttttttgaaggaaaagtggacgaaccaagagagtattctgctcatgctcgcagctgctttctttcaaatggc

SEQ ID NO: 357750 - DNA, 75 bp, Artificial Sequence
  Synthetic
ttcttttttgaaggaaaagtggacgaaccaagagagtattgtgctcatgctcgcagctgctttctttcaaatggc

SEQ ID NO: 357751 - DNA, 75 bp, Artificial Sequence
  Synthetic
ttcttttttgaaggtaaagtggacgaaccaagagagtattatgctcatgctcgcagctgctttctttcaaatggc

SEQ ID NO: 357752 - DNA, 75 bp, Artificial Sequence
  Synthetic
ttcttttttgaaggtaaagtggacgaaccaagagagtattttgctcatgctcgcagctgctttctttcaaatggc

SEQ ID NO: 357753 - DNA, 75 bp, Artificial Sequence
  Synthetic
ttcttttttgaaggtaaagtggacgaaccaagagagtattctgctcatgctcgcagctgctttctttcaaatggc

SEQ ID NO: 357754 - DNA, 75 bp, Artificial Sequence
  Synthetic
ttcttttttgaaggtaaagtggacgaaccaagagagtattgtgctcatgctcgcagctgctttctttcaaatggc

SEQ ID NO: 357755 - DNA, 75 bp, Artificial Sequence
  Synthetic
ttcttttttgaaggcaaagtggacgaaccaagagagtattatgctcatgctcgcagctgctttctttcaaatggc

SEQ ID NO: 357756 - DNA, 75 bp, Artificial Sequence
  Synthetic
ttcttttttgaaggcaaagtggacgaaccaagagagtattttgctcatgctcgcagctgctttctttcaaatggc

SEQ ID NO: 357757 - DNA, 75 bp, Artificial Sequence
  Synthetic
ttcttttttgaaggcaaagtggacgaaccaagagagtattctgctcatgctcgcagctgctttctttcaaatggc

SEQ ID NO: 357758 - DNA, 75 bp, Artificial Sequence
  Synthetic
ttcttttttgaaggcaaagtggacgaaccaagagagtattgtgctcatgctcgcagctgctttctttcaaatggc

SEQ ID NO: 357759 - DNA, 75 bp, Artificial Sequence
  Synthetic
ttcttttttgaagggaaagtggacgaaccaagagagtattatgctcatgctcgcagctgctttctttcaaatggc

SEQ ID NO: 357760 - DNA, 75 bp, Artificial Sequence
  Synthetic
ttcttttttgaagggaaagtggacgaaccaagagagtattttgctcatgctcgcagctgctttctttcaaatggc

SEQ ID NO: 357761 - DNA, 75 bp, Artificial Sequence
  Synthetic
ttcttttttgaagggaaagtggacgaaccaagagagtattctgctcatgctcgcagctgctttctttcaaatggc

SEQ ID NO: 357762 - DNA, 75 bp, Artificial Sequence
  Synthetic
ttcttttttgaagggaaagtggacgaaccaagagagtattgtgctcatgctcgcagctgctttctttcaaatggc

SEQ ID NO: 357763 - DNA, 75 bp, Artificial Sequence
  Synthetic
ttcctttttgaaggaaaagtggacgaaccaagagagtattatgctcatgctcgcagctgctttctttcaaatggc

SEQ ID NO: 357764 - DNA, 75 bp, Artificial Sequence
  Synthetic
ttcctttttgaaggaaaagtggacgaaccaagagagtattttgctcatgctcgcagctgctttctttcaaatggc

SEQ ID NO: 357765 - DNA, 75 bp, Artificial Sequence
  Synthetic
ttcctttttgaaggaaaagtggacgaaccaagagagtattctgctcatgctcgcagctgctttctttcaaatggc

SEQ ID NO: 357766 - DNA, 75 bp, Artificial Sequence
  Synthetic
ttcctttttgaaggaaaagtggacgaaccaagagagtattgtgctcatgctcgcagctgctttctttcaaatggc

SEQ ID NO: 357767 - DNA, 75 bp, Artificial Sequence
  Synthetic
ttcctttttgaaggtaaagtggacgaaccaagagagtattatgctcatgctcgcagctgctttctttcaaatggc

SEQ ID NO: 357768 - DNA, 75 bp, Artificial Sequence
  Synthetic
ttcctttttgaaggtaaagtggacgaaccaagagagtattttgctcatgctcgcagctgctttctttcaaatggc

SEQ ID NO: 357769 - DNA, 75 bp, Artificial Sequence
  Synthetic
ttcctttttgaaggtaaagtggacgaaccaagagagtattctgctcatgctcgcagctgctttctttcaaatggc

SEQ ID NO: 357770 - DNA, 75 bp, Artificial Sequence
  Synthetic
ttcctttttgaaggtaaagtggacgaaccaagagagtattgtgctcatgctcgcagctgctttctttcaaatggc

SEQ ID NO: 357771 - DNA, 75 bp, Artificial Sequence
  Synthetic
ttcctttttgaaggcaaagtggacgaaccaagagagtattatgctcatgctcgcagctgctttctttcaaatggc

SEQ ID NO: 357772 - DNA, 75 bp, Artificial Sequence
  Synthetic
ttcctttttgaaggcaaagtggacgaaccaagagagtattttgctcatgctcgcagctgctttctttcaaatggc

SEQ ID NO: 357773 - DNA, 75 bp, Artificial Sequence
  Synthetic
ttcctttttgaaggcaaagtggacgaaccaagagagtattctgctcatgctcgcagctgctttctttcaaatggc

SEQ ID NO: 357774 - DNA, 75 bp, Artificial Sequence
  Synthetic
ttcctttttgaaggcaaagtggacgaaccaagagagtattgtgctcatgctcgcagctgctttctttcaaatggc

SEQ ID NO: 357775 - DNA, 75 bp, Artificial Sequence
  Synthetic
ttcctttttgaagggaaagtggacgaaccaagagagtattatgctcatgctcgcagctgctttctttcaaatggc

SEQ ID NO: 357776 - DNA, 75 bp, Artificial Sequence
  Synthetic
ttcctttttgaagggaaagtggacgaaccaagagagtattttgctcatgctcgcagctgctttctttcaaatggc

SEQ ID NO: 357777 - DNA, 75 bp, Artificial Sequence
  Synthetic
ttcctttttgaagggaaagtggacgaaccaagagagtattctgctcatgctcgcagctgctttctttcaaatggc

SEQ ID NO: 357778 - DNA, 75 bp, Artificial Sequence
  Synthetic
ttcctttttgaagggaaagtggacgaaccaagagagtattgtgctcatgctcgcagctgctttctttcaaatggc

SEQ ID NO: 357779 - DNA, 75 bp, Artificial Sequence
  Synthetic
ttcgtttttgaaggaaaagtggacgaaccaagagagtattatgctcatgctcgcagctgctttctttcaaatggc

SEQ ID NO: 357780 - DNA, 75 bp, Artificial Sequence
  Synthetic
ttcgtttttgaaggaaaagtggacgaaccaagagagtattttgctcatgctcgcagctgctttctttcaaatggc

SEQ ID NO: 357781 - DNA, 75 bp, Artificial Sequence
  Synthetic
ttcgtttttgaaggaaaagtggacgaaccaagagagtattctgctcatgctcgcagctgctttctttcaaatggc

SEQ ID NO: 357782 - DNA, 75 bp, Artificial Sequence
  Synthetic
ttcgtttttgaaggaaaagtggacgaaccaagagagtattgtgctcatgctcgcagctgctttctttcaaatggc

SEQ ID NO: 357783 - DNA, 75 bp, Artificial Sequence
  Synthetic
ttcgtttttgaaggtaaagtggacgaaccaagagagtattatgctcatgctcgcagctgctttctttcaaatggc

SEQ ID NO: 357784 - DNA, 75 bp, Artificial Sequence
  Synthetic
ttcgtttttgaaggtaaagtggacgaaccaagagagtattttgctcatgctcgcagctgctttctttcaaatggc

SEQ ID NO: 357785 - DNA, 75 bp, Artificial Sequence
  Synthetic
ttcgtttttgaaggtaaagtggacgaaccaagagagtattctgctcatgctcgcagctgctttctttcaaatggc

SEQ ID NO: 357786 - DNA, 75 bp, Artificial Sequence
  Synthetic
ttcgtttttgaaggtaaagtggacgaaccaagagagtattgtgctcatgctcgcagctgctttctttcaaatggc

SEQ ID NO: 357787 - DNA, 75 bp, Artificial Sequence
  Synthetic
ttcgtttttgaaggcaaagtggacgaaccaagagagtattatgctcatgctcgcagctgctttctttcaaatggc

SEQ ID NO: 357788 - DNA, 75 bp, Artificial Sequence
  Synthetic
ttcgtttttgaaggcaaagtggacgaaccaagagagtattttgctcatgctcgcagctgctttctttcaaatggc

SEQ ID NO: 357789 - DNA, 75 bp, Artificial Sequence
  Synthetic
ttcgtttttgaaggcaaagtggacgaaccaagagagtattctgctcatgctcgcagctgctttctttcaaatggc

SEQ ID NO: 357790 - DNA, 75 bp, Artificial Sequence
  Synthetic
ttcgtttttgaaggcaaagtggacgaaccaagagagtattgtgctcatgctcgcagctgctttctttcaaatggc

SEQ ID NO: 357791 - DNA, 75 bp, Artificial Sequence
  Synthetic
ttcgtttttgaagggaaagtggacgaaccaagagagtattatgctcatgctcgcagctgctttctttcaaatggc

SEQ ID NO: 357792 - DNA, 75 bp, Artificial Sequence
  Synthetic
ttcgtttttgaagggaaagtggacgaaccaagagagtattttgctcatgctcgcagctgctttctttcaaatggc

SEQ ID NO: 357793 - DNA, 75 bp, Artificial Sequence
  Synthetic
ttcgtttttgaagggaaagtggacgaaccaagagagtattctgctcatgctcgcagctgctttctttcaaatggc

SEQ ID NO: 357794 - DNA, 75 bp, Artificial Sequence
  Synthetic
ttcgtttttgaagggaaagtggacgaaccaagagagtattgtgctcatgctcgcagctgctttctttcaaatggc

SEQ ID NO: 357795 - DNA, 75 bp, Artificial Sequence
  Synthetic
tgactacgatggccatgactgacaccactccttttggccagcagcgagtgtttaaagagaaggtggacacgaaag

SEQ ID NO: 357796 - DNA, 75 bp, Artificial Sequence
  Synthetic
gtacgtcctcaatgagacgacaaactggttgtgggcttacttagctcgagagaaaaaaccgaggatgtgctcccg

SEQ ID NO: 357797 - DNA, 75 bp, Artificial Sequence
  Synthetic
tggttgtgggcttacttagctcgagagaaaaaaccgaggatgtgctcccgagaagagtttatcagtaaagtcaac

SEQ ID NO: 357798 - DNA, 75 bp, Artificial Sequence
  Synthetic
ttgaggaacagaaccaatggaaaaatgccagagaggctgtagaagacccgaagttttgggagatggtggacgagg

SEQ ID NO: 357799 - DNA, 75 bp, Artificial Sequence
  Synthetic
tgccagagaggctgtagaagacccgaagttttgggagatggtggacgaggagcgcgaggctcaccttcgcggcga

SEQ ID NO: 357800 - DNA, 75 bp, Artificial Sequence
  Synthetic
ggctctagtgaaagagtagaagttaggctggatgatgatggaaattttcaactgatgaatgaccccggggccccc

SEQ ID NO: 357801 - DNA, 75 bp, Artificial Sequence
  Synthetic
cttttggtggccccagcttacagcttcaactgccttggaatgagcaacagagacttcttggaaggagtgtctgga

SEQ ID NO: 357802 - DNA, 75 bp, Artificial Sequence
  Synthetic
atgggcaagcgtgagaagaaaccaggagagtttggcaaggccaagggtagtagagccatttggtttatgtggcta

SEQ ID NO: 357803 - DNA, 75 bp, Artificial Sequence
  Synthetic
gagagtttggcaaggccaagggtagtagagccatttggtttatgtggctaggagctcggtttcttgagtttgagg

SEQ ID NO: 357804 - DNA, 75 bp, Artificial Sequence
  Synthetic
ctggttaggcagaaagaactcaggagggggggttgaaggcctgggcctccagaagctcgggtacatcctgaagtc

SEQ ID NO: 357805 - DNA, 75 bp, Artificial Sequence
  Synthetic
gggggggttgaaggcctgggcctccagaagctcgggtacatcctgaagtcggttggggtgaggcctggtggaaag

SEQ ID NO: 357806 - DNA, 75 bp, Artificial Sequence
  Synthetic
gggatacacgcatcacgaaagctgacctggagaatgaagcaaaggtcctcgagctactagatggagagcatcggc

SEQ ID NO: 357807 - DNA, 75 bp, Artificial Sequence
  Synthetic
cctggagaatgaagcaaaggtcctcgagctactagatggagagcatcggcgcctagcgcgatccatcatcgagct

SEQ ID NO: 357808 - DNA, 75 bp, Artificial Sequence
  Synthetic
tggtggtaaacccgtctgtgaagacagtgcgggaagccggaattctgattacggcagcagctgttaccctctggg

SEQ ID NO: 357809 - DNA, 75 bp, Artificial Sequence
  Synthetic
gtgatgagaccggccgccgatggaaagactgtaatggatgtgatatctagagaggatcagaggggaagcggacaa

SEQ ID NO: 357810 - DNA, 75 bp, Artificial Sequence
  Synthetic
agactgtaatggatgtgatatctagagaggatcagaggggaagcggacaagttgtgacctatgcgctgaacactt

SEQ ID NO: 357811 - DNA, 75 bp, Artificial Sequence
  Synthetic
gagaatgatggaaggggaaggagtcattggacctgatgatgttgaaagattagggaaagggaaaggaccaaaagt

SEQ ID NO: 357812 - DNA, 75 bp, Artificial Sequence
  Synthetic
attggacctgatgatgttgaaagattagggaaagggaaaggaccaaaagtcaggacttggctgtttgaaaatggc

SEQ ID NO: 357813 - DNA, 75 bp, Artificial Sequence
  Synthetic
tcagtggcgatgattgtgtagttaaacccctggacgacaggttcgccacatcgctgcactttctgaatgccatgt

SEQ ID NO: 357814 - DNA, 75 bp, Artificial Sequence
  Synthetic
acccctggacgacaggttcgccacatcgctgcactttctgaatgccatgtcaaaggtccgcaaagatatccaaga

SEQ ID NO: 357815 - DNA, 75 bp, Artificial Sequence
  Synthetic
gactggcagcaagtcccgttttgctcaaaccatttcacggaactgatcatgaaagatggaaggacgctggtggtt

SEQ ID NO: 357816 - DNA, 75 bp, Artificial Sequence
  Synthetic
caaaccatttcacggaactgatcatgaaagatggaaggacgctggtggttccttgccgtggccaggacgagttga

SEQ ID NO: 357817 - DNA, 75 bp, Artificial Sequence
  Synthetic
ggctgggtggaatgtgcgcgatacagcttgcttggcgaaatcgtatgcgcagatgtggttgttgctttatttcca

SEQ ID NO: 357818 - DNA, 75 bp, Artificial Sequence
  Synthetic
gcttgcttggcgaaatcgtatgcgcagatgtggttgttgctttatttccaccgcagggatttgagattgatggct

SEQ ID NO: 357819 - DNA, 75 bp, Artificial Sequence
  Synthetic
ttaactgggttcccacaggtcgcaccacttggtcgatccacgcgaagggggaatggatgacgacagaagacatgc

SEQ ID NO: 357820 - DNA, 75 bp, Artificial Sequence
  Synthetic
cacttggtcgatccacgcgaagggggaatggatgacgacagaagacatgctcgcggtctggaatagggtatggat

SEQ ID NO: 357821 - DNA, 75 bp, Artificial Sequence
  Synthetic
aagacgcctgttgaaagatggagcgacattccctattccgggaagagagaggatatctggtgcggcagtctgatt

SEQ ID NO: 357822 - DNA, 75 bp, Artificial Sequence
  Synthetic
acattccctattccgggaagagagaggatatctggtgcggcagtctgattggaacacgaacccgagccacttggg

SEQ ID NO: 357823 - DNA, 75 bp, Artificial Sequence
  Synthetic
ccaggtgcgctcattgattggagaagggaaatatgtggattatatgagttctctgagaagatatgaggataccac

SEQ ID NO: 357824 - DNA, 75 bp, Artificial Sequence
  Synthetic
gggaaatatgtggattatatgagttctctgagaagatatgaggataccacagttgtagaggacactgttttgtaa

SEQ ID NO: 357825 - DNA, 75 bp, Artificial Sequence
  Synthetic
aatttaggaagagagtcaggccagactagagctgccaccggaagttgagtagacggtgctgcctgcaactcaacc

SEQ ID NO: 357826 - DNA, 75 bp, Artificial Sequence
  Synthetic
gcgaggtgatccacgtaagccctcagaaccgtctcggaaagaggaccccacgtgttttagcctcaaggcccaatg

SEQ ID NO: 357827 - DNA, 75 bp, Artificial Sequence
  Synthetic
tgttcaaagagaaggtggacacgaaagctccggaaccgccagaaggagtgaagtatgtgctcaatgaaaccacca

SEQ ID NO: 357828 - DNA, 75 bp, Artificial Sequence
  Synthetic
aggcacaacatcgccccacgcggccacaacctcggccatggtgttaaccgaggagaagggactagaggttagagg

SEQ ID NO: 357829 - DNA, 75 bp, Artificial Sequence
  Synthetic
gggaggaaagactcagccgcatggctgtcagtggagatgactgtgtggtaaagcccttggatgatcgctttgcca

SEQ ID NO: 357830 - DNA, 75 bp, Artificial Sequence
  Synthetic
cgtctagcgcggtccatcatcgaactcacataccgacacaaagtcgtgaaagtgatgaggccagcggccgacggg

SEQ ID NO: 357831 - DNA, 75 bp, Artificial Sequence
  Synthetic
tcacataccgacacaaagtcgtgaaagtgatgaggccagcggccgacgggaaaactgtgatggacgtcatctcca

SEQ ID NO: 357832 - DNA, 75 bp, Artificial Sequence
  Synthetic
gagaggaccagagaggaagcggtcaggtagtgacttacgccctgaacaccttcactaatctagcagttcagctgg

SEQ ID NO: 357833 - DNA, 75 bp, Artificial Sequence
  Synthetic
ggaacgtccgcgacactgcttgtctggctaagtcttatgcccagatgtggctgcttctgtacttccacagaagag

SEQ ID NO: 357834 - DNA, 75 bp, Artificial Sequence
  Synthetic
gggatagactaggggatcttctgctctgcacaaccagccacacggcacagtgcgccgatataggtggctggtggt

SEQ ID NO: 357835 - DNA, 75 bp, Artificial Sequence
  Synthetic
aggattctgccacagatcatcaaagaggccataaacagaagactgagaacagccgtgctagcaccaaccagggtt

SEQ ID NO: 357836 - DNA, 75 bp, Artificial Sequence
  Synthetic
ctaacacccgggctgagatgcttgaatctggatgtgtacaggatcctgctgttgatggtcggaataggcagcttg

SEQ ID NO: 357837 - DNA, 75 bp, Artificial Sequence
  Synthetic
agaacaggattgaacgactcaggcgtgagtacagttcgacgtggcaccacgatgagaaccacccatatagaacct

SEQ ID NO: 357838 - DNA, 75 bp, Artificial Sequence
  Synthetic
taaaagtgtagttttatagtagtatttagtggtgttagtgtaaatagttaagaaaattttgaggagaaagtcagg

SEQ ID NO: 357839 - DNA, 75 bp, Artificial Sequence
  Synthetic
acaacatcaacatgccaaacggactgatcgctcaattctaccaaccagagcgtgagaaggtatacaccatggatg

SEQ ID NO: 357840 - DNA, 75 bp, Artificial Sequence
  Synthetic
ccaggcactaaaggcgttcaaggactttgcttcgggaaagcgttctcagatagggctcattgaggtcctgggaaa

SEQ ID NO: 357841 - DNA, 75 bp, Artificial Sequence
  Synthetic
aaaacaccacaacaaaacagcatattgacacctgggatagactaggagatcttctgctctgcacaaccagccaca

SEQ ID NO: 357842 - DNA, 75 bp, Artificial Sequence
  Synthetic
gaccccacatgttgatccatgtaagccctcagaaccgtctcggaacggaggaccccacatgttgatccatgtaag

SEQ ID NO: 357843 - DNA, 75 bp, Artificial Sequence
  Synthetic
cactatgcctacatggttcccggttggcaagctgaggcaatgcgctcagcccagcggcggacagcagccggaatc

SEQ ID NO: 357844 - DNA, 75 bp, Artificial Sequence
  Synthetic
gaccccacatgttgatccatgtaagccctcagaaccgtctcggaaggaggacccccacatgtaagcccctcagaa

SEQ ID NO: 357845 - DNA, 75 bp, Artificial Sequence
  Synthetic
ccgtctcggaaggaggacccccacatgtaagccctcagaaccgtcctacgggaaggaggacccccacggatggta

SEQ ID NO: 357846 - DNA, 75 bp, Artificial Sequence
  Synthetic
accgtctcggaaggaggaccccacatgttgtaacttcaaagcccaatgtcagaccacgctacggcgtgctactct

SEQ ID NO: 357847 - DNA, 75 bp, Artificial Sequence
  Synthetic
gatggctgaagcactgagaggactgcccatccggtaccagacatccgcagtgcccagagaacacaatggaaatga

SEQ ID NO: 357848 - DNA, 75 bp, Artificial Sequence
  Synthetic
gccactcaggcagggagattcagcatcactcctgcggcgccttcatacacactaaagcttggagaatatggagag

SEQ ID NO: 357849 - DNA, 75 bp, Artificial Sequence
  Synthetic
agtggagaccccgtgccacaaaacaccacaacaaaacagcatattgacacctgggatagactaggagatcttctg

SEQ ID NO: 357850 - DNA, 75 bp, Artificial Sequence
  Synthetic
cactgtcaagttgacgtcgggtcatttgaagtgtagagtgaagatggaaaaattgcagttgaagggaacaaccta

SEQ ID NO: 357851 - DNA, 75 bp, Artificial Sequence
  Synthetic
cttcattgaacgacctaacgccagtgggcagattggtcactgtcaacccttttgtttcagtggccacggccaacg

SEQ ID NO: 357852 - DNA, 75 bp, Artificial Sequence
  Synthetic
tatcacttatgaatgtccggtcctagctgctggaaatgaccctgaagacattgactgctggtgcacgaaatcatc

SEQ ID NO: 357853 - DNA, 75 bp, Artificial Sequence
  Synthetic
tgtggattgagaggacggctgatattacttgggagagtgacgctgaaatcacaggctctagtgaaagagtagatg

SEQ ID NO: 357854 - DNA, 75 bp, Artificial Sequence
  Synthetic
tgtctgaggctctgagaggacttcccatccggtaccaaacctcagcagtgcacagagagcacagtggaaatgaga

SEQ ID NO: 357855 - DNA, 75 bp, Artificial Sequence
  Synthetic
caactgggttcccacagggcgtaccacctggtcgatccacgcaaaaggagaatggatgacgacagaagacatgct

SEQ ID NO: 357856 - DNA, 75 bp, Artificial Sequence
  Synthetic
tggcccagatgatgtggagaaactcacaaaggggaaaggacccaaagtcaggacctggctgtttgagaatgggga

SEQ ID NO: 357857 - DNA, 75 bp, Artificial Sequence
  Synthetic
ggcaagatctatgctgatgacacagctggctgggacacccgcatcacgagagctgacttggaaaatgaagctaag

SEQ ID NO: 357858 - DNA, 75 bp, Artificial Sequence
  Synthetic
ggacctggctgtttgagaatggggaggaaagactcagccgcatggctgtcagtggagatgactgtgtggtaaagc

SEQ ID NO: 357859 - DNA, 75 bp, Artificial Sequence
  Synthetic
tttggtctcaccagcactcggatgttcctgaaggtcagagagagcaacacaactgaatgtgactcgaagatcatt

SEQ ID NO: 357860 - DNA, 75 bp, Artificial Sequence
  Synthetic
actttatcaattgtaaatagacaacataagtatgtatataggtataggtttatagtggcatttaattatgttagt

SEQ ID NO: 357861 - DNA, 75 bp, Artificial Sequence
  Synthetic
tctagcctcaacaggacttttcaaccccatgatccttgctgctggactgattgcatgtgatcccaaccgtaaacg

SEQ ID NO: 357862 - DNA, 75 bp, Artificial Sequence
  Synthetic
accgtggacctgccactcgcaccaccacagagagcggaaagttgataacagactggtgctgcaggagctgcacct

SEQ ID NO: 357863 - DNA, 75 bp, Artificial Sequence
  Synthetic
actcaaccccaggaggactgggtgaacaaagccgcgaagtgatccatgtaagccctcaggccaagactgagtcgg

SEQ ID NO: 357864 - DNA, 75 bp, Artificial Sequence
  Synthetic
caacacctttgtcatcgacggtcctgagactgaggaatgcccaacggccaaccgagcatggaacagtatggaggt

SEQ ID NO: 357865 - DNA, 75 bp, Artificial Sequence
  Synthetic
aagaacaacatggctgtgcatagtgatctgtcgtactggatagagagcggactcaacgacacctggaagcttgag

SEQ ID NO: 357866 - DNA, 75 bp, Artificial Sequence
  Synthetic
aaaacagcatattgacacctgggatagactaggagatcttctgctctgcacaaccagccacacggcacagtgcgc

SEQ ID NO: 357867 - DNA, 75 bp, Artificial Sequence
  Synthetic
agcgggcgtgatggttgaaggtgttttccacaccctttggcatacaacaaaaggagccgctttgatgagcggaga

SEQ ID NO: 357868 - DNA, 75 bp, Artificial Sequence
  Synthetic
ccaaggtccatgggatgaggggcgtgtcgagattgactttgactattgcccaggaacaacagtaactataagtga

SEQ ID NO: 357869 - DNA, 75 bp, Artificial Sequence
  Synthetic
agtgtcaaggaggatcgactttgttacggaggaccctggaaattgcagcacaagtggaacgggcaggatgaggtg

SEQ ID NO: 357870 - DNA, 75 bp, Artificial Sequence
  Synthetic
ccattggcacaagtctggaagcagcattggcaaagcctttacaaccaccctcaaaggggcgcagagactagccgc

SEQ ID NO: 357871 - DNA, 75 bp, Artificial Sequence
  Synthetic
gacggccaagatcagcattccagctatcatgcttgcactcctagtcctagtgtttgggggtattacgtacactga

SEQ ID NO: 357872 - DNA, 75 bp, Artificial Sequence
  Synthetic
aacttagtagtgtttgtgaggattttgaacaattaacacagtgcgagctgtttcttagcacgaagatctcgatgt

SEQ ID NO: 357873 - DNA, 75 bp, Artificial Sequence
  Synthetic
gacattatcacgataccaacggccgctggaaagaacctgtgcattgtcagagctatggatgtggggcacatgtgt

SEQ ID NO: 357874 - DNA, 75 bp, Artificial Sequence
  Synthetic
aagttagcagtctacgttaggtatggaagatgcaccaagacacgacactcaagacgcagcagaaggtcactaaca

SEQ ID NO: 357875 - DNA, 75 bp, Artificial Sequence
  Synthetic
gaagatgcaccaagacacgacactcaagacgcagcagaaggtcactaacagtgcagacgcatggagagagcaccc

SEQ ID NO: 357876 - DNA, 75 bp, Artificial Sequence
  Synthetic
tgagaggactgcccatccggtatcagacatctgcagtgcccagagaacacaatggaaatgagattgttgatgtca

SEQ ID NO: 357877 - DNA, 75 bp, Artificial Sequence
  Synthetic
tgtttgccgtgttactgcttttggtagctccagcttacagctttaactgtcttggaatgagcaacagagatttcc

SEQ ID NO: 357878 - DNA, 75 bp, Artificial Sequence
  Synthetic
gcaccagctggcttcgaacctgaaatgttgaggaagaaacagatcactgtccttgatctgcaccccggagcagga

SEQ ID NO: 357879 - DNA, 75 bp, Artificial Sequence
  Synthetic
ttacacgctaaagttgggtgagtatggtgaggtcacggttgactgtgagccacggtcaggaatagacactagcgc

SEQ ID NO: 357880 - DNA, 75 bp, Artificial Sequence
  Synthetic
tgggaacggcgtcatcatgcctaatggttcatacataagcgccattgtgcaaggagagagaatggaagaaccggc

SEQ ID NO: 357881 - DNA, 75 bp, Artificial Sequence
  Synthetic
gcatcgacacatgcgccaaatttgcctgttcaaccaaggcaacgggaaggactatcttaaaggagaacattaagt

SEQ ID NO: 357882 - DNA, 75 bp, Artificial Sequence
  Synthetic
ctgaggccctgagaggacttcccatccggtaccaaacctcagcagtgcacagagagcacagtggaaatgagatcg

SEQ ID NO: 357883 - DNA, 75 bp, Artificial Sequence
  Synthetic
accaactaccgtggaatcgcatgggaactacttcacgcaaaccggagctgctcaggctgggagatttagtatcac

SEQ ID NO: 357884 - DNA, 75 bp, Artificial Sequence
  Synthetic
acaaagccgcgaagtgatccatgtaagccctcaggaaccgtctcggaagggaggaccccacatgttgtaacaaag

SEQ ID NO: 357885 - DNA, 75 bp, Artificial Sequence
  Synthetic
aagctcggagagtatggagaagtaacagtggactgtgaaccacgctcagggatagacaccagtgcatactatgtg

SEQ ID NO: 357886 - DNA, 75 bp, Artificial Sequence
  Synthetic
acacgctacgaagcaatctgtgatagcattgggctctcaagagggagccctgcatcaagctctggcaggagccat

SEQ ID NO: 357887 - DNA, 75 bp, Artificial Sequence
  Synthetic
ttatccagctgaacagaaagtcctatgagacagagtaccccaagtgcaagaacgatgattgggattttgtcatca

SEQ ID NO: 357888 - DNA, 75 bp, Artificial Sequence
  Synthetic
gtcaagctgacgtcaggccacctgaagtgtagggtgaagatggaaaaattgcagctgaaggggacaacttatggc

SEQ ID NO: 357889 - DNA, 75 bp, Artificial Sequence
  Synthetic
tgggagaatggagcaagctctgtttggaacgcaacaaccgccatcggactctgccacatcatgcgtgggggttgg

SEQ ID NO: 357890 - DNA, 75 bp, Artificial Sequence
  Synthetic
gtctgttcaaaggccttcagattccttgggactcccgcagacacgggccatggtactgtggtactggaactgcag

SEQ ID NO: 357891 - DNA, 75 bp, Artificial Sequence
  Synthetic
agatacccatttcatcagtagcttcattgaatgacctaacgccagtgggcaggttagttaccgtcaacccctttg

SEQ ID NO: 357892 - DNA, 75 bp, Artificial Sequence
  Synthetic
attgaatgacctaacgccagtgggcaggttagttaccgtcaacccctttgtctccgtgtcaacggccaatgctaa

SEQ ID NO: 357893 - DNA, 75 bp, Artificial Sequence
  Synthetic
tttggaggcatgtcttggataactcagggtctgctgggggccctcctattgtggatgggtattaacgctcgtgat

SEQ ID NO: 357894 - DNA, 75 bp, Artificial Sequence
  Synthetic
aagactcaaccagatgacaaaagaagagttcactaggtaccgcaaagaggccatcatcgaagtcgatcgctcagc

SEQ ID NO: 357895 - DNA, 75 bp, Artificial Sequence
  Synthetic
gacctcgaaccaacacgattcttgaagacaacaatgaagttgaagtcatcacgaagttgggtgagagaaagatcc

SEQ ID NO: 357896 - DNA, 75 bp, Artificial Sequence
  Synthetic
tggatggaccgatacaagtactaccctgaaacaccacaaggtctagctaagatcattcaaaaggctcacaaggaa

SEQ ID NO: 357897 - DNA, 75 bp, Artificial Sequence
  Synthetic
ctgaaacaccacaaggtctagctaagatcattcaaaaggctcacaaggaaggagtgtgcggtctacgatcagttt

SEQ ID NO: 357898 - DNA, 75 bp, Artificial Sequence
  Synthetic
cttttgaaggaaaatggtgtggaccttagtattgtggttgagaaacaggaggggatgtacaaatcagcacctaga

SEQ ID NO: 357899 - DNA, 75 bp, Artificial Sequence
  Synthetic
actagtgcaaagttatggatggaacattgtcaccatgaagagtggagtggatgtgttctacagaccttctgagtg

SEQ ID NO: 357900 - DNA, 75 bp, Artificial Sequence
  Synthetic
gacaagaccaagaatgacattagcagcctgttgggacacaagccagaaactagagagacgaccctgggagttgag

SEQ ID NO: 357901 - DNA, 75 bp, Artificial Sequence
  Synthetic
aacccagaaccgtgcctggaacagcttggaggtggaagattttggattcggcctcaccagcactcggatgttctt

SEQ ID NO: 357902 - DNA, 75 bp, Artificial Sequence
  Synthetic
gaaagcaggtttaatgacacgtggaagctcgaaagggcggtcctaggtgaagtcaaatcatgcacgtggccggaa

SEQ ID NO: 357903 - DNA, 75 bp, Artificial Sequence
  Synthetic
cctatcccctgtgtgccatcccctgttgcgtgtctcagtgtctcaggttcgcctgtgtgagctgacaaacttagt

SEQ ID NO: 357904 - DNA, 75 bp, Artificial Sequence
  Synthetic
cgagctgggggaggcggcggcaatattcatgacagccaccccaccaggcacttcagatccattcccagagtccaa

SEQ ID NO: 357905 - DNA, 75 bp, Artificial Sequence
  Synthetic
agtgaatgcatacaacgccgacatgattgatccttttcagttgggccttctggtcgtgttcttggccacccagga

SEQ ID NO: 357906 - DNA, 75 bp, Artificial Sequence
  Synthetic
acgtccaagccagtgcgttgttcaccttggccagaggcttcccttttgtggacgttggtgtgtcagctctcttgc

SEQ ID NO: 357907 - DNA, 75 bp, Artificial Sequence
  Synthetic
ggagatgagaagtatgtggattacatgagttcactaaagagatatgaagacacaactttggttgaggacacagta

SEQ ID NO: 357908 - DNA, 75 bp, Artificial Sequence
  Synthetic
ttttaaagaggaagtcaggccggaaaatttccgccaccggaagttgagtagacggtgctgcctgcgactcaaccc

SEQ ID NO: 357909 - DNA, 75 bp, Artificial Sequence
  Synthetic
atctggtgggggcggcctttgcagaatccaactcaggaggagatgtggtgcatctggcgctcatggcaaccttca

SEQ ID NO: 357910 - DNA, 75 bp, Artificial Sequence
  Synthetic
atcatttctcaaggcgagatggaccaaccaagaaaacattctgctgatgttggcagctgctttcttccaaatggc

SEQ ID NO: 357911 - DNA, 75 bp, Artificial Sequence
  Synthetic
tggcagctgctttcttccaaatggcttactatgatgcccggcaaattttgctttgggaaatgcctgatgtattga

SEQ ID NO: 357912 - DNA, 75 bp, Artificial Sequence
  Synthetic
atcctgctactgatggttggaataggcagtttgatcagggaaaaaagaagtgcagctgcaaaaaagaaaggagcc

SEQ ID NO: 357913 - DNA, 75 bp, Artificial Sequence
  Synthetic
aggccatccagtctcacggggaaccgcgaaattacggtggttagtggaaaggcgtttcctcgagccagtgggaaa

SEQ ID NO: 357914 - DNA, 75 bp, Artificial Sequence
  Synthetic
gggcttgcagaactggacatagactccatggccattccaatgactatcgcagggctcatgtttgctgcttttgtg

SEQ ID NO: 357915 - DNA, 75 bp, Artificial Sequence
  Synthetic
gtcaagtgccgaggtagaagaacaccgcaccgtccgtgtcttggagatggtggaagactggctgcacagaggacc

SEQ ID NO: 357916 - DNA, 75 bp, Artificial Sequence
  Synthetic
ccctacaggacctggaactaccacggaagctatgaagtgaaaccaaccggctcagccagctcccttgtgaatggg

SEQ ID NO: 357917 - DNA, 75 bp, Artificial Sequence
  Synthetic
agccctcagaaccgtctcggaaggtggaccccacatgttgaacgaaagccgcgaaagtgatccagtgtaagccct

SEQ ID NO: 357918 - DNA, 75 bp, Artificial Sequence
  Synthetic
gctcatgaatgatccaggagcaccttggaaaatatggatgctccgtatggcttgcctggcaatcagcgcgtacac

SEQ ID NO: 357919 - DNA, 75 bp, Artificial Sequence
  Synthetic
ggacggggaatataggctcagaggggaagaacggaagaacttccttgaattcttgagaacagctgatttaccagt

SEQ ID NO: 357920 - DNA, 75 bp, Artificial Sequence
  Synthetic
ccagatgtggctgcttctgtacttccacagaagagacctgcggctcatggccaacgccatttgctccgctgtccc

SEQ ID NO: 357921 - DNA, 75 bp, Artificial Sequence
  Synthetic
tgtcaagaacgtccagactaagccgggggtgttcaaaacacctgaaggggagatcggggccgtgactctggattt

SEQ ID NO: 357922 - DNA, 75 bp, Artificial Sequence
  Synthetic
aaggtggacacaaaggctccagagcctccagaaggggtcaaatacgtcctcaatgagaccacgaactggctgtgg

SEQ ID NO: 357923 - DNA, 75 bp, Artificial Sequence
  Synthetic
atagtggacaaaaacggtgatgtgattgggctttatggcaacggagtcataatgcccaatggctcatacataagc

SEQ ID NO: 357924 - DNA, 75 bp, Artificial Sequence
  Synthetic
cctgagaggacttcccatccggtaccaaacctcagcagtgcacagagagcacagtggaaatgagatcgttgatgt

SEQ ID NO: 357925 - DNA, 75 bp, Artificial Sequence
  Synthetic
gttttatagtagtatttagtggtgttagtgtaaatagttaagaaaattttgaggagaaagtcaggccgggaagtt

SEQ ID NO: 357926 - DNA, 75 bp, Artificial Sequence
  Synthetic
tagtgtaaatagttaagaaaattttgaggagaaagtcaggccgggaagttcccgccaccggaagttgagtagacg

SEQ ID NO: 357927 - DNA, 75 bp, Artificial Sequence
  Synthetic
cccgccaccggaagttgagtagacggtgctgcctgcgactcaaccccaggaggactgggtgaacaaagccgcgaa

SEQ ID NO: 357928 - DNA, 75 bp, Artificial Sequence
  Synthetic
cggtggccagagagcacaatggaaatgagatcgtcgacgtcatgtgccatgcaaccctcacccataggctgatgt

SEQ ID NO: 357929 - DNA, 75 bp, Artificial Sequence
  Synthetic
cctgactgaagctgtaggtcaggggaaggactagaggttagtggagaccccgtgccacaaaacaccacaacaaaa

SEQ ID NO: 357930 - DNA, 75 bp, Artificial Sequence
  Synthetic
cctagtgtgaagatgggaaatgagatagccctctgtctgcagcgcgctggcaaaaaagtcatccagctaaacaga

SEQ ID NO: 357931 - DNA, 75 bp, Artificial Sequence
  Synthetic
ttttttagcatattgcccccccggctctggccggcccctcctggtttcttagacatcgagatcttcgtgctaaga

SEQ ID NO: 357932 - DNA, 75 bp, Artificial Sequence
  Synthetic
aatgcaagaacgatgattgggactttgtcgtcacaacagatatatctgagatgggagcaaactttaaggcaagca

SEQ ID NO: 357933 - DNA, 75 bp, Artificial Sequence
  Synthetic
tagttcgcctgtgtgagctgacaaacttagtagtgtttgtgaggattaacaacaattaacacagtgcgagctgtt

SEQ ID NO: 357934 - DNA, 75 bp, Artificial Sequence
  Synthetic
cgaccgcttcgccacatcactacacttcctaaatgccatgtcaaaggtccgcaaagacatccaggaatggaaacc

SEQ ID NO: 357935 - DNA, 75 bp, Artificial Sequence
  Synthetic
catccgctgtgacggcagccagtgcagcccagagacgaggacgcattggtaggaatccatcacaagttggagatg

SEQ ID NO: 357936 - DNA, 75 bp, Artificial Sequence
  Synthetic
agcccagagacgaggacgcattggtaggaatccatcacaagttggagatgagtactgctatggagggcacacgaa

SEQ ID NO: 357937 - DNA, 75 bp, Artificial Sequence
  Synthetic
tggactgaggcacgaatcatgctcgataacatcaacatgccaaacggattgattgctcaattctaccaaccagag

SEQ ID NO: 357938 - DNA, 75 bp, Artificial Sequence
  Synthetic
gggaataccgacttagaggagaggagaggaaaaacttcctggaattgttgagaactgcagacttgccagtatggc

SEQ ID NO: 357939 - DNA, 75 bp, Artificial Sequence
  Synthetic
gaggaaaaacttcctggaattgttgagaactgcagacttgccagtatggctagcttataaggtggcagcagctgg

SEQ ID NO: 357940 - DNA, 75 bp, Artificial Sequence
  Synthetic
gatgcctgaacatttcatggggaagacatgggaagcactcgacaccatgtatgttgtagccactgcagagaaagg

SEQ ID NO: 357941 - DNA, 75 bp, Artificial Sequence
  Synthetic
gaggagctaccagacgccctccaaacaatagctctgatcgctctgttgagtgtgatgaccatgggagtgtttttt

SEQ ID NO: 357942 - DNA, 75 bp, Artificial Sequence
  Synthetic
gaaagataggcctgggaggcgttgtcctgggagccgcaacctttttctgttggatggctgaagtaccaggaacga

SEQ ID NO: 357943 - DNA, 75 bp, Artificial Sequence
  Synthetic
agacagacaaccagctagctgtgttcctgatttgcgtgttgacccttgtgggtgcggtggcagccaatgagatgg

SEQ ID NO: 357944 - DNA, 75 bp, Artificial Sequence
  Synthetic
cctgatttgcgtgttgacccttgtgggtgcggtggcagccaatgagatgggttggctggacaagaccaagagtga

SEQ ID NO: 357945 - DNA, 75 bp, Artificial Sequence
  Synthetic
attgaaaccaaggagaattttagcattggggagttccttttggacctgaggccggcaacggcttggtcactgtat

SEQ ID NO: 357946 - DNA, 75 bp, Artificial Sequence
  Synthetic
agactacatcaacacctcattgacctcaataaatgttcaagctagtgcgctattcacgctcgcgcgaggcttccc

SEQ ID NO: 357947 - DNA, 75 bp, Artificial Sequence
  Synthetic
gacaagtcactctcaccgtgacggtgacatcagcaacacttctgttctgccattatgcctacatggtacctggat

SEQ ID NO: 357948 - DNA, 75 bp, Artificial Sequence
  Synthetic
gacatcagcaacacttctgttctgccattatgcctacatggtacctggatggcaggctgaggcaatgcgctcagc

SEQ ID NO: 357949 - DNA, 75 bp, Artificial Sequence
  Synthetic
tcgtggccacggacgttccagagctagagcgtaccacacccatcatgcagaagaaggttggacaagttatgctga

SEQ ID NO: 357950 - DNA, 75 bp, Artificial Sequence
  Synthetic
aacttagtagtgtttgtgaggattaataacaattaacacagtgcgagctgttcttagcacgaagatctcgatgtc

SEQ ID NO: 357951 - DNA, 75 bp, Artificial Sequence
  Synthetic
tcaggcagggagatttagcatcactcctgcggcgccttcatacacactaaagcttggagaatatggagaggtgac

SEQ ID NO: 357952 - DNA, 75 bp, Artificial Sequence
  Synthetic
agtgaacatgaccagccaggtactcttaggaaggatggagaagaagacctggaagggacctcagtacgaagaaga

SEQ ID NO: 357953 - DNA, 75 bp, Artificial Sequence
  Synthetic
ggaatgagcaacagagacttcttagagggagtatctggagcaacatgggtggatttggttctcgaaggcgacagc

SEQ ID NO: 357954 - DNA, 75 bp, Artificial Sequence
  Synthetic
agcctaccatcgatgtgaagatgatgaatatggaggctgccaacctggcagaggtccgcagttattgctatttgg

SEQ ID NO: 357955 - DNA, 75 bp, Artificial Sequence
  Synthetic
cttggagagtatggagaggtgacagtggactgtgaaccacgatcagggattgacaccaatgcatactacgtgatg

SEQ ID NO: 357956 - DNA, 75 bp, Artificial Sequence
  Synthetic
gacacccgcatcacaagagctgacctggagaatgaagccaaggttcttgagttgttggacggggagcaccggcgc

SEQ ID NO: 357957 - DNA, 75 bp, Artificial Sequence
  Synthetic
tgtcacctacgctctaaacacctttaccaacctggctgtccaattggtgagaatgatggaaggagagggtgtgat

SEQ ID NO: 357958 - DNA, 75 bp, Artificial Sequence
  Synthetic
accaacctggctgtccaattggtgagaatgatggaaggagagggtgtgatcggcccagatgatgtggagaaactc

SEQ ID NO: 357959 - DNA, 75 bp, Artificial Sequence
  Synthetic
catacacaatgatgtggaggcttggatggaccggtacaagtactaccctgaaacgccacaaggcctagccaagat

SEQ ID NO: 357960 - DNA, 75 bp, Artificial Sequence
  Synthetic
gcaaaacatgccaggagagagggaaacatcactggaggccatccagtctcacggggaaccgcgaaattacggtgg

SEQ ID NO: 357961 - DNA, 75 bp, Artificial Sequence
  Synthetic
tggctggtggtgcgagaacacaggatcttttagtctatcccaggtgtcaatatgctgttttgttgtggtgttttg

SEQ ID NO: 357962 - DNA, 75 bp, Artificial Sequence
  Synthetic
tcatgaaggacggcaggacgttggtggtcccgtgtcgtggacaagacgagttgattggacgggccagaatctctc

SEQ ID NO: 357963 - DNA, 75 bp, Artificial Sequence
  Synthetic
gccaacaacacctttgtggttgatggtccggagaccaaggaatgcccaactcagaatcgcgcttggaatagcttg

SEQ ID NO: 357964 - DNA, 75 bp, Artificial Sequence
  Synthetic
cctatcccctgtgtgcctttgcctatcccctgttgcgtgtctcagagtagttcgcctgtgtgagctgacaaactt

SEQ ID NO: 357965 - DNA, 75 bp, Artificial Sequence
  Synthetic
aagtcagatcaataattggagatgagaaatatgtggattacatgagttcattgaagagatatgaagacacaacat

SEQ ID NO: 357966 - DNA, 75 bp, Artificial Sequence
  Synthetic
tcccctgttgcgtgtctcagagtagttcgcctgtgtgagctgacaaacttagtagtgtttgtgaggattaacaac

SEQ ID NO: 357967 - DNA, 75 bp, Artificial Sequence
  Synthetic
attgagaatggaagtcaggccagattaatgctgccaccggaagttgagtagacggtgctgcctgcggctcaaccc

SEQ ID NO: 357968 - DNA, 75 bp, Artificial Sequence
  Synthetic
actttgttaattgtaaataaatattgttattatgtgtagaagtttagctttataatagtgtttagtgtgtttaga

SEQ ID NO: 357969 - DNA, 75 bp, Artificial Sequence
  Synthetic
gttattatgtgtagaagtttagctttataatagtgtttagtgtgtttagagttagaaaaattttagtgaggaagt

SEQ ID NO: 357970 - DNA, 75 bp, Artificial Sequence
  Synthetic
tcaactgccttggaatgagcaacagagacttcttggagggagtatctggagcaacatgggtggatttggttctcg

SEQ ID NO: 357971 - DNA, 75 bp, Artificial Sequence
  Synthetic
gtgaagatgatgaatatggaggctgccaacctggcagaggtccgcagttattgctatttggctaccgtcagcgat

SEQ ID NO: 357972 - DNA, 75 bp, Artificial Sequence
  Synthetic
tacttacactgatgtgttacgctatgtcatcttggtgggggcagctttcgcagaatctaattcgggaggagacgt

SEQ ID NO: 357973 - DNA, 75 bp, Artificial Sequence
  Synthetic
atgtgatcccaaccgtaaacgcggatggcccgcaactgaagtgatgacagctgtcggcctaatgtttgccatcgt

SEQ ID NO: 357974 - DNA, 75 bp, Artificial Sequence
  Synthetic
agaagttcgtctgcgtgagctgacaaacttagtagtgtttgtgaggattatcaacaattaatacagtgtgagctg

SEQ ID NO: 357975 - DNA, 75 bp, Artificial Sequence
  Synthetic
aacttagtagtgtttgtgaggattatcaacaattaatacagtgtgagctgtttcttagcacgaagatttcgatgt

SEQ ID NO: 357976 - DNA, 75 bp, Artificial Sequence
  Synthetic
tcaacaattaatacagtgtgagctgtttcttagcacgaagatttcgatgtctaggaaaccaggagggcccggaga

SEQ ID NO: 357977 - DNA, 75 bp, Artificial Sequence
  Synthetic
tgaacaaagccgcgaagtgatccatgtaagccctcagaaccgtctcggaaggaggaccccacatgttgtgatcca

SEQ ID NO: 357978 - DNA, 75 bp, Artificial Sequence
  Synthetic
cgcggtaagccccgcggaggatccctgatgggattgaagagggctattttgagcttgatagatggtaggggtcca

SEQ ID NO: 357979 - DNA, 75 bp, Artificial Sequence
  Synthetic
tgatgggattgaagagggctattttgagcttgatagatggtaggggtccaatacgattcgtattggccctattgg

SEQ ID NO: 357980 - DNA, 75 bp, Artificial Sequence
  Synthetic
tccgactcgagcagtgttggaaagatggagaggtgtcaacaaacaaacagcgatgaaacatctcaccagtttcaa

SEQ ID NO: 357981 - DNA, 75 bp, Artificial Sequence
  Synthetic
ccatgtaagccctcagaaccctgagacatacggcaagccacatggttgtgatccatgtaagccctcagaaccggt

SEQ ID NO: 357982 - DNA, 75 bp, Artificial Sequence
  Synthetic
tggagaggtgtcaacaaacaaacagcgatgaaacatctcaccagtttcaagaaagaactgggaatactcaccaac

SEQ ID NO: 357983 - DNA, 75 bp, Artificial Sequence
  Synthetic
acatacggcaagccacatggttgtgatccatgtaagccctcagaaccggtctcggaaggaggaccccacatggtt

SEQ ID NO: 357984 - DNA, 75 bp, Artificial Sequence
  Synthetic
aaaagaaaagaggaggctcgataggagttgccatccttattggtttgatgactggtgccggagccgtcgtcttgt

SEQ ID NO: 357985 - DNA, 75 bp, Artificial Sequence
  Synthetic
agttgccatccttattggtttgatgactggtgccggagccgtcgtcttgtcgaacttccaggggaagttgatgat

SEQ ID NO: 357986 - DNA, 75 bp, Artificial Sequence
  Synthetic
tctgggaaatcaacagatatgtggatcgagaggacggcggacatctcctgggaaagtgatgcagaaattacaggc

SEQ ID NO: 357987 - DNA, 75 bp, Artificial Sequence
  Synthetic
aatgtgatcaccattccaattgcctccggaaaaaatttgtgcacagtgcgagctatagatgttggcttcctgtgt

SEQ ID NO: 357988 - DNA, 75 bp, Artificial Sequence
  Synthetic
ccggaaaaaatttgtgcacagtgcgagctatagatgttggcttcctgtgtgatgataccatcacatatgaatgtc

SEQ ID NO: 357989 - DNA, 75 bp, Artificial Sequence
  Synthetic
agaggatatagattgctggtgtacaaaactggccatgtatgttcgatatggaaggtgcacaaagactcgccagtc

SEQ ID NO: 357990 - DNA, 75 bp, Artificial Sequence
  Synthetic
aaactggccatgtatgttcgatatggaaggtgcacaaagactcgccagtcacgtcgcagcagacgttctcttacg

SEQ ID NO: 357991 - DNA, 75 bp, Artificial Sequence
  Synthetic
ccctttggcatacaacaaaaggagccgctttgatgagcggagaaggccgcctggacccatactggggtagtgtca

SEQ ID NO: 357992 - DNA, 75 bp, Artificial Sequence
  Synthetic
agttcgcctgtgtgaactgacaaacttagtagtgtttgtgaggattaacaacaattaacacagtgcgagctgttt

SEQ ID NO: 357993 - DNA, 75 bp, Artificial Sequence
  Synthetic
ttgccaacaaaaaaggagcctggatggacagcaccaaagcgacaaggtacttggtcaaaacggaatcgtggatct

SEQ ID NO: 357994 - DNA, 75 bp, Artificial Sequence
  Synthetic
ggacagcaccaaagcgacaaggtacttggtcaaaacggaatcgtggatcttgagaaaccctgggtatgctctagt

SEQ ID NO: 357995 - DNA, 75 bp, Artificial Sequence
  Synthetic
ggaagcaacacaactcagagggttgtgttcatggtcttactcctgcttgtagctccagcctacagcttcaattgc

SEQ ID NO: 357996 - DNA, 75 bp, Artificial Sequence
  Synthetic
tgttcatggtcttactcctgcttgtagctccagcctacagcttcaattgcctgggaatgagtaacagagactttt

SEQ ID NO: 357997 - DNA, 75 bp, Artificial Sequence
  Synthetic
ggttgatttggtgcttgaaggagatagctgcgtaaccattatgtctaaggataaacccacaattgatgttaagat

SEQ ID NO: 357998 - DNA, 75 bp, Artificial Sequence
  Synthetic
agctgcgtaaccattatgtctaaggataaacccacaattgatgttaagatgatgaacatggaagctaccagcttg

SEQ ID NO: 357999 - DNA, 75 bp, Artificial Sequence
  Synthetic
agaagactgagaacagccgtgctagcaccaactagggttgtggctgctgagatggctgaagcactgagaggactg

SEQ ID NO: 358000 - DNA, 75 bp, Artificial Sequence
  Synthetic
tggctgcagtaagtgatttgtcaacaaaggcagcttgccccacgatgggtgaagcacataatgaaaagcgagcag

SEQ ID NO: 358001 - DNA, 75 bp, Artificial Sequence
  Synthetic
aaaggcagcttgccccacgatgggtgaagcacataatgaaaagcgagcagatccagcgtacttctgcaagcaagg

SEQ ID NO: 358002 - DNA, 75 bp, Artificial Sequence
  Synthetic
cccatccggtatcagacatctgcagtgaccagagaacacaatggaaatgagattgttgatgtcatgtgccatgct

SEQ ID NO: 358003 - DNA, 75 bp, Artificial Sequence
  Synthetic
ggttgtggtctcttcggtaaagggagcatagacacgtgtgctaaattcgcatgcacaagcaaagcaaccgggtgg

SEQ ID NO: 358004 - DNA, 75 bp, Artificial Sequence
  Synthetic
gcatagacacgtgtgctaaattcgcatgcacaagcaaagcaaccgggtggatcatacagaaggaaaacatcaagt

SEQ ID NO: 358005 - DNA, 75 bp, Artificial Sequence
  Synthetic
acctacgacagtggattcccacggcaattactccacgcaaatgggagctacccaagctggaagattcacagtgtc

SEQ ID NO: 358006 - DNA, 75 bp, Artificial Sequence
  Synthetic
aattactccacgcaaatgggagctacccaagctggaagattcacagtgtccccttcagcccccacgtacacaatg

SEQ ID NO: 358007 - DNA, 75 bp, Artificial Sequence
  Synthetic
acctatttctgacttacagactgagatcccggatcgggcctggaactctggatacgaatggatcacagaatacat

SEQ ID NO: 358008 - DNA, 75 bp, Artificial Sequence
  Synthetic
ccgttgattgtgagcctcgatcaggtatcgatacaaacgcatactacgtcatgtcagttggctccaagtcatttt

SEQ ID NO: 358009 - DNA, 75 bp, Artificial Sequence
  Synthetic
tatcgatacaaacgcatactacgtcatgtcagttggctccaagtcatttttggtccatagggaatggttcatgga

SEQ ID NO: 358010 - DNA, 75 bp, Artificial Sequence
  Synthetic
gctggcacggcttggaggaacagagaaacgttgatggaatttgaagaaccacatgccacgaagcaatcggtggtc

SEQ ID NO: 358011 - DNA, 75 bp, Artificial Sequence
  Synthetic
aaacgttgatggaatttgaagaaccacatgccacgaagcaatcggtggtcgccttaggttctcaggaaggagcac

SEQ ID NO: 358012 - DNA, 75 bp, Artificial Sequence
  Synthetic
tccagtgtcgttcacgagtaacactgtgaaattgacttcaggacacctgaaatgtagagtgaagatgggaaagtt

SEQ ID NO: 358013 - DNA, 75 bp, Artificial Sequence
  Synthetic
gtgaaattgacttcaggacacctgaaatgtagagtgaagatgggaaagttgaagctcaaaggaacgacctatgga

SEQ ID NO: 358014 - DNA, 75 bp, Artificial Sequence
  Synthetic
ctgggaatccagctgacacagggcatggcaccgtggtcttagagttgcaatacaccggaaccgatggtccttgta

SEQ ID NO: 358015 - DNA, 75 bp, Artificial Sequence
  Synthetic
tggcaccgtggtcttagagttgcaatacaccggaaccgatggtccttgtaaggtgcctgtctcttccgtggcttc

SEQ ID NO: 358016 - DNA, 75 bp, Artificial Sequence
  Synthetic
agactggtgacagtgaatccctttgttgctgcagctactgctaattcaaaggttctgatagaactggaacctcca

SEQ ID NO: 358017 - DNA, 75 bp, Artificial Sequence
  Synthetic
ttgctgcagctactgctaattcaaaggttctgatagaactggaacctccattcggtgactcatacattgtggtag

SEQ ID NO: 358018 - DNA, 75 bp, Artificial Sequence
  Synthetic
gcccggcaagagccgggctgtcaatatgctaaaacgcggaatgccccgcgtgttgtccttgattggactgaagag

SEQ ID NO: 358019 - DNA, 75 bp, Artificial Sequence
  Synthetic
ccattggcacaagtctggaagcagtattggaaaggcgtttacgacgaccctgaagggagcgcaaaggttggcagc

SEQ ID NO: 358020 - DNA, 75 bp, Artificial Sequence
  Synthetic
attggaaaggcgtttacgacgaccctgaagggagcgcaaaggttggcagctcttggagacaccgcctgggatttt

SEQ ID NO: 358021 - DNA, 75 bp, Artificial Sequence
  Synthetic
ctatgtcatcttggtgggagcagctttcgcagaatctaattcgggaggagacgtggtacacttggcgctcatggc

SEQ ID NO: 358022 - DNA, 75 bp, Artificial Sequence
  Synthetic
cctttgggaaagccgtacaccaagtgtttggaggagcgttccggtcattgtttggtggaatgtcctggatcactc

SEQ ID NO: 358023 - DNA, 75 bp, Artificial Sequence
  Synthetic
gtttggaggagcgttccggtcattgtttggtggaatgtcctggatcactcaggggcttatgggagccctcctcgt

SEQ ID NO: 358024 - DNA, 75 bp, Artificial Sequence
  Synthetic
aagtccattgcacttacgttcctggcggtgggaggaatcctactattcctatcagccaacgtccatgcagacact

SEQ ID NO: 358025 - DNA, 75 bp, Artificial Sequence
  Synthetic
aaagaccggaattgcagtcatgattggcctgatcgccagcgtaggagcagttaccctctctaacttccaagggaa

SEQ ID NO: 358026 - DNA, 75 bp, Artificial Sequence
  Synthetic
gcagatgtgcgcagttactgttacctagcttcggtcagtgacttgtcaacaagagccgcgtgtccaaccatgggt

SEQ ID NO: 358027 - DNA, 75 bp, Artificial Sequence
  Synthetic
cggtgggaggaatcctactattcctatcagccaacgtccatgcagacactggctgtgccattgacatcggaaggc

SEQ ID NO: 358028 - DNA, 75 bp, Artificial Sequence
  Synthetic
agattacatcaacacctcattgacctcaataaatgttcaggcaagtgcactattcacactcgcgcgaggcttccc

SEQ ID NO: 358029 - DNA, 75 bp, Artificial Sequence
  Synthetic
gttcattcacaatgacgtggaggcctggacggaccgatataagttccatccagaaaccccccaggggctggccag

SEQ ID NO: 358030 - DNA, 75 bp, Artificial Sequence
  Synthetic
ggatgcggactgtttggaaaggggagcattgacacatgtgcgaagtttgcctgtacaaccaaagcaactggttgg

SEQ ID NO: 358031 - DNA, 75 bp, Artificial Sequence
  Synthetic
tggacggaccgatataagttccatccagaaaccccccaggggctggccagagtgattcaaaaggctcacgaaagt

SEQ ID NO: 358032 - DNA, 75 bp, Artificial Sequence
  Synthetic
ggcaacagcctggtcactgtacgctgtgaccacagcggtcctcactccactgctaaagcatctgatcacgtcaga

SEQ ID NO: 358033 - DNA, 75 bp, Artificial Sequence
  Synthetic
cccgcttggagcatcagatgtgggactccgtcaaagatgaactcaacactctgtttagagagaatgggattgact

SEQ ID NO: 358034 - DNA, 75 bp, Artificial Sequence
  Synthetic
ctccgtcaaagatgaactcaacactctgtttagagagaatgggattgacttaagcatggtggttgagaagcagag

SEQ ID NO: 358035 - DNA, 75 bp, Artificial Sequence
  Synthetic
cgcttggccgctaccagtgaaaaactggaaatcggatggaaggcatgggggaagagtataatgttcgcctcagaa

SEQ ID NO: 358036 - DNA, 75 bp, Artificial Sequence
  Synthetic
aagttgggtgagtatggtgaggtcacggttgattgtgagccacggtcaggaatagacactagcgcctattacgtt

SEQ ID NO: 358037 - DNA, 75 bp, Artificial Sequence
  Synthetic
tggaaatcggatggaaggcatgggggaagagtataatgttcgcctcagaactggccaatcacaccttcgtggtag

SEQ ID NO: 358038 - DNA, 75 bp, Artificial Sequence
  Synthetic
agcggcaacactcctgttctgccactatgcctacatggttcccggatggcaggctgaggcaatgcgctcagccca

SEQ ID NO: 358039 - DNA, 75 bp, Artificial Sequence
  Synthetic
caccgtgagcagagcgtggaacagcatggaagtggaggattttggattcggcctcatgaccactcgcatgttctt

SEQ ID NO: 358040 - DNA, 75 bp, Artificial Sequence
  Synthetic
atggaagtggaggattttggattcggcctcatgaccactcgcatgttcttgaaagtaagggagggcaacaccact

SEQ ID NO: 358041 - DNA, 75 bp, Artificial Sequence
  Synthetic
ccgccgtcaagaataacttggcggtgcatagcgacctgtcttattggattgaaagtggtcttgatgaaacctgga

SEQ ID NO: 358042 - DNA, 75 bp, Artificial Sequence
  Synthetic
gcatagcgacctgtcttattggattgaaagtggtcttgatgaaacctggaaacttgaacgcgcagtgcttggtga

SEQ ID NO: 358043 - DNA, 75 bp, Artificial Sequence
  Synthetic
gtgaagttgacatcaggacatctgaagtgtagggtgaagatggagaagttgcagctgaagggaacaacatatgga

SEQ ID NO: 358044 - DNA, 75 bp, Artificial Sequence
  Synthetic
tggtgtctctagctgcagtagtagtgaacccgtctgtgaagacagtgcgagaagccggaattttgatcacggcag

SEQ ID NO: 358045 - DNA, 75 bp, Artificial Sequence
  Synthetic
acccacacgttgtggggtgatggagtgatcgagagtgagctcattatcccagttactttggccggtccaaagagc

SEQ ID NO: 358046 - DNA, 75 bp, Artificial Sequence
  Synthetic
tgatcgagagtgagctcattatcccagttactttggccggtccaaagagcaatcacaacaagaggccaggctata

SEQ ID NO: 358047 - DNA, 75 bp, Artificial Sequence
  Synthetic
tggggcaacggctgcggactatttggcaaaggaagcattgacacatgcgccaaatttgcctgctctaccaaggca

SEQ ID NO: 358048 - DNA, 75 bp, Artificial Sequence
  Synthetic
tgaaggtcgaattgagattgattttgactattgcccaggaacgaccgttaccatcagtgaaaactgtggccatcg

SEQ ID NO: 358049 - DNA, 75 bp, Artificial Sequence
  Synthetic
acaaaaggagccgctttgatgagcggagaaggccgcctggacccatactggggtagtgtcaaggaggaccgactt

SEQ ID NO: 358050 - DNA, 75 bp, Artificial Sequence
  Synthetic
gactattgcccaggaacgaccgttaccatcagtgaaaactgtggccatcgtggtccatccgcgcgcaccaccaca

SEQ ID NO: 358051 - DNA, 75 bp, Artificial Sequence
  Synthetic
tagtagtgtttgtgaggattaacaacaattaacacagtgcgagctgtttcttagcacgaagatctcgatgtctaa

SEQ ID NO: 358052 - DNA, 75 bp, Artificial Sequence
  Synthetic
ggtgctgcagaagctgcacgctccccccactacggtatcaaactgatagtggatgttggtatggaatggaaatca

SEQ ID NO: 358053 - DNA, 75 bp, Artificial Sequence
  Synthetic
cccactacggtatcaaactgatagtggatgttggtatggaatggaaatcagacctttgaagcatgatgagaagac

SEQ ID NO: 358054 - DNA, 75 bp, Artificial Sequence
  Synthetic
tactacgtgatgactgttggaacaaagacgttcttggtccatcgtgagtggttcatggacctcaacctcccttgg

SEQ ID NO: 358055 - DNA, 75 bp, Artificial Sequence
  Synthetic
gtttatccacaacgatgtggaagcctggatggatcgttacaagttctacccggagacgccacagggcctagcaaa

SEQ ID NO: 358056 - DNA, 75 bp, Artificial Sequence
  Synthetic
agtcctagtgcttgggggcatcacttacactgatgttctgagatacatcattcttgtgggtgcggcctttatgga

SEQ ID NO: 358057 - DNA, 75 bp, Artificial Sequence
  Synthetic
tacactgatgttctgagatacatcattcttgtgggtgcggcctttatggaagccaactcaggtggagatgtggtg

SEQ ID NO: 358058 - DNA, 75 bp, Artificial Sequence
  Synthetic
atagagaagatggagctgctccagcgccggtatggggggggactggtcagaaacccactctcacggaattccacg

SEQ ID NO: 358059 - DNA, 75 bp, Artificial Sequence
  Synthetic
gaattcaaccagtctttatggtagcttcgtttctaaaggcaagatggacaaaccaggaaaatattttgttgatgt

SEQ ID NO: 358060 - DNA, 75 bp, Artificial Sequence
  Synthetic
ttcgtttctaaaggcaagatggacaaaccaggaaaatattttgttgatgttggctgctgctttctttcagatggc

SEQ ID NO: 358061 - DNA, 75 bp, Artificial Sequence
  Synthetic
gtaaatgctactgacgtcacagatgtcatcacgattccaacagctgctggaaagaatctatgcattgtcagagca

SEQ ID NO: 358062 - DNA, 75 bp, Artificial Sequence
  Synthetic
tcatcacgattccaacagctgctggaaagaatctatgcattgtcagagcaatggatgtgggatacatgtgtgatg

SEQ ID NO: 358063 - DNA, 75 bp, Artificial Sequence
  Synthetic
ggttgggaaatccctgatgttctcaattcattggcggtggcttggatggtgcttcgagctataagctttacttct

SEQ ID NO: 358064 - DNA, 75 bp, Artificial Sequence
  Synthetic
gtggggaaacccctactcaactcagacaccagtaaaatcaagaacaggattgaacgactcaggcgtgagtacagt

SEQ ID NO: 358065 - DNA, 75 bp, Artificial Sequence
  Synthetic
attcattggcggtggcttggatggtgcttcgagctataagctttacttctacttctaacgtggtggttcccgcac

SEQ ID NO: 358066 - DNA, 75 bp, Artificial Sequence
  Synthetic
atgcttgaacttggatgtgtacagaattttgttgctcatggtgggaatagggagtttgatcaaggagaagcggag

SEQ ID NO: 358067 - DNA, 75 bp, Artificial Sequence
  Synthetic
attttgttgctcatggtgggaatagggagtttgatcaaggagaagcggagtgcggcagcaaaaaagaagggagcc

SEQ ID NO: 358068 - DNA, 75 bp, Artificial Sequence
  Synthetic
caactggcattttcagtccaataacgctagctgcaggactaatggcctgtgacccaaaccggaagagggggtggc

SEQ ID NO: 358069 - DNA, 75 bp, Artificial Sequence
  Synthetic
gctagctgcaggactaatggcctgtgacccaaaccggaagagggggtggcctgctaccgaagtgatgacagctgt

SEQ ID NO: 358070 - DNA, 75 bp, Artificial Sequence
  Synthetic
gagaagcagttgaagatccaaaattttgggagatggtggatgaggagcgcgaggcacacctgcggggggaatgtc

SEQ ID NO: 358071 - DNA, 75 bp, Artificial Sequence
  Synthetic
gggctcgctgagctggatattgattccatggcggttcctatgactatcgcagggctcatgttcgcggcttttgtc

SEQ ID NO: 358072 - DNA, 75 bp, Artificial Sequence
  Synthetic
ccatggcggttcctatgactatcgcagggctcatgttcgcggcttttgtcatctcgggaaagtccacagatatgt

SEQ ID NO: 358073 - DNA, 75 bp, Artificial Sequence
  Synthetic
gtgggagagtgacgcggagatcacaggatctagtgatagggtggacgtcaagcttgatgatgatggaaacttcca

SEQ ID NO: 358074 - DNA, 75 bp, Artificial Sequence
  Synthetic
ggatctagtgatagggtggacgtcaagcttgatgatgatggaaacttccagctgatcaatgatccaggagctccg

SEQ ID NO: 358075 - DNA, 75 bp, Artificial Sequence
  Synthetic
tctgcctagccattagtgcctacactccgtgggcaatcttgccatcagttgttgggttctggatcactctccaat

SEQ ID NO: 358076 - DNA, 75 bp, Artificial Sequence
  Synthetic
tccgtgggcaatcttgccatcagttgttgggttctggatcactctccaatatactaagagagggggcgttctatg

SEQ ID NO: 358077 - DNA, 75 bp, Artificial Sequence
  Synthetic
gcggattatttggcaaaggaagcattgacacatgcgccaaatttgcctgctccaccaaggcaacaggaagaacca

SEQ ID NO: 358078 - DNA, 75 bp, Artificial Sequence
  Synthetic
aggaaaggtgacacggccaccggtgtttataggatcatgactcgtggactactaggtaactatcaagccggagta

SEQ ID NO: 358079 - DNA, 75 bp, Artificial Sequence
  Synthetic
tttataggatcatgactcgtggactactaggtaactatcaagccggagtaggagtcatggtggagggagtgttcc

SEQ ID NO: 358080 - DNA, 75 bp, Artificial Sequence
  Synthetic
ggctgccttgatgagcggtgaaggccgtctcgacccctactggggtagtgtgaaagaggaccgcctatgttatgg

SEQ ID NO: 358081 - DNA, 75 bp, Artificial Sequence
  Synthetic
ggtctggcagaacttgacatagattctatggctatccccatgaccattgccggacttatgttcgtggcatttgtc

SEQ ID NO: 358082 - DNA, 75 bp, Artificial Sequence
  Synthetic
cgtctcgacccctactggggtagtgtgaaagaggaccgcctatgttatggagggccatggaagcttgggcatcgg

SEQ ID NO: 358083 - DNA, 75 bp, Artificial Sequence
  Synthetic
tgattgtggttgaacctgggaaaaatgtaaaaaatgtgcaaacaaagcctggtgtgtttaagacccctgatgggg

SEQ ID NO: 358084 - DNA, 75 bp, Artificial Sequence
  Synthetic
ttgggagagtgatgctgaaatcacaggctctagcgaaagagtagatgttaggctggacgatgatggaaattttca

SEQ ID NO: 358085 - DNA, 75 bp, Artificial Sequence
  Synthetic
tgtaaaaaatgtgcaaacaaagcctggtgtgtttaagacccctgatggggaaataggggctgtcaccctcgacta

SEQ ID NO: 358086 - DNA, 75 bp, Artificial Sequence
  Synthetic
atcgttgacaaaaatggagatgtaattggactgtatggtaatggagtcatcatgcccagtggatcttacatcagc

SEQ ID NO: 358087 - DNA, 75 bp, Artificial Sequence
  Synthetic
catttcactgaattgatcatgaaagatggaagaacactggtggttccatgccgaggacaggacgaattggtaggc

SEQ ID NO: 358088 - DNA, 75 bp, Artificial Sequence
  Synthetic
ttggactgtatggtaatggagtcatcatgcccagtggatcttacatcagcgccattgtgcagggagagaggatgg

SEQ ID NO: 358089 - DNA, 75 bp, Artificial Sequence
  Synthetic
aggaacgaagatcgccggaatgttgctgctttcccttctcttgatgattgtgctaattcctgagccagagaagca

SEQ ID NO: 358090 - DNA, 75 bp, Artificial Sequence
  Synthetic
accggacatgcttcgcaagaagcaaatcaccgtccttgacctccatccaggagccggcaagactcggaagatctt

SEQ ID NO: 358091 - DNA, 75 bp, Artificial Sequence
  Synthetic
atcaccgtccttgacctccatccaggagccggcaagactcggaagatcttacctcagatcataaaggaagctatc

SEQ ID NO: 358092 - DNA, 75 bp, Artificial Sequence
  Synthetic
ttgctcccactagggttgtagctgcagagatggcagatgccctgcgtgggcttccgatacgataccaaacttcgg

SEQ ID NO: 358093 - DNA, 75 bp, Artificial Sequence
  Synthetic
agagatggcagatgccctgcgtgggcttccgatacgataccaaacttcggccgttaacagggagcatagtggaaa

SEQ ID NO: 358094 - DNA, 75 bp, Artificial Sequence
  Synthetic
gcgactttgacgcacagactgatgtctccccacagagttccgaactacaacctgttcgtgatggatgaggcccat

SEQ ID NO: 358095 - DNA, 75 bp, Artificial Sequence
  Synthetic
ctccccacagagttccgaactacaacctgttcgtgatggatgaggcccattttacggatccggctagtatagctg

SEQ ID NO: 358096 - DNA, 75 bp, Artificial Sequence
  Synthetic
actgacagcggctgttggtatggtatggagatcagaccacagagacatgatgaaaagaccctcgtgcagtcacaa

SEQ ID NO: 358097 - DNA, 75 bp, Artificial Sequence
  Synthetic
ggagtgttcaagacaccagaaggagaaattggggcagttacgctagactatcccaccggaacgtcaggttccccc

SEQ ID NO: 358098 - DNA, 75 bp, Artificial Sequence
  Synthetic
aagtgcactattcacactcgcgcgaggcttccccttcgtcgatgttggagtgtcagctctcttgctagcagccgg

SEQ ID NO: 358099 - DNA, 75 bp, Artificial Sequence
  Synthetic
agtagcatttagtgatgttagtgtaaatagttaagaaaattttaaggaggaagtcaggccgggaagtttccgcca

SEQ ID NO: 358100 - DNA, 75 bp, Artificial Sequence
  Synthetic
agaactgggagatgccgcggcaatctttatgactgccaccccgccaggttcatccgaccctttcccagaatcaaa

SEQ ID NO: 358101 - DNA, 75 bp, Artificial Sequence
  Synthetic
aagtcaggccgggaagtttccgccaccggaagttgagtagacggtgctgcctgcgactcaaccccaggaggactg

SEQ ID NO: 358102 - DNA, 75 bp, Artificial Sequence
  Synthetic
tttatgactgccaccccgccaggttcatccgaccctttcccagaatcaaacgctcccatttcagacattcaaact

SEQ ID NO: 358103 - DNA, 75 bp, Artificial Sequence
  Synthetic
tgttctgccactatgcctacatggttcccggatggcaggctgaggcaatgcgctcagcccagcggcggacagcgg

SEQ ID NO: 358104 - DNA, 75 bp, Artificial Sequence
  Synthetic
cagggtatgaatggatcactgagttcgttgggaagacggtctggttcgtgccaagcgtgagaatgagtaatgaaa

SEQ ID NO: 358105 - DNA, 75 bp, Artificial Sequence
  Synthetic
cgttgggaagacggtctggttcgtgccaagcgtgagaatgagtaatgaaatggcccagtgcctccaacgtgctgg

SEQ ID NO: 358106 - DNA, 75 bp, Artificial Sequence
  Synthetic
atggtgttaaccagggcgaaaggactagaggttagaggagaccccgcggtttgaagtgcacggcccagcctggct

SEQ ID NO: 358107 - DNA, 75 bp, Artificial Sequence
  Synthetic
aaatcatatgagactgagtaccccaaatgcaagaatgatgattgggacttcgtcataacaacggacatctcagag

SEQ ID NO: 358108 - DNA, 75 bp, Artificial Sequence
  Synthetic
aatgcaagaatgatgattgggacttcgtcataacaacggacatctcagagatgggagcaaacttccgtgccagcc

SEQ ID NO: 358109 - DNA, 75 bp, Artificial Sequence
  Synthetic
gaaaccaattatcatcactgaaggagaaggacgagtgatactaggggaaccctctgccattacggctgctagtgc

SEQ ID NO: 358110 - DNA, 75 bp, Artificial Sequence
  Synthetic
gaaggacgagtgatactaggggaaccctctgccattacggctgctagtgcagcccaaaggagaggacgcattgga

SEQ ID NO: 358111 - DNA, 75 bp, Artificial Sequence
  Synthetic
aatactgctacggagggcacaccaacgaggatgactctaacttcgcccattggactgaagcccggatcatgcttg

SEQ ID NO: 358112 - DNA, 75 bp, Artificial Sequence
  Synthetic
cgaggatgactctaacttcgcccattggactgaagcccggatcatgcttgacaacatcaacatgccgaatggcct

SEQ ID NO: 358113 - DNA, 75 bp, Artificial Sequence
  Synthetic
agagaaaaggtgtacacgatggatggagagtataggctcaggggagaagagcggaagaactttctggaattgttg

SEQ ID NO: 358114 - DNA, 75 bp, Artificial Sequence
  Synthetic
gagagtataggctcaggggagaagagcggaagaactttctggaattgttgagaacggctgaccttcccgtttggc

SEQ ID NO: 358115 - DNA, 75 bp, Artificial Sequence
  Synthetic
agtatcctatcatgaccggaagtggtgcttcgacgggcccagaaccaacacggtcctagaggacaacaatgaagt

SEQ ID NO: 358116 - DNA, 75 bp, Artificial Sequence
  Synthetic
tgcttcgacgggcccagaaccaacacggtcctagaggacaacaatgaagtggaagtgataaccaaagtgggtgaa

SEQ ID NO: 358117 - DNA, 75 bp, Artificial Sequence
  Synthetic
ctgatgcccgagtatactctgatcaccaagcgttgaagtctttcaaagattttgctgcaggaaagcgctcacaga

SEQ ID NO: 358118 - DNA, 75 bp, Artificial Sequence
  Synthetic
ccaagcgttgaagtctttcaaagattttgctgcaggaaagcgctcacagataggactggttgaagttcttggaag

SEQ ID NO: 358119 - DNA, 75 bp, Artificial Sequence
  Synthetic
acctgggaagccttggacacaatgtatgtggtagccacagctgagcgaggaggtcgggcccatagatcggctctt

SEQ ID NO: 358120 - DNA, 75 bp, Artificial Sequence
  Synthetic
atgtggtagccacagctgagcgaggaggtcgggcccatagatcggctcttgaagaactgcctgatgctcttcaaa

SEQ ID NO: 358121 - DNA, 75 bp, Artificial Sequence
  Synthetic
gctgatcttggtgtctctagctgcagtagtagtgaacccgtctgtgaagacagtacgagaagccggaattttgat

SEQ ID NO: 358122 - DNA, 75 bp, Artificial Sequence
  Synthetic
tgtgatgaccatgggaatcttctttctgcttatgcagaggaagggtatcgggaagattggcctgggaggcacagt

SEQ ID NO: 358123 - DNA, 75 bp, Artificial Sequence
  Synthetic
ctgcttatgcagaggaagggtatcgggaagattggcctgggaggcacagttctcggggcagcaacgttcttctgt

SEQ ID NO: 358124 - DNA, 75 bp, Artificial Sequence
  Synthetic
aaatcgctggtatgttgttactatcccttctgctaatgattgttctgatacctgaaccagaaaagcagcgatctc

SEQ ID NO: 358125 - DNA, 75 bp, Artificial Sequence
  Synthetic
ccttctgctaatgattgttctgatacctgaaccagaaaagcagcgatctcaaacagacaaccagctggcggtgtt

SEQ ID NO: 358126 - DNA, 75 bp, Artificial Sequence
  Synthetic
cttaggagctgccacattcttttgctggatggctgaagtcccaggaacgaaaatagcaggcatgctcctgctttc

SEQ ID NO: 358127 - DNA, 75 bp, Artificial Sequence
  Synthetic
agcgccgttgcagccaatgagatgggctggttggacaaaaccaaaaatgacatgagcaacttgctggggcaaaag

SEQ ID NO: 358128 - DNA, 75 bp, Artificial Sequence
  Synthetic
gctggttggacaaaaccaaaaatgacatgagcaacttgctggggcaaaagcctgggacaacggagagtctcggaa

SEQ ID NO: 358129 - DNA, 75 bp, Artificial Sequence
  Synthetic
ctgatgtgttgcgctatgtcatcttggtgggagcagctttcgcagaatctaattcaggaggagacgtggtacact

SEQ ID NO: 358130 - DNA, 75 bp, Artificial Sequence
  Synthetic
accggctacggcctggtcactttacgcaatttcaaccgcgttcatgacaccattgctgaaacatttgataacatc

SEQ ID NO: 358131 - DNA, 75 bp, Artificial Sequence
  Synthetic
gcaatttcaaccgcgttcatgacaccattgctgaaacatttgataacatcggactatatcaacacgtctttgacg

SEQ ID NO: 358132 - DNA, 75 bp, Artificial Sequence
  Synthetic
tatttactttggctcgaggatttcctttcgttgacgtgggtatatcttccttgttactagcagttgggtgttggg

SEQ ID NO: 358133 - DNA, 75 bp, Artificial Sequence
  Synthetic
tttcgttgacgtgggtatatcttccttgttactagcagttgggtgttggggtcaggtgactttgactgtagccgt

SEQ ID NO: 358134 - DNA, 75 bp, Artificial Sequence
  Synthetic
actggcagtagcttggatgatattgagagccataacattcacaacgacatcaaacgtggttgttccgttgctggc

SEQ ID NO: 358135 - DNA, 75 bp, Artificial Sequence
  Synthetic
cactacgcttatatggtgcctggatggcaagctgaagctatgcgctcagctcaacggcggacggctgctggcatc

SEQ ID NO: 358136 - DNA, 75 bp, Artificial Sequence
  Synthetic
ggaggaccccacatgtgatccagtgtaagccctcagaaccgtctcggaaggagggaccccacatgtgatccagtg

SEQ ID NO: 358137 - DNA, 75 bp, Artificial Sequence
  Synthetic
ggcaagctgaagctatgcgctcagctcaacggcggacggctgctggcatcatgaagaatgccgttgttgacggaa

SEQ ID NO: 358138 - DNA, 75 bp, Artificial Sequence
  Synthetic
agaacgcacgactccaatcatgcagaagaaagtcggccagatcatgctgatcttggtgtccctagcggcagtggt

SEQ ID NO: 358139 - DNA, 75 bp, Artificial Sequence
  Synthetic
aagaaagtcggccagatcatgctgatcttggtgtccctagcggcagtggtggtcaacccatccgtgaaaacagcc

SEQ ID NO: 358140 - DNA, 75 bp, Artificial Sequence
  Synthetic
tgttatgcttggctctagcctcaacaggacttttcaaccccatgatccttgccgctggactgattgcatgtgatc

SEQ ID NO: 358141 - DNA, 75 bp, Artificial Sequence
  Synthetic
cggcttccgttacgctgtgggagaacggagcaagttcagtctggaacgccacaacagccattggcctctgccatg

SEQ ID NO: 358142 - DNA, 75 bp, Artificial Sequence
  Synthetic
cggagcaagttcagtctggaacgccacaacagccattggcctctgccatgttatgcgaggtggttggttgtcttg

SEQ ID NO: 358143 - DNA, 75 bp, Artificial Sequence
  Synthetic
ttacagactgagatcccggatcgagcttggaactctggatacgaatggatcacagaatacaccgggaagacggtt

SEQ ID NO: 358144 - DNA, 75 bp, Artificial Sequence
  Synthetic
aaaaacatggagaaacccgggttgaagagaggaggcgcgaagggacgcacattgggtgaggcgtggaaggagaga

SEQ ID NO: 358145 - DNA, 75 bp, Artificial Sequence
  Synthetic
agagaggaggcgcgaagggacgcacattgggtgaggcgtggaaggagagacttaaccagttaaccaaggaggagt

SEQ ID NO: 358146 - DNA, 75 bp, Artificial Sequence
  Synthetic
caccgaggtggatcgagcaccagccaagtatgccagaaaggaaggtaatgtcacaggtggccactcggtgtcaag

SEQ ID NO: 358147 - DNA, 75 bp, Artificial Sequence
  Synthetic
aagtatgccagaaaggaaggtaatgtcacaggtggccactcggtgtcaagaggcactgccaaacttcggtggctt

SEQ ID NO: 358148 - DNA, 75 bp, Artificial Sequence
  Synthetic
ttggaaaggtcatagacctaggctgtggaagaggaggctggtgctactacatggcgactcaaaaaagagtgcagg

SEQ ID NO: 358149 - DNA, 75 bp, Artificial Sequence
  Synthetic
tggaagaggaggctggtgctactacatggcgactcaaaaaagagtgcaggaagtcagaggttatacaaaaggggg

SEQ ID NO: 358150 - DNA, 75 bp, Artificial Sequence
  Synthetic
gtccagagttatgggtggaacatcgtcaccatgaagagtaaggtagatgtgttctaccggacctcagaagccagt

SEQ ID NO: 358151 - DNA, 75 bp, Artificial Sequence
  Synthetic
tcaccatgaagagtaaggtagatgtgttctaccggacctcagaagccagtgataccctgctttgtgacattgggg

SEQ ID NO: 358152 - DNA, 75 bp, Artificial Sequence
  Synthetic
ggaacataggacagtgcgcgtcttggaaatggtggaagattggctgcaccgcggaccacgcgagttttgtgtgaa

SEQ ID NO: 358153 - DNA, 75 bp, Artificial Sequence
  Synthetic
gaaatggtggaagattggctgcaccgcggaccacgcgagttttgtgtgaaggtgctgtgtccttatatgccaaag

SEQ ID NO: 358154 - DNA, 75 bp, Artificial Sequence
  Synthetic
agcgtcggtatggaggtggccttgttagaaacccgctatcacgcaattccacacatgagatgtactgggtcagtc

SEQ ID NO: 358155 - DNA, 75 bp, Artificial Sequence
  Synthetic
tagaaacccgctatcacgcaattccacacatgagatgtactgggtcagtcatgcgtcgggcaacatagtgcacgc

SEQ ID NO: 358156 - DNA, 75 bp, Artificial Sequence
  Synthetic
ctcggtagaatggaaaagaaaacgtggaaaggcccacattatgaggaagacgtaaatttgggaagtggcacacga

SEQ ID NO: 358157 - DNA, 75 bp, Artificial Sequence
  Synthetic
ggaaaggcccacattatgaggaagacgtaaatttgggaagtggcacacgagcagttggaaaacccctactcaact

SEQ ID NO: 358158 - DNA, 75 bp, Artificial Sequence
  Synthetic
aattgagagactgaagaaagaatacagttcaacgtggcatcaagacagcaaccatccctataggacttggaacta

SEQ ID NO: 358159 - DNA, 75 bp, Artificial Sequence
  Synthetic
agttcaacgtggcatcaagacagcaaccatccctataggacttggaactatcatgggagctatgaggtgaagccc

SEQ ID NO: 358160 - DNA, 75 bp, Artificial Sequence
  Synthetic
tataggtttatagtggcatttaatgatgttagtgtaaatagttaagaaaattttaaggaggaagtcaggccggaa

SEQ ID NO: 358161 - DNA, 75 bp, Artificial Sequence
  Synthetic
acggagttgtgcgactcctatccaagccttgggacaccatcatgaatgtcaccaccatggctatgacggatacca

SEQ ID NO: 358162 - DNA, 75 bp, Artificial Sequence
  Synthetic
gccttgggacaccatcatgaatgtcaccaccatggctatgacggataccacaccctttggacagcagcgcgtgtt

SEQ ID NO: 358163 - DNA, 75 bp, Artificial Sequence
  Synthetic
ccagaaccacctgagggggtaaagtgcgtgcttaatgagaccaccaactggttgtggtcgcacctcgagcgtgaa

SEQ ID NO: 358164 - DNA, 75 bp, Artificial Sequence
  Synthetic
gcgtgcttaatgagaccaccaactggttgtggtcgcacctcgagcgtgaaaagcgtcccaggatgtgctcccgag

SEQ ID NO: 358165 - DNA, 75 bp, Artificial Sequence
  Synthetic
aggttatatttccacaaaggtcgagctgggggaggcggcggcaatattcatgacagccaccccgccgggcacctc

SEQ ID NO: 358166 - DNA, 75 bp, Artificial Sequence
  Synthetic
caatgcagcgctaggagctatgtttgaggaacagaaccagtggaaaagcgctagagaagctgtcgaggactccac

SEQ ID NO: 358167 - DNA, 75 bp, Artificial Sequence
  Synthetic
gaggaacagaaccagtggaaaagcgctagagaagctgtcgaggactccacgttttgggagatggttgatgaagaa

SEQ ID NO: 358168 - DNA, 75 bp, Artificial Sequence
  Synthetic
gggaagacggtttggtttgtgcctagtgtgaaaatggggaatgagattgccctttgtctacaacgtgccggaaag

SEQ ID NO: 358169 - DNA, 75 bp, Artificial Sequence
  Synthetic
gcaacacctgcatctacaacatgatggggaaaagagagaaaaaaccaggagagttcggaaaagccaggggcagcc

SEQ ID NO: 358170 - DNA, 75 bp, Artificial Sequence
  Synthetic
aaattgcagttgaagggaacaacctacggcgtctgctcaaaggctttcaagtttcttgggactcccgcagacaca

SEQ ID NO: 358171 - DNA, 75 bp, Artificial Sequence
  Synthetic
ggggaaaagagagaaaaaaccaggagagttcggaaaagccaggggcagccgagctatttggtttatgtggctggg

SEQ ID NO: 358172 - DNA, 75 bp, Artificial Sequence
  Synthetic
ctaggattcttgaatgaagaccactggcttggcagagaaaattcaggaggtggagtggaaggcttgggcttgcag

SEQ ID NO: 358173 - DNA, 75 bp, Artificial Sequence
  Synthetic
gggctaacttcaaggcgagcagggtgatcgacagcaggaaaagcgtgaagccaaccatcataacagaaggagaag

SEQ ID NO: 358174 - DNA, 75 bp, Artificial Sequence
  Synthetic
ggcttggcagagaaaattcaggaggtggagtggaaggcttgggcttgcagaagctggggtacgtccttagagaag

SEQ ID NO: 358175 - DNA, 75 bp, Artificial Sequence
  Synthetic
gtacgccgacgacaccgctggatgggacacccggatcacgaaagctgatttggagaacgaggcaaaagttcttga

SEQ ID NO: 358176 - DNA, 75 bp, Artificial Sequence
  Synthetic
gacacccggatcacgaaagctgatttggagaacgaggcaaaagttcttgagctgttggatggagagcaccgacgg

SEQ ID NO: 358177 - DNA, 75 bp, Artificial Sequence
  Synthetic
cctataggcacaaagtcgtgaaggtcatgagaccagcagcggacggaaaaaccgtgatggacatcatatccaggg

SEQ ID NO: 358178 - DNA, 75 bp, Artificial Sequence
  Synthetic
catgagaccagcagcggacggaaaaaccgtgatggacatcatatccagggaagatcagcgggggagcggacaagt

SEQ ID NO: 358179 - DNA, 75 bp, Artificial Sequence
  Synthetic
aaaaacttcctggaattgttgaggactgcagatctgccagtttggctggcttacaaggtggcagcggctggagtg

SEQ ID NO: 358180 - DNA, 75 bp, Artificial Sequence
  Synthetic
accaacctggccgtgcaactggtcaggatgatggaaggtgaaggtgtcatcgggccagatgacattgagaagtta

SEQ ID NO: 358181 - DNA, 75 bp, Artificial Sequence
  Synthetic
ggatgatggaaggtgaaggtgtcatcgggccagatgacattgagaagttaggcaaaggtaaaggaccaaaggtaa

SEQ ID NO: 358182 - DNA, 75 bp, Artificial Sequence
  Synthetic
ggagcgccttggtaggatggcagttagcggtgacgattgcgtggtcaaaccactggatgatcgattcgccacttc

SEQ ID NO: 358183 - DNA, 75 bp, Artificial Sequence
  Synthetic
agcggtgacgattgcgtggtcaaaccactggatgatcgattcgccacttctcttcacttcctcaatgccatgtca

SEQ ID NO: 358184 - DNA, 75 bp, Artificial Sequence
  Synthetic
ggaagccttccactggctggtacgactggcagcaggtgcccttctgttcaaaccactttactgaactgatcatga

SEQ ID NO: 358185 - DNA, 75 bp, Artificial Sequence
  Synthetic
ctggcagcaggtgcccttctgttcaaaccactttactgaactgatcatgaaggatggtaggactctggtggtgcc

SEQ ID NO: 358186 - DNA, 75 bp, Artificial Sequence
  Synthetic
aaaattggaaattggctggaaggcctggggaaagagcatcttatttgcaccagaactcgccaacaacacctttgt

SEQ ID NO: 358187 - DNA, 75 bp, Artificial Sequence
  Synthetic
ggcagagccagaatctccccaggggcaggttggaatgttcgcgatacagcttgtcttgcaaaatcatacgctcaa

SEQ ID NO: 358188 - DNA, 75 bp, Artificial Sequence
  Synthetic
tggggaaagagcatcttatttgcaccagaactcgccaacaacacctttgtggttgatggtccggagaccaaggaa

SEQ ID NO: 358189 - DNA, 75 bp, Artificial Sequence
  Synthetic
ttgtagtggaggacactgttttgtaaataataaagctgtgttgagtagtgatatagttgtagtgtttatagcaat

SEQ ID NO: 358190 - DNA, 75 bp, Artificial Sequence
  Synthetic
atgaccatgggagtattctttctcctcatgcagcggaagggcattggaaagataggtctgggaggtattgtcttg

SEQ ID NO: 358191 - DNA, 75 bp, Artificial Sequence
  Synthetic
caggttggaatgttcgcgatacagcttgtcttgcaaaatcatacgctcaaatgtggctgctgctatatttccatc

SEQ ID NO: 358192 - DNA, 75 bp, Artificial Sequence
  Synthetic
cgccatctgctcggcagtccccgtggactgggtcccgaccggtaggacgacctggtcaattcatgctaagggtga

SEQ ID NO: 358193 - DNA, 75 bp, Artificial Sequence
  Synthetic
gactgggtcccgaccggtaggacgacctggtcaattcatgctaagggtgagtggatgaccactgctgacatgctg

SEQ ID NO: 358194 - DNA, 75 bp, Artificial Sequence
  Synthetic
aagagaatgagtggatggaagacaagactccggtcgaacgttggagcgacattccatattccggaaaacgggaag

SEQ ID NO: 358195 - DNA, 75 bp, Artificial Sequence
  Synthetic
gaagcaaccacaatcggagacctgggtacaagacacaaaaccagggcccatgggacgaaggccgggtagagattg

SEQ ID NO: 358196 - DNA, 75 bp, Artificial Sequence
  Synthetic
gactccggtcgaacgttggagcgacattccatattccggaaaacgggaagacatctggtgtggaagcttgattgg

SEQ ID NO: 358197 - DNA, 75 bp, Artificial Sequence
  Synthetic
ggtcaccctgagtgagagctgcggacaccgtggacctgccactcgcaccactacagagagcggaaagttgataac

SEQ ID NO: 358198 - DNA, 75 bp, Artificial Sequence
  Synthetic
gaaaacatccaagttgccattggtcaggtccgttcgataatcggagaagaaaaatacgtcgactacatgagttcg

SEQ ID NO: 358199 - DNA, 75 bp, Artificial Sequence
  Synthetic
aggtccgttcgataatcggagaagaaaaatacgtcgactacatgagttcgctcaagaggtatgaagacgtcacgg

SEQ ID NO: 358200 - DNA, 75 bp, Artificial Sequence
  Synthetic
gaaggagcgttcattgtaaatatgtgtatatatagggttgaagaagtcaggccagctttaagctgccaccggatg

SEQ ID NO: 358201 - DNA, 75 bp, Artificial Sequence
  Synthetic
gtatatatagggttgaagaagtcaggccagctttaagctgccaccggatgtcgagtagacggtgctgcctgcagc

SEQ ID NO: 358202 - DNA, 75 bp, Artificial Sequence
  Synthetic
acagagtaccccaagtgcaagaacgatgattgggattttgtcatcaccacagacatatcagaaatgggagccaac

SEQ ID NO: 358203 - DNA, 75 bp, Artificial Sequence
  Synthetic
aaagctgcggggtgatccacgtaagccctcaaaaccgactcggaaagaggtccccacgtgtcttaaccctaaggc

SEQ ID NO: 358204 - DNA, 75 bp, Artificial Sequence
  Synthetic
ccagttgtcagaccacacgcaagtgtgctactctgcgaagagtactgtctgcgttagagccccaggaggactggg

SEQ ID NO: 358205 - DNA, 75 bp, Artificial Sequence
  Synthetic
ttaaccagggagaagggactagaggttagaggagaccccgcgttcagaagtgcacggcccaacctggctaaagct

SEQ ID NO: 358206 - DNA, 75 bp, Artificial Sequence
  Synthetic
tagtggagaccccgtgccaatcacaccaaacaaaaaacagcatattgacacctgggatagactaggagatcttct

SEQ ID NO: 358207 - DNA, 75 bp, Artificial Sequence
  Synthetic
tctgcttagcacaaccagccacaaggcacagtgcgccgatataggtggctggtggggaactagaccacaggatct

SEQ ID NO: 358208 - DNA, 75 bp, Artificial Sequence
  Synthetic
tccttgaaaggattctctcagaatcctttcaggattctgaggagaatcttttcaggattctgaggagaatcctga

SEQ ID NO: 358209 - DNA, 75 bp, Artificial Sequence
  Synthetic
cggaaggaggaccccacatgttgtgatccatgtaagccctcagaaccgtctcggaaggaggaccccacatgttgt

SEQ ID NO: 358210 - DNA, 75 bp, Artificial Sequence
  Synthetic
ctcatttcaccgacccagctagcatcgcagcaagaggttacatttccacaaaggtcgagctaggggaggcggcgg

SEQ ID NO: 358211 - DNA, 75 bp, Artificial Sequence
  Synthetic
ctcttggcgttttttaggttcacggcaattgctccgacccgggcagtgctggatcgatggagaagtgtgaacaaa

SEQ ID NO: 358212 - DNA, 75 bp, Artificial Sequence
  Synthetic
gtttcaagaaggaactaggaaccttgaccagcgctatcaaccggcggagttcaaaacagaagaagagaggaggaa

SEQ ID NO: 358213 - DNA, 75 bp, Artificial Sequence
  Synthetic
acacaactttggttgaggacacagtactgtagatatttaattaattgtaaatagacaatataagtatgcataaaa

SEQ ID NO: 358214 - DNA, 75 bp, Artificial Sequence
  Synthetic
cgtcgcagacattatcacggtaccaacggccgctggaaagaacctgtgcacagtcagagctatggacgtggggta

SEQ ID NO: 358215 - DNA, 75 bp, Artificial Sequence
  Synthetic
gaatgcccagttttgtcggccggaaatgatccagaagacattgactgctggtgcacgaagttagcagtctacgtt

SEQ ID NO: 358216 - DNA, 75 bp, Artificial Sequence
  Synthetic
aaggtatttggtaaaaacagaatcatggatcttgagaaaccctggatatgccttggtggcagctgtcattggatg

SEQ ID NO: 358217 - DNA, 75 bp, Artificial Sequence
  Synthetic
cgtgtcgtgttcaccgtgttactgctcttggtagctcctgcctacagctttaactgtcttggaatgagcaacaga

SEQ ID NO: 358218 - DNA, 75 bp, Artificial Sequence
  Synthetic
caacatgggtggacctggtccttgaaggtgacagctgtgtgaccattatgtccaaggacaagcccactatcgatg

SEQ ID NO: 358219 - DNA, 75 bp, Artificial Sequence
  Synthetic
ccatgtgtaagccctcagaaaccgtctcggaaggagggaccccaccatgatgtgaacacatgacgcgaagtgatc

SEQ ID NO: 358220 - DNA, 75 bp, Artificial Sequence
  Synthetic
taacttagcagaagtccgcagttactgctacttagccactgtcagtgaactctccaccaaggctgcgtgcccaac

SEQ ID NO: 358221 - DNA, 75 bp, Artificial Sequence
  Synthetic
tgctacttagccactgtcagtgaactctccaccaaggctgcgtgcccaaccatgggggaagcccataatgacaag

SEQ ID NO: 358222 - DNA, 75 bp, Artificial Sequence
  Synthetic
tctccaccaaggctgcgtgcccaaccatgggggaagcccataatgacaagcgagctgacccatctttcgtgtgca

SEQ ID NO: 358223 - DNA, 75 bp, Artificial Sequence
  Synthetic
gggcaatgggtgcggactttttggcaaaggaagcatcgacacatgcgccaaatttgcctgttcaaccaaggcgac

SEQ ID NO: 358224 - DNA, 75 bp, Artificial Sequence
  Synthetic
aaaggaagcatcgacacatgcgccaaatttgcctgttcaaccaaggcgacaggaaggactatcctaaaggagaac

SEQ ID NO: 358225 - DNA, 75 bp, Artificial Sequence
  Synthetic
tgcatgggccaaccaccgtggaatcgcatgggaactactccacgcaaaccggagccgctcaggctgggagattta

SEQ ID NO: 358226 - DNA, 75 bp, Artificial Sequence
  Synthetic
gaagtaacggtggactgtgaaccacgctcagggatagacaccagtgcatactatgtgatgactgtcgggacaaag

SEQ ID NO: 358227 - DNA, 75 bp, Artificial Sequence
  Synthetic
gctcagggatagacaccagtgcatactatgtgatgactgtcgggacaaagactttcttggtccaccgcgagtggt

SEQ ID NO: 358228 - DNA, 75 bp, Artificial Sequence
  Synthetic
cagtgctgaaagtaatgtttggaggaacagagagacgctaatggagtttgaagaaccacatgccacgaagcaatc

SEQ ID NO: 358229 - DNA, 75 bp, Artificial Sequence
  Synthetic
aagaaccacatgccacgaagcaatctgtaatagcactaggctctcaagagggagccttgcaccaagctctggcag

SEQ ID NO: 358230 - DNA, 75 bp, Artificial Sequence
  Synthetic
tatgtggattacatgagttcactaaagagatatgaagacacaactttggttgaggacacagtactgtaaatactt

SEQ ID NO: 358231 - DNA, 75 bp, Artificial Sequence
  Synthetic
ttatggcgtttgttcaaaggctttcagattccttgggacccccgcagacacgggccatggtactgtggtattgga

SEQ ID NO: 358232 - DNA, 75 bp, Artificial Sequence
  Synthetic
ggggcgatggaatccttgagagtgacttgataataccagtcacactggcgggaccacgaagcaaccacaatcgga

SEQ ID NO: 358233 - DNA, 75 bp, Artificial Sequence
  Synthetic
tagcctcattgaatgacctaacgccagtgggcaggttagtcaccgtcaacccctttgtctccgtgtcaacggcta

SEQ ID NO: 358234 - DNA, 75 bp, Artificial Sequence
  Synthetic
accgcccttcggagattcgtacatagtggtgggaagaggagagcaacagatcaaccatcactggcacaagtctgg

SEQ ID NO: 358235 - DNA, 75 bp, Artificial Sequence
  Synthetic
gtggtgggaagaggagagcaacagatcaaccatcactggcacaagtctggaagtagcattggcaaagctttcaca

SEQ ID NO: 358236 - DNA, 75 bp, Artificial Sequence
  Synthetic
tggcagctctgggagacacagcttgggactttggatcagttggaggagtgtttacctccgtgggaaaggctgtcc

SEQ ID NO: 358237 - DNA, 75 bp, Artificial Sequence
  Synthetic
ctcattgtttggaggcatgtcttggataactcagggtttgctgggggccctcctactgtggatgggtatcaacgc

SEQ ID NO: 358238 - DNA, 75 bp, Artificial Sequence
  Synthetic
ttcctcgcggttggaggagttctgctctttctttccgtgaacgtgcatgctgacactggatgtgccatagatata

SEQ ID NO: 358239 - DNA, 75 bp, Artificial Sequence
  Synthetic
tctttctttccgtgaacgtgcatgctgacactggatgtgccatagatataagtcggcaagagttgaggtgtggca

SEQ ID NO: 358240 - DNA, 75 bp, Artificial Sequence
  Synthetic
ggtcaatggagtggttaggctcctctcaaaaccatgggacaccatcacgaatgttaccaccatggccatgactga

SEQ ID NO: 358241 - DNA, 75 bp, Artificial Sequence
  Synthetic
ggaagcttggatggaccgatacaagtactaccctgaaacaccacaaggtctagctaagatcgttcaaaaggctca

SEQ ID NO: 358242 - DNA, 75 bp, Artificial Sequence
  Synthetic
tactaccctgaaacaccacaaggtctagctaagatcgttcaaaaggctcacaaggagggagtgtgcggtctacgc

SEQ ID NO: 358243 - DNA, 75 bp, Artificial Sequence
  Synthetic
tgtgggaagcagtgaaggatgaactaaacacccttttgaaggaaaatggtgtagaccttagtattgtggttgaga

SEQ ID NO: 358244 - DNA, 75 bp, Artificial Sequence
  Synthetic
gagaaactggaaataggttggaaagcctgggggaagagcattctgttcgcaccagaactggccaacaacactttc

SEQ ID NO: 358245 - DNA, 75 bp, Artificial Sequence
  Synthetic
agtgtccaactcgaaaccgcgcctggaacagtttggaggtggaagattttggatttggcctcaccagcactcgaa

SEQ ID NO: 358246 - DNA, 75 bp, Artificial Sequence
  Synthetic
cacgactgaatgtgactcaaagatcatcgggactgccgtcaagaataacttggcgatccatagcgacctatccta

SEQ ID NO: 358247 - DNA, 75 bp, Artificial Sequence
  Synthetic
aaccatcataacagaaggagaagggagagtgatcctgggagaaccatctgcagtgacggcagctagtgccgccca

SEQ ID NO: 358248 - DNA, 75 bp, Artificial Sequence
  Synthetic
taataccaatcacgctagcgggaccgcgaagcaaccacaaccggaggcctgggtataaaacgcaaagccagggtc

SEQ ID NO: 358249 - DNA, 75 bp, Artificial Sequence
  Synthetic
tgtcaaaggttcgcaaagacatccaagagtggaaaccgtcaactggatggtatgattggcagcaggttccattct

SEQ ID NO: 358250 - DNA, 75 bp, Artificial Sequence
  Synthetic
ggcatcgtggacctgccatccgcaccactacagagagtggaaagctgataacggactggtgctgtaggagttgca

SEQ ID NO: 358251 - DNA, 75 bp, Artificial Sequence
  Synthetic
ggagagtggatgacaacagaggacatgctggaggtctggaaccgtgtttggatagaggagaatgaatggatggaa

SEQ ID NO: 358252 - DNA, 75 bp, Artificial Sequence
  Synthetic
agacaatggttgttggtatggcatggagattaggccacagagacatgatgaaaaaactcttgtgcagtcacaagt

SEQ ID NO: 358253 - DNA, 75 bp, Artificial Sequence
  Synthetic
tatgtcattttggtgggggctgcctttgcagaatccaactcaggaggagatgtggtgcacctggcgctcatggcg

SEQ ID NO: 358254 - DNA, 75 bp, Artificial Sequence
  Synthetic
tggtagcatcatttctcaaggcgagatggaccaaccaagagaacattctgttgatgttggcggctgtcttcttcc

SEQ ID NO: 358255 - DNA, 75 bp, Artificial Sequence
  Synthetic
ttgatgttggcggctgtcttcttccaaatggcttactatgatgcccggcaaattttgctttgggaaatacctgat

SEQ ID NO: 358256 - DNA, 75 bp, Artificial Sequence
  Synthetic
ggatgatattgagagcgataacgttcaccacaacatctaatgtggtcgttccgctgctggccttgttaacacctg

SEQ ID NO: 358257 - DNA, 75 bp, Artificial Sequence
  Synthetic
gtataggatcctgctattgatggttggagtcggcagtttgatgagggaaaaaagaagtgcagctgcaaaaaagaa

SEQ ID NO: 358258 - DNA, 75 bp, Artificial Sequence
  Synthetic
ctagcctcaacaggattttttaaccccatgatccttgctgctggacttattgcatgtgatcccaatcgcaagcgg

SEQ ID NO: 358259 - DNA, 75 bp, Artificial Sequence
  Synthetic
gggtggcctgcaactgaagtgatgacagctgtaggcttaatgtttgccatcgttggagggcttgcagaactggac

SEQ ID NO: 358260 - DNA, 75 bp, Artificial Sequence
  Synthetic
cgttggagggcttgcagaactggacatggactctatggccattccaatgaccattgcagggctaatgtttgctgc

SEQ ID NO: 358261 - DNA, 75 bp, Artificial Sequence
  Synthetic
gttcatacacaatgatgtggaggcttggatggaccggtacaagtactaccctgaaacgccacaaggcttagccaa

SEQ ID NO: 358262 - DNA, 75 bp, Artificial Sequence
  Synthetic
gacatgtggattgagagaacagcggacatctcctgggagagtgatgcggaaatcacaggttccagtgaaagagtt

SEQ ID NO: 358263 - DNA, 75 bp, Artificial Sequence
  Synthetic
ctccaatacacaaagagaggaggtgtgctgtgggacactccctctccaaaggagtacaagaagggggacacgacc

SEQ ID NO: 358264 - DNA, 75 bp, Artificial Sequence
  Synthetic
gatccacagtgacctgtcctattggattgaaagcaggctcaatgatacgtggaagcttgaaagggcggttctggg

SEQ ID NO: 358265 - DNA, 75 bp, Artificial Sequence
  Synthetic
gtggattacttggtagttaccaagcaggagccggcgtgatggttgaaggtgttttccacaccctctggcacacga

SEQ ID NO: 358266 - DNA, 75 bp, Artificial Sequence
  Synthetic
aggagccggcgtgatggttgaaggtgttttccacaccctctggcacacgacaaaaggagccgctctgatgagcgg

SEQ ID NO: 358267 - DNA, 75 bp, Artificial Sequence
  Synthetic
agcttgaaagggcagttctgggtgaagtcaaatcatgcacgtggcctgagacgcacaccttgtggggcgatggaa

SEQ ID NO: 358268 - DNA, 75 bp, Artificial Sequence
  Synthetic
agtcaaatcatgcacgtggcctgagacgcacaccttgtggggcgatggaatcctcgagagtgacttgataatacc

SEQ ID NO: 358269 - DNA, 75 bp, Artificial Sequence
  Synthetic
ggcagcgtcaaggaggatcgactttgttatggtggaccctggaaattgcagcacaagtggaatggccaagatgag

SEQ ID NO: 358270 - DNA, 75 bp, Artificial Sequence
  Synthetic
ctcgcgcgaggcttccctttcgtcgatgttggagtgtcggctctcctgctagcagccggatgctggggacaagtc

SEQ ID NO: 358271 - DNA, 75 bp, Artificial Sequence
  Synthetic
ggaagaatgtcaagaacgtccagaccaaaccgggggtgttcaaaactcctgaaggggaaattggggccgtgactt

SEQ ID NO: 358272 - DNA, 75 bp, Artificial Sequence
  Synthetic
gtgcacggcccagcctggctgaagctgtaggtcaggggctgagacacgcaacaggggataggcaaggcacacagg

SEQ ID NO: 358273 - DNA, 75 bp, Artificial Sequence
  Synthetic
tggacctgccattcgcactactacagagagcggaaagttgataacagattggtgctgcaggagctgcaccttacc

SEQ ID NO: 358274 - DNA, 75 bp, Artificial Sequence
  Synthetic
tctggcggggccctcctggtttcttagacatcgagatcttcgtgctaagaaacagctcgcactgtgttaattgtt

SEQ ID NO: 358275 - DNA, 75 bp, Artificial Sequence
  Synthetic
gatgtgattgggctttatggcaacggagttataatgcccaatggctcatacataagcgcgatagtgcaaggtgaa

SEQ ID NO: 358276 - DNA, 75 bp, Artificial Sequence
  Synthetic
gattcgaacctgagatgttgaggaaaaaacagatcaccgttttggatcttcaccctggtgctggtaaaacaagga

SEQ ID NO: 358277 - DNA, 75 bp, Artificial Sequence
  Synthetic
aaaacagatcaccgttttggatcttcaccctggtgctggtaaaacaaggaggattctgccacagatcattaagga

SEQ ID NO: 358278 - DNA, 75 bp, Artificial Sequence
  Synthetic
gctgtgctggcgccaactagggttgtggccgctgagatggctgaagccctaagaggattgcccatccggtaccaa

SEQ ID NO: 358279 - DNA, 75 bp, Artificial Sequence
  Synthetic
attacaacctatttgtgatggatgaggcccacttcaccgacccggccagcatcgcggctagaggatacatttcca

SEQ ID NO: 358280 - DNA, 75 bp, Artificial Sequence
  Synthetic
tgcaatattcatgactgccaccccaccaggtacctcagacccatttccagagtctaatgcaccaatatccgactt

SEQ ID NO: 358281 - DNA, 75 bp, Artificial Sequence
  Synthetic
tggaactcggggtatgagtggattacagaatacatcgggaagacggtttggtttgtgcctagtgtgaagatggga

SEQ ID NO: 358282 - DNA, 75 bp, Artificial Sequence
  Synthetic
gggactttgtcgtcacaacagatatatctgagatgggagcaaactttaaggcaagcagggtgattgacagccgga

SEQ ID NO: 358283 - DNA, 75 bp, Artificial Sequence
  Synthetic
atctgagatgggagcaaactttaaggcaagcagggtgattgacagccggaagagtgtaaaacccactatcatcac

SEQ ID NO: 358284 - DNA, 75 bp, Artificial Sequence
  Synthetic
ggggaaccatccgctgtgactgctgccagtgcggcccagagacgaggacgcattggtagaagtccatcacaagtt

SEQ ID NO: 358285 - DNA, 75 bp, Artificial Sequence
  Synthetic
ccagtgcggcccagagacgaggacgcattggtagaagtccatcacaagttggagatgagtactgctatggagggc

SEQ ID NO: 358286 - DNA, 75 bp, Artificial Sequence
  Synthetic
gctcggtagttatcaagcaggagcgggcgtgatggttgaaggtgttttccacacactttggcatacaacaaaagg

SEQ ID NO: 358287 - DNA, 75 bp, Artificial Sequence
  Synthetic
atgctcgacaatatcaacatgccaaacggactgattgctcaattctaccaaccagagcgcgagaaggtgtacacc

SEQ ID NO: 358288 - DNA, 75 bp, Artificial Sequence
  Synthetic
gagaggaaaggaaaaatttcctggaattgttgagaactgctgacttgccggtatggctggcttacaaggtggcag

SEQ ID NO: 358289 - DNA, 75 bp, Artificial Sequence
  Synthetic
gaggtggtgttttgatggccctaggacaaatacaatccttgaagacaataatgaagtagaagtcatcacaaagct

SEQ ID NO: 358290 - DNA, 75 bp, Artificial Sequence
  Synthetic
tggtgagaggaagattttgaggccacgctggattgatgcaagggtgtactcagaccatcaggcgctgaaatcatt

SEQ ID NO: 358291 - DNA, 75 bp, Artificial Sequence
  Synthetic
caaagacttcgcctcagggaagcgctctcaaatagggtttatcgaggtccttggaaagatgcctgaacatttcat

SEQ ID NO: 358292 - DNA, 75 bp, Artificial Sequence
  Synthetic
ctccaaacaataactctgatcgctctgttgagtgtgatgaccatgggagtgttttttcttctcatgcagaggaaa

SEQ ID NO: 358293 - DNA, 75 bp, Artificial Sequence
  Synthetic
gttttttcttctcatgcagaggaaaggcatcggaaagataggcctgggaggcgttgtcttgggagccgcaacctt

SEQ ID NO: 358294 - DNA, 75 bp, Artificial Sequence
  Synthetic
ggcatcggaaagataggcctgggaggcgttgtcttgggagccgcaaccttcttctgttggatggctgaagtgcca

SEQ ID NO: 358295 - DNA, 75 bp, Artificial Sequence
  Synthetic
tgctttccctccttctgatgattgtgttgattcctgagccagagaagcaacgctcgcagacagacaaccagctag

SEQ ID NO: 358296 - DNA, 75 bp, Artificial Sequence
  Synthetic
cgagctaggggaggcggcagcaatattcatgacagccaccccaccaggtacctcagatccattcccagagtccaa

SEQ ID NO: 358297 - DNA, 75 bp, Artificial Sequence
  Synthetic
ctgtgttcctgatttgcgtgttgacccttgttagtgcggtggcagccaatgagatgggctggctggacaagacca

SEQ ID NO: 358298 - DNA, 75 bp, Artificial Sequence
  Synthetic
tttagcattggggagttcctcttggacctgaggccggcaacggcttggtcactgtatgctgtgactacagcattt

SEQ ID NO: 358299 - DNA, 75 bp, Artificial Sequence
  Synthetic
ttgccctttgcctacaacgtgctggaaagaaagtagtccaattaaacagaaagtcgtacgagacggagtacccaa

SEQ ID NO: 358300 - DNA, 75 bp, Artificial Sequence
  Synthetic
attgacctcaataaatgtccaagctagtgcgctattcacgctcgcgcgcggcttcccttttgtcgatgttggagt

SEQ ID NO: 358301 - DNA, 75 bp, Artificial Sequence
  Synthetic
atgccccgcgtaacgtccttgataggactgaagagggcaatgctgagcctgattgacggcagaggaccaatacga

SEQ ID NO: 358302 - DNA, 75 bp, Artificial Sequence
  Synthetic
tgctggggacaagtcactctcaccgtgacagtgacatcagcagcacttctgttctgccattacgcctacatggtg

SEQ ID NO: 358303 - DNA, 75 bp, Artificial Sequence
  Synthetic
tgacagtgacatcagcagcacttctgttctgccattacgcctacatggtgcctggatggcaggctgaggcaatgc

SEQ ID NO: 358304 - DNA, 75 bp, Artificial Sequence
  Synthetic
aagagcattgttggacagatggagaggtgtgagcaaacaaacagcgatgcgacatctcttgagcttcaagaaaga

SEQ ID NO: 358305 - DNA, 75 bp, Artificial Sequence
  Synthetic
tggaatcatgaaaaatgctgtggtagacggcatcgtggccacggacgttcccgagctagagcgtaccacacccat

SEQ ID NO: 358306 - DNA, 75 bp, Artificial Sequence
  Synthetic
gacggcatcgtggccacggacgttcccgagctagagcgtaccacacccatcatgcagaaaaaggttggacaagtt

SEQ ID NO: 358307 - DNA, 75 bp, Artificial Sequence
  Synthetic
aacaaacggagcgtgaaacaaaaaagaggaggaacagttggggtggccgccatcatgggcttgattgcctgtgct

SEQ ID NO: 358308 - DNA, 75 bp, Artificial Sequence
  Synthetic
gaggaggaacagttggggtggccgccatcatgggcttgattgcctgtgctggcgcatttaccctctccaacttcc

SEQ ID NO: 358309 - DNA, 75 bp, Artificial Sequence
  Synthetic
gacagtgcgggaagccggaattttgattacggcagcagctgttaccctctgggagaacggagcaagctctgtgtg

SEQ ID NO: 358310 - DNA, 75 bp, Artificial Sequence
  Synthetic
aaacaaggaggattctgccacagatcatcaaagaggccataaatagaagactgagaacagccgtgctagcaccaa

SEQ ID NO: 358311 - DNA, 75 bp, Artificial Sequence
  Synthetic
tgcaacggacacaacgggagtcattacgatccccacagcggcagggaaaaatctctgcactgtgcgggcaatgga

SEQ ID NO: 358312 - DNA, 75 bp, Artificial Sequence
  Synthetic
attacggcagcagctgttaccctctgggagaacggagcaagctctgtgtggaatgcaacaaccgccataggactt

SEQ ID NO: 358313 - DNA, 75 bp, Artificial Sequence
  Synthetic
acgatccccacagcggcagggaaaaatctctgcactgtgcgggcaatggatgtaggattcatgtgtgatgacacc

SEQ ID NO: 358314 - DNA, 75 bp, Artificial Sequence
  Synthetic
tatcgtgtttatccataacatggactctcataaaaaacatggaaaaaccagggctgaagagaggtggggcaaaag

SEQ ID NO: 358315 - DNA, 75 bp, Artificial Sequence
  Synthetic
cagaaggaaacgaccctgaggatatcgattgttggtgtacgaaatcagccgtatttgtgaaatatgggaggtgca

SEQ ID NO: 358316 - DNA, 75 bp, Artificial Sequence
  Synthetic
gacgtaccttgggggaggtttggaaagaaagacttaaccagatgacgaaagaagaattcaccaggtaccgtaaag

SEQ ID NO: 358317 - DNA, 75 bp, Artificial Sequence
  Synthetic
cgattgttggtgtacgaaatcagccgtatttgtgaaatatgggaggtgcacaaggacacgaaactcaaggcgcag

SEQ ID NO: 358318 - DNA, 75 bp, Artificial Sequence
  Synthetic
agcagcaaaacacgccaggaaggaaaggaatgtcactggagggcatccagtttctagaggcacggcaaagctaag

SEQ ID NO: 358319 - DNA, 75 bp, Artificial Sequence
  Synthetic
cacggagagagttccctggccaacagaaaaggagcctggctggatagcaccaaagcttcgcgatatctaatgaaa

SEQ ID NO: 358320 - DNA, 75 bp, Artificial Sequence
  Synthetic
aggaatgtcactggagggcatccagtttctagaggcacggcaaagctaagatggctggtcgagaggaggtttctt

SEQ ID NO: 358321 - DNA, 75 bp, Artificial Sequence
  Synthetic
gaaaaggagcctggctggatagcaccaaagcttcgcgatatctaatgaaaacggaatcatggatccttaggaatc

SEQ ID NO: 358322 - DNA, 75 bp, Artificial Sequence
  Synthetic
ttggatgtggaagaggcggctggtgttattacatggccacacaaaaaagagtccaagaagtcaaagggtacacaa

SEQ ID NO: 358323 - DNA, 75 bp, Artificial Sequence
  Synthetic
cgtagggtggatgctgggaagcaacacgacgcagagagtcgtattcatgattctactcctcctcgttgctccagc

SEQ ID NO: 358324 - DNA, 75 bp, Artificial Sequence
  Synthetic
ttattacatggccacacaaaaaagagtccaagaagtcaaagggtacacaaaaggtggtcccggacatgaagagcc

SEQ ID NO: 358325 - DNA, 75 bp, Artificial Sequence
  Synthetic
acgacgcagagagtcgtattcatgattctactcctcctcgttgctccagcctacagttttaattgtttgggcatg

SEQ ID NO: 358326 - DNA, 75 bp, Artificial Sequence
  Synthetic
aacattgtcaccatgaagagtggggtggatgtgttctataggccttctgaatgctgtgacactctcctttgtgat

SEQ ID NO: 358327 - DNA, 75 bp, Artificial Sequence
  Synthetic
cctcaggagccacttgggtcgacctcgtgttggaaggagacagttgtgtcaccataatggccaaagaccgaccaa

SEQ ID NO: 358328 - DNA, 75 bp, Artificial Sequence
  Synthetic
atgctgtgacactctcctttgtgatatcggagagtcctcatcaagtgctgaagttgaagaacatagaacgctccg

SEQ ID NO: 358329 - DNA, 75 bp, Artificial Sequence
  Synthetic
cgtgttggaaggagacagttgtgtcaccataatggccaaagaccgaccaacaattgacgtgaagatggtaaacat

SEQ ID NO: 358330 - DNA, 75 bp, Artificial Sequence
  Synthetic
aggagttactgctattcggccatggccactgaaatatccagcagtgctgcttgccccactatgggtgaggcacat

SEQ ID NO: 358331 - DNA, 75 bp, Artificial Sequence
  Synthetic
ttgcatcgagggccaaaggaattttgtgtgaagatactgtgcccctacatgccaaaggtcatagaaaagatggag

SEQ ID NO: 358332 - DNA, 75 bp, Artificial Sequence
  Synthetic
gtgtgaagatactgtgcccctacatgccaaaggtcatagaaaagatggagctgctccagcgccggtatggcgggg

SEQ ID NO: 358333 - DNA, 75 bp, Artificial Sequence
  Synthetic
cataagcagtttgtttgggcaaagaattgaggtcaaggagaatttcagcatgggagagttccttctggacttgag

SEQ ID NO: 358334 - DNA, 75 bp, Artificial Sequence
  Synthetic
ccactgaaatatccagcagtgctgcttgccccactatgggtgaggcacataacgagaagagaactgactcggcgt

SEQ ID NO: 358335 - DNA, 75 bp, Artificial Sequence
  Synthetic
cagaggttggggcaacggatgcggcctgttcggaaaaggcagtatagacacctgtgcaaagttcacttgctctta

SEQ ID NO: 358336 - DNA, 75 bp, Artificial Sequence
  Synthetic
gaattccacacatgaaatgtattgggtgagtcgagcctcaggcaatgtggtgcactcagtgaacatgaccagcca

SEQ ID NO: 358337 - DNA, 75 bp, Artificial Sequence
  Synthetic
ctgttcggaaaaggcagtatagacacctgtgcaaagttcacttgctcttacaaagcaactggactgaccatccag

SEQ ID NO: 358338 - DNA, 75 bp, Artificial Sequence
  Synthetic
tgcactcagtgaacatgaccagccaggtgctcctaggaagaatggagaagaagacctggaaaggacctcagtacg

SEQ ID NO: 358339 - DNA, 75 bp, Artificial Sequence
  Synthetic
cggctttcgtccatggaccaacgacggtggatacacacagcaatttgagcgcccagagcgctgccgtgcaagctg

SEQ ID NO: 358340 - DNA, 75 bp, Artificial Sequence
  Synthetic
ggtggatacacacagcaatttgagcgcccagagcgctgccgtgcaagctggaagattcagcgtgtccccggcagc

SEQ ID NO: 358341 - DNA, 75 bp, Artificial Sequence
  Synthetic
aacgagagcagtgggaaaacctctactcaattcagacaccagcaagataaagaacaggattgaacgacttaggcg

SEQ ID NO: 358342 - DNA, 75 bp, Artificial Sequence
  Synthetic
ctcaattcagacaccagcaagataaagaacaggattgaacgacttaggcgtgagtacagctcgacatggcatcat

SEQ ID NO: 358343 - DNA, 75 bp, Artificial Sequence
  Synthetic
tagcttcggtcagtgatttgtcaacaaaagcagcgtgtccaaccatgggtgaagcccacaacgagaaaagagccg

SEQ ID NO: 358344 - DNA, 75 bp, Artificial Sequence
  Synthetic
gactacggagaggtctctttcgactgcgagcctcggtcaggcgtcgacacagacgccttctatgtgatgacggtc

SEQ ID NO: 358345 - DNA, 75 bp, Artificial Sequence
  Synthetic
gcgagcctcggtcaggcgtcgacacagacgccttctatgtgatgacggtcgcgacgaagactttcttagtacaca

SEQ ID NO: 358346 - DNA, 75 bp, Artificial Sequence
  Synthetic
ggaactaccacggtagctatgaagtgaagccaacaggctctgcaagctcactggtcaatggagtggtcaggctcc

SEQ ID NO: 358347 - DNA, 75 bp, Artificial Sequence
  Synthetic
agttgtgtaaccataatgtcaaaagacaagccaaccattgatgtcaaaatgatgaacatggaggcagccaacctt

SEQ ID NO: 358348 - DNA, 75 bp, Artificial Sequence
  Synthetic
ctggtcaatggagtggtcaggctcctctcgaaaccatgggacaccatcacaaatgtcaccacgatggccatgacg

SEQ ID NO: 358349 - DNA, 75 bp, Artificial Sequence
  Synthetic
gccatggactagccctggaaacacaaactggagaaacagagaagccttgcttgagttcgaggaggctcacgccac

SEQ ID NO: 358350 - DNA, 75 bp, Artificial Sequence
  Synthetic
ggatgtggactgtttggaaaggggagcatcgacacatgtgcaaagttcgcctgcacaaccaaggcaactggttgg

SEQ ID NO: 358351 - DNA, 75 bp, Artificial Sequence
  Synthetic
aactggagaaacagagaagccttgcttgagttcgaggaggctcacgccacgaaacaatcagtggtggccctcggg

SEQ ID NO: 358352 - DNA, 75 bp, Artificial Sequence
  Synthetic
aaaagcagcgtgtccaaccatgggtgaagcccacaacgagaaaagagccgaccccgccttcgtctgcaagcaagg

SEQ ID NO: 358353 - DNA, 75 bp, Artificial Sequence
  Synthetic
taaagctccggaaccgccagaaggagtgaagtacgtgctcaatgaaaccaccaactggttgtgggcgttcctggc

SEQ ID NO: 358354 - DNA, 75 bp, Artificial Sequence
  Synthetic
ccctggccggagcaattcctgttgactacaagaacaacatagtgaagttgacatcagggcatctgaaatgccgag

SEQ ID NO: 358355 - DNA, 75 bp, Artificial Sequence
  Synthetic
ctacaagaacaacatagtgaagttgacatcagggcatctgaaatgccgagtgaaaatggaaaagctgaagctgaa

SEQ ID NO: 358356 - DNA, 75 bp, Artificial Sequence
  Synthetic
tcgcgggaggaatttataaggaaggtcaatagtaatgcagctctgggcgccatgtttgaggagcagaatcaatgg

SEQ ID NO: 358357 - DNA, 75 bp, Artificial Sequence
  Synthetic
ttttttagcatattgcccccccggctcttgcggggccctcctggtttcttagacatcgagatcttcgtgctaaga

SEQ ID NO: 358358 - DNA, 75 bp, Artificial Sequence
  Synthetic
agtagttcgcctgtgtgagctgacaaacttagtagtgtttgtgaggataacaacaattaacacagtgcgagctgt

SEQ ID NO: 358359 - DNA, 75 bp, Artificial Sequence
  Synthetic
aaggcctttaggtttgtgaacaatccagcagatactggacacgggaccgtagtaatggaattgcagtatacaggg

SEQ ID NO: 358360 - DNA, 75 bp, Artificial Sequence
  Synthetic
tcaatagtaatgcagctctgggcgccatgtttgaggagcagaatcaatggaggagtgccagagaagcggttgaag

SEQ ID NO: 358361 - DNA, 75 bp, Artificial Sequence
  Synthetic
tgaagagcgtgaggcgcacttacgcggagaatgtcatacttgcatctacaacatgatgggaaagagggagaaaaa

SEQ ID NO: 358362 - DNA, 75 bp, Artificial Sequence
  Synthetic
ggagaatgtcatacttgcatctacaacatgatgggaaagagggagaaaaaacccggagagtttgggaaagccaag

SEQ ID NO: 358363 - DNA, 75 bp, Artificial Sequence
  Synthetic
tatgactcctgttggaagattggtaacggtaaacccgtacgtttcagtggcgacagccaacgcaaagatcctgat

SEQ ID NO: 358364 - DNA, 75 bp, Artificial Sequence
  Synthetic
aatagacactagcgcctactatgtcatgtcagttggggcgaagtccttcttggtccaccgagaatggtttatgga

SEQ ID NO: 358365 - DNA, 75 bp, Artificial Sequence
  Synthetic
cagcagatactggacacgggaccgtagtaatggaattgcagtatacagggacggatggcccttgcaaaatcccca

SEQ ID NO: 358366 - DNA, 75 bp, Artificial Sequence
  Synthetic
ggctgggagctcgctttctagagtttgaggctctgggctttcttaatgaggatcactggcttggaagaaagaact

SEQ ID NO: 358367 - DNA, 75 bp, Artificial Sequence
  Synthetic
tgcaccaagctttagccggagcgatccctgttgagttctcaagtaacactgtgaagttgacatcaggacatttga

SEQ ID NO: 358368 - DNA, 75 bp, Artificial Sequence
  Synthetic
ataaagaacatggacaaaccaggactaaaaagaggtggggcaaaaggacgcaccttgggagaggtttggaaagaa

SEQ ID NO: 358369 - DNA, 75 bp, Artificial Sequence
  Synthetic
atcaacaagttacccaccactggcacaagtctgggagcagtataggaaaggccttcgccactaccatgcagggtg

SEQ ID NO: 358370 - DNA, 75 bp, Artificial Sequence
  Synthetic
tctccagaaattaggctacatcctgcgtgaagttggcacccgacccggaggcagaatctacgctgatgacacagc

SEQ ID NO: 358371 - DNA, 75 bp, Artificial Sequence
  Synthetic
cgtgaagttggcacccgacccggaggcagaatctacgctgatgacacagccggttgggacacccgcatcaccaga

SEQ ID NO: 358372 - DNA, 75 bp, Artificial Sequence
  Synthetic
gcagaatctacgctgatgacacagccggttgggacacccgcatcaccagagctgacttggagaatgaagccaagg

SEQ ID NO: 358373 - DNA, 75 bp, Artificial Sequence
  Synthetic
ggcggagtgtttaactcaattggaaaagccgtccatcagctatttgggggagccttccgctccctttttggtggc

SEQ ID NO: 358374 - DNA, 75 bp, Artificial Sequence
  Synthetic
cggttgggacacccgcatcaccagagctgacttggagaatgaagccaaggtccttgagttgttgaacggggagca

SEQ ID NO: 358375 - DNA, 75 bp, Artificial Sequence
  Synthetic
aagtgcctatttcttccgtggcttccctgaatgacctcacacctgttggaaggttggtgaccgtgaatccatttg

SEQ ID NO: 358376 - DNA, 75 bp, Artificial Sequence
  Synthetic
caagtctgggagcagtataggaaaggccttcgccactaccatgcagggtgcccaacgcttggtttcgctaggaga

SEQ ID NO: 358377 - DNA, 75 bp, Artificial Sequence
  Synthetic
gagctcacctaccgccacaaagtagtgaaggtaatgcgcccagctgctgatggaagaaccgtcatggacgtcatc

SEQ ID NO: 358378 - DNA, 75 bp, Artificial Sequence
  Synthetic
aatcaactcacgagatcgctcaatagctctgactttcttggccgtgggtggagttctcctcttcctctcggtgaa

SEQ ID NO: 358379 - DNA, 75 bp, Artificial Sequence
  Synthetic
tgaaggtaatgcgcccagctgctgatggaagaaccgtcatggacgtcatctccagggaagaccagagagggagtg

SEQ ID NO: 358380 - DNA, 75 bp, Artificial Sequence
  Synthetic
aagccgtccatcagctatttgggggagccttccgctccctttttggtggcatgtcatggataacgcagggactct

SEQ ID NO: 358381 - DNA, 75 bp, Artificial Sequence
  Synthetic
gtagaggagaacagcagataaaccaccactggcacaaatctgggagcagtattgggaaggccttcactaccacac

SEQ ID NO: 358382 - DNA, 75 bp, Artificial Sequence
  Synthetic
cacctttaccaatttggctgtccagttagtgagaatgatggaaggagagggcgtgattggtccagatgatgtgga

SEQ ID NO: 358383 - DNA, 75 bp, Artificial Sequence
  Synthetic
gatgtgggagcggagtgtttatacacaatgatgttgaggcatggatggaccgttacaggtatcaccccgagaccc

SEQ ID NO: 358384 - DNA, 75 bp, Artificial Sequence
  Synthetic
ttagtgagaatgatggaaggagagggcgtgattggtccagatgatgtggagaagcttacaaagggaaaagggccc

SEQ ID NO: 358385 - DNA, 75 bp, Artificial Sequence
  Synthetic
tcttggagatactgcctgggatttcggatcagttggaggggttttcacatcagtgggaaaagctatacaccaagt

SEQ ID NO: 358386 - DNA, 75 bp, Artificial Sequence
  Synthetic
gctctgactttcttggccgtgggtggagttctcctcttcctctcggtgaacgtttacgctgacactggatgcgcc

SEQ ID NO: 358387 - DNA, 75 bp, Artificial Sequence
  Synthetic
caatgatgttgaggcatggatggaccgttacaggtatcaccccgagaccccccaaggcctagcaaagattatcca

SEQ ID NO: 358388 - DNA, 75 bp, Artificial Sequence
  Synthetic
ggtatcaggtcggtgtcccggctggaacaccaaatgtgggaatccatcaaggatgagctgaacaccttgcttaag

SEQ ID NO: 358389 - DNA, 75 bp, Artificial Sequence
  Synthetic
aacaccaaatgtgggaatccatcaaggatgagctgaacaccttgcttaaggagaatgggattgacctcagcgttg

SEQ ID NO: 358390 - DNA, 75 bp, Artificial Sequence
  Synthetic
catgtcaaaggtgcgcaaggacattcaagagtggaaaccatcaaccggatggtatgattggcaacaagttccatt

SEQ ID NO: 358391 - DNA, 75 bp, Artificial Sequence
  Synthetic
ctcccttcggacagcagcgagtgttcaaagagaaggtggacacgaaagctcctgaaccgccagaaggagtgaagt

SEQ ID NO: 358392 - DNA, 75 bp, Artificial Sequence
  Synthetic
taaatcagccccaaagcgattagctgccacaaccgagaagcttgagatagggtggaaagcatggggaaagagcat

SEQ ID NO: 358393 - DNA, 75 bp, Artificial Sequence
  Synthetic
caagagtggaaaccatcaaccggatggtatgattggcaacaagttccattctgttcaaaccacttcattgaactg

SEQ ID NO: 358394 - DNA, 75 bp, Artificial Sequence
  Synthetic
gccacaaccgagaagcttgagatagggtggaaagcatggggaaagagcattatctttgcccctgagttggccaat

SEQ ID NO: 358395 - DNA, 75 bp, Artificial Sequence
  Synthetic
tgactccatgccgagggcaggatgagttagtgggcagggctcgcatctccccaggggctggatggaatgttcgag

SEQ ID NO: 358396 - DNA, 75 bp, Artificial Sequence
  Synthetic
agacgaaagaatgtccgtccgctgatagagcttggaatagcttggaggtggaggactttggttttggtctgacta

SEQ ID NO: 358397 - DNA, 75 bp, Artificial Sequence
  Synthetic
tagagcttggaatagcttggaggtggaggactttggttttggtctgactagcacacggatgtttctccgcgttag

SEQ ID NO: 358398 - DNA, 75 bp, Artificial Sequence
  Synthetic
tgctcagatgtggttgctcctgtatttccacagaagagatctgcggttgatggccaacgccatctgctccgccgt

SEQ ID NO: 358399 - DNA, 75 bp, Artificial Sequence
  Synthetic
ttccacagaagagatctgcggttgatggccaacgccatctgctccgccgtacctgtgaactgggtccctactgga

SEQ ID NO: 358400 - DNA, 75 bp, Artificial Sequence
  Synthetic
ggagtttgtggcctgcgttccgtttccagactcgaacatcaaatgtgggaagccattaaggatgagctgaacacc

SEQ ID NO: 358401 - DNA, 75 bp, Artificial Sequence
  Synthetic
gcaaagataattggaacagcagtgaagaataacatggctgtccatagcgatctctcctactggattgagagtgga

SEQ ID NO: 358402 - DNA, 75 bp, Artificial Sequence
  Synthetic
ctgctgaaagagaatggggttgacctgagtgtcgtagtggaaaaacagaatgggatgtacaaagcagcaccaaga

SEQ ID NO: 358403 - DNA, 75 bp, Artificial Sequence
  Synthetic
gaggagagtggatgacaacggaagacatgctggaggtctggaatcgtgtttggattgaggaaaatgaatggatgg

SEQ ID NO: 358404 - DNA, 75 bp, Artificial Sequence
  Synthetic
agaataacatggctgtccatagcgatctctcctactggattgagagtggactcaacgagacatggaaacttgagc

SEQ ID NO: 358405 - DNA, 75 bp, Artificial Sequence
  Synthetic
atgtacctggcctgagacgcacacgctgtggggggaaggagtgcaggagagtgatctcattatcccagtcacgct

SEQ ID NO: 358406 - DNA, 75 bp, Artificial Sequence
  Synthetic
gagcgatgttccatactctggcaaacgggaggacatttggtgtggcagcctgattggcacaagagcccgggccac

SEQ ID NO: 358407 - DNA, 75 bp, Artificial Sequence
  Synthetic
ctgtggggggaaggagtgcaggagagtgatctcattatcccagtcacgctggcaggacctagaagcaaccacaat

SEQ ID NO: 358408 - DNA, 75 bp, Artificial Sequence
  Synthetic
atggaggtggaggattttgggtttggactgacaagcactcgcatgttcctaaagattcgggaaactaacacgacg

SEQ ID NO: 358409 - DNA, 75 bp, Artificial Sequence
  Synthetic
accaagggccatgggacgaagggagagtggagctggactttgattattgtcctggaacgaccgttactctcagtg

SEQ ID NO: 358410 - DNA, 75 bp, Artificial Sequence
  Synthetic
gactgacaagcactcgcatgttcctaaagattcgggaaactaacacgacggagtgtgattcgaagatcatcggaa

SEQ ID NO: 358411 - DNA, 75 bp, Artificial Sequence
  Synthetic
agtggagctggactttgattattgtcctggaacgaccgttactctcagtgcgacctgtgggcatcgtgggcctgc

SEQ ID NO: 358412 - DNA, 75 bp, Artificial Sequence
  Synthetic
gagatgagaaatatgtggattacatgagctcattgaagagatatgaagacacgacatttgttgaggatacagtat

SEQ ID NO: 358413 - DNA, 75 bp, Artificial Sequence
  Synthetic
aagtattattattatgtgtagaagcttagttttataatagtgttttagtgtgtttagagtttaggaaaattttag

SEQ ID NO: 358414 - DNA, 75 bp, Artificial Sequence
  Synthetic
aagtatttttattatgtgtagaagcttagttttataatagtgttttagtgtgtttagagtttaggaaaattttag

SEQ ID NO: 358415 - DNA, 75 bp, Artificial Sequence
  Synthetic
aagtattcttattatgtgtagaagcttagttttataatagtgttttagtgtgtttagagtttaggaaaattttag

SEQ ID NO: 358416 - DNA, 75 bp, Artificial Sequence
  Synthetic
aagtattgttattatgtgtagaagcttagttttataatagtgttttagtgtgtttagagtttaggaaaattttag

SEQ ID NO: 358417 - DNA, 75 bp, Artificial Sequence
  Synthetic
aagcttatttctgattggtgctgccgtagctgcactttaccgccgctgcgctaccaaacggaatctggttgttgg

SEQ ID NO: 358418 - DNA, 75 bp, Artificial Sequence
  Synthetic
ctaccaaacggaatctggttgttggtacgggatggaaatacggcccttacgccatgatgagaaaaccctggtcca

SEQ ID NO: 358419 - DNA, 75 bp, Artificial Sequence
  Synthetic
gacatgattgatccttttcagctgggccttctggtagtgttcttggccacccaggaggtccttcgcaagaggtgg

SEQ ID NO: 358420 - DNA, 75 bp, Artificial Sequence
  Synthetic
gccttctggtagtgttcttggccacccaggaggtccttcgcaagaggtggacggccaagatcagcgtcccagcca

SEQ ID NO: 358421 - DNA, 75 bp, Artificial Sequence
  Synthetic
ccaggaggtccttcgcaagaggtggacggccaagatcagcgtcccagccatcatgattgccctgctaaccttgat

SEQ ID NO: 358422 - DNA, 75 bp, Artificial Sequence
  Synthetic
tagcttcaaggcccagtgtcagaccacgccatggcgtgccactctgcggagagtgcagtctgtgacagtgcccca

SEQ ID NO: 358423 - DNA, 75 bp, Artificial Sequence
  Synthetic
gactactgcccgggaacaacagtaactataagtgacagctgtggacaccgtggccctgcagcacgcacgaccacc

SEQ ID NO: 358424 - DNA, 75 bp, Artificial Sequence
  Synthetic
ttgattaggtatgtgatactcgtgggagccgcattcgctgaatcaaactcggggggtgatgtggtgcatctcgcg

SEQ ID NO: 358425 - DNA, 75 bp, Artificial Sequence
  Synthetic
tcaacgtcccacgcggccctagctctggcaatggtgttagccagagtgaaaggactagaggttagaggagacccc

SEQ ID NO: 358426 - DNA, 75 bp, Artificial Sequence
  Synthetic
tccactgcgtttccagactgagaacggctgttggtatggaatggaaattcggcccctgcggcacgacgaaaagac

SEQ ID NO: 358427 - DNA, 75 bp, Artificial Sequence
  Synthetic
gagccgcattcgctgaatcaaactcggggggtgatgtggtgcatctcgcgctcatggcaacgtttaagattcaac

SEQ ID NO: 358428 - DNA, 75 bp, Artificial Sequence
  Synthetic
caagacgagatggacgaaccaagagaacatcctgctcatgctggctgcggcgttcttccagatggcttaccttga

SEQ ID NO: 358429 - DNA, 75 bp, Artificial Sequence
  Synthetic
aacatcctgctcatgctggctgcggcgttcttccagatggcttaccttgacgctcgacacatgttcaatttaaac

SEQ ID NO: 358430 - DNA, 75 bp, Artificial Sequence
  Synthetic
ctgtggcgtggatgatactcagagccattgggtttacaaccacttctaatgtggcaacacctctgctggcactcc

SEQ ID NO: 358431 - DNA, 75 bp, Artificial Sequence
  Synthetic
cattgggtttacaaccacttctaatgtggcaacacctctgctggcactcctaaccccaggcctaaaatgcttaca

SEQ ID NO: 358432 - DNA, 75 bp, Artificial Sequence
  Synthetic
tatagtggcatttagtgatgttagtgtaaatagttaagaaaattttaaggaggaagtcaggccgggaagttcccg

SEQ ID NO: 358433 - DNA, 75 bp, Artificial Sequence
  Synthetic
ctcatggttggggttggaagcctggttaaggaaaggcggagtgcagtagcaaaaaagaaaggagctagcctcatt

SEQ ID NO: 358434 - DNA, 75 bp, Artificial Sequence
  Synthetic
ttaaggaaaggcggagtgcagtagcaaaaaagaaaggagctagcctcatttgtctggcattggcatcgaccggcc

SEQ ID NO: 358435 - DNA, 75 bp, Artificial Sequence
  Synthetic
tccatgccgaggacaggacgaactggtaggcagagctcgcatttctccaggggccggatggaacgtccgcgacac

SEQ ID NO: 358436 - DNA, 75 bp, Artificial Sequence
  Synthetic
aaccaagagagtattttgctcatgcttgcggctgcttttttccaaatggcctactatgacgccaagaatgtcttg

SEQ ID NO: 358437 - DNA, 75 bp, Artificial Sequence
  Synthetic
ttgcggctgcttttttccaaatggcctactatgacgccaagaatgtcttgttatgggaagtgcctgatgtattga

SEQ ID NO: 358438 - DNA, 75 bp, Artificial Sequence
  Synthetic
aggcttgctggcttgcgatccaaaccgaaagagagggtggccagcgacagaagtcatgacagccgtgggactgat

SEQ ID NO: 358439 - DNA, 75 bp, Artificial Sequence
  Synthetic
cgaaagagagggtggccagcgacagaagtcatgacagccgtgggactgatgtttgccatcgtaggaggtctggcg

SEQ ID NO: 358440 - DNA, 75 bp, Artificial Sequence
  Synthetic
ttcctatgaccattgctggtctaatgttcgctgcgtatgtgataacagggaggtccacggacatgtggattgaga

SEQ ID NO: 358441 - DNA, 75 bp, Artificial Sequence
  Synthetic
tagcccttttgacacctggattgaaatgcttaaacctggatgtgtacagaattttgctgcttatggttggagttg

SEQ ID NO: 358442 - DNA, 75 bp, Artificial Sequence
  Synthetic
gttcgctgcgtatgtgataacagggaggtccacggacatgtggattgagagaaccgccgacatctcatgggaaag

SEQ ID NO: 358443 - DNA, 75 bp, Artificial Sequence
  Synthetic
ctccgcagcaaagaagaaaggagcttgcctcatctgcctagcactggcgtccacaggagtgttcaacccaatgat

SEQ ID NO: 358444 - DNA, 75 bp, Artificial Sequence
  Synthetic
gatagagtcgacgtgaagcttgacgatgacggaaattttcaactcataaatgatcctggagccccgtggaagatc

SEQ ID NO: 358445 - DNA, 75 bp, Artificial Sequence
  Synthetic
atgacggaaattttcaactcataaatgatcctggagccccgtggaagatctggatgcttcgcatgacgtgcttag

SEQ ID NO: 358446 - DNA, 75 bp, Artificial Sequence
  Synthetic
acttgcagctgggctaatggcttgcgaccccaatcgcaagcgcggctggcctgccacagaggtgatgactgcagt

SEQ ID NO: 358447 - DNA, 75 bp, Artificial Sequence
  Synthetic
catcctcccctcaatcgtcggattttggattaccctccagtacacaaaaagaggaggcgtcttgtgggacacacc

SEQ ID NO: 358448 - DNA, 75 bp, Artificial Sequence
  Synthetic
tggattaccctccagtacacaaaaagaggaggcgtcttgtgggacacaccgtcacccagagagtacaagaaagga

SEQ ID NO: 358449 - DNA, 75 bp, Artificial Sequence
  Synthetic
tcatgacccgcggaatgctcgggagttaccaagctggggttggcgtgatggtcgaaggggtgttccacaccttgt

SEQ ID NO: 358450 - DNA, 75 bp, Artificial Sequence
  Synthetic
ggattgagaggacggctgacatcacttgggagagtgatgctgagatcacaggctctagtgagagagtagatgtta

SEQ ID NO: 358451 - DNA, 75 bp, Artificial Sequence
  Synthetic
cgaagtgatccatgtaagccctcagaaccgtctcggaaggaggaccccgacatgttgaacaaagccgcgaaagtg

SEQ ID NO: 358452 - DNA, 75 bp, Artificial Sequence
  Synthetic
ttaccaagctggggttggcgtgatggtcgaaggggtgttccacaccttgtggcacacaactaaaggtgctgcttt

SEQ ID NO: 358453 - DNA, 75 bp, Artificial Sequence
  Synthetic
ccttactggggcagtgtgcgagaggatcgcctctgctatggaggaccatggaaattgcagaggaagtggaatggc

SEQ ID NO: 358454 - DNA, 75 bp, Artificial Sequence
  Synthetic
atcgcctctgctatggaggaccatggaaattgcagaggaagtggaatggcctagatgaagtgcagatgatcgtgg

SEQ ID NO: 358455 - DNA, 75 bp, Artificial Sequence
  Synthetic
cgtccaaacaaagcctggagtatttaaaactcctgatggtgagataggagccgtcacactagattacccgaccgg

SEQ ID NO: 358456 - DNA, 75 bp, Artificial Sequence
  Synthetic
aaaactcctgatggtgagataggagccgtcacactagattacccgaccggcacatctggatcacccattgtcgat

SEQ ID NO: 358457 - DNA, 75 bp, Artificial Sequence
  Synthetic
atggcaacggggtcatcatgccgaatggctcgtacatcagtgccatcgtgcaaggtgagaggatggaagaaccgg

SEQ ID NO: 358458 - DNA, 75 bp, Artificial Sequence
  Synthetic
tggctcgtacatcagtgccatcgtgcaaggtgagaggatggaagaaccggctccagccgggtttgagccagacat

SEQ ID NO: 358459 - DNA, 75 bp, Artificial Sequence
  Synthetic
ctggatctccatccaggtgccgggaagacgagaaagatccttccacagatcatcaaagaagccatcaacaagcgg

SEQ ID NO: 358460 - DNA, 75 bp, Artificial Sequence
  Synthetic
agacgagaaagatccttccacagatcatcaaagaagccatcaacaagcggctgcggacagcaatacttgccccca

SEQ ID NO: 358461 - DNA, 75 bp, Artificial Sequence
  Synthetic
aaattggggcagtcacgctagattatcccaccggaacgtcaggttcccccattgtggacaagaatggagacgtga

SEQ ID NO: 358462 - DNA, 75 bp, Artificial Sequence
  Synthetic
tgaagccctgcgggggctcccaatccggtaccagacttcagctgtgacgagagagcacacagggaacgagatagt

SEQ ID NO: 358463 - DNA, 75 bp, Artificial Sequence
  Synthetic
cggtaccagacttcagctgtgacgagagagcacacagggaacgagatagttgacgtgatgtgtcacgccacgttg

SEQ ID NO: 358464 - DNA, 75 bp, Artificial Sequence
  Synthetic
catgcccaacggtgcgtacataagtgccattgtgcaaggagagagaatggaagagccagcgccagctggttttga

SEQ ID NO: 358465 - DNA, 75 bp, Artificial Sequence
  Synthetic
gagtccctaactataatctgtatgttatggatgaagcccactttaccgatccagctagtatagctgctaggggat

SEQ ID NO: 358466 - DNA, 75 bp, Artificial Sequence
  Synthetic
tatggatgaagcccactttaccgatccagctagtatagctgctaggggatacatctcaaccagagtggagctagg

SEQ ID NO: 358467 - DNA, 75 bp, Artificial Sequence
  Synthetic
gccacgccccccggaacctctgatcccttcccagaatcaaacgcaccagtggctgatatccagacggaaatcccc

SEQ ID NO: 358468 - DNA, 75 bp, Artificial Sequence
  Synthetic
ccttcccagaatcaaacgcaccagtggctgatatccagacggaaatccccgatagagcctggaattcgggatatg

SEQ ID NO: 358469 - DNA, 75 bp, Artificial Sequence
  Synthetic
aaggacaacccggggggcttcccgctttttagcatattgcccccccggctcttgcggggccctcctggtttctta

SEQ ID NO: 358470 - DNA, 75 bp, Artificial Sequence
  Synthetic
gactgtatggttcgtgccaagtgtgcgtatgggaaatgagatggcgcagtgtttgcagagggctggaaagaaagt

SEQ ID NO: 358471 - DNA, 75 bp, Artificial Sequence
  Synthetic
cgtatgggaaatgagatggcgcagtgtttgcagagggctggaaagaaagtgatccagttaaaccggaagtcatat

SEQ ID NO: 358472 - DNA, 75 bp, Artificial Sequence
  Synthetic
gacatcgagatcttcgtgctaagaaacagctcgcactgtgttaattgttgttaatcctcacaaacactactaagt

SEQ ID NO: 358473 - DNA, 75 bp, Artificial Sequence
  Synthetic
atgatgactgggacttcgtgatcacgaccgatatctcagaaatgggagctaacttcaaggccagccgtgtgatcg

SEQ ID NO: 358474 - DNA, 75 bp, Artificial Sequence
  Synthetic
ttcatgacggccacaccacccgggacttcggacccctttccagagtctaatgctcctatctcggacatgcagaca

SEQ ID NO: 358475 - DNA, 75 bp, Artificial Sequence
  Synthetic
gaccgatatctcagaaatgggagctaacttcaaggccagccgtgtgatcgacagtcgaaagagtgtgaagccaac

SEQ ID NO: 358476 - DNA, 75 bp, Artificial Sequence
  Synthetic
gtggtcttgggagatccctctgccatcactgcagctagtgcagcgcagaggagaggacgtattggaagaaatccc

SEQ ID NO: 358477 - DNA, 75 bp, Artificial Sequence
  Synthetic
tcactgcagctagtgcagcgcagaggagaggacgtattggaagaaatccctcacaagtgggggatgagtactgct

SEQ ID NO: 358478 - DNA, 75 bp, Artificial Sequence
  Synthetic
gtttctcaaagcgagatggaccaaccaggagaacatcttgttgatgttggcggctgttttctttcaaatggctta

SEQ ID NO: 358479 - DNA, 75 bp, Artificial Sequence
  Synthetic
gtgttggctctcttggcgttcttcaggttcacagcaattgctccgacccgagcagtgctggatcgatggagaggt

SEQ ID NO: 358480 - DNA, 75 bp, Artificial Sequence
  Synthetic
ttctaactatgctcactggacagaagcaagaatcatgctggacaacatcaacatgcccaacggccttatcgcgca

SEQ ID NO: 358481 - DNA, 75 bp, Artificial Sequence
  Synthetic
tgtcatcaccacagacatatcagaaatgggagccaactttaaggcaaacagagtgatcgacagccgcaaaagtgt

SEQ ID NO: 358482 - DNA, 75 bp, Artificial Sequence
  Synthetic
gcaagaatcatgctggacaacatcaacatgcccaacggccttatcgcgcagctttatgaaccggaacgtgaaaaa

SEQ ID NO: 358483 - DNA, 75 bp, Artificial Sequence
  Synthetic
aactcaggggtgaagagaggaagaattttctggagctgttgaggaccgccgacctgccagtctggttggcttacc

SEQ ID NO: 358484 - DNA, 75 bp, Artificial Sequence
  Synthetic
ttttctggagctgttgaggaccgccgacctgccagtctggttggcttaccaagtcgctgcggctggaatagcgta

SEQ ID NO: 358485 - DNA, 75 bp, Artificial Sequence
  Synthetic
ggaccgcgaacaaacacaattctggaggagaataccgaagtggaaatcgtgactaagatgggagagaggaagatc

SEQ ID NO: 358486 - DNA, 75 bp, Artificial Sequence
  Synthetic
aggagaataccgaagtggaaatcgtgactaagatgggagagaggaagatccttaggccccgctgggctgatgcaa

SEQ ID NO: 358487 - DNA, 75 bp, Artificial Sequence
  Synthetic
aaagttgttcaaggattttgcagctggcagacggtcgcagataggactggttgaagttatagggagaatgccaga

SEQ ID NO: 358488 - DNA, 75 bp, Artificial Sequence
  Synthetic
gggaatacaggctcagaggggaagaacgcaagaatttccttgagttcctaaggacagctgatctaccagtctggc

SEQ ID NO: 358489 - DNA, 75 bp, Artificial Sequence
  Synthetic
acgcaagaatttccttgagttcctaaggacagctgatctaccagtctggcttgcttacaaagtggcagcagcagg

SEQ ID NO: 358490 - DNA, 75 bp, Artificial Sequence
  Synthetic
ggcagacggtcgcagataggactggttgaagttatagggagaatgccagaacacttcctggggaagacatgggaa

SEQ ID NO: 358491 - DNA, 75 bp, Artificial Sequence
  Synthetic
ctaccgcggaaaaaggtggacgagcccataggacggcgttagaggagctgccggacgccttgcagaccatagctc

SEQ ID NO: 358492 - DNA, 75 bp, Artificial Sequence
  Synthetic
ccataggacggcgttagaggagctgccggacgccttgcagaccatagctctgataaccctactgagtgtcatgac

SEQ ID NO: 358493 - DNA, 75 bp, Artificial Sequence
  Synthetic
caaagaaagggagtgagcaaaattggacttgttagagccacccttggactggctactttcttttgttggatggct

SEQ ID NO: 358494 - DNA, 75 bp, Artificial Sequence
  Synthetic
gacttgttagagccacccttggactggctactttcttttgttggatggctgaggtcccgggaactaaaattgccg

SEQ ID NO: 358495 - DNA, 75 bp, Artificial Sequence
  Synthetic
atgtggtggcaaccgctgagaaagggggtcgagctcacaggatggcccttgaagagctcccggacgccctccaga

SEQ ID NO: 358496 - DNA, 75 bp, Artificial Sequence
  Synthetic
aatgatagttttaattccagaacctgaaaaacagcgatcccaaactgacaaccagctagcagtgtttctcatttg

SEQ ID NO: 358497 - DNA, 75 bp, Artificial Sequence
  Synthetic
gaaaaacagcgatcccaaactgacaaccagctagcagtgtttctcatttgcgtcctgacgctggtcggaatggtc

SEQ ID NO: 358498 - DNA, 75 bp, Artificial Sequence
  Synthetic
gggtcgagctcacaggatggcccttgaagagctcccggacgccctccagacaatagctctgattgcactattgag

SEQ ID NO: 358499 - DNA, 75 bp, Artificial Sequence
  Synthetic
acagaacgaagggtgacatcggcattctcctaggaccgcgacaggaaactaaggagagctttggagtggaaagct

SEQ ID NO: 358500 - DNA, 75 bp, Artificial Sequence
  Synthetic
tctcctaggaccgcgacaggaaactaaggagagctttggagtggaaagcttcctacttgatctgaagcctgcaac

SEQ ID NO: 358501 - DNA, 75 bp, Artificial Sequence
  Synthetic
gcaagattggcttggggggagtaatcttaggagctgccacattcttttgctggatggctgaagttccagggacga

SEQ ID NO: 358502 - DNA, 75 bp, Artificial Sequence
  Synthetic
actgcggtgatgacgccactgctgaaacacctgatcacttccgattatatcaacacctctctaacttcgatcaac

SEQ ID NO: 358503 - DNA, 75 bp, Artificial Sequence
  Synthetic
aacacctgatcacttccgattatatcaacacctctctaacttcgatcaacgtccaagcaagtgcgcttttcaccc

SEQ ID NO: 358504 - DNA, 75 bp, Artificial Sequence
  Synthetic
agcgccgtggctgccaatgaaatgggctggctggacaaaaccaaaaatgacattagtagcctgctagggtataag

SEQ ID NO: 358505 - DNA, 75 bp, Artificial Sequence
  Synthetic
cgttggggtctcagctctcttgctggctgccgggtgctgggggcaagtcacgctgaccgtgactgtcacggccgc

SEQ ID NO: 358506 - DNA, 75 bp, Artificial Sequence
  Synthetic
gagttgagagcttcttgcttgatctacggccggctacggcatggtccctctatgctgtaacaacagccgctctta

SEQ ID NO: 358507 - DNA, 75 bp, Artificial Sequence
  Synthetic
gctgccgggtgctgggggcaagtcacgctgaccgtgactgtcacggccgcggtcctgctcttctgccactatgcg

SEQ ID NO: 358508 - DNA, 75 bp, Artificial Sequence
  Synthetic
acggccggctacggcatggtccctctatgctgtaacaacagccgctcttacccctttgctgaagcacctaattac

SEQ ID NO: 358509 - DNA, 75 bp, Artificial Sequence
  Synthetic
aggccatgcgcgcagctcaacgaaggacagcggctgggatcatgaaaaatgccgtgattgacggcatggtggcca

SEQ ID NO: 358510 - DNA, 75 bp, Artificial Sequence
  Synthetic
acctcaataaacgtccaagccagcgcgttgtttaccctggccagaggtttcccttttgtggacgttggtgtatca

SEQ ID NO: 358511 - DNA, 75 bp, Artificial Sequence
  Synthetic
gacagcggctgggatcatgaaaaatgccgtgattgacggcatggtggccactgacgtccctgaactggagcgaac

SEQ ID NO: 358512 - DNA, 75 bp, Artificial Sequence
  Synthetic
cgttgtttaccctggccagaggtttcccttttgtggacgttggtgtatcagctctcctgctggcagctggatgct

SEQ ID NO: 358513 - DNA, 75 bp, Artificial Sequence
  Synthetic
ggacagactatgctgatactcgtatcggctgcagccgtcatcgtgaacccttcagtaagaacggtcagagaagct

SEQ ID NO: 358514 - DNA, 75 bp, Artificial Sequence
  Synthetic
tgtgactgcagctgctctgcttttttgccattatgcgtacatggtgccaggctggcaagctgaagccatgcgatc

SEQ ID NO: 358515 - DNA, 75 bp, Artificial Sequence
  Synthetic
cggctgcagccgtcatcgtgaacccttcagtaagaacggtcagagaagctggcatcctcgttacagcagctgcga

SEQ ID NO: 358516 - DNA, 75 bp, Artificial Sequence
  Synthetic
ctcggtatggaatgccaccaccgccattggtctttgccacgtcatgcgcggaggatggctgtcatgtctgtccat

SEQ ID NO: 358517 - DNA, 75 bp, Artificial Sequence
  Synthetic
attggtctttgccacgtcatgcgcggaggatggctgtcatgtctgtccatcacctggactttggtgaagaacatg

SEQ ID NO: 358518 - DNA, 75 bp, Artificial Sequence
  Synthetic
cagaaaaaagttggacagatcatgttgatcttggtgtcaatggccgcggtggttgtcaatccatcagtgaggact

SEQ ID NO: 358519 - DNA, 75 bp, Artificial Sequence
  Synthetic
gagccaagggtagaacccttggtgaggtgtggaaagacaggcttaatcggttgacaaaagaagaattcaccaggt

SEQ ID NO: 358520 - DNA, 75 bp, Artificial Sequence
  Synthetic
ggtgtggaaagacaggcttaatcggttgacaaaagaagaattcaccaggtacagaaaagaggccataatcgaggt

SEQ ID NO: 358521 - DNA, 75 bp, Artificial Sequence
  Synthetic
aggaaggaagggaatatcacaagcggtcatcccgtttcaagaggcacggcgaagcttagatggcttgtggaaaga

SEQ ID NO: 358522 - DNA, 75 bp, Artificial Sequence
  Synthetic
attaaaaacatggagaagcctggcctcaagaggggtggagccaaaggacgcacgctgggggaattttggaaggag

SEQ ID NO: 358523 - DNA, 75 bp, Artificial Sequence
  Synthetic
gtcatcccgtttcaagaggcacggcgaagcttagatggcttgtggaaagaaggttcatcgaccccatcggaaaag

SEQ ID NO: 358524 - DNA, 75 bp, Artificial Sequence
  Synthetic
cggttggtgttactacatggcaacgcaaaagcgcgtccaagaggtcaagggctacacaaaaggcggccctgggca

SEQ ID NO: 358525 - DNA, 75 bp, Artificial Sequence
  Synthetic
caaaagcgcgtccaagaggtcaagggctacacaaaaggcggccctgggcacgaagagccgcagctcgtccaaagt

SEQ ID NO: 358526 - DNA, 75 bp, Artificial Sequence
  Synthetic
agagcggagttgatgtgtattatagggcatcagagacgagtgacacccttctttgcgacataggagaatcagctg

SEQ ID NO: 358527 - DNA, 75 bp, Artificial Sequence
  Synthetic
cagtgggaaaggttgtagatcttggctgtggtagaggcggctggtgttactacatggctacccagaagagggtac

SEQ ID NO: 358528 - DNA, 75 bp, Artificial Sequence
  Synthetic
ggcatcagagacgagtgacacccttctttgcgacataggagaatcagctgcgagcgcagaggtggaggagcaccg

SEQ ID NO: 358529 - DNA, 75 bp, Artificial Sequence
  Synthetic
gaagactggctgcatcgaggccccaaagagttctgcattaaagtgttatgtccatacatgcccaaagtcattgag

SEQ ID NO: 358530 - DNA, 75 bp, Artificial Sequence
  Synthetic
aggacccggtcatgaggaaccacaactggtgcagagctatggttggaacatcgttaccatgaagagtggggtcga

SEQ ID NO: 358531 - DNA, 75 bp, Artificial Sequence
  Synthetic
aagagttctgcattaaagtgttatgtccatacatgcccaaagtcattgagaagctggaagtgttgcaacgacgtt

SEQ ID NO: 358532 - DNA, 75 bp, Artificial Sequence
  Synthetic
atagacatcagccggcaagagctgagatgtggaagtggagtgttcatacacaatgatgtggaggcttggatggac

SEQ ID NO: 358533 - DNA, 75 bp, Artificial Sequence
  Synthetic
actttcgcgcaattcatcccacgagatgtactgggtgagccgcgcctcaggaaacattgtgaactccgccaacat

SEQ ID NO: 358534 - DNA, 75 bp, Artificial Sequence
  Synthetic
atgtactgggtgagccgcgcctcaggaaacattgtgaactccgccaacatgactagccaagttctccttgggcgc

SEQ ID NO: 358535 - DNA, 75 bp, Artificial Sequence
  Synthetic
ctcattatgaggaagacgtcaacttgggcagtggaactagagcagtaggacgacctctgcttaattccgacactg

SEQ ID NO: 358536 - DNA, 75 bp, Artificial Sequence
  Synthetic
gggcagtggaactagagcagtaggacgacctctgcttaattccgacactggaaagattcggaaccggattgaacg

SEQ ID NO: 358537 - DNA, 75 bp, Artificial Sequence
  Synthetic
ctcctggggaggatggaaaagaaaacatggaaggggccccagtatgaggaagatgtcaacttgggaagtggaaca

SEQ ID NO: 358538 - DNA, 75 bp, Artificial Sequence
  Synthetic
tggcatcaggatgacaaccacccgtacaggacttggaactaccatggcagctatgaggtgaagcccacaggctcg

SEQ ID NO: 358539 - DNA, 75 bp, Artificial Sequence
  Synthetic
acaggacttggaactaccatggcagctatgaggtgaagcccacaggctcggccagctcactggtaaacggcgttg

SEQ ID NO: 358540 - DNA, 75 bp, Artificial Sequence
  Synthetic
ccgaattgagagactgaagaaagaatacagctccacatggcaccaggatgtgaaccacccttacagaacctggaa

SEQ ID NO: 358541 - DNA, 75 bp, Artificial Sequence
  Synthetic
taccatcaccaatgtgaccacaatggccatgaccgacaccaccccctttgggcagcagcgcgtgttcaaggaaaa

SEQ ID NO: 358542 - DNA, 75 bp, Artificial Sequence
  Synthetic
gccatgaccgacaccaccccctttgggcagcagcgcgtgttcaaggaaaaggttgacacgaaggcccctgaacca

SEQ ID NO: 358543 - DNA, 75 bp, Artificial Sequence
  Synthetic
ccaaccggctcagccagctctcttgtgaatggggtagtcagattgctttcaaaaccatgggacactatcaccaat

SEQ ID NO: 358544 - DNA, 75 bp, Artificial Sequence
  Synthetic
gaggattttggatttggtctcaccagcactcggatgttcctgaaggtcagagagagcaacacaactgaatgtgac

SEQ ID NO: 358545 - DNA, 75 bp, Artificial Sequence
  Synthetic
tgaatggggtagtcagattgctttcaaaaccatgggacactatcaccaatgtgacaactatggccatgacagaca

SEQ ID NO: 358546 - DNA, 75 bp, Artificial Sequence
  Synthetic
atgaaaccaccaactggctgtgggcttttctggcgcgagagaagcgaccacgcatgtgcacgagagaagagttca

SEQ ID NO: 358547 - DNA, 75 bp, Artificial Sequence
  Synthetic
ttttctggcgcgagagaagcgaccacgcatgtgcacgagagaagagttcataagcaaggtcaacagcaacgcggc

SEQ ID NO: 358548 - DNA, 75 bp, Artificial Sequence
  Synthetic
aaccagtggtcaaacgccagagacgctgtagaagatcctaagttctgggagatggtggatgaagagcgcgaggcc

SEQ ID NO: 358549 - DNA, 75 bp, Artificial Sequence
  Synthetic
ctgtagaagatcctaagttctgggagatggtggatgaagagcgcgaggcccatctccgaggtgaatgccacacgt

SEQ ID NO: 358550 - DNA, 75 bp, Artificial Sequence
  Synthetic
agaaaagaaacctggtgaattcggtaaagcgaagggtagccgagctatttggttcatgtggctgggagctcggtt

SEQ ID NO: 358551 - DNA, 75 bp, Artificial Sequence
  Synthetic
aaagcgaagggtagccgagctatttggttcatgtggctgggagctcggtttctggagtttgaagccttgggattc

SEQ ID NO: 358552 - DNA, 75 bp, Artificial Sequence
  Synthetic
gagcgtgaagcgcatctccgtggagagtgcaacacctgcatttacaacatgatgggaaagagagagaaaaagcct

SEQ ID NO: 358553 - DNA, 75 bp, Artificial Sequence
  Synthetic
ggaagaactcagggggaggcgtcgagggactaggcctgcagaagctcgggtacgttctcagggaagttggagtaa

SEQ ID NO: 358554 - DNA, 75 bp, Artificial Sequence
  Synthetic
gggactaggcctgcagaagctcgggtacgttctcagggaagttggagtaaaatccggagggaaaatgtacgctga

SEQ ID NO: 358555 - DNA, 75 bp, Artificial Sequence
  Synthetic
attacgaaggctgatctcgaaaatgaggccaaggtgctggaactcctcggaggtgagcaccgccggctagccaga

SEQ ID NO: 358556 - DNA, 75 bp, Artificial Sequence
  Synthetic
aggccaaggtgctggaactcctcggaggtgagcaccgccggctagccagatccataattgagctcacataccgcc

SEQ ID NO: 358557 - DNA, 75 bp, Artificial Sequence
  Synthetic
gatctacgctgatgacactgcaggctgggacacacgcatcactaaagctgaccttgagaatgaggcgaaggttct

SEQ ID NO: 358558 - DNA, 75 bp, Artificial Sequence
  Synthetic
agcagttggaggaaaaaccgtgatggacgtcatttcccgtgaagatcagagaggcagcgggcaagttgtgacata

SEQ ID NO: 358559 - DNA, 75 bp, Artificial Sequence
  Synthetic
gacgtcatttcccgtgaagatcagagaggcagcgggcaagttgtgacatacgcacttaacacgttcacaaacctg

SEQ ID NO: 358560 - DNA, 75 bp, Artificial Sequence
  Synthetic
aaggtgaaggcgtgatcgggcctgacgatgtggagaagctaggaaaaggcaaaggagtgaaggtgcgcgtctggc

SEQ ID NO: 358561 - DNA, 75 bp, Artificial Sequence
  Synthetic
cgatgtggagaagctaggaaaaggcaaaggagtgaaggtgcgcgtctggctctttgagaacggagaggagcgact

SEQ ID NO: 358562 - DNA, 75 bp, Artificial Sequence
  Synthetic
gactgtgtggtaaagccgattgatgacaggttcgccacctcacttcacttccttaatgccatgtcaaaagtgagg

SEQ ID NO: 358563 - DNA, 75 bp, Artificial Sequence
  Synthetic
tcagaacctggctgtttgagaatggtgaagagcgtctcagtcgcatggccgtcagtggtgatgactgcgtggtga

SEQ ID NO: 358564 - DNA, 75 bp, Artificial Sequence
  Synthetic
acaggttcgccacctcacttcacttccttaatgccatgtcaaaagtgaggaaagacatccaggaatggaagcctt

SEQ ID NO: 358565 - DNA, 75 bp, Artificial Sequence
  Synthetic
ggtacctttttgctcaaaccactttaccgagctgatcatgaaagacggcaggaccctggtggtgccctgcagagg

SEQ ID NO: 358566 - DNA, 75 bp, Artificial Sequence
  Synthetic
accgagctgatcatgaaagacggcaggaccctggtggtgccctgcagaggacaagatgagctaatcgggcgagcc

SEQ ID NO: 358567 - DNA, 75 bp, Artificial Sequence
  Synthetic
agccctcagaaccgtctcggaaggaggaccccacagtggatcacaacatgtgggggtcctcgttccgagacggtt

SEQ ID NO: 358568 - DNA, 75 bp, Artificial Sequence
  Synthetic
acgtgcgggacacagcgtgtttggccaaatcgtatgcgcaaatgtggcaattgttgtacttccacaggagggacc

SEQ ID NO: 358569 - DNA, 75 bp, Artificial Sequence
  Synthetic
caaatcgtatgcgcaaatgtggcaattgttgtacttccacaggagggacctcaggctgatggcgaacgccatctg

SEQ ID NO: 358570 - DNA, 75 bp, Artificial Sequence
  Synthetic
cgcctgcctggcgaagtcatacgcgcagatgtggctgctgctctactttcaccgcagagatctgaggttgatggc

SEQ ID NO: 358571 - DNA, 75 bp, Artificial Sequence
  Synthetic
cccacaggcagaacgacctggtcaatccatgcaaaaggtgagtggatgaccacatctgacatgcttggagtgtgg

SEQ ID NO: 358572 - DNA, 75 bp, Artificial Sequence
  Synthetic
tccatgcaaaaggtgagtggatgaccacatctgacatgcttggagtgtggaatcgggtatggatagaagaaaatg

SEQ ID NO: 358573 - DNA, 75 bp, Artificial Sequence
  Synthetic
tgaaaaatggtcagacgttccctactcggggaagcgtgaagacatctggtgtggaagcctcatcggaacgcgctc

SEQ ID NO: 358574 - DNA, 75 bp, Artificial Sequence
  Synthetic
ttgaggagaatgagtggatggaagacaaaacaccaattgagaagtggagtgacgttccatattctggaaagagag

SEQ ID NO: 358575 - DNA, 75 bp, Artificial Sequence
  Synthetic
tcggggaagcgtgaagacatctggtgtggaagcctcatcggaacgcgctctcgagcaacatgggccgaaaacatt

SEQ ID NO: 358576 - DNA, 75 bp, Artificial Sequence
  Synthetic
gtggatgggaatcaatgcccgtgacaggtcaattgctatgacgttccttgcggttggaggagttctgctcttcct

SEQ ID NO: 358577 - DNA, 75 bp, Artificial Sequence
  Synthetic
ccgtgattggagaggaaaaatacgtcgattacatgagctcattcaagaggtacgaagagcccacaccagaggaag

SEQ ID NO: 358578 - DNA, 75 bp, Artificial Sequence
  Synthetic
gctgaaaacatccatgtggcaatcaatcaggtccgttcggtgattggggaagagaagtatgtagactacatgagc

SEQ ID NO: 358579 - DNA, 75 bp, Artificial Sequence
  Synthetic
cgattacatgagctcattcaagaggtacgaagagcccacaccagaggaagactctgtgctgtaagatcgacaaat

SEQ ID NO: 358580 - DNA, 75 bp, Artificial Sequence
  Synthetic
ccgtagtggaggacactgttttgtaaataataaagttgtattgaatagttgtacagttgcagtgtttatagcaat

SEQ ID NO: 358581 - DNA, 75 bp, Artificial Sequence
  Synthetic
ataaatgtaatttaagaacaagaatttgcagtcaggccggcaatgccgccaccggaagttgagtagacggtgctg

SEQ ID NO: 358582 - DNA, 75 bp, Artificial Sequence
  Synthetic
ttgcagtcaggccggcaatgccgccaccggaagttgagtagacggtgctgcctgcgcctcaaccccagaaggact

SEQ ID NO: 358583 - DNA, 75 bp, Artificial Sequence
  Synthetic
ttgaattatgattaattatttaggtttgagatagtattatagttagtgtagtgttaataggattttattgagaat

SEQ ID NO: 358584 - DNA, 75 bp, Artificial Sequence
  Synthetic
cacgtaagccctcaataccgattcggaacgaggaccccacgtgttttaactctatggaccacacaaaacgcagcc

SEQ ID NO: 358585 - DNA, 75 bp, Artificial Sequence
  Synthetic
caagagtatcatctttgctccagagctagctaataacacctttgtcattgacggccctgagactgaggaatgccc

SEQ ID NO: 358586 - DNA, 75 bp, Artificial Sequence
  Synthetic
aggagaagggactagaggttagtggagaccctgcgcaaaacatggcacggcccaacctgaccaaagctgtaggtc

SEQ ID NO: 358587 - DNA, 75 bp, Artificial Sequence
  Synthetic
tcgcaagttggtgatgagtactgttatggggggcacacgaatgaagacgactcgaacttcgcccattggactgag

SEQ ID NO: 358588 - DNA, 75 bp, Artificial Sequence
  Synthetic
acatgccaaacggactgatcgctcaattctaccaaccagagcgtgagaaggtatataccatggatggggaatacc

SEQ ID NO: 358589 - DNA, 75 bp, Artificial Sequence
  Synthetic
acatcatgcgaggaggatggctctcgtgtctctccatcacgtggactctcattaaaaacatggagaagccaggcc

SEQ ID NO: 358590 - DNA, 75 bp, Artificial Sequence
  Synthetic
cctatcccctgtgtgccttgcctatcccctgttgcgtgtctcagtagttcgcctgtgtgagctgacaaacttagt

SEQ ID NO: 358591 - DNA, 75 bp, Artificial Sequence
  Synthetic
attgtaaatagacaatataagtatgcataaaagtgtagtttatagtagtattagtgtgttagtgtaatagttaag

SEQ ID NO: 358592 - DNA, 75 bp, Artificial Sequence
  Synthetic
ctcggaaggaggactgggtgatcaaagccgcgaagtgatccatgtaagccctcagaaccgtctcggaaggaggac

SEQ ID NO: 358593 - DNA, 75 bp, Artificial Sequence
  Synthetic
ctcagaaccgtctcggaaggaggaccccacatgtgatccatgtaagccctcagaaccgtctcggaaggaggactg

SEQ ID NO: 358594 - DNA, 75 bp, Artificial Sequence
  Synthetic
ccccacatgtaagccctcagaaccgtctcggaaggaggaccccacatgtaagccctcgagaaccgtctcggaagg

SEQ ID NO: 358595 - DNA, 75 bp, Artificial Sequence
  Synthetic
tctcggaaggaggaccccacatgtaagccctcgagaaccgtctcggaaggaggaccccacatgtaagcccctcag

SEQ ID NO: 358596 - DNA, 75 bp, Artificial Sequence
  Synthetic
tcaggctcctctcaaaaccatgggacaccatcacgaatgttaccaccatggccatgactgacactactcccttcg

SEQ ID NO: 358597 - DNA, 75 bp, Artificial Sequence
  Synthetic
cctatcccctgtgtgccttgcctatcccctgttgcgtgtctcagagtagttcgcctgtgtgagctgacaaactta

SEQ ID NO: 358598 - DNA, 75 bp, Artificial Sequence
  Synthetic
tacactgatgtgttacgctatgtcattctggtgggggcggcctttgcagaatccaactcaggaggagatgtggtg

SEQ ID NO: 358599 - DNA, 75 bp, Artificial Sequence
  Synthetic
acagcggtcctcactccactgctaaagcatttgatcacgtcagattacatcaacacctcattgacctcaataaat

SEQ ID NO: 358600 - DNA, 75 bp, Artificial Sequence
  Synthetic
gccatcggactctgccacatcatgcgtgggggttggttgtcatgtctatccataacatggacactcataaagaac

SEQ ID NO: 358601 - DNA, 75 bp, Artificial Sequence
  Synthetic
caccgagagagtacagaaaaggggacaccaccacgggagtataccgaatcatgacgcgagggatacttggcagct

SEQ ID NO: 358602 - DNA, 75 bp, Artificial Sequence
  Synthetic
gcagaggagaacaacagatcaatcaccattggcacaagtctggaagcagcattggcaaagcctttacaaccactc

SEQ ID NO: 358603 - DNA, 75 bp, Artificial Sequence
  Synthetic
agatatgaagacacaactttggttgaggacacagtattgtagatatttaattaattgctgagacacgcaacaggg

SEQ ID NO: 358604 - DNA, 75 bp, Artificial Sequence
  Synthetic
acagcatattgacacctgggatagactaggagatcttctgctctgcacaaccagccacacggcacagtgcgccga

SEQ ID NO: 358605 - DNA, 75 bp, Artificial Sequence
  Synthetic
gttaacaaaggcaaaccaacgccccacgcggccctagcccggtaatggtgttaaccagggcgaaaggactagagg

SEQ ID NO: 358606 - DNA, 75 bp, Artificial Sequence
  Synthetic
tgggacacccgcatcacgagagctgacttggaaaatgaagctaaggtgcttgagctgcttgatggggaacatcgg

SEQ ID NO: 358607 - DNA, 75 bp, Artificial Sequence
  Synthetic
cgtcagtggcttcattgaacgacctaacgccagtgggcagattggtcactgtcaacccttttgtttcagtggcca

SEQ ID NO: 358608 - DNA, 75 bp, Artificial Sequence
  Synthetic
gtaggcagagctcgcatatctccaggggccggatggaacgtccgcgacactgcttgtctggctaagtcttatgcc

SEQ ID NO: 358609 - DNA, 75 bp, Artificial Sequence
  Synthetic
ggagaaaaagacttggaagggagcccactacgaggaagacgtcaatttgggcagtgggaccagggccgttggaaa

SEQ ID NO: 358610 - DNA, 75 bp, Artificial Sequence
  Synthetic
atttgcaccagaactcgccaacaacacctttgtggttgatggtccggagaccaaggaatgtccgactcagaatcg

SEQ ID NO: 358611 - DNA, 75 bp, Artificial Sequence
  Synthetic
ccgccaccggaagttgagtagacggtgctgcctgcgactcaaccccaggaggactgggtgaacaaagccgcgaag

SEQ ID NO: 358612 - DNA, 75 bp, Artificial Sequence
  Synthetic
ggacagcacaaaagccacgagatatctggtaaagacagaatcatggatactgagaaacccgggctacgccctcgt

SEQ ID NO: 358613 - DNA, 75 bp, Artificial Sequence
  Synthetic
ggccccttgccgtcgatcaggctcaacatagccctcttcagtccaatcaaggacaacacgcggggcattccgcgt

SEQ ID NO: 358614 - DNA, 75 bp, Artificial Sequence
  Synthetic
atcccgccttcgtttgcaagcaaggcgttgtggatagaggatggggaaacggatgcggactgtttggaaagggga

SEQ ID NO: 358615 - DNA, 75 bp, Artificial Sequence
  Synthetic
atgaggttgccatatttgtgcatggcccgacgaccgttgaatctcatggcaattattcaacacagataggggcca

SEQ ID NO: 358616 - DNA, 75 bp, Artificial Sequence
  Synthetic
tccatgtaagccctcagaaccgtctcggaaggaggaccccacatgaagtgatccatgtaagccctcagaaccgtc

SEQ ID NO: 358617 - DNA, 75 bp, Artificial Sequence
  Synthetic
ctcggaaggaggaccccacatgaagtgatccatgtaagccctcagaaccgtctcgggaaggaggaccccacatgt

SEQ ID NO: 358618 - DNA, 75 bp, Artificial Sequence
  Synthetic
ggttttgattgaactcgaacccccgtttggtgactcttacatcgtggtgggaagaggagaacagcagataaacca

SEQ ID NO: 358619 - DNA, 75 bp, Artificial Sequence
  Synthetic
aactgccaaccgagcatggaacagtatggaggtagaggactttggatttggactgacaagcactcgcatgttcct

SEQ ID NO: 358620 - DNA, 75 bp, Artificial Sequence
  Synthetic
tgtgtgcctgtgccttgcctatcccctgtctcagagtagttcgcctgtgtgagctgacaaacttagtagtgtttg

SEQ ID NO: 358621 - DNA, 75 bp, Artificial Sequence
  Synthetic
ccacaaaacaccacaacaaaacagcatattgacacctgggatagactaggagatcctgtgttctcgcaccaccag

SEQ ID NO: 358622 - DNA, 75 bp, Artificial Sequence
  Synthetic
gcgaagtgatccatgtaagccctcagaaccgctgagacacgcaacaagggataggcaaggcacacaggggatagg

SEQ ID NO: 358623 - DNA, 75 bp, Artificial Sequence
  Synthetic
cgcgaggcttccccttcgtcgatgttggagtgtcggctctcttgctagcagccggatgctggggacaagtcaccc

SEQ ID NO: 358624 - DNA, 75 bp, Artificial Sequence
  Synthetic
tgggcaatcctgccctcagtagttggattttggataactctccaatacacaaagagaggaggcgtgttgtgggac

SEQ ID NO: 358625 - DNA, 75 bp, Artificial Sequence
  Synthetic
cctgctgctcatgattgttttgattccagagccggaaaagcagcgctcacagactgacaaccagctcgctgtgtt

SEQ ID NO: 358626 - DNA, 75 bp, Artificial Sequence
  Synthetic
cattgttcaccttggccagaggcttcccttttgtggacgttggtgtgtcagctctcttgctggcagccgggtgct

SEQ ID NO: 358627 - DNA, 75 bp, Artificial Sequence
  Synthetic
ttcagtcaaataaaggacaccccggggggctttccgctttttagcatattgcccccccggctctggccggcccct

SEQ ID NO: 358628 - DNA, 75 bp, Artificial Sequence
  Synthetic
tgatgtttgccattgtcggagggctggcagagcttgacattgactccatggccattccaatgactatcgcggggc

SEQ ID NO: 358629 - DNA, 75 bp, Artificial Sequence
  Synthetic
agccgcgaagtgatccatgtaagccctcagaaccgtctcggaaggaggaccccacatgttgtaacttcaaagccc

SEQ ID NO: 358630 - DNA, 75 bp, Artificial Sequence
  Synthetic
aaaaggacctggaagggaccccaatacgaggaagatgtaaacttgggaagtggaaccagggcggtgggaaaaccc

SEQ ID NO: 358631 - DNA, 75 bp, Artificial Sequence
  Synthetic
tttgtttgttcacacctctccatcgatccagcactgctcgggtcggagcaattgctgtgaacctgaagaacgcca

SEQ ID NO: 358632 - DNA, 75 bp, Artificial Sequence
  Synthetic
ggatagactaggagatcttctgctctgcacaaccagccacacggcacagtgcgccgacaatggtggctggtggtg

SEQ ID NO: 358633 - DNA, 75 bp, Artificial Sequence
  Synthetic
gtggtaaagcccctggacgatcgctttgccacctcgctccacttcctcaatgctatgtcaaaggttcgcaaagac

SEQ ID NO: 358634 - DNA, 75 bp, Artificial Sequence
  Synthetic
aattttgaggagaaagtcaggccgggaagttcccgccaccggaagttgagtagacggtgctgcctgcgactcaac

SEQ ID NO: 358635 - DNA, 75 bp, Artificial Sequence
  Synthetic
ggaccgactttgttacggaggaccctggaaattgcagcataagtggaacgggcaggatgaggtgcagatgattgt

SEQ ID NO: 358636 - DNA, 75 bp, Artificial Sequence
  Synthetic
atccagctagcatcgcagcaagaggttatatttccacaaaggtcgagctgggggaggcggcggcaatattcatga

SEQ ID NO: 358637 - DNA, 75 bp, Artificial Sequence
  Synthetic
cggatcgggcctggaactctggatacgaatggatcacagaatacatcgggaagacggtttggtttgtgcctagtg

SEQ ID NO: 358638 - DNA, 75 bp, Artificial Sequence
  Synthetic
gaacaaagccgcgaagtgatccatgtaagccctcagaacctgagacacgcaacaggggataggcaaggcacacag

SEQ ID NO: 358639 - DNA, 75 bp, Artificial Sequence
  Synthetic
tccatgtaagccctcagaaccgtctcggaaggaggaccccacatgtaagccctcagaaccgtctcggaaggagga

SEQ ID NO: 358640 - DNA, 75 bp, Artificial Sequence
  Synthetic
ccccacatgtaagccctcagaaccgtctcggaaggaggaccccacatgtaagcccctcaggaaccgtctcggaag

SEQ ID NO: 358641 - DNA, 75 bp, Artificial Sequence
  Synthetic
cctaggacaaacacaattttagaagacaacaacgaagtggaagtcatcacgaagcttggtgaaaggaagattctg

SEQ ID NO: 358642 - DNA, 75 bp, Artificial Sequence
  Synthetic
ggctgttggtatggtatggagatcagaccacagagacatgatgaaaagacccttgtgcagtcacaagtgaatgct

SEQ ID NO: 358643 - DNA, 75 bp, Artificial Sequence
  Synthetic
aaacgttctcagatagggctcattgaggttctgggaaagatgcctgagcacttcatggggaagacatgggaagca

SEQ ID NO: 358644 - DNA, 75 bp, Artificial Sequence
  Synthetic
catatttgtgcatggcccgacgactgttgaatctcatggcaattattcaacacagataggggccacccaggctgg

SEQ ID NO: 358645 - DNA, 75 bp, Artificial Sequence
  Synthetic
agaatggtttatggatctgaacctgccatggagcagtgctggaagcaccacgtggaggaatcgggaaacactgat

SEQ ID NO: 358646 - DNA, 75 bp, Artificial Sequence
  Synthetic
agccatacaccaagtctttggaggagcttttagatcactctttggagggatgtcctggatcacacagggacttct

SEQ ID NO: 358647 - DNA, 75 bp, Artificial Sequence
  Synthetic
agggtacacaaagggtggtcccggacatgaagagccccaactagtgcaaagttatggatggaacattgtcaccat

SEQ ID NO: 358648 - DNA, 75 bp, Artificial Sequence
  Synthetic
tggtattcaatgatgctagtgtaaatagttaagaaaattttaaagaggaacaatgatgctagtgtaaatagttaa

SEQ ID NO: 358649 - DNA, 75 bp, Artificial Sequence
  Synthetic
tcgctcagcggcaaaacacgccaggaaagaaggcaatgtcactggagggcatccagtctctaggggcacagcaaa

SEQ ID NO: 358650 - DNA, 75 bp, Artificial Sequence
  Synthetic
tgcagctgtcattggatggatgctaggaagcaacacaatgcaacgcgtcgtgtttgccatcctattgctcctggt

SEQ ID NO: 358651 - DNA, 75 bp, Artificial Sequence
  Synthetic
acaagccaaccattgacgtcaaaatgatgaacatggaagcagccaatctcgcagatgtgcgcagttactgttatc

SEQ ID NO: 358652 - DNA, 75 bp, Artificial Sequence
  Synthetic
atcattcagaaggaaaacatcaagtatgaggttgccatatttgtgcatggcccgacgaccgttgaatcccatggc

SEQ ID NO: 358653 - DNA, 75 bp, Artificial Sequence
  Synthetic
tggttgaggacacagtactgtagatatttaatcaattgtaaatagacaatataagtatgtataaaagtgtagttt

SEQ ID NO: 358654 - DNA, 75 bp, Artificial Sequence
  Synthetic
aattgcagtcatgattggcctgatcgccagcgtgggagcagttaccctctctaacttccaagggaaggtgatgat

SEQ ID NO: 358655 - DNA, 75 bp, Artificial Sequence
  Synthetic
aagtgcccatttcttccgtagcttccctgaatgacctcacacctgttggaagactggtgacagtgaatccatttg

SEQ ID NO: 358656 - DNA, 75 bp, Artificial Sequence
  Synthetic
aggtccatagctctcacgtttctcgcagttggaggagtcctgctcttcctctccgtgaacgtgcatgctgacact

SEQ ID NO: 358657 - DNA, 75 bp, Artificial Sequence
  Synthetic
tgaatggatggaagacaaaaccccagtggagaaatggagtgacgtcccatactcaggaaaacgggaggacatctg

SEQ ID NO: 358658 - DNA, 75 bp, Artificial Sequence
  Synthetic
gtggatgggaatcaatgctcgtgacaggtcaattgctatgacgttccttgcagttggaggagttttgctctttct

SEQ ID NO: 358659 - DNA, 75 bp, Artificial Sequence
  Synthetic
tgggatgtacaaagcagcaccaaaacgtttggctgccaccaccgaaaaactggagatgggttggaaggcttgggg

SEQ ID NO: 358660 - DNA, 75 bp, Artificial Sequence
  Synthetic
agatcttctgctctgcacaaccagccacaattgtcggcacagtgcgccgacaatggtggctggtggtgcgagaac

SEQ ID NO: 358661 - DNA, 75 bp, Artificial Sequence
  Synthetic
taacttccaagggaaagtgatgatgacggtaaatgctactgacgtcacagatgtcatcacgattccaacagctgc

SEQ ID NO: 358662 - DNA, 75 bp, Artificial Sequence
  Synthetic
cagaatctaattcgggaggagacgtggtacacttggcgctcatggcgaccttcaagatacagccagtgtttatgg

SEQ ID NO: 358663 - DNA, 75 bp, Artificial Sequence
  Synthetic
ggctccagcctacagctttaactgccttggaatgagcaacagagacttcttagagggagtatctggagcaacatg

SEQ ID NO: 358664 - DNA, 75 bp, Artificial Sequence
  Synthetic
aagactcaaccagatgacaaaagaggagttcactaggtaccgcaaagaggccatcatcgaagtcgatcgctcagc

SEQ ID NO: 358665 - DNA, 75 bp, Artificial Sequence
  Synthetic
ggctgcggactattcggcaaaggaagcattgacacatgcgccaaatttgcctgttccaccaaagcaacaggaaga

SEQ ID NO: 358666 - DNA, 75 bp, Artificial Sequence
  Synthetic
ggtctggcagaacttgacatagattctatggctatccccatgaccatcgccggactcatgttcgtggcatttgtc

SEQ ID NO: 358667 - DNA, 75 bp, Artificial Sequence
  Synthetic
ggattgagaggacagctgacatcacttgggagagtgatgctgagatcacaggctctagcgaaagagtagatgtta

SEQ ID NO: 358668 - DNA, 75 bp, Artificial Sequence
  Synthetic
aattgacaccaatgcatactatgtgatgaccgtcggaacaaagacgtttctggtccatcgtgagtggttcatgga

SEQ ID NO: 358669 - DNA, 75 bp, Artificial Sequence
  Synthetic
acacactgtggcacaccactaagggagccgctctcatgagtggtgaaggacgtttggatccctactgggggagcg

SEQ ID NO: 358670 - DNA, 75 bp, Artificial Sequence
  Synthetic
cgtttggatccctactgggggagcgtgaaagaagaccgactctgctatggggggccatggaaactccaacacaaa

SEQ ID NO: 358671 - DNA, 75 bp, Artificial Sequence
  Synthetic
gtttgctcaaaggctttcaagtttcttgggactcccgcagacacaggtcacggtaccgtggtgttggaattgcag

SEQ ID NO: 358672 - DNA, 75 bp, Artificial Sequence
  Synthetic
cagtgccatcaaccgccggagcacaaaacaaaagaaaagaggaggcacagcgggctttactatcttgcttgggct

SEQ ID NO: 358673 - DNA, 75 bp, Artificial Sequence
  Synthetic
ttaaaggggcgcagagactagccgccttgggagatacagcctgggactttggatcagttggaggggtgttcacct

SEQ ID NO: 358674 - DNA, 75 bp, Artificial Sequence
  Synthetic
tgtccggtcctagctgctggaaatgaccctgaagacattgactgctggtgcacgaaatcatctgtttacgtgcgc

SEQ ID NO: 358675 - DNA, 75 bp, Artificial Sequence
  Synthetic
gttcggtggagcgtttcgctcactgttcggaggcatgtcttggataacgcaaggattgctgggggctctgctgtt

SEQ ID NO: 358676 - DNA, 75 bp, Artificial Sequence
  Synthetic
aaggattgctgggggctctgctgttgtggatgggcgtcaatgctcgtgacaggtctatagctcttacgtttctcg

SEQ ID NO: 358677 - DNA, 75 bp, Artificial Sequence
  Synthetic
gattgaattggaaccaccctttggagactcatacatagtggtgggcagaggagaacaacagatcaatcaccactg

SEQ ID NO: 358678 - DNA, 75 bp, Artificial Sequence
  Synthetic
ttcctggagggagtgtctggagctacatgggttgatctggtactggaaggcgatagttgtgtgaccataatgtca

SEQ ID NO: 358679 - DNA, 75 bp, Artificial Sequence
  Synthetic
ggagtgtgcggtctacggtcagtttctaggctggagcaccagatgtgggaagcagtgaaggacgagctgaacact

SEQ ID NO: 358680 - DNA, 75 bp, Artificial Sequence
  Synthetic
gctgaccccgccttcgtttgcaagcaaggcgttgtggacagaggatggggaaatggctgcggactgtttggaaag

SEQ ID NO: 358681 - DNA, 75 bp, Artificial Sequence
  Synthetic
acggtaaacccgtacgtttcagtggcgacagccaacgcaaagatcctgatagagttggagcccccattcggggac

SEQ ID NO: 358682 - DNA, 75 bp, Artificial Sequence
  Synthetic
gagttgagagcttcttacttgatctgcggccggccacggcatggtcgctctatgccgtaacgacagccgttctca

SEQ ID NO: 358683 - DNA, 75 bp, Artificial Sequence
  Synthetic
tatgccgtaacgacagccgttctcacccctttgttgaaacatctaatcacgtcagactacatcaatacctcgttg

SEQ ID NO: 358684 - DNA, 75 bp, Artificial Sequence
  Synthetic
cccgtttggtgactcttacatcgtggtgggaagaggagaacagcagataaaccaccactggcacaaatctgggag

SEQ ID NO: 358685 - DNA, 75 bp, Artificial Sequence
  Synthetic
atcatgaaaaatgcagtggtggatgggatcgtggccactgatgtacctgaacttgaacgaacaactccagtcatg

SEQ ID NO: 358686 - DNA, 75 bp, Artificial Sequence
  Synthetic
ctttgggagatccctgatgtgttgaattcactggcagtagcttggatgatactgagagccataacattcacaaca

SEQ ID NO: 358687 - DNA, 75 bp, Artificial Sequence
  Synthetic
gcagcttgatcagggagaagagaagtgcagctgcaaaaaagaaaggagcaagtctgttatgcctggctctagcct

SEQ ID NO: 358688 - DNA, 75 bp, Artificial Sequence
  Synthetic
caacaggacttttcaaccctatgatcctcgccgctggactcattgcatgtgatcccaaccgtaaacgagggtggc

SEQ ID NO: 358689 - DNA, 75 bp, Artificial Sequence
  Synthetic
gggctagcagagcttgacatcgactccatggctatcccaatgactatcgcagggctcatgtttgctgctttcgtg

SEQ ID NO: 358690 - DNA, 75 bp, Artificial Sequence
  Synthetic
gggaagccattaaggatgagctgaacaccctgttgaaagagaatggagtcgacttgagtgtcgtggtggaaaaac

SEQ ID NO: 358691 - DNA, 75 bp, Artificial Sequence
  Synthetic
ggcttgatgatgatggaaatttccagcttatgaatgatccaggagcgccttggaagatatggatgctcagaatgg

SEQ ID NO: 358692 - DNA, 75 bp, Artificial Sequence
  Synthetic
gcttatgaatgatccaggagcgccttggaagatatggatgctcagaatggcttgccttgcgattagcgcgtacac

SEQ ID NO: 358693 - DNA, 75 bp, Artificial Sequence
  Synthetic
agaagaacaccgcaccgtccgtgtcttggagatggtggaagactggctgcacagaggaccgaaggaattctgcat

SEQ ID NO: 358694 - DNA, 75 bp, Artificial Sequence
  Synthetic
ttggagatggtggaagactggctgcacagaggaccgaaggaattctgcattaaagtgctatgcccttacatgcct

SEQ ID NO: 358695 - DNA, 75 bp, Artificial Sequence
  Synthetic
ccttttcagttgggccttctggtcgtgttcttggccacccaggaggtccttcgcaagaggtggacggccaagatc

SEQ ID NO: 358696 - DNA, 75 bp, Artificial Sequence
  Synthetic
ccctcaccgttacggtaacagcggcaacactccttttctgccactatgcctacatggttcccggttggcaagctg

SEQ ID NO: 358697 - DNA, 75 bp, Artificial Sequence
  Synthetic
atgcttgcagctgctttctttcaaatggcttactatgacgccaagaatgttttgtcatgggaagtgcctgacgtt

SEQ ID NO: 358698 - DNA, 75 bp, Artificial Sequence
  Synthetic
cattggacccgatgacgttgaaaaactgggaaaaggaaaaggccctaaggtcagaacctggctgtttgagaatgg

SEQ ID NO: 358699 - DNA, 75 bp, Artificial Sequence
  Synthetic
gatcgctcaattctaccaaccagagcgcgagaaggtgtacaccatggatggggaataccgactcagaggagaaga

SEQ ID NO: 358700 - DNA, 75 bp, Artificial Sequence
  Synthetic
aataataaagctgtgttgagtagttgtatagttgtagtgtttatagcaacttgaatcatgattaatcatttaggc

SEQ ID NO: 358701 - DNA, 75 bp, Artificial Sequence
  Synthetic
gtacaagaagggtgataccaccactggcgtttacagaatcatgactcgaggtctgcttggcagttaccaagctgg

SEQ ID NO: 358702 - DNA, 75 bp, Artificial Sequence
  Synthetic
gttctcgaaggcgacagctgcgtgactatcatgtccaaggacaagcctaccatcgatgtgaagatgatgaatatg

SEQ ID NO: 358703 - DNA, 75 bp, Artificial Sequence
  Synthetic
caattgccctgatcgccttattgagtgtgatgaccatgggagtgttcttcctccttatgcagcgaaagggcattg

SEQ ID NO: 358704 - DNA, 75 bp, Artificial Sequence
  Synthetic
ctatcatgtccaaggacaagcctaccatcgatgtgaagatgatgaatatggaggcggccaacctggcagaggtcc

SEQ ID NO: 358705 - DNA, 75 bp, Artificial Sequence
  Synthetic
gcccggagtgtttaagacaccagaaggagaaattggggcagttacgctagactatcccactggaacgtcaggttc

SEQ ID NO: 358706 - DNA, 75 bp, Artificial Sequence
  Synthetic
tgggagagtttctcctggacttgagaccggcaacagcctggtcactgtacgctgtgaccacagcggttctcactc

SEQ ID NO: 358707 - DNA, 75 bp, Artificial Sequence
  Synthetic
accggcaacagcctggtcactgtacgctgtgaccacagcggttctcactccactgctaaagcatctgattacgtc

SEQ ID NO: 358708 - DNA, 75 bp, Artificial Sequence
  Synthetic
gattttcatgacggcaacgccacccgggacttctgacccctttccagagtccaatgctcctatctcggacatgca

SEQ ID NO: 358709 - DNA, 75 bp, Artificial Sequence
  Synthetic
aacactggatatgaatggataactgagtatgttggaaagaccgtttggtttgttccaagtgtgaaaatgggaaat

SEQ ID NO: 358710 - DNA, 75 bp, Artificial Sequence
  Synthetic
agaaatgggagcaaacttcaaggcaagcagagtgatcgacagccgcaaaagcgtgaaacccaccatcattgagga

SEQ ID NO: 358711 - DNA, 75 bp, Artificial Sequence
  Synthetic
gacggggaatataggctcagaggggaagaacggaagaacttccttgaattcttgagaacagctgatttaccagtc

SEQ ID NO: 358712 - DNA, 75 bp, Artificial Sequence
  Synthetic
agttcgacgtggcaccacgatgagaaccacccatacagaacctggaactatcacggcagttatgatgtgaaaccc

SEQ ID NO: 358713 - DNA, 75 bp, Artificial Sequence
  Synthetic
cgcgaggcacatctgcggggggaatgctacacttgcatctacaatatgatgggaaagagagagaagaaacctgga

SEQ ID NO: 358714 - DNA, 75 bp, Artificial Sequence
  Synthetic
ttggcacccgacctggaggcaagatctatgctgatgacacagctggctgggacacccgcatcacgagagctgact

SEQ ID NO: 358715 - DNA, 75 bp, Artificial Sequence
  Synthetic
ggactgggtgaacaaagccgcgaagtgatccatgtaagccctcagaaccgtctcggaaggaggaccccacatgtt

SEQ ID NO: 358716 - DNA, 75 bp, Artificial Sequence
  Synthetic
aaccatttcactgaactgatcatgaaagatggaagaacactggtggctccgtgccgaggacaggacgaactggta

SEQ ID NO: 358717 - DNA, 75 bp, Artificial Sequence
  Synthetic
gaagagacttgcggctaatggccaacgccatttgctccgccgtccctgtgaattgggtccctactggaagaacca

SEQ ID NO: 358718 - DNA, 75 bp, Artificial Sequence
  Synthetic
aatgccactgacgtcacagatgtcatcacgattccaacagctgctggaaagaacctatgcattgtcagagcaatg

SEQ ID NO: 358719 - DNA, 75 bp, Artificial Sequence
  Synthetic
tggttgaggacacagtattgtaaacactttattaattgtaaatagacaatgtaagcatgtgtaaaagtatagctt

SEQ ID NO: 358720 - DNA, 75 bp, Artificial Sequence
  Synthetic
ttcacctatttctgacttgcagactgagatcccggaccgggcctggaactctgggtacgaatggattacagaata

SEQ ID NO: 358721 - DNA, 75 bp, Artificial Sequence
  Synthetic
tgtcttggagatggtggaagactggctgcacagaggacctaaggaattctgcatcaaagtgctatgcccttacat

SEQ ID NO: 358722 - DNA, 75 bp, Artificial Sequence
  Synthetic
aggaagatgtcaacttgggaagtggaacgcgggcagtagggaagcctctcctcaattctgatactagcaagatca

SEQ ID NO: 358723 - DNA, 75 bp, Artificial Sequence
  Synthetic
tgtgaactgggtccctaccggaagaaccacgtggtccatccatgcaggaggagagtggatgacaacagaggacat

SEQ ID NO: 358724 - DNA, 75 bp, Artificial Sequence
  Synthetic
aaaactgggaaaaggaaaaggccctaaggtcagaacctggctgtttgagaatggcgaggagcgtctcagtcgcat

SEQ ID NO: 358725 - DNA, 75 bp, Artificial Sequence
  Synthetic
ctgttcaaaccatttcacggaactgatcatgaaggacggcaggacgttggtggtcccgtgtcgtggacaagacga

SEQ ID NO: 358726 - DNA, 75 bp, Artificial Sequence
  Synthetic
atcatgaaggacggcaggacgttggtggtcccgtgtcgtggacaagacgagttgattggacgggccagaatctct

SEQ ID NO: 358727 - DNA, 75 bp, Artificial Sequence
  Synthetic
ccaggggctggatggaatgtgcgcgacaccgcctgcctggcgaagtcatacgcgcagatgtggctgttgctttat

SEQ ID NO: 358728 - DNA, 75 bp, Artificial Sequence
  Synthetic
gcctgtcaactgggttcccacagggcgtaccacctggtcgatccacgcaaaaggagaatggatgacgacagaaga

SEQ ID NO: 358729 - DNA, 75 bp, Artificial Sequence
  Synthetic
ttgggctgaaaatatccatgtggcaatcaatcaggtccgttcggtgattggagaagagaagtatgtggattacat

SEQ ID NO: 358730 - DNA, 75 bp, Artificial Sequence
  Synthetic
acttagtagtgtttgtgaggattaataacaattaacacagtgcgagctgtttcttagcacgaagatctcgatgtc

SEQ ID NO: 358731 - DNA, 75 bp, Artificial Sequence
  Synthetic
taacaattaacacagtgcgagctgtttcttagcacgaagatctcgatgtctaagaaaccaggagggcccggcaag

SEQ ID NO: 358732 - DNA, 75 bp, Artificial Sequence
  Synthetic
tctacaggatcatgactcgtgggctgctcggcagttatcaagcaggagcgggcgtgatggttgaaggcgttttcc

SEQ ID NO: 358733 - DNA, 75 bp, Artificial Sequence
  Synthetic
tgccaaaaacaccaaaagaaacagcatattgacacctgggatagactaggggatcttctgctctgcacaaccagc

SEQ ID NO: 358734 - DNA, 75 bp, Artificial Sequence
  Synthetic
gacgtgattaccattccaacagctgccgggaaaaacctgtgcatcgtgagggctatggacgtaggatacctttgt

SEQ ID NO: 358735 - DNA, 75 bp, Artificial Sequence
  Synthetic
ggctatggacgtaggatacctttgtgaggatactatcacttatgaatgtccggtcctagctgctggaaatgaccc

SEQ ID NO: 358736 - DNA, 75 bp, Artificial Sequence
  Synthetic
cgagctgggggaggcggcggcaatattcatgacagccaccccaccaggcacctcagatccattcccagagtccaa

SEQ ID NO: 358737 - DNA, 75 bp, Artificial Sequence
  Synthetic
acaccccgggggccttcccgttttttagcatattgcccccccggctctggcgggcccctcctggtttcttagaca

SEQ ID NO: 358738 - DNA, 75 bp, Artificial Sequence
  Synthetic
cttgggagtcgcgaccttcttctgttggatggctgaagttccaggaacgaagatcgccggaatgttgctgctttc

SEQ ID NO: 358739 - DNA, 75 bp, Artificial Sequence
  Synthetic
gcagctgaagggaacaacatacggagtatgttcaaaagcgttcaaattcgctgggactcctgctgacactggcca

SEQ ID NO: 358740 - DNA, 75 bp, Artificial Sequence
  Synthetic
gtatgttcaaaagcgttcaaattcgctgggactcctgctgacactggccatggaacggtggtgttggaactgcag

SEQ ID NO: 358741 - DNA, 75 bp, Artificial Sequence
  Synthetic
ggatcagttggaggggtattcacctcggtggggaaagctatacaccaagtctttggaggagcttttagatcactt

SEQ ID NO: 358742 - DNA, 75 bp, Artificial Sequence
  Synthetic
ctttggaggagcttttagatcactttttggagggatgtcctggatcacacagggacttctgggagctcttctgtt

SEQ ID NO: 358743 - DNA, 75 bp, Artificial Sequence
  Synthetic
agggacttctgggagctcttctgttgtggatgggaatcaatgcccgtgacaggtcaattgctatgacgttccttg

SEQ ID NO: 358744 - DNA, 75 bp, Artificial Sequence
  Synthetic
aggtcaattgctatgacgttccttgcggttggaggagttttgctcttcctttcggtcaacgtccacgctgacaca

SEQ ID NO: 358745 - DNA, 75 bp, Artificial Sequence
  Synthetic
tcaggaccgggaagttcccgccaccggaagttgagtagacggtgctgcctgcgactcaacccaggaggactgggt

SEQ ID NO: 358746 - DNA, 75 bp, Artificial Sequence
  Synthetic
ggaagttgagtagacggtgctgcctgcgactcaacccaggaggactgggtgaacaaagctgcgaagtgatccatg

SEQ ID NO: 358747 - DNA, 75 bp, Artificial Sequence
  Synthetic
aagagctccggtgcggaagtggagtattcatccataacgatgtggaagcctggatggatcgttacaagttctacc

SEQ ID NO: 358748 - DNA, 75 bp, Artificial Sequence
  Synthetic
agtgtttgtgaggatttacgaggattaatacagtacgagctgttttttagcaagaagatttcaatgtctaagaaa

SEQ ID NO: 358749 - DNA, 75 bp, Artificial Sequence
  Synthetic
agtgaacatgactagccaggtgcttctgggaagaatggagaagaggacctggaagggaccccaatacgaggaaga

SEQ ID NO: 358750 - DNA, 75 bp, Artificial Sequence
  Synthetic
tggagatgggttggaaggcttggggcaagagtatcatctttgctccagagctagctaacaacacctttgtcattg

SEQ ID NO: 358751 - DNA, 75 bp, Artificial Sequence
  Synthetic
gcatagtgatctgtcatactggatagagagcgggctcaacgacacctggaagcttgagagggcggtcctgggaga

SEQ ID NO: 358752 - DNA, 75 bp, Artificial Sequence
  Synthetic
aagccgcgaagtgatccatgtaagccctcagaaccgtctcggaagtgatccatgtaagccctcagaaccgtctcg

SEQ ID NO: 358753 - DNA, 75 bp, Artificial Sequence
  Synthetic
gagagtgggaagctcatcacagactggtgctgcagaagttgcaccctccctccactgcgcttccagactgagaat

SEQ ID NO: 358754 - DNA, 75 bp, Artificial Sequence
  Synthetic
cagaaccgtctcggaaggaggaccctacatgtaagccctcagaaccgtactcggaaggaggacccccacatgttg

SEQ ID NO: 358755 - DNA, 75 bp, Artificial Sequence
  Synthetic
tacatgtaagccctcagaaccgtactcggaaggaggacccccacatgttgtgatcccatcgtaagcccctcacga

SEQ ID NO: 358756 - DNA, 75 bp, Artificial Sequence
  Synthetic
atcgttgtgatcccatgtaagcccctcacgaaccgtctcggaaggaggaccccacatgtaagcccctcagaaccg

SEQ ID NO: 358757 - DNA, 75 bp, Artificial Sequence
  Synthetic
cacttggcacttatggctacattcaagattcaaccagtctttctggtggcttcttttttgaaggcaaggtggacc

SEQ ID NO: 358758 - DNA, 75 bp, Artificial Sequence
  Synthetic
aaccaagagagtattttgctcatgcttgcagccgctttcttccaaatggcttactatgacgccaagaatgttttg

SEQ ID NO: 358759 - DNA, 75 bp, Artificial Sequence
  Synthetic
ccccactggaacatcaggctcaccaatagtggacaaaaacggtgatgtgatcgggctttatggcaatggagtcat

SEQ ID NO: 358760 - DNA, 75 bp, Artificial Sequence
  Synthetic
actgatgaatgaccccggggcgccatggaaaatttggatgcttaggatggcctgcctggcaataagtgcctacac

SEQ ID NO: 358761 - DNA, 75 bp, Artificial Sequence
  Synthetic
cgcacggaggatcctaggcgttttggacttgcgcaactaattgaccttgtctgattgccccacaatggggcaact

SEQ ID NO: 358762 - DNA, 75 bp, Artificial Sequence
  Synthetic
gatctccttcattggggagatcccatcaattatccatgaagcactaaatattgcattgatagcagtcagcatcat

SEQ ID NO: 358763 - DNA, 75 bp, Artificial Sequence
  Synthetic
atcgctgctgaaaggtattgtcaacatctggaaaagtggtattctacaactcttcgtcttcttagcactggctgg

SEQ ID NO: 358764 - DNA, 75 bp, Artificial Sequence
  Synthetic
aagatcctgttcctacacaataggtcatcacattgagctccaacacttcaccttgaacgcatcctacatcatgcc

SEQ ID NO: 358765 - DNA, 75 bp, Artificial Sequence
  Synthetic
ttatgtgccaatggcatgcatgattaatgacacacactttctgctaaaaggaccatttgaagctgagtgggtgct

SEQ ID NO: 358766 - DNA, 75 bp, Artificial Sequence
  Synthetic
agaacttgagatcacttccatcacagttgttgtggaaacagagggtgggacatccaagagagccacaattcagaa

SEQ ID NO: 358767 - DNA, 75 bp, Artificial Sequence
  Synthetic
catcagtgagtgtgtagcaggttaccagaacaaggaaatggtgggcttcactcttacatggtttctaaatggctt

SEQ ID NO: 358768 - DNA, 75 bp, Artificial Sequence
  Synthetic
agggtacaatcaccagtttaacccacagacattatgtcaaaacaagagtaagaccgatgaagactacatccaatt

SEQ ID NO: 358769 - DNA, 75 bp, Artificial Sequence
  Synthetic
gaatataaccaatagaaatcactgtgatcaagtcttcctaagaatgaggaagatctttggaactttcaaagatcc

SEQ ID NO: 358770 - DNA, 75 bp, Artificial Sequence
  Synthetic
ctgtgtgactgatgggaaactaaacatactgttcaagatgaagaactggactaatcaatgctcaagagaccatct

SEQ ID NO: 358771 - DNA, 75 bp, Artificial Sequence
  Synthetic
aagcaccatgcatcttgtaattcagaatgcttacagtcaagcaattagagcaaggaaactacaaaacttttttac

SEQ ID NO: 358772 - DNA, 75 bp, Artificial Sequence
  Synthetic
ttggtcactatctgatgctacagggaatgaattgccaggtggttattgtctagagaggtggatgcttatctcaag

SEQ ID NO: 358773 - DNA, 75 bp, Artificial Sequence
  Synthetic
tgaactcaagtgctttgggaacactgctgtggccaaatgtaatttggaacataattcagagttctgtgatatgct

SEQ ID NO: 358774 - DNA, 75 bp, Artificial Sequence
  Synthetic
cagactttttgaatataataaaaatgcagttaagacacttcaaaatgagagtaaacatcaattagacatgatcat

SEQ ID NO: 358775 - DNA, 75 bp, Artificial Sequence
  Synthetic
aactgctgtaaattctttaatctctgataacatactcatgaaaaatagaattcatgagctgatcaacattcctta

SEQ ID NO: 358776 - DNA, 75 bp, Artificial Sequence
  Synthetic
ctgcaactacactaaattctggtacatcaaccacactggttttaatgttcattcattaccaaaatgttggcttac

SEQ ID NO: 358777 - DNA, 75 bp, Artificial Sequence
  Synthetic
aaaaaatggcagttatttgaacatatctgattttagaaatgattggctcttggagagtgatcatctaatctctca

SEQ ID NO: 358778 - DNA, 75 bp, Artificial Sequence
  Synthetic
aatcttaagtagagaatatgaggaaaggcaaagtaaaacaccattaggtttagtagatttgtgtttttggtgtac

SEQ ID NO: 358779 - DNA, 75 bp, Artificial Sequence
  Synthetic
attgttctatgtttcaacaattttcctgcatcttttaagaattcccacccacagacacattgttggtgagggctg

SEQ ID NO: 358780 - DNA, 75 bp, Artificial Sequence
  Synthetic
tccaaaaccacataggctgactagcaattcattgtgtgcgtgtggtctttttaaacagaaaggaaggcccttaag

SEQ ID NO: 358781 - DNA, 75 bp, Artificial Sequence
  Synthetic
gtgggtcagaaaagtgtaagccaccagccccagtggcctccattgctgcacccccttcggggtgcagcaatggag

SEQ ID NO: 358782 - DNA, 75 bp, Artificial Sequence
  Synthetic
gccctctgcgaacttagaggacgactgttgtttcgggctctctaaagagcaggtcaatggggagcatcctcatgg

SEQ ID NO: 358783 - DNA, 75 bp, Artificial Sequence
  Synthetic
gtttctcattggatactgatccggatatgactgcactaaacattatgcaatcaaggagtgcacaatgtgcattag

SEQ ID NO: 358784 - DNA, 75 bp, Artificial Sequence
  Synthetic
ttgttgctggtgttgaccctttcttcttacttttgatcactatacccttgtgcttatcacagagatgctcaaacc

SEQ ID NO: 358785 - DNA, 75 bp, Artificial Sequence
  Synthetic
ttttccacacaaggtcttcaaagattcgtgactcctcagcactcagtttgacatcgacaattttaagatcctgtc

SEQ ID NO: 358786 - DNA, 75 bp, Artificial Sequence
  Synthetic
ttccatgcatgtcaaaaagctttcttatatcatctgcaccttgtgcagtgaaaaccattgatttaggtagactcc

SEQ ID NO: 358787 - DNA, 75 bp, Artificial Sequence
  Synthetic
taattattgatgaaatgagacctggccgtgcatactcaacatcttttagtaatattccgtgacaatacttactct

SEQ ID NO: 358788 - DNA, 75 bp, Artificial Sequence
  Synthetic
gatccttaaaagactttatgtcatttggtcttctataacaatggatgtacctctgtgactctggttgataaatgg

SEQ ID NO: 358789 - DNA, 75 bp, Artificial Sequence
  Synthetic
caaactcaacagggtcatttggtggaccttcgatgtcaatccatgttgtgtcgctaacaagcagggattccacac

SEQ ID NO: 358790 - DNA, 75 bp, Artificial Sequence
  Synthetic
tcttctttacctgactttcaatttcaggtttgagtgttgttagagaaggggcccctccatttcttattggcattg

SEQ ID NO: 358791 - DNA, 75 bp, Artificial Sequence
  Synthetic
ctggtcttgttggaacactctcaaactcaacaactgtattatcccatgccctacccttgatctgtgatcgtgaag

SEQ ID NO: 358792 - DNA, 75 bp, Artificial Sequence
  Synthetic
caatgtaaggccagccctcaccagaaagacataatttataaagtacattctcataagggtttctctgtccagggg

SEQ ID NO: 358793 - DNA, 75 bp, Artificial Sequence
  Synthetic
tgggactcacaaacattttctccttgtttttgatctctaaaagagttttcatgatagttgtgaatgaggattctt

SEQ ID NO: 358794 - DNA, 75 bp, Artificial Sequence
  Synthetic
ctacctttattgtctctagcatgtttccaccatcaatgagacaggctccagctttgacagcagccgatagactaa

SEQ ID NO: 358795 - DNA, 75 bp, Artificial Sequence
  Synthetic
ggttgtaaccagaaatgttgatttgtgaatcttcttgagtgatcattttgagagagggatgtttctctgtcagag

SEQ ID NO: 358796 - DNA, 75 bp, Artificial Sequence
  Synthetic
ccttgagatcagctagatttggatatttcgctgtgtatagaagccctaaatcagttaggccctgtacaacatcat

SEQ ID NO: 358797 - DNA, 75 bp, Artificial Sequence
  Synthetic
tgagagattcacctccttgctctgccatacaagatattgttatagcaggcactgagccaaattggttaattagga

SEQ ID NO: 358798 - DNA, 75 bp, Artificial Sequence
  Synthetic
gtgatgggtcttttatgtcccatatcttcaccacccctccagctgacattgaattggttctttgaatgccaacaa

SEQ ID NO: 358799 - DNA, 75 bp, Artificial Sequence
  Synthetic
gctgtaaaatctcagacctccttgtcagttgtgtggtagagaggttgccttgatactgccctgttgtgttgtttg

SEQ ID NO: 358800 - DNA, 75 bp, Artificial Sequence
  Synthetic
ttctctcagtcctctggaccttctgtctaagtttctctaggtcacttgagagttccatcaactcatctttagata

SEQ ID NO: 358801 - DNA, 75 bp, Artificial Sequence
  Synthetic
atgagcccactttcaagaacatgtttttttggcttgacttcatggtcatcagtgagtcaacctctttgttcaggt

SEQ ID NO: 358802 - DNA, 75 bp, Artificial Sequence
  Synthetic
ctcttagacctattaaatcgttgtcatcccttttcaccctcctcatcatcctttgaacacttgcaaccttagcaa

SEQ ID NO: 358803 - DNA, 75 bp, Artificial Sequence
  Synthetic
agtccaacccggatagaagagcccttgtgtcggtaagcacatctgccttgacagcagttgtccaggcagaaagcc

SEQ ID NO: 358804 - DNA, 75 bp, Artificial Sequence
  Synthetic
cccgtcttaaacactgagtccagcgaaaggatggaacagcttgatcactcattgtcaaagttttgcgcagatctc

SEQ ID NO: 358805 - DNA, 75 bp, Artificial Sequence
  Synthetic
aaggatggaacagcttgatcactcattgtcaaagttttgcgcagatctcctatatgcctaggatccctccgtgcg

SEQ ID NO: 358806 - DNA, 75 bp, Artificial Sequence
  Synthetic
gttttacacttgcgcacaaaactgactacctacaaactacccacctgctgacccagaccatggggcagttggtat

SEQ ID NO: 358807 - DNA, 75 bp, Artificial Sequence
  Synthetic
cattctttggagaaattccctccataatacatgaagccttgaatgttgcgttgatggcagtcagcatcatagcag

SEQ ID NO: 358808 - DNA, 75 bp, Artificial Sequence
  Synthetic
tagtaaaaggtctcatcaatctttggaagagtggcattctgcagctggtggtcttcctgcttctagctggaaggt

SEQ ID NO: 358809 - DNA, 75 bp, Artificial Sequence
  Synthetic
gaagagtggcattctgcagctggtggtcttcctgcttctagctggaaggtcctgctctgtccccataggtcatca

SEQ ID NO: 358810 - DNA, 75 bp, Artificial Sequence
  Synthetic
catagaactagagcacatcaccataaatgcatcctctgtgattccatttgtgccatcaacttgctcagtaaatca

SEQ ID NO: 358811 - DNA, 75 bp, Artificial Sequence
  Synthetic
cacacactttttaatcaggggtccatttgaggcaaagtgggggatcagtctagagatcaccgacattgcatctct

SEQ ID NO: 358812 - DNA, 75 bp, Artificial Sequence
  Synthetic
ggtcgacactgaaggtggacgacaagcatccatagtgcccagcaatgtcagtctctgttttgagggaaatggaga

SEQ ID NO: 358813 - DNA, 75 bp, Artificial Sequence
  Synthetic
caaaaaattggtggtattcacactaaattggttcctgaacggtctagcgtatgataaaaaaaccgatccaaaaat

SEQ ID NO: 358814 - DNA, 75 bp, Artificial Sequence
  Synthetic
cctttgtgagaataacactgttgacaaagtctcaaggatgcagatcaacataactaatgaggattactgcaataa

SEQ ID NO: 358815 - DNA, 75 bp, Artificial Sequence
  Synthetic
ggtgtactttaaaatgagaaagatttttggttcattcgtggacccctgtttgaatggtcaaaagaaatacatttt

SEQ ID NO: 358816 - DNA, 75 bp, Artificial Sequence
  Synthetic
atttaaaaacattagttggattaatggatgtgatggaaatcacttgagcactttacatttaatccttcaaaatgc

SEQ ID NO: 358817 - DNA, 75 bp, Artificial Sequence
  Synthetic
atatgggcagactgctgggatcagaaaattacaggcctttttcagttggacattgtctgacaatgttgggactga

SEQ ID NO: 358818 - DNA, 75 bp, Artificial Sequence
  Synthetic
tgtgccaggaggttactgcctggaaaggtggatgttgatttcaagtgaactgaaatgttttgggaacactgcagt

SEQ ID NO: 358819 - DNA, 75 bp, Artificial Sequence
  Synthetic
aggtggatgttgatttcaagtgaactgaaatgttttgggaacactgcagtggccaaatgtaatttgaaccatgat

SEQ ID NO: 358820 - DNA, 75 bp, Artificial Sequence
  Synthetic
tcagaattctgtgacatgcttagactctttgattttaacagaagggcaatcagtgtacttcaaaataagactaaa

SEQ ID NO: 358821 - DNA, 75 bp, Artificial Sequence
  Synthetic
catcaattggacataatgacaactgctgtgaacaatttgatctcagacaatatcttgatgaaaaacagggtgaag

SEQ ID NO: 358822 - DNA, 75 bp, Artificial Sequence
  Synthetic
gaattactcgatatcccatattgcaactatacgagattctggtatgtgaatcacacaggtctaaatgtgcattcc

SEQ ID NO: 358823 - DNA, 75 bp, Artificial Sequence
  Synthetic
tcacacaggtctaaatgtgcattcccttccaaaatgttggctgacaaaaaatggtagctttctaaatatatccga

SEQ ID NO: 358824 - DNA, 75 bp, Artificial Sequence
  Synthetic
atttagaaatgaatggcttttagaaagtgaccaccttatatctgagatcttgagtagagaatatgaagagaggca

SEQ ID NO: 358825 - DNA, 75 bp, Artificial Sequence
  Synthetic
aaaacatacaccattgagcctggtagatatttgtttctggagcactctgttctacacagcgtctatatttttgca

SEQ ID NO: 358826 - DNA, 75 bp, Artificial Sequence
  Synthetic
cctgttgaggattcccacccacagacacattatcggtgaagcctgcccaaaaccccatagacttactagtgactc

SEQ ID NO: 358827 - DNA, 75 bp, Artificial Sequence
  Synthetic
attatgtgcatgcggcctcttcaggcaaaaaggaaggccccttaagtgggtgaggaggacatgagattgatggtt

SEQ ID NO: 358828 - DNA, 75 bp, Artificial Sequence
  Synthetic
caccgcctccattgctgcacccccttttggggggtgcagcaatggaggcccttgtctgtctaaaggacaactgtt

SEQ ID NO: 358829 - DNA, 75 bp, Artificial Sequence
  Synthetic
gtttcgggttctctgaataacacatcaatgggcaatgccctcctgggtttgtcattggtaactgatccagataga

SEQ ID NO: 358830 - DNA, 75 bp, Artificial Sequence
  Synthetic
acagcgctgaacatcaggcagtcaagaagcgcgcaatgtgggtttgttgtggcaggtgttgatccctttttcttg

SEQ ID NO: 358831 - DNA, 75 bp, Artificial Sequence
  Synthetic
cttttgatgactattcctttgtgtctgtcacagagatgctcaaacctcttccaaacaagttcctcaaaaagtctc

SEQ ID NO: 358832 - DNA, 75 bp, Artificial Sequence
  Synthetic
tgtcacagagatgctcaaacctcttccaaacaagttcctcaaaaagtctcgattgttctgcgctcaacttcacat

SEQ ID NO: 358833 - DNA, 75 bp, Artificial Sequence
  Synthetic
gattgttctgcgctcaacttcacatccacgattttgaggtcttgtctcccatgcatgtcaaagagctttctgata

SEQ ID NO: 358834 - DNA, 75 bp, Artificial Sequence
  Synthetic
tcatctgcaccttgtgcagtgaaaaccatcgatttagggagatttctaattatggatgtgattagacctggtctc

SEQ ID NO: 358835 - DNA, 75 bp, Artificial Sequence
  Synthetic
ccatcgatttagggagatttctaattatggatgtgattagacctggtctcgcatattcaacatctttcaaaagta

SEQ ID NO: 358836 - DNA, 75 bp, Artificial Sequence
  Synthetic
tcccatgacaatatttgctttgatccttgaaagacttgatgtcgttgggcttcctataacagtgtaagtacctct

SEQ ID NO: 358837 - DNA, 75 bp, Artificial Sequence
  Synthetic
gcgattctggctgatagatagcaaactcaacaggatcgtgtggcggcccctctatgtcaatccaagttgtgtcag

SEQ ID NO: 358838 - DNA, 75 bp, Artificial Sequence
  Synthetic
aggtgatcaaggtctccacacttcttttcacttgattttcgatttcaggctttagagtggatagtgagggagccc

SEQ ID NO: 358839 - DNA, 75 bp, Artificial Sequence
  Synthetic
caccattccttattggggctggttccttgattggggcactgtcaaactctatcactgtgttgtcccatgctctgc

SEQ ID NO: 358840 - DNA, 75 bp, Artificial Sequence
  Synthetic
cctttatttgtgatctggatgcaatatagggccaaccttcaccagagaggcatagtttgtagagtacattttcat

SEQ ID NO: 358841 - DNA, 75 bp, Artificial Sequence
  Synthetic
agggattccttaaccctggtgtggggctcacaaacatcttctctctgctcttaatttctaatagggtcttgatga

SEQ ID NO: 358842 - DNA, 75 bp, Artificial Sequence
  Synthetic
ttaatttctaatagggtcttgatgatggtggtaaatgtagactcctcaactttcaatgtctcgagcatgttacca

SEQ ID NO: 358843 - DNA, 75 bp, Artificial Sequence
  Synthetic
ccatcaatcaggcatgccccggcttttatagcggcagaaaggctgagattgtatcctgagatattgatctgcgaa

SEQ ID NO: 358844 - DNA, 75 bp, Artificial Sequence
  Synthetic
atggatgtttttccataaggatctcaagatcacccaggttggggtatttggctgtgtacaaaagacccagatcag

SEQ ID NO: 358845 - DNA, 75 bp, Artificial Sequence
  Synthetic
taaggccttgaacaacatcattgagagtctctcctccttgttcagccatgcatgagatcgtcacagctggcattg

SEQ ID NO: 358846 - DNA, 75 bp, Artificial Sequence
  Synthetic
agtctctcctccttgttcagccatgcatgagatcgtcacagctggcattgaaccaaattggttgatcatgagtga

SEQ ID NO: 358847 - DNA, 75 bp, Artificial Sequence
  Synthetic
tgggtccttgacatcccaaactttcaccaccccaccagatcttgggaaacctggtctctgtaacccaacaagttg

SEQ ID NO: 358848 - DNA, 75 bp, Artificial Sequence
  Synthetic
accaccccaccagatcttgggaaacctggtctctgtaacccaacaagttgcaagagctcagatcttcttgtcagt

SEQ ID NO: 358849 - DNA, 75 bp, Artificial Sequence
  Synthetic
caagagctcagatcttcttgtcagttgtgttgtagacaggtttccttgatattgaccagtggagccagatgttct

SEQ ID NO: 358850 - DNA, 75 bp, Artificial Sequence
  Synthetic
ctcagttctctgtactttttgtcttaatttgtccaaatcactggagagttccatcaactcatctttggccaaaga

SEQ ID NO: 358851 - DNA, 75 bp, Artificial Sequence
  Synthetic
aatttgtccaaatcactggagagttccatcaactcatctttggccaaagagcccacttttaagtacatgttcttt

SEQ ID NO: 358852 - DNA, 75 bp, Artificial Sequence
  Synthetic
tgagatgatttcattgtcattagtgagtcaacttccttgttcaagtcccttagatttatgagatcactgtcatcc

SEQ ID NO: 358853 - DNA, 75 bp, Artificial Sequence
  Synthetic
tagatttatgagatcactgtcatcccttttggtccttctcatcatccgctggacacttgcaacctttgcaaaatc

SEQ ID NO: 358854 - DNA, 75 bp, Artificial Sequence
  Synthetic
cagccctgataagagagccctggtgtctgcaagcacatctgccttcacaccagtagtccagttggaaagccccct

SEQ ID NO: 358855 - DNA, 75 bp, Artificial Sequence
  Synthetic
cctgagggactgagtccaacgaaaggatggaattggttggtcattcatgtctctcaaaatgcgtagattcccaaa

SEQ ID NO: 358856 - DNA, 75 bp, Artificial Sequence
  Synthetic
cgcacggaggatcctaggctttttgactcgcgctgaaatttgaatctgcttttaaatcagactcagatccaactg

SEQ ID NO: 358857 - DNA, 75 bp, Artificial Sequence
  Synthetic
tatccaactaccacacaatgggacagctagtgtccttcttcgaggggatacccgctctcctccaggaggccctca

SEQ ID NO: 358858 - DNA, 75 bp, Artificial Sequence
  Synthetic
atgttgcattaattgcagtcagcatgattgcaattttgaagggtgtcatcaacatctggacaagtggtgttttac

SEQ ID NO: 358859 - DNA, 75 bp, Artificial Sequence
  Synthetic
agcttatcacatttttactgttggcagggaggtcatgttccattaaagtaggccatcacattgaactacaacacg

SEQ ID NO: 358860 - DNA, 75 bp, Artificial Sequence
  Synthetic
tcattgtgaatagttcctcagtcatcccttttgcaccaggtgcctgcaaagtcaacagcacttattttctgctaa

SEQ ID NO: 358861 - DNA, 75 bp, Artificial Sequence
  Synthetic
ggggtccgtttgatgcccaatgggcacttggcttggacatcaccgagatctcggttcttgtagatgttgaggctg

SEQ ID NO: 358862 - DNA, 75 bp, Artificial Sequence
  Synthetic
gaacctcgcgggtgatcggtgctaagaacatcagcaactgtttccagggaaatagaaattcaaaccaggttcatt

SEQ ID NO: 358863 - DNA, 75 bp, Artificial Sequence
  Synthetic
tcacagttaaatggctactggatgggctgggacatgatttcttgcatgatccgaagatcttatgtgacaatgtga

SEQ ID NO: 358864 - DNA, 75 bp, Artificial Sequence
  Synthetic
cccagcaacaagtgttcagaattcagatcaacatgactgaagatgactattgtcataaaatcttcctgaagttaa

SEQ ID NO: 358865 - DNA, 75 bp, Artificial Sequence
  Synthetic
ccaagatttttggcctgtttgatgacccctgcccaaaacctgggaaggtgtacatcttgatcaaaaatgtcagtt

SEQ ID NO: 358866 - DNA, 75 bp, Artificial Sequence
  Synthetic
gggcaggtcaatgccagactagccacttaagcactatgcatcttattctccagaatatccataaccaagtgataa

SEQ ID NO: 358867 - DNA, 75 bp, Artificial Sequence
  Synthetic
gggctaggaaacttcatgctttttttacgtggtcattaactgactctgaaggagttgacatgccaggtggttact

SEQ ID NO: 358868 - DNA, 75 bp, Artificial Sequence
  Synthetic
gtttagagaagtggatgttgatctcatctgagctgaagtgctttggaaacacagcagtggcaaagtgtaatctca

SEQ ID NO: 358869 - DNA, 75 bp, Artificial Sequence
  Synthetic
accatgactcagagttctgtgacatgcttagactttttgagttcaataagaatgcagttaaaacactccagaata

SEQ ID NO: 358870 - DNA, 75 bp, Artificial Sequence
  Synthetic
aaactaagcatcaaatagataccattattactgctgtcaactccctaatatcggacaacattctgatgaaaaata

SEQ ID NO: 358871 - DNA, 75 bp, Artificial Sequence
  Synthetic
ggataaaggaattaattgacataccttactgcaattacaccaagttttggtatgtcaaccacaccagctttaatg

SEQ ID NO: 358872 - DNA, 75 bp, Artificial Sequence
  Synthetic
tgcattctctcccaagatgctggcttataaagaatggcagctatttaaatgtttctgatttcaggaatgaatggc

SEQ ID NO: 358873 - DNA, 75 bp, Artificial Sequence
  Synthetic
tgttagagagtgatcatttaatctctgagatcttgagcaaggagtatgaagaaaggcagaatcgcacaccattgg

SEQ ID NO: 358874 - DNA, 75 bp, Artificial Sequence
  Synthetic
gattggtggacatttgtttttggagcacactattttacactgcctcaatattcttgcatttgttggggattccca

SEQ ID NO: 358875 - DNA, 75 bp, Artificial Sequence
  Synthetic
cacacagacacataattggagatgggtgcccaaagccacatagattgacgagtgcttcaacatgctcatgtggtc

SEQ ID NO: 358876 - DNA, 75 bp, Artificial Sequence
  Synthetic
tcttcaaacagaagggtagacccctgaagtgggtgagaaagacatagacccattgaacatcggttgcctccattg

SEQ ID NO: 358877 - DNA, 75 bp, Artificial Sequence
  Synthetic
ctgcaccccctttggggggtgcagcaatggaggccctcgcggctctagaggacaacagttgtgtcgggctctcta

SEQ ID NO: 358878 - DNA, 75 bp, Artificial Sequence
  Synthetic
aagaggatatctattggcagaatccttctgggtttctcattggtgactgatcctgaaagaacagcactgaacatc

SEQ ID NO: 358879 - DNA, 75 bp, Artificial Sequence
  Synthetic
aaacaatcaagaagtgcacagtgtgcgtttgttgttgcaggcgctgatcctttctttttacttttgattactata

SEQ ID NO: 358880 - DNA, 75 bp, Artificial Sequence
  Synthetic
cctttgtgcttgtcacagagatgttcaaacctcttccacactagatcctcaaaaatacgtgattgttctgcactc

SEQ ID NO: 358881 - DNA, 75 bp, Artificial Sequence
  Synthetic
agcttcacatccacaatcttcaagtcttgtctcccatgcatatcaaaaagtttccttatgtcatctgcaccctgt

SEQ ID NO: 358882 - DNA, 75 bp, Artificial Sequence
  Synthetic
gcggtaaagaccatggacttgggtaaattcttaattatacaggaaatcaaacctggccgtgcatattcaacatct

SEQ ID NO: 358883 - DNA, 75 bp, Artificial Sequence
  Synthetic
tttaagagtataccgtgacagtatttgctctgatctttaaaggacttgatgtcgttaggcttcctatagcaatgg

SEQ ID NO: 358884 - DNA, 75 bp, Artificial Sequence
  Synthetic
atgtacatttgtgactctggctggtaaattgcgaattcaaccgggtcatttgatggcccctcaatgtcgatccat

SEQ ID NO: 358885 - DNA, 75 bp, Artificial Sequence
  Synthetic
gttgtgtcattgacatgaagagactctacactcttcttcacttgcgactctacctcaggcttaattgtggtcaat

SEQ ID NO: 358886 - DNA, 75 bp, Artificial Sequence
  Synthetic
aaaggtgcaccaccattccttattggtatggttcctttagctggaatgttatcaaactccactactgtgttgtcc

SEQ ID NO: 358887 - DNA, 75 bp, Artificial Sequence
  Synthetic
caggctctgcctttgatttgtgatcgtgatgcaatgtagggccaaccttctccagaaagacatagtttgtaaagt

SEQ ID NO: 358888 - DNA, 75 bp, Artificial Sequence
  Synthetic
atgttctcataaggattcctctgccctggtgtaggactaatgaacattctctctctggcctttatctccaaaaga

SEQ ID NO: 358889 - DNA, 75 bp, Artificial Sequence
  Synthetic
gttttgatgatagtcgagaaggtagagtcttcaaccttgattgtttcaagcatgtttcccccatcaaccaggcag

SEQ ID NO: 358890 - DNA, 75 bp, Artificial Sequence
  Synthetic
gcccctgccttcacagcagctgaaagactaagattgtaacctgaaatgttaatctgggattcttcctgcgtgatt

SEQ ID NO: 358891 - DNA, 75 bp, Artificial Sequence
  Synthetic
accttcagagaaggatgtttttctgataaagcctcaagatcacttaagtttgggtatttggctgtatacaggagg

SEQ ID NO: 358892 - DNA, 75 bp, Artificial Sequence
  Synthetic
cccaggtcagtaagaccttgtaccacatcattcagaggctcacctccttgttcagtcatgcaagagattgtcact

SEQ ID NO: 358893 - DNA, 75 bp, Artificial Sequence
  Synthetic
gcagggattgaaccaaattggttgatcatgagtgatgagtctttcacgtcccacactctcacaaccccattagtc

SEQ ID NO: 358894 - DNA, 75 bp, Artificial Sequence
  Synthetic
ctcacgacgcctggtctttgcattccaacaagttgtagaatctcagttcttcttgttaactgtgtggtggacaag

SEQ ID NO: 358895 - DNA, 75 bp, Artificial Sequence
  Synthetic
ttgccctggtattgtcctgcagaagtggaggctctctctgtcctctgaactttctgtcttaatttgtccaagtcg

SEQ ID NO: 358896 - DNA, 75 bp, Artificial Sequence
  Synthetic
ctggagagctccatgagttcctccttagataaagaaccgacctttagaaacatattcttttgggaggatctcatg

SEQ ID NO: 358897 - DNA, 75 bp, Artificial Sequence
  Synthetic
gtcatcagagagtcaacttccttatttaggtctcttaggctgacaaggtcattgtcgtctctcttcacccttctc

SEQ ID NO: 358898 - DNA, 75 bp, Artificial Sequence
  Synthetic
atcatccgttgaacgcttgcaacctttgcaaagtcaagaccagacagcagagctcttgtatcggtgagaacatct

SEQ ID NO: 358899 - DNA, 75 bp, Artificial Sequence
  Synthetic
gctttgacggatgttgtccagttcgagaggccccttctcagagactgagtccagcgaaaggaggggacaggttgg

SEQ ID NO: 358900 - DNA, 75 bp, Artificial Sequence
  Synthetic
aaaggaggggacaggttggtcactcatggtgaacaattagcgcagaggtccggaatgcctaggatccaccgtgcg

SEQ ID NO: 358901 - DNA, 75 bp, Artificial Sequence
  Synthetic
aaaggaggggacaggttggtcactcatggtgaacaattagcgcagaggtccggaatgcctaggatcctccgtgcg

SEQ ID NO: 358902 - DNA, 75 bp, Artificial Sequence
  Synthetic
aaaggaggggacaggttggtcactcatggtgaacaattagcgcagaggtccggaatgcctaggatcccccgtgcg

SEQ ID NO: 358903 - DNA, 75 bp, Artificial Sequence
  Synthetic
aaaggaggggacaggttggtcactcatggtgaacaattagcgcagaggtccggaatgcctaggatccgccgtgcg

SEQ ID NO: 358904 - DNA, 75 bp, Artificial Sequence
  Synthetic
cgcacagaggatcctaggcgtcttttctcgcgctgctaattgacatcgtttaattgccccacaatggggcaattg

SEQ ID NO: 358905 - DNA, 75 bp, Artificial Sequence
  Synthetic
cgcactgaggatcctaggcgtcttttctcgcgctgctaattgacatcgtttaattgccccacaatggggcaattg

SEQ ID NO: 358906 - DNA, 75 bp, Artificial Sequence
  Synthetic
cgcaccgaggatcctaggcgtcttttctcgcgctgctaattgacatcgtttaattgccccacaatggggcaattg

SEQ ID NO: 358907 - DNA, 75 bp, Artificial Sequence
  Synthetic
cgcacggaggatcctaggcgtcttttctcgcgctgctaattgacatcgtttaattgccccacaatggggcaattg

SEQ ID NO: 358908 - DNA, 75 bp, Artificial Sequence
  Synthetic
ttctcctttattggggagatcccctcaatagtacatgaggctttaaacgttgcattgatagcagttagcatcata

SEQ ID NO: 358909 - DNA, 75 bp, Artificial Sequence
  Synthetic
tcagtactaaaaggcattattaatatttggaaaagtgggcttctacaattcattgccttcttactacttgctgga

SEQ ID NO: 358910 - DNA, 75 bp, Artificial Sequence
  Synthetic
agatcttgttcttatagaataggccatcatgttgaactgcagcacataacattgaatggatcctacatcacacct

SEQ ID NO: 358911 - DNA, 75 bp, Artificial Sequence
  Synthetic
tatgttcctctggcatgtatggtcaatcagagtcattttcttctgagaggcccatttgaagccaagtgggcaatc

SEQ ID NO: 358912 - DNA, 75 bp, Artificial Sequence
  Synthetic
cagctagaaatcacagacatcacgactcttgtagagacagaggggggaagctcatctagagtcagacttaagaat

SEQ ID NO: 358913 - DNA, 75 bp, Artificial Sequence
  Synthetic
gctggtgattgtctaacagaccgtctggacagagaagagaaagtctacactctaagatggtttctaagcgggctg

SEQ ID NO: 358914 - DNA, 75 bp, Artificial Sequence
  Synthetic
ggagatagtgaacaatttgatccacagattctgtgtaacaatggtacttcaacagctgggctgaatgtccaaata

SEQ ID NO: 358915 - DNA, 75 bp, Artificial Sequence
  Synthetic
aacatcacggagaaaggcaactgtgatcatgtcttcctaagaatgaggaagattttcggagcctttaagaatcct

SEQ ID NO: 358916 - DNA, 75 bp, Artificial Sequence
  Synthetic
tgtttgagtaaaggaaaactaaacatgttgttgacaatccataattggactgaccagtgccccagggaccatcta

SEQ ID NO: 358917 - DNA, 75 bp, Artificial Sequence
  Synthetic
agtactatgcatcttgtgattcaaaatgcttacaaacaagtgattaaagtaaggaaattactagccttcttcact

SEQ ID NO: 358918 - DNA, 75 bp, Artificial Sequence
  Synthetic
tggtcactatctgatgccgtcgggaatgatacaccaggaggctactgtcttgagaaatggatgcttatctcaagt

SEQ ID NO: 358919 - DNA, 75 bp, Artificial Sequence
  Synthetic
gagctaaagtgttttggaaatactgcaatagctaaatgtaatttagaccacaattcagaattctgtgatatgctt

SEQ ID NO: 358920 - DNA, 75 bp, Artificial Sequence
  Synthetic
aggttatttgaatttaataaaaatgctattaaattacttcaaaatgaaagcaagcatcaattggatacaattata

SEQ ID NO: 358921 - DNA, 75 bp, Artificial Sequence
  Synthetic
acagctgtaaaccatctgatctcagataatgtacttatgaagaatagaattcatgagttgattaacattccttat

SEQ ID NO: 358922 - DNA, 75 bp, Artificial Sequence
  Synthetic
tgcaactatactaaattctggtatgttaaccacactggcttcaatgtccactcattaccaaagtgctggctcaca

SEQ ID NO: 358923 - DNA, 75 bp, Artificial Sequence
  Synthetic
aagaatggcagttatttaaatatatctgactttagaaatgagtggatcttggagagtgaccacctgatctctgag

SEQ ID NO: 358924 - DNA, 75 bp, Artificial Sequence
  Synthetic
attttgagcaaggagtatgaggagagacaaagtaaaacgccactgagtttggtggacacatgcttttggagtaca

SEQ ID NO: 358925 - DNA, 75 bp, Artificial Sequence
  Synthetic
cttttttatgtttcaacaatttttttacatcttttgaagataccaacccacagacacatcattggagagggttgt

SEQ ID NO: 358926 - DNA, 75 bp, Artificial Sequence
  Synthetic
cccaaaccacacagattgaccaggagttcattatgtgcatgtggtctattcaaacaagaagggaggcctttgaga

SEQ ID NO: 358927 - DNA, 75 bp, Artificial Sequence
  Synthetic
tgggtcagggacacatagaatgaaggctcacagccccagtggcctccatcgctgcaccccctatgggggtgcagc

SEQ ID NO: 358928 - DNA, 75 bp, Artificial Sequence
  Synthetic
gatggaggccctctatagccttagaggacaactgttgtttcaggttccctgaagagtagatcaatagggagcatc

SEQ ID NO: 358929 - DNA, 75 bp, Artificial Sequence
  Synthetic
ctcatgggtttctcattggacactgatcctgatacaacggcactaaacattatacaatcaaggagtgcacaatgt

SEQ ID NO: 358930 - DNA, 75 bp, Artificial Sequence
  Synthetic
gcattggttgttgcaggtgttgagcctttcttcttgctctttatcactatccctttgtgtttgtcgcaaaggtgt

SEQ ID NO: 358931 - DNA, 75 bp, Artificial Sequence
  Synthetic
tcaaacctcttccaaacaagatcttcaaaaatccgtgattcttcagcactcagcttgacatcaacaatttttaga

SEQ ID NO: 358932 - DNA, 75 bp, Artificial Sequence
  Synthetic
tcttgtctaccatgcatgtcaaaaagctttctaatgtcatctgcaccctgtgcagtgaacaccattgatttgggc

SEQ ID NO: 358933 - DNA, 75 bp, Artificial Sequence
  Synthetic
agacttctaattattgatgaaataagacctggtcgtgcatactcaatgtccttcagcaaaatcccatgacaatac

SEQ ID NO: 358934 - DNA, 75 bp, Artificial Sequence
  Synthetic
ttgctttggtccttgaaggactttatatcattaggtttcctataacagtgaatgtatctttttgactctggttga

SEQ ID NO: 358935 - DNA, 75 bp, Artificial Sequence
  Synthetic
taaatggcaaattcgacaggatcatttggtggcccctcaatgtcaatccatgttgtgtcactggtaggtaaagac

SEQ ID NO: 358936 - DNA, 75 bp, Artificial Sequence
  Synthetic
tctacaattctccttacctgactctcaatttcaggtttaagcgttgttaaggaaggagcccctccatttctaatt

SEQ ID NO: 358937 - DNA, 75 bp, Artificial Sequence
  Synthetic
ggtattggtcctttaattggaacagagtcaaactcaacaactgtattgtcccatgctctgcctttaatctgtgac

SEQ ID NO: 358938 - DNA, 75 bp, Artificial Sequence
  Synthetic
cgtgaagcaatgtaaggccatccttcacctgagaggcaaagtttgtaaagtatattctcataggggttcctttgc

SEQ ID NO: 358939 - DNA, 75 bp, Artificial Sequence
  Synthetic
ccaggagttgtgctgacaaacattctctctctactcttgatctccaaaagagttttaataatggtggtgaatgtg

SEQ ID NO: 358940 - DNA, 75 bp, Artificial Sequence
  Synthetic
gattcttcaactttaattgtctcaagcatgtttccaccatcaattagacaagctccagccttcacagcagctgac

SEQ ID NO: 358941 - DNA, 75 bp, Artificial Sequence
  Synthetic
aagctaagattgtacccagaaatattaacttgtgattcttcttgggtgattattttgagagagggatgcttctct

SEQ ID NO: 358942 - DNA, 75 bp, Artificial Sequence
  Synthetic
gtaagaaccttgagatcagttaaatttgggtattttgctgtatacagaagtccaaggtcagtaaggccttgaaca

SEQ ID NO: 358943 - DNA, 75 bp, Artificial Sequence
  Synthetic
acatcattgagaggttctcctccttgttctgtcatgcaagatattgtcacagcaggcactgaaccaaattgatta

SEQ ID NO: 358944 - DNA, 75 bp, Artificial Sequence
  Synthetic
attaagagtaatgggtcttttatgtcccatatcttcactgctcctccagttgacattgatccaggtctttgtatg

SEQ ID NO: 358945 - DNA, 75 bp, Artificial Sequence
  Synthetic
cccacaagctgtaaaatctcagatcttcttgtcagctgtgtggacgaaagatttccttgatactgacctgtggta

SEQ ID NO: 358946 - DNA, 75 bp, Artificial Sequence
  Synthetic
ttgtttgttctctcagtcctttgtactttctgtctaagtttttctaaatcactagaaagttccattaattcatct

SEQ ID NO: 358947 - DNA, 75 bp, Artificial Sequence
  Synthetic
tttgacagagaacccacttttaagaacatgtttttctggtttgatttcatgatcatcagtgagtcaacttcctta

SEQ ID NO: 358948 - DNA, 75 bp, Artificial Sequence
  Synthetic
tttaaatctcttaagccaatgagatcactatcatctcttttaaccctcctcatcatcctctgaacacttgcaacc

SEQ ID NO: 358949 - DNA, 75 bp, Artificial Sequence
  Synthetic
tttgcaaaatccagaccagagaggagagcccttgtgtcagaaagcacatctgccttgacggcagttgtccaagca

SEQ ID NO: 358950 - DNA, 75 bp, Artificial Sequence
  Synthetic
gagagacctcttcttagagattgagtccagcgaaaggatggtaccatctggtcactcatagtaaaatgtgatgaa

SEQ ID NO: 358951 - DNA, 75 bp, Artificial Sequence
  Synthetic
taccatctggtcactcatagtaaaatgtgatgaagtttcgaacagatttcctataagcctaggatccaccgtgcg

SEQ ID NO: 358952 - DNA, 75 bp, Artificial Sequence
  Synthetic
taccatctggtcactcatagtaaaatgtgatgaagtttcgaacagatttcctataagcctaggatcctccgtgcg

SEQ ID NO: 358953 - DNA, 75 bp, Artificial Sequence
  Synthetic
taccatctggtcactcatagtaaaatgtgatgaagtttcgaacagatttcctataagcctaggatcccccgtgcg

SEQ ID NO: 358954 - DNA, 75 bp, Artificial Sequence
  Synthetic
taccatctggtcactcatagtaaaatgtgatgaagtttcgaacagatttcctataagcctaggatccgccgtgcg

SEQ ID NO: 358955 - DNA, 75 bp, Artificial Sequence
  Synthetic
cgcacagaggatcctaggcatttttaacttgcgcaactaactgactttgtcttgttgccccacaatggggcagct

SEQ ID NO: 358956 - DNA, 75 bp, Artificial Sequence
  Synthetic
gatctcattttttggagagattccatcaatattgcatgaggctttaaacattgctttaatagcaatcagcataat

SEQ ID NO: 358957 - DNA, 75 bp, Artificial Sequence
  Synthetic
ttcaattctaaagggtgtcatcaatatctggaaaagtggtctgctgcaactcattatttttctgttactagctgg

SEQ ID NO: 358958 - DNA, 75 bp, Artificial Sequence
  Synthetic
gagatcctgctcatataaaataggtcatcatatagaacttcagcatataattttgaatgggtcctacataacagc

SEQ ID NO: 358959 - DNA, 75 bp, Artificial Sequence
  Synthetic
ctatgcaccaacagcatgcatgatcaatggaacacattttttgctgagaggaccatttgaagccaagtcggctgt

SEQ ID NO: 358960 - DNA, 75 bp, Artificial Sequence
  Synthetic
ccaactagaaatcactgacatcaccacccttgtggagggcccagacaacatagctggagtcaagaacatcagcaa

SEQ ID NO: 358961 - DNA, 75 bp, Artificial Sequence
  Synthetic
ttgcttcataggcagtgtagacaaagaagtaatccattttattatggaatggttcctgagtgggctggagcatga

SEQ ID NO: 358962 - DNA, 75 bp, Artificial Sequence
  Synthetic
tcaccactttgccccacaaatcttatgcgggaatagttccaaaggagagtttgatgtccaaatgaatataactga

SEQ ID NO: 358963 - DNA, 75 bp, Artificial Sequence
  Synthetic
agaaaatcattgtaatcaaatctatttaaaaatgagaaagatttttggggctttcaaagatccttgcacttctgg

SEQ ID NO: 358964 - DNA, 75 bp, Artificial Sequence
  Synthetic
tggaaagttgaatttattttttaaaaatgttagttgggctgagcaatgttcagctaatcatctgagttccatgca

SEQ ID NO: 358965 - DNA, 75 bp, Artificial Sequence
  Synthetic
tcttataatacagaatgcatacaaacaagtgttcagagtgagaaagctgcaggcattcttcacctggtcactgtc

SEQ ID NO: 358966 - DNA, 75 bp, Artificial Sequence
  Synthetic
tgatgctacaggaaaagatttaccaggtggatattgtttagaaagatggatgtttatctcaagtgagttaaagtg

SEQ ID NO: 358967 - DNA, 75 bp, Artificial Sequence
  Synthetic
tttcggcaatactgccatagctaaatgtaacttagatcacagttcagaattttgtgacatgcttagactctttga

SEQ ID NO: 358968 - DNA, 75 bp, Artificial Sequence
  Synthetic
gttcaacaaaaatgcagtcaagacacttcaaaatgaaagcaaacaccagttggacacaatcatagctgctgtcaa

SEQ ID NO: 358969 - DNA, 75 bp, Artificial Sequence
  Synthetic
ctctctgatttcagataacattcttatgaagaacagaattagggagcttatcagcatcccttattgcaattacac

SEQ ID NO: 358970 - DNA, 75 bp, Artificial Sequence
  Synthetic
aaagttttggtatgtcaaccacactggacttaatgtccaatcattgccgaagtgttggctcacaaggaatggtag

SEQ ID NO: 358971 - DNA, 75 bp, Artificial Sequence
  Synthetic
ttacctgaatgtgtctgactttaggaatgaatggctactggagagtgatcatctgatctctgagattctgaataa

SEQ ID NO: 358972 - DNA, 75 bp, Artificial Sequence
  Synthetic
agaatatgaggaaagacaaggaaggacaccactgtcattggtggatgtatgtttttggagcacattgttttatgt

SEQ ID NO: 358973 - DNA, 75 bp, Artificial Sequence
  Synthetic
ctcatcaattttcctacatcttttaaggatacctacccatagacatattgttggtgagggttgtcccaaaccaca

SEQ ID NO: 358974 - DNA, 75 bp, Artificial Sequence
  Synthetic
caggcttgatggtgattcgctgtgtgcatgtggccttttcaaacaaaagggaaggcatctgagatgggttaggaa

SEQ ID NO: 358975 - DNA, 75 bp, Artificial Sequence
  Synthetic
agtgtaggacaccagcagtggaggccctctatcatcttagaggactactgttgtctcaggctctctaaagagtag

SEQ ID NO: 358976 - DNA, 75 bp, Artificial Sequence
  Synthetic
atcaatgggaagcatcctcattggtttctcatttgaaactgaccctgatataacagcactaaacattatgcagtc

SEQ ID NO: 358977 - DNA, 75 bp, Artificial Sequence
  Synthetic
taagagtgcacaatgtgcattagttgttgcaggtgttgagcctttcttcttgctcttaattactatccccttgtg

SEQ ID NO: 358978 - DNA, 75 bp, Artificial Sequence
  Synthetic
tttatcacagagatgctcaaatctcttccaaacaaggtcttcgaagatccgtgattcttcagcactcaatttgac

SEQ ID NO: 358979 - DNA, 75 bp, Artificial Sequence
  Synthetic
atcaacaatctttaaatcttgtctaccatgcatatcgaaaagctttctaatgtcatctgcaccttgtgcagtgaa

SEQ ID NO: 358980 - DNA, 75 bp, Artificial Sequence
  Synthetic
aaccatcgatttagggagattcctaattattgatgaaataatacccggtcgtgcatactcaacatctttcaataa

SEQ ID NO: 358981 - DNA, 75 bp, Artificial Sequence
  Synthetic
aatcccatgacaatatttgctttgatccttgaaagacttcacatcattaggtctcctgtaacaatgtatgtatct

SEQ ID NO: 358982 - DNA, 75 bp, Artificial Sequence
  Synthetic
ttgtgattccggttggtagatagcaaactcaacaggatcatttggtggcccttcaatgtcaatccacgttgtatc

SEQ ID NO: 358983 - DNA, 75 bp, Artificial Sequence
  Synthetic
attggtgagtagagaatccacactcttttttatttgagtctcaatttctggtttgagtgttgttaatgaaggagc

SEQ ID NO: 358984 - DNA, 75 bp, Artificial Sequence
  Synthetic
tcctccattccttattggtggatgctccctgatgacagtggtgtcaaattccactactgtgttgtcccatgctct

SEQ ID NO: 358985 - DNA, 75 bp, Artificial Sequence
  Synthetic
acctttaatctgggagcgtgatgcaatgtatggccaaccctcaccagaaaggcacagcttgtaaagtacattctc

SEQ ID NO: 358986 - DNA, 75 bp, Artificial Sequence
  Synthetic
atagggattcctttgtcctggagttaaactgacaaacatcctctctctacttttgatttcaagaagtgttttgat

SEQ ID NO: 358987 - DNA, 75 bp, Artificial Sequence
  Synthetic
gattgttgtaaatgtggactcttcaacttttattgtctcaagcatattgccaccatcaataaggcaagctccagc

SEQ ID NO: 358988 - DNA, 75 bp, Artificial Sequence
  Synthetic
tttaacagcggctgacaaactaaggttatatccagaaatgttgatctgtgagtcctcttgagtgattatcttcaa

SEQ ID NO: 358989 - DNA, 75 bp, Artificial Sequence
  Synthetic
ggaaggatgttttattgtcagagtcttaagatcagtcaaatttggaaattttgctgtgtataaaagcccaaggtc

SEQ ID NO: 358990 - DNA, 75 bp, Artificial Sequence
  Synthetic
agtaagtccttggacaacatcgtttaagggttctcctccttgctcagtcatacaggagattgtcacagctggcac

SEQ ID NO: 358991 - DNA, 75 bp, Artificial Sequence
  Synthetic
tgatccaaattggttaatcaaaagcgatggatctttaatgtcccaaatcttggctattcccccacctgcagctga

SEQ ID NO: 358992 - DNA, 75 bp, Artificial Sequence
  Synthetic
accaagtctttgtatgccgacaagctgcaggatttcggatcttcttgtcaactgcgtagttgagaggttccccag

SEQ ID NO: 358993 - DNA, 75 bp, Artificial Sequence
  Synthetic
atactgacccccagtgctgtttgtcttttcagttctttgaaccttctgccttaacttttccaagtcactagacag

SEQ ID NO: 358994 - DNA, 75 bp, Artificial Sequence
  Synthetic
ttccatcaattcatctttggataaagaacccactttcaaaaacatattcttctgatttgatttcatggtcattaa

SEQ ID NO: 358995 - DNA, 75 bp, Artificial Sequence
  Synthetic
tgaatccacttctttgttcaggtctcttagaccaatgaggtcattgtcatctctcttggctcttctcatcatcct

SEQ ID NO: 358996 - DNA, 75 bp, Artificial Sequence
  Synthetic
ctgaacacttgcaaccttcgcaaagtccaaaccagacaaaagtgcccttgtgtcattgagcacatctgccttgac

SEQ ID NO: 358997 - DNA, 75 bp, Artificial Sequence
  Synthetic
ggtggttgtccaagcggagagtcctcttctgagggactgtgtccagcggaaggatggcactggctggtcactcat

SEQ ID NO: 358998 - DNA, 75 bp, Artificial Sequence
  Synthetic
aaggatggcactggctggtcactcattgtgaagttcttttgcgttgatttcctaaagcctaggatcctccgtgcg

SEQ ID NO: 358999 - DNA, 75 bp, Artificial Sequence
  Synthetic
cgcacagtggatcctaggcgttttgacttgcgcaattaattgacttcattcattgccccacaatggggcagctga

SEQ ID NO: 359000 - DNA, 75 bp, Artificial Sequence
  Synthetic
tctcgtttttcggggaaattccatcaataatacacgaggccctgaacattgcattaatagcagtcagcatcatat

SEQ ID NO: 359001 - DNA, 75 bp, Artificial Sequence
  Synthetic
caattctgaagggtgttatcaacatttgggggagtggcctactgcagttcattgtgtttctgctgttggctgggc

SEQ ID NO: 359002 - DNA, 75 bp, Artificial Sequence
  Synthetic
gatcctgctcatacaagattggccatcatgttgaacttcaacacataattctgaatgcatcctacatcacaccct

SEQ ID NO: 359003 - DNA, 75 bp, Artificial Sequence
  Synthetic
atgtaccaatgccctgcatgatcaatgacacacatttcttactgaggggtccttttgaggccagttgggccatca

SEQ ID NO: 359004 - DNA, 75 bp, Artificial Sequence
  Synthetic
agttggagattactgatgtgacaactcttgtggtggacactgacaacgttgctaatcccacaaacattagcaagt

SEQ ID NO: 359005 - DNA, 75 bp, Artificial Sequence
  Synthetic
gttttgcaaacaaccaggatgagaggttgttaggcttcaccatggagtggtttttgagtggattggaacatgatc

SEQ ID NO: 359006 - DNA, 75 bp, Artificial Sequence
  Synthetic
accatttcactccacagatcatttgtggaaatgtatccaaaggagaggttaatgctcaagtgaacataactatgg

SEQ ID NO: 359007 - DNA, 75 bp, Artificial Sequence
  Synthetic
aggatcattgcagtcaggtgtttttgaaaatgagaaggatttttggggttttcaaaaacccttgcacttcacatg

SEQ ID NO: 359008 - DNA, 75 bp, Artificial Sequence
  Synthetic
ggaagcagaatgtgctaatctccgtcagtaattggaccaatcaatgctcagggaaccacttaagttccatgcacc

SEQ ID NO: 359009 - DNA, 75 bp, Artificial Sequence
  Synthetic
ttatagtgcaaaatgcatataaacaaatgatcaaatcaagaactttgaaaagtttttttgcctggtcactgtctg

SEQ ID NO: 359010 - DNA, 75 bp, Artificial Sequence
  Synthetic
atgccacagggactgacatgccaggagggtactgtttggagaaatggatgctgatttcaagtgagctaaaatgtt

SEQ ID NO: 359011 - DNA, 75 bp, Artificial Sequence
  Synthetic
ttggaaacactgcaatagctaagtgcaacttggatcacagttcagagttttgtgacatgctcaaattgtttgagt

SEQ ID NO: 359012 - DNA, 75 bp, Artificial Sequence
  Synthetic
ttaacagaaatgcaatcaaaacacttcagaatgacagcaagcatcaactagacatgatcataactgctgtcaact

SEQ ID NO: 359013 - DNA, 75 bp, Artificial Sequence
  Synthetic
ctctgatttcagacaatactctaatgaaaaacagacttaaagaactcatcaacattccttattgtaattatacta

SEQ ID NO: 359014 - DNA, 75 bp, Artificial Sequence
  Synthetic
agttctggtatgtgaaccacactggatttaatgtccattcactgccaagatgttggctcacaaaaaatggcagtt

SEQ ID NO: 359015 - DNA, 75 bp, Artificial Sequence
  Synthetic
acttgaatgtgtctgactttaggaatcaatggcttttagaaagtgaccatttgatctctgaaatcttaagtagag

SEQ ID NO: 359016 - DNA, 75 bp, Artificial Sequence
  Synthetic
aatatgaggcaagacaaggcaagacaccacttgggttggtggatgtatgcttctggagcaccttgttttatgttt

SEQ ID NO: 359017 - DNA, 75 bp, Artificial Sequence
  Synthetic
catcgatatttttacacctactgagaatacccacccacagacacataattggtgaaggctgtcccaaaccacata

SEQ ID NO: 359018 - DNA, 75 bp, Artificial Sequence
  Synthetic
aatacccacccacagacacataattggtgaaggctgtcccaaaccacatagactttccagtaactcagtatgtgc

SEQ ID NO: 359019 - DNA, 75 bp, Artificial Sequence
  Synthetic
atgtggtctttttaaacaaaaagggaggcccttaaggtgggccgggaaagtgtagaatgtcaaccgaggtggcct

SEQ ID NO: 359020 - DNA, 75 bp, Artificial Sequence
  Synthetic
ccaacgctgcacccccttcggggggtgcagcggtggaggccctttgcagcctcaaaggacgactgttgtttcagg

SEQ ID NO: 359021 - DNA, 75 bp, Artificial Sequence
  Synthetic
ctccctgaagagcaggtcaatgggaagcattctctttggtttctcattggaaactgaacctgatataacagcact

SEQ ID NO: 359022 - DNA, 75 bp, Artificial Sequence
  Synthetic
agcattctctttggtttctcattggaaactgaacctgatataacagcactgaacatcacgccgtccagcagcgca

SEQ ID NO: 359023 - DNA, 75 bp, Artificial Sequence
  Synthetic
cagtgtgcattggttgttgcaggtgtcgaccccttctttttactcttgatgactatccccttatgtttgtcacaa

SEQ ID NO: 359024 - DNA, 75 bp, Artificial Sequence
  Synthetic
aggtgctcaaatcttttccaaacaaggtcttcaaaaatccgtgactcttctgcactcaatttgacatcaacaatc

SEQ ID NO: 359025 - DNA, 75 bp, Artificial Sequence
  Synthetic
ttcagatcttgcctgccatgcatatcaaaaagtttccttatatcgtctgcaccttgtgcagtgaagaccattgat

SEQ ID NO: 359026 - DNA, 75 bp, Artificial Sequence
  Synthetic
ttaggtaaactcctaattattgatgaaataagacctggtcgcgcattctcaacatctttcaataatattccatgg

SEQ ID NO: 359027 - DNA, 75 bp, Artificial Sequence
  Synthetic
caatatttactctgatctttgaaggattttatgtcattgggtctcctgtaacagtgtatatatctctgtgattcc

SEQ ID NO: 359028 - DNA, 75 bp, Artificial Sequence
  Synthetic
ggctggtagatggcaaactcaacggggtcatttggtggcccctcaatgtcaatccatgttgtatcattgataagc

SEQ ID NO: 359029 - DNA, 75 bp, Artificial Sequence
  Synthetic
agagactccacactcctcttcacttgattctcaatctcaggtttaagtgttgtcaacaagggggcacccccattt

SEQ ID NO: 359030 - DNA, 75 bp, Artificial Sequence
  Synthetic
cttataggtatgggctccttaactgtggcagtgtcaaactcaacaactgtgttatcccatgctctaccttttatc

SEQ ID NO: 359031 - DNA, 75 bp, Artificial Sequence
  Synthetic
gttatcccatgctctaccttttatctgtgatcgtgaggcaatgtagggccaaccgtcacccgatagacatagttt

SEQ ID NO: 359032 - DNA, 75 bp, Artificial Sequence
  Synthetic
gtagagcacattctcgtaaggatttctctgcccaggggtgggactaacaaacattttttccttgtttttgacttc

SEQ ID NO: 359033 - DNA, 75 bp, Artificial Sequence
  Synthetic
caaaagtgttttgatgactgttgtgaatgtagattcctcaatctttattgtttcaagcatgttgccaccatcaat

SEQ ID NO: 359034 - DNA, 75 bp, Artificial Sequence
  Synthetic
aagacaagcaccagctttcacagcagctgataaactgagattgtatccagaaatattgatctgtgactcctcctg

SEQ ID NO: 359035 - DNA, 75 bp, Artificial Sequence
  Synthetic
agtgattatattcaaggatggatgttttgttgttagagccttgagatcattgagatttggatattttgctgtgta

SEQ ID NO: 359036 - DNA, 75 bp, Artificial Sequence
  Synthetic
cagaagcccaaggtcagtaagaccctggaccacatcattgagggactctcccccttgctcagtcatacaggagat

SEQ ID NO: 359037 - DNA, 75 bp, Artificial Sequence
  Synthetic
tgtcacagctggcacagatccaaactgattgaccaagagtgatgggtcttttatatcccatatctttactacacc

SEQ ID NO: 359038 - DNA, 75 bp, Artificial Sequence
  Synthetic
tccggttggtgccaagcctgctctttgtataccgacaagttgtaggatttcagatctccttgttagctgtgtgtt

SEQ ID NO: 359039 - DNA, 75 bp, Artificial Sequence
  Synthetic
tgaaaggtttccttggtactgtcctgtgccgttgcccaccctttcagttctctgtaccttttgttttagcttttc

SEQ ID NO: 359040 - DNA, 75 bp, Artificial Sequence
  Synthetic
caagtcactggagagttccatcagttcatccttggataaagaacccactttcaggaacatgtttttttggtttga

SEQ ID NO: 359041 - DNA, 75 bp, Artificial Sequence
  Synthetic
cttcataatcatcagtgagtccacttctttgtttagatctctcaaaccaacaagatcactatcatcccttttgac

SEQ ID NO: 359042 - DNA, 75 bp, Artificial Sequence
  Synthetic
cctcctcatcatcctttgaacacttgcgacctttgcaaagtccaggccagacaaaagtgctcttgtatcattgag

SEQ ID NO: 359043 - DNA, 75 bp, Artificial Sequence
  Synthetic
aacgtctgccttgacactagtcgtccaggcagagagccctctcctaagagattgagtccagcggaaggatggcac

SEQ ID NO: 359044 - DNA, 75 bp, Artificial Sequence
  Synthetic
ggatggcactgattggtcactcattcttgattatcttttgcgctgatatcctataagcctaggatccactgtgcg

SEQ ID NO: 359045 - DNA, 75 bp, Artificial Sequence
  Synthetic
cgcacagaggatcctaggcattttgacttgcgcaactaactgaacttgtttgttgccccgaaatggggcagctgg

SEQ ID NO: 359046 - DNA, 75 bp, Artificial Sequence
  Synthetic
tctcgttctttggagaaattccatcaatattgaatgaggctttgaacattgccctaatggcagtcagtattataa

SEQ ID NO: 359047 - DNA, 75 bp, Artificial Sequence
  Synthetic
caattctaaaaggcttcatcaacatttggaaaagtggtctactacagctcattgccttcctgttgctggctggaa

SEQ ID NO: 359048 - DNA, 75 bp, Artificial Sequence
  Synthetic
gatcctgttcacacaacataggtcatcatatagagcttcaatatgtaattctaaatgcgtcccacatcacacctt

SEQ ID NO: 359049 - DNA, 75 bp, Artificial Sequence
  Synthetic
atgtgccaacagcatgcatgatcaatcacacagactttttgttgaggggaccatttgaagcgaagtgggtcattg

SEQ ID NO: 359050 - DNA, 75 bp, Artificial Sequence
  Synthetic
agatgcagatcacagaaattacaacccttgtggataatgggcataataaagccgaaatcatgaacatcagtaatt

SEQ ID NO: 359051 - DNA, 75 bp, Artificial Sequence
  Synthetic
gttttgaaaatgtccaagataagaaaatggtgagtttcaatatggagtggtttttcagtggattggagcatgatc

SEQ ID NO: 359052 - DNA, 75 bp, Artificial Sequence
  Synthetic
gtcactttgccccacagatcctttgtggaaacagttccaaaggagagtatgatgtcctaatgaatataactataa

SEQ ID NO: 359053 - DNA, 75 bp, Artificial Sequence
  Synthetic
aggaccattgcactcagattttccttaagatgagaaagatattcggggcctttaaggatccctgcatctccaatg

SEQ ID NO: 359054 - DNA, 75 bp, Artificial Sequence
  Synthetic
gcaaattgaacatgttgtttagaattggcaactggaccaaccaatgttcagaaagtcatctgagttccatgcatc

SEQ ID NO: 359055 - DNA, 75 bp, Artificial Sequence
  Synthetic
ttatagtgcagaatgcttacaaacagatgattggagcaaggagtctaaaagcattcttcacctggtcactatctg

SEQ ID NO: 359056 - DNA, 75 bp, Artificial Sequence
  Synthetic
atgccacagggaacgacatgccaggtggttactgtctagaaaaatggatgctcatctcaagtgaactgaaatgtt

SEQ ID NO: 359057 - DNA, 75 bp, Artificial Sequence
  Synthetic
ttgggaacactgctattgctaaatgtaatctggaccacaactcagaattttgtgacatgctcagattatttgaat

SEQ ID NO: 359058 - DNA, 75 bp, Artificial Sequence
  Synthetic
tcaataaaaatgcaataaaaacactccaaaatgaaagcaaacatcagttagatatggtcataactgctgtcaact

SEQ ID NO: 359059 - DNA, 75 bp, Artificial Sequence
  Synthetic
ccttaatttcagataacattcttatgaagaataggattcgggaactcatcaatattccttattgtaattacacta

SEQ ID NO: 359060 - DNA, 75 bp, Artificial Sequence
  Synthetic
aattttggtacattaatcacactggttttaacgtccattcattgccaaggtgttggcttacaaagaatggtagtt

SEQ ID NO: 359061 - DNA, 75 bp, Artificial Sequence
  Synthetic
acttgaatgtgtctgatttcaggaatgagtggcttttggaaagtgaccacctgatctctgaaatactaagtagag

SEQ ID NO: 359062 - DNA, 75 bp, Artificial Sequence
  Synthetic
aatatgaggaaaggcaaggaaggacgccattaggattagtggatgtgtgcttttggagcaccctgttttatgtct

SEQ ID NO: 359063 - DNA, 75 bp, Artificial Sequence
  Synthetic
catccatttttctacatttattaagaatacccactcataggcacattgttggtgaggggtgtccaaagccacaca

SEQ ID NO: 359064 - DNA, 75 bp, Artificial Sequence
  Synthetic
gactctcatccaattcattgtgtgcatgtggcctctttaggcagaaaggaagaccattgaggtggacaaggggta

SEQ ID NO: 359065 - DNA, 75 bp, Artificial Sequence
  Synthetic
tatagaacactaactgcgacggcctccactgctgcaccccttttgggggtgcagcagtggaggccacgtctcgtg

SEQ ID NO: 359066 - DNA, 75 bp, Artificial Sequence
  Synthetic
gtcttagaggacgactgttgtttcgggatctctgaagagtaaatcaatggggagcattcttttgggtttctcatt

SEQ ID NO: 359067 - DNA, 75 bp, Artificial Sequence
  Synthetic
ggaaactgaccctgatataacagcactgaacattatacaatcaagaagtgcacaatgtgcattggttgttgcagg

SEQ ID NO: 359068 - DNA, 75 bp, Artificial Sequence
  Synthetic
tgttgaccctttcttcttgctcttgatcacaatccctttgtgtttgtcacaaagatgttcaaacctcttccaaac

SEQ ID NO: 359069 - DNA, 75 bp, Artificial Sequence
  Synthetic
aagatcttcaaaaatccgtgattcttctgcacttaacttcacatcaacaatcttcaaatcctgtctaccatgcat

SEQ ID NO: 359070 - DNA, 75 bp, Artificial Sequence
  Synthetic
gtcaaaaagcttcctaatgtcatctgcaccctgtgcagtgaaaaccattgacttgggtaaactcctaattattga

SEQ ID NO: 359071 - DNA, 75 bp, Artificial Sequence
  Synthetic
agaaatgagacccggtcttgcgtattcaacatctttcaatagtattccatggcaatatttgctttgatccttgaa

SEQ ID NO: 359072 - DNA, 75 bp, Artificial Sequence
  Synthetic
agattttatatcattgggtctcctatagcagtgtatgtatctctgtgattctggttgaaagatggcaaactcaac

SEQ ID NO: 359073 - DNA, 75 bp, Artificial Sequence
  Synthetic
aggatcgtttggtggcccctcaatgtcaatccatgttgtatcattgacaagtaaggactccacacttctccttac

SEQ ID NO: 359074 - DNA, 75 bp, Artificial Sequence
  Synthetic
ctgactctcaacttcaggtttaagagttgtcagcaagggagcacccccatttcttattggcacatgctctttaac

SEQ ID NO: 359075 - DNA, 75 bp, Artificial Sequence
  Synthetic
caccatgttgtcaaactcaataactgtgttgtcccaagctcttcctttgatctgtgatcgtgaagcaatataggg

SEQ ID NO: 359076 - DNA, 75 bp, Artificial Sequence
  Synthetic
ccagccttcaccagagagacacaacttataaagcacattctcataagggtttctctgtccaggggtggggttgat

SEQ ID NO: 359077 - DNA, 75 bp, Artificial Sequence
  Synthetic
gaacatcttttctctgttcttaatctccaaaagggttttcacaattgtagtgaatgtggactcctcaacctttat

SEQ ID NO: 359078 - DNA, 75 bp, Artificial Sequence
  Synthetic
tgtttcaagcatgttcccaccatcaataagacaggctccagctttcacagcagctgacaaactgaggttgtatcc

SEQ ID NO: 359079 - DNA, 75 bp, Artificial Sequence
  Synthetic
agaaatgttaatctgtgagtcctcttgagtgattattttcaaagagggatgtttcattgtcagagccttgagatc

SEQ ID NO: 359080 - DNA, 75 bp, Artificial Sequence
  Synthetic
agcaaggtttggatattttgctgtgtaaaggagtccaagatcggtgaggccctgaacaacatcgttgagaggttc

SEQ ID NO: 359081 - DNA, 75 bp, Artificial Sequence
  Synthetic
agcaaggtttggttattttgctgtgtaaaggagtccaagatcggtgaggccctgaacaacatcgttgagaggttc

SEQ ID NO: 359082 - DNA, 75 bp, Artificial Sequence
  Synthetic
agcaaggtttggctattttgctgtgtaaaggagtccaagatcggtgaggccctgaacaacatcgttgagaggttc

SEQ ID NO: 359083 - DNA, 75 bp, Artificial Sequence
  Synthetic
agcaaggtttgggtattttgctgtgtaaaggagtccaagatcggtgaggccctgaacaacatcgttgagaggttc

SEQ ID NO: 359084 - DNA, 75 bp, Artificial Sequence
  Synthetic
tcccccttgttcagtcatgcaggagattgtcacagctggcacagatccaaactggttaatcaagagtgatgagtc

SEQ ID NO: 359085 - DNA, 75 bp, Artificial Sequence
  Synthetic
ctttatatcccacactctcattgtccctcccacgacagttgagccaggcttttgtacgccgacaagttgcaggat

SEQ ID NO: 359086 - DNA, 75 bp, Artificial Sequence
  Synthetic
ctcagaccttcttgtcagctgtgtgcttgataaattcccttgatactgtcctgggacattgcccaccctttcact

SEQ ID NO: 359087 - DNA, 75 bp, Artificial Sequence
  Synthetic
cctttgcactttttgctttaacttttccaaatcactggagagctccattaattcatccttggataaagagcccac

SEQ ID NO: 359088 - DNA, 75 bp, Artificial Sequence
  Synthetic
tttaaggaacatgtttttctggtttgacttcatgaccatcaatgaatctacttccttgttcaaatctctcagact

SEQ ID NO: 359089 - DNA, 75 bp, Artificial Sequence
  Synthetic
aataagatcattatcatctctcttaactctcctcatcatcctttgaacacttgcaacctttgcaaaatccagacc

SEQ ID NO: 359090 - DNA, 75 bp, Artificial Sequence
  Synthetic
agacaggagtgctcttgcatcggtgagcacgtccgccttgacgctggttgtccaggcagagagccccctcctgag

SEQ ID NO: 359091 - DNA, 75 bp, Artificial Sequence
  Synthetic
agattgggtccagcgaaaggatggtactgattggtcattcattttgaacactttttgcgctgatatcctcaaaag

SEQ ID NO: 359092 - DNA, 75 bp, Artificial Sequence
  Synthetic
ggatggtactgattggtcattcattttgaacactttttgcgctgatatcctcaaaagcctaggatccaccgtgcg

SEQ ID NO: 359093 - DNA, 75 bp, Artificial Sequence
  Synthetic
ggatggtactgattggtcattcattttgaacactttttgcgctgatatcctcaaaagcctaggatcctccgtgcg

SEQ ID NO: 359094 - DNA, 75 bp, Artificial Sequence
  Synthetic
ggatggtactgattggtcattcattttgaacactttttgcgctgatatcctcaaaagcctaggatcccccgtgcg

SEQ ID NO: 359095 - DNA, 75 bp, Artificial Sequence
  Synthetic
ggatggtactgattggtcattcattttgaacactttttgcgctgatatcctcaaaagcctaggatccgccgtgcg

SEQ ID NO: 359096 - DNA, 75 bp, Artificial Sequence
  Synthetic
gttatacacttgcgcacaaaactgataacaaacaaacaacccacctgctgacccacatcatggggcaactggttt

SEQ ID NO: 359097 - DNA, 75 bp, Artificial Sequence
  Synthetic
cattctttggagaaatcccttccataatacatgaagccttgaatgttgcgttgatggcagtcagcatcatagcag

SEQ ID NO: 359098 - DNA, 75 bp, Artificial Sequence
  Synthetic
tggtcaaaggtctcatcaatctttggaaaagcggcattctgcagctggtggccttcctgctgttagctggaaggt

SEQ ID NO: 359099 - DNA, 75 bp, Artificial Sequence
  Synthetic
gaaaagcggcattctgcagctggtggccttcctgctgttagctggaaggtcttgctctgtcccaataggccatca

SEQ ID NO: 359100 - DNA, 75 bp, Artificial Sequence
  Synthetic
cacacactttttaatcaagggtccatttgaggcaaggtgggggatcagtctggagatcactgatattgcagttct

SEQ ID NO: 359101 - DNA, 75 bp, Artificial Sequence
  Synthetic
ggtcgatgttgacggtggaaagcaagcatctatagtacccagtaatgtcagtctctgttttgagggaaatgagga

SEQ ID NO: 359102 - DNA, 75 bp, Artificial Sequence
  Synthetic
caaaagattggtggcattcacactgaattggtttttgaacggtttggggtatgatcaaaaaactgatccaaaaat

SEQ ID NO: 359103 - DNA, 75 bp, Artificial Sequence
  Synthetic
cttgtgtgagaatacgactgttgaccaggtctcaaggttgcagatcaacataactaatgaggattactgtaataa

SEQ ID NO: 359104 - DNA, 75 bp, Artificial Sequence
  Synthetic
ggtgttctttaaaatgaagaagatttttggttcatttgtggacccctgtttaaatggtcaaaagaaatacatcct

SEQ ID NO: 359105 - DNA, 75 bp, Artificial Sequence
  Synthetic
tttgaaaaacactagctggattaatggatgtgatggaaatcacttaagcaccttacacttaatccttcaaaatgc

SEQ ID NO: 359106 - DNA, 75 bp, Artificial Sequence
  Synthetic
atataggcaggctgttgggatcagaaaattgcaagcctttttcagttggacattgtctgacaatgttgggactga

SEQ ID NO: 359107 - DNA, 75 bp, Artificial Sequence
  Synthetic
tgtgccaggaggttattgcctggaaaaatggatgttaatttcaagtgaattgaaatgttttggaaacactgcagt

SEQ ID NO: 359108 - DNA, 75 bp, Artificial Sequence
  Synthetic
aaatggatgttaatttcaagtgaattgaaatgttttggaaacactgcagtggccaaatgtaatttgaaccatgac

SEQ ID NO: 359109 - DNA, 75 bp, Artificial Sequence
  Synthetic
gaattactcgatatcccatattgcaattatacgagattctggtatataaatcacacaggtctaaatgtgcattcc

SEQ ID NO: 359110 - DNA, 75 bp, Artificial Sequence
  Synthetic
tcacacaggtctaaatgtgcattcccttcctaaatgttggttgacaagaaatggtagcttcctaaatatatccga

SEQ ID NO: 359111 - DNA, 75 bp, Artificial Sequence
  Synthetic
aaaacatacaccattgagcttggtagatatttgtttctggagcactttgttctacacagcgtccatatttttgca

SEQ ID NO: 359112 - DNA, 75 bp, Artificial Sequence
  Synthetic
cctgttgagaattcccactcacagacacattatcggtgaagtttgcccaaaaccccatagactcactagtgactc

SEQ ID NO: 359113 - DNA, 75 bp, Artificial Sequence
  Synthetic
attatgtgcatgtggtctcttcaggctgaaaggaaggcccctcaagtgggtgaggaggacatgagattgatggtt

SEQ ID NO: 359114 - DNA, 75 bp, Artificial Sequence
  Synthetic
caccgcctccattgctgcaccccccttggggggtgcagcaatggaggcctttgtctgtctaaaggacaactgttg

SEQ ID NO: 359115 - DNA, 75 bp, Artificial Sequence
  Synthetic
tttcaggttctctgaacaacacatcaatgggcaatgctcttctgggcttgtcattggtaactgatccagatagaa

SEQ ID NO: 359116 - DNA, 75 bp, Artificial Sequence
  Synthetic
cagcactgaacatcaggcagtcgagaagcgcgcaatgtgggtttgttgtggcaggcgttgatccctttttcttgc

SEQ ID NO: 359117 - DNA, 75 bp, Artificial Sequence
  Synthetic
attgttctgcgctcaacttcacatccacgattttaaggtcctgtctcccatgcatgtcaaagagctttctgatat

SEQ ID NO: 359118 - DNA, 75 bp, Artificial Sequence
  Synthetic
catctgcgccttgtgcagtgaaaaccattgatttagggagatttctaattatggatgtgatcagacctggtctag

SEQ ID NO: 359119 - DNA, 75 bp, Artificial Sequence
  Synthetic
cattgatttagggagatttctaattatggatgtgatcagacctggtctagcatactcaacatctttcagaagtat

SEQ ID NO: 359120 - DNA, 75 bp, Artificial Sequence
  Synthetic
cgattctggctgatagatggcaaactcaacaggatcgtgtggcggcccctctatgtcaatccaagttgtgtcaga

SEQ ID NO: 359121 - DNA, 75 bp, Artificial Sequence
  Synthetic
ggtgattaaagtctccacacttctcttcacttgattttcgatttcaggctttagagtggatagtgaaggagcccc

SEQ ID NO: 359122 - DNA, 75 bp, Artificial Sequence
  Synthetic
ctttatttgtgatctggatgcaatatagggccaaccttcaccagagaggcatagtttgtagagcacattttcata

SEQ ID NO: 359123 - DNA, 75 bp, Artificial Sequence
  Synthetic
gggattccttagccctggtgtagggctcacaaacatcttctctctgttcttaatttctaatagggtcttgataat

SEQ ID NO: 359124 - DNA, 75 bp, Artificial Sequence
  Synthetic
taatttctaatagggtcttgataatggtagtaaatgtggattcctcaactttcaatgtctcaagcatgttaccac

SEQ ID NO: 359125 - DNA, 75 bp, Artificial Sequence
  Synthetic
tatcctgagatattgatctgcgaatcctcctgagtaattattttaagagatggatgtttctccataaggatctca

SEQ ID NO: 359126 - DNA, 75 bp, Artificial Sequence
  Synthetic
tggatgtttctccataaggatctcaagatcacccaggttggggtacttggctgtgtacaaaagacctagatcagt

SEQ ID NO: 359127 - DNA, 75 bp, Artificial Sequence
  Synthetic
gtctctcctccctgttcagccatgcatgagatcgtcacagctggcattgaaccaaattgattgatcatgagtgat

SEQ ID NO: 359128 - DNA, 75 bp, Artificial Sequence
  Synthetic
aggagctcagatcttcttgtcagttgtgttgtggacaggtttccttgatattgaccagtggagccagatgttctt

SEQ ID NO: 359129 - DNA, 75 bp, Artificial Sequence
  Synthetic
tcagttctctgtactttttgtcttaatttgtccaaatcactagagagttccatcagctcatctttggccaaagag

SEQ ID NO: 359130 - DNA, 75 bp, Artificial Sequence
  Synthetic
atttgtccaaatcactagagagttccatcagctcatctttggccaaagagcctacttttaagtacatgttctttt

SEQ ID NO: 359131 - DNA, 75 bp, Artificial Sequence
  Synthetic
agatttatgagatcactgtcatcccttttggtcctcctcatcatccgctggacacttgcaaccttcgcaaagtcc

SEQ ID NO: 359132 - DNA, 75 bp, Artificial Sequence
  Synthetic
tctaagggactgagtccaacgaaaggatggaattgattggtcattcatgtctctcaaaatgcgtagattcccaaa

SEQ ID NO: 359133 - DNA, 75 bp, Artificial Sequence
  Synthetic
cgcaccggggatcctaggctactctggagattgcgccatttgacgactttatcacaacaagttgtgattatcaca

SEQ ID NO: 359134 - DNA, 75 bp, Artificial Sequence
  Synthetic
atggggctcagatattccaaggatgtcaaagatcgatatggtgatagagagccagaagggagaattccgattaca

SEQ ID NO: 359135 - DNA, 75 bp, Artificial Sequence
  Synthetic
ttgaatatgcctcaaagcctttatggcagatacaattgcaagtcttgttggtttgccaacaaaggtctcctcaaa

SEQ ID NO: 359136 - DNA, 75 bp, Artificial Sequence
  Synthetic
tgtagcaatcactacctgtgtctaaagtgtctcacattgatgctcagaaggtcagactactgcggaatctgtggt

SEQ ID NO: 359137 - DNA, 75 bp, Artificial Sequence
  Synthetic
gaagttcttccaaagaaactggtgttcgaaaactcaccatcagcccccccgtacgaggcctagagccacggggcc

SEQ ID NO: 359138 - DNA, 75 bp, Artificial Sequence
  Synthetic
ccagggcacacccccagtcgggggtgtgccctcggggcccccggggccgggggccccgggttgttcactctattt

SEQ ID NO: 359139 - DNA, 75 bp, Artificial Sequence
  Synthetic
ctagcggtcttgggtttgtggaggcacttctgcacttcctacccttgagcttgaattgtcccccatcgtcagcaa

SEQ ID NO: 359140 - DNA, 75 bp, Artificial Sequence
  Synthetic
tcataatacaattgaggctgttgctgaaacatagagcaaaatcaccgaattcaacccagtctgattccgatttca

SEQ ID NO: 359141 - DNA, 75 bp, Artificial Sequence
  Synthetic
atatatttgcaaaggcaacttcataggattcaatcaataaacacagatcttcctgtgtcatgcggatgaagcacg

SEQ ID NO: 359142 - DNA, 75 bp, Artificial Sequence
  Synthetic
gattgctcttgctcatccttgttttcatgtaggtatgaagtgacttgagaaaaggtgtatgatctgctgcatcta

SEQ ID NO: 359143 - DNA, 75 bp, Artificial Sequence
  Synthetic
gggcttccagtgcaaggaacactgattttgacgttactgggacatcaagtctagagacaatggtgtctctttcta

SEQ ID NO: 359144 - DNA, 75 bp, Artificial Sequence
  Synthetic
tgatttggcctctgtacaggtgtagtgggctgagtccttgttctggtccttggaatttataagaaaacttgttcc

SEQ ID NO: 359145 - DNA, 75 bp, Artificial Sequence
  Synthetic
tcaattctttcacgtgctgtttaaaatcaagtttgaccttttgaaatactgatgatacctgtttaaattcaatag

SEQ ID NO: 359146 - DNA, 75 bp, Artificial Sequence
  Synthetic
attgatctgcaagaagcttgttgaagtcaatgagttcttttccagaaaacagagggtgcaatgggattaggccca

SEQ ID NO: 359147 - DNA, 75 bp, Artificial Sequence
  Synthetic
caccatccaggcttatgtgatgcccttgtgacccgctaacaaaacattcaatctcagacacttcaatttccagaa

SEQ ID NO: 359148 - DNA, 75 bp, Artificial Sequence
  Synthetic
tgtcaaccccgttcaccttgctcataatcaattcactttttcttatgataattttacatttaatgtgataattag

SEQ ID NO: 359149 - DNA, 75 bp, Artificial Sequence
  Synthetic
tttttctgtcatatttgaacttaaaacttctcctgacatgtgatacaactatgcctatctcaataggtacctgtt

SEQ ID NO: 359150 - DNA, 75 bp, Artificial Sequence
  Synthetic
caagtcctgattctaagataatcttgtcaaatgactcataatcacataaattcccccagtcaagtagatgtatga

SEQ ID NO: 359151 - DNA, 75 bp, Artificial Sequence
  Synthetic
agctactcaggtttataaatacatcactaagagtgattttactatgcacatatccaacgtctagatcatccaggc

SEQ ID NO: 359152 - DNA, 75 bp, Artificial Sequence
  Synthetic
tcatgcacctagaaacatttaaagttttgcagtccatgatgaactgagtgagctgacctaaatcatgatctgcat

SEQ ID NO: 359153 - DNA, 75 bp, Artificial Sequence
  Synthetic
cattaggaaggagttctacttcaccataccaaaagtactttttaaactgagaagtggttaatagtaccgggtgta

SEQ ID NO: 359154 - DNA, 75 bp, Artificial Sequence
  Synthetic
acattgattcgaatacaatttgatacaaaaaatttctacagatctcaagtgaatttagctgaaagccaccttcga

SEQ ID NO: 359155 - DNA, 75 bp, Artificial Sequence
  Synthetic
gaggagttgagtctctcatgtgagccaatgataactcattctgtttcactatgtatgactcctctcttttgcgcc

SEQ ID NO: 359156 - DNA, 75 bp, Artificial Sequence
  Synthetic
tcatgatgtgagaaatgactcccaaacactcactagacatatccattgcaacacagagatccaaaaatcttattc

SEQ ID NO: 359157 - DNA, 75 bp, Artificial Sequence
  Synthetic
tttggacccaagatatttttagagaacttaggtctgataaaaagggtgcaatgtgctcatcaaaaagatcaggga

SEQ ID NO: 359158 - DNA, 75 bp, Artificial Sequence
  Synthetic
aattccttttaatagaatagagcacatgattcatattcactttatcctccaactcagtatgactccctggcttaa

SEQ ID NO: 359159 - DNA, 75 bp, Artificial Sequence
  Synthetic
cacaccagaaaaaattaggattcactacacttgggatttttttaggtgtttctacacatgaaaagacccagttcc

SEQ ID NO: 359160 - DNA, 75 bp, Artificial Sequence
  Synthetic
ccaattcgcaggcatttgtgaataccagtgaaaaataatcccataagagtgaccttgagtacttagagattcttt

SEQ ID NO: 359161 - DNA, 75 bp, Artificial Sequence
  Synthetic
ccagtgcagacttacagtaaacgctaaacctaggtttgcaggtttcacaagtatggtggcacacaacttcactta

SEQ ID NO: 359162 - DNA, 75 bp, Artificial Sequence
  Synthetic
gcaatgattttatatacacaaatccaccagacccatctctgacacacttggaacccatactcttgcacacaccta

SEQ ID NO: 359163 - DNA, 75 bp, Artificial Sequence
  Synthetic
tgaacccagaacaaacactgctttgaaatgcagatttgttgattgcatctgtaacaatctttttagctcctctca

SEQ ID NO: 359164 - DNA, 75 bp, Artificial Sequence
  Synthetic
caaagttttttgagagttttgactgaacagatctaataagagatggcacctcttccctatccaagattcttgtgc

SEQ ID NO: 359165 - DNA, 75 bp, Artificial Sequence
  Synthetic
ctgacataatcttagttcttaagacaagtcttaagtcaccaaaggccctcaggttcaaccacctaatctcaatta

SEQ ID NO: 359166 - DNA, 75 bp, Artificial Sequence
  Synthetic
atttctcaattgtctgatcatcaacctcagttatcctcaacatttgcctaaggcaatcatcaggagaggattgga

SEQ ID NO: 359167 - DNA, 75 bp, Artificial Sequence
  Synthetic
gagcattcacaagatattcttcttgtatgtctcctgacctaattttataaaaaagttttttacaagagtttctga

SEQ ID NO: 359168 - DNA, 75 bp, Artificial Sequence
  Synthetic
taatcgacagttgtttgtcatcagcaataattgattcaattgatctttggagacgataacccctagatccatcca

SEQ ID NO: 359169 - DNA, 75 bp, Artificial Sequence
  Synthetic
cccagtccttcaaatctgtctcaacaacacacagaaaggggtcaattggatgaccactgtaacttatcaatctat

SEQ ID NO: 359170 - DNA, 75 bp, Artificial Sequence
  Synthetic
tagtccttttagaaatttcttttataatcttgattgagacgccattagctacacattgatccagaattgtgtcca

SEQ ID NO: 359171 - DNA, 75 bp, Artificial Sequence
  Synthetic
cagtttcagccagttgatggggtgattttgccttcacattatgcaatgcagctgcaacaaactttgttaataaag

SEQ ID NO: 359172 - DNA, 75 bp, Artificial Sequence
  Synthetic
gaacttcttgtgaccaaatgaaaaaccttgacttgaattcactcgcaaaagaacctgccacagtcttaggactaa

SEQ ID NO: 359173 - DNA, 75 bp, Artificial Sequence
  Synthetic
caaatttgttcagttttgaagacaaataataatgaaattctaatagttccccacacttttgaatgtccaatgatt

SEQ ID NO: 359174 - DNA, 75 bp, Artificial Sequence
  Synthetic
catcactcttatctttcaatgaatgtgaattgctcaacatgatctcatcatcactcgatgtgtaagcagtcattc

SEQ ID NO: 359175 - DNA, 75 bp, Artificial Sequence
  Synthetic
tcacatcaaaacacaattctaaacacaacatgataaactgttctgttacaagaccataataatctgatgtgttgt

SEQ ID NO: 359176 - DNA, 75 bp, Artificial Sequence
  Synthetic
gtaatataccttgacccatgtccaaaacagaagagatgtgagaaggcacttgacccttagcaaaccagttgaaga

SEQ ID NO: 359177 - DNA, 75 bp, Artificial Sequence
  Synthetic
tgaaatcctcacaaactgtacttgacatcttgtccatgagtcctaaacctctttttgtgtaacctttaagatatg

SEQ ID NO: 359178 - DNA, 75 bp, Artificial Sequence
  Synthetic
cctcaataacattgtatggaacttcaaccagtttgtgtaagtgccaattgaggagattctcaatgggactcttat

SEQ ID NO: 359179 - DNA, 75 bp, Artificial Sequence
  Synthetic
caatcaagcttccatccctcaattgtaaatcaagacttgtgaacaaagagttgaaaatcgcgggtgacatgtatg

SEQ ID NO: 359180 - DNA, 75 bp, Artificial Sequence
  Synthetic
gaccccattttgagtgatccagactcactgctaatcctgagagtcgcacaacagacttcatatccaatatcgcct

SEQ ID NO: 359181 - DNA, 75 bp, Artificial Sequence
  Synthetic
tttcaaactcagagtcattatttaaacaagaaaacttactctctgatgttattgattcaaaatagtcctcaatca

SEQ ID NO: 359182 - DNA, 75 bp, Artificial Sequence
  Synthetic
atctactggtgagctttgtgttcaagtcaccaacataaagttccctattactcccaacttgttccttatatgata

SEQ ID NO: 359183 - DNA, 75 bp, Artificial Sequence
  Synthetic
atccaaacttcagctttcctgtactggatgaaactgttgactgaaaggttggagattcttcagaataaaaacata

SEQ ID NO: 359184 - DNA, 75 bp, Artificial Sequence
  Synthetic
aatttctaagggatgagtttgtaaaaaaacttttatcaagcctctttgaaactgcttcagagttgctctctctga

SEQ ID NO: 359185 - DNA, 75 bp, Artificial Sequence
  Synthetic
gacttattctggatttttccttcacatggtatgcagcatctttaaacccaagtctggatctacttctatggtcat

SEQ ID NO: 359186 - DNA, 75 bp, Artificial Sequence
  Synthetic
acctaccaactctattatcaaacccagcagatatcagtatgtatttaaaacattcaaaaaaatccttttcaatga

SEQ ID NO: 359187 - DNA, 75 bp, Artificial Sequence
  Synthetic
agttctttgtcgttaaattttttacaagcaactctaagggacaaaacctcaacacatcatctaaaaagaattgct

SEQ ID NO: 359188 - DNA, 75 bp, Artificial Sequence
  Synthetic
ccttaagctcactgttaaagatcaattcacacaattcctgataagtttcaaacgagaaaattgatgggtcaaaat

SEQ ID NO: 359189 - DNA, 75 bp, Artificial Sequence
  Synthetic
ctttcacctcatgtagtgaagtctcagctaaaatgggtcccatcaactctctggaccacaatctccccagcaaat

SEQ ID NO: 359190 - DNA, 75 bp, Artificial Sequence
  Synthetic
caggaccctcatacctctgtgttatttcttgccctttgataactttcctcactggcggtgtggccatattgctca

SEQ ID NO: 359191 - DNA, 75 bp, Artificial Sequence
  Synthetic
agcactcaaggacattggattctatatcactgatcaatctacatgtgtcctcatcaagaaactcttcaaaatctt

SEQ ID NO: 359192 - DNA, 75 bp, Artificial Sequence
  Synthetic
cacaattctcattgatgtgatttttttcattgagattctttgtgagcaccatattagttaatcttctatagatgg

SEQ ID NO: 359193 - DNA, 75 bp, Artificial Sequence
  Synthetic
catattggacacttttcctatcaagcttataccttagtttgtctttaaaagattgtgccatttcaaccaccactg

SEQ ID NO: 359194 - DNA, 75 bp, Artificial Sequence
  Synthetic
atgacaaaaggttctggtaatcataatgtgtgattatctcaccaacttcatccagtttaggtacaacaacacttt

SEQ ID NO: 359195 - DNA, 75 bp, Artificial Sequence
  Synthetic
tgttactagaaatatcaagagctgtactactaaatgagggtgattggggatcattttgtaaaaccttgcccactg

SEQ ID NO: 359196 - DNA, 75 bp, Artificial Sequence
  Synthetic
taagcattccacagttaaaacaggaggtgcataatgataagatttccttggacaaacctgggctttctaaatcat

SEQ ID NO: 359197 - DNA, 75 bp, Artificial Sequence
  Synthetic
tggtgtgaagatcttttgaaaaaagattatttatgtccttaacaaatttgtcctcaatttccttcggtaaactag

SEQ ID NO: 359198 - DNA, 75 bp, Artificial Sequence
  Synthetic
gtgatgaatccagattgacaaatgcggaaccaaactgtaattttggctctaagaacttttcaaaacattttattt

SEQ ID NO: 359199 - DNA, 75 bp, Artificial Sequence
  Synthetic
gatctgttaatctatcaggggtttctttggtgataaagtgacataaataagacaaattcaacacaaacttgaaga

SEQ ID NO: 359200 - DNA, 75 bp, Artificial Sequence
  Synthetic
tcttagccatattttcttctaaagcttcctccaacaaacatacaaccaactcatccattaacacaaatacatgat

SEQ ID NO: 359201 - DNA, 75 bp, Artificial Sequence
  Synthetic
gttctgcagaagtcaatgcctgaacacttaacttctcattcaatcttttgaagtgaaactcatttacaaaggcca

SEQ ID NO: 359202 - DNA, 75 bp, Artificial Sequence
  Synthetic
taatgaaatatctaaaaccttgcaaataaatttgaacccttttactaggaactgtgagaacgtttataactaatg

SEQ ID NO: 359203 - DNA, 75 bp, Artificial Sequence
  Synthetic
tgaatagtttggtccttatcatattcgtctcttcatttgttaaccaatctaaccatgataacatttcttcacatg

SEQ ID NO: 359204 - DNA, 75 bp, Artificial Sequence
  Synthetic
ttttcaaaataacatttgaactcatgattggtaaaaagaatcttttgggatctgcgtaaaaactctgacccactc

SEQ ID NO: 359205 - DNA, 75 bp, Artificial Sequence
  Synthetic
tatacacatcagacagttcatcatcatttaacatcaggccataacaccttgatttctcacccgtcttttgatata

SEQ ID NO: 359206 - DNA, 75 bp, Artificial Sequence
  Synthetic
aaagaatactattatatgagctgtctaaatcttggaaatagcattcctcacattgaactgtcccataaaaacttt

SEQ ID NO: 359207 - DNA, 75 bp, Artificial Sequence
  Synthetic
tctcatcattgatcaccagcttagttgctgaacttgttttcattgagttcatcattcctaagctcaaactcgata

SEQ ID NO: 359208 - DNA, 75 bp, Artificial Sequence
  Synthetic
atgcatcaaggtattccaaaaaaacctcttcattgaaaatcttatctgttccaaattcaacctgataacagacac

SEQ ID NO: 359209 - DNA, 75 bp, Artificial Sequence
  Synthetic
gctcactttgccttttgtatctcaatgttggcttttcatacctagcagagtgctccctttcaaatttaaattcat

SEQ ID NO: 359210 - DNA, 75 bp, Artificial Sequence
  Synthetic
accaaaattcgtaatctaattccttcaaccatgttatcacatagtcaagattgtaaggtttaattcttttactta

SEQ ID NO: 359211 - DNA, 75 bp, Artificial Sequence
  Synthetic
gcttgcctttaacattaccaagccagtcaggttgttttaataattttttctctaacttgttgattattaaatcta

SEQ ID NO: 359212 - DNA, 75 bp, Artificial Sequence
  Synthetic
cagacaacaatctgtcattaacacttttgaaatggttgttgattagaaattgactgctgttgatttttagtttaa

SEQ ID NO: 359213 - DNA, 75 bp, Artificial Sequence
  Synthetic
tcatctcaatcagactattgagaacaatcacatcaagacaaagtagtgtgtgtcttcttgtattaagaaccttca

SEQ ID NO: 359214 - DNA, 75 bp, Artificial Sequence
  Synthetic
aaccttttattttattacaatctgaaagtagttttttatgtctcgatatctctttatcatttgtaggagtatagt

SEQ ID NO: 359215 - DNA, 75 bp, Artificial Sequence
  Synthetic
tagatgatactctcttgctgtggaccaactcggcaataacccttaacatatgattctgacaaaaaccacaacgct

SEQ ID NO: 359216 - DNA, 75 bp, Artificial Sequence
  Synthetic
cattgttaaaaaaggtgccttcgctaccatttattaatgaggtcaatttatgatcctttaaccactcaatcatct

SEQ ID NO: 359217 - DNA, 75 bp, Artificial Sequence
  Synthetic
ctgatctagaagttctgcaatacacgttttgatattgtccactatctcttaataggcagaattgatcataaactt

SEQ ID NO: 359218 - DNA, 75 bp, Artificial Sequence
  Synthetic
tggcaattcctattctacactcggaagctgtaaggttgggccttattccatctctgattgcttccatcaactttg

SEQ ID NO: 359219 - DNA, 75 bp, Artificial Sequence
  Synthetic
tcttgtaatcaagaccctcttctctcagagctttaagtgattcaagtcccaagttttgattttccatgctggaaa

SEQ ID NO: 359220 - DNA, 75 bp, Artificial Sequence
  Synthetic
gactagatatcaagcggttgtactctagctcttcaattctttctccagtgtcttttacattatccattaatttga

SEQ ID NO: 359221 - DNA, 75 bp, Artificial Sequence
  Synthetic
gtagcagccatctaatcctttccacaacccaatctgggaaccggtccacgtaataatttgaccttccgtcaatca

SEQ ID NO: 359222 - DNA, 75 bp, Artificial Sequence
  Synthetic
caggaacaaggataagaccacacttgctcaaatctttagacaactgaattagtttctcaaaatcatgtttatatt

SEQ ID NO: 359223 - DNA, 75 bp, Artificial Sequence
  Synthetic
tttgctcaaatgactcctggttgactcgaacaaaggtttccaagagaattattgtggaacctgacactctatatc

SEQ ID NO: 359224 - DNA, 75 bp, Artificial Sequence
  Synthetic
cgtctggaacaacgtctggaagtgttgggccaattatcctgtggtccttcaaaatctgattcactgtcttgtttc

SEQ ID NO: 359225 - DNA, 75 bp, Artificial Sequence
  Synthetic
tgttgaacacacacccatgtttcaagcatgagtctatttcaataagcattgacagcaactttaatccttcagtga

SEQ ID NO: 359226 - DNA, 75 bp, Artificial Sequence
  Synthetic
taattgatgaagggttcacttgagagaggaatgttgttttttgctcagtgtaggcctcttcatcgggcacccact

SEQ ID NO: 359227 - DNA, 75 bp, Artificial Sequence
  Synthetic
ttctaataagatccttgagctcatttatacgatcattacaatcaaccatgatcaagaaacgcctaggatcctcgg

SEQ ID NO: 359228 - DNA, 75 bp, Artificial Sequence
  Synthetic
aataagatccttgagctcatttatacgatcattacaatcaaccatgatcaagaaacgcctaggatcctcggtgcg

SEQ ID NO: 359229 - DNA, 75 bp, Artificial Sequence
  Synthetic
agcattctctttggtttctcattggaaactgaacctgatataacagcactgaacattatgcagtcaagaagtgca

SEQ ID NO: 359230 - DNA, 75 bp, Artificial Sequence
  Synthetic
gttatcccatgctctaccttttatctgtgatcgtgaggcaatgtaaggccagccttcaccagatagacatagttt

SEQ ID NO: 359231 - DNA, 75 bp, Artificial Sequence
  Synthetic
cgcacagaggatcctaggcatttttgacttgcgcaactaaacgaacttgtttcattgccccataatggggcagct

SEQ ID NO: 359232 - DNA, 75 bp, Artificial Sequence
  Synthetic
cgcactgaggatcctaggcatttttgacttgcgcaactaaacgaacttgtttcattgccccataatggggcagct

SEQ ID NO: 359233 - DNA, 75 bp, Artificial Sequence
  Synthetic
cgcaccgaggatcctaggcatttttgacttgcgcaactaaacgaacttgtttcattgccccataatggggcagct

SEQ ID NO: 359234 - DNA, 75 bp, Artificial Sequence
  Synthetic
cgcacggaggatcctaggcatttttgacttgcgcaactaaacgaacttgtttcattgccccataatggggcagct

SEQ ID NO: 359235 - DNA, 75 bp, Artificial Sequence
  Synthetic
ggtctcattctttggggaaatcccatcaattgttaacgaagctttaaatattgccttaatagcagttagcatcat

SEQ ID NO: 359236 - DNA, 75 bp, Artificial Sequence
  Synthetic
atcaattctaaagggcctcatcaacatatggaagagtggtctattgcagctcattgtttttttactgatggctgg

SEQ ID NO: 359237 - DNA, 75 bp, Artificial Sequence
  Synthetic
aagatcttgttcatacaaaataggccatcacatagagcttgagcatatagttctgaatgcatctcacatcacacc

SEQ ID NO: 359238 - DNA, 75 bp, Artificial Sequence
  Synthetic
ctatgtgccaatggcatgcatgattaatcacacagattttctgctgaggggtccatttgaggcgagatgggctgt

SEQ ID NO: 359239 - DNA, 75 bp, Artificial Sequence
  Synthetic
caatataaggatcaccggtgtaacaacccttgtggagaccgctggaggcacatctaggagggctgaggtgatgaa

SEQ ID NO: 359240 - DNA, 75 bp, Artificial Sequence
  Synthetic
cattagcagatgcttcacgtatgctcaagataacaaattggtggactttaccatggagtggttccttggtggatt

SEQ ID NO: 359241 - DNA, 75 bp, Artificial Sequence
  Synthetic
agaacacaaccctcattttgctccacaaatcctctgtggaaacagcagtaaaggagagtatgatgtccagatgaa

SEQ ID NO: 359242 - DNA, 75 bp, Artificial Sequence
  Synthetic
cataactgtggaagatcattgcaatcagatcttcctcaaaatgaagaagatttttgggattttcaaggacccttg

SEQ ID NO: 359243 - DNA, 75 bp, Artificial Sequence
  Synthetic
tacatctaaaggaaaactgaatatgttattcaaagtcagtaattggactaatcaatgttccggaaatcatttgag

SEQ ID NO: 359244 - DNA, 75 bp, Artificial Sequence
  Synthetic
caccatgcacctcataatacagaatgcctacaaacagatgatcaaacctagaagtttaaagagtttcttttcctg

SEQ ID NO: 359245 - DNA, 75 bp, Artificial Sequence
  Synthetic
gtcattgtctgatgccacaggaaatgacttgccgggtggctactgtttggagaaatggatgcttatttcgagtga

SEQ ID NO: 359246 - DNA, 75 bp, Artificial Sequence
  Synthetic
attaaagtgttttggaaatactgccatagctaagtgtaacttagagcacaactcagagttctgtgacatgctcag

SEQ ID NO: 359247 - DNA, 75 bp, Artificial Sequence
  Synthetic
gctatttgagtttaataagaatgcaattaaaacacttcagaataaaaccaaacatcaattggacactgttataac

SEQ ID NO: 359248 - DNA, 75 bp, Artificial Sequence
  Synthetic
cgctgtcaattccctaatctcggacaacatcctaatgaagaatagagtaagggagctcatcaacatcccttattg

SEQ ID NO: 359249 - DNA, 75 bp, Artificial Sequence
  Synthetic
taattacactaaattttggtacatcaaccatactggactcaatgttcattcattacccagatgttggctcacaaa

SEQ ID NO: 359250 - DNA, 75 bp, Artificial Sequence
  Synthetic
gaatggtagttacttaaatatatctgattttagaaatgattggcttttggaaagtgatcatctaatctctgaaat

SEQ ID NO: 359251 - DNA, 75 bp, Artificial Sequence
  Synthetic
tttgaatagagaatatgaagaaaggcaaagtaggacaccactgggcttagtggatgtgtgcttctggagcatctt

SEQ ID NO: 359252 - DNA, 75 bp, Artificial Sequence
  Synthetic
gttttacacctcatcaattttcttacatctactaagaataccaactcatagacacattgttggtgaaggatgtcc

SEQ ID NO: 359253 - DNA, 75 bp, Artificial Sequence
  Synthetic
aaaaccacatagactttcaagtgaatcattgtgtgcatgtggtctttttaaacagaaaggaagaccattaaggtg

SEQ ID NO: 359254 - DNA, 75 bp, Artificial Sequence
  Synthetic
ggtcaggaaagtgtagaacaccaaccagaacagcctccattgctgcaccccttttgggggtgcagcaatggaggc

SEQ ID NO: 359255 - DNA, 75 bp, Artificial Sequence
  Synthetic
cctctttatggtcttaaaggacaactgttgtttcaggttccctgaagagtagatcaatgggaagcatcctcttag

SEQ ID NO: 359256 - DNA, 75 bp, Artificial Sequence
  Synthetic
gtttctcattggagactgatcctgatatgacagcactaaacattatgcagtcaagaagtgcacagtgtgcattgg

SEQ ID NO: 359257 - DNA, 75 bp, Artificial Sequence
  Synthetic
ttgtggcgggtgttgaccccttcttcttgctctttatcactatccctttatgtttgtcacatagatgctcaaatc

SEQ ID NO: 359258 - DNA, 75 bp, Artificial Sequence
  Synthetic
tcttccaaacaagatcttcaaaaattcgtgactcttctgcactcagctttacatcaacaatttttaaatcttgtc

SEQ ID NO: 359259 - DNA, 75 bp, Artificial Sequence
  Synthetic
tgccatgcatatcaaagagttttctaatgtcatctgcaccttgtgcagtgaaaaccattgatttaggcagactcc

SEQ ID NO: 359260 - DNA, 75 bp, Artificial Sequence
  Synthetic
tgattattgatgagatgagacctggtcgtgcatactcaacatccttcaatagtatcccatggcagtacttgcttt

SEQ ID NO: 359261 - DNA, 75 bp, Artificial Sequence
  Synthetic
gatccttgaaagattttatgtcattaggtctcctgtaacagtgtatatatctttgtgattctggttggtagatgg

SEQ ID NO: 359262 - DNA, 75 bp, Artificial Sequence
  Synthetic
cgaattcaacagggtcatttggtggtccctcaatgtcgatccatgttgtatcgttaagaagtaatgactccacac

SEQ ID NO: 359263 - DNA, 75 bp, Artificial Sequence
  Synthetic
tccttttcacttgattctcaatttcaggtttgagtgttgttaacaaaggagcacctccatttcttattggcacat

SEQ ID NO: 359264 - DNA, 75 bp, Artificial Sequence
  Synthetic
aggtttgagtgttgttaacaaaggagcacctccatttcttattggcacatgctccttattcggaacactatcaaa

SEQ ID NO: 359265 - DNA, 75 bp, Artificial Sequence
  Synthetic
ctcaacaactgtgttatcccatgctctacctttgatctgtgatcgtgaggcaatgtaaggccagccttcaccaga

SEQ ID NO: 359266 - DNA, 75 bp, Artificial Sequence
  Synthetic
aaggcatagtttatacaacacattttcgtaagggtttctctgtccaggggtggaactgacaaacattttctcttt

SEQ ID NO: 359267 - DNA, 75 bp, Artificial Sequence
  Synthetic
gttcttgatttccaacagggtcttgacaattgttgtgaacgttgattcttcaacctttattgtttcgagcatgtt

SEQ ID NO: 359268 - DNA, 75 bp, Artificial Sequence
  Synthetic
gccaccatcaataagacaggcccctgctttcacagcagctgacagactaaggttataaccagaaatattgatctg

SEQ ID NO: 359269 - DNA, 75 bp, Artificial Sequence
  Synthetic
tgaatcctcttgagtgatgatctttaaggaaggatgcttcaccgttaaagccttgaggtcagttagatttgggta

SEQ ID NO: 359270 - DNA, 75 bp, Artificial Sequence
  Synthetic
ctttgctgtatatagaagcccaaggtcagtgaggccctgaacaacatcattgagagactcccctccctgctcagt

SEQ ID NO: 359271 - DNA, 75 bp, Artificial Sequence
  Synthetic
catacaagagattgtaacagctggcacagatccaaattggttgatcaagagtgtagagtcctttatatcccatat

SEQ ID NO: 359272 - DNA, 75 bp, Artificial Sequence
  Synthetic
ctttactgttcccccagtcgctgccaagctgggtctctgtatgccaacaagttgcaggatctcagacctccttgt

SEQ ID NO: 359273 - DNA, 75 bp, Artificial Sequence
  Synthetic
cagttgtgtacttgaaagattcccttgatactgtccagtggtattgcccaacctttcagttctctgtaccttttg

SEQ ID NO: 359274 - DNA, 75 bp, Artificial Sequence
  Synthetic
tcttaatttctccaagtcactggagagttccattagttcatccttggacaaagatcccactttcaagaacatgtt

SEQ ID NO: 359275 - DNA, 75 bp, Artificial Sequence
  Synthetic
cttctggtttgacttcatggtcatcagtgaatctacttccttattcaggtctcttagtccagtgagatcactatc

SEQ ID NO: 359276 - DNA, 75 bp, Artificial Sequence
  Synthetic
gtctcttttgaccctcctcatcattctttgaacacttgcaacctttgcaaaatccaatccagatagaagtgctct

SEQ ID NO: 359277 - DNA, 75 bp, Artificial Sequence
  Synthetic
tgtgtctgtgagcacatctgccttgacgttggttgtccaggcggaaagccccctcctaagagattgggtccagcg

SEQ ID NO: 359278 - DNA, 75 bp, Artificial Sequence
  Synthetic
aaaggatggcactgattggtcgctcattgtgattgcctttttgcgctgatttcctatcaagcctaggatcctctg

SEQ ID NO: 359279 - DNA, 75 bp, Artificial Sequence
  Synthetic
gatggcactgattggtcgctcattgtgattgcctttttgcgctgatttcctatcaagcctaggatcctctgtgcg

SEQ ID NO: 359280 - DNA, 75 bp, Artificial Sequence
  Synthetic
cgcaccgaggatcctaggctattctggagattgcgcaattgaactcttttgacccagtgtcagaacagattgcaa

SEQ ID NO: 359281 - DNA, 75 bp, Artificial Sequence
  Synthetic
taatggggcttaggtattcaaaggaagtcagggatcggtatggtgacaaagagccagagggaagaattcctatta

SEQ ID NO: 359282 - DNA, 75 bp, Artificial Sequence
  Synthetic
cattgaacatgcctcagactctttatggtagatacaattgcaaatcttgctggtttgcaaacaagggcctcctta

SEQ ID NO: 359283 - DNA, 75 bp, Artificial Sequence
  Synthetic
agtgtagtaatcattatctatgtttaaaatgtctcacattgatgcttgggagatctgattactgtgggatttgtg

SEQ ID NO: 359284 - DNA, 75 bp, Artificial Sequence
  Synthetic
gcgaggttctgccaaaaaaactggtattcgaaaattcgccatcagcccccccatacgaggcctaaggccacgggg

SEQ ID NO: 359285 - DNA, 75 bp, Artificial Sequence
  Synthetic
ccccagggcacacccccagctgggggtgtgccctcggggccccccgggcccaggggcccgggaatgctcactcta

SEQ ID NO: 359286 - DNA, 75 bp, Artificial Sequence
  Synthetic
tttctagtggtcttggacatgtggaggcactcctgcactttctgccttttagcttaaattggcctccatcatcgg

SEQ ID NO: 359287 - DNA, 75 bp, Artificial Sequence
  Synthetic
caatcatgatgcagttgaggctattgctgaagcataaagcaaaatcaccaaactcaatccagtctgattcaagct

SEQ ID NO: 359288 - DNA, 75 bp, Artificial Sequence
  Synthetic
tgagaacgccaatgaaggctgcctcataggactcaatcagtagacacaggtcctcctgagtcatgcggatgaagc

SEQ ID NO: 359289 - DNA, 75 bp, Artificial Sequence
  Synthetic
aaggattgcttttgctcattctggttttcatataagtgtggagtgaggtgagaaaagtggtgtgttctgctggat

SEQ ID NO: 359290 - DNA, 75 bp, Artificial Sequence
  Synthetic
ccaaagcctccaatgccaagaacactgattttgatgagattgggacatctagccttgaaacaattgtgtttcttt

SEQ ID NO: 359291 - DNA, 75 bp, Artificial Sequence
  Synthetic
ccataatttgacctttatataagtgtagtggactaagcccttgttctggtccttgaaacttgtaagagaacttat

SEQ ID NO: 359292 - DNA, 75 bp, Artificial Sequence
  Synthetic
ttcttaaatcctttgtgtgctgtctaaaatcaagcctgactctctgaaaaactgttgatgtctgtctaaactcaa

SEQ ID NO: 359293 - DNA, 75 bp, Artificial Sequence
  Synthetic
ctgactgatctactaaaagtttgttaaaatctatgagttccttcccagaaaacaaaggatgcaatggaatgagtc

SEQ ID NO: 359294 - DNA, 75 bp, Artificial Sequence
  Synthetic
cgacgccatccaaacttatatgatgtccttctgagccacttacaaagcattgaacctctgaaacctcaatctcca

SEQ ID NO: 359295 - DNA, 75 bp, Artificial Sequence
  Synthetic
aaatgttatcctcatcccatctgttcatcatcatttcatccttgtctattattagtctgcattcaatgtgataat

SEQ ID NO: 359296 - DNA, 75 bp, Artificial Sequence
  Synthetic
tagttttcctatcatacttgaacttgaaacttctcctaatgtgcgagagtactatgcctatttcaataggtgtct

SEQ ID NO: 359297 - DNA, 75 bp, Artificial Sequence
  Synthetic
gcttttgtcctgttttgaggatgatgtcatcaaatgactcatagtcatttaaacttccccagtcaagtaaatgca

SEQ ID NO: 359298 - DNA, 75 bp, Artificial Sequence
  Synthetic
tgaaactgctcaaatttatgaatatgtcactcagtgttattttactatgtacataaccaacgtccaaatcatcta

SEQ ID NO: 359299 - DNA, 75 bp, Artificial Sequence
  Synthetic
aactcatgcatctggagatattcagagttttgcagtccataatgaattgagtgagttggcccaaatcatggtctg

SEQ ID NO: 359300 - DNA, 75 bp, Artificial Sequence
  Synthetic
catcattagggaggagctccacttcaccataccaaaaatactttttaaattgagaagttgttaataaaactgggt

SEQ ID NO: 359301 - DNA, 75 bp, Artificial Sequence
  Synthetic
gcaacattgattcaaatattatctgatataagaaatttctacaaatctcaagtgaatttaattgaaatccccctt

SEQ ID NO: 359302 - DNA, 75 bp, Artificial Sequence
  Synthetic
ccaagggatttgaatctctgacatgagcatgtgacaactcattttgtttcactatgtacgactcctctcttttac

SEQ ID NO: 359303 - DNA, 75 bp, Artificial Sequence
  Synthetic
gcctcataatgtgggaaataacccctaaacactcactagacatgtccatagcgacacaaaggtctaaaaacttaa

SEQ ID NO: 359304 - DNA, 75 bp, Artificial Sequence
  Synthetic
ttctctgaacccaggatatttttaaagaagcaaggtctgacaaaaaaggtgcaatgtgctcatcaaagagatcag

SEQ ID NO: 359305 - DNA, 75 bp, Artificial Sequence
  Synthetic
ggaaattcctcttgatagaatagagaacatgattcatgttgaccttgtcctccagctcagtgtggcttccaggtt

SEQ ID NO: 359306 - DNA, 75 bp, Artificial Sequence
  Synthetic
tgacacaccaaaaaaagttggggtttaccatagttgggactctcttaggtaacattgcttctgaaaaaacccagt

SEQ ID NO: 359307 - DNA, 75 bp, Artificial Sequence
  Synthetic
tccctaactcacaagcatttgtaaacaccagtgaataatagtcccacaaaagtgaccttgaatactttgggagtc

SEQ ID NO: 359308 - DNA, 75 bp, Artificial Sequence
  Synthetic
tatccaaagcacttttgcaaaacacactgagtttgggtttacaaattccacaagcttgatggtccttgatttctc

SEQ ID NO: 359309 - DNA, 75 bp, Artificial Sequence
  Synthetic
tcaacagcattttgatataaacaaaaccaccagtaccgtctctaacacatttggaacccatacttttacacaacc

SEQ ID NO: 359310 - DNA, 75 bp, Artificial Sequence
  Synthetic
ctatgaacccagagcatatactgctttgaaaagcagatttattgattgcgtctgtgacaatctttttagcccccc

SEQ ID NO: 359311 - DNA, 75 bp, Artificial Sequence
  Synthetic
tcacaaaattctttgagagttttgattgcacagatttgatcagtgatggtatctcttctctatccaagatccttg

SEQ ID NO: 359312 - DNA, 75 bp, Artificial Sequence
  Synthetic
tgcctgacataattttagttcttaagactagtcttaaatcaccaaaggttcttagattcaaccatcttgtttcaa

SEQ ID NO: 359313 - DNA, 75 bp, Artificial Sequence
  Synthetic
ctaggtcctcaatctcttgttcattcacttcagtaatgctcaacatctgtctgaggcattcatcaggagaagatt

SEQ ID NO: 359314 - DNA, 75 bp, Artificial Sequence
  Synthetic
gaagggcacttataagatactcttcttgtatatttcctgatcttattttaaaaaagagtttcttacaagaatttc

SEQ ID NO: 359315 - DNA, 75 bp, Artificial Sequence
  Synthetic
ttataatcgagagttgtgtgtcatcaccaatggctgactctatggacctttgaagacggtaacctcttgatccgt

SEQ ID NO: 359316 - DNA, 75 bp, Artificial Sequence
  Synthetic
ccacccagtccttaagatctgtgtcaacaacacataaaaaagggtcaattggatgaccactatatttgatcagtc

SEQ ID NO: 359317 - DNA, 75 bp, Artificial Sequence
  Synthetic
tattagtccttttggagatctcttttacaatctcaattgagacaccattagccacacattgatcaagaattgtgt

SEQ ID NO: 359318 - DNA, 75 bp, Artificial Sequence
  Synthetic
ctatagtttccgctagttgatgaggtgattttgctttcacattatgtagtgcagctgcaacaaatttagtcaata

SEQ ID NO: 359319 - DNA, 75 bp, Artificial Sequence
  Synthetic
agggcacttcttgtgaccaaataaaaaatcttgatttgaattcacttgcgaaggatccagcaacagttttggggc

SEQ ID NO: 359320 - DNA, 75 bp, Artificial Sequence
  Synthetic
taacaaacttattcaattttgaagatagataataatggaactcaagaagttctttacacttaagattatttaatg

SEQ ID NO: 359321 - DNA, 75 bp, Artificial Sequence
  Synthetic
attcattatcagaattccttaatgaaaatgaattacttaagattatttcatcatcacttgacgtgtaggcagaca

SEQ ID NO: 359322 - DNA, 75 bp, Artificial Sequence
  Synthetic
tctttacatcaaagcactgttctaaacacaacatgataaattgctcagtaaccaacccataataatctgatgtgt

SEQ ID NO: 359323 - DNA, 75 bp, Artificial Sequence
  Synthetic
tgtgtaaaattccctgacccatatctaatacagaagaaatgtgggaggggaccacacctctggcaaaccagttga

SEQ ID NO: 359324 - DNA, 75 bp, Artificial Sequence
  Synthetic
aaataaagttttcacagattgtgtttgacatcctatccatgagtcccaaacctctctttgtgtaacccttgaggt

SEQ ID NO: 359325 - DNA, 75 bp, Artificial Sequence
  Synthetic
atgcctcaataacattgtaaggaacctcaactaacttgtgcaaatgccaattgaggaggttttcaataggaccct

SEQ ID NO: 359326 - DNA, 75 bp, Artificial Sequence
  Synthetic
tgtcaattgaggtcccatcttttagttgcaaatcaaggtttgagaacagggcattgaaaatagcaggggacatat

SEQ ID NO: 359327 - DNA, 75 bp, Artificial Sequence
  Synthetic
aagggccccattttgaatggtccatgctcaccgctagccctgagagtcgcaccacagacttcatatccaatattg

SEQ ID NO: 359328 - DNA, 75 bp, Artificial Sequence
  Synthetic
ccttttcaaactcaagctcattgtttaagcaggaaaatttactctctgatgtgattgattcaaagtagtcctcaa

SEQ ID NO: 359329 - DNA, 75 bp, Artificial Sequence
  Synthetic
tcaatctactagtgagttttgtatttaaatcaccaacatatagctctctattacttccaacttgttctttatatg

SEQ ID NO: 359330 - DNA, 75 bp, Artificial Sequence
  Synthetic
acaatccaaacttaagttttcctgtactggaagaaaccgttgattgaaaggttggtgattcttcagaataaaagc

SEQ ID NO: 359331 - DNA, 75 bp, Artificial Sequence
  Synthetic
ataaatttctaagggatgagtttgtaaagaaacttttatcaagcctttttgaaattgcttcagaattgctttctc

SEQ ID NO: 359332 - DNA, 75 bp, Artificial Sequence
  Synthetic
tgagacttattctagaagcctccttcacatgatatgcagcatctttgaatccaagcctagacctactcctgtgat

SEQ ID NO: 359333 - DNA, 75 bp, Artificial Sequence
  Synthetic
cgtatcttccaactctgttatcaaaccctgctgagatcagtatatatttgaaacattcaaaataatccttttcaa

SEQ ID NO: 359334 - DNA, 75 bp, Artificial Sequence
  Synthetic
tatagttcttagtggctaagttcttcaccagtgattctaagggacaaaatcttaacacatcatccaagaagaaat

SEQ ID NO: 359335 - DNA, 75 bp, Artificial Sequence
  Synthetic
gctttttaaatttactgttaaaaactgaatgacacaaatcttggtaggtgccgtctgaaaagattgaaggatcaa

SEQ ID NO: 359336 - DNA, 75 bp, Artificial Sequence
  Synthetic
aatccttgacttcatgtagtgaggtctcagctaaaatggggcccattaactctctcggccacaatgtgcttagca

SEQ ID NO: 359337 - DNA, 75 bp, Artificial Sequence
  Synthetic
aatcagaaccctcataccttcgtactgctccctgttctttaacatccttcttcattggagaggtgaccattccgt

SEQ ID NO: 359338 - DNA, 75 bp, Artificial Sequence
  Synthetic
ttaagcactcaagaacattagattctatatcattgattagtttatatgtgccctcatcaagcagttcctcgaatt

SEQ ID NO: 359339 - DNA, 75 bp, Artificial Sequence
  Synthetic
cttcagcacactcatcgtcatggtcctttgggtgggaccttcttttgagcaccatattagttagtcttttgtaaa

SEQ ID NO: 359340 - DNA, 75 bp, Artificial Sequence
  Synthetic
ttgcaaattgaatagattttctatccagtttaaatcttaacttatctttaaaggattgtgccatttcaactacta

SEQ ID NO: 359341 - DNA, 75 bp, Artificial Sequence
  Synthetic
cagatgacaaaaggctctgataatcataatgtgtgataacctcacctgcttcatccaatttagggacaacaacac

SEQ ID NO: 359342 - DNA, 75 bp, Artificial Sequence
  Synthetic
tcttattgctggatatatcaagagctgtgctgctgaatgatggtgattgagggtcacgatccaaaactttgttaa

SEQ ID NO: 359343 - DNA, 75 bp, Artificial Sequence
  Synthetic
ttggtagtattccacaattaaagcaagaaacacataatgatagaatagttttgcatatgcctggattctccatat

SEQ ID NO: 359344 - DNA, 75 bp, Artificial Sequence
  Synthetic
catcaacaccaaggtcttttgaaaagagtttgttcaaattcataataaacttctcttcatcttctttacacaagt

SEQ ID NO: 359345 - DNA, 75 bp, Artificial Sequence
  Synthetic
tgggggatgagtccagattaacaaatgaagatccaaattgtatcttgggctccaaaaatttctcaaagcacttaa

SEQ ID NO: 359346 - DNA, 75 bp, Artificial Sequence
  Synthetic
tctgatctgtcaatctatcaggggtctccttagtgataaagtgacacaagtaagacagatttagaacaaatttaa

SEQ ID NO: 359347 - DNA, 75 bp, Artificial Sequence
  Synthetic
aaatcttagccatgttctcttctaaagcctcctccaacagatacacaaccagctcatccatcaatacaaaaacat

SEQ ID NO: 359348 - DNA, 75 bp, Artificial Sequence
  Synthetic
gttgttctgcagaagtcaatgcctgaacgcttaacttttgatctaacttcttgaaatggaattcattgacaaaag

SEQ ID NO: 359349 - DNA, 75 bp, Artificial Sequence
  Synthetic
ccatgataaaatatctgaatccctgtaaataaatctggacccttttactaggtgtaatgaggatattcacaacca

SEQ ID NO: 359350 - DNA, 75 bp, Artificial Sequence
  Synthetic
gtgtgaagagtttggttttcacatcatttatttcagcggttgatagccaatctaaccatgataacatctccagac

SEQ ID NO: 359351 - DNA, 75 bp, Artificial Sequence
  Synthetic
atgttttaagaatcacagttgaactcattattggtaagaagaacctcttggggtctgcataaaagcttgggcctg

SEQ ID NO: 359352 - DNA, 75 bp, Artificial Sequence
  Synthetic
ttttatatgcattagtcatttcttcatcttttagcatcaaaccgtaacaccttgatttctcaccggtcttctgat

SEQ ID NO: 359353 - DNA, 75 bp, Artificial Sequence
  Synthetic
ataagagtatactgttgtataaattatccagatcctgatagtaacactcctcacattggattgttccataaaaat

SEQ ID NO: 359354 - DNA, 75 bp, Artificial Sequence
  Synthetic
tcttctcatcattaattattaattttggtgctgaacttgtcttcatagagttcatcatgcttaaacttagacttg

SEQ ID NO: 359355 - DNA, 75 bp, Artificial Sequence
  Synthetic
ataatgcatcaagataatccacaaacataccttcattaaggaccttatctgtcccgaatttaacctgataacatg

SEQ ID NO: 359356 - DNA, 75 bp, Artificial Sequence
  Synthetic
tatcttgattctgttttttataccttaatgttggtttctcacatttacctgagtgctctctctcaaatttaaact

SEQ ID NO: 359357 - DNA, 75 bp, Artificial Sequence
  Synthetic
cataccagaactcataatccaattccttcaaccatacagtgacataatctaaactttgttccttgacacttttat

SEQ ID NO: 359358 - DNA, 75 bp, Artificial Sequence
  Synthetic
tcaattttcttcccacaattttgagccaatcaggttgtttcaacaatttcctttctaatttattgattattaagt

SEQ ID NO: 359359 - DNA, 75 bp, Artificial Sequence
  Synthetic
ctactgacagtagtctgtcattcacacttttatagtgattgttaataaggaagtgactactatcaactcctgatt

SEQ ID NO: 359360 - DNA, 75 bp, Artificial Sequence
  Synthetic
tgattacttcaatcagactattaaggacaatcacatcaagacaaagtattgcatgtctccttgtattaaggactt

SEQ ID NO: 359361 - DNA, 75 bp, Artificial Sequence
  Synthetic
tcagccccttcactttattacagtcagagagcagttttttgtgtctcaatgtctctttgctctcagctggcagtt

SEQ ID NO: 359362 - DNA, 75 bp, Artificial Sequence
  Synthetic
gggtgcatgatgctctcttgctttgtaccagctcggcaataaccctcagcatatggttttgacaaaaaccacaac

SEQ ID NO: 359363 - DNA, 75 bp, Artificial Sequence
  Synthetic
gttcactattgagtgggcctccttcaccattgcttataggtgaaattaacttgtgagtttttaaccatttgatca

SEQ ID NO: 359364 - DNA, 75 bp, Artificial Sequence
  Synthetic
tgtctgccctagatgtttcacagtacacatcctgatattgcccactatcccttagcaaacaaaattgatcataaa

SEQ ID NO: 359365 - DNA, 75 bp, Artificial Sequence
  Synthetic
tcttagcgatacctattctacactcagaagctgtcattttggacattgtcccatcctttatcacccccatcaatt

SEQ ID NO: 359366 - DNA, 75 bp, Artificial Sequence
  Synthetic
tcgctttgtaatccaaaccttcttctctcagagccttaagtgattcaagccctaggttctgattctccatgttag

SEQ ID NO: 359367 - DNA, 75 bp, Artificial Sequence
  Synthetic
agagactggaaattaaacgattatattccaactcttcaatactttctccgctatccttcacagaatccattagtt

SEQ ID NO: 359368 - DNA, 75 bp, Artificial Sequence
  Synthetic
taagcaacagccatctaatcctctctataacccagtctgggaaacgatccacataatagtttgacctcccatcaa

SEQ ID NO: 359369 - DNA, 75 bp, Artificial Sequence
  Synthetic
tcacaggcacaagaatgagaccacatttattcaagtctttagataattgcattaatttttcaaaatcatatttgt

SEQ ID NO: 359370 - DNA, 75 bp, Artificial Sequence
  Synthetic
acttttgttcaaaagattcttgattcacacgaacaaaagtttccaagagaattattgtagatcctgacactttga

SEQ ID NO: 359371 - DNA, 75 bp, Artificial Sequence
  Synthetic
atccatcagggaccacatctgggagtgttggacctacaatcttgtggtctttcaagatttgattcactgtcttat

SEQ ID NO: 359372 - DNA, 75 bp, Artificial Sequence
  Synthetic
tcttgttgaaaacgcacccatgcttaaggcatgaatcaatctcgatcagcattgataggagcttcagaccctcgg

SEQ ID NO: 359373 - DNA, 75 bp, Artificial Sequence
  Synthetic
ttataactgaagagggattgacctgagagaggactattgttttttgttctgtgtaggcttcttcgtcgggaaccc

SEQ ID NO: 359374 - DNA, 75 bp, Artificial Sequence
  Synthetic
accttctaacgagatccttgagctcatttatacgatcagagcaatcaatcatgatcaagaaatgcctaggatcca

SEQ ID NO: 359375 - DNA, 75 bp, Artificial Sequence
  Synthetic
aacgagatccttgagctcatttatacgatcagagcaatcaatcatgatcaagaaatgcctaggatccactgtgcg

SEQ ID NO: 359376 - DNA, 75 bp, Artificial Sequence
  Synthetic
gcctcaggcctccttattataataaaaaaaagctaagcatgattgacagtgtgggctaaaccaaaagcacaagaa

SEQ ID NO: 359377 - DNA, 75 bp, Artificial Sequence
  Synthetic
aaaaaagctaagcatgattgacagtgtgggctaaaccaaaagcacaagaacaaagcttttagccaattagcagcc

SEQ ID NO: 359378 - DNA, 75 bp, Artificial Sequence
  Synthetic
acaaggtggagcaaaagtattaagtttcactgttatgtgcaggaatgtgcagctgtgaccttttaaagtttccgg

SEQ ID NO: 359379 - DNA, 75 bp, Artificial Sequence
  Synthetic
gcacggcgccaacttcctgggcctggtgccataccaacacagctgctgagcttccggaatacaatactggtgccc

SEQ ID NO: 359380 - DNA, 75 bp, Artificial Sequence
  Synthetic
cttccggaatacaatactggtgccctttgtaagtgttttacaggtaagtaaggcctacaacagggcttatttgta

SEQ ID NO: 359381 - DNA, 75 bp, Artificial Sequence
  Synthetic
ctataagttaatgggggccctttgtagtccagcggaaagtgaagggtggcttaacagagacgtccttgggttcaa

SEQ ID NO: 359382 - DNA, 75 bp, Artificial Sequence
  Synthetic
acctaagggtgccataagcaacattacattaatgttgtgacatctccagtcgggggtattggcctataggaaacc

SEQ ID NO: 359383 - DNA, 75 bp, Artificial Sequence
  Synthetic
cttccggaatacaatactggtgccctttgtaagtgttttacaggtaagtaaggcctacaagagggcttatttgta

SEQ ID NO: 359384 - DNA, 75 bp, Artificial Sequence
  Synthetic
acattaatgttgtgacatctccagtcgggggtattggcctataggaaaccctagggctctataagcagcatacat

SEQ ID NO: 359385 - DNA, 75 bp, Artificial Sequence
  Synthetic
atgttgtgacatctccgttgagtctgggggtattggtgctaccgtctcgaacctagccgacagccgttggatata

SEQ ID NO: 359386 - DNA, 75 bp, Artificial Sequence
  Synthetic
aatgctatagttcaacaagtaagaagctttgttagtggaggaagagaaagagaactgttacaaatagctgcaggt

SEQ ID NO: 359387 - DNA, 75 bp, Artificial Sequence
  Synthetic
aagggtcaccatttttatttcagatgggcatattgcttgctgtgcctgaaataattgctgcatctgtagctggag

SEQ ID NO: 359388 - DNA, 75 bp, Artificial Sequence
  Synthetic
gagcagaggcactatcaattgctggatctggagctgcaatagcaactggtgaaggtttagctgctcttggtgggc

SEQ ID NO: 359389 - DNA, 75 bp, Artificial Sequence
  Synthetic
tcaacccacaagactgcaaagccttccaaaacaagtcagaaaaggaggggtggacgtgctggccgccgtaccact

SEQ ID NO: 359390 - DNA, 75 bp, Artificial Sequence
  Synthetic
ttacagagtcagcagcactattaggggaaactgttgaaatatctgaagcagctgctactgtactaacaaaagtac

SEQ ID NO: 359391 - DNA, 75 bp, Artificial Sequence
  Synthetic
ttattggtctattagtagcccacttaaagctgctgaagctgctaatgttactcctgatgctgatactactgtgtg

SEQ ID NO: 359392 - DNA, 75 bp, Artificial Sequence
  Synthetic
ctgagcttgtaactgtaacacaaggtgtaacagcagctgtacaagggggtgcaggtcttgtaggtggtatatata

SEQ ID NO: 359393 - DNA, 75 bp, Artificial Sequence
  Synthetic
cagctttagcagcagatcgccctggggacctgcctgcgagtaccccaacaggaagtccaagtggactacatcccc

SEQ ID NO: 359394 - DNA, 75 bp, Artificial Sequence
  Synthetic
ggaagtccaagtggactacatccccccgcaggatacaatccccaaggaggtggacttaatatccagtccatccac

SEQ ID NO: 359395 - DNA, 75 bp, Artificial Sequence
  Synthetic
aagcccctccacgccccctacccaggaatggcactggcacctatccctgaatacaacttggaaactggaattcca

SEQ ID NO: 359396 - DNA, 75 bp, Artificial Sequence
  Synthetic
ggggtcccggactgggtattcaacttcattgcatcccacctgcccgagttgcctagcctgcaggacgtgttcaat

SEQ ID NO: 359397 - DNA, 75 bp, Artificial Sequence
  Synthetic
agaattgcctatggaatctggacatcatattacaatacggggagaacagtagttaatagagcagttagtgaagaa

SEQ ID NO: 359398 - DNA, 75 bp, Artificial Sequence
  Synthetic
ttacaaagactactaggagatttagaatatggatttagaactgcacttgccaccattggggaatctgacccagta

SEQ ID NO: 359399 - DNA, 75 bp, Artificial Sequence
  Synthetic
gaagaaacagggcccttgcctcccacagtagagggaaatattggtgtacccacaaccagtaatttgtctcatttg

SEQ ID NO: 359400 - DNA, 75 bp, Artificial Sequence
  Synthetic
caacctgtagacatttctgaaggtgtatcaagaggcacagctactatttcaaatgctgtagaagctgtaagagat

SEQ ID NO: 359401 - DNA, 75 bp, Artificial Sequence
  Synthetic
taccaggctacaccagccatatataataaaacatcttgctcacctttaatagttttatccattttgtccaatatt

SEQ ID NO: 359402 - DNA, 75 bp, Artificial Sequence
  Synthetic
gcaactcaaagactatcacaagcaacctacaactttgtttatgatgcttctacccttccaagggatggctttaat

SEQ ID NO: 359403 - DNA, 75 bp, Artificial Sequence
  Synthetic
taggccagtggatttcaatgcctggggctacagggggtactccccattatgcagcccctgactggattttatatg

SEQ ID NO: 359404 - DNA, 75 bp, Artificial Sequence
  Synthetic
aaaagaaaactacaacaaaatggcctgcacagcaaagccagcctgcacagcaaaaccaggaaggtcaccaagaag

SEQ ID NO: 359405 - DNA, 75 bp, Artificial Sequence
  Synthetic
caaaaccaggaaggtcaccaagaagtcaacccacaagagtgcaaagccttccaaaacaagtcagaaaaggagggg

SEQ ID NO: 359406 - DNA, 75 bp, Artificial Sequence
  Synthetic
tcaacccacaagagtgcaaagccttccaaaacaagtcagaaaaggaggggtagacgtgctggccgccgtaccact

SEQ ID NO: 359407 - DNA, 75 bp, Artificial Sequence
  Synthetic
gaattgtttgttaaacctgttattggaaatgcagaggggactaccccacattattggtctattagtagcccactt

SEQ ID NO: 359408 - DNA, 75 bp, Artificial Sequence
  Synthetic
ttattggtctattagtagcccacttaaaactgctgaagctgctaatgttactcctgatgctgatactactgtgtg

SEQ ID NO: 359409 - DNA, 75 bp, Artificial Sequence
  Synthetic
ctacagcttgtcacaggttgctccccctgatattcctaatcaggttagtgaatgtgacatgcttatatgggagct

SEQ ID NO: 359410 - DNA, 75 bp, Artificial Sequence
  Synthetic
aatgtgacatgcttatatgggagctgtatagaatggaaacagaagttttggtgcttcctgtgcttaatgctggca

SEQ ID NO: 359411 - DNA, 75 bp, Artificial Sequence
  Synthetic
gtatagaatggaaacagaagttttggtgcttcctgtgcttaatgctggcatacttactacagggggtgtaggagg

SEQ ID NO: 359412 - DNA, 75 bp, Artificial Sequence
  Synthetic
tgggcagttggaggacagcccttggatgtgctaggacttgctcccactgaaaaatacaaggggcctgctcagtat

SEQ ID NO: 359413 - DNA, 75 bp, Artificial Sequence
  Synthetic
actgtaaatcctaaaaccaatggtactgtgcctcatgtttattccagttctgaaacacccagggcaagggtcact

SEQ ID NO: 359414 - DNA, 75 bp, Artificial Sequence
  Synthetic
aatgaaaagtacagcattgaatcatgggtggcagaccctagccgcaatgataactgcagatactttggcagaatg

SEQ ID NO: 359415 - DNA, 75 bp, Artificial Sequence
  Synthetic
gttggaggggctgcaactccaccagtggtgtcatttagtaataatagcacaattccactgttggatgaaaatggc

SEQ ID NO: 359416 - DNA, 75 bp, Artificial Sequence
  Synthetic
attggcattctttgcttgcaaggtagattgtacataacttgtgctgaccttttgggagttaacaaaaatagagta

SEQ ID NO: 359417 - DNA, 75 bp, Artificial Sequence
  Synthetic
catacagggctttccagattttttaggctacactttagacaaagaagggttagaaacccatatactataaatttg

SEQ ID NO: 359418 - DNA, 75 bp, Artificial Sequence
  Synthetic
ggctacactttagacaaagaagggttagaaacccatatactataaatttgctttataagcaggtgtttaataagc

SEQ ID NO: 359419 - DNA, 75 bp, Artificial Sequence
  Synthetic
agctgtgaccttttaaagtttccgggcaaggcgccaacttcctgggcttggtgccataccaagacagctgctgag

SEQ ID NO: 359420 - DNA, 75 bp, Artificial Sequence
  Synthetic
cagctgatgacattagtgggcaactgcaggttacagaggttactatgactgaagaaacagggcccttgcctccca

SEQ ID NO: 359421 - DNA, 75 bp, Artificial Sequence
  Synthetic
gaagaaacagggcccttgcctcccacagtagagggaaatgttggtgtacccacaaccagtaatttgtctcatttg

SEQ ID NO: 359422 - DNA, 75 bp, Artificial Sequence
  Synthetic
cctgcaactgtaactttacaagccacaggcccaatactaaacacacaaggataatgtaataaatgcagtttatta

SEQ ID NO: 359423 - DNA, 75 bp, Artificial Sequence
  Synthetic
ataaagcaattttaagcattgtgtttttcaagtatgttgcatccatttgttacattcatttgcatgtcagcaaat

SEQ ID NO: 359424 - DNA, 75 bp, Artificial Sequence
  Synthetic
tttcaagtatgttgcatccatttgttacattcatttgcatgtcagcaaattcagtaaggcctatatatttgtcta

SEQ ID NO: 359425 - DNA, 75 bp, Artificial Sequence
  Synthetic
acagttctttccaatacacaactttagcttgtatacatgggtgaaaatcactaacaggcctgcaccatattaaca

SEQ ID NO: 359426 - DNA, 75 bp, Artificial Sequence
  Synthetic
taaaactctttttaccattagttctggagttttatccagactttcttttaagtgtcttttgggtgtaaaaagtac

SEQ ID NO: 359427 - DNA, 75 bp, Artificial Sequence
  Synthetic
ggagttttatccagactttcttttaagtgtcttttgggtgtaaaaagtacagttttatgaaatctaggagccaaa

SEQ ID NO: 359428 - DNA, 75 bp, Artificial Sequence
  Synthetic
gtagcagggactaaatattcattcattgttacaatacctggaggaaaaatttgtgaccttttatttaaatgtttt

SEQ ID NO: 359429 - DNA, 75 bp, Artificial Sequence
  Synthetic
ggtaacagtttattatctcctacttgaccttttacatcttcaaatactactgtaaattgatctattgcaactcct

SEQ ID NO: 359430 - DNA, 75 bp, Artificial Sequence
  Synthetic
aactcaaagtttaatctatcagctggaatattaatatttaaggcctttcctccacaaaggtcaagtaaagcagca

SEQ ID NO: 359431 - DNA, 75 bp, Artificial Sequence
  Synthetic
gcaacagttgttttaccactgtttataggccccttaaaaacccaatacctttttttaggtacattttcaactata

SEQ ID NO: 359432 - DNA, 75 bp, Artificial Sequence
  Synthetic
acttttaggtacctgtatacaagctcatctattttaccatttaggcctaaataccaggctacaccagccatatat

SEQ ID NO: 359433 - DNA, 75 bp, Artificial Sequence
  Synthetic
ataccaggctacaccagccatatataataaaacatcttgctcacctttaatagttttatccattttgtccagtat

SEQ ID NO: 359434 - DNA, 75 bp, Artificial Sequence
  Synthetic
tttttcaaatcttctagctaataaatcttctctggacatatttaaactatctacccttctttttgcaataaccac

SEQ ID NO: 359435 - DNA, 75 bp, Artificial Sequence
  Synthetic
atcaatagcctgttgacacacatttttttgacttttactgtctgaaaatagtaaagcatttttttgatgttccat

SEQ ID NO: 359436 - DNA, 75 bp, Artificial Sequence
  Synthetic
tttgccttctttagcctcaaggcgcctcagcaaggccctctgcttttagttgaaaaaggtgaggctttttaggcc

SEQ ID NO: 359437 - DNA, 75 bp, Artificial Sequence
  Synthetic
atgaagtctattatgagttgcatcttcattactattgcatttttcacactcttctaccttaatagatagttgtaa

SEQ ID NO: 359438 - DNA, 75 bp, Artificial Sequence
  Synthetic
tcattactattgcatttttcacactcttctaccttaatagatagttgtaaatataatccaagtaataagtacaca

SEQ ID NO: 359439 - DNA, 75 bp, Artificial Sequence
  Synthetic
tcatcaattcctaattctaaagcaaattctgacaaagccttccaatttaattgatctttaaactccccatataaa

SEQ ID NO: 359440 - DNA, 75 bp, Artificial Sequence
  Synthetic
ttgatctttaaactccccatataaatcctcagctttaaaatcattttcttttaagccaccaggaatattttcttc

SEQ ID NO: 359441 - DNA, 75 bp, Artificial Sequence
  Synthetic
tgtgaccttttaaagtttccgggcacggcgccaacttcctgggcctggtgccaataccaacacagctgctgagct

SEQ ID NO: 359442 - DNA, 75 bp, Artificial Sequence
  Synthetic
acataaagtaaatggatctctagtcattctactatataaaccatatgcattattaacacctttacaaaataaaaa

SEQ ID NO: 359443 - DNA, 75 bp, Artificial Sequence
  Synthetic
gctaatagtacagtatcccttacaaaagttattaacagcactaactctatgtctaaaaggtgttaaaataaacac

SEQ ID NO: 359444 - DNA, 75 bp, Artificial Sequence
  Synthetic
aagttattaacagcactaactctatgtctaaaaggtgttaaaataaacacaagtgcagtattataataagaatgt

SEQ ID NO: 359445 - DNA, 75 bp, Artificial Sequence
  Synthetic
aagtgcagtattataataagaatgtctacttgcaaaattacatttaaacttacttaaaagttttttatatagggt

SEQ ID NO: 359446 - DNA, 75 bp, Artificial Sequence
  Synthetic
ttctgccttttctttggtggtatgtattacaaatgcagttaaagttctattactaaatacagcttgagacacaaa

SEQ ID NO: 359447 - DNA, 75 bp, Artificial Sequence
  Synthetic
ttcttccaattctttaggaaatgataaagatgcatctgtagcattgtcctttttttttttaggtggtgttgcctg

SEQ ID NO: 359448 - DNA, 75 bp, Artificial Sequence
  Synthetic
tgaacattgtggttcctcatcatcttctctagtacgctttgtaggggtttctccaggagatttaggcatttcctc

SEQ ID NO: 359449 - DNA, 75 bp, Artificial Sequence
  Synthetic
tctctagtacgctttgtaggggtttctccaggagatttaggcatttcctcattacatcttagttcttcttcccag

SEQ ID NO: 359450 - DNA, 75 bp, Artificial Sequence
  Synthetic
taggaattaaactgagaccaccagtaatcccagtctggggtaccatatgtgggtatctataataaaaaaaagtta

SEQ ID NO: 359451 - DNA, 75 bp, Artificial Sequence
  Synthetic
tacccctataataaaaacatgcttacctggttaagccaaccccttgcatggttgtaagaaatataatctttttcc

SEQ ID NO: 359452 - DNA, 75 bp, Artificial Sequence
  Synthetic
agtaaaaaaatgtttctgcactaatttcaaagccaaaccactctctatagcacctgtagcagtaacactctatcc

SEQ ID NO: 359453 - DNA, 75 bp, Artificial Sequence
  Synthetic
ttcaaagccaaaccactctctatagcacctgtagcagtaacactctatccacattggaggttttctaaatatttt

SEQ ID NO: 359454 - DNA, 75 bp, Artificial Sequence
  Synthetic
atatttttgcttgtggcgcttgtctaaaaagcagtaaaaacaattacacaaataataaaacccctttaagcatat

SEQ ID NO: 359455 - DNA, 75 bp, Artificial Sequence
  Synthetic
aaaaagcagtaaaaacaattacacaaataataaaacccctttaagcatatgtcccagtcttttaaaatatactct

SEQ ID NO: 359456 - DNA, 75 bp, Artificial Sequence
  Synthetic
gtcccagtcttttaaaatatactcttcaaaaacatcaccataaacttctccaacaagcctgtactttctaggggg

SEQ ID NO: 359457 - DNA, 75 bp, Artificial Sequence
  Synthetic
aaagttacagcacaattctgtgcattctacctgtgaagagctccacacttcatcttcttcttcatttagttggtg

SEQ ID NO: 359458 - DNA, 75 bp, Artificial Sequence
  Synthetic
cactgtactaacacactcttgcagttttaaatataaagaattaagctttttcattttttcctcatttcccccttt

SEQ ID NO: 359459 - DNA, 75 bp, Artificial Sequence
  Synthetic
tttaaatataaagaattaagctttttcattttttcctcatttccccctttgtcaggatgaaattctttgcatttg

SEQ ID NO: 359460 - DNA, 75 bp, Artificial Sequence
  Synthetic
gcctcaggcctccttattataataaaaaaaagctaaccatgattgacagtgtgggctaaaccaaaaccacaaaaa

SEQ ID NO: 359461 - DNA, 75 bp, Artificial Sequence
  Synthetic
ctaaggtattttgttctcattagtggtaaatttccccagcaggtcatatcaagacccagcagctgcataagttct

SEQ ID NO: 359462 - DNA, 75 bp, Artificial Sequence
  Synthetic
caaagcttttagccaattaccagccacaaggtggagcaaaagtattaagtttcaatgttatgtgcaggaatgtgc

SEQ ID NO: 359463 - DNA, 75 bp, Artificial Sequence
  Synthetic
tttgcttcatttctggacaaagttttatccattttgccttctttagcctcaaggcgcctcagcaaggccctctgc

SEQ ID NO: 359464 - DNA, 75 bp, Artificial Sequence
  Synthetic
atctgtgaccttttaaagtttcagggaactacgccaacttcctgggcctggtgccctaccaacacagctgctgag

SEQ ID NO: 359465 - DNA, 75 bp, Artificial Sequence
  Synthetic
cattttgccttctttagcctcaaggcgcctcagcaaggccctctgcttttagttcaaaaaggtgaggctttttag

SEQ ID NO: 359466 - DNA, 75 bp, Artificial Sequence
  Synthetic
aatgctatagttgaacaagtaagaagctttgttagtggaggaagagaaagagaactgttacaaatagctgcaggt

SEQ ID NO: 359467 - DNA, 75 bp, Artificial Sequence
  Synthetic
cttccggaatacaatactggtgccctttgtaagtgttttacaggtaagtgaggcctacaacagggctggtttgta

SEQ ID NO: 359468 - DNA, 75 bp, Artificial Sequence
  Synthetic
cctacaactttgtttatgatgcttctacccttccaagggatggctttaatgcacttagtgatggagttcacagac

SEQ ID NO: 359469 - DNA, 75 bp, Artificial Sequence
  Synthetic
tacttactacagggggtgtaggaggtattgctggtccccaactttatttttgggcagttggaggacagcccttgg

SEQ ID NO: 359470 - DNA, 75 bp, Artificial Sequence
  Synthetic
gacgtgctggccgccgtaccactgtcagaagaaacagagtttaaagttgaattgtttgttaaacctgttattgga

SEQ ID NO: 359471 - DNA, 75 bp, Artificial Sequence
  Synthetic
ttttctaaattaactttaacacttccatctaaatagtctcttaaattatctaagttactcattccatttccagat

SEQ ID NO: 359472 - DNA, 75 bp, Artificial Sequence
  Synthetic
ggaagtccaagtggactacatccccccgctagaatcaatcgccaaggaggtagtcttaatatccagtccatccac

SEQ ID NO: 359473 - DNA, 75 bp, Artificial Sequence
  Synthetic
aatcccagtctggggtaccatatgtgggtatctataataaaaaaaagttattaatttactataaaacataaaagt

SEQ ID NO: 359474 - DNA, 75 bp, Artificial Sequence
  Synthetic
ggagttttatccaaactttcttttaagtgtcttttgggtgtaaaaagtacagttttatgaaatctaggagccaaa

SEQ ID NO: 359475 - DNA, 75 bp, Artificial Sequence
  Synthetic
aataaaacatcttgctcacctttaatagttttatccatttttcccagtattttttcaaatccttcagttaataaa

SEQ ID NO: 359476 - DNA, 75 bp, Artificial Sequence
  Synthetic
tttttcaaatccttcagttaataaaaccttcctggacatatttaaactatcttcccttctttttgcaataaccac

SEQ ID NO: 359477 - DNA, 75 bp, Artificial Sequence
  Synthetic
acattggaggttttttaaatattttgtatttttgttcgtggctcttgtctaaaaagcagtaaaaacaattacaca

SEQ ID NO: 359478 - DNA, 75 bp, Artificial Sequence
  Synthetic
cagctttagcagcagatcgccctggggacctgtctgcgagtaccccaacaggaagcccaagtggactacatctcc

SEQ ID NO: 359479 - DNA, 75 bp, Artificial Sequence
  Synthetic
tagaaacccatatactataaatttgctttataagcaagtgtttaataagccagctgatgacattagtgggcaact

SEQ ID NO: 359480 - DNA, 75 bp, Artificial Sequence
  Synthetic
aaagatgcatctgtagcattgtcctttttttttttaggtggtgttgcctgtgaacattctggttcctcatcatct

SEQ ID NO: 359481 - DNA, 75 bp, Artificial Sequence
  Synthetic
ctaacaggcctgcaccatattaacataattaaaatacacattccactttgtaaaactctttttaccattagttct

SEQ ID NO: 359482 - DNA, 75 bp, Artificial Sequence
  Synthetic
cattttgccttctttagcctcaaggcgcctcagcaaggccctctgcttttagttcagaaagttgaggctttttag

SEQ ID NO: 359483 - DNA, 75 bp, Artificial Sequence
  Synthetic
gcctcaggcctccttattatagtaaaaaaaaggtaagcatgattgacagtgtgggctaaaccaaaagcacaagaa

SEQ ID NO: 359484 - DNA, 75 bp, Artificial Sequence
  Synthetic
agctgtgaccttttaaagtttccgggcaaggcgccaacttcctgggcctggtgccataccacaacagctgctgag

SEQ ID NO: 359485 - DNA, 75 bp, Artificial Sequence
  Synthetic
ccgcaggatacaatccccaaggagggggacttaatatccagtccatccacaagcccctccacgccccctacccag

SEQ ID NO: 359486 - DNA, 75 bp, Artificial Sequence
  Synthetic
caacctgtagacatttctcaaggtgtatcaacaggcagagctactatttcaaatgctgtacaagctgtaagagat

SEQ ID NO: 359487 - DNA, 75 bp, Artificial Sequence
  Synthetic
tatcaacaggcagagctactatttcaaatgctgtacaagctgtaagagatgcaactgaaagactatcacaagcaa

SEQ ID NO: 359488 - DNA, 75 bp, Artificial Sequence
  Synthetic
tacttgaagagctaaacagtgacatttctaaaattcctatacagggaattaaaagaaaactacaacaaaatggcc

SEQ ID NO: 359489 - DNA, 75 bp, Artificial Sequence
  Synthetic
gtatagaatggaaacagaagttttggtgcttcctttccttaatgctggcgtacttaatacagggggtgtaggagg

SEQ ID NO: 359490 - DNA, 75 bp, Artificial Sequence
  Synthetic
tccccagcaggtcatatcaagacccagcagctgcataagttcttttgcttcatttctggacaaagttttatccat

SEQ ID NO: 359491 - DNA, 75 bp, Artificial Sequence
  Synthetic
actgtaaatcctaaaaccaatggcactgtgcctcatgtttattccagttctgacacacccagggcaagggttact

SEQ ID NO: 359492 - DNA, 75 bp, Artificial Sequence
  Synthetic
caggcccaatactaaacacacaaggataatgtaataaatgcagtttattaataaagcaatttaagcattgtgttt

SEQ ID NO: 359493 - DNA, 75 bp, Artificial Sequence
  Synthetic
tgatctttaaactccccatataaatcctcagctttaaaatcattttcttttaatccaccaggaatattttcttca

SEQ ID NO: 359494 - DNA, 75 bp, Artificial Sequence
  Synthetic
taggagttaaactgagaccaccagtaatcccagtctggggtaccatatgtgggtatctataataaaaaaagttat

SEQ ID NO: 359495 - DNA, 75 bp, Artificial Sequence
  Synthetic
agtgcagtattataataagaatgtctacttgcaaaattacatttaaacttacttaaaagttttttatagagagtt

SEQ ID NO: 359496 - DNA, 75 bp, Artificial Sequence
  Synthetic
tacattcatttgcatgtcagcaaattcagtaaggcctattaagcattgtgtttttcaagtatgttgcatccattt

SEQ ID NO: 359497 - DNA, 75 bp, Artificial Sequence
  Synthetic
attggaggttttttaaatattttatatttttgcttgtggcgcttgtctaaaaagcagtgaaaacaattacacaaa

SEQ ID NO: 359498 - DNA, 75 bp, Artificial Sequence
  Synthetic
cattttgccttctttagcctcaaggcgcctcagcaaggccctctgcttttagttcaaaaagttgaggctttttag

SEQ ID NO: 359499 - DNA, 75 bp, Artificial Sequence
  Synthetic
acattggaggttttttaaatattttatatttttgcttgtggcgcttgtctaaaaagcagtaaaaacaattacaca

SEQ ID NO: 359500 - DNA, 75 bp, Artificial Sequence
  Synthetic
ccaaaacaagtcagaaaaggaggggtagacgtgctgtccgccgtaccactgtcagaagaaacagagtttaaagtt

SEQ ID NO: 359501 - DNA, 75 bp, Artificial Sequence
  Synthetic
tacttaatacagggggtgtaggaggtattgctggtccccaactttatttttgggcagttggaggacagcccttgg

SEQ ID NO: 359502 - DNA, 75 bp, Artificial Sequence
  Synthetic
tattaatttacttataaaacataaaagtacccctataataaaaacatgcttacctggttaagccaaccccttgca

SEQ ID NO: 359503 - DNA, 75 bp, Artificial Sequence
  Synthetic
taataaaatccctttaagcatatgtcccagtcttttaaaatatactcttcaaaaacatcaccataaacttctcca

SEQ ID NO: 359504 - DNA, 75 bp, Artificial Sequence
  Synthetic
ggagcagttgctctggactaccccagtggaacctcaggctcccccattgtgaaccgaaatggtgaagtggtcggg

SEQ ID NO: 359505 - DNA, 75 bp, Artificial Sequence
  Synthetic
gtggaacctcaggctcccccattgtgaaccgaaatggtgaagtggtcgggctctatggcaatggaattctggtgg

SEQ ID NO: 359506 - DNA, 75 bp, Artificial Sequence
  Synthetic
ctcacaaactgaattgaaggaagaatccaaagaagaactgcaagaaataccaactatgctgaagaaaggaatgac

SEQ ID NO: 359507 - DNA, 75 bp, Artificial Sequence
  Synthetic
tccaaagaagaactgcaagaaataccaactatgctgaagaaaggaatgaccaccatccttgacttccaccctggg

SEQ ID NO: 359508 - DNA, 75 bp, Artificial Sequence
  Synthetic
ctcaaatattggcggagtgtgccagaaggcgtttgcgcactctggtattagcacccaccagggttgttttgtcag

SEQ ID NO: 359509 - DNA, 75 bp, Artificial Sequence
  Synthetic
aaggcgtttgcgcactctggtattagcacccaccagggttgttttgtcagagatgaaagaagcttttcaggggtt

SEQ ID NO: 359510 - DNA, 75 bp, Artificial Sequence
  Synthetic
ttctcagcccatgggagtgggaaggaggtcattgatgcaatgtgccatgcaacccttacatatagaatgctggaa

SEQ ID NO: 359511 - DNA, 75 bp, Artificial Sequence
  Synthetic
agtggtggccagtttgatgagaggattgtcctcaaggaaacgccgttcccatgatgttctgactgtgcaattcct

SEQ ID NO: 359512 - DNA, 75 bp, Artificial Sequence
  Synthetic
atgatgttctgactgtgcaattcctaattttgggaatgctgttgatgacgggtggagtgaccttggtgcggaaaa

SEQ ID NO: 359513 - DNA, 75 bp, Artificial Sequence
  Synthetic
aggtcattgatgcaatgtgccatgcaacccttacatatagaatgctggaaccaacaagggtagtcaactgggagg

SEQ ID NO: 359514 - DNA, 75 bp, Artificial Sequence
  Synthetic
ggtggagtgaccttggtgcggaaaaacagatggttgctcctaaatgtgacatctgaggacctcgggaaaacattc

SEQ ID NO: 359515 - DNA, 75 bp, Artificial Sequence
  Synthetic
cctggaccctgctagcatagcagcgagaggctgggcggctcatagagcaagagcaaatgagagcgccaccatact

SEQ ID NO: 359516 - DNA, 75 bp, Artificial Sequence
  Synthetic
atctgaggacctcgggaaaacattctctgtgggcacaggcaactgcacaacaaacattttggaagccaagtactg

SEQ ID NO: 359517 - DNA, 75 bp, Artificial Sequence
  Synthetic
agaggctgggcggctcatagagcaagagcaaatgagagcgccaccatacttatgaccgccaccccaccaggcacc

SEQ ID NO: 359518 - DNA, 75 bp, Artificial Sequence
  Synthetic
gtgcccagactcaatggaatacaactgtcccaatctcagtccaagagaggagccagatgacattgattgctggtg

SEQ ID NO: 359519 - DNA, 75 bp, Artificial Sequence
  Synthetic
gtgagattgaggacgtccagactgacatccccagcgagccatggaccgcaggacatgaatggatcttggcggaca

SEQ ID NO: 359520 - DNA, 75 bp, Artificial Sequence
  Synthetic
catccccagcgagccatggaccgcaggacatgaatggatcttggcggacaagcgaccaactgcatggttccttcc

SEQ ID NO: 359521 - DNA, 75 bp, Artificial Sequence
  Synthetic
ctatggggtggaaaacgttagagtcgcatatggtaagtgtgactcagcaggcaggtctaggaggtcaagaagggc

SEQ ID NO: 359522 - DNA, 75 bp, Artificial Sequence
  Synthetic
gcatatggtaagtgtgactcagcaggcaggtctaggaggtcaagaagggccattgacttgcctacgcatgaaaac

SEQ ID NO: 359523 - DNA, 75 bp, Artificial Sequence
  Synthetic
gcagcctcgctgcggaaagcggggaaaaatgtggtggtgctgaataggaaaacctttgaaaaggagtaccccacc

SEQ ID NO: 359524 - DNA, 75 bp, Artificial Sequence
  Synthetic
aaaatgtggtggtgctgaataggaaaacctttgaaaaggagtaccccaccattaagcagaagaaaccggatttca

SEQ ID NO: 359525 - DNA, 75 bp, Artificial Sequence
  Synthetic
gggagcaaacctgtgtgtggagagagtcttggactgcagaactgcctacaagcctgtcctggttgatgaagggaa

SEQ ID NO: 359526 - DNA, 75 bp, Artificial Sequence
  Synthetic
ccttgtgggaagcaacatgacgcaacgagtcgtgattgccctactggtcttggctgttggtccggcctactcagc

SEQ ID NO: 359527 - DNA, 75 bp, Artificial Sequence
  Synthetic
gtcttggactgcagaactgcctacaagcctgtcctggttgatgaagggaagaaggtggccatcaaagggccgcta

SEQ ID NO: 359528 - DNA, 75 bp, Artificial Sequence
  Synthetic
tggctgttggtccggcctactcagctcactgcattggaattactgacagggatttcattgagggggtgcatggag

SEQ ID NO: 359529 - DNA, 75 bp, Artificial Sequence
  Synthetic
agaggagaggacgcattggacgcaatcccaacagagatggtgactcttactactactcagaacctaccagtgagg

SEQ ID NO: 359530 - DNA, 75 bp, Artificial Sequence
  Synthetic
tcccaacagagatggtgactcttactactactcagaacctaccagtgaggacaatgcacaccatgtgtgctggct

SEQ ID NO: 359531 - DNA, 75 bp, Artificial Sequence
  Synthetic
atggaggttagaggggggatggttgctccactttatggcattgagggaacaaagactcccgtctctccaggagaa

SEQ ID NO: 359532 - DNA, 75 bp, Artificial Sequence
  Synthetic
ctccactttatggcattgagggaacaaagactcccgtctctccaggagaaatgaggctaagagatgatcagagaa

SEQ ID NO: 359533 - DNA, 75 bp, Artificial Sequence
  Synthetic
tgaagattaatgacaagtgccccagcactggagaggcccacctagctgaagagaacgaaggggacaatgcgtgca

SEQ ID NO: 359534 - DNA, 75 bp, Artificial Sequence
  Synthetic
cactggagaggcccacctagctgaagagaacgaaggggacaatgcgtgcaagcgcacttattctgatagaggctg

SEQ ID NO: 359535 - DNA, 75 bp, Artificial Sequence
  Synthetic
gtgtgatttgccagtgtggttggcatggcaagtggcaaaagctggcctgaagaccaatgaccgcaaatggtgttt

SEQ ID NO: 359536 - DNA, 75 bp, Artificial Sequence
  Synthetic
tggcaagtggcaaaagctggcctgaagaccaatgaccgcaaatggtgttttgagggtcctgaagagcatgaaata

SEQ ID NO: 359537 - DNA, 75 bp, Artificial Sequence
  Synthetic
aaagggagcattgtggcatgcgccaaattcacttgtgccaaatccatgagtttgtttgaggttgatcagaccaaa

SEQ ID NO: 359538 - DNA, 75 bp, Artificial Sequence
  Synthetic
agtgtagatctccgggcggagcaaaaagagcattgagacctagatggtgtgacgagagagtttcctcagaccaga

SEQ ID NO: 359539 - DNA, 75 bp, Artificial Sequence
  Synthetic
aagagcattgagacctagatggtgtgacgagagagtttcctcagaccagagtgccttggctgacttcatcaagtt

SEQ ID NO: 359540 - DNA, 75 bp, Artificial Sequence
  Synthetic
ttggactaccgacattaagactctcaagtttgatgccctgtcaggctcccaggaagtcgagttcattgggtatgg

SEQ ID NO: 359541 - DNA, 75 bp, Artificial Sequence
  Synthetic
gagatgcttgtgatcctcacggagttgcccgatttcctggcaaagaagggtggggaggccatggataccatcagt

SEQ ID NO: 359542 - DNA, 75 bp, Artificial Sequence
  Synthetic
tgcccgatttcctggcaaagaagggtggggaggccatggataccatcagtgtgttcctacattctgaagagggtt

SEQ ID NO: 359543 - DNA, 75 bp, Artificial Sequence
  Synthetic
aatgatgccagaagccatgaccattgtcatgctcttcctgcttgccggactcttgacctcaggagcggtgatttt

SEQ ID NO: 359544 - DNA, 75 bp, Artificial Sequence
  Synthetic
gtcatgctcttcctgcttgccggactcttgacctcaggagcggtgattttcttcatgtcgcctaaaggcatgagt

SEQ ID NO: 359545 - DNA, 75 bp, Artificial Sequence
  Synthetic
tggctggcagtggatatctcatgtttttggggggagtaaaaccaacccacatctcttacgtcatgttaatattct

SEQ ID NO: 359546 - DNA, 75 bp, Artificial Sequence
  Synthetic
tttggggggagtaaaaccaacccacatctcttacgtcatgttaatattctttgtcctcatggtcgtcgtaattcc

SEQ ID NO: 359547 - DNA, 75 bp, Artificial Sequence
  Synthetic
caggataaccaagttgcctatctcataattgggatcttgacattgctatcagttgtggcagctaatgaactaggg

SEQ ID NO: 359548 - DNA, 75 bp, Artificial Sequence
  Synthetic
taattgggatcttgacattgctatcagttgtggcagctaatgaactagggatgctggagaagaccaaggaagatt

SEQ ID NO: 359549 - DNA, 75 bp, Artificial Sequence
  Synthetic
caatcaataaaggcattttggttacagttaaccccatcgcctcaaccaatgatgatgaagtgctgattgaggtga

SEQ ID NO: 359550 - DNA, 75 bp, Artificial Sequence
  Synthetic
accaagtggggctatcccatggagttggcctgacctggatctgaaacctggggcagcctggacagtctatgtggg

SEQ ID NO: 359551 - DNA, 75 bp, Artificial Sequence
  Synthetic
tggcctgacctggatctgaaacctggggcagcctggacagtctatgtgggaatcgtgacgatgttgtctcccatg

SEQ ID NO: 359552 - DNA, 75 bp, Artificial Sequence
  Synthetic
atggcaatttgtcactatcgggaatagcccaatctgcctcagttctttcatttatggacaaaggaattcccttca

SEQ ID NO: 359553 - DNA, 75 bp, Artificial Sequence
  Synthetic
agcccaatctgcctcagttctttcatttatggacaaaggaattcccttcatgaaaatgaacatatctgtggtcat

SEQ ID NO: 359554 - DNA, 75 bp, Artificial Sequence
  Synthetic
atcacagtgatccctctgttgtgcggcattggtggagccatgttgcactggacgctcatacttcctgggattaaa

SEQ ID NO: 359555 - DNA, 75 bp, Artificial Sequence
  Synthetic
gcattggtggagccatgttgcactggacgctcatacttcctgggattaaagcccagcaatcaaagctggctcaaa

SEQ ID NO: 359556 - DNA, 75 bp, Artificial Sequence
  Synthetic
gtacttatatgggttggcatcaacacaagaaacatgacaatgtccatgagcatgatcttggtaggagtgatcatg

SEQ ID NO: 359557 - DNA, 75 bp, Artificial Sequence
  Synthetic
aaatccagttgttgatggtaatccaactgctgacattgaggaagccccagaaatgccagctttatatgaaaagaa

SEQ ID NO: 359558 - DNA, 75 bp, Artificial Sequence
  Synthetic
actgctgacattgaggaagccccagaaatgccagctttatatgaaaagaagctggctctttacctccttctggcc

SEQ ID NO: 359559 - DNA, 75 bp, Artificial Sequence
  Synthetic
cggatcaaggatgcgccatcaactttggcaagagagagctcaagtgcggagatggtatcttcatatttagagact

SEQ ID NO: 359560 - DNA, 75 bp, Artificial Sequence
  Synthetic
gcagaacccctttttccttagcggaaggaatagtattgtcatctgccgcccttggacctctcattgaggggaaca

SEQ ID NO: 359561 - DNA, 75 bp, Artificial Sequence
  Synthetic
aggaatagtattgtcatctgccgcccttggacctctcattgaggggaacactagtctgttgtggaatggcccaat

SEQ ID NO: 359562 - DNA, 75 bp, Artificial Sequence
  Synthetic
atactatccagaagatcctgtgaagcttgcatcaatagtgaaagcctcttttgaagaagggaagtgtggcctaaa

SEQ ID NO: 359563 - DNA, 75 bp, Artificial Sequence
  Synthetic
cttgcatcaatagtgaaagcctcttttgaagaagggaagtgtggcctaaattcagttgactcccttgagcatgag

SEQ ID NO: 359564 - DNA, 75 bp, Artificial Sequence
  Synthetic
cgtggcaactactatgcttttgtgggagtcatgtacaatctctggaaaatgaaaacagagcgtagagggagtgca

SEQ ID NO: 359565 - DNA, 75 bp, Artificial Sequence
  Synthetic
gagtcatgtacaatctctggaaaatgaaaacagagcgtagagggagtgcaagtggaaaaacattgggtgaggtct

SEQ ID NO: 359566 - DNA, 75 bp, Artificial Sequence
  Synthetic
caaacaacaatttgaaatgtacaaaagaacagacatcattgaggtggaccgagacatggcacgacgacacttggc

SEQ ID NO: 359567 - DNA, 75 bp, Artificial Sequence
  Synthetic
agaacagacatcattgaggtggaccgagacatggcacgacgacacttggcagagggaaaggtggacacgggagtg

SEQ ID NO: 359568 - DNA, 75 bp, Artificial Sequence
  Synthetic
tgagatggttccacgagcgtggctatgtgaagctagaaggaagggtcaccgatcttgggtgtggacgtggaggct

SEQ ID NO: 359569 - DNA, 75 bp, Artificial Sequence
  Synthetic
tgtgaagctagaaggaagggtcaccgatcttgggtgtggacgtggaggctggtgctactatgcagcagctcaaaa

SEQ ID NO: 359570 - DNA, 75 bp, Artificial Sequence
  Synthetic
acccttggcagagatggtcatgagaaacctatgaatgtccaaagcttgggatggaatattgtgacttttaaggac

SEQ ID NO: 359571 - DNA, 75 bp, Artificial Sequence
  Synthetic
aagagtgcccatggctctccaacattttggatgggaagtcatgaagtaaatgggacatggatgatccacaccttg

SEQ ID NO: 359572 - DNA, 75 bp, Artificial Sequence
  Synthetic
tttggatgggaagtcatgaagtaaatgggacatggatgatccacaccttggaggcattagattacaaggagtgtg

SEQ ID NO: 359573 - DNA, 75 bp, Artificial Sequence
  Synthetic
aacctatgaatgtccaaagcttgggatggaatattgtgacttttaaggacaagactgatgttcaccgactggagc

SEQ ID NO: 359574 - DNA, 75 bp, Artificial Sequence
  Synthetic
tgacattggagaatcgtccccatcctccgcaactgagggtgagaggaccttaagagttctggacacagttgaaaa

SEQ ID NO: 359575 - DNA, 75 bp, Artificial Sequence
  Synthetic
tccgcaactgagggtgagaggaccttaagagttctggacacagttgaaaagtggttggcttgtggagtggacaac

SEQ ID NO: 359576 - DNA, 75 bp, Artificial Sequence
  Synthetic
acatgcccgatgtgatagagaaactggagcttcttcaaagaagattcggtggaaccgtcattaggaatcctcttt

SEQ ID NO: 359577 - DNA, 75 bp, Artificial Sequence
  Synthetic
ggagcttcttcaaagaagattcggtggaaccgtcattaggaatcctctttccaggaattccactcatgaaatgta

SEQ ID NO: 359578 - DNA, 75 bp, Artificial Sequence
  Synthetic
tcctgaatggtgttgccgctcctgcacaatgccgcctgtgagcttccatggtagtgatgggtgttggtatcccat

SEQ ID NO: 359579 - DNA, 75 bp, Artificial Sequence
  Synthetic
atcacattcacagtcaatcagacatcacgcctgctgatgcgaaggatgaggcggcccacaggcaaagttaccttg

SEQ ID NO: 359580 - DNA, 75 bp, Artificial Sequence
  Synthetic
cacgcctgctgatgcgaaggatgaggcggcccacaggcaaagttaccttggaagctgatgttattcttccgatag

SEQ ID NO: 359581 - DNA, 75 bp, Artificial Sequence
  Synthetic
ttacagctggagaaatacatgctgtcccttttggtttggtgagcatgatgatagcaatggaagtggtcctaagga

SEQ ID NO: 359582 - DNA, 75 bp, Artificial Sequence
  Synthetic
aggcccattggataaggatgctattgaggaaagagttgagagaatcaagaatgaatatgccactacatggttcta

SEQ ID NO: 359583 - DNA, 75 bp, Artificial Sequence
  Synthetic
cccttttggtttggtgagcatgatgatagcaatggaagtggtcctaaggaaaagacagggaccaaagcaaatgtt

SEQ ID NO: 359584 - DNA, 75 bp, Artificial Sequence
  Synthetic
gaggaaagagttgagagaatcaagaatgaatatgccactacatggttctatgacaatgacaacccgtatagaacg

SEQ ID NO: 359585 - DNA, 75 bp, Artificial Sequence
  Synthetic
gcaatgctggtcgggcaagtaactctccttgatttgctgaaactcacagtggctgtgggattgcatttccatgag

SEQ ID NO: 359586 - DNA, 75 bp, Artificial Sequence
  Synthetic
ccaaaacgtcaggaagtgcagccagcatgataaatggagttatcaaaatcttaacttttccatgggacagaatag

SEQ ID NO: 359587 - DNA, 75 bp, Artificial Sequence
  Synthetic
catgataaatggagttatcaaaatcttaacttttccatgggacagaatagaagaagtcacaagaatggcaatgac

SEQ ID NO: 359588 - DNA, 75 bp, Artificial Sequence
  Synthetic
agagttttcaaggagaaagtagacacaagagcaaaagaccctcctgctggaacaaggaagatcatgaaggtggtg

SEQ ID NO: 359589 - DNA, 75 bp, Artificial Sequence
  Synthetic
caagagcaaaagaccctcctgctggaacaaggaagatcatgaaggtggtgaatagatggttgtttcggcatctgt

SEQ ID NO: 359590 - DNA, 75 bp, Artificial Sequence
  Synthetic
caccaaagaagagttcattgccaaagtgcggagccatgccgcagtgggggcttttctagaggagcaagagcagtg

SEQ ID NO: 359591 - DNA, 75 bp, Artificial Sequence
  Synthetic
gtgcggagccatgccgcagtgggggcttttctagaggagcaagagcagtggaaaacggccaatgaggcagtccag

SEQ ID NO: 359592 - DNA, 75 bp, Artificial Sequence
  Synthetic
atgcagaacgcaaacttcatcagcaggggcgatgccagtcctgtgtgtacaacatgatgggaaagagggaaaaga

SEQ ID NO: 359593 - DNA, 75 bp, Artificial Sequence
  Synthetic
ggggcgatgccagtcctgtgtgtacaacatgatgggaaagagggaaaagaaactctctgaatttggaaaggccaa

SEQ ID NO: 359594 - DNA, 75 bp, Artificial Sequence
  Synthetic
tggcttggggcacggtttcttgagtttgaggctcttgggttcttaaatgaagatcactgggcctcccgggagaac

SEQ ID NO: 359595 - DNA, 75 bp, Artificial Sequence
  Synthetic
ttgaggctcttgggttcttaaatgaagatcactgggcctcccgggagaactcggggggaggagttgagggcacag

SEQ ID NO: 359596 - DNA, 75 bp, Artificial Sequence
  Synthetic
acaaccttttttgggcctgtgtgcatttctggcaacccgcatatttgggcgaaggagtatcccagtgaatgaggc

SEQ ID NO: 359597 - DNA, 75 bp, Artificial Sequence
  Synthetic
cagggacttgtcagccaaagaaggtggagggttttatgctgatgacaccgccggctgggacacacgcatcacaga

SEQ ID NO: 359598 - DNA, 75 bp, Artificial Sequence
  Synthetic
ggagggttttatgctgatgacaccgccggctgggacacacgcatcacagaagctgacctggatgacgagcaagag

SEQ ID NO: 359599 - DNA, 75 bp, Artificial Sequence
  Synthetic
aaaggaagctggcctgggccataatggaaatgacatacaagaacaaagtggtcaaggtgctgaggccagccccag

SEQ ID NO: 359600 - DNA, 75 bp, Artificial Sequence
  Synthetic
atgatgtggcactcagtgaacaaggggagttcaagctgctttctgaagagaaagtgccatgggaccaggttgtga

SEQ ID NO: 359601 - DNA, 75 bp, Artificial Sequence
  Synthetic
ggagttcaagctgctttctgaagagaaagtgccatgggaccaggttgtgatgacctcgctggccttggttggggc

SEQ ID NO: 359602 - DNA, 75 bp, Artificial Sequence
  Synthetic
ggaaatgacatacaagaacaaagtggtcaaggtgctgaggccagccccaggaggcaaggccttcatggacatcat

SEQ ID NO: 359603 - DNA, 75 bp, Artificial Sequence
  Synthetic
ggacaagttgtgacatacgccctcaacaccataaccaatctaaaagtccagctcataagaatggctgaagctgaa

SEQ ID NO: 359604 - DNA, 75 bp, Artificial Sequence
  Synthetic
acaccataaccaatctaaaagtccagctcataagaatggctgaagctgaaatggtgattaaccatcagcatgtgc

SEQ ID NO: 359605 - DNA, 75 bp, Artificial Sequence
  Synthetic
atctggaggatgggatttatggcatattccagtcaaccttcttgggggcctcccagcgaggagtgggagtggcac

SEQ ID NO: 359606 - DNA, 75 bp, Artificial Sequence
  Synthetic
gcggctcgaaacttggcttgctgaaaatggatgtgacagattgagccgaatggctgtgagtggagatgattgtgt

SEQ ID NO: 359607 - DNA, 75 bp, Artificial Sequence
  Synthetic
attccagtcaaccttcttgggggcctcccagcgaggagtgggagtggcacagggaggggtgttccacacaatgtg

SEQ ID NO: 359608 - DNA, 75 bp, Artificial Sequence
  Synthetic
aatggatgtgacagattgagccgaatggctgtgagtggagatgattgtgtggtgagaccggtggatgacagattt

SEQ ID NO: 359609 - DNA, 75 bp, Artificial Sequence
  Synthetic
agggaggggtgttccacacaatgtggcatgtcacaagaggagctttccttgtcaggaatggcaagaagttgattc

SEQ ID NO: 359610 - DNA, 75 bp, Artificial Sequence
  Synthetic
caatgtccaaagttaggaaggacatatcagaatggcaaccctccaaaggatggacagattgggaaaatgttcctt

SEQ ID NO: 359611 - DNA, 75 bp, Artificial Sequence
  Synthetic
catcttgggcttcagtaaaggaagaccttgtcgcctatggtggctcatggaagttggaaggcagatgggatggag

SEQ ID NO: 359612 - DNA, 75 bp, Artificial Sequence
  Synthetic
atcagaatggcaaccctccaaaggatggacagattgggaaaatgttcctttctgctctcaccacttccatgaact

SEQ ID NO: 359613 - DNA, 75 bp, Artificial Sequence
  Synthetic
gtggtgccttgcagagaccaagatgaactgatagggagagggagagtgtccccaggaaatggctggatgatcaag

SEQ ID NO: 359614 - DNA, 75 bp, Artificial Sequence
  Synthetic
gtccagacaaaaccgagcttgttcaaagtgaggaatgggggagaaatcggggctgtcgctcttgactatccgagt

SEQ ID NO: 359615 - DNA, 75 bp, Artificial Sequence
  Synthetic
aactgatagggagagggagagtgtccccaggaaatggctggatgatcaaggaaacagcctgcctcagcaaagctt

SEQ ID NO: 359616 - DNA, 75 bp, Artificial Sequence
  Synthetic
ggctgtcgctcttgactatccgagtggcacttcaggatctcctattgttaacaggaacggagaggtgattgggct

SEQ ID NO: 359617 - DNA, 75 bp, Artificial Sequence
  Synthetic
cttccacaagagggacatgaggctactttcatttgctgtttcctccgctgttccaacagcctgggtgcccagtgg

SEQ ID NO: 359618 - DNA, 75 bp, Artificial Sequence
  Synthetic
ctttcatttgctgtttcctccgctgttccaacagcctgggtgcccagtggaaggacgacgtggtctgtccacgga

SEQ ID NO: 359619 - DNA, 75 bp, Artificial Sequence
  Synthetic
acatgctagatgtctggaacagggtgtgggtgttgaataacccgcacatgacggacaaaacaaccatcaaggagt

SEQ ID NO: 359620 - DNA, 75 bp, Artificial Sequence
  Synthetic
gtgggtgttgaataacccgcacatgacggacaaaacaaccatcaaggagtggagagatgttccctacctcacaaa

SEQ ID NO: 359621 - DNA, 75 bp, Artificial Sequence
  Synthetic
gacgcttgcgcactcttgtgttggcccccaccagggttgttctttctgaaatgaaggaggcttttcacggcctgg

SEQ ID NO: 359622 - DNA, 75 bp, Artificial Sequence
  Synthetic
ctgataggaatgacaaacagggccacatgggcatctcacatccaccttgtgatccaccggatcagaactctaata

SEQ ID NO: 359623 - DNA, 75 bp, Artificial Sequence
  Synthetic
catgggcatctcacatccaccttgtgatccaccggatcagaactctaataggtcaagagaagttcacagactacc

SEQ ID NO: 359624 - DNA, 75 bp, Artificial Sequence
  Synthetic
tgatgctgaccttcagccaggagagcttatttgagacatgacaacatggaaaaccgggataaaaactacgggtgg

SEQ ID NO: 359625 - DNA, 75 bp, Artificial Sequence
  Synthetic
cttatttgagacatgacaacatggaaaaccgggataaaaactacgggtggagaaccggactccccacttgagaaa

SEQ ID NO: 359626 - DNA, 75 bp, Artificial Sequence
  Synthetic
tggatccagctagcatagccgctagaggttgggcagcgcacagagctagggcaaatgaaagtgcaacaatcttga

SEQ ID NO: 359627 - DNA, 75 bp, Artificial Sequence
  Synthetic
caacggatggagaaccggactccacactgaataggttataaacgtcagcccaggatccaaaatttgaatgggtct

SEQ ID NO: 359628 - DNA, 75 bp, Artificial Sequence
  Synthetic
tgatgaatttccacattcaaatggtgaaatagaagatgttcaaacggacatacccagtgagccctggaacacagg

SEQ ID NO: 359629 - DNA, 75 bp, Artificial Sequence
  Synthetic
tgccaccgctaagctgtgaggcggtgcgggctgggacagccgtttcccgggcaacgacatgcctggtttctggga

SEQ ID NO: 359630 - DNA, 75 bp, Artificial Sequence
  Synthetic
gcatgactggatcctggctgacaaaaggcccacggcatggttccttccatccatcagagctgcaaatgtcatggc

SEQ ID NO: 359631 - DNA, 75 bp, Artificial Sequence
  Synthetic
ccatcagagctgcaaatgtcatggctgcctctttgcgtaaggctggaaagagtgtggtggtcctgaacaggaaaa

SEQ ID NO: 359632 - DNA, 75 bp, Artificial Sequence
  Synthetic
agtgtggtggtcctgaacaggaaaacctttgagagagaataccccacgataaagcagaagaaacctgactttata

SEQ ID NO: 359633 - DNA, 75 bp, Artificial Sequence
  Synthetic
aatgcccaccacgtctgctggttggaggcctcaatgctcttggacaacatggaggtgaggggtggaatggtcgcc

SEQ ID NO: 359634 - DNA, 75 bp, Artificial Sequence
  Synthetic
aaacaccagtttcccctggtgaaatgagactgagggatgaccagaggaaagtcttcagagaactagtgaggaatt

SEQ ID NO: 359635 - DNA, 75 bp, Artificial Sequence
  Synthetic
gcaagtggccaaggctggtttgaagacgaatgatcgtaagtggtgttttgaaggccctgaggaacatgagatctt

SEQ ID NO: 359636 - DNA, 75 bp, Artificial Sequence
  Synthetic
tgcagggctcctggaggagcaaagaagcctctgcgcccaaggtggtgtgatgaaagggtgtcatctgaccagagt

SEQ ID NO: 359637 - DNA, 75 bp, Artificial Sequence
  Synthetic
agtgctagttgtgctgagtgaactccctgatttcctggctaaaaaaggtggagaggcaatggataccatcagtgt

SEQ ID NO: 359638 - DNA, 75 bp, Artificial Sequence
  Synthetic
aatgtctatggcgatgggcacaatggccggctgtggatatctcatgttccttggaggcgtcaaacccactcacat

SEQ ID NO: 359639 - DNA, 75 bp, Artificial Sequence
  Synthetic
gtcctgatggtggttgtgatccccgagccagggcaacaaaggtccatccaagacaaccaagtggcatacctcatt

SEQ ID NO: 359640 - DNA, 75 bp, Artificial Sequence
  Synthetic
gctggagaaaaccaaagaggacctctttgggaagaagaacttaattccatctagtgcttcaccctggagttggcc

SEQ ID NO: 359641 - DNA, 75 bp, Artificial Sequence
  Synthetic
tggtcagtggctggaattcaataacagtgatgcctctgctctgtggcatagggtgcgccatgctccactggtctc

SEQ ID NO: 359642 - DNA, 75 bp, Artificial Sequence
  Synthetic
cttcacctcggttgggaaaggaattcatacggtgtttggctctgcctttcaggggctatttggtggcttgaactg

SEQ ID NO: 359643 - DNA, 75 bp, Artificial Sequence
  Synthetic
ctgtggttgatgggaatccaacagttgacattgaggaagctcctgaaatgcctgccctttatgagaagaaactgg

SEQ ID NO: 359644 - DNA, 75 bp, Artificial Sequence
  Synthetic
tgacattgaggaagctcctgaaatgcctgccctttatgagaagaaactggctctatatctccttcttgctctcag

SEQ ID NO: 359645 - DNA, 75 bp, Artificial Sequence
  Synthetic
cttctttggaatggacccatggctgtctccatgacaggagtcatgagggggaatcactatgcttttgtgggagtc

SEQ ID NO: 359646 - DNA, 75 bp, Artificial Sequence
  Synthetic
ctccagggggaccgcaaagttaaggtggttccatgagcgtggctatgtcaagctggaaggtagggtgattgacct

SEQ ID NO: 359647 - DNA, 75 bp, Artificial Sequence
  Synthetic
tggttccatgagcgtggctatgtcaagctggaaggtagggtgattgacctggggtgtggccgcggaggctggtgt

SEQ ID NO: 359648 - DNA, 75 bp, Artificial Sequence
  Synthetic
cacagagggggaaaggaccgtgagagttcttgatactgtagaaaaatggctggcttgtggggttgacaacttctg

SEQ ID NO: 359649 - DNA, 75 bp, Artificial Sequence
  Synthetic
ccagatgttctcgagaaactggaattgctccaaaggaggtttggcggaacagtgatcaggaaccctctctccagg

SEQ ID NO: 359650 - DNA, 75 bp, Artificial Sequence
  Synthetic
aagggttgagaggataaaatctgagtacatgacctcttggttttatgacaatgacaacccctacaggacctggca

SEQ ID NO: 359651 - DNA, 75 bp, Artificial Sequence
  Synthetic
atgacaacccctacaggacctggcactactgtggctcctatgtcacaaaaacctcaggaagtgcggcgagcatgg

SEQ ID NO: 359652 - DNA, 75 bp, Artificial Sequence
  Synthetic
atatccatgggacaggatagaggaggtcacaagaatggcaatgactgacacaaccccttttggacagcaaagagt

SEQ ID NO: 359653 - DNA, 75 bp, Artificial Sequence
  Synthetic
gtcacaagaatggcaatgactgacacaaccccttttggacagcaaagagtgtttaaagaaaaagttgacaccaga

SEQ ID NO: 359654 - DNA, 75 bp, Artificial Sequence
  Synthetic
gcaaaggatccaccagcgggaactaggaagatcatgaaagttgtcaacaggtggctgttccgccacctggccaga

SEQ ID NO: 359655 - DNA, 75 bp, Artificial Sequence
  Synthetic
gaaaggaagctgcaccaacaaggcaggtgtcggacttgtgtgtacaacatgatggggaaaagagagaagaagctg

SEQ ID NO: 359656 - DNA, 75 bp, Artificial Sequence
  Synthetic
ggtgtcggacttgtgtgtacaacatgatggggaaaagagagaagaagctgtcagagtttgggaaagcaaagggaa

SEQ ID NO: 359657 - DNA, 75 bp, Artificial Sequence
  Synthetic
aggaggagtggaaggcattggcttacaatacctaggatatgtgatcagagacctggctgcaatggatggtggtgg

SEQ ID NO: 359658 - DNA, 75 bp, Artificial Sequence
  Synthetic
acctggctgcaatggatggtggtggattctacgcggatgacaccgctggatgggacacgcgcatcacagaggcag

SEQ ID NO: 359659 - DNA, 75 bp, Artificial Sequence
  Synthetic
gaactacatgagcccacatcacaaaaaactggcacaagcagtgatggaaatgacatacaagaacaaagtggtgaa

SEQ ID NO: 359660 - DNA, 75 bp, Artificial Sequence
  Synthetic
agtgttgagaccagccccaggagggaaagcctacatggatgtcataagtcgacgagaccagagaggatccgggca

SEQ ID NO: 359661 - DNA, 75 bp, Artificial Sequence
  Synthetic
tggaggcatggctcactgagcacggatgtaacagactgaagaggatggcggtgagtggagacgactgtgtggtcc

SEQ ID NO: 359662 - DNA, 75 bp, Artificial Sequence
  Synthetic
ggccctgtcccatctcaacgccatgtccaaggttagaaaggacatatctgaatggcagccatcaaaagggtggaa

SEQ ID NO: 359663 - DNA, 75 bp, Artificial Sequence
  Synthetic
tgaaggatggcaggaggattgtggtgccttgccgagaacaggacgagctcattgggagaggaagggtgtctccag

SEQ ID NO: 359664 - DNA, 75 bp, Artificial Sequence
  Synthetic
gccttgccgagaacaggacgagctcattgggagaggaagggtgtctccaggaaacggctggatgatcaaggaaac

SEQ ID NO: 359665 - DNA, 75 bp, Artificial Sequence
  Synthetic
acctcatgggttccacaaggacgcacaacatggtcgattcatgggaaaggggagtggatgaccacggaagacatg

SEQ ID NO: 359666 - DNA, 75 bp, Artificial Sequence
  Synthetic
ggagtggatgaccacggaagacatgcttgaggtgtggaacagagtatggataaccaacaacccacacatgcagga

SEQ ID NO: 359667 - DNA, 75 bp, Artificial Sequence
  Synthetic
aatgtcaatggcgaaaggcacaatggccggctgcggatatctcatgtttcttggaggcgtggaacccactcacat

SEQ ID NO: 359668 - DNA, 75 bp, Artificial Sequence
  Synthetic
ggagaaatacactgactacctaacagtcatggacaggtattctgtggatgctgacctgcaactgggtgagcttat

SEQ ID NO: 359669 - DNA, 75 bp, Artificial Sequence
  Synthetic
ccgggatacaaaccacgggtggagaaccggactccccacaacctgaaaccgggatataaaccacggctggagaac

SEQ ID NO: 359670 - DNA, 75 bp, Artificial Sequence
  Synthetic
catattgacgccagggaaagaccggagtggttctctgcttttcctccagaggtctgtgagcacagtttgctcaag

SEQ ID NO: 359671 - DNA, 75 bp, Artificial Sequence
  Synthetic
aaacatcttggaagccaagtactggtgcccagattcaatggaatacaactgtcccaatctcagtccaagagagga

SEQ ID NO: 359672 - DNA, 75 bp, Artificial Sequence
  Synthetic
aatgacaacaacctttacaaactacatggtggacatgtttcttgcagagtgaaattgtcagctttgacactcaag

SEQ ID NO: 359673 - DNA, 75 bp, Artificial Sequence
  Synthetic
atggtctgcagtatggttggaagacttggggtaagaaccttgtgttctccccagggaggaagaatggaagcttca

SEQ ID NO: 359674 - DNA, 75 bp, Artificial Sequence
  Synthetic
gatgatgaagtgttgatcgaggtgaaccctccctttggggacagctacatcatagttggaactggggattcacgc

SEQ ID NO: 359675 - DNA, 75 bp, Artificial Sequence
  Synthetic
ctcacatcttacctgggcttgacacaaccttttttgggcctgtgtgcatttctggcaacccgcatatttgggcga

SEQ ID NO: 359676 - DNA, 75 bp, Artificial Sequence
  Synthetic
ccagcgaggagtgggagtggcacagggaggggtgttccacacaatgtggcatgtcacaagaggagctttccttgt

SEQ ID NO: 359677 - DNA, 75 bp, Artificial Sequence
  Synthetic
gaactcaaaggacacttccatgcagaagaccatacccctggtggcccttacactgacatcttacctaggactgac

SEQ ID NO: 359678 - DNA, 75 bp, Artificial Sequence
  Synthetic
ggaatttaaactactctctgaagagaaggtgccatgggatcaggttgtgatgacttcattggccttggtcggagc

SEQ ID NO: 359679 - DNA, 75 bp, Artificial Sequence
  Synthetic
ccgctcacggcagcgggagagaagtcattgatgctatgtgccatgccaccctaacttacaggatgttggaaccaa

SEQ ID NO: 359680 - DNA, 75 bp, Artificial Sequence
  Synthetic
aggaggagtttatagcaaaagttcgcagtcatgcggccatcggagctttcctggaagagcaagaacagtggaaga

SEQ ID NO: 359681 - DNA, 75 bp, Artificial Sequence
  Synthetic
cttaaaccgggataaaaactacggatggagaaccggactccacacattaaacagaagaggatgtcagcccagaaa

SEQ ID NO: 359682 - DNA, 75 bp, Artificial Sequence
  Synthetic
aaatggagcctccgctaccacctccccacgtggtggtagaaagacggggtctagaggttagaggagaccctccag

SEQ ID NO: 359683 - DNA, 75 bp, Artificial Sequence
  Synthetic
cgccagggaaagaccggagtggttctctgcttttcctccagaggttctgtgagcacagttgctcaagaataagca

SEQ ID NO: 359684 - DNA, 75 bp, Artificial Sequence
  Synthetic
cagtgttgagacagacaagggacccctggacaaagaggccatagaagaaagggttgagaggataaaatctgagta

SEQ ID NO: 359685 - DNA, 75 bp, Artificial Sequence
  Synthetic
cagaccgcagtggacttcagcaacagttacattgcagagatggagaaagagagctggattgtggataaacagtgg

SEQ ID NO: 359686 - DNA, 75 bp, Artificial Sequence
  Synthetic
catagttggaacaggggattcacgcttgacttaccagtggcacaaggaaggcagctcaatagggaagttgttcac

SEQ ID NO: 359687 - DNA, 75 bp, Artificial Sequence
  Synthetic
ttgacttaccagtggcacaaggaaggcagctcaatagggaagttgttcacccagaccatgaagggcgcagagcgt

SEQ ID NO: 359688 - DNA, 75 bp, Artificial Sequence
  Synthetic
cagatgactggctgaacaagtattcatattatccagaggacccagtaaaacttgcttcaatagtgaaagcttcct

SEQ ID NO: 359689 - DNA, 75 bp, Artificial Sequence
  Synthetic
acatggtcgattcatgggaaaggggagtggatgaccacggaagacatgcttgaggtgtggaacagagtatggata

SEQ ID NO: 359690 - DNA, 75 bp, Artificial Sequence
  Synthetic
acaatgccaccagtgagcttccacgggagtgatggttgctggtatcctatggagatcagaccaaagaagacacat

SEQ ID NO: 359691 - DNA, 75 bp, Artificial Sequence
  Synthetic
ggagtgatggttgctggtatcctatggagatcagaccaaagaagacacatgacagccacctggtccgctcatggg

SEQ ID NO: 359692 - DNA, 75 bp, Artificial Sequence
  Synthetic
agaagtttcttgggaagaggaagctgagatcagtggaagttctgcccgttatgatgtgactctcagtgagcaagg

SEQ ID NO: 359693 - DNA, 75 bp, Artificial Sequence
  Synthetic
aaggtgccatgggatcaggttgtgatgacttcattggctttggtcggagctgctatccacccatttgcactctta

SEQ ID NO: 359694 - DNA, 75 bp, Artificial Sequence
  Synthetic
gacaactcttttgtgtctgccatatcccaaactgaggtgaaagaagaggggaaagaggagctacaggaaatcccg

SEQ ID NO: 359695 - DNA, 75 bp, Artificial Sequence
  Synthetic
gcatgtaggggccaagcaggaaaattggaaaaccgacattaagactctcaagtttgatgccctgtcaggctccca

SEQ ID NO: 359696 - DNA, 75 bp, Artificial Sequence
  Synthetic
aaactgcggtggactttggtaacagttacatcgctgagatggaaaaagagagctggatagtggacagacagtggg

SEQ ID NO: 359697 - DNA, 75 bp, Artificial Sequence
  Synthetic
catggtggacatgtttcttgcagagtgaaattgtcagctttgacactcaaggggacatcctacaaaatgtgcact

SEQ ID NO: 359698 - DNA, 75 bp, Artificial Sequence
  Synthetic
atgatgaagtgctgattgaggtgaacccaccttttggagatagctacattatcgttgggacaggagattcacgtc

SEQ ID NO: 359699 - DNA, 75 bp, Artificial Sequence
  Synthetic
cagaccatgaaaggcgcggaacgcctggccgtcatgggagacgccgcctgggatttcagctccgctggagggttc

SEQ ID NO: 359700 - DNA, 75 bp, Artificial Sequence
  Synthetic
tgagtggggttaagggattcacccttggaaaggaaggccacgaaaagcccatgaatgtgcaaagcctggggtgga

SEQ ID NO: 359701 - DNA, 75 bp, Artificial Sequence
  Synthetic
atgacaacccttacaggacttggcattattgcggttcctatgttacaagaacctcagggagcgcggcaagcatga

SEQ ID NO: 359702 - DNA, 75 bp, Artificial Sequence
  Synthetic
gcaaaggatccaccagcagggaccaggaaaatcatgaaggttgtcaataggtggctattccgtcacttggccaga

SEQ ID NO: 359703 - DNA, 75 bp, Artificial Sequence
  Synthetic
ggagcagccatggtggagattgccttgggtggcatgatgggcggcctgtggaagtatctaaatgcagtttctctc

SEQ ID NO: 359704 - DNA, 75 bp, Artificial Sequence
  Synthetic
cttctaggaaagcatcaaataccatcctgcccctcatggctctgttgacacctgtcactatggctgaggtgagac

SEQ ID NO: 359705 - DNA, 75 bp, Artificial Sequence
  Synthetic
tgctggcaggactggcttttcaggagatggagaacttccttggtccgattgcagttggaggaatcctgatgatgc

SEQ ID NO: 359706 - DNA, 75 bp, Artificial Sequence
  Synthetic
gacctcgctggccttggttggggctgccattcatccatttgctcttctgctggtccttgctgggtggctgtttca

SEQ ID NO: 359707 - DNA, 75 bp, Artificial Sequence
  Synthetic
cacggctcacctaaagaggttgtggaaaatgctggacccaagacaaggcctggctgtcctgaggaaagtcaaaag

SEQ ID NO: 359708 - DNA, 75 bp, Artificial Sequence
  Synthetic
ttgtcctcaaggaaacgccgttcccacgatgtcctgactgtgcaatttttgattctgggaatgctgctgatggcg

SEQ ID NO: 359709 - DNA, 75 bp, Artificial Sequence
  Synthetic
acgatgtcctgactgtgcaatttttgattctgggaatgctgctgatggcgggtggagtaaccttggtgcggaaaa

SEQ ID NO: 359710 - DNA, 75 bp, Artificial Sequence
  Synthetic
atctgaggaccttgggaagaccttttctgtgggtacgggcaactgcacaacaaacatcttggaagccaagtattg

SEQ ID NO: 359711 - DNA, 75 bp, Artificial Sequence
  Synthetic
tctgtgggtacgggcaactgcacaacaaacatcttggaagccaagtattggtgtccagattcaatggaatacaac

SEQ ID NO: 359712 - DNA, 75 bp, Artificial Sequence
  Synthetic
agccggatgacattgattgttggtgttacggagtggaaaatgtcagagttgcatatggcaagtgtgactcagcag

SEQ ID NO: 359713 - DNA, 75 bp, Artificial Sequence
  Synthetic
ttacggagtggaaaatgtcagagttgcatatggcaagtgtgactcagcaggcaggtcaagaaggtcaagaagagc

SEQ ID NO: 359714 - DNA, 75 bp, Artificial Sequence
  Synthetic
tcttgtgggtagcaacatgacgcagcgagtcgtgattgccctcctggttttggctgttggtccggcttactcagc

SEQ ID NO: 359715 - DNA, 75 bp, Artificial Sequence
  Synthetic
cggaccagctgaggcgagaaaggtgtgttacaatgcagtcctcactcatgtgaagatcaatgacaagtgccctag

SEQ ID NO: 359716 - DNA, 75 bp, Artificial Sequence
  Synthetic
gaaaatgagggggacaatgcgtgtaagcgcacttattcggatagaggctggggaaacggctgtggcctgttcggg

SEQ ID NO: 359717 - DNA, 75 bp, Artificial Sequence
  Synthetic
agcgcacttattcggatagaggctggggaaacggctgtggcctgttcgggaaaggaagcattgtggcatgcgcca

SEQ ID NO: 359718 - DNA, 75 bp, Artificial Sequence
  Synthetic
atccagtacgtcatcagagcacaactgcatgttggggcaaagcaggaaaattggaacaccgacatcaaaactctc

SEQ ID NO: 359719 - DNA, 75 bp, Artificial Sequence
  Synthetic
caacagagatggagactcatactactattctgagcctacaagtgaagataatgcccaccacgtctgctggttgga

SEQ ID NO: 359720 - DNA, 75 bp, Artificial Sequence
  Synthetic
aggaagccgagttcactgggtatggaaaagctactctggaatgccaggtgcaaactgcagtagactttggcaaca

SEQ ID NO: 359721 - DNA, 75 bp, Artificial Sequence
  Synthetic
aaaagctactctggaatgccaggtgcaaactgcagtagactttggcaacagttacatcgctgagatggaaaagga

SEQ ID NO: 359722 - DNA, 75 bp, Artificial Sequence
  Synthetic
gctcaggacttaaccttaccatggcagagcggcagtggtggggtgtggagggaaatgcaccaccttgttgaattt

SEQ ID NO: 359723 - DNA, 75 bp, Artificial Sequence
  Synthetic
agagcggcagtggtggggtgtggagggaaatgcaccaccttgttgaatttgaacctccccatgctgcaaccatca

SEQ ID NO: 359724 - DNA, 75 bp, Artificial Sequence
  Synthetic
aggctctttaaaaacagccctcacaggtgcaatgagggttacaaaggacacgaatgacaacaatctgtacaaact

SEQ ID NO: 359725 - DNA, 75 bp, Artificial Sequence
  Synthetic
acatggcggacatgtctcctgtagagtgaaattgtcagctttaacactcaaagggacatcctacaagatgtgcac

SEQ ID NO: 359726 - DNA, 75 bp, Artificial Sequence
  Synthetic
agtcaaccccatcgcctcaaccaatgatgatgaagtgttgatcgaagtgaatccaccctttggagatagttacat

SEQ ID NO: 359727 - DNA, 75 bp, Artificial Sequence
  Synthetic
gatgcctgaggcaatgacaatagtcatgctgtttatactggctggactactgacatcgggaatggtcatcttttt

SEQ ID NO: 359728 - DNA, 75 bp, Artificial Sequence
  Synthetic
ctcacctatcagtggcacaaagagggaagttcaataggaaagctgttcacccagactatgaaaggcgcagagcgc

SEQ ID NO: 359729 - DNA, 75 bp, Artificial Sequence
  Synthetic
cttcacttcgattgggaaaggaattcacacggtgtttggctctgcctttcagggactttttggtggcttgagctg

SEQ ID NO: 359730 - DNA, 75 bp, Artificial Sequence
  Synthetic
gtcctcatatgggtcggcatcaacacaaggaatatgacaatgtccatgagcatgatcttagtaggagtgattatg

SEQ ID NO: 359731 - DNA, 75 bp, Artificial Sequence
  Synthetic
caaggaatatgacaatgtccatgagcatgatcttagtaggagtgattatgatgttcttgtctctgggagttgggg

SEQ ID NO: 359732 - DNA, 75 bp, Artificial Sequence
  Synthetic
tggcaagagggagctcaagtgcggggatggtatcttcatctttagagactctgatgactggctgaacaagtactc

SEQ ID NO: 359733 - DNA, 75 bp, Artificial Sequence
  Synthetic
atattacccagaagaccctgtgaagcttgcatcaatagtgaaagcctcctttgaggaaggaaagtgcggcctaaa

SEQ ID NO: 359734 - DNA, 75 bp, Artificial Sequence
  Synthetic
ggatggcttgcagtatggctggaagacttggggtaagaaccttgtgttctctccagggagaaagaatggaagttt

SEQ ID NO: 359735 - DNA, 75 bp, Artificial Sequence
  Synthetic
ctccagggagaaagaatggaagtttcatcatagacggaaagtccagaaaagaatgcccgttctcaaaccgagttt

SEQ ID NO: 359736 - DNA, 75 bp, Artificial Sequence
  Synthetic
tgtcctagcatcagctgccttagggccgctcatagagggaaacaccagccttctttggaatggacccatggctgt

SEQ ID NO: 359737 - DNA, 75 bp, Artificial Sequence
  Synthetic
aagagcgcccatgggtccccaacattttggatgggaagccatgaggtgaatgggacatggatgattcacacctta

SEQ ID NO: 359738 - DNA, 75 bp, Artificial Sequence
  Synthetic
tttggatgggaagccatgaggtgaatgggacatggatgattcacaccttagagacgctggattataaggagtgcg

SEQ ID NO: 359739 - DNA, 75 bp, Artificial Sequence
  Synthetic
gacattgtggaggtggatcgtgatacggcacgcaggcatttggccgaagggaaggtggacaccggggtggcggtc

SEQ ID NO: 359740 - DNA, 75 bp, Artificial Sequence
  Synthetic
acaatgccacccgtgagttttcacgggaatgatggatgctggtaccccatggaaattaggccaaggaaaacacat

SEQ ID NO: 359741 - DNA, 75 bp, Artificial Sequence
  Synthetic
ggaatgatggatgctggtaccccatggaaattaggccaaggaaaacacatgaaagccacttggtacgatcatggg

SEQ ID NO: 359742 - DNA, 75 bp, Artificial Sequence
  Synthetic
tccttgacttgctgaaactcacagtggctgtgggattacactttcatgagatgaacaatggaggagacgctatgt

SEQ ID NO: 359743 - DNA, 75 bp, Artificial Sequence
  Synthetic
ggctgtgggattacactttcatgagatgaacaatggaggagacgctatgtacatggcgttgattgctgccttttc

SEQ ID NO: 359744 - DNA, 75 bp, Artificial Sequence
  Synthetic
tttgggcttaggacgctgtggagccctcgggaacgccttgtgctgaccctgggagccgccatggtggagatagcc

SEQ ID NO: 359745 - DNA, 75 bp, Artificial Sequence
  Synthetic
ctcgggaacgccttgtgctgaccctgggagccgccatggtggagatagccctgggtggtatgatgggcggcctgt

SEQ ID NO: 359746 - DNA, 75 bp, Artificial Sequence
  Synthetic
ctgcatcctgaccataaatgctgttgcttctaggaaagcatcaaatgtcatcttgcccctcatggccttgttaac

SEQ ID NO: 359747 - DNA, 75 bp, Artificial Sequence
  Synthetic
tcttgcccctcatggccttgttaacacccgtgaccatggcagaggtgaggcttgccacaatgcttttttgcactg

SEQ ID NO: 359748 - DNA, 75 bp, Artificial Sequence
  Synthetic
ctggtcagcgtggctgggagagtagatgggcttgagctcaggaaacttggtgaagtctcatgggaagaggaagca

SEQ ID NO: 359749 - DNA, 75 bp, Artificial Sequence
  Synthetic
tgctatccacccatttgctctcctgttagtccttgctggctggctgtttcatgtcaaaggagctaggagaagtgg

SEQ ID NO: 359750 - DNA, 75 bp, Artificial Sequence
  Synthetic
gtcaggaatggcaagaagctgattccatcctgggcttcagtgaaagaggaccttgttgcctatggtggttcatgg

SEQ ID NO: 359751 - DNA, 75 bp, Artificial Sequence
  Synthetic
aagaagaggttcaactgattgctgctgtcccaggaaagaatgtggtcaatgtccagacaaaaccgagcttgttta

SEQ ID NO: 359752 - DNA, 75 bp, Artificial Sequence
  Synthetic
tgtcccaggaaagaatgtggtcaatgtccagacaaaaccgagcttgtttaaagtgaggaatggaggagaaatcgg

SEQ ID NO: 359753 - DNA, 75 bp, Artificial Sequence
  Synthetic
acaggaatggagaggtgattggtctgtatggcaatggcattcttgtcggtgataactccttcgtgtccgccatat

SEQ ID NO: 359754 - DNA, 75 bp, Artificial Sequence
  Synthetic
aaaggaggagcttcaagagatcccgacaatgttgaaaaaaggaatgacaactatcctcgacttccatcctggagc

SEQ ID NO: 359755 - DNA, 75 bp, Artificial Sequence
  Synthetic
tgggaagacgcgacgtttcctcccacagatcttggctgaatgcgcacggagacgtctacgcacgcttgtgctggc

SEQ ID NO: 359756 - DNA, 75 bp, Artificial Sequence
  Synthetic
gtcatcgatgccatgtgccatgctactctaacatacaggatgttggaaccaaccaggattgtcaactgggaagtg

SEQ ID NO: 359757 - DNA, 75 bp, Artificial Sequence
  Synthetic
aggttgggcagcacacagagctagggcaaatgaaagtgcaacaatcttgatgacggccacaccgccagggaccag

SEQ ID NO: 359758 - DNA, 75 bp, Artificial Sequence
  Synthetic
gagatagaagatgtccaaacggacatacccagtgagccctggaatacagggcatgattggatcctggcggacaaa

SEQ ID NO: 359759 - DNA, 75 bp, Artificial Sequence
  Synthetic
tacccagtgagccctggaatacagggcatgattggatcctggcggacaaaaggcccacggcatggttcctcccat

SEQ ID NO: 359760 - DNA, 75 bp, Artificial Sequence
  Synthetic
gagaaatatactgactacctaacagtcatggacagatattctgtggatgctgacctgcaaccgggtgagcttatc

SEQ ID NO: 359761 - DNA, 75 bp, Artificial Sequence
  Synthetic
agaagaggacgcattgggagaaatcccaatagagatggagactcatactactattctgagcccacaagtgaagac

SEQ ID NO: 359762 - DNA, 75 bp, Artificial Sequence
  Synthetic
aaaccgggataaaaactacggatggagaaccggactccacacattgagacagaagaagttgtcagcccagaactc

SEQ ID NO: 359763 - DNA, 75 bp, Artificial Sequence
  Synthetic
agaagaagttgtcagcccagaactccacacgagttttgccactgctaagctgtgaggcagtgcaggctgggacag

SEQ ID NO: 359764 - DNA, 75 bp, Artificial Sequence
  Synthetic
gaacgacagtggtgaaacagtgaagtgccgggctcctggcggggcgaagaggcctctgcgcccaaggtggtgcga

SEQ ID NO: 359765 - DNA, 75 bp, Artificial Sequence
  Synthetic
gcgcttgctgatttcataaaatttgctgaaggtagaaggggagccgcagaagtgctggttgtgctgagtgaactt

SEQ ID NO: 359766 - DNA, 75 bp, Artificial Sequence
  Synthetic
ctgaaggtagaaggggagccgcagaagtgctggttgtgctgagtgaacttcctgactttctggcgaagaaaggtg

SEQ ID NO: 359767 - DNA, 75 bp, Artificial Sequence
  Synthetic
agggcttaccgcaatgctctgtcaatgatgcctgaagcaatgacaatagtcatgctgttcatactagctggactg

SEQ ID NO: 359768 - DNA, 75 bp, Artificial Sequence
  Synthetic
agaatgctggacccaagacagggcttagctgtcctgaagaaggttaagagggtggtggcgagtctgatgagaggt

SEQ ID NO: 359769 - DNA, 75 bp, Artificial Sequence
  Synthetic
tagctgtcctgaagaaggttaagagggtggtggcgagtctgatgagaggtttgtcctcgaggaaacgccgatctc

SEQ ID NO: 359770 - DNA, 75 bp, Artificial Sequence
  Synthetic
gttctgatggtagttgtgatccccgagccagggcaacaaaggtccatccaagacaatcaggtggcatatctcatc

SEQ ID NO: 359771 - DNA, 75 bp, Artificial Sequence
  Synthetic
agccagggcaacaaaggtccatccaagacaatcaggtggcatatctcatcattggcatcctgacgctggtctcag

SEQ ID NO: 359772 - DNA, 75 bp, Artificial Sequence
  Synthetic
acagatggttacttctgaatgttacatctgaggacctggggaaaaccttttctgttggcacaggtaactgcacaa

SEQ ID NO: 359773 - DNA, 75 bp, Artificial Sequence
  Synthetic
gctggagagaactaaagaagatctatttgggaggaagaacttgatcccgtcaagcgcctcgccctggagttggcc

SEQ ID NO: 359774 - DNA, 75 bp, Artificial Sequence
  Synthetic
gcttggactgtgtatgttggcattgtcacgatgctctctccaatgttgcaccactggattaaggtcgaatatggc

SEQ ID NO: 359775 - DNA, 75 bp, Artificial Sequence
  Synthetic
ttatggagtggaaaatgtcagagtcgcttacggcaagtgtgattcagcgggtaggtcaagaaggtccagaagggc

SEQ ID NO: 359776 - DNA, 75 bp, Artificial Sequence
  Synthetic
gagacagctgcagaaaattgaaagatggctggtaaggaaccccttttttgcggcaacagccttggccattgccta

SEQ ID NO: 359777 - DNA, 75 bp, Artificial Sequence
  Synthetic
tggctggtaaggaaccccttttttgcggcaacagccttggccattgcctacctggtggggagcaacatgacgcaa

SEQ ID NO: 359778 - DNA, 75 bp, Artificial Sequence
  Synthetic
agtgatgcctctgctttgtggcatagggtgtgccatgctccattggactctcatcctacctgggattaaggcgca

SEQ ID NO: 359779 - DNA, 75 bp, Artificial Sequence
  Synthetic
tatcactagaaacagttgccattgatggacctgctgaagcaaggaaggtgtgctacagtgcagtcttaaccaatg

SEQ ID NO: 359780 - DNA, 75 bp, Artificial Sequence
  Synthetic
acgcctttttcaatggctgaaggcattgtcctagcatcagctgccttggggccgctcatagagggaaacactagc

SEQ ID NO: 359781 - DNA, 75 bp, Artificial Sequence
  Synthetic
acgcctttttcattggctgaaggcattgtcctagcatcagctgccttggggccgctcatagagggaaacactagc

SEQ ID NO: 359782 - DNA, 75 bp, Artificial Sequence
  Synthetic
acgcctttttcactggctgaaggcattgtcctagcatcagctgccttggggccgctcatagagggaaacactagc

SEQ ID NO: 359783 - DNA, 75 bp, Artificial Sequence
  Synthetic
acgcctttttcagtggctgaaggcattgtcctagcatcagctgccttggggccgctcatagagggaaacactagc

SEQ ID NO: 359784 - DNA, 75 bp, Artificial Sequence
  Synthetic
cttagcctctgttgccatgtgcagaacgcctttttcaatggctgaaggcattgtcctagcatcagctgccttggg

SEQ ID NO: 359785 - DNA, 75 bp, Artificial Sequence
  Synthetic
cttagcctctgttgccatgtgcagaacgcctttttcattggctgaaggcattgtcctagcatcagctgccttggg

SEQ ID NO: 359786 - DNA, 75 bp, Artificial Sequence
  Synthetic
cttagcctctgttgccatgtgcagaacgcctttttcactggctgaaggcattgtcctagcatcagctgccttggg

SEQ ID NO: 359787 - DNA, 75 bp, Artificial Sequence
  Synthetic
cttagcctctgttgccatgtgcagaacgcctttttcagtggctgaaggcattgtcctagcatcagctgccttggg

SEQ ID NO: 359788 - DNA, 75 bp, Artificial Sequence
  Synthetic
tgaagatcaatgacaagtgccccagcactggtgaagcccacttggaagaagaaaatgaaggagacaatgcttgta

SEQ ID NO: 359789 - DNA, 75 bp, Artificial Sequence
  Synthetic
tttccatgacaggagttatgcggggaaactactatgcctttgtaggggtcatgtacaatctgtggaagatggaaa

SEQ ID NO: 359790 - DNA, 75 bp, Artificial Sequence
  Synthetic
aaactactatgcctttgtaggggtcatgtacaatctgtggaagatggaaactggacgcagggggagggcgaatgg

SEQ ID NO: 359791 - DNA, 75 bp, Artificial Sequence
  Synthetic
gggaaatggttgtggcctgtttggaaaaggaagcattgtggcatgtgccaagtttacctgtgctaaatccatgag

SEQ ID NO: 359792 - DNA, 75 bp, Artificial Sequence
  Synthetic
tctatttgaggttgatcagaccaaaattcagtatgtcattagggcacagctacatgttggagccaagcaggagaa

SEQ ID NO: 359793 - DNA, 75 bp, Artificial Sequence
  Synthetic
agggagctgaacctgctggacaagcagcaatttgagttgtacaaaaggactgatattgtggaggtggatcgtgac

SEQ ID NO: 359794 - DNA, 75 bp, Artificial Sequence
  Synthetic
gaaaagtggacaccggggtggctgtctcgagggggaccgcaaagctgaggtggtttcatgagcgtggctatgtca

SEQ ID NO: 359795 - DNA, 75 bp, Artificial Sequence
  Synthetic
aggaagctgagttcactggatacgggaaggccacactggagtgccaggttcagaccgcagtggacttcagcaata

SEQ ID NO: 359796 - DNA, 75 bp, Artificial Sequence
  Synthetic
ctcgagggggaccgcaaagctgaggtggtttcatgagcgtggctatgtcaagctggaaggtagggtgactgactt

SEQ ID NO: 359797 - DNA, 75 bp, Artificial Sequence
  Synthetic
agagtggaagtggcggcgtgtggagagagatgcatcatctcgtggaattcgagcctccacatgctgcaaccatca

SEQ ID NO: 359798 - DNA, 75 bp, Artificial Sequence
  Synthetic
agagatgcatcatctcgtggaattcgagcctccacatgctgcaaccatcaaagtgttagcccttggaaaccaaga

SEQ ID NO: 359799 - DNA, 75 bp, Artificial Sequence
  Synthetic
ggtgcaatgcgagttacaaaagacacaaataacagcaagctgtacaagctgcatggggggcacgtcgcgtgtagg

SEQ ID NO: 359800 - DNA, 75 bp, Artificial Sequence
  Synthetic
gcatggggggcacgtcgcgtgtagggtgaagttgtcagctctcacacttaagggaacatcctacaagatgtgtac

SEQ ID NO: 359801 - DNA, 75 bp, Artificial Sequence
  Synthetic
agggaacatcctacaagatgtgtaccgacaaaatgtcttttgtcaagaatccaactgacactggacatggcactg

SEQ ID NO: 359802 - DNA, 75 bp, Artificial Sequence
  Synthetic
cgacaaaatgtcttttgtcaagaatccaactgacactggacatggcactgcagtgatgcaagtgaaggtgccaaa

SEQ ID NO: 359803 - DNA, 75 bp, Artificial Sequence
  Synthetic
aattccactcatgagatgtactacgtgtctggagcccgcagcaatgtcacgtttactgtgaatcaaacatcccgt

SEQ ID NO: 359804 - DNA, 75 bp, Artificial Sequence
  Synthetic
gggagcaccctgcagaatcccagtaatggtcgccgatgatctcacagcggcagtcaacaagggtattttggtcac

SEQ ID NO: 359805 - DNA, 75 bp, Artificial Sequence
  Synthetic
caactggtaaagtgaccctggaggctgatgtcattcttccaatcggcacacgtagtgtcgagacagacaaaggac

SEQ ID NO: 359806 - DNA, 75 bp, Artificial Sequence
  Synthetic
tgatgtcattcttccaatcggcacacgtagtgtcgagacagacaaaggacccctagatagagaggccatagaaga

SEQ ID NO: 359807 - DNA, 75 bp, Artificial Sequence
  Synthetic
ttgacttaccagtggcacaaggaaggtagctcaatagggaagttgttcactcagaccatgaagggcgcagagcgc

SEQ ID NO: 359808 - DNA, 75 bp, Artificial Sequence
  Synthetic
tacatgaccacctggttttatgacaatgacaacccctacaggacctggcactactgcggctcctatgtcacgaaa

SEQ ID NO: 359809 - DNA, 75 bp, Artificial Sequence
  Synthetic
atgacaacccctacaggacctggcactactgcggctcctatgtcacgaaaacttcagggagtgcagcaagcatgg

SEQ ID NO: 359810 - DNA, 75 bp, Artificial Sequence
  Synthetic
gggactttggctctgccggaggattcttcacatcagtcggaaaaggaatacacactgtgtttggctctgccttcc

SEQ ID NO: 359811 - DNA, 75 bp, Artificial Sequence
  Synthetic
cacactgtgtttggctctgccttccaaggattgtttggtggcttgagctggataacaaaggtcattatgggggta

SEQ ID NO: 359812 - DNA, 75 bp, Artificial Sequence
  Synthetic
atatccatgggacaggatagaggaggtcacaaggatggcaatgactgacacaactccctttggacagcaaagggt

SEQ ID NO: 359813 - DNA, 75 bp, Artificial Sequence
  Synthetic
gtcacaaggatggcaatgactgacacaactccctttggacagcaaagggtgtttaaagagaaagttgataccaga

SEQ ID NO: 359814 - DNA, 75 bp, Artificial Sequence
  Synthetic
atgttcctgtccctaggagttggggcggaccaaggatgtgcaataaactttggcaagagagaactcaagtgtggg

SEQ ID NO: 359815 - DNA, 75 bp, Artificial Sequence
  Synthetic
ggaaaatcatgaaagttgtcaacaggtggcttttccgtcatctggccagagaaaagaatcccagattgtgcacaa

SEQ ID NO: 359816 - DNA, 75 bp, Artificial Sequence
  Synthetic
tagccatgcagccattggagcctacctggaagaacaagaacagtggaagactgccaacgaggctgttcaggaccc

SEQ ID NO: 359817 - DNA, 75 bp, Artificial Sequence
  Synthetic
ttgaggaaggaaagtgtggcttgaactcagtcgactccctggaacatgaaatgtggagaagcagagcagatgaga

SEQ ID NO: 359818 - DNA, 75 bp, Artificial Sequence
  Synthetic
gccgtgccatctggtacatgtggctgggagcgcggtatcttgagtttgaagccctaggatttctgaatgaggacc

SEQ ID NO: 359819 - DNA, 75 bp, Artificial Sequence
  Synthetic
acttggggcaaaaaccttgtattctctccaggaagaaagaatggaagcttcatcatagatgggaagtccaggaaa

SEQ ID NO: 359820 - DNA, 75 bp, Artificial Sequence
  Synthetic
catcatagatgggaagtccaggaaagagtgtccgttttcaaacagagtgtggaactccttccagatagaagagtt

SEQ ID NO: 359821 - DNA, 75 bp, Artificial Sequence
  Synthetic
attctatgcggatgacaccgctggatgggacacacgcatcacagaggcagaccttgatgatgaacaggaaatctt

SEQ ID NO: 359822 - DNA, 75 bp, Artificial Sequence
  Synthetic
gtgtacatggatgcagtctttgaatacactatggattgtgatggatccatcctgggtgcagcagtgaatggaaag

SEQ ID NO: 359823 - DNA, 75 bp, Artificial Sequence
  Synthetic
tgacatacaagaacaaggtggtgaaagtgctgagaccagcaccaggcgggaaagcttacatggatgtcataagcc

SEQ ID NO: 359824 - DNA, 75 bp, Artificial Sequence
  Synthetic
tctggatgggaagccatgaggtgaatggaacatggatgattcacaccctggagacactggactacaaggaatgtg

SEQ ID NO: 359825 - DNA, 75 bp, Artificial Sequence
  Synthetic
aatggccgctgacacacacgattggaacatcagttgaagagagtgacatgttcatgccgaggtcaattgggggtc

SEQ ID NO: 359826 - DNA, 75 bp, Artificial Sequence
  Synthetic
atcactaacctgaaagtccaattgatcaggatggcagaagcagagatggtgatacatcatcaacacgtccaggat

SEQ ID NO: 359827 - DNA, 75 bp, Artificial Sequence
  Synthetic
gggatacaaggtccagacaaacggaccctggatgcaggtgccactagaggtgaaaagggaagcttgcccaggaac

SEQ ID NO: 359828 - DNA, 75 bp, Artificial Sequence
  Synthetic
atgtgacagactgaagaggatggcggtgagtggagacgactgcgtggtccggcctattgatgataggttcggcat

SEQ ID NO: 359829 - DNA, 75 bp, Artificial Sequence
  Synthetic
tccaaggttagaaaggatatatctgaatggcagccatcaaaaggatggaatgactgggagaacgtgcccttttgc

SEQ ID NO: 359830 - DNA, 75 bp, Artificial Sequence
  Synthetic
tcccaccacttccatgaattgcagctgaaggatggcagaaggattgtggtgccctgccgggaacaagatgagctc

SEQ ID NO: 359831 - DNA, 75 bp, Artificial Sequence
  Synthetic
cccctttgggttggtgagcatgatgatagccatggaagtggtattgaggaagagacagggacccaagcaaatact

SEQ ID NO: 359832 - DNA, 75 bp, Artificial Sequence
  Synthetic
ggcatgcctcagcaaggcctacgccaacatgtggtcactgatgtactttcataagagggacatgagattgctgtc

SEQ ID NO: 359833 - DNA, 75 bp, Artificial Sequence
  Synthetic
acctcatgggtcccacaaggacgcacgacatggtcgattcatgggaagggggagtggatgaccccagaagacatg

SEQ ID NO: 359834 - DNA, 75 bp, Artificial Sequence
  Synthetic
cgacatggtcgattcatgggaagggggagtggatgaccccagaagacatgcttgaggtgtggaacagagtgtgga

SEQ ID NO: 359835 - DNA, 75 bp, Artificial Sequence
  Synthetic
tttggattgaggacgctgtggagcccccgggaacgccttgtgctgaccctgggggccgccatggtggagattgct

SEQ ID NO: 359836 - DNA, 75 bp, Artificial Sequence
  Synthetic
ttaggtggcatgatgggaggtctgtggaagtacctgaatgcagtatccctttgcatcctgacaataaatgctgtt

SEQ ID NO: 359837 - DNA, 75 bp, Artificial Sequence
  Synthetic
ggaagtacctgaatgcagtatccctttgcatcctgacaataaatgctgttgcctccagaaaagcatcaaatgtca

SEQ ID NO: 359838 - DNA, 75 bp, Artificial Sequence
  Synthetic
ggagaaatacactgactacttaacagtcatggatagatactctgttgatgctgacctgcaaccaggtgagctcat

SEQ ID NO: 359839 - DNA, 75 bp, Artificial Sequence
  Synthetic
accgggatacaaaccacgggtggagaaccggactccccacaactgaaaaccgggatacaaaccacggctggagaa

SEQ ID NO: 359840 - DNA, 75 bp, Artificial Sequence
  Synthetic
ttcatggcaacccgaatattcgggcgaaggagcatcccagtgaatgaagcgcttgcagctgctggtctcgtggga

SEQ ID NO: 359841 - DNA, 75 bp, Artificial Sequence
  Synthetic
atggacttgaactcaagaaacttggagaagtttcttgggaagaggaagctgagattagtggaagttctgcccgct

SEQ ID NO: 359842 - DNA, 75 bp, Artificial Sequence
  Synthetic
aaggtgccatgggatcaggttgtgatgacttcattggccttggtcggagctgctatccacccatttgccctctta

SEQ ID NO: 359843 - DNA, 75 bp, Artificial Sequence
  Synthetic
acgtcaaaggagccagaagaagtggagatgtcctttgggacattcccacacctaaaatcattgaggagtgtgaat

SEQ ID NO: 359844 - DNA, 75 bp, Artificial Sequence
  Synthetic
agatgtcctttgggacattcccacacctaaaatcattgaggagtgtgaatatctagaggatggaatctacggcat

SEQ ID NO: 359845 - DNA, 75 bp, Artificial Sequence
  Synthetic
tggaggcatggctcactgagcacggatgtgacagactgaagaggatggcggtgagtggagacgactgtgtggtcc

SEQ ID NO: 359846 - DNA, 75 bp, Artificial Sequence
  Synthetic
atttcagtcaacattcctaggagcctctcaacggggagtgggagtggcgcagggaggggtcttccacacgatgtg

SEQ ID NO: 359847 - DNA, 75 bp, Artificial Sequence
  Synthetic
gtgctaattgaggtgcattggtctgcaaatcgagttgctaggcaataaacacatttggattaattttaatcgttc

SEQ ID NO: 359848 - DNA, 75 bp, Artificial Sequence
  Synthetic
caaatcgagttgctaggcaataaacacatttggattaattttaatcgttcgttgagcgattagcagagaactgac

SEQ ID NO: 359849 - DNA, 75 bp, Artificial Sequence
  Synthetic
gcacgtcacgagaggggcctttctcgttagaaacggcaaaaagctggttccatcctgggcctcagtcaaggagga

SEQ ID NO: 359850 - DNA, 75 bp, Artificial Sequence
  Synthetic
catcctgggcctcagtcaaggaggaccttgttgcttatggcggctcatggaagttggagggtagatgggatggag

SEQ ID NO: 359851 - DNA, 75 bp, Artificial Sequence
  Synthetic
ccttgttgcttatggcggctcatggaagttggagggtagatgggatggagaagaggaggttcagttgatagcagc

SEQ ID NO: 359852 - DNA, 75 bp, Artificial Sequence
  Synthetic
ggcggttgcccttgactacccgagcggcacttctggttctcccatcgtcaacaggaatggtgaggtaatagggct

SEQ ID NO: 359853 - DNA, 75 bp, Artificial Sequence
  Synthetic
ccaagacaaggcttggctgttctaaggaaagtcaagagagtggtggccagtttgatgagaggattgtcctcaagg

SEQ ID NO: 359854 - DNA, 75 bp, Artificial Sequence
  Synthetic
gaaagaggagctacaggaaatcccaacaatgctgaagaaagggatgacaaccattcttgatttccatcctggagc

SEQ ID NO: 359855 - DNA, 75 bp, Artificial Sequence
  Synthetic
atgaaggaagcctttcatggcctagatgtcaagttccatacacaggccttctccgcccacggtagcggaaaagaa

SEQ ID NO: 359856 - DNA, 75 bp, Artificial Sequence
  Synthetic
ccctgacatatagaatgctggaaccaaccagagtggtcaattgggaagtgatcatcatggacgaagcacactttt

SEQ ID NO: 359857 - DNA, 75 bp, Artificial Sequence
  Synthetic
tagatccggctagcatagcagccagaggctgggcggcacatagagccagagcaaatgaaagtgcaacaatcttga

SEQ ID NO: 359858 - DNA, 75 bp, Artificial Sequence
  Synthetic
tgactgccacccctccgggaactagtgatgaattcccacattcaaatggggaaatagaggatgtccaaacggaca

SEQ ID NO: 359859 - DNA, 75 bp, Artificial Sequence
  Synthetic
agtgtggtggtgctgaacaggaaaacctttgagaaagaataccccacaattaaacagaaaaaacctgatttcatc

SEQ ID NO: 359860 - DNA, 75 bp, Artificial Sequence
  Synthetic
taaacagaaaaaacctgatttcatcctggccactgacatagctgagatgggagccaatctctgcgtggagagagt

SEQ ID NO: 359861 - DNA, 75 bp, Artificial Sequence
  Synthetic
ctggccactgacatagctgagatgggagccaatctctgcgtggagagagtgttggattgtaggacggctttcaaa

SEQ ID NO: 359862 - DNA, 75 bp, Artificial Sequence
  Synthetic
cctgtgcttgtggatgaagggaggaaggtggcaataaaagggccactccggatttcagcttcctccgctgcccaa

SEQ ID NO: 359863 - DNA, 75 bp, Artificial Sequence
  Synthetic
aggtggcaataaaagggccactccggatttcagcttcctccgctgcccaaaggagggggcgcattggaaggaacc

SEQ ID NO: 359864 - DNA, 75 bp, Artificial Sequence
  Synthetic
ctactctgagcccacaagtgaagacaatgcacatcatgtctgttggctggaggcctcaatgctcttagataacat

SEQ ID NO: 359865 - DNA, 75 bp, Artificial Sequence
  Synthetic
ccactttatggcattgaaggaacaaagacaccagtttccccaggtgaaatgaggctaagagatgaccagaggaga

SEQ ID NO: 359866 - DNA, 75 bp, Artificial Sequence
  Synthetic
acaaatgaccgaaagtggtgctttgagggcccagaagaacacgagatcttgaatgacagtggtgagacagtaaag

SEQ ID NO: 359867 - DNA, 75 bp, Artificial Sequence
  Synthetic
tgatgcctgaggcaatgacaacagtcatgctgtttgttctggctgggctgctgacgtctggaatggttatcttct

SEQ ID NO: 359868 - DNA, 75 bp, Artificial Sequence
  Synthetic
ttggaggcgtcaaacccacccatatctcctacatcatgctaatattttttgtcttgatggtggttgtggttccgg

SEQ ID NO: 359869 - DNA, 75 bp, Artificial Sequence
  Synthetic
gctggaaaagactaaggaagacctctttgggaaaaagaatttgattccatctagtgccgcaccttggagctggcc

SEQ ID NO: 359870 - DNA, 75 bp, Artificial Sequence
  Synthetic
ctagtgccgcaccttggagctggccagactttgacttgaaaccaggagctgcttggactgtctatgttggcattg

SEQ ID NO: 359871 - DNA, 75 bp, Artificial Sequence
  Synthetic
agactttgacttgaaaccaggagctgcttggactgtctatgttggcattgtcacaatgctctccccaatgctgca

SEQ ID NO: 359872 - DNA, 75 bp, Artificial Sequence
  Synthetic
ggtgatgcccctgctttgtggcattggatgcgccatgcttcactggactctcatcctgcctggaattaaagcgca

SEQ ID NO: 359873 - DNA, 75 bp, Artificial Sequence
  Synthetic
gtgtttcatggtgttgctaagaatccggtggttgatgggaatccaacagttgacattgaggaagccccggaaatg

SEQ ID NO: 359874 - DNA, 75 bp, Artificial Sequence
  Synthetic
cggtggttgatgggaatccaacagttgacattgaggaagccccggaaatgcctgccctctatgagaagaagttgg

SEQ ID NO: 359875 - DNA, 75 bp, Artificial Sequence
  Synthetic
cctgccctctatgagaagaagttggcactgtaccttctgcttgcccttagcttggcctctgttgccatgtgtaga

SEQ ID NO: 359876 - DNA, 75 bp, Artificial Sequence
  Synthetic
aaccttgtgttctccccagggaggaagaatggaagcttcatcatagatggaaagtccaggaaagaatgcccgttt

SEQ ID NO: 359877 - DNA, 75 bp, Artificial Sequence
  Synthetic
gaactactacgcttttgtgggtgtcatgtacaatctctggaagatgaatactgggcgcagggggagagcgaatgg

SEQ ID NO: 359878 - DNA, 75 bp, Artificial Sequence
  Synthetic
agggagctgaacctactggacaaacagcagtttgagctgtataaacggacagacattgtggaagtggaccgtgac

SEQ ID NO: 359879 - DNA, 75 bp, Artificial Sequence
  Synthetic
ctcgagagggaccgcaaaattgaggtggttccatgaacgtggctatgttaagctggaaggaagagtgactgacct

SEQ ID NO: 359880 - DNA, 75 bp, Artificial Sequence
  Synthetic
atgaatgtgcaaagcctggggtggaacatcatcactttcaaggataagactgatatccatcgccttgagccagtg

SEQ ID NO: 359881 - DNA, 75 bp, Artificial Sequence
  Synthetic
ttggagagtcgtctccatcatcagtgaccgaaggggaaaggaccatgagagttcttgacactgttgagaaatggt

SEQ ID NO: 359882 - DNA, 75 bp, Artificial Sequence
  Synthetic
tgtgaaggtgttggctccatacatgccagatgtgcttgaaaagttagagttgctccaaaggaggtttggtggaac

SEQ ID NO: 359883 - DNA, 75 bp, Artificial Sequence
  Synthetic
gtgcgctcctgggttacagctggagaaatacatgctgtcccttttggtttggtgagcatgatgatagcaatggaa

SEQ ID NO: 359884 - DNA, 75 bp, Artificial Sequence
  Synthetic
tgctccaaaggaggtttggtggaacggttatcaggaatcctctctccagaaattctacccacgagatgtattatg

SEQ ID NO: 359885 - DNA, 75 bp, Artificial Sequence
  Synthetic
ggagacgccatgtatatggcgttgattgctgccttttcaatcagaccagggctgctcatcggctttgggctcagg

SEQ ID NO: 359886 - DNA, 75 bp, Artificial Sequence
  Synthetic
cgcagtgtggaaacagataaaggaccacttgatagggcagccattgaagagagggttgaaagaataaaatctgaa

SEQ ID NO: 359887 - DNA, 75 bp, Artificial Sequence
  Synthetic
atacccctgggacaggatagaggaagtcacgagaatggcaatgacagacacaactccttttggacaacaaagagt

SEQ ID NO: 359888 - DNA, 75 bp, Artificial Sequence
  Synthetic
ctgccaatgaagctgtccaagatccaaaattctgggaattagtggatgaagagcgacggctacatcagcagggca

SEQ ID NO: 359889 - DNA, 75 bp, Artificial Sequence
  Synthetic
gatggggaagagagaaaagaaactgtcagaatttggaaaggcgaagggaagccgtgccatctggtacatgtggct

SEQ ID NO: 359890 - DNA, 75 bp, Artificial Sequence
  Synthetic
gggagcccgatatcttgagtttgaagccctgggatttctgaatgaggaccactgggcatccagggagaactcagg

SEQ ID NO: 359891 - DNA, 75 bp, Artificial Sequence
  Synthetic
gaactacatgagtccacaccacaggaagctagcgctggctgtaatggaaatgacatacaaaaataaagtggtgaa

SEQ ID NO: 359892 - DNA, 75 bp, Artificial Sequence
  Synthetic
ggcgggaccagagaggatccggacaggtggtgacctacgccttgaataccatcaccaacctgaaggtccaactga

SEQ ID NO: 359893 - DNA, 75 bp, Artificial Sequence
  Synthetic
ggtggtgacctacgccttgaataccatcaccaacctgaaggtccaactgatcaggatggcggaggcagagatggt

SEQ ID NO: 359894 - DNA, 75 bp, Artificial Sequence
  Synthetic
atcaccaacctgaaggtccaactgatcaggatggcggaggcagagatggtgatacaccaccagcatgtccaggac

SEQ ID NO: 359895 - DNA, 75 bp, Artificial Sequence
  Synthetic
tcaggatggcggaggcagagatggtgatacaccaccagcatgtccaggactgtgacgacacggttttgaccaaac

SEQ ID NO: 359896 - DNA, 75 bp, Artificial Sequence
  Synthetic
gatacaccaccagcatgtccaggactgtgacgacacggttttgaccaaacttgaggcatggctcgctgaacatgg

SEQ ID NO: 359897 - DNA, 75 bp, Artificial Sequence
  Synthetic
gaacgtggtcaacgtccagacaaaaccgagcttgttcaaagtgaggaatgggggagaaatcggggctgtcgctct

SEQ ID NO: 359898 - DNA, 75 bp, Artificial Sequence
  Synthetic
ggctctgtcccatcttaacgccatgtcaaaggtgcgaaaggacatatctgaatggcagccatcaaaaggatggga

SEQ ID NO: 359899 - DNA, 75 bp, Artificial Sequence
  Synthetic
tcaaaggtgcgaaaggacatatctgaatggcagccatcaaaaggatgggatgactgggagaacgtacctttctgc

SEQ ID NO: 359900 - DNA, 75 bp, Artificial Sequence
  Synthetic
tctcaccactttcatgaactgcaactgaaggatggcaggagaattgtagtgccttgccgagatcaagatgagctg

SEQ ID NO: 359901 - DNA, 75 bp, Artificial Sequence
  Synthetic
tgaaggatggcaggagaattgtagtgccttgccgagatcaagatgagctggttggcagaggaagagtgtctccag

SEQ ID NO: 359902 - DNA, 75 bp, Artificial Sequence
  Synthetic
gccttgccgagatcaagatgagctggttggcagaggaagagtgtctccaggaaatggctggatgatcaaggagac

SEQ ID NO: 359903 - DNA, 75 bp, Artificial Sequence
  Synthetic
aacatgtggtcactgatgtactttcacaagagggatatgaggctgctttcactggctgtttcttctgctgttccc

SEQ ID NO: 359904 - DNA, 75 bp, Artificial Sequence
  Synthetic
aggacaagctttgtggatcactgattgggatgaccaacagagccacttgggcatctcacatccacttggtaatac

SEQ ID NO: 359905 - DNA, 75 bp, Artificial Sequence
  Synthetic
aagaactggaccttgtacataaaaacttaaaccgggatagaaactacggatggagaaccggactccacacattaa

SEQ ID NO: 359906 - DNA, 75 bp, Artificial Sequence
  Synthetic
gctgtgaggcagtgcaggctgggacagccgccttccaggttgcgaaaaacctggtttctgagacttcccacctca

SEQ ID NO: 359907 - DNA, 75 bp, Artificial Sequence
  Synthetic
atgtcagcccagaaacccgcgtgggttctgccactgctaagctgtgaggcagtgcaggctgggacagccgccttc

SEQ ID NO: 359908 - DNA, 75 bp, Artificial Sequence
  Synthetic
gtctgctggttggaggcctcaatgctcttggacaacatggaggtgaggggtggaatggtcgccccactctatggc

SEQ ID NO: 359909 - DNA, 75 bp, Artificial Sequence
  Synthetic
agacttcccacgtcagggaaagaccgaagtggagctctgcttcccctccagaggtggtagaaagacacaaaacca

SEQ ID NO: 359910 - DNA, 75 bp, Artificial Sequence
  Synthetic
aagtttgatgccctgtcaggctcccaggaagccgagttcactgggtatggaaaagctacactggaatgccaggtg

SEQ ID NO: 359911 - DNA, 75 bp, Artificial Sequence
  Synthetic
gctctgtggcatagggtgcgccatgctccactggtctctcattttacctggaatcaaagcgcagcagtcaaagct

SEQ ID NO: 359912 - DNA, 75 bp, Artificial Sequence
  Synthetic
ttcagttgactcccttgagcatgagatgtggagaagcagggcagatgagatcaatgccattcttgaggaaaacga

SEQ ID NO: 359913 - DNA, 75 bp, Artificial Sequence
  Synthetic
aaggatttactcttggaagagacggccatgagaaacccatgaatgtgcaaagtctgggatggaacatcatcacct

SEQ ID NO: 359914 - DNA, 75 bp, Artificial Sequence
  Synthetic
gcagcaatgtcacatttactgtgaaccaaacatcccgcctcctgatgaggagaatgaggcgtccaactggaaaag

SEQ ID NO: 359915 - DNA, 75 bp, Artificial Sequence
  Synthetic
aaagtccaattgatcagaatggcagaagcagagatggtgatacatcaccaacatgttcaagattgtgatgaatca

SEQ ID NO: 359916 - DNA, 75 bp, Artificial Sequence
  Synthetic
aaggacatatctgaatggcagccatcaaaagggtggaatgattgggagaatgtgcccttctgttcccaccacttc

SEQ ID NO: 359917 - DNA, 75 bp, Artificial Sequence
  Synthetic
ctaaccaagagacaagacaagctgtgcggatcactgattggaatgaccaatagggccacctgggcctcccacatc

SEQ ID NO: 359918 - DNA, 75 bp, Artificial Sequence
  Synthetic
acgcccttttcattggctgaaggcattgtcctagcatcagctgccttagggccgctcatagagggaaacaccagc

SEQ ID NO: 359919 - DNA, 75 bp, Artificial Sequence
  Synthetic
tgccactgctaagctgtgaggcagtgcaggctgggacagccgacctccaggttgcgaaaaacctggtttctggga

SEQ ID NO: 359920 - DNA, 75 bp, Artificial Sequence
  Synthetic
ggagcctccgctaccaccctcccacgtggtggtagaaagacggggtctagaggttagaggagaccctccagggaa

SEQ ID NO: 359921 - DNA, 75 bp, Artificial Sequence
  Synthetic
ctggacgccgggggacagcgaatggaaaaactttgggtgaagtctggaagagggaactgaatctgttggacaagc

SEQ ID NO: 359922 - DNA, 75 bp, Artificial Sequence
  Synthetic
tgtcaaacaaaataaaacaaaaaacaaaacaaattggaaacagacctggaccttcaagaggtgttcaaggattta

SEQ ID NO: 359923 - DNA, 75 bp, Artificial Sequence
  Synthetic
gactggaaaaaagatcacggcccacctaaagaggttgtggaaaatgctggacccaagacaaggcttggctgttct

SEQ ID NO: 359924 - DNA, 75 bp, Artificial Sequence
  Synthetic
ctggaagaacaagaacagtggaagactgccaatgaggctgtccaagacccaaagttctgggaattggtggatgaa

SEQ ID NO: 359925 - DNA, 75 bp, Artificial Sequence
  Synthetic
aacatgtggtcactgatgtattttcacaaaagggacatgaggctgctgtcattggctgtttcctcagctgttccc

SEQ ID NO: 359926 - DNA, 75 bp, Artificial Sequence
  Synthetic
tggaagaatgggtgaaaggcaactccaaaagattgagagatggctcgtgaggaaccccttttttgcagtgacagc

SEQ ID NO: 359927 - DNA, 75 bp, Artificial Sequence
  Synthetic
agcaacatgacgcaacgagtcgtgattgccctactggtcttggctgttggtccggcctactcagctcactgcatt

SEQ ID NO: 359928 - DNA, 75 bp, Artificial Sequence
  Synthetic
tgtgtcactgttatggcccctgacaagccttcattggacatctcactagagacagtagccattgatggacctgct

SEQ ID NO: 359929 - DNA, 75 bp, Artificial Sequence
  Synthetic
tgcatgtaggggccaagcaggaaaattggaataccgacattaagactctcaagtttgatgccctgtcaggctccc

SEQ ID NO: 359930 - DNA, 75 bp, Artificial Sequence
  Synthetic
acgtgaaattccacacacaggctttttccgctcacggcagcgggagagaagtcattgatgccatgtgccatgcca

SEQ ID NO: 359931 - DNA, 75 bp, Artificial Sequence
  Synthetic
atagtagctgatgatcttacagcggcagtcaataaaggcattttggttacagttaaccccatcgcctcaaccaat

SEQ ID NO: 359932 - DNA, 75 bp, Artificial Sequence
  Synthetic
ggtgaaagtgccaaaaggagccccctgcaagattccagtgatagtagctgatgatcttacagcggcaatcaataa

SEQ ID NO: 359933 - DNA, 75 bp, Artificial Sequence
  Synthetic
acaggagattcacgtctcacttaccagtggcacaaagagggaagctcaataggaaagttgttcactcagaccatg

SEQ ID NO: 359934 - DNA, 75 bp, Artificial Sequence
  Synthetic
cctaagatcattgaggaatgtgaacatctggaggatgggatttatggcatattccagtcaaccttcttgggggcc

SEQ ID NO: 359935 - DNA, 75 bp, Artificial Sequence
  Synthetic
gtcatcatgggggcggtactcatatgggttggcatcaacacaagaaacatgacaatgtccatgagcatgatcttg

SEQ ID NO: 359936 - DNA, 75 bp, Artificial Sequence
  Synthetic
tagacctggaccttcaagaggcgttcaaggatttgtttttttctttttgttcaatgttttgactggaaagaagat

SEQ ID NO: 359937 - DNA, 75 bp, Artificial Sequence
  Synthetic
attgatggcaactgtgatggacggggaaaatcaaccagatccaccacggatagcgggaaaattattcctgaatgg

SEQ ID NO: 359938 - DNA, 75 bp, Artificial Sequence
  Synthetic
tggctgttggcccagcctattcggctcactgtataggaataaccgacagggatttcattgagggggtgcatgggg

SEQ ID NO: 359939 - DNA, 75 bp, Artificial Sequence
  Synthetic
gatttcattgagggggtgcatgggggaacctgggtttcagccaccttggaacaggacaagtgtgtcactgtgatg

SEQ ID NO: 359940 - DNA, 75 bp, Artificial Sequence
  Synthetic
tgaagatcaatgacaagtgccccagcactggtgaagcccatttggaagaagaaaatgaaggagacaatgcttgta

SEQ ID NO: 359941 - DNA, 75 bp, Artificial Sequence
  Synthetic
ggaatcctgatgatgctggttagcgtggctgggagggtggatgggctagagctcaagaagcttggtgaagtttca

SEQ ID NO: 359942 - DNA, 75 bp, Artificial Sequence
  Synthetic
tgggatattcccactcctaagatcattgaggaatgtgaacatctggaggatgggatttatggcatattccagtca

SEQ ID NO: 359943 - DNA, 75 bp, Artificial Sequence
  Synthetic
ccctggatgcaggtgccactagaggtgaaaagggaagcttgcccaggaaccagtgtggttgttgacggaggctgt

SEQ ID NO: 359944 - DNA, 75 bp, Artificial Sequence
  Synthetic
ctccaagagatcccgacaatgctaaagaaaggaatgacaactatccttgattttcatcctggagctgggaagaca

SEQ ID NO: 359945 - DNA, 75 bp, Artificial Sequence
  Synthetic
tgacggctggagagatccatgcaatcccctttgggttggtgagcatgatgatagccatggaagtggtattgagga

SEQ ID NO: 359946 - DNA, 75 bp, Artificial Sequence
  Synthetic
tcctgcccttgatggctctgttgacacctgtgacaatggctgaggtgagacttgcaacaatgctcttctgcactg

SEQ ID NO: 359947 - DNA, 75 bp, Artificial Sequence
  Synthetic
atgaagcccattttttggatccagctagcatagccgccagaggttgggcagcgcacagagctagggcaaatgaaa

SEQ ID NO: 359948 - DNA, 75 bp, Artificial Sequence
  Synthetic
agaataccccacgataaagcagaagaaacctgactttatattggccactgacatagctgaaatgggagccaacct

SEQ ID NO: 359949 - DNA, 75 bp, Artificial Sequence
  Synthetic
gacggttgcgcacacttgtgctggctcccactagagttgttctctctgaaatgaaggaagcctttcacggcctag

SEQ ID NO: 359950 - DNA, 75 bp, Artificial Sequence
  Synthetic
ctccgctcacggtagcggaaaagaagtcattgacgctatgtgtcatgctaccctgacatatagaatgctggaacc

SEQ ID NO: 359951 - DNA, 75 bp, Artificial Sequence
  Synthetic
ggtgaaacagtgaagtgcagggctcctggaggagcaaagaagcctctgcgcccaaggtggtgtgatgaaagggtg

SEQ ID NO: 359952 - DNA, 75 bp, Artificial Sequence
  Synthetic
aatttattaagtttgctgaaggtaggaggggagctgcggaagtgctagttgtgctgagtgaactccctgatttcc

SEQ ID NO: 359953 - DNA, 75 bp, Artificial Sequence
  Synthetic
caaaggcatcagtagaatgtctatggcgatgggcacaatggccggctgtggatatctcatgttccttggaggcgt

SEQ ID NO: 359954 - DNA, 75 bp, Artificial Sequence
  Synthetic
ggacaaccaggtggcttatcttatcattggcatcctgacgctgatttctgtggtggcagccaatgaactaggcat

SEQ ID NO: 359955 - DNA, 75 bp, Artificial Sequence
  Synthetic
attggcatcctgacgctgatttctgtggtggcagccaatgaactaggcatgctggaaaagactaaggaagacctc

SEQ ID NO: 359956 - DNA, 75 bp, Artificial Sequence
  Synthetic
tgacgctggtttcagtggtggcagccaacgagctaggcatgctggagaaaaccaaagaggacctctttgggaaga

SEQ ID NO: 359957 - DNA, 75 bp, Artificial Sequence
  Synthetic
ctctccaatgttgcaccactggatcaaagtcgaatatggcaacctgtctctgtctggaatagcccagtcagcctc

SEQ ID NO: 359958 - DNA, 75 bp, Artificial Sequence
  Synthetic
gggatgtgggcgtggtggctggtgctactatgctgctgcacagaaagaggtgagtggggttaagggattcaccct

SEQ ID NO: 359959 - DNA, 75 bp, Artificial Sequence
  Synthetic
gccctgggatttctgaatgaggaccactgggcttccagggagaactcagggggaggggttgaaggtatcggtcta

SEQ ID NO: 359960 - DNA, 75 bp, Artificial Sequence
  Synthetic
acctagctgcactagagggtggtggattctatgcggatgacacagctggatgggacacacgcataacagaggcgg

SEQ ID NO: 359961 - DNA, 75 bp, Artificial Sequence
  Synthetic
aagctagcgctggctgtaatggaaatgacatacaaaaataaagtggtgaaagtcctgaggccagctccaggtggg

SEQ ID NO: 359962 - DNA, 75 bp, Artificial Sequence
  Synthetic
tgacatacaaaaataaagtggtgaaagtcctgaggccagctccaggtgggaaagcttacatggatgtcataagcc

SEQ ID NO: 359963 - DNA, 75 bp, Artificial Sequence
  Synthetic
ttctgccactgctaagctgtgaggcagtgcaggctgggacagccgctttccatgttgcgaaaaacctggtttctg

SEQ ID NO: 359964 - DNA, 75 bp, Artificial Sequence
  Synthetic
ggagtggttctctgcttttcctccagaggttctgtgagcacagttgctcaagaataagcagacctttggtagaaa

SEQ ID NO: 359965 - DNA, 75 bp, Artificial Sequence
  Synthetic
gggcgtcaatatggttcgacggggagtccgctccttgtcaaacaaaataaaacaaaaaacaaaacaaattggaaa

SEQ ID NO: 359966 - DNA, 75 bp, Artificial Sequence
  Synthetic
tcaacattctgactggaaagaagatcacggctcacctaaagaggttgtggaaaatgctagacccaaggcaaggcc

SEQ ID NO: 359967 - DNA, 75 bp, Artificial Sequence
  Synthetic
cacggctcacctaaagaggttgtggaaaatgctagacccaaggcaaggcctggctgttctgaggaaagttaaaag

SEQ ID NO: 359968 - DNA, 75 bp, Artificial Sequence
  Synthetic
ttgtcttcaaggaaacgccgctcccatgatgtcttgactgtgcaatttctgattctgggaatgctgctgatggcg

SEQ ID NO: 359969 - DNA, 75 bp, Artificial Sequence
  Synthetic
atgatgtcttgactgtgcaatttctgattctgggaatgctgctgatggcgggtggagttaccttggtgcggaaaa

SEQ ID NO: 359970 - DNA, 75 bp, Artificial Sequence
  Synthetic
atctgaggaccttgggaagaccttttctgtgggcacaggcaactgtacaacaaacattctagaagccaagtactg

SEQ ID NO: 359971 - DNA, 75 bp, Artificial Sequence
  Synthetic
tctgtgggcacaggcaactgtacaacaaacattctagaagccaagtactggtgccccgattcaatggaatacaac

SEQ ID NO: 359972 - DNA, 75 bp, Artificial Sequence
  Synthetic
agcctgatgacatcgattgctggtgttacggagtggaaaatgttagagttgcatatggtaagtgtgactcagcag

SEQ ID NO: 359973 - DNA, 75 bp, Artificial Sequence
  Synthetic
ttacggagtggaaaatgttagagttgcatatggtaagtgtgactcagcaggcaggtcgaggaggtcaagaagagc

SEQ ID NO: 359974 - DNA, 75 bp, Artificial Sequence
  Synthetic
catggcctgaaaactcggcaagaaaaatggatgactggaagaatgggggagaggcaactccaaaagattgagaga

SEQ ID NO: 359975 - DNA, 75 bp, Artificial Sequence
  Synthetic
gaggcaactccaaaagattgagagatggcttgtgaggaatcccttctttgcagtaacagccctggccatcgccta

SEQ ID NO: 359976 - DNA, 75 bp, Artificial Sequence
  Synthetic
ccttgtgggcagcaacatgacacaacgagtcgtgattgccctgctggttttggctgttggcccggcttactcagc

SEQ ID NO: 359977 - DNA, 75 bp, Artificial Sequence
  Synthetic
gatttcattgagggggtgcacggaggaacctgggtttcagccaccttggagcaagacaagtgtgtcactgtcatg

SEQ ID NO: 359978 - DNA, 75 bp, Artificial Sequence
  Synthetic
gaacctgggtttcagccaccttggagcaagacaagtgtgtcactgtcatggcccctgacaagccttcactggaca

SEQ ID NO: 359979 - DNA, 75 bp, Artificial Sequence
  Synthetic
tggacctgctgaggcaagaaaagtgtgttacaatgcagtccttacccatgtgaagatcaatgacaagtgccctag

SEQ ID NO: 359980 - DNA, 75 bp, Artificial Sequence
  Synthetic
gagaatgagggggataatgcgtgtaagcgcacctattcggacagaggctggggaaacggctgtggcctgtttggg

SEQ ID NO: 359981 - DNA, 75 bp, Artificial Sequence
  Synthetic
agcgcacctattcggacagaggctggggaaacggctgtggcctgtttgggaagggaagcattgtggcatgcgcca

SEQ ID NO: 359982 - DNA, 75 bp, Artificial Sequence
  Synthetic
cttgtttgaggttgaccagacaaagatccagtacgtcatcagagcacaattacatgttggggcaaagcaggaaaa

SEQ ID NO: 359983 - DNA, 75 bp, Artificial Sequence
  Synthetic
atccagtacgtcatcagagcacaattacatgttggggcaaagcaggaaaattggaataccgatatcaaaactctc

SEQ ID NO: 359984 - DNA, 75 bp, Artificial Sequence
  Synthetic
aggaagccgagtttactgggtatggaaaagctactctggaatgccgggtgcagactgcagtagactttggcaaca

SEQ ID NO: 359985 - DNA, 75 bp, Artificial Sequence
  Synthetic
aaaagctactctggaatgccgggtgcagactgcagtagactttggcaacagttacattgctgagatggagaaaga

SEQ ID NO: 359986 - DNA, 75 bp, Artificial Sequence
  Synthetic
gcccaggatctaaccttaccatggcagagcggtagcggcggggtgtggagagaaatgcaccatcttgttgaattt

SEQ ID NO: 359987 - DNA, 75 bp, Artificial Sequence
  Synthetic
agagcggtagcggcggggtgtggagagaaatgcaccatcttgttgaatttgaaccccctcacgccgcaaccatca

SEQ ID NO: 359988 - DNA, 75 bp, Artificial Sequence
  Synthetic
aggctctttgaaaacagcccttacaggtgcaatgagggtcacaaaggacaccaatgataacaatctgtacaaact

SEQ ID NO: 359989 - DNA, 75 bp, Artificial Sequence
  Synthetic
acatggtggacatgtttcctgtagagtgaaactgtcagctttaacactcaaggggacatcctacaaaatgtgcac

SEQ ID NO: 359990 - DNA, 75 bp, Artificial Sequence
  Synthetic
ccgactgacactgaccatggcactgttgtgatgcaggtgaaagtgccaaaaggagctccctgcaagatcccagtg

SEQ ID NO: 359991 - DNA, 75 bp, Artificial Sequence
  Synthetic
agttaaccccatcgcctcaaccaatgatgatgaagtgctgattgaggtgaatccaccctttggagatagttacat

SEQ ID NO: 359992 - DNA, 75 bp, Artificial Sequence
  Synthetic
cttacttatcagtggcacaaagaggggagttcaataggaaagctgtttacccagaccatgaaaggcgcagaacgc

SEQ ID NO: 359993 - DNA, 75 bp, Artificial Sequence
  Synthetic
ggagttcaataggaaagctgtttacccagaccatgaaaggcgcagaacgcctggctgttatgggagacgctgcct

SEQ ID NO: 359994 - DNA, 75 bp, Artificial Sequence
  Synthetic
cttcacttcgattgggaaaggaagtcacacggtgtttggctctgcctttcagggattgtttggtggcttgagctg

SEQ ID NO: 359995 - DNA, 75 bp, Artificial Sequence
  Synthetic
cacacggtgtttggctctgcctttcagggattgtttggtggcttgagctggataacgaaggtcattatgggcgcg

SEQ ID NO: 359996 - DNA, 75 bp, Artificial Sequence
  Synthetic
caagaaacatgacaatgtccatgagtatgatcttggtgggagtgatcatgatgttcttgtctctgggagttgggg

SEQ ID NO: 359997 - DNA, 75 bp, Artificial Sequence
  Synthetic
tatgatcttggtgggagtgatcatgatgttcttgtctctgggagttggggcggatcaaggatgtgcaatcaactt

SEQ ID NO: 359998 - DNA, 75 bp, Artificial Sequence
  Synthetic
gatggcatcttcatctttagagattctgatgactggctgaacaagtactcatactacccagaggatcctgtgaag

SEQ ID NO: 359999 - DNA, 75 bp, Artificial Sequence
  Synthetic
atactacccagaggatcctgtgaagcttgcatcaatagtgaaagcctcctttgaggaaggaaagtgtggcctaaa

SEQ ID NO: 360000 - DNA, 75 bp, Artificial Sequence
  Synthetic
atgtggagaagtagggcagatgagatcaatgccattctcgaggaaaatgaggttgacatttctgttgtcgtgcag

SEQ ID NO: 360001 - DNA, 75 bp, Artificial Sequence
  Synthetic
tcaatgccattctcgaggaaaatgaggttgacatttctgttgtcgtgcaggacccaaaaaatgtgtaccagagag

SEQ ID NO: 360002 - DNA, 75 bp, Artificial Sequence
  Synthetic
ccccagggaggaagaacggaagcttcattatagatggaaagtccagaaaagaatgcccgttttcaaaccgggttt

SEQ ID NO: 360003 - DNA, 75 bp, Artificial Sequence
  Synthetic
aagagtgcccatgggtctccaacattttggatgggaagccatgaggtgaatgggacatggatgatccacacctta

SEQ ID NO: 360004 - DNA, 75 bp, Artificial Sequence
  Synthetic
tttggatgggaagccatgaggtgaatgggacatggatgatccacaccttagagacattagattataaggagtgtg

SEQ ID NO: 360005 - DNA, 75 bp, Artificial Sequence
  Synthetic
aacatcagttgaagaaagtgacatgttcatgccaagatcaattggaggcccggttagctcccacaatcatattcc

SEQ ID NO: 360006 - DNA, 75 bp, Artificial Sequence
  Synthetic
ccttggatgcaggtgccactggaagtgaagagagaagcctgcccggggaccagtgtgatcattgatggcaattgt

SEQ ID NO: 360007 - DNA, 75 bp, Artificial Sequence
  Synthetic
tgaagagagaagcctgcccggggaccagtgtgatcattgatggcaattgtgatggacggggaaaatcaactagat

SEQ ID NO: 360008 - DNA, 75 bp, Artificial Sequence
  Synthetic
cagtgtgatcattgatggcaattgtgatggacggggaaaatcaactagatccaccacagacagcgggaagatcat

SEQ ID NO: 360009 - DNA, 75 bp, Artificial Sequence
  Synthetic
acaatgccgcctgtgagctttcatgggaatgatggatgttggtaccccatggaaattcggccaaggaaaacacat

SEQ ID NO: 360010 - DNA, 75 bp, Artificial Sequence
  Synthetic
ggaatgatggatgttggtaccccatggaaattcggccaaggaaaacacatgaaagccatctggtacgatcatggg

SEQ ID NO: 360011 - DNA, 75 bp, Artificial Sequence
  Synthetic
cccttttgggctggtgagcatgatgatagcaatggaggtggtcctaaggaaaagacagggaccaaagcaaatgct

SEQ ID NO: 360012 - DNA, 75 bp, Artificial Sequence
  Synthetic
atagcaatggaggtggtcctaaggaaaagacagggaccaaagcaaatgctagttggaggaatggtgctcctgggg

SEQ ID NO: 360013 - DNA, 75 bp, Artificial Sequence
  Synthetic
tccttgatttgctgaaactcacaatggccgtgggactgcattttcatgagatgaacaatggaggagacgccatgt

SEQ ID NO: 360014 - DNA, 75 bp, Artificial Sequence
  Synthetic
ggccgtgggactgcattttcatgagatgaacaatggaggagacgccatgtacatggcgttgattgctgccttttc

SEQ ID NO: 360015 - DNA, 75 bp, Artificial Sequence
  Synthetic
ctggtttctgagacttcccacctcagagtaaaaccaaatggagcctccgctaccacctccccacgtggtggtaga

SEQ ID NO: 360016 - DNA, 75 bp, Artificial Sequence
  Synthetic
tttgggctcaggaccctgtggagcccccgggaacgccttgtgctgaccctgggtgcagccatggtggagattgcc

SEQ ID NO: 360017 - DNA, 75 bp, Artificial Sequence
  Synthetic
cccgggaacgccttgtgctgaccctgggtgcagccatggtggagattgccctgggtggcatgatgggcggcctgt

SEQ ID NO: 360018 - DNA, 75 bp, Artificial Sequence
  Synthetic
ctgcatcctgacaataaatgctgtagcctctaggaaagcatcaaacaccatcttgcccctcatggctctgttaac

SEQ ID NO: 360019 - DNA, 75 bp, Artificial Sequence
  Synthetic
tcttgcccctcatggctctgttaacacctgtgaccatggcggaggtgaggcttgccacgatgctcttatgcgccg

SEQ ID NO: 360020 - DNA, 75 bp, Artificial Sequence
  Synthetic
tgggcgtcaatatggtaagacgaggagtacgctccttgtcaaacaaaataaaacaaaaaacaaaacagattggaa

SEQ ID NO: 360021 - DNA, 75 bp, Artificial Sequence
  Synthetic
gaactccaaggacacctccatgcaaaagaccatacccttggtggctctcacacttacatcttacctgggcttgac

SEQ ID NO: 360022 - DNA, 75 bp, Artificial Sequence
  Synthetic
taactacccacctgaaaaggctctggagaatgcttgacccccgacagggacttgctgttctaaggaaagttaaga

SEQ ID NO: 360023 - DNA, 75 bp, Artificial Sequence
  Synthetic
actcgcggcagctggtttggtgggagtgctggcaggactggctttccaggagatggagaacttccttggtccgat

SEQ ID NO: 360024 - DNA, 75 bp, Artificial Sequence
  Synthetic
gagaatgcttgacccccgacagggacttgctgttctaaggaaagttaagagggtggtagccagcttgatgagagg

SEQ ID NO: 360025 - DNA, 75 bp, Artificial Sequence
  Synthetic
ctggttagcgtggctgggagagtagatgggcttgagctgaagaagctcggtgaggtttcatgggaagaggaggca

SEQ ID NO: 360026 - DNA, 75 bp, Artificial Sequence
  Synthetic
accaacatccttgaggcaaagtattggtgtcccgactcaatggaatacaattgtcccaatcttagccccagagag

SEQ ID NO: 360027 - DNA, 75 bp, Artificial Sequence
  Synthetic
tgacctcgctggccttggttggagctgccattcatccatctgctcttctgctggtccttgctggctggctgttcc

SEQ ID NO: 360028 - DNA, 75 bp, Artificial Sequence
  Synthetic
gttatggagtggaaaatgtccgagtagcctatggaaggtgtgatgcagtgggaaggtcaaagagatctaggagag

SEQ ID NO: 360029 - DNA, 75 bp, Artificial Sequence
  Synthetic
ggaaggtcaaagagatctaggagagcaattgatctgcccacacatgaaaaccacggactgaaaactcggcaggaa

SEQ ID NO: 360030 - DNA, 75 bp, Artificial Sequence
  Synthetic
gtggctggtgaggaatccgttcttcgccataacagccttggccattgcttatttggtgggcaataatatgacaca

SEQ ID NO: 360031 - DNA, 75 bp, Artificial Sequence
  Synthetic
ccttgtcgcctatggtggctcatggaaattggaaggtagatgggatggggaagaagaggtccagttgattgctgc

SEQ ID NO: 360032 - DNA, 75 bp, Artificial Sequence
  Synthetic
ctggcagttggcccagcctattctgcacattgcattgggataactgacagagacttcattgagggtgtccatggg

SEQ ID NO: 360033 - DNA, 75 bp, Artificial Sequence
  Synthetic
tgtaccagggaagaatgtggtcaatgtccagacgaaacctagcttgttcaaagtgaggaatgggggagaaatcgg

SEQ ID NO: 360034 - DNA, 75 bp, Artificial Sequence
  Synthetic
agacttcattgagggtgtccatgggggcacctgggtgtcagcaaccctggagcaggataagtgcgtgactgtcat

SEQ ID NO: 360035 - DNA, 75 bp, Artificial Sequence
  Synthetic
ggcacttcgggatctcctattgtcaacaggaatggagaggtgattggtctgtatggcaatggcattcttgtcggt

SEQ ID NO: 360036 - DNA, 75 bp, Artificial Sequence
  Synthetic
acaggaatggagaggtgattggtctgtatggcaatggcattcttgtcggtgacaattcattcgtgtccgccattt

SEQ ID NO: 360037 - DNA, 75 bp, Artificial Sequence
  Synthetic
atgggccagctgaagcgagaaaggtttgctacagcgcggttctcacccatgtaaaaatcaatgataaatgcccga

SEQ ID NO: 360038 - DNA, 75 bp, Artificial Sequence
  Synthetic
aaaggaggagcttcaggagatcccgacaatgttgaagaaaggaatgacaactatcctcgactaccatcctggagc

SEQ ID NO: 360039 - DNA, 75 bp, Artificial Sequence
  Synthetic
ggaaaatgatggtgacaacgcgtgcaaacgaacatactcagatagaggctggggcaatggttgtgggctctttgg

SEQ ID NO: 360040 - DNA, 75 bp, Artificial Sequence
  Synthetic
aaacgaacatactcagatagaggctggggcaatggttgtgggctctttggaaaggggagcattgtggcatgtgct

SEQ ID NO: 360041 - DNA, 75 bp, Artificial Sequence
  Synthetic
tgggaagacgcgacggtttctcccacagatcttggctgaatgcgcacggagacgcctacgcacgcttgtgctggc

SEQ ID NO: 360042 - DNA, 75 bp, Artificial Sequence
  Synthetic
gcctttttgaagtggaccagaccaaaatccagtatgtcatcagagcccagcttcatgtaggtgccaagcaggaaa

SEQ ID NO: 360043 - DNA, 75 bp, Artificial Sequence
  Synthetic
atgaaggaggctttccatggcttggacgtgaaatttcacacacaggctttctccgcccacggcagtggaagagaa

SEQ ID NO: 360044 - DNA, 75 bp, Artificial Sequence
  Synthetic
acgtgaaatttcacacacaggctttctccgcccacggcagtggaagagaagtcattgatgccatgtgccatgcca

SEQ ID NO: 360045 - DNA, 75 bp, Artificial Sequence
  Synthetic
gaaatttgatgccttatctggctctcaagaggccgaatttactggctatgggaaagcaacactagagtgtcaggt

SEQ ID NO: 360046 - DNA, 75 bp, Artificial Sequence
  Synthetic
aaccaggattgtcaactgggaagtgatcattatggatgaagcccatttcctggacccagccagcatagcagctag

SEQ ID NO: 360047 - DNA, 75 bp, Artificial Sequence
  Synthetic
atcattatggatgaagcccatttcctggacccagccagcatagcagctagaggctgggcagcacacagagccagg

SEQ ID NO: 360048 - DNA, 75 bp, Artificial Sequence
  Synthetic
acagctggattgttgaccgccagtgggcacaagacttgacactaccatggcagagtgggagtggtggaatatgga

SEQ ID NO: 360049 - DNA, 75 bp, Artificial Sequence
  Synthetic
tgacggccacaccgccagggaccagtgatgaattcccacattcaaatggtgaaatagaagatgtccaaacggaca

SEQ ID NO: 360050 - DNA, 75 bp, Artificial Sequence
  Synthetic
gggaaatgcatcatctagttgagtttgagcctcctcatgccgccacaatcagagtgttggccctgggaaaccaag

SEQ ID NO: 360051 - DNA, 75 bp, Artificial Sequence
  Synthetic
tacccagtgaaccctggaacacagggcatgattggatcctggcagacaaaaggcccacggcatggttcctccctt

SEQ ID NO: 360052 - DNA, 75 bp, Artificial Sequence
  Synthetic
gaaaatgacaacaacttgtacaagctgcatggtggtcatgtttcttgtagggtgaaactctcagctttaactctc

SEQ ID NO: 360053 - DNA, 75 bp, Artificial Sequence
  Synthetic
tgcttccttgcgcaaggctggaaagagcgtggtggtcctgaacagaaaaacctttgagaaagaataccccacgat

SEQ ID NO: 360054 - DNA, 75 bp, Artificial Sequence
  Synthetic
cctttgagaaagaataccccacgataaaacagaagaaacctgatttcatcttggccactgacatagctgagatgg

SEQ ID NO: 360055 - DNA, 75 bp, Artificial Sequence
  Synthetic
tccaacggacacaggtcatggcactgttgtcatgcaggtgaaggtccccaaaggagctccatgcaagatccccgt

SEQ ID NO: 360056 - DNA, 75 bp, Artificial Sequence
  Synthetic
catctctgcatcttctgctgcccaaagaagaggacgcattgggagaaatcccaatagagatggagattcatacta

SEQ ID NO: 360057 - DNA, 75 bp, Artificial Sequence
  Synthetic
aatcccccttttggagacagctacattattgttgggactggagactcaagactgacttatcagtggcataaagaa

SEQ ID NO: 360058 - DNA, 75 bp, Artificial Sequence
  Synthetic
aggcctcaatgctcctggacaacatggaggtgaggggtggaatggtcgccccactctatggcattgaagggacaa

SEQ ID NO: 360059 - DNA, 75 bp, Artificial Sequence
  Synthetic
ggaggtgaggggtggaatggtcgccccactctatggcattgaagggacaaaaacaccagtttcccctggtgaaat

SEQ ID NO: 360060 - DNA, 75 bp, Artificial Sequence
  Synthetic
tcttgcagtgatgggtgacgccgcctgggactttagctctgcaggtggcttcttcacgtcagtgggaaaaggaat

SEQ ID NO: 360061 - DNA, 75 bp, Artificial Sequence
  Synthetic
gtctccagagaattggtgaggaactgtgatctgcctgtctggctgtcctggcaagtggccaaggctggtttgaag

SEQ ID NO: 360062 - DNA, 75 bp, Artificial Sequence
  Synthetic
caggggttgtttggtggcctgagctggattacaaaggtcatcatgggagctgttcttatctgggttggaattaac

SEQ ID NO: 360063 - DNA, 75 bp, Artificial Sequence
  Synthetic
tgttcttatctgggttggaattaacacacgtaacatgactatgtccatgtctatgattctggtaggagtgatcat

SEQ ID NO: 360064 - DNA, 75 bp, Artificial Sequence
  Synthetic
gtgatctgcctgtctggctgtcctggcaagtggccaaggctggtttgaagacgaatgaccggaaatggtgtttcg

SEQ ID NO: 360065 - DNA, 75 bp, Artificial Sequence
  Synthetic
ctgaaggtagaaggggagctgcagaaatcctggtagtgctgagtgagctccctgacttcttggcgaagaaaggtg

SEQ ID NO: 360066 - DNA, 75 bp, Artificial Sequence
  Synthetic
gttcctgcattccgaggaaggctccagggcataccgcaatgctctgtcaatgatgcctgaagcaatgacaatagt

SEQ ID NO: 360067 - DNA, 75 bp, Artificial Sequence
  Synthetic
agggcataccgcaatgctctgtcaatgatgcctgaagcaatgacaatagtcatgctgttcatactggctggattg

SEQ ID NO: 360068 - DNA, 75 bp, Artificial Sequence
  Synthetic
gggacacatcctttttctcggattcgtgatgggttgcagtatggatggaaaacctggggtaaaaatcttatcttc

SEQ ID NO: 360069 - DNA, 75 bp, Artificial Sequence
  Synthetic
tcatgtctcccaaaggtatcagtagaatgtccatggcgatgggcacaatggccggctgtggatatctcatgtttc

SEQ ID NO: 360070 - DNA, 75 bp, Artificial Sequence
  Synthetic
aatgtccatggcgatgggcacaatggccggctgtggatatctcatgtttcttggaggcgccaaacccactcatat

SEQ ID NO: 360071 - DNA, 75 bp, Artificial Sequence
  Synthetic
gtgatgggttgcagtatggatggaaaacctggggtaaaaatcttatcttctcacccggaagaagaaatggcagtt

SEQ ID NO: 360072 - DNA, 75 bp, Artificial Sequence
  Synthetic
ggaatgccctttttcaaacagagtgtggaactcttttcaaattgaggagtttggcatgggggtttttacgacacg

SEQ ID NO: 360073 - DNA, 75 bp, Artificial Sequence
  Synthetic
gtcctgatggtagttgtgattcccgagccagggcaacaaaggtccattcaggacaatcaggtggcatatcttatc

SEQ ID NO: 360074 - DNA, 75 bp, Artificial Sequence
  Synthetic
ttggcatgggggtttttacgacacgggtttttatggatgctgtctttgactactcagtggactgtgatggggcca

SEQ ID NO: 360075 - DNA, 75 bp, Artificial Sequence
  Synthetic
agccagggcaacaaaggtccattcaggacaatcaggtggcatatcttatcattggcatcttgacactggtctcgg

SEQ ID NO: 360076 - DNA, 75 bp, Artificial Sequence
  Synthetic
gctggagagaactaaagaagacctctttgggaagaagaacttgattccatctagcgcctcaccctggagttggcc

SEQ ID NO: 360077 - DNA, 75 bp, Artificial Sequence
  Synthetic
tttgggaagaagaacttgattccatctagcgcctcaccctggagttggccggatcttgacttaaagccaggagcg

SEQ ID NO: 360078 - DNA, 75 bp, Artificial Sequence
  Synthetic
caggttacaaggtccaaacgaacggaccatggatgcaagtccctctggaagtcagaagggagccatgtccgggga

SEQ ID NO: 360079 - DNA, 75 bp, Artificial Sequence
  Synthetic
tggttagtggctggaattcaataacagtgatgcccctgctttgtggcatagggtgtgccatgctccactggactc

SEQ ID NO: 360080 - DNA, 75 bp, Artificial Sequence
  Synthetic
agtgatgcccctgctttgtggcatagggtgtgccatgctccactggactctcatcttacctgggatcaaggcgca

SEQ ID NO: 360081 - DNA, 75 bp, Artificial Sequence
  Synthetic
tcaactactgacagtgggaaaataattccagaatggtgctgtagatcttgcaccatgcccccagtcagctttcac

SEQ ID NO: 360082 - DNA, 75 bp, Artificial Sequence
  Synthetic
gtgtttcatggcgtagccaagaacccggtggttgatggaaacccaacagttgacattgaagaagcccctgaaatg

SEQ ID NO: 360083 - DNA, 75 bp, Artificial Sequence
  Synthetic
tggaaattagacccatgaagacccacgagagccatctggtgagatcatgggttgctgcaggagaagtgcatgcgg

SEQ ID NO: 360084 - DNA, 75 bp, Artificial Sequence
  Synthetic
cggtggttgatggaaacccaacagttgacattgaagaagcccctgaaatgcctgctctgtatgaaaagaaactgg

SEQ ID NO: 360085 - DNA, 75 bp, Artificial Sequence
  Synthetic
cgagagccatctggtgagatcatgggttgctgcaggagaagtgcatgcggtgcctttcggtttggtgagcatgat

SEQ ID NO: 360086 - DNA, 75 bp, Artificial Sequence
  Synthetic
cttggcctctgttgccatgtgcagaactcccttctcactggctgaaggcattgtcctagcatcagcagccttggg

SEQ ID NO: 360087 - DNA, 75 bp, Artificial Sequence
  Synthetic
actcccttctcactggctgaaggcattgtcctagcatcagcagccttggggcctctcatagagggaaacactagc

SEQ ID NO: 360088 - DNA, 75 bp, Artificial Sequence
  Synthetic
tggtgggaggaatcattttacttggagcaatgctagtaggacaagtcacgacattggatctagtgaaacttattg

SEQ ID NO: 360089 - DNA, 75 bp, Artificial Sequence
  Synthetic
tttccatgacaggagttatgcgtggaaactactatgcctttgtgggagtcatgtacaatctgtggaagatggaga

SEQ ID NO: 360090 - DNA, 75 bp, Artificial Sequence
  Synthetic
gatcaacaatggaggagacgctatgtacatggctttgattgcgagcttttctattcgcccgggcctgctcatagg

SEQ ID NO: 360091 - DNA, 75 bp, Artificial Sequence
  Synthetic
aaactactatgcctttgtgggagtcatgtacaatctgtggaagatggagactggacgcagggggagggcgaatgg

SEQ ID NO: 360092 - DNA, 75 bp, Artificial Sequence
  Synthetic
tacatggctttgattgcgagcttttctattcgcccgggcctgctcataggttttggactgcgcacactctggagt

SEQ ID NO: 360093 - DNA, 75 bp, Artificial Sequence
  Synthetic
agggagctgaacctgctggacaggcagcagtttgagctgtacaaaaggactgacattgtggaggtggaccgtgac

SEQ ID NO: 360094 - DNA, 75 bp, Artificial Sequence
  Synthetic
tcggagcagccatggttgaagtggcattgggcgggatgatgggtggactgtggcagtatttgaacgccgtctcac

SEQ ID NO: 360095 - DNA, 75 bp, Artificial Sequence
  Synthetic
gaaaggtggacaccggggtggctgtctcgagggggaccgcaaagttaaggtggtttcatgaacgtggctatgtca

SEQ ID NO: 360096 - DNA, 75 bp, Artificial Sequence
  Synthetic
ttcttcaagaaaggcctcaaatgcggtcctccctcttatggcgctcttgactcctgtgacaatgcatgaagtaag

SEQ ID NO: 360097 - DNA, 75 bp, Artificial Sequence
  Synthetic
ctcgagggggaccgcaaagttaaggtggtttcatgaacgtggctatgtcaagctggaaggcagggtgactgacct

SEQ ID NO: 360098 - DNA, 75 bp, Artificial Sequence
  Synthetic
gtcctccctcttatggcgctcttgactcctgtgacaatgcatgaagtaaggatggcaacaatgttgttctgcaca

SEQ ID NO: 360099 - DNA, 75 bp, Artificial Sequence
  Synthetic
tactacgctgctgcacagaaggaagtgagtggggtcaaaggatttactcttggaagagaaggccatgagaaaccc

SEQ ID NO: 360100 - DNA, 75 bp, Artificial Sequence
  Synthetic
tgagtggggtcaaaggatttactcttggaagagaaggccatgagaaacccatgaacgtgcgaagcctgggatgga

SEQ ID NO: 360101 - DNA, 75 bp, Artificial Sequence
  Synthetic
aaaagccattcccattgtggctctgacactgacttcatatatgggtctaacccaaccttttcttggactgtgtgc

SEQ ID NO: 360102 - DNA, 75 bp, Artificial Sequence
  Synthetic
atatcatcaccttcaaggataaaactgacatccaccacctggaaccagtgaaatgtgacacccttctgtgtgaca

SEQ ID NO: 360103 - DNA, 75 bp, Artificial Sequence
  Synthetic
tgacatccaccacctggaaccagtgaaatgtgacacccttctgtgtgacattggagagtcatcatcgtcatcagt

SEQ ID NO: 360104 - DNA, 75 bp, Artificial Sequence
  Synthetic
agaagaagcatccccgtaaatgaagctcttgcagcagctggcctggtaggagtgttggcaggcttggccttccaa

SEQ ID NO: 360105 - DNA, 75 bp, Artificial Sequence
  Synthetic
gttcttgataccgttgagaaatggctggcttgcggcgttgacaatttctgtgtgaaggtgttggctccatacatg

SEQ ID NO: 360106 - DNA, 75 bp, Artificial Sequence
  Synthetic
ttgctgtgggcgggatactcatgatgctagtcagtgtggcagggaaagttgatggactggaactcaaaaagctcg

SEQ ID NO: 360107 - DNA, 75 bp, Artificial Sequence
  Synthetic
tgctccaaaggaggtttggtggaacagtgatcaggaaccctctttccagaaattccactcatgagatgtactacg

SEQ ID NO: 360108 - DNA, 75 bp, Artificial Sequence
  Synthetic
tgagataagtggaagctccagccgctacgatgtggcactaagtgaacagggagaattcaagcttctctcagagga

SEQ ID NO: 360109 - DNA, 75 bp, Artificial Sequence
  Synthetic
agtgatcaggaaccctctttccagaaattccactcatgagatgtactacgtgtctggagcccgcagtaatgtcac

SEQ ID NO: 360110 - DNA, 75 bp, Artificial Sequence
  Synthetic
aattccactcatgagatgtactacgtgtctggagcccgcagtaatgtcacatttactgtgaaccaaacatctcgt

SEQ ID NO: 360111 - DNA, 75 bp, Artificial Sequence
  Synthetic
taaagtgccctgggaccagattgtcatgacctccttggctcttgttggggcagcaatacatccatttgccctatt

SEQ ID NO: 360112 - DNA, 75 bp, Artificial Sequence
  Synthetic
caactggcaaagtgaccctggaagctgatgtcattctcccaattgggacacgcagtgtcgagacagacaaaggac

SEQ ID NO: 360113 - DNA, 75 bp, Artificial Sequence
  Synthetic
tgatgtcattctcccaattgggacacgcagtgtcgagacagacaaaggacccctgaatagagaggccatagaaga

SEQ ID NO: 360114 - DNA, 75 bp, Artificial Sequence
  Synthetic
gggatgtcctttgggacattcccacaccaaaagtcatagaggaatgtgagcacctggaagatggaatttacggca

SEQ ID NO: 360115 - DNA, 75 bp, Artificial Sequence
  Synthetic
tacatgactacctggttttatgacaatgacaacccttacaggacttggcattactgtggctcctatgttactaaa

SEQ ID NO: 360116 - DNA, 75 bp, Artificial Sequence
  Synthetic
atgacaacccttacaggacttggcattactgtggctcctatgttactaaaacctcagggagcgcggcaagcatgg

SEQ ID NO: 360117 - DNA, 75 bp, Artificial Sequence
  Synthetic
gtatccatgggacagaatagaggaggttacaagaatggcaatgactgacacaaccccctttggacagcagagggt

SEQ ID NO: 360118 - DNA, 75 bp, Artificial Sequence
  Synthetic
gttacaagaatggcaatgactgacacaaccccctttggacagcagagggtgttcaaagaaaaagttgacaccaga

SEQ ID NO: 360119 - DNA, 75 bp, Artificial Sequence
  Synthetic
gaaaaatcatgaaagttgtcaacagatggctcttccgtcacttggccagggagaagaatcctagactgtgcacaa

SEQ ID NO: 360120 - DNA, 75 bp, Artificial Sequence
  Synthetic
atggctcttccgtcacttggccagggagaagaatcctagactgtgcacaaaagaagaattcattgcaaaggtccg

SEQ ID NO: 360121 - DNA, 75 bp, Artificial Sequence
  Synthetic
aaagttagaaatggaggtgagattggggcagtagccctggactatcctagcgggacctctggttcacccattgtg

SEQ ID NO: 360122 - DNA, 75 bp, Artificial Sequence
  Synthetic
gggcagtagccctggactatcctagcgggacctctggttcacccattgtgaatcgcagtggtgaagtggtggggc

SEQ ID NO: 360123 - DNA, 75 bp, Artificial Sequence
  Synthetic
ctggaagaacaagaacagtggaagactgccaacgaggctgtccaggacccgaagttttgggaattggtggatgaa

SEQ ID NO: 360124 - DNA, 75 bp, Artificial Sequence
  Synthetic
gaagttttgggaattggtggatgaagaaaggaggctgcaccaacaaggcaggtgccggacttgcgtgtacaacat

SEQ ID NO: 360125 - DNA, 75 bp, Artificial Sequence
  Synthetic
tcacaaactgaggtgaaagaggaatctaaagaggaactgcaggaaataccaacaatgttgaaaaaaggaatgaca

SEQ ID NO: 360126 - DNA, 75 bp, Artificial Sequence
  Synthetic
tcagagtttgggaaagcaaaaggaagccgtgccatctggtacatgtggctgggggcgcggtatcttgagtttgaa

SEQ ID NO: 360127 - DNA, 75 bp, Artificial Sequence
  Synthetic
cgggaaagacccgcaggttcctgccccaaatactggcagaatgcgccaggaggcgcctacgaacactagtgctgg

SEQ ID NO: 360128 - DNA, 75 bp, Artificial Sequence
  Synthetic
gccgtgccatctggtacatgtggctgggggcgcggtatcttgagtttgaagccctaggattcctgaatgaagacc

SEQ ID NO: 360129 - DNA, 75 bp, Artificial Sequence
  Synthetic
ccaaatactggcagaatgcgccaggaggcgcctacgaacactagtgctggcgcctacccgggttgtcctgtcaga

SEQ ID NO: 360130 - DNA, 75 bp, Artificial Sequence
  Synthetic
gggaggagtagaaggcattggtttacagtacctaggatatgtgatcagagacttggctgcaatggatggtggggg

SEQ ID NO: 360131 - DNA, 75 bp, Artificial Sequence
  Synthetic
gatgtgaagtttcacacgcaggctttttcggcccatgggagtgggaaagaagtcattgatgcaatgtgccatgcg

SEQ ID NO: 360132 - DNA, 75 bp, Artificial Sequence
  Synthetic
attctacgcggatgataccgctgggtgggacacacgcatcacagaggcagaccttgatgatgaacaggagatcct

SEQ ID NO: 360133 - DNA, 75 bp, Artificial Sequence
  Synthetic
caacaagagctgtcaactgggaggtgattatcatggatgaggctcacttcttggatcctgccagcattgcagcaa

SEQ ID NO: 360134 - DNA, 75 bp, Artificial Sequence
  Synthetic
aaactggcacaagcagtgatggaaatgacatacaagaataaggtggtgaaagtgctgagaccaacaccaggcggg

SEQ ID NO: 360135 - DNA, 75 bp, Artificial Sequence
  Synthetic
tgacatacaagaataaggtggtgaaagtgctgagaccaacaccaggcgggaaagcctacatggatgtcataagcc

SEQ ID NO: 360136 - DNA, 75 bp, Artificial Sequence
  Synthetic
ggtggtgacctatgccctgaacaccatcaccaacctgaaagtccaattgatcaggatggcagaagcagagatggt

SEQ ID NO: 360137 - DNA, 75 bp, Artificial Sequence
  Synthetic
atcaccaacctgaaagtccaattgatcaggatggcagaagcagagatggtgatacatcatcatcatgttcaagat

SEQ ID NO: 360138 - DNA, 75 bp, Artificial Sequence
  Synthetic
tggaggcatggctcattgagcatggatgtgacagactgaataggatggcggtgaatggagacgactgcgtggtcc

SEQ ID NO: 360139 - DNA, 75 bp, Artificial Sequence
  Synthetic
acctttgaaaaggaataccccaccattaaacaaaagagaccggatttcatcctagccacagacattgccgagatg

SEQ ID NO: 360140 - DNA, 75 bp, Artificial Sequence
  Synthetic
tgactgggagaatgtgcccttttgttcccaccacttccacgaactgcagctgaaggacggcaggaggattgtggt

SEQ ID NO: 360141 - DNA, 75 bp, Artificial Sequence
  Synthetic
attgggagaggaagggtgtctccaggaaatggctggatgatcaaggaaacggcatgccttagcaaagcctatgcc

SEQ ID NO: 360142 - DNA, 75 bp, Artificial Sequence
  Synthetic
taatgcccatcatgtgtgttggctggaagcttccatgcttcttgacaacatggaagttagagggggaatggttgc

SEQ ID NO: 360143 - DNA, 75 bp, Artificial Sequence
  Synthetic
ggcatgccttagcaaagcctatgccaacatgtggtcactgatgtactttcacaagagggacatgagattgttgtc

SEQ ID NO: 360144 - DNA, 75 bp, Artificial Sequence
  Synthetic
aagactcctgtttcccctggggaaatgaggctgagagatgatcaaaggagagttttcagggagttggtgcgtgga

SEQ ID NO: 360145 - DNA, 75 bp, Artificial Sequence
  Synthetic
caaaacagtggtgaaagaatggagggatgtcccctatctgaccaagagacaagacaagctgtgcggatcactgat

SEQ ID NO: 360146 - DNA, 75 bp, Artificial Sequence
  Synthetic
gaaggacccgaggaacacgagatactcaatgacaacggtgaaactgtgaagtgtaggtcacctggtggagcgaaa

SEQ ID NO: 360147 - DNA, 75 bp, Artificial Sequence
  Synthetic
aagacaagctgtgcggatcactgattggaatgaccaacagggccacctgggcctcccacatccatttggtaatcc

SEQ ID NO: 360148 - DNA, 75 bp, Artificial Sequence
  Synthetic
atgaaagagtgtcctcagatcagagcgctttggctgacttcattaagtttgccgaaggtagaagaggagctgctg

SEQ ID NO: 360149 - DNA, 75 bp, Artificial Sequence
  Synthetic
ggagaaatatactgactatctgacagtcatggacagatactctgtggatgctgacctgcaaccaggtgagcttat

SEQ ID NO: 360150 - DNA, 75 bp, Artificial Sequence
  Synthetic
gccgaaggtagaagaggagctgctgagatgcttgtggttctcacggaactgcctgacttcttgatgcaaaaaggg

SEQ ID NO: 360151 - DNA, 75 bp, Artificial Sequence
  Synthetic
gtaaaaaagaaaggagcctccgctaccacctccccacgtggtggtagaaaggtggggtctagaggttagaggaga

SEQ ID NO: 360152 - DNA, 75 bp, Artificial Sequence
  Synthetic
ttttggaagaagaaatgctgccacacctggggggacgattccatggagttggcccgatttggatctgaaacctgg

SEQ ID NO: 360153 - DNA, 75 bp, Artificial Sequence
  Synthetic
agacctggaccttcaagaggtgttcaaggatttatttttttctttttgtttaacattctgactgggaaaaagatc

SEQ ID NO: 360154 - DNA, 75 bp, Artificial Sequence
  Synthetic
attgtgacaatgctgtcaccaatgcttcatcactggattaaagtggagtatggcaacctctcgttgtcagggata

SEQ ID NO: 360155 - DNA, 75 bp, Artificial Sequence
  Synthetic
ttcatcactggattaaagtggagtatggcaacctctcgttgtcagggatagcccagtcggcctcggtcctttcat

SEQ ID NO: 360156 - DNA, 75 bp, Artificial Sequence
  Synthetic
cagaactcctttttccctagccgaaggcatagtgctgtcatctgctgcccttgggcccctaatagagggaaacac

SEQ ID NO: 360157 - DNA, 75 bp, Artificial Sequence
  Synthetic
gccgtttccatgactggggttatgcgcggcaattactacgcttttgtgggtgtgatgtacaacctctggaagatg

SEQ ID NO: 360158 - DNA, 75 bp, Artificial Sequence
  Synthetic
gaagagggagctcaacctgctagacaaacagcaatttgagctgtacaagagaacagatatcaccgaggtggatcg

SEQ ID NO: 360159 - DNA, 75 bp, Artificial Sequence
  Synthetic
gaggggaaggtggacactggagtggccgtgtcgagagggacagcgaagctaaggtggttccacgagcgtggctat

SEQ ID NO: 360160 - DNA, 75 bp, Artificial Sequence
  Synthetic
atttgggatgtggacgtggaggttggtgctactatgcagcagctcagaaagaggtcagtggtgtgaaaggttaca

SEQ ID NO: 360161 - DNA, 75 bp, Artificial Sequence
  Synthetic
gttacaatgcagttctcacccatgtgaagattaatgacaagtgtcccagcaccggagaggctcacctagctgaag

SEQ ID NO: 360162 - DNA, 75 bp, Artificial Sequence
  Synthetic
agactgacatccacaggctagagccggccaagtgtgaaaccctcctttgtgacattggagaatcctcaccttcct

SEQ ID NO: 360163 - DNA, 75 bp, Artificial Sequence
  Synthetic
tggctggcctgtggagtggacaacttttgtgtcaaggttctagcaccatacatgcctgatgtgatagagaaactg

SEQ ID NO: 360164 - DNA, 75 bp, Artificial Sequence
  Synthetic
gaactgttatcaggaatcccctttccagaaactcaacccatgagatgtattatgtgtcaggagcaagaagtaata

SEQ ID NO: 360165 - DNA, 75 bp, Artificial Sequence
  Synthetic
cagaaactcaacccatgagatgtattatgtgtcaggagcaagaagtaatatcactttcacagtcaaccaaacgtc

SEQ ID NO: 360166 - DNA, 75 bp, Artificial Sequence
  Synthetic
agctggatagtggacagacagtgggctcaggacctgaccctgccatggcagagtggaagtggcggggtgtggaga

SEQ ID NO: 360167 - DNA, 75 bp, Artificial Sequence
  Synthetic
cgcccaacaggcaaggtcacccttgagcccgatgtcattcttcccataggcacacgcagcgtagaaactgacaag

SEQ ID NO: 360168 - DNA, 75 bp, Artificial Sequence
  Synthetic
gagtggaagtggcggggtgtggagagagatgcatcatcttgttgaatttgaacctccgcatgccgcaactatcag

SEQ ID NO: 360169 - DNA, 75 bp, Artificial Sequence
  Synthetic
agcccgatgtcattcttcccataggcacacgcagcgtagaaactgacaagggaccattggacagggatgccattg

SEQ ID NO: 360170 - DNA, 75 bp, Artificial Sequence
  Synthetic
cgagtatgccactacatggttctatgacaatgacaacccataccggacctggcattactgtggctcatatatcac

SEQ ID NO: 360171 - DNA, 75 bp, Artificial Sequence
  Synthetic
gacaatgacaacccataccggacctggcattactgtggctcatatatcactaaaacatcaggcagtgcagccagc

SEQ ID NO: 360172 - DNA, 75 bp, Artificial Sequence
  Synthetic
tgacttttccatgggataggatagaagaggtcaccaggatggcaatgactgacactacgccttttggccaacaaa

SEQ ID NO: 360173 - DNA, 75 bp, Artificial Sequence
  Synthetic
agaggtcaccaggatggcaatgactgacactacgccttttggccaacaaagagttttcaaggaaaaggtggacac

SEQ ID NO: 360174 - DNA, 75 bp, Artificial Sequence
  Synthetic
actaggaaaatcatgaaggtggtaaaccgttggctgttccgtcatctggcccgggagaagaaccctaggctgtgc

SEQ ID NO: 360175 - DNA, 75 bp, Artificial Sequence
  Synthetic
accgttggctgttccgtcatctggcccgggagaagaaccctaggctgtgcacaaaggaggaattcatagccaagg

SEQ ID NO: 360176 - DNA, 75 bp, Artificial Sequence
  Synthetic
cccaccctttggagatagctacatcatcgttgggacaggagattcacgtctcacctaccagtggcacaaagaggg

SEQ ID NO: 360177 - DNA, 75 bp, Artificial Sequence
  Synthetic
ctttctagaagagcaggagcaatggaagacagccaatgaagcagttcaagaccctaagttttgggagatggttga

SEQ ID NO: 360178 - DNA, 75 bp, Artificial Sequence
  Synthetic
aagacagccaatgaagcagttcaagaccctaagttttgggagatggttgatgctgagcgcaaactacatcaacag

SEQ ID NO: 360179 - DNA, 75 bp, Artificial Sequence
  Synthetic
acatgatgggaaagagagagaaaaaactgtctgagtttgggaaagcaaaaggaagtcgtgcgatctggtacatgt

SEQ ID NO: 360180 - DNA, 75 bp, Artificial Sequence
  Synthetic
ttcacctcggttgggaaaggaattcatacggtgtttggctctgcctttcaggggctatttggtggcttgagctgg

SEQ ID NO: 360181 - DNA, 75 bp, Artificial Sequence
  Synthetic
ggaagtcgtgcgatctggtacatgtggctgggggcgcgtttccttgagttcgaggctcttgggttcttgaatgaa

SEQ ID NO: 360182 - DNA, 75 bp, Artificial Sequence
  Synthetic
ctgctcccaccatttccatgaacttgtgttgaaagatggaaggaaagttgtggtgccctgtagagaccaagatga

SEQ ID NO: 360183 - DNA, 75 bp, Artificial Sequence
  Synthetic
tggtgccctgtagagaccaagatgagttgataggaagagggagagtgtctccaggaaatggctggatgatcaaag

SEQ ID NO: 360184 - DNA, 75 bp, Artificial Sequence
  Synthetic
gttgataggaagagggagagtgtctccaggaaatggctggatgatcaaagaaacagcctgcctcagcaaggctta

SEQ ID NO: 360185 - DNA, 75 bp, Artificial Sequence
  Synthetic
tttcacaagagggacatgaggctgctttcatttgctgtctcatcggccgtcccaacggcatgggtacccagtgga

SEQ ID NO: 360186 - DNA, 75 bp, Artificial Sequence
  Synthetic
tttcatttgctgtctcatcggccgtcccaacggcatgggtacccagtggaagaacaacatggtctgttcatggaa

SEQ ID NO: 360187 - DNA, 75 bp, Artificial Sequence
  Synthetic
catgttggacgtctggaacagagtttgggttttaaacaacccacacatgaaggacaagactaccgtgaaggagtg

SEQ ID NO: 360188 - DNA, 75 bp, Artificial Sequence
  Synthetic
aggcaagacaagctctgtgggtccctaataggaatgacaaacagggccacatgggcctcacacatccacctggtg

SEQ ID NO: 360189 - DNA, 75 bp, Artificial Sequence
  Synthetic
acatcagttgaagagagtgaaatgttcatgccgagatcaattggaggcccagttagctctcacaatcatatccct

SEQ ID NO: 360190 - DNA, 75 bp, Artificial Sequence
  Synthetic
cactgtgatggacaggtactcggttgatgctgacctccaaccaggagagctcatctgagaccagccatcgtaaat

SEQ ID NO: 360191 - DNA, 75 bp, Artificial Sequence
  Synthetic
cttggatgcaggtaccactagaagtgaggagagaagcttgcccagggactagtgtgatcattgatggcaactgtg

SEQ ID NO: 360192 - DNA, 75 bp, Artificial Sequence
  Synthetic
catcaacaagaaaccggtataaaaactacggatggagaaccggactccacacttaagaggccattgacgtcagcc

SEQ ID NO: 360193 - DNA, 75 bp, Artificial Sequence
  Synthetic
gttggaggagtggtgctcttgggagcaatgctggtcgggcaggtaactctccttgatttgctgaaactcacagtg

SEQ ID NO: 360194 - DNA, 75 bp, Artificial Sequence
  Synthetic
agtgggaccatattgacgccagggaaagaccggagtggttctctgcttttcctccaggggtctgcgagcacagtt

SEQ ID NO: 360195 - DNA, 75 bp, Artificial Sequence
  Synthetic
aagaccggagtggttctctgcttttcctccaggggtctgcgagcacagtttgctctagaagaagcagacctttgg

SEQ ID NO: 360196 - DNA, 75 bp, Artificial Sequence
  Synthetic
gaagtatctgaatgcagtttctctctgcatcttgacaataaatgctgttgcttctaggaaagcatcaaacaccat

SEQ ID NO: 360197 - DNA, 75 bp, Artificial Sequence
  Synthetic
agaagtttcttgggaagaggaagctgagatcagtggaagttctgcccgttatgatgtgactctcagtgaacaggg

SEQ ID NO: 360198 - DNA, 75 bp, Artificial Sequence
  Synthetic
tcacaatgctctccccaatgctgcaccactggatcaaggttgagtatggtaatctgtctttgtctggaattgcac

SEQ ID NO: 360199 - DNA, 75 bp, Artificial Sequence
  Synthetic
gttccaggaaagaacgtggtcaatattcagacaaaaccgagcttgttcaaagtgaggaacgggggagaaatcggg

SEQ ID NO: 360200 - DNA, 75 bp, Artificial Sequence
  Synthetic
ttcagacaaaaccgagcttgttcaaagtgaggaacgggggagaaatcggggctgtcgctcttgactacccaagtg

SEQ ID NO: 360201 - DNA, 75 bp, Artificial Sequence
  Synthetic
gaactactatgcttttgtgggtgtcatgtacaatctctggaagatgaagactggacgcagggggagagcgaatgg

SEQ ID NO: 360202 - DNA, 75 bp, Artificial Sequence
  Synthetic
cccaccagggttgttctctctgaaatgaaggaagcttttcacggcttggacgtgaaattccacacacaggccttt

SEQ ID NO: 360203 - DNA, 75 bp, Artificial Sequence
  Synthetic
ctgtgcttgtggatgaagggaggaaggtggcaataaaggggccactccgcatctccgcatcctctgctgctcaaa

SEQ ID NO: 360204 - DNA, 75 bp, Artificial Sequence
  Synthetic
tgaaggtaggaggggagctgcggaagtgctagttgtgctgagtgaactccctgattttttggctaagaaaggtgg

SEQ ID NO: 360205 - DNA, 75 bp, Artificial Sequence
  Synthetic
ttcctccactctgaggaaggctctagggcttaccgcaatgcactatcaatgatgcctgaggcaatgacaatagtc

SEQ ID NO: 360206 - DNA, 75 bp, Artificial Sequence
  Synthetic
tagtgcttcaccctggagttggccggatcttgacttgaagccaggggctgcctggacagtgtatgttggcattgt

SEQ ID NO: 360207 - DNA, 75 bp, Artificial Sequence
  Synthetic
gtcagcctcagtcctttctttcatggacaaggggataccattcatgaagatgaacatctcggtcataatactgct

SEQ ID NO: 360208 - DNA, 75 bp, Artificial Sequence
  Synthetic
cgcccttttcactggctgaaggcattgtcctagcatcagctgccttagggccgcttatagagggaaacaccagcc

SEQ ID NO: 360209 - DNA, 75 bp, Artificial Sequence
  Synthetic
ctctatgacgggagttatgcgggggaactactatgcctttgtgggagtcatgtacaatctatggaagatgaaaac

SEQ ID NO: 360210 - DNA, 75 bp, Artificial Sequence
  Synthetic
tgtacaatctatggaagatgaaaactggacgccgagggagcgcgaatggaaaaactctgggtgaagtctggaaga

SEQ ID NO: 360211 - DNA, 75 bp, Artificial Sequence
  Synthetic
acagtttgagctgtacaaaaggactgacattgtggaggtggatcgtgacacggcacgcaggcatctggccgaagg

SEQ ID NO: 360212 - DNA, 75 bp, Artificial Sequence
  Synthetic
gctggaaggtagggtgactgaccttgggtgtggccgcggaggctggtgttactatgctgctgcgcaaaaggaagt

SEQ ID NO: 360213 - DNA, 75 bp, Artificial Sequence
  Synthetic
aatgtgacacccttttgtgtgacattggagagtcatcatcgtcatcggtcacagagggggaaaggaccatgagag

SEQ ID NO: 360214 - DNA, 75 bp, Artificial Sequence
  Synthetic
ttcttgatactgtggagaaatggctggcttgtggggttgacaacttctgtgtgaaggtgttagctccatacatgc

SEQ ID NO: 360215 - DNA, 75 bp, Artificial Sequence
  Synthetic
gtgatcaggaaccctctctccaggaattccacccatgaaatgtactatgtgtctggagcccgcagcaatgtcacg

SEQ ID NO: 360216 - DNA, 75 bp, Artificial Sequence
  Synthetic
ggaagaatttattgcaaaagtccgcagtcatgcagccattggagcttacctggaagaacaagaacagtggaagac

SEQ ID NO: 360217 - DNA, 75 bp, Artificial Sequence
  Synthetic
aagttctgggaactggtggatgaagaaagaaagctgcaccaacaaggcaggtgtcggacttgtgtgtacaacatg

SEQ ID NO: 360218 - DNA, 75 bp, Artificial Sequence
  Synthetic
ggaggcatggctcactgagcacggatgtgacagactgaagaggatggcggtgagtggagacgattgtgttgtccg

SEQ ID NO: 360219 - DNA, 75 bp, Artificial Sequence
  Synthetic
gcctgcctcagcaaggcctatgccaacatgtggtcactgatgtattttcacaaaagggacatgagactgctgtca

SEQ ID NO: 360220 - DNA, 75 bp, Artificial Sequence
  Synthetic
gagtggatgaccacggaagacatgcttggggtgtggaacagagtgtggataaccaacaacccacacatgcaggat

SEQ ID NO: 360221 - DNA, 75 bp, Artificial Sequence
  Synthetic
aaaccgggataaaaactacggatggagaaccggactccacacattgaaacagaagaagttgtcagcccagaactc

SEQ ID NO: 360222 - DNA, 75 bp, Artificial Sequence
  Synthetic
tgttccaggaaagaacgtggtcaacgtccagacaaaaccgagcttgttcaaagtgaggaatgggggggaaatcgg

SEQ ID NO: 360223 - DNA, 75 bp, Artificial Sequence
  Synthetic
tagacctggaccttcaagaggcgttcaaggatttatttttttctttttgttcaatgtcttgactggaaggaagat

SEQ ID NO: 360224 - DNA, 75 bp, Artificial Sequence
  Synthetic
aggatgctggacccaagacagggattagctgttctgaagaaggtcaagagagtggtggcgagtctgatgagaggt

SEQ ID NO: 360225 - DNA, 75 bp, Artificial Sequence
  Synthetic
agtggtggcgagtctgatgagaggtttgtcctcgaggaaacgccgatcccatgaagtcttgactgttcactttct

SEQ ID NO: 360226 - DNA, 75 bp, Artificial Sequence
  Synthetic
atgaagtcttgactgttcactttctgatccttggaatgatgctgatgactggtggagtgaccctggtgcgcaaga

SEQ ID NO: 360227 - DNA, 75 bp, Artificial Sequence
  Synthetic
atctgaggaccttgggaaaaccttctctgttggcacaggcaattgcacaaccaacattctggatgccaagaattg

SEQ ID NO: 360228 - DNA, 75 bp, Artificial Sequence
  Synthetic
tctgttggcacaggcaattgcacaaccaacattctggatgccaagaattggtgtccggattccatggaatacaac

SEQ ID NO: 360229 - DNA, 75 bp, Artificial Sequence
  Synthetic
agcctgatgacatagattgttggtgttatggagtggaaaatgttagggttgcttatggcaagtgtgattcagcgg

SEQ ID NO: 360230 - DNA, 75 bp, Artificial Sequence
  Synthetic
gcttatggcaagtgtgattcagcgggtaggtcaagaaggtctagaagggccattgacttacccacacatgaaaac

SEQ ID NO: 360231 - DNA, 75 bp, Artificial Sequence
  Synthetic
agtggatgactggaagaatgggcgagagacaattgcagaaaattgaaagatggctagtgaggaatcccttttttg

SEQ ID NO: 360232 - DNA, 75 bp, Artificial Sequence
  Synthetic
cggtgacagccttagctattgcttatttagtggggagcaacatgacgcaacgagttgtgattgccttgctagttt

SEQ ID NO: 360233 - DNA, 75 bp, Artificial Sequence
  Synthetic
tcactgcataggaataactgatagggatttcattgagggggtgcatggaggaacttgggtctcagccaccttgga

SEQ ID NO: 360234 - DNA, 75 bp, Artificial Sequence
  Synthetic
gcccctgacaagccctcattggacatatcattggaaacagttgccattgatggacctgctgaagcgaggaaagtg

SEQ ID NO: 360235 - DNA, 75 bp, Artificial Sequence
  Synthetic
tatcattggaaacagttgccattgatggacctgctgaagcgaggaaagtgtgctacagtgcagtcttgacccatg

SEQ ID NO: 360236 - DNA, 75 bp, Artificial Sequence
  Synthetic
caccggcgaagcccatttggccgaagaaaacgagggagataatgcctgtaaacggacttactctgacaggggctg

SEQ ID NO: 360237 - DNA, 75 bp, Artificial Sequence
  Synthetic
gaaaacgagggagataatgcctgtaaacggacttactctgacaggggctgggggaatggttgtggcctgtttggg

SEQ ID NO: 360238 - DNA, 75 bp, Artificial Sequence
  Synthetic
agtttacctgtgccaagtccatgagcctgtttgaggttgaccagaccaaaatccagtatgtcatcagggcacaat

SEQ ID NO: 360239 - DNA, 75 bp, Artificial Sequence
  Synthetic
ctggaatgctgacatcaagaccctcaaatttgatgccctgtcaggttctcaggaggctgagtttactggatacgg

SEQ ID NO: 360240 - DNA, 75 bp, Artificial Sequence
  Synthetic
aaatttgatgccctgtcaggttctcaggaggctgagtttactggatacgggaaggctacattggagtgccaagta

SEQ ID NO: 360241 - DNA, 75 bp, Artificial Sequence
  Synthetic
gctacattgcagagatggagaaggagagctggattgtggatagacagtgggctcaagatttgaccctaccttggc

SEQ ID NO: 360242 - DNA, 75 bp, Artificial Sequence
  Synthetic
agagatgcaccatcttgtggaatttgagcctccacatgctgcaaccatcaaggtgttggccctgggaaaccaaga

SEQ ID NO: 360243 - DNA, 75 bp, Artificial Sequence
  Synthetic
gagcctccacatgctgcaaccatcaaggtgttggccctgggaaaccaagaaggctctttgaagacagctctcact

SEQ ID NO: 360244 - DNA, 75 bp, Artificial Sequence
  Synthetic
caaatggcagcaacctatacaagctccatggggggcacgtctcatgtagagtgaaattgtcagctttgacactca

SEQ ID NO: 360245 - DNA, 75 bp, Artificial Sequence
  Synthetic
ccatggggggcacgtctcatgtagagtgaaattgtcagctttgacactcaagggaacatcctacaagatgtgtac

SEQ ID NO: 360246 - DNA, 75 bp, Artificial Sequence
  Synthetic
cgataaaatgtcttttgttaagaatccaactgacactggacatggcactgccgtgatgcaggtgaaggtgccaaa

SEQ ID NO: 360247 - DNA, 75 bp, Artificial Sequence
  Synthetic
atggtagctgatgatctcacagcggcagtcaacaaaggcattttagtcacagtcaacccgatagcctccaccaac

SEQ ID NO: 360248 - DNA, 75 bp, Artificial Sequence
  Synthetic
cagtcaacaaaggcattttagtcacagtcaacccgatagcctccaccaacgaggatgaagtgttgattgaggtga

SEQ ID NO: 360249 - DNA, 75 bp, Artificial Sequence
  Synthetic
tatagttgggacaggggactcccgcctgacctatcagtggcacaaggagggcagctcaataggaaagttgttcac

SEQ ID NO: 360250 - DNA, 75 bp, Artificial Sequence
  Synthetic
ctgacctatcagtggcacaaggagggcagctcaataggaaagttgttcacccagaccatgaagggcgcggagcgc

SEQ ID NO: 360251 - DNA, 75 bp, Artificial Sequence
  Synthetic
gggacttcagctctgctggaggatttttcacatcagtcggaaaaggaatacacatggtgtttggttctgcctttc

SEQ ID NO: 360252 - DNA, 75 bp, Artificial Sequence
  Synthetic
aaggattgtttggtggcctgagttggataacaaaggtcatcataggggcagtccttatatgggttggcatcaaca

SEQ ID NO: 360253 - DNA, 75 bp, Artificial Sequence
  Synthetic
catgatcctggttggagtcatcatgatgtttctgtccctgggagtgggggcggaccaaggatgtgcaatcaactt

SEQ ID NO: 360254 - DNA, 75 bp, Artificial Sequence
  Synthetic
cggaccaaggatgtgcaatcaactttggtaagagagaacttaaatgtggggatggagttttcatcttcagggatt

SEQ ID NO: 360255 - DNA, 75 bp, Artificial Sequence
  Synthetic
atactatccagaagatccagtgaaacttgcttcaatagtgaaggcctccttcgaagaagggaagtgtggtttaaa

SEQ ID NO: 360256 - DNA, 75 bp, Artificial Sequence
  Synthetic
tcaacgccatccttgaggagaatgaggtagacatctcagtggtggtccaagacccaaaaaacatctaccagagag

SEQ ID NO: 360257 - DNA, 75 bp, Artificial Sequence
  Synthetic
tgatggcttgcaatatggctggaagacctggggtaagaaccttgtgttttctccaggaagaaagaatggaagctt

SEQ ID NO: 360258 - DNA, 75 bp, Artificial Sequence
  Synthetic
cttgggggcagcagtgaatggaaaaaagagtgcacatgggtccccaacattttggatgggaagccatgaggtgaa

SEQ ID NO: 360259 - DNA, 75 bp, Artificial Sequence
  Synthetic
aatggccgctgacacacacgattggaacatcagttgaagagagcgacatgtttatgccgaggtcaatcgggggcc

SEQ ID NO: 360260 - DNA, 75 bp, Artificial Sequence
  Synthetic
aggatacaaggtccagacaaatgggccttggatgcaggtgccactggaagtgaagagagaagcctgcccaggaac

SEQ ID NO: 360261 - DNA, 75 bp, Artificial Sequence
  Synthetic
ccttggatgcaggtgccactggaagtgaagagagaagcctgcccaggaaccagtgtggttgttgacggtggctgt

SEQ ID NO: 360262 - DNA, 75 bp, Artificial Sequence
  Synthetic
ccaccaccgacagtgggaagatcattcctgaatggtgttgccgatcatgcacaatgccgccagtgagctttcacg

SEQ ID NO: 360263 - DNA, 75 bp, Artificial Sequence
  Synthetic
ggaaattagaccaaggaagacacatgacaaccacctggttcgctcatgggtgacagctggagaggtccatgcagt

SEQ ID NO: 360264 - DNA, 75 bp, Artificial Sequence
  Synthetic
gacaaccacctggttcgctcatgggtgacagctggagaggtccatgcagtcccttttgggttggtgagcatgatg

SEQ ID NO: 360265 - DNA, 75 bp, Artificial Sequence
  Synthetic
agagacagggacccaagcaaatactagttggaggcatagtgctcctaggagccatgttagttggacaggtgaccc

SEQ ID NO: 360266 - DNA, 75 bp, Artificial Sequence
  Synthetic
agttggaggcatagtgctcctaggagccatgttagttggacaggtgaccctgttggatttgctgaagctcacagt

SEQ ID NO: 360267 - DNA, 75 bp, Artificial Sequence
  Synthetic
atgaacaatggaggggacgccatgtacatggccctgatcgctgctttctcgataaggccaggactgctcatcggc

SEQ ID NO: 360268 - DNA, 75 bp, Artificial Sequence
  Synthetic
acatggccctgatcgctgctttctcgataaggccaggactgctcatcggcttcgggttgaggacactgtggagtc

SEQ ID NO: 360269 - DNA, 75 bp, Artificial Sequence
  Synthetic
gggagcagccatggtggagatagccttgggcggcatgatgggggggctgtggaagtacctgaatgcagtgtccct

SEQ ID NO: 360270 - DNA, 75 bp, Artificial Sequence
  Synthetic
ttgggcggcatgatgggggggctgtggaagtacctgaatgcagtgtccctttgcatcttgacaataaatgctgtt

SEQ ID NO: 360271 - DNA, 75 bp, Artificial Sequence
  Synthetic
tcctgcccttgatggcgctgttgacacctgtaacaatggctgaggtgagacttgcaacgatgctcttttgcactg

SEQ ID NO: 360272 - DNA, 75 bp, Artificial Sequence
  Synthetic
acctgtaacaatggctgaggtgagacttgcaacgatgctcttttgcactgtggtcatcatcggagtcctccacca

SEQ ID NO: 360273 - DNA, 75 bp, Artificial Sequence
  Synthetic
aagaccatacccctggtggcccttacactgacttcttatctggggttgacacagccttttttgggcttgtgcgcc

SEQ ID NO: 360274 - DNA, 75 bp, Artificial Sequence
  Synthetic
cactgacttcttatctggggttgacacagccttttttgggcttgtgcgccttcatggcaacccgaatattcggac

SEQ ID NO: 360275 - DNA, 75 bp, Artificial Sequence
  Synthetic
acttgcagcggctggtctcgtgggagtgttggcgggactagctttccaagagatggaaaattttctgggcccagt

SEQ ID NO: 360276 - DNA, 75 bp, Artificial Sequence
  Synthetic
gtgttggcgggactagctttccaagagatggaaaattttctgggcccagttgcagttggaggaattctgatgatg

SEQ ID NO: 360277 - DNA, 75 bp, Artificial Sequence
  Synthetic
atggactcgaactcaggaagctaggagaagtttcctgggaagaggaagctgagatcagtggaagttctgcccgtt

SEQ ID NO: 360278 - DNA, 75 bp, Artificial Sequence
  Synthetic
agaagtttcctgggaagaggaagctgagatcagtggaagttctgcccgttatgatgtggctcttagtgaacaagg

SEQ ID NO: 360279 - DNA, 75 bp, Artificial Sequence
  Synthetic
aaggttccatgggatcagattgtcatgacctcactggccttggtcggagctgctatccatccatttgcactcatg

SEQ ID NO: 360280 - DNA, 75 bp, Artificial Sequence
  Synthetic
tgacctcactggccttggtcggagctgctatccatccatttgcactcatgctggttcttgctggctggctgctcc

SEQ ID NO: 360281 - DNA, 75 bp, Artificial Sequence
  Synthetic
agacgtcctctgggatatccccgcacctacaattgttgaggagtgtgaacatttagaggatgggatttatggcat

SEQ ID NO: 360282 - DNA, 75 bp, Artificial Sequence
  Synthetic
cctacaattgttgaggagtgtgaacatttagaggatgggatttatggcattttccagtcgacatttctaggagcc

SEQ ID NO: 360283 - DNA, 75 bp, Artificial Sequence
  Synthetic
agggaggggtcttccacacgatgtggcatgtgacaagaggtgcctttctcgttagaaatggcaagaagctagtcc

SEQ ID NO: 360284 - DNA, 75 bp, Artificial Sequence
  Synthetic
gcatgtgacaagaggtgcctttctcgttagaaatggcaagaagctagtcccaacctgggcctcagtcaaggagga

SEQ ID NO: 360285 - DNA, 75 bp, Artificial Sequence
  Synthetic
aagctggaaggcagatgggatggagaggaggaggttcagttgattgcagccgcccccggaaagaacgtggtcaac

SEQ ID NO: 360286 - DNA, 75 bp, Artificial Sequence
  Synthetic
gttcagacaaaaccaagcctgtttaaggttaggaatggcggagaaatcggggcggtggcccttgactacccgagc

SEQ ID NO: 360287 - DNA, 75 bp, Artificial Sequence
  Synthetic
acaggaatggtgaagtgatagggttgtatggcaatggaattcttgttggtgacaactcctttgtatctgccatat

SEQ ID NO: 360288 - DNA, 75 bp, Artificial Sequence
  Synthetic
gaaggaagagcttcaggaaatcccgacaatgctaaagaagggaatgacaaccattcttgacttccatcctggggc

SEQ ID NO: 360289 - DNA, 75 bp, Artificial Sequence
  Synthetic
acaatgctaaagaagggaatgacaaccattcttgacttccatcctggggctgggaaaaccagacgctttcttccc

SEQ ID NO: 360290 - DNA, 75 bp, Artificial Sequence
  Synthetic
gacggctgcgcacacttgttctggctcccactagagttgtcctctccgaaatgaaggaagcctttcacggcctag

SEQ ID NO: 360291 - DNA, 75 bp, Artificial Sequence
  Synthetic
tcccactagagttgtcctctccgaaatgaaggaagcctttcacggcctagatgtaaagtttcacacacaggcctt

SEQ ID NO: 360292 - DNA, 75 bp, Artificial Sequence
  Synthetic
gtcattgatgccatgtgtcatgctactctgacatacaggatgctggagccgactagagtggtgaattgggaagtg

SEQ ID NO: 360293 - DNA, 75 bp, Artificial Sequence
  Synthetic
tagatccggccagcatagcagccagaggctgggcagcacacagagctagagcgaatgaaagtgcaacaatcttga

SEQ ID NO: 360294 - DNA, 75 bp, Artificial Sequence
  Synthetic
tgatgaatttccacactcgaatggggaaatagaggatgttcagacagatattcctagtgagccctggaatacggg

SEQ ID NO: 360295 - DNA, 75 bp, Artificial Sequence
  Synthetic
aggcccacggcctggtttcttccatccatcagggctgcaaacgtcatggcagcatctctacgcaaagctgggaag

SEQ ID NO: 360296 - DNA, 75 bp, Artificial Sequence
  Synthetic
cctttgaaaaagagtatcccacaattaaacagaagaaacctgacttcatcctggccactgacatagctgaaatgg

SEQ ID NO: 360297 - DNA, 75 bp, Artificial Sequence
  Synthetic
gggccaacctctgtgtggagagagtgctggattgcaggacggctttcaaacctgtgcttgtggatgaggggagga

SEQ ID NO: 360298 - DNA, 75 bp, Artificial Sequence
  Synthetic
cctgtgcttgtggatgaggggaggaaggtggcgataaagggaccacttcggatttcagcttcttccgctgcccaa

SEQ ID NO: 360299 - DNA, 75 bp, Artificial Sequence
  Synthetic
aggtggcgataaagggaccacttcggatttcagcttcttccgctgcccaaagaaggggacgcattggaaggaacc

SEQ ID NO: 360300 - DNA, 75 bp, Artificial Sequence
  Synthetic
ttactctgagccaacaagtgaagacaatgcccatcatgtctgctggctggaagcctcaatgctcttagacaatat

SEQ ID NO: 360301 - DNA, 75 bp, Artificial Sequence
  Synthetic
aagcctcaatgctcttagacaatatggaggtgaggggtggaatggtcgctccactctatggcatagagggaacaa

SEQ ID NO: 360302 - DNA, 75 bp, Artificial Sequence
  Synthetic
ccactctatggcatagagggaacaaaaacaccagtttccccaggcgaaatgaggctaagagatgaccaaaggaga

SEQ ID NO: 360303 - DNA, 75 bp, Artificial Sequence
  Synthetic
agggtccagaagaacatgagatcttgaatgacagtggtgagacagtaaagtgcagggcccctggaggagcgaaga

SEQ ID NO: 360304 - DNA, 75 bp, Artificial Sequence
  Synthetic
tgagagggtttcatccgaccagagcgcccttgctgaattcataaagtttgccgagggcaggagaggggcggcaga

SEQ ID NO: 360305 - DNA, 75 bp, Artificial Sequence
  Synthetic
gcccttgctgaattcataaagtttgccgagggcaggagaggggcggcagaggtgctggttgtactgagtgaactc

SEQ ID NO: 360306 - DNA, 75 bp, Artificial Sequence
  Synthetic
gagaggcgatggacactatcagcgtgttcttgaactctgaggaaggttccagagcttaccgcaatgcattgtcca

SEQ ID NO: 360307 - DNA, 75 bp, Artificial Sequence
  Synthetic
gttcttgaactctgaggaaggttccagagcttaccgcaatgcattgtccatgatgcctgaggctatgacgatagt

SEQ ID NO: 360308 - DNA, 75 bp, Artificial Sequence
  Synthetic
ctgacgtctggaatggtcatctttttcatgtctcccaagggaatcagcagaatgtccatggcaatgggcacaatg

SEQ ID NO: 360309 - DNA, 75 bp, Artificial Sequence
  Synthetic
ctcctacatcatgctaatattttttgtcctgatggtggtggtggttccagagccggggcagcagagaaccatcca

SEQ ID NO: 360310 - DNA, 75 bp, Artificial Sequence
  Synthetic
attggcattttgacgttggtttccgtggtggcggccaatgaactgggtatgttggaaaagaccaaggaagacctt

SEQ ID NO: 360311 - DNA, 75 bp, Artificial Sequence
  Synthetic
ccaacaccgcaccctggaattggccagatcttgacttgaagccaggagctgcttggactgtctatgttggcattg

SEQ ID NO: 360312 - DNA, 75 bp, Artificial Sequence
  Synthetic
gcttggactgtctatgttggcattgtaacaatgctctccccaatgctgcaccattggatcaaggttgagtatggc

SEQ ID NO: 360313 - DNA, 75 bp, Artificial Sequence
  Synthetic
ggacaagggcatcccgttcatgaagatgaacatctcggtcataatcctactaatcagtggctggaattcaataac

SEQ ID NO: 360314 - DNA, 75 bp, Artificial Sequence
  Synthetic
atgaacatctcggtcataatcctactaatcagtggctggaattcaataacagtgatgcctctactttgtggcatt

SEQ ID NO: 360315 - DNA, 75 bp, Artificial Sequence
  Synthetic
tcatcctgcccggaatcaaggcgcagcaatcaaagttggcacagaggagagtgtttcatggtgttgctaaaaatc

SEQ ID NO: 360316 - DNA, 75 bp, Artificial Sequence
  Synthetic
gtgtttcatggtgttgctaaaaatccagtggttgatggaaatccaacagttgacattgaggaagccccggaaatg

SEQ ID NO: 360317 - DNA, 75 bp, Artificial Sequence
  Synthetic
cattgtacctcttgcttgcccttagtttggcctctgttgccatgtgcaggacccctttctcattagccgaaggca

SEQ ID NO: 360318 - DNA, 75 bp, Artificial Sequence
  Synthetic
tttggcctctgttgccatgtgcaggacccctttctcattagccgaaggcattgtattggcgtcagcagctctggg

SEQ ID NO: 360319 - DNA, 75 bp, Artificial Sequence
  Synthetic
ctcctatggaatggacctatggctgtgtccatgacaggagttatgcgagggaattattatgcttttgtgggtgtc

SEQ ID NO: 360320 - DNA, 75 bp, Artificial Sequence
  Synthetic
tgtccatgacaggagttatgcgagggaattattatgcttttgtgggtgtcatgtacaatctctggaagatgaaaa

SEQ ID NO: 360321 - DNA, 75 bp, Artificial Sequence
  Synthetic
gaaaaccctgggtgaggtctggaaaagggagttgaacctgctggacaagcaacagtttgagctgtacaaaaggac

SEQ ID NO: 360322 - DNA, 75 bp, Artificial Sequence
  Synthetic
agggagttgaacctgctggacaagcaacagtttgagctgtacaaaaggacagatatagtggaggtggaccgtgag

SEQ ID NO: 360323 - DNA, 75 bp, Artificial Sequence
  Synthetic
ggaaggtggacactggggtagctgtttcgagagggaccgcaaaattgagatggtttcatgaacgtggctacgtca

SEQ ID NO: 360324 - DNA, 75 bp, Artificial Sequence
  Synthetic
tactatgctgctgcacagaaagaggtgagtggggtcaagggattcacccttggaaaggaaggccatgaaaaaccc

SEQ ID NO: 360325 - DNA, 75 bp, Artificial Sequence
  Synthetic
tgagtggggtcaagggattcacccttggaaaggaaggccatgaaaaacccatgaatgtgcaaagcctgggatgga

SEQ ID NO: 360326 - DNA, 75 bp, Artificial Sequence
  Synthetic
tgatattcaccgcctggagccagtgaagtgtgacaccctcttgtgcgatattggagagtcgtctccatcatcagt

SEQ ID NO: 360327 - DNA, 75 bp, Artificial Sequence
  Synthetic
gaccgagggggaaaggaccatgcgagttcttgacaccgttgagaaatggcttggctgcggtgttgagagcttttg

SEQ ID NO: 360328 - DNA, 75 bp, Artificial Sequence
  Synthetic
gttcttgacaccgttgagaaatggcttggctgcggtgttgagagcttttgtgtgaaggtgttggctccatacatg

SEQ ID NO: 360329 - DNA, 75 bp, Artificial Sequence
  Synthetic
tactccaaaggaggtttggtgggacggtcatcaggaaccccctttccagaaactctacccatgagatgtattatg

SEQ ID NO: 360330 - DNA, 75 bp, Artificial Sequence
  Synthetic
ggtcatcaggaaccccctttccagaaactctacccatgagatgtattatgtatctggagcccgcagcaacatcac

SEQ ID NO: 360331 - DNA, 75 bp, Artificial Sequence
  Synthetic
ctcttaatgagaagaatgaggcgcccaacaggcaaagtgactctggaggctgacgtcatcctcccaattggaaca

SEQ ID NO: 360332 - DNA, 75 bp, Artificial Sequence
  Synthetic
cgcagtgtggaaacggacaaagggccactggatagggcagccattgaagagagggttgaaagaataaaatctgaa

SEQ ID NO: 360333 - DNA, 75 bp, Artificial Sequence
  Synthetic
cactggatagggcagccattgaagagagggttgaaagaataaaatctgaatacacagccacctggttttatgaca

SEQ ID NO: 360334 - DNA, 75 bp, Artificial Sequence
  Synthetic
ttactgcggctcctatgtcacaagaacttcagggagtgcagcaagcatgatcaatggagtgattaagatcttaac

SEQ ID NO: 360335 - DNA, 75 bp, Artificial Sequence
  Synthetic
acttcagggagtgcagcaagcatgatcaatggagtgattaagatcttaacatacccctgggacaggatagaggaa

SEQ ID NO: 360336 - DNA, 75 bp, Artificial Sequence
  Synthetic
gtggctgtttcgccacttggctagggaaaagagccccaggctgtgcacaaaggaggagttcatagcaaaagtccg

SEQ ID NO: 360337 - DNA, 75 bp, Artificial Sequence
  Synthetic
gaaattctgggaattggtggatgaagaacgacggctacaccaacagggtaggtgtcggacttgtgtgtacaacat

SEQ ID NO: 360338 - DNA, 75 bp, Artificial Sequence
  Synthetic
tcagagttcggaaaggcgaaaggaagtcgagccatctggtacatgtggttgggagcccgatatcttgagtttgaa

SEQ ID NO: 360339 - DNA, 75 bp, Artificial Sequence
  Synthetic
gccctgggattcttaaatgaggaccactgggcgtccagggaaaactcaggggggggagttgaaggcatcggtctg

SEQ ID NO: 360340 - DNA, 75 bp, Artificial Sequence
  Synthetic
gcctggctgcactagaaggtggtggattctatgcagatgacacagctggatgggatacacgcatcacagaggcgg

SEQ ID NO: 360341 - DNA, 75 bp, Artificial Sequence
  Synthetic
gaactacatgagtccacaccataggaagctcgcactggcagtgatggaaatgacatataaaaacaaggtggtgaa

SEQ ID NO: 360342 - DNA, 75 bp, Artificial Sequence
  Synthetic
aaagcatacatggatgtcataagccggcgggaccagaggggatctgggcaggtagtgacttatgctttgaatacc

SEQ ID NO: 360343 - DNA, 75 bp, Artificial Sequence
  Synthetic
tcaggatggcggaagcagagatggtggtgcaccaccagcatgtccaggattgtgacgatgcggttttgacaaaac

SEQ ID NO: 360344 - DNA, 75 bp, Artificial Sequence
  Synthetic
ggtgcaccaccagcatgtccaggattgtgacgatgcggttttgacaaaacttgaggcatggctcgctgagcatgg

SEQ ID NO: 360345 - DNA, 75 bp, Artificial Sequence
  Synthetic
gtgagtggagatgactgtgtcgttcgccccattgatgacaggtttggcctggctctgtctcatcttaacgccatg

SEQ ID NO: 360346 - DNA, 75 bp, Artificial Sequence
  Synthetic
gccccattgatgacaggtttggcctggctctgtctcatcttaacgccatgtccaaggtgcgcaaggacatatctg

SEQ ID NO: 360347 - DNA, 75 bp, Artificial Sequence
  Synthetic
tgactgggagaatgtgccgttctgctcccaccacttccacgaactgcagctgaaggatggcaggagaatcgtggt

SEQ ID NO: 360348 - DNA, 75 bp, Artificial Sequence
  Synthetic
gccttgtcgggatcaagatgagctaattgggaggggaagagtttctccaggaaatggctggatgatcaaggagac

SEQ ID NO: 360349 - DNA, 75 bp, Artificial Sequence
  Synthetic
aacatgtggtcattgatgtactttcacaagagggatatgaggctgctgtcactggctgtttcttctgctgttccc

SEQ ID NO: 360350 - DNA, 75 bp, Artificial Sequence
  Synthetic
ccacgtggtctgttcatgggaaaggagagtggatgaccacagaagacatgcttgaggtgtggaacagagtgtgga

SEQ ID NO: 360351 - DNA, 75 bp, Artificial Sequence
  Synthetic
cttgaggtgtggaacagagtgtggatagtcaacaacccacacatgcaggacaaaacaacggtgaaagagtggcga

SEQ ID NO: 360352 - DNA, 75 bp, Artificial Sequence
  Synthetic
aggacaagctttgtggatcactgattggaatgaccaacagagccacttgggcatctcatatccacttggtgatac

SEQ ID NO: 360353 - DNA, 75 bp, Artificial Sequence
  Synthetic
tggaatgaccaacagagccacttgggcatctcatatccacttggtgatacaccgcatccggacattgattgggaa

SEQ ID NO: 360354 - DNA, 75 bp, Artificial Sequence
  Synthetic
gtcatggacagatactctgtggatgctgacctgcagcccggcgagctcatttgagacgccattttacagggacaa

SEQ ID NO: 360355 - DNA, 75 bp, Artificial Sequence
  Synthetic
ttgagacgccattttacagggacaaccaagaacctaacactgtatatagaatgggaatgaaaccgggataaaaac

SEQ ID NO: 360356 - DNA, 75 bp, Artificial Sequence
  Synthetic
cattaaatagaagatgatgtcagcccagaaccccatgtgggttctgccactgctaagctgtgaggcagtgcaggc

SEQ ID NO: 360357 - DNA, 75 bp, Artificial Sequence
  Synthetic
cagaaccccatgtgggttctgccactgctaagctgtgaggcagtgcaggctgggacagccgccttccaggttgcg

SEQ ID NO: 360358 - DNA, 75 bp, Artificial Sequence
  Synthetic
acctcagagtaaaaccaaacggagcctccgctaccaccttcccacgtggtggtagaaagacggggtctagaggtt

SEQ ID NO: 360359 - DNA, 75 bp, Artificial Sequence
  Synthetic
aagaccggagtggttctctgcttttcctccagaggtctgtgagcacagtttgctcaagaataagcagacctttgg

SEQ ID NO: 360360 - DNA, 75 bp, Artificial Sequence
  Synthetic
agcgtacctattctgatagaggctggggtaatggctgtggcctgtttgggaaagggagcattgtggcatgcgcca

SEQ ID NO: 360361 - DNA, 75 bp, Artificial Sequence
  Synthetic
gggtaatggctgtggcctgtttgggaaagggagcattgtggcatgcgccaaattcacttgtgccaaatccatgag

SEQ ID NO: 360362 - DNA, 75 bp, Artificial Sequence
  Synthetic
gatgatgaagtgctgattgaggtgaacccaccctttggagatagctacatcatcgttgggacaggagattcacgt

SEQ ID NO: 360363 - DNA, 75 bp, Artificial Sequence
  Synthetic
tgggaagacaagacggtttctcccacagatcttggctgagtgtgcacggagacgcttgcgcactcttgtgctggc

SEQ ID NO: 360364 - DNA, 75 bp, Artificial Sequence
  Synthetic
gcctggacagtgtatgttggcattgtcacaatgctctctccaatgttgcaccactggatcaaagtcgaatatggc

SEQ ID NO: 360365 - DNA, 75 bp, Artificial Sequence
  Synthetic
gggtgcgccatgctccactggtctctcattttacctggaattaaagcgcagcagtcaaagcttgcacagagaagg

SEQ ID NO: 360366 - DNA, 75 bp, Artificial Sequence
  Synthetic
ctggacgccgagggagagcgaatggaaaaactctgggtgaagtctggaagagggaactgaacctgctggacaagc

SEQ ID NO: 360367 - DNA, 75 bp, Artificial Sequence
  Synthetic
tgacatccaccgcctggaaccagtgaaatgtgacacccttttgtgtgacattggagagtcatcatcgtcatcggt

SEQ ID NO: 360368 - DNA, 75 bp, Artificial Sequence
  Synthetic
caactggaaaagtgaccttggaggctgatgtcatcctcccaattgggacacgcagtgttgagacagacaagggac

SEQ ID NO: 360369 - DNA, 75 bp, Artificial Sequence
  Synthetic
agtggtggccagtttgatgagaggactgtcctcaaggaaacgccgttcccatgacgctctgactgtgcaactcct

SEQ ID NO: 360370 - DNA, 75 bp, Artificial Sequence
  Synthetic
aatggatgactggaagaatgggtgaaaggcagctccaaaagattgagagatggcttgtgaggaatcccttttttg

SEQ ID NO: 360371 - DNA, 75 bp, Artificial Sequence
  Synthetic
ttggaataccgatatcaaaactctcaagtttgatgccctatcaggctcccaggaggccgagttcactgggtatgg

SEQ ID NO: 360372 - DNA, 75 bp, Artificial Sequence
  Synthetic
acccaccctttggagatagctacatcatcgtcgggacaggagattcacgtctcacctatcagtggcataaagagg

SEQ ID NO: 360373 - DNA, 75 bp, Artificial Sequence
  Synthetic
tcagaccatgaaaggcgcggaacgcctagctgtcatgggagacgccgcctgggattttagctcagctggagggtt

SEQ ID NO: 360374 - DNA, 75 bp, Artificial Sequence
  Synthetic
gatccaaagaatgtttaccagagaggaacgcatccattttccagaattcgggatggtctgcagtatggttggaag

SEQ ID NO: 360375 - DNA, 75 bp, Artificial Sequence
  Synthetic
ccccagggaggaagaatggaagttttatcatagatggaaagtctaggaaagaatgcccattttcaaaccgggttt

SEQ ID NO: 360376 - DNA, 75 bp, Artificial Sequence
  Synthetic
tgggacgggagtgttcaccacacgcgtgtacatggacgcagtctttgaatacaccatagactgcgatggatccat

SEQ ID NO: 360377 - DNA, 75 bp, Artificial Sequence
  Synthetic
aagaccatacctttggtggccctcacactcacatcttacctgggcttgacacaaccttttttgggcctgtgtgca

SEQ ID NO: 360378 - DNA, 75 bp, Artificial Sequence
  Synthetic
ctggtcagcgtggctgggagagtggatgggctagagctcaggaagcttggtgaagtttcatgggaagaggaggca

SEQ ID NO: 360379 - DNA, 75 bp, Artificial Sequence
  Synthetic
ctggtccttgctgggtggctgtttcatgtcaagggagctaggagaagtggggatgttttgtgggatattcccact

SEQ ID NO: 360380 - DNA, 75 bp, Artificial Sequence
  Synthetic
acaggaacggagaggtgattgggctgtacggcaatggcattcttgttggtgacaactccttcgtgtccgccatat

SEQ ID NO: 360381 - DNA, 75 bp, Artificial Sequence
  Synthetic
tcccactagggttgttctttctgaaatgaaagaggcttttcacggcttggacgtgaaattccacacacaagcctt

SEQ ID NO: 360382 - DNA, 75 bp, Artificial Sequence
  Synthetic
gtcattgacgccatgtgtcatgccaccctaacttataggatgttggaaccaactaggattgtcaactgggaagtg

SEQ ID NO: 360383 - DNA, 75 bp, Artificial Sequence
  Synthetic
tggatccagctagcatagccgcaagaggttgggcagcgcatagagctagggcaaatgaaagtgcaacaattttga

SEQ ID NO: 360384 - DNA, 75 bp, Artificial Sequence
  Synthetic
tggatccagctagcatagccgctagaggttgggcagcgcatagagctagggcaaatgaaagtgcaacaattttga

SEQ ID NO: 360385 - DNA, 75 bp, Artificial Sequence
  Synthetic
tggatccagctagcatagccgccagaggttgggcagcgcatagagctagggcaaatgaaagtgcaacaattttga

SEQ ID NO: 360386 - DNA, 75 bp, Artificial Sequence
  Synthetic
tggatccagctagcatagccgcgagaggttgggcagcgcatagagctagggcaaatgaaagtgcaacaattttga

SEQ ID NO: 360387 - DNA, 75 bp, Artificial Sequence
  Synthetic
ctgacatcgggaatggtcattttctttatgtctcccaaaggcattagtagaatgtccatggcgatgggcacaatg

SEQ ID NO: 360388 - DNA, 75 bp, Artificial Sequence
  Synthetic
aatgtccatggcgatgggcacaatggctggctgtgggtatctcatgttccttggaggcgtcaaacccacacacat

SEQ ID NO: 360389 - DNA, 75 bp, Artificial Sequence
  Synthetic
ctcttgatgaggagaatgaggcgtccaactggaaaagtgaccttggaggctgatgtcatactcccaattgggaca

SEQ ID NO: 360390 - DNA, 75 bp, Artificial Sequence
  Synthetic
ggaagatcatgaaagttgtcaataggtggctgttccgccacctggccagagaaaagaaccccagactgtgtacaa

SEQ ID NO: 360391 - DNA, 75 bp, Artificial Sequence
  Synthetic
attgggcttctagggaaaactcaggaggaggagtggaaggcattggcttacaatacctaggatatgtgatcagag

SEQ ID NO: 360392 - DNA, 75 bp, Artificial Sequence
  Synthetic
cggactccgcactcaaaatgaaacagaaaccgggataaaaactacggatggagaaccggactccacacattgaaa

SEQ ID NO: 360393 - DNA, 75 bp, Artificial Sequence
  Synthetic
agtggtggccagtttgatgagaggattgtcctcaaggaaacgccgttcccatgacgctctggctgtgcaattcct

SEQ ID NO: 360394 - DNA, 75 bp, Artificial Sequence
  Synthetic
cttgtttgaggttgatcagaccaaaatccagtatgtcatcagagcacaattgcatgttggggccaagcaggaaaa

SEQ ID NO: 360395 - DNA, 75 bp, Artificial Sequence
  Synthetic
ttggaataccgacattaaaactctcaagtttgatgccctatcaggctcccaggaggccgagttcactgggtatgg

SEQ ID NO: 360396 - DNA, 75 bp, Artificial Sequence
  Synthetic
gaacctccgcatgccgcaactatcagagtgctggccctgggaaaccaggaaggctccttgaaaacagctcttacc

SEQ ID NO: 360397 - DNA, 75 bp, Artificial Sequence
  Synthetic
ggagttcaataggaaaactgttcactcagaccatgaaaggtgcggaacgcctggccgtcatgggagacgccgcct

SEQ ID NO: 360398 - DNA, 75 bp, Artificial Sequence
  Synthetic
cagttagctctcacaatcatattcctgggtacaaggttcagacgaacggaccttggatgcaggtaccactagaag

SEQ ID NO: 360399 - DNA, 75 bp, Artificial Sequence
  Synthetic
atagcaatggaagtggtcctaaggaaaagacagggaccaaagcaaatgctggttggaggagtggtgctcctggga

SEQ ID NO: 360400 - DNA, 75 bp, Artificial Sequence
  Synthetic
cttgccacgatgctcttttgcaccgtggttatcataggggtccttcatcagaactccaaggacacctccatgcaa

SEQ ID NO: 360401 - DNA, 75 bp, Artificial Sequence
  Synthetic
acaaccttttttgggcctgtgtgcatttctggcaacccgcctatttgggcgaaggagcatcccagtgaatgaggc

SEQ ID NO: 360402 - DNA, 75 bp, Artificial Sequence
  Synthetic
gcaagtggccaaggctggtttgaagacgaatgatcgcaagtggtgttttgaaggccctgaggaacacgagatctt

SEQ ID NO: 360403 - DNA, 75 bp, Artificial Sequence
  Synthetic
ttgtcctcgaggaaacgccgatcccaagatgttttaactgtgcaatttctgattctgggaatgctgctgatggtt

SEQ ID NO: 360404 - DNA, 75 bp, Artificial Sequence
  Synthetic
gattctgggaatgctgctgatggttggtggagtgaccctggtacgcagaaacagatggttacttctgaatgttac

SEQ ID NO: 360405 - DNA, 75 bp, Artificial Sequence
  Synthetic
ggtggagtgaccctggtacgcagaaacagatggttacttctgaatgttacatctgaggaccttgggaaaaccttc

SEQ ID NO: 360406 - DNA, 75 bp, Artificial Sequence
  Synthetic
gtaggtcaagaaggtccagaagggccattgacttacccacacatgaaaatcatggcttaaagacccggcaagaaa

SEQ ID NO: 360407 - DNA, 75 bp, Artificial Sequence
  Synthetic
aagtttgatgccctgtcaggctctcaggaagctgagttcactggatacgggagggccacactggagtgccaggta

SEQ ID NO: 360408 - DNA, 75 bp, Artificial Sequence
  Synthetic
aggaagctgagttcactggatacgggagggccacactggagtgccaggtacagaccgcagtggacttcagcaaca

SEQ ID NO: 360409 - DNA, 75 bp, Artificial Sequence
  Synthetic
gagctggattgtggataaacagtgggcccaagacctgaccctaccttggcagagtggaagtggcggcgtgtggag

SEQ ID NO: 360410 - DNA, 75 bp, Artificial Sequence
  Synthetic
atggtcgccgatgatctcacagcggcagtcaacaagggcatcttggtcacagtcaatccaatagcctccaccaat

SEQ ID NO: 360411 - DNA, 75 bp, Artificial Sequence
  Synthetic
gatgatgaagtgttgatcgaggtgaatcctccctttggggatagttacatcatagttggaacaggggattcacgc

SEQ ID NO: 360412 - DNA, 75 bp, Artificial Sequence
  Synthetic
ctgacctaccagtggcacaaggaaggcagctcaatagggaagttgttcactcagaccatgaagggcgcagagcgc

SEQ ID NO: 360413 - DNA, 75 bp, Artificial Sequence
  Synthetic
gcagctcaatagggaagttgttcactcagaccatgaagggcgcagagcgcctggccgtcatgggggatgctgcct

SEQ ID NO: 360414 - DNA, 75 bp, Artificial Sequence
  Synthetic
gataacaaaggtcatcatgggggtagtcctcatatgggttggcattaacacaaggaatatgacaatgtccatgag

SEQ ID NO: 360415 - DNA, 75 bp, Artificial Sequence
  Synthetic
ctcagtcgactccctggaacatgaaatgtggagaagcagggcagatgagatcaatgccattcttgaggagaatga

SEQ ID NO: 360416 - DNA, 75 bp, Artificial Sequence
  Synthetic
tcttggacttgctaaagctcacagtggcggttggattgcactttcatgagatgaataatggaggggatgccatgt

SEQ ID NO: 360417 - DNA, 75 bp, Artificial Sequence
  Synthetic
aaggtgccatgggatcaggtcgtgatgacttcattggctttggtcggagctgccatccacccatttgcactttta

SEQ ID NO: 360418 - DNA, 75 bp, Artificial Sequence
  Synthetic
aagttggagggtagatgggatggagaagaggaggttcagttgatagcagctgcccccggaaaaaacgtagtgaat

SEQ ID NO: 360419 - DNA, 75 bp, Artificial Sequence
  Synthetic
acaatgttgaagaaagggatgacaaccattcttgatttccatcctggagctgggaaaacaagacgttttcttcct

SEQ ID NO: 360420 - DNA, 75 bp, Artificial Sequence
  Synthetic
tgggaaaacaagacgttttcttcctcagatcctggctgaatgcgcacgaagacggttgcgcacacttgtgctggc

SEQ ID NO: 360421 - DNA, 75 bp, Artificial Sequence
  Synthetic
gatgctggtcgtgctgagtgaactcccagacttcttggccaagaaaggcggagaggcggtggatactatcagcgt

SEQ ID NO: 360422 - DNA, 75 bp, Artificial Sequence
  Synthetic
aatgtccatggcaatgggcacgatggctggttgtggatacctcatgtttcttggaggcgtcaaacccacccacat

SEQ ID NO: 360423 - DNA, 75 bp, Artificial Sequence
  Synthetic
gtcttgatggtggttgtggttccggagccggggcagcagagaaccattcaggacaatcaggtggcttatcttatc

SEQ ID NO: 360424 - DNA, 75 bp, Artificial Sequence
  Synthetic
ttgtgctggcatcagcagccctggggccgctcatagagggaaataccagcctcttgtggaatggacccatggctg

SEQ ID NO: 360425 - DNA, 75 bp, Artificial Sequence
  Synthetic
agacattgtggaagtggaccgtgacacagctcgccgacacctagctgaagggaaagtggacaccggagtggccgt

SEQ ID NO: 360426 - DNA, 75 bp, Artificial Sequence
  Synthetic
atgaatgtgcaaagcctggggtggaacatcatcacttttaaggataagactgatgtccatcgccttgagccagtg

SEQ ID NO: 360427 - DNA, 75 bp, Artificial Sequence
  Synthetic
tgctccaaaggaggtttggtggaacggtaatcaggaatcccctctctagaaattcaacccacgagatgtattatg

SEQ ID NO: 360428 - DNA, 75 bp, Artificial Sequence
  Synthetic
caactccttttggacaacaaagagtgttcaaggaaaaagttgacaccagagcaaaggatccaccagcagggacca

SEQ ID NO: 360429 - DNA, 75 bp, Artificial Sequence
  Synthetic
ctggaagaacaagaacagtggaagactgccaatgaagctgtccaagatccgaagttctgggaattagtggatgag

SEQ ID NO: 360430 - DNA, 75 bp, Artificial Sequence
  Synthetic
attctatgcggatgacacagctggatgggacacacgcataacagaggcggatctggatgatgaacaggaaatctt

SEQ ID NO: 360431 - DNA, 75 bp, Artificial Sequence
  Synthetic
tgggacacacgcataacagaggcggatctggatgatgaacaggaaatcttgaactacatgagcccacaccacagg

SEQ ID NO: 360432 - DNA, 75 bp, Artificial Sequence
  Synthetic
aaagcttacatggatgtcataagccggcgggaccagagaggatccgggcaggtggtgacttacgccttgaacacc

SEQ ID NO: 360433 - DNA, 75 bp, Artificial Sequence
  Synthetic
ttgaagcatggctcgctgagcatggctgcgacaggctcaagaggatggcagtgagtggagatgactgtgttgtcc

SEQ ID NO: 360434 - DNA, 75 bp, Artificial Sequence
  Synthetic
gaaatggttggatgatcaaggagacagcatgccttagcaaggcctacgccaacatgtggtcactgatgtactttc

SEQ ID NO: 360435 - DNA, 75 bp, Artificial Sequence
  Synthetic
caaaacgacggtgaaggagtggcgagacatcccttacctgaccaagagacaggacaagctttgtggatcactgat

SEQ ID NO: 360436 - DNA, 75 bp, Artificial Sequence
  Synthetic
agagagatacactgactatctgacagtcatggataggtactctgtggatgctgatctgcagcccggtgagctcat

SEQ ID NO: 360437 - DNA, 75 bp, Artificial Sequence
  Synthetic
ttgagacactgttccaagaacaaccaagaactagaccttgtacataggacaaaactgaaaccgggataaaaacca

SEQ ID NO: 360438 - DNA, 75 bp, Artificial Sequence
  Synthetic
aagtagtgcaggctgggacagccgctttccatgttgcgaaaaacctggtttctgagacttcccacctcagagtaa

SEQ ID NO: 360439 - DNA, 75 bp, Artificial Sequence
  Synthetic
tctatttgaggttgatcagaccaaaatccagtatgtcatcagggcacagctgcatgtcggagccaagcaggagaa

SEQ ID NO: 360440 - DNA, 75 bp, Artificial Sequence
  Synthetic
aagtgttagcccttgggaaccaagaaggatccttgaagactgctctcactggtgcaatgcgagttacaaaagaca

SEQ ID NO: 360441 - DNA, 75 bp, Artificial Sequence
  Synthetic
cagttaacaagggcattctggtcacagtcaatccaatagcctccactaatgacgatgaagtgttgatcgaggtga

SEQ ID NO: 360442 - DNA, 75 bp, Artificial Sequence
  Synthetic
gactcaaaaaacatttatcagagagggacacatccattttccagaatacgtgatggcctacaatatggctggaag

SEQ ID NO: 360443 - DNA, 75 bp, Artificial Sequence
  Synthetic
ggaattccttccagatagaagagtttgggacaggagtgttcaccactcgagtgtacatggatgcagtctttgaat

SEQ ID NO: 360444 - DNA, 75 bp, Artificial Sequence
  Synthetic
atatggccttgatcgctgctttctcaatcagaccagggctgctcatcggctttggattgaggacgctgtggagcc

SEQ ID NO: 360445 - DNA, 75 bp, Artificial Sequence
  Synthetic
aatcagaccagggctgctcatcggctttggattgaggacgctgtggagcccccgggaacgccttgtgctgaccct

SEQ ID NO: 360446 - DNA, 75 bp, Artificial Sequence
  Synthetic
gacggttgcgcacacttgtgctggctcccactagagttgtcctctctgaaatgaaggaagcctttcacggcctag

SEQ ID NO: 360447 - DNA, 75 bp, Artificial Sequence
  Synthetic
aggcctcaatgctcctagacaacatggaggtgaggggtgggatggttgctccactttatggcatagaaggaacaa

SEQ ID NO: 360448 - DNA, 75 bp, Artificial Sequence
  Synthetic
agcctctgcgtccaaggtggtgcgatgaaagggtgtcgtctgaccagagtgcgcttgccgacttcataaagtttg

SEQ ID NO: 360449 - DNA, 75 bp, Artificial Sequence
  Synthetic
gatgctggtcgtgctgagtgaactcccagacttcttggccaagaaaggtggagaggcggtggacactatcagcgt

SEQ ID NO: 360450 - DNA, 75 bp, Artificial Sequence
  Synthetic
agagcttaccgcaatgcattatcaatgatgcctgaggcaatgacaacagtcatgctgtttgttctggctgggctg

SEQ ID NO: 360451 - DNA, 75 bp, Artificial Sequence
  Synthetic
agtgatgcccctgctttgtggcattggatgcgccatgcttcactggactctcatcctgcctggaatcaaggcgca

SEQ ID NO: 360452 - DNA, 75 bp, Artificial Sequence
  Synthetic
agctggaaggaagagtgactgacctgggatgtgggcgtggtggctggtgctactatgctgctgcacagagagaag

SEQ ID NO: 360453 - DNA, 75 bp, Artificial Sequence
  Synthetic
tgatgtccatcgccttgagccagtgaagtgtgacaccctgctgtgcgacattggagagtcgtctccatcatcagt

SEQ ID NO: 360454 - DNA, 75 bp, Artificial Sequence
  Synthetic
cagtcatgcagccatcggagctttcctggaagagcaagaacagtggaagactgccaatgaggctgtccaagatcc

SEQ ID NO: 360455 - DNA, 75 bp, Artificial Sequence
  Synthetic
ctggaagagcaagaacagtggaagactgccaatgaggctgtccaagatccgaaattctgggaattagtggatgaa

SEQ ID NO: 360456 - DNA, 75 bp, Artificial Sequence
  Synthetic
ggtgccggacttgtgtgtacaacatgatggggaagagagaaaagaaactgtcagagtttggaaaggcgaagggaa

SEQ ID NO: 360457 - DNA, 75 bp, Artificial Sequence
  Synthetic
tctcaccatttccatgaattgcaactgaaggatggcaggagagttgtagtgccttgtcgggatcaagatgagctg

SEQ ID NO: 360458 - DNA, 75 bp, Artificial Sequence
  Synthetic
ctacgtggtctgttcatgggaaaggagagtggatgaccacagaggacatgcttgaagtgtggaacagagtgtgga

SEQ ID NO: 360459 - DNA, 75 bp, Artificial Sequence
  Synthetic
ctgagacaccgttccaagaacaaccaagaactggaccttgtacatagaataaaactgaaaccgggataaaaacta

SEQ ID NO: 360460 - DNA, 75 bp, Artificial Sequence
  Synthetic
gttctctgcttttcctccagaggttctgtgagcacagttgctcaagaataagcagacctttggatgacaaacaca

SEQ ID NO: 360461 - DNA, 75 bp, Artificial Sequence
  Synthetic
gaacctccgcatgccgccactatcagagtactggccctgggaaaccaggaaggctccttgaaaacagctcttacc

SEQ ID NO: 360462 - DNA, 75 bp, Artificial Sequence
  Synthetic
gggatttcagctctgctggagggttcttcacttcggttgggaaaggaattcatacggtgtttggctctgcctttc

SEQ ID NO: 360463 - DNA, 75 bp, Artificial Sequence
  Synthetic
tggttatcataggggtccttcaccagaactccaaggacacctccatgcagaagactatacctctggtggccctca

SEQ ID NO: 360464 - DNA, 75 bp, Artificial Sequence
  Synthetic
cctgtgcttgtggatgaagggaggaaggtggcaataaaagggccacttcgcatctccgcatcctctgctgctcaa

SEQ ID NO: 360465 - DNA, 75 bp, Artificial Sequence
  Synthetic
ccaacattctggaggccaaatattggtgtccagattccatggaatacaactgccccaatctcagtccaagagaag

SEQ ID NO: 360466 - DNA, 75 bp, Artificial Sequence
  Synthetic
gtgtccagattccatggaatacaactgccccaatctcagtccaagagaagagcctgatgacatagactgttggtg

SEQ ID NO: 360467 - DNA, 75 bp, Artificial Sequence
  Synthetic
gcttatggcaagtgtgattcagcgggtaggtcaagaaggtccagaagggccattgacttacccacacatgaaaat

SEQ ID NO: 360468 - DNA, 75 bp, Artificial Sequence
  Synthetic
cgaccactgacagcgggaagatcattcctgaatggtgttgccgctcatgcacaatgccaccagtgagcttccacg

SEQ ID NO: 360469 - DNA, 75 bp, Artificial Sequence
  Synthetic
tctcaacggggagtgggagtggcgcagggaggggtcttccacacgatgtggcacgtcacgcgaggggcctttctc

SEQ ID NO: 360470 - DNA, 75 bp, Artificial Sequence
  Synthetic
gtgacctgcctgtttggctctcatggcaggtggctaaggctggattgaagacgaatgaccgaaagtggtgctttg

SEQ ID NO: 360471 - DNA, 75 bp, Artificial Sequence
  Synthetic
acgaatgaccgaaagtggtgctttgagggcccagaagaacatgagatcttgaatgacagtggtgagacagtaaag

SEQ ID NO: 360472 - DNA, 75 bp, Artificial Sequence
  Synthetic
agtcagcctcagttttgtcattcatggacaagggcatcccgttcatgaagatgaacatctcggtcataattctac

SEQ ID NO: 360473 - DNA, 75 bp, Artificial Sequence
  Synthetic
cttggcctctgttgccatgtgtagaacacccttttcactggctgaaggcattgtgctggcatcagcagccctggg

SEQ ID NO: 360474 - DNA, 75 bp, Artificial Sequence
  Synthetic
tggttccatgaacgtggctatgtcaagttggaaggaagagtgactgacctgggatgtgggcgtggtggctggtgc

SEQ ID NO: 360475 - DNA, 75 bp, Artificial Sequence
  Synthetic
gttcactgtgaatcaaacatcccgcctcttaatgaggagaatgaggcgcccgacaggcaaagtgactcttgaagc

SEQ ID NO: 360476 - DNA, 75 bp, Artificial Sequence
  Synthetic
atgacaacccttacaggacttggcattattgcggttcctacgtcacaagaacctcagggagtgcagcaagcatga

SEQ ID NO: 360477 - DNA, 75 bp, Artificial Sequence
  Synthetic
gtgagtggagatgactgtgttgtccgacccattgatgacaggtttggcctggctctgtcccatcttaacgccatg

SEQ ID NO: 360478 - DNA, 75 bp, Artificial Sequence
  Synthetic
ttgagacaccgttccaagaacaatcaagaactagactttgtacatagaacaaaactgaaaccgggataaaaacta

SEQ ID NO: 360479 - DNA, 75 bp, Artificial Sequence
  Synthetic
atggtcgccgatgatctcacagcggcagttaacaagggcattctggtcacagtcaatccaatagcctccactaac

SEQ ID NO: 360480 - DNA, 75 bp, Artificial Sequence
  Synthetic
cttcacatcagtcggaaaaggtatacacactgtgtttggttctgccttccaaggattgtttggtggcttgagctg

SEQ ID NO: 360481 - DNA, 75 bp, Artificial Sequence
  Synthetic
atgtggaggagcagggcagatgagatcaatgccatccttgaggagaatgaggtagacatctcagtggtggtccaa

SEQ ID NO: 360482 - DNA, 75 bp, Artificial Sequence
  Synthetic
ggtagacatctcagtggtggtccaagactcaaaaaacatttatcagagagggacacatccattttccagaatacg

SEQ ID NO: 360483 - DNA, 75 bp, Artificial Sequence
  Synthetic
gagacactggactacaaggaatgtgaatggccgctgacgcacacgattggaacatcagttgaagagagtgacatg

SEQ ID NO: 360484 - DNA, 75 bp, Artificial Sequence
  Synthetic
gccatgttagttggacaggtgactatcttggacttgctgaagctcacagtggcggttggattgcactttcatgag

SEQ ID NO: 360485 - DNA, 75 bp, Artificial Sequence
  Synthetic
agatggaaaattttctaggtccagtcgcagttggaggaatcctgatgatgctggtcagtgtggctgggagggtgg

SEQ ID NO: 360486 - DNA, 75 bp, Artificial Sequence
  Synthetic
aagaggaggttcagttgatagcagctgcccccggaaaaaacgtggtgaatgtccagacaaagccaagcctattca

SEQ ID NO: 360487 - DNA, 75 bp, Artificial Sequence
  Synthetic
gtccagacaaagccaagcctattcaaagttaggaatggaggagaaatcggggcggttgcccttgactacccgagc

SEQ ID NO: 360488 - DNA, 75 bp, Artificial Sequence
  Synthetic
gtcattgacgccatgtgtcatgctaccctgacatatagaatgctggaaccgaccagagtggtcaattgggaagtg

SEQ ID NO: 360489 - DNA, 75 bp, Artificial Sequence
  Synthetic
tcatgactggattttggcggacaaaaggcccacggcctggtttcttccatccatcagggctgcaaatgtcatggc

SEQ ID NO: 360490 - DNA, 75 bp, Artificial Sequence
  Synthetic
ctaacagagacggggactcatactactactctgagcccacaagtgaagacaatgcacaccatgtctgttggctgg

SEQ ID NO: 360491 - DNA, 75 bp, Artificial Sequence
  Synthetic
gtgacctgcctgtttggctctcatggcaagtggctaaggccggattgaagacgaatgaccgaaagtggtgctttg

SEQ ID NO: 360492 - DNA, 75 bp, Artificial Sequence
  Synthetic
gaattacatgagcccacaccacaggaagctagcgctggctgtaatggaaatgacatacaaaaataaagtggtgaa

SEQ ID NO: 360493 - DNA, 75 bp, Artificial Sequence
  Synthetic
aaagcttacatggatgtcataagccggcgggaccagagaggatccgggcaggtggtgacctacgccctgaatacc

SEQ ID NO: 360494 - DNA, 75 bp, Artificial Sequence
  Synthetic
ccaactgacactggccatggcactgttgtgatgcaggtgaaagtgccaaaaggagccccctgcaagattccagtg

SEQ ID NO: 360495 - DNA, 75 bp, Artificial Sequence
  Synthetic
catacggtgtttggctctgcctttcaggggctatttggtggcttgagctggataacgaaggtcatcatgggggcg

SEQ ID NO: 360496 - DNA, 75 bp, Artificial Sequence
  Synthetic
ctcgggaacgccttgtgctgaccctgggagcagccatggtggagattgccctgggtggcatgatgggtggcctgt

SEQ ID NO: 360497 - DNA, 75 bp, Artificial Sequence
  Synthetic
gcttctaggaaagcatcaaacaccatcctgcccctcatggctctgttgacacctgtcactatggctgaggtgaga

SEQ ID NO: 360498 - DNA, 75 bp, Artificial Sequence
  Synthetic
gagccaacctttgtgtggagcgagtgctggactgcaggacggcttttaagcctgtgcttgtggatgaagggagga

SEQ ID NO: 360499 - DNA, 75 bp, Artificial Sequence
  Synthetic
gctggactgcaggacggcttttaagcctgtgcttgtggatgaagggaggaaggtggcaataaaggggccactccg

SEQ ID NO: 360500 - DNA, 75 bp, Artificial Sequence
  Synthetic
tggaagagacggccatgagaaaccaatgaatgtgcaaagtctgggttggaacattattacctttaaggacaaaac

SEQ ID NO: 360501 - DNA, 75 bp, Artificial Sequence
  Synthetic
tggaagagacggccatgagaaacctatgaatgtgcaaagtctgggttggaacattattacctttaaggacaaaac

SEQ ID NO: 360502 - DNA, 75 bp, Artificial Sequence
  Synthetic
tggaagagacggccatgagaaacccatgaatgtgcaaagtctgggttggaacattattacctttaaggacaaaac

SEQ ID NO: 360503 - DNA, 75 bp, Artificial Sequence
  Synthetic
tggaagagacggccatgagaaaccgatgaatgtgcaaagtctgggttggaacattattacctttaaggacaaaac

SEQ ID NO: 360504 - DNA, 75 bp, Artificial Sequence
  Synthetic
gtcgtaaagctcagggaaaaaccctgggcgtcaatatggtacgacgaggagttcgctccttgtcaagcaaaataa

SEQ ID NO: 360505 - DNA, 75 bp, Artificial Sequence
  Synthetic
aagtgccatgggaccaggttgtgatgacctcactggccttggttggagctgccattcatccatttgctcttctgc

SEQ ID NO: 360506 - DNA, 75 bp, Artificial Sequence
  Synthetic
gtcccaggaaagaacgtggttaatgtccagacaaaaccgagcttgttcaaagtgaggaatgggggagaaatcggg

SEQ ID NO: 360507 - DNA, 75 bp, Artificial Sequence
  Synthetic
gagtggggtgaaagggttcactcttggaagagacggccatgagaaacccatgaatgtgcaaagtctgggttggaa

SEQ ID NO: 360508 - DNA, 75 bp, Artificial Sequence
  Synthetic
cagagtttgggaaagcaaagggaagccgtgccatatggtacatgtggctgggagcgcggtatcttgagtttgagg

SEQ ID NO: 360509 - DNA, 75 bp, Artificial Sequence
  Synthetic
gagaaatacactgactacctaacagtcatggacagatattctgtggatgctgacctgcaaccgggtgagcttatc

SEQ ID NO: 360510 - DNA, 75 bp, Artificial Sequence
  Synthetic
tcaaggatttattttcttctttttgttcaacattctaactgggaaaaaattaaccacccacctgaaaaggctctg

SEQ ID NO: 360511 - DNA, 75 bp, Artificial Sequence
  Synthetic
gagaatgcttgacccccgacagggacttgctgttctgaggaaagtcaagagggtggtagccagcttgatgatagg

SEQ ID NO: 360512 - DNA, 75 bp, Artificial Sequence
  Synthetic
aatgagatggccatgatgccacttctaatcttgagcatggtgattttggctggaggggtgacactcgtccggaaa

SEQ ID NO: 360513 - DNA, 75 bp, Artificial Sequence
  Synthetic
tggaggggtgacactcgtccggaaaaatcgatggttgcttttgaatgtcacagctgaggacttgggaaagacgtt

SEQ ID NO: 360514 - DNA, 75 bp, Artificial Sequence
  Synthetic
cagctgaggacttgggaaagacgttctcattgggaaccgggaactgcaccaccaacatccttgaggcaaagtatt

SEQ ID NO: 360515 - DNA, 75 bp, Artificial Sequence
  Synthetic
ctcattgggaaccgggaactgcaccaccaacatccttgaggcaaagtattggtgtcccgactcaatggaatacaa

SEQ ID NO: 360516 - DNA, 75 bp, Artificial Sequence
  Synthetic
accaacatccttgaggcaaagtattggtgtcccgactcaatggaatacaactgtcccaatctcagtcccagagag

SEQ ID NO: 360517 - DNA, 75 bp, Artificial Sequence
  Synthetic
gttatggagtggaaaatgtcagagtggcctatggaaggtgtgatgcagtggggaggtcaaagcggtctaggaggg

SEQ ID NO: 360518 - DNA, 75 bp, Artificial Sequence
  Synthetic
gggaggtcaaagcggtctaggagggcaattgatctgcccacgcatgaaaatcacggactgaaaactcggcaggag

SEQ ID NO: 360519 - DNA, 75 bp, Artificial Sequence
  Synthetic
agcggcaactccaaaagattgagcggtggctggtgagaaatccgtttttcgccataacagccttggccattgctt

SEQ ID NO: 360520 - DNA, 75 bp, Artificial Sequence
  Synthetic
gtggctggtgagaaatccgtttttcgccataacagccttggccattgcttatttagtgggtaataacatgacaca

SEQ ID NO: 360521 - DNA, 75 bp, Artificial Sequence
  Synthetic
ttagcagttggtccagcctattctgcacattgtattgggataactgacagagacttcattgagggtgtccatggg

SEQ ID NO: 360522 - DNA, 75 bp, Artificial Sequence
  Synthetic
agacttcattgagggtgtccatgggggcacgtgggtgtcagcaaccctagagcagggcaagtgcgtaactgtcat

SEQ ID NO: 360523 - DNA, 75 bp, Artificial Sequence
  Synthetic
atctcgctccaaacagtggcaatagatgggcctgctgaagcgagaaaggtttgctacagcgcggttctcacccat

SEQ ID NO: 360524 - DNA, 75 bp, Artificial Sequence
  Synthetic
atgggcctgctgaagcgagaaaggtttgctacagcgcggttctcacccatgtaaaaatcaatgacaagtgcccaa

SEQ ID NO: 360525 - DNA, 75 bp, Artificial Sequence
  Synthetic
ggaaaatgatggtgacaatgcttgcaaacgaacatactcagatagaggctggggtaatggttgtgggctctttgg

SEQ ID NO: 360526 - DNA, 75 bp, Artificial Sequence
  Synthetic
aaacgaacatactcagatagaggctggggtaatggttgtgggctctttggaaaggggagtattgtggcatgtgcc

SEQ ID NO: 360527 - DNA, 75 bp, Artificial Sequence
  Synthetic
gcctttttgaagtggaccagaccaaaatccagtacgttatcagggctcagcttcatgtgggtgctaagcaggaga

SEQ ID NO: 360528 - DNA, 75 bp, Artificial Sequence
  Synthetic
gaaatttgatgccctatctggctctcaagaagccgaatttactggttatgggaaagcaacactggagtgtcaggt

SEQ ID NO: 360529 - DNA, 75 bp, Artificial Sequence
  Synthetic
agttacattgcagagatggagaaagacagctggattgttgaccgccagtgggcacaagacttgacactaccatgg

SEQ ID NO: 360530 - DNA, 75 bp, Artificial Sequence
  Synthetic
cagagcgggagtggtggaatatggagggaaatgcatcatcttgttgagtttgagcctcctcatgccgccacaatc

SEQ ID NO: 360531 - DNA, 75 bp, Artificial Sequence
  Synthetic
gggaaatgcatcatcttgttgagtttgagcctcctcatgccgccacaatcagagtgctagccttgggaaaccaag

SEQ ID NO: 360532 - DNA, 75 bp, Artificial Sequence
  Synthetic
aggagctatgcgggtcactaaagatgaaaatgacaacaacttgtacaagctgcatggtggtcatgtctcttgtag

SEQ ID NO: 360533 - DNA, 75 bp, Artificial Sequence
  Synthetic
ggtgaaactttcagctctaactcttaagggaacatcctacaagatgtgcacagataaaatgtcatttgtgaaaaa

SEQ ID NO: 360534 - DNA, 75 bp, Artificial Sequence
  Synthetic
gttgtcatgcaggtgaaggtccccaaaggagccccatgcaagattcccgtgattgtggctgatgacctaacggct

SEQ ID NO: 360535 - DNA, 75 bp, Artificial Sequence
  Synthetic
ctgtcaaccccatagcatccacaaatgatgatgaagtcctaattgaagtcaatcccccttttggagacagctaca

SEQ ID NO: 360536 - DNA, 75 bp, Artificial Sequence
  Synthetic
aatcccccttttggagacagctacatcattgttgggactggagactcaagactgacttatcagtggcataaggaa

SEQ ID NO: 360537 - DNA, 75 bp, Artificial Sequence
  Synthetic
cacagacaatgaagggagctgaacgtcttgcagtgatgggtgatgccgcctgggactttagctctgcaggtggtt

SEQ ID NO: 360538 - DNA, 75 bp, Artificial Sequence
  Synthetic
tcttgcagtgatgggtgatgccgcctgggactttagctctgcaggtggtttcttcacgtcagtggggaaaggaat

SEQ ID NO: 360539 - DNA, 75 bp, Artificial Sequence
  Synthetic
caggggttgtttggtggtctgagctggattacgaaagtcatcatgggagccgttctcatctgggtaggaattaac

SEQ ID NO: 360540 - DNA, 75 bp, Artificial Sequence
  Synthetic
cgttctcatctgggtaggaattaacacacgtaacatgaccatgtccatgtctatgattctggtaggtgtgatcat

SEQ ID NO: 360541 - DNA, 75 bp, Artificial Sequence
  Synthetic
gcagaccaaggatgtgctgtcaactttgggaagcgagagctcaaatgtggagatggcatctttgtgttcagagac

SEQ ID NO: 360542 - DNA, 75 bp, Artificial Sequence
  Synthetic
agatggcatctttgtgttcagagactcagatgattggctcactaagtattcatattatccagaagaccctgttaa

SEQ ID NO: 360543 - DNA, 75 bp, Artificial Sequence
  Synthetic
catgaagagggcaaatgtggactgaattctgtggactcccttgagcatgaaatgtggaggagtagagctgatgag

SEQ ID NO: 360544 - DNA, 75 bp, Artificial Sequence
  Synthetic
attctgtggactcccttgagcatgaaatgtggaggagtagagctgatgagatcaacgccatatttgaggaaaatg

SEQ ID NO: 360545 - DNA, 75 bp, Artificial Sequence
  Synthetic
aatgtggaggagtagagctgatgagatcaacgccatatttgaggaaaatgaggtagacatctcggttgttgttca

SEQ ID NO: 360546 - DNA, 75 bp, Artificial Sequence
  Synthetic
gggacacatcctttctctcggattcgtgatgggttgcagtatggatggaaaacctggggaaaaaatctcatcttc

SEQ ID NO: 360547 - DNA, 75 bp, Artificial Sequence
  Synthetic
gtgatgggttgcagtatggatggaaaacctggggaaaaaatctcatcttctcacccggaaggaaaaatggcagtt

SEQ ID NO: 360548 - DNA, 75 bp, Artificial Sequence
  Synthetic
ggaatgccctttctcaaacagagtgtggaactctttccagattgaggagtttggcatgggagttttcacaacacg

SEQ ID NO: 360549 - DNA, 75 bp, Artificial Sequence
  Synthetic
tggaactctttccagattgaggagtttggcatgggagttttcacaacacgggtttttatggatgctgtttttgat

SEQ ID NO: 360550 - DNA, 75 bp, Artificial Sequence
  Synthetic
ttggcatgggagttttcacaacacgggtttttatggatgctgtttttgattactcagtggactgtgatggggcta

SEQ ID NO: 360551 - DNA, 75 bp, Artificial Sequence
  Synthetic
gaagagcgcacacggatcgcccacattctggatgggaagccatgaggtcaatggaacatggatggtacacacact

SEQ ID NO: 360552 - DNA, 75 bp, Artificial Sequence
  Synthetic
ttctggatgggaagccatgaggtcaatggaacatggatggtacacacacttgagacccttgattacaaagagtgt

SEQ ID NO: 360553 - DNA, 75 bp, Artificial Sequence
  Synthetic
gaacctcagtggaagagagtgacatgttcatgccccgttccattggaggcccagtgagctcccataaccatattc

SEQ ID NO: 360554 - DNA, 75 bp, Artificial Sequence
  Synthetic
gttcatgccccgttccattggaggcccagtgagctcccataaccatattccaggttacaaagtccaaacgaatgg

SEQ ID NO: 360555 - DNA, 75 bp, Artificial Sequence
  Synthetic
gttagaagggagccatgcccggggacaagtgtggtgctggacaccggctgtgatggacgtggcaaatcaaccaga

SEQ ID NO: 360556 - DNA, 75 bp, Artificial Sequence
  Synthetic
caagtgtggtgctggacaccggctgtgatggacgtggcaaatcaaccagatcaaccactgacagtgggaaaatta

SEQ ID NO: 360557 - DNA, 75 bp, Artificial Sequence
  Synthetic
cactatgcccccagttagctttcacggcagtgatggctgctggtaccccatggaaatcagacccatgaaaaccca

SEQ ID NO: 360558 - DNA, 75 bp, Artificial Sequence
  Synthetic
tgaaagccatctggtgagatcatgggttaccgcaggagaagtgcatgcggttcctttcggattggtgagcatgat

SEQ ID NO: 360559 - DNA, 75 bp, Artificial Sequence
  Synthetic
aaaagacaaggaccaaagcagatgctggtgggaggaatcattttacttggagcaatgctagtgggacaagtcacg

SEQ ID NO: 360560 - DNA, 75 bp, Artificial Sequence
  Synthetic
tggcagtaggcttgcacttccatgagatcaacaatggaggagatgccatgtatatggctttgattgcgagctttt

SEQ ID NO: 360561 - DNA, 75 bp, Artificial Sequence
  Synthetic
ctttggactgcgcacactctggagtcctcgcgagcgtctcgtgatggcattcggagcagccatggtcgaagtggc

SEQ ID NO: 360562 - DNA, 75 bp, Artificial Sequence
  Synthetic
cctcgcgagcgtctcgtgatggcattcggagcagccatggtcgaagtggccttgggcgggatgatgggtggactg

SEQ ID NO: 360563 - DNA, 75 bp, Artificial Sequence
  Synthetic
tatgtgtcctcaccatcaacgcaatttcttcaagaaaggcgtcaaatgcggtcctccccctgatggcactcttga

SEQ ID NO: 360564 - DNA, 75 bp, Artificial Sequence
  Synthetic
gtcctccccctgatggcactcttgactcctgtaacaatgcatgaagtaaggatggcaacaatgctgttctgcaca

SEQ ID NO: 360565 - DNA, 75 bp, Artificial Sequence
  Synthetic
agaatgcaaaagacacgtccatgcaaaaaaccattcccattgtggctctgacactgacttcatatatgggtctaa

SEQ ID NO: 360566 - DNA, 75 bp, Artificial Sequence
  Synthetic
aaaaaccattcccattgtggctctgacactgacttcatatatgggtctaactcagccttttcttggattgtgtgc

SEQ ID NO: 360567 - DNA, 75 bp, Artificial Sequence
  Synthetic
agaagaagcatccctgtaaatgaagctcttgcagcagccggcctggtaggagtgctggcaggcctagccttccaa

SEQ ID NO: 360568 - DNA, 75 bp, Artificial Sequence
  Synthetic
ttgcagtgggtgggatactcatgatgctggtcagtgtggcagggaaagttgatggattggaactcaagaagctcg

SEQ ID NO: 360569 - DNA, 75 bp, Artificial Sequence
  Synthetic
gagaattcaagcttctctcagaggataaagtgccctgggaccagattgtcatgacttccttggctctcgttgggg

SEQ ID NO: 360570 - DNA, 75 bp, Artificial Sequence
  Synthetic
taaagtgccctgggaccagattgtcatgacttccttggctctcgttggggcagcgatacatccatttgccctatt

SEQ ID NO: 360571 - DNA, 75 bp, Artificial Sequence
  Synthetic
cacatcaaaggagctagaaggagcggggatgttctttgggacattcccacaccaaaagtcatagaggaatgtgag

SEQ ID NO: 360572 - DNA, 75 bp, Artificial Sequence
  Synthetic
gggatgttctttgggacattcccacaccaaaagtcatagaggaatgtgagtatctggaagatggaatttatggca

SEQ ID NO: 360573 - DNA, 75 bp, Artificial Sequence
  Synthetic
atcccagagaggagtcggagtggcccaggggggtgtcttccacacgatgtggcacgtcaccagaggagcgtttct

SEQ ID NO: 360574 - DNA, 75 bp, Artificial Sequence
  Synthetic
ggcacgtcaccagaggagcgtttctcttgaggaacgggaagaagttagtaccatcctgggcctctgtgaaggagg

SEQ ID NO: 360575 - DNA, 75 bp, Artificial Sequence
  Synthetic
gaagctagatggaaagtgggatggtgaggaagaggtacaactcatagctgctgtgccaggaaaagccgttgtcaa

SEQ ID NO: 360576 - DNA, 75 bp, Artificial Sequence
  Synthetic
ctgtgccaggaaaagccgttgtcaatgtgcaaaccaagccaagtgtgttcaaagttagaaatggaggtgagattg

SEQ ID NO: 360577 - DNA, 75 bp, Artificial Sequence
  Synthetic
gagcagttgccttggactatcctagcgggacatctggttcacccattgtgaatcgcagtggtgaagtggtgggac

SEQ ID NO: 360578 - DNA, 75 bp, Artificial Sequence
  Synthetic
tgacaattcctttgtgtccgccatctcacaaactgaggtgaaagaggaatccaaagaggaactgcaggaaatacc

SEQ ID NO: 360579 - DNA, 75 bp, Artificial Sequence
  Synthetic
cgggaaagacccgtaggttcttgccccaaatactggcagaatgcgccaggaggcgtctacggacgctagtgctgg

SEQ ID NO: 360580 - DNA, 75 bp, Artificial Sequence
  Synthetic
ccaaatactggcagaatgcgccaggaggcgtctacggacgctagtgctggcgcctactcgggttgtcctgtcaga

SEQ ID NO: 360581 - DNA, 75 bp, Artificial Sequence
  Synthetic
gatgtaaagtttcacacgcaggccttttcagcccatgggagtgggaaagaagtcattgatgcaatgtgccacgct

SEQ ID NO: 360582 - DNA, 75 bp, Artificial Sequence
  Synthetic
caacaagagctgttaactgggaggtgatcatcatggatgaggcccacttcttggatcctgccagcatcgcagcaa

SEQ ID NO: 360583 - DNA, 75 bp, Artificial Sequence
  Synthetic
agcaaacgagagtgccacaatacttatgacagccactccaccaggcacaagtgatgaatttccccattccaatgg

SEQ ID NO: 360584 - DNA, 75 bp, Artificial Sequence
  Synthetic
atgacagccactccaccaggcacaagtgatgaatttccccattccaatggtgagattgaggatgtccaaactgac

SEQ ID NO: 360585 - DNA, 75 bp, Artificial Sequence
  Synthetic
attccaagtgaaccatggacttcaggccatgagtggatcctagccgacaagcgaccaacggcatggtttctccca

SEQ ID NO: 360586 - DNA, 75 bp, Artificial Sequence
  Synthetic
gccatgagtggatcctagccgacaagcgaccaacggcatggtttctcccatcgatcagagcagcaaatgtcatgg

SEQ ID NO: 360587 - DNA, 75 bp, Artificial Sequence
  Synthetic
gcgaccaacggcatggtttctcccatcgatcagagcagcaaatgtcatggccgcctctttgcggaaggccgggaa

SEQ ID NO: 360588 - DNA, 75 bp, Artificial Sequence
  Synthetic
acctttgaaaaggaataccccaccatcaaacaaaagaggccggatttcatcctggccacagacattgccgaaatg

SEQ ID NO: 360589 - DNA, 75 bp, Artificial Sequence
  Synthetic
ggagcaaacttgtgcgttgaaagagtgctggactgtaggactgcatataaacctgttctggtggatgaagggagg

SEQ ID NO: 360590 - DNA, 75 bp, Artificial Sequence
  Synthetic
aaggtggccatcaaagggccactacggatttctgcatcatcggctgctcagagaagagggcgcattggacgaaac

SEQ ID NO: 360591 - DNA, 75 bp, Artificial Sequence
  Synthetic
ggatttctgcatcatcggctgctcagagaagagggcgcattggacgaaacccaaacagggatggagattcctact

SEQ ID NO: 360592 - DNA, 75 bp, Artificial Sequence
  Synthetic
caatgcccatcatgtgtgttggctggaagcttccatgctccttgacaacatggaagttagaggaggaatggttgc

SEQ ID NO: 360593 - DNA, 75 bp, Artificial Sequence
  Synthetic
aagacccctgtctcccctggggaaatgaggctgagagatgatcaaaggagagtcttcagggagttggtgcgtgga

SEQ ID NO: 360594 - DNA, 75 bp, Artificial Sequence
  Synthetic
ggcaggtagcaaagcccggtttaaaaaccaatgaccgcaagtggtgctttgaaggacccgaggaacacgagatac

SEQ ID NO: 360595 - DNA, 75 bp, Artificial Sequence
  Synthetic
aaccaatgaccgcaagtggtgctttgaaggacccgaggaacacgagatacttaatgacaacggtgaaactgtgaa

SEQ ID NO: 360596 - DNA, 75 bp, Artificial Sequence
  Synthetic
gaaggacccgaggaacacgagatacttaatgacaacggtgaaactgtgaagtgcaggtcacccggtggagcgaaa

SEQ ID NO: 360597 - DNA, 75 bp, Artificial Sequence
  Synthetic
atgaaagagtgtcctcagaccagagcgctttggctgatttcatcaaatttgccgaaggtagaagaggagcagctg

SEQ ID NO: 360598 - DNA, 75 bp, Artificial Sequence
  Synthetic
gccgaaggtagaagaggagcagctgagatgcttgtggttctcacggaactgcctgatttcctggcaaaaaaaggt

SEQ ID NO: 360599 - DNA, 75 bp, Artificial Sequence
  Synthetic
tgtttctccattctgaggagggatcaagagcttatagaaatgctctgtcaatgatgcctgaagccatgaccatcg

SEQ ID NO: 360600 - DNA, 75 bp, Artificial Sequence
  Synthetic
ggatgtctatggcaatggggactatggctggcagcgggtatctcatgttcttggggggagtgaaaccaacacaca

SEQ ID NO: 360601 - DNA, 75 bp, Artificial Sequence
  Synthetic
ggctggcagcgggtatctcatgttcttggggggagtgaaaccaacacacatttcatatgttatgttgatcttttt

SEQ ID NO: 360602 - DNA, 75 bp, Artificial Sequence
  Synthetic
cattggaatactcacattgctgtccattgtggcagccaatgagttaggaatgctggaaaagaccaaggaagactt

SEQ ID NO: 360603 - DNA, 75 bp, Artificial Sequence
  Synthetic
ttttggaagaaggaatattgcaacatctggtggaacgattccatggagctggcccgacttggatctgaaacctgg

SEQ ID NO: 360604 - DNA, 75 bp, Artificial Sequence
  Synthetic
attgtgacaatgctgtcaccaatgcttcatcactggattaaagtggaatatggaaacctctcgctgtcaggaata

SEQ ID NO: 360605 - DNA, 75 bp, Artificial Sequence
  Synthetic
ttcatcactggattaaagtggaatatggaaacctctcgctgtcaggaatagctcagtcagcctcagtcctttcat

SEQ ID NO: 360606 - DNA, 75 bp, Artificial Sequence
  Synthetic
gaagatgaacatatctgtggtcatactcctggtcagtggttggaactcaataacagtgatccccctgttatgtgg

SEQ ID NO: 360607 - DNA, 75 bp, Artificial Sequence
  Synthetic
acgctgattcttcctggaatcaaagcccagcagtcaaaactggcacaaaaaagagtttttcatggagtggcaaaa

SEQ ID NO: 360608 - DNA, 75 bp, Artificial Sequence
  Synthetic
cccagcagtcaaaactggcacaaaaaagagtttttcatggagtggcaaaaaatccagtagttgatggcaatccaa

SEQ ID NO: 360609 - DNA, 75 bp, Artificial Sequence
  Synthetic
aatgcctgccttgtatgagaagaaattggcactgtatcttcttctcgctttgagcctgatgtcagtagccatgtg

SEQ ID NO: 360610 - DNA, 75 bp, Artificial Sequence
  Synthetic
cagaactcctttttccctagcagaaggcatagtgttgtcatctgctgctcttgggcccctaatagagggaaacac

SEQ ID NO: 360611 - DNA, 75 bp, Artificial Sequence
  Synthetic
gcggcaactactacgcttttgtgggtgtgatgtacaacctctggaagatgaaaacagggcgtagagggagcgcaa

SEQ ID NO: 360612 - DNA, 75 bp, Artificial Sequence
  Synthetic
gaagagggaactcaacctgctagacaaacagcaatttgagttgtacaagagaacagacatcaccgaggtggatcg

SEQ ID NO: 360613 - DNA, 75 bp, Artificial Sequence
  Synthetic
gaggggaaggtggatactggagtggccgtgtcgagggggacagcaaagctgagatggttccacgagcgtggctat

SEQ ID NO: 360614 - DNA, 75 bp, Artificial Sequence
  Synthetic
gcccatgaacgtgcaaagtttaggatggaacattgtgaccttcaaggacaagactgacatccacaggctagagcc

SEQ ID NO: 360615 - DNA, 75 bp, Artificial Sequence
  Synthetic
tggaacattgtgaccttcaaggacaagactgacatccacaggctagagccagccaagtgtgaaaccctcctttgt

SEQ ID NO: 360616 - DNA, 75 bp, Artificial Sequence
  Synthetic
agactgacatccacaggctagagccagccaagtgtgaaaccctcctttgtgacattggggaatcctcgccttctt

SEQ ID NO: 360617 - DNA, 75 bp, Artificial Sequence
  Synthetic
gagagttcttgaaacaattgaaaagtggctggcttgtggagtggacaacttttgtgtcaaggttttagcaccata

SEQ ID NO: 360618 - DNA, 75 bp, Artificial Sequence
  Synthetic
tggctggcttgtggagtggacaacttttgtgtcaaggttttagcaccatacatgcctgatgtgatagagaaattg

SEQ ID NO: 360619 - DNA, 75 bp, Artificial Sequence
  Synthetic
gaactatcatcaggaatcccctttccagaaactcaacccatgagatgtattatgtgtcaggagcaagaagtaaca

SEQ ID NO: 360620 - DNA, 75 bp, Artificial Sequence
  Synthetic
cagaaactcaacccatgagatgtattatgtgtcaggagcaagaagtaacattaccttcacagtcaaccaaacatc

SEQ ID NO: 360621 - DNA, 75 bp, Artificial Sequence
  Synthetic
cgaccaacaggcaaagtcactcttgagcccgatgtcattcttcccataggcacacgtagtgtggaaactgataag

SEQ ID NO: 360622 - DNA, 75 bp, Artificial Sequence
  Synthetic
aagagagggttgagagaattaagacagagtatgctgctacatggttctatgacaatgataacccgtatcggacct

SEQ ID NO: 360623 - DNA, 75 bp, Artificial Sequence
  Synthetic
caagacatcaggcagtgcagccagcatgataaatggagtcattaaaatcttgaccttcccatgggacaggataga

SEQ ID NO: 360624 - DNA, 75 bp, Artificial Sequence
  Synthetic
agaggttaccagaatggcaatgactgacaccacgccttttggccaacaaagagtctttaaggaaaaggtggacac

SEQ ID NO: 360625 - DNA, 75 bp, Artificial Sequence
  Synthetic
gacaccacgccttttggccaacaaagagtctttaaggaaaaggtggacacaagagccaaagatcctcctgctgga

SEQ ID NO: 360626 - DNA, 75 bp, Artificial Sequence
  Synthetic
accgttggttgtttcgacatctggcccgggaaaagaatcccaggctgtgcacaaaggaggaattcatagccaagg

SEQ ID NO: 360627 - DNA, 75 bp, Artificial Sequence
  Synthetic
ccgggaaaagaatcccaggctgtgcacaaaggaggaattcatagccaaggtgcgcagtcatgctgcggtaggagc

SEQ ID NO: 360628 - DNA, 75 bp, Artificial Sequence
  Synthetic
aagacagccaatgaagcggttcaagaccctaagttttgggagatggttgatgctgagcgcaagctccatcaacag

SEQ ID NO: 360629 - DNA, 75 bp, Artificial Sequence
  Synthetic
accctaagttttgggagatggttgatgctgagcgcaagctccatcaacaggggcgatgccagtcttgtgtctata

SEQ ID NO: 360630 - DNA, 75 bp, Artificial Sequence
  Synthetic
actatctgagtttggaaaagcaaaaggaagtcgtgcgatctggtacatgtggctgggggcacgtttccttgagtt

SEQ ID NO: 360631 - DNA, 75 bp, Artificial Sequence
  Synthetic
ggaagtcgtgcgatctggtacatgtggctgggggcacgtttccttgagtttgaggctcttgggttcctgaatgaa

SEQ ID NO: 360632 - DNA, 75 bp, Artificial Sequence
  Synthetic
gaggattctatgcagatgacacagcaggatgggacacacgcatcacggaagctgacctggatgatgaacaggaga

SEQ ID NO: 360633 - DNA, 75 bp, Artificial Sequence
  Synthetic
tcatgagctacatgaacgctgagcagaggaaactggcctgggcagtgatggaaatgacatacaagaacaaagtgg

SEQ ID NO: 360634 - DNA, 75 bp, Artificial Sequence
  Synthetic
gaggaaactggcctgggcagtgatggaaatgacatacaagaacaaagtggtcaaggtccttcgaccagcaccagg

SEQ ID NO: 360635 - DNA, 75 bp, Artificial Sequence
  Synthetic
agtaggagagatcaaagggggtcagggcaagtggtgacatacgctctcaacactatcaccaatttgaaagtccag

SEQ ID NO: 360636 - DNA, 75 bp, Artificial Sequence
  Synthetic
ctcataaggatggctgaagctgagatggtaatcaaccatcagcacgtgaatgaatgtgacgagggcgttttggca

SEQ ID NO: 360637 - DNA, 75 bp, Artificial Sequence
  Synthetic
atggatgtgacagacttgcccggatggctgtgagtggagatgattgtgtcgtgaggcctgtggatgatagatttg

SEQ ID NO: 360638 - DNA, 75 bp, Artificial Sequence
  Synthetic
gcctggctctttcccatcttaatgccatgtcaaaagtcaggaaggacatttcagaatggcagccctccaaggagt

SEQ ID NO: 360639 - DNA, 75 bp, Artificial Sequence
  Synthetic
gttgatagggagagggagagtgtctccaggaaatggctggatgattaaagaaacggcttgcctcagcaaggctta

SEQ ID NO: 360640 - DNA, 75 bp, Artificial Sequence
  Synthetic
ttccataagagagacatgaggctgctctcatttgctgtctcatcagccgttccaatggcatgggtacccagtgga

SEQ ID NO: 360641 - DNA, 75 bp, Artificial Sequence
  Synthetic
tctcatttgctgtctcatcagccgttccaatggcatgggtacccagtggaagaacaacatggtctgttcatggaa

SEQ ID NO: 360642 - DNA, 75 bp, Artificial Sequence
  Synthetic
catgttggacgtctggaacagagtttgggtcctaaacaacccacacatgaaggacaagaccaccgtaaaggagtg

SEQ ID NO: 360643 - DNA, 75 bp, Artificial Sequence
  Synthetic
tgggtcctaaacaacccacacatgaaggacaagaccaccgtaaaggagtggagagatgttccttacctcacaaaa

SEQ ID NO: 360644 - DNA, 75 bp, Artificial Sequence
  Synthetic
tgatagggatgacaaacagggccacatgggcctcacacatccacctggtgatccaccgaatccgaaccttaatcg

SEQ ID NO: 360645 - DNA, 75 bp, Artificial Sequence
  Synthetic
gccaagaaaaatacacagattatctcactgtgatggacaggtactcggttgatgctgacctccaaccaggagagc

SEQ ID NO: 360646 - DNA, 75 bp, Artificial Sequence
  Synthetic
cactgtgatggacaggtactcggttgatgctgacctccaaccaggagagctcatctgagaccagccactgtgaac

SEQ ID NO: 360647 - DNA, 75 bp, Artificial Sequence
  Synthetic
caggactctagaatcctaggagtcttgccaccgctaagctgtgaggcggtgcgggctgggacagccgtcttccag

SEQ ID NO: 360648 - DNA, 75 bp, Artificial Sequence
  Synthetic
tgccaccgctaagctgtgaggcggtgcgggctgggacagccgtcttccagatcacgataggtctggtttctggaa

SEQ ID NO: 360649 - DNA, 75 bp, Artificial Sequence
  Synthetic
gagcctccgccaccacccacccacggggtggtggaaagatggggtctagaggttagaggagaccctccagggaaa

SEQ ID NO: 360650 - DNA, 75 bp, Artificial Sequence
  Synthetic
ttttcctccaggggtctgcgagcacagtttgctctagaagaagcagacctttggatgacaaaacccaaaaccact

SEQ ID NO: 360651 - DNA, 75 bp, Artificial Sequence
  Synthetic
cttactgttctaaggaaagtcaagagagtggtagccagtttgatgagagggttgtcttctaggaagcgtcgctcc

SEQ ID NO: 360652 - DNA, 75 bp, Artificial Sequence
  Synthetic
gagtggtagccagtttgatgagagggttgtcttctaggaagcgtcgctccagtgagatgaccatgatgccacttc

SEQ ID NO: 360653 - DNA, 75 bp, Artificial Sequence
  Synthetic
aatcgatggctgcttttgaatgtcacagctgaggacttgggaaagacgttctcggtgggaaccgggaactgcaca

SEQ ID NO: 360654 - DNA, 75 bp, Artificial Sequence
  Synthetic
ggtgtcccgattcaatggaatacaactgtcccaatctcagtcctagagaggagcctgatgacattgactgttggt

SEQ ID NO: 360655 - DNA, 75 bp, Artificial Sequence
  Synthetic
ctgtcccaatctcagtcctagagaggagcctgatgacattgactgttggtgttatggagtagaaaacgtcagagt

SEQ ID NO: 360656 - DNA, 75 bp, Artificial Sequence
  Synthetic
ggaaggtcaaaacgttctaggagagcaattgatctgcccacacatgaaaatcacggactgaaaactcgacaggag

SEQ ID NO: 360657 - DNA, 75 bp, Artificial Sequence
  Synthetic
caattgatctgcccacacatgaaaatcacggactgaaaactcgacaggagaaatggatgacgggcagaatgggtg

SEQ ID NO: 360658 - DNA, 75 bp, Artificial Sequence
  Synthetic
gtggctagtgagaaatccattctttgccgtaacagccctggccattgcttacttggtgggcaacaacaagacaca

SEQ ID NO: 360659 - DNA, 75 bp, Artificial Sequence
  Synthetic
gccgtaacagccctggccattgcttacttggtgggcaacaacaagacacaacgtgttgttatagctctgttggtt

SEQ ID NO: 360660 - DNA, 75 bp, Artificial Sequence
  Synthetic
cacactgcattgggataactgacagagacttcattgagggggtccacggaggcacttgggtgtcagcttctctgg

SEQ ID NO: 360661 - DNA, 75 bp, Artificial Sequence
  Synthetic
agacttcattgagggggtccacggaggcacttgggtgtcagcttctctggagcaggacaagtgcgtgactgtcat

SEQ ID NO: 360662 - DNA, 75 bp, Artificial Sequence
  Synthetic
atctcgcttcaaacagtggcgatagatgggcctgctgaggcaaggaaggtctgctacagtgcagttctcacccat

SEQ ID NO: 360663 - DNA, 75 bp, Artificial Sequence
  Synthetic
atgggcctgctgaggcaaggaaggtctgctacagtgcagttctcacccatgtgaaaatcaatgacaaatgcccga

SEQ ID NO: 360664 - DNA, 75 bp, Artificial Sequence
  Synthetic
ggaaaatgatggtgataacgcctgcaaacggacatactcagatagaggctggggcaatggctgtgggctatttgg

SEQ ID NO: 360665 - DNA, 75 bp, Artificial Sequence
  Synthetic
aaacggacatactcagatagaggctggggcaatggctgtgggctatttgggaaagggagcattgtggcatgtgcc

SEQ ID NO: 360666 - DNA, 75 bp, Artificial Sequence
  Synthetic
gtctttttgaagtggaccagaccaagatccaatacgtcatcagggctcagcttcatgttggtgccaagcaggaga

SEQ ID NO: 360667 - DNA, 75 bp, Artificial Sequence
  Synthetic
gaagtttgatgccttatctggctcccaagaggctgaattcactggctatgggaaagcaacactggaatgtcaggt

SEQ ID NO: 360668 - DNA, 75 bp, Artificial Sequence
  Synthetic
caagaggctgaattcactggctatgggaaagcaacactggaatgtcaggtccagactgcagtggattttgggaac

SEQ ID NO: 360669 - DNA, 75 bp, Artificial Sequence
  Synthetic
ggcacaagacttgactctaccatggcagagtgggagtggtggaatatggagggaaatgcatcaccttgttgagtt

SEQ ID NO: 360670 - DNA, 75 bp, Artificial Sequence
  Synthetic
agggtgttggccctggggaaccaagaggggtccttgaagacagccctcacaggagctatgcgggttaccaaggac

SEQ ID NO: 360671 - DNA, 75 bp, Artificial Sequence
  Synthetic
aggggtccttgaagacagccctcacaggagctatgcgggttaccaaggacgaaaatgataacaacttgtataagc

SEQ ID NO: 360672 - DNA, 75 bp, Artificial Sequence
  Synthetic
cagataaaatgtcatttgtgaaaaacccaacggacacagggcatggcactgttgtcatgcaggtgaaggtcccca

SEQ ID NO: 360673 - DNA, 75 bp, Artificial Sequence
  Synthetic
gcagtcaacaagggaatattggtcactgtcaaccccatagcatccacaaatgacgatgaagttctaattgaagtc

SEQ ID NO: 360674 - DNA, 75 bp, Artificial Sequence
  Synthetic
ctgtcaaccccatagcatccacaaatgacgatgaagttctaattgaagtcaatcccccctttggggacagttaca

SEQ ID NO: 360675 - DNA, 75 bp, Artificial Sequence
  Synthetic
actgacctatcagtggcacaaagaaggaagttcaataggaaaacttttcactcagacaatgaagggagtagaacg

SEQ ID NO: 360676 - DNA, 75 bp, Artificial Sequence
  Synthetic
ggaagttcaataggaaaacttttcactcagacaatgaagggagtagaacgtcttgcagtaatgggtgatgctgcc

SEQ ID NO: 360677 - DNA, 75 bp, Artificial Sequence
  Synthetic
tcttcacgtcagtggggaaaggaattcacactgtgtttggttcagcttttcaggggttgtttggcggcctgagct

SEQ ID NO: 360678 - DNA, 75 bp, Artificial Sequence
  Synthetic
tcacactgtgtttggttcagcttttcaggggttgtttggcggcctgagctggattacaaaggtcatcatgggagc

SEQ ID NO: 360679 - DNA, 75 bp, Artificial Sequence
  Synthetic
acacgtaatatgaccatgtccatgtctatgattttggtgggtgtgatcatgatgttcctttccctgggtgtcggg

SEQ ID NO: 360680 - DNA, 75 bp, Artificial Sequence
  Synthetic
ctatgattttggtgggtgtgatcatgatgttcctttccctgggtgtcggggcagaccaagggtgtgccgtcaact

SEQ ID NO: 360681 - DNA, 75 bp, Artificial Sequence
  Synthetic
agatggcatttttgtgttcagagactcagatgactggcttaccaagtattcttattatccagaagaccctgtcaa

SEQ ID NO: 360682 - DNA, 75 bp, Artificial Sequence
  Synthetic
tcagatgactggcttaccaagtattcttattatccagaagaccctgtcaagctggcctccatcatcaaggcctct

SEQ ID NO: 360683 - DNA, 75 bp, Artificial Sequence
  Synthetic
aatgtggaggagtagagctgatgagatcaacgccatatttgaggaaaatgaagtggacatctcgatcgttgtcca

SEQ ID NO: 360684 - DNA, 75 bp, Artificial Sequence
  Synthetic
gggacgcatcctttctccaggattcgtgatgggttacagtatggatggaaaacctggggcaagaatctaatcttc

SEQ ID NO: 360685 - DNA, 75 bp, Artificial Sequence
  Synthetic
gtgatgggttacagtatggatggaaaacctggggcaagaatctaatcttctcacccggaaggaaaaacggcagct

SEQ ID NO: 360686 - DNA, 75 bp, Artificial Sequence
  Synthetic
tactgggtgcggctgtgaatgggaagaagagcgcgcatggatcgccaacattctggatgggaagtcatgaggtca

SEQ ID NO: 360687 - DNA, 75 bp, Artificial Sequence
  Synthetic
gaagagcgcgcatggatcgccaacattctggatgggaagtcatgaggtcaatggaacatggatgatgcacacact

SEQ ID NO: 360688 - DNA, 75 bp, Artificial Sequence
  Synthetic
gaatggcccctgacacatactataggaacctcagtggaagagagtgacatgtttatgccccgttccattggaggc

SEQ ID NO: 360689 - DNA, 75 bp, Artificial Sequence
  Synthetic
caggctataaggttcagacgaatggaccatggatgcaagtccctctggaagtcagaagggagccatgcccaggga

SEQ ID NO: 360690 - DNA, 75 bp, Artificial Sequence
  Synthetic
tgatggacgtggcaaatcaaccagatcaactactgacagcgggaaaataattccagaatggtgctgcagatcttg

SEQ ID NO: 360691 - DNA, 75 bp, Artificial Sequence
  Synthetic
tcaactactgacagcgggaaaataattccagaatggtgctgcagatcttgcaccatgcccccagttagcttccac

SEQ ID NO: 360692 - DNA, 75 bp, Artificial Sequence
  Synthetic
tggaaattagacccatgaaaacccacgagagccatctggtgaggtcatgggtgaccgcaggagaagtgcatgcgg

SEQ ID NO: 360693 - DNA, 75 bp, Artificial Sequence
  Synthetic
cgagagccatctggtgaggtcatgggtgaccgcaggagaagtgcatgcggtgccttttggattggtgagcatgat

SEQ ID NO: 360694 - DNA, 75 bp, Artificial Sequence
  Synthetic
aaaagacaagggccaaagcagatgctggtgggaggaattatactacttggagcaatgctagtgggacaagtcacg

SEQ ID NO: 360695 - DNA, 75 bp, Artificial Sequence
  Synthetic
tggcagtaggtttgcatttccatgagatcaacaatggaggagacgctatgtacatggccttgattgcgagctttt

SEQ ID NO: 360696 - DNA, 75 bp, Artificial Sequence
  Synthetic
tgtgcgtcctcaccatcaatgcaatttcttcaaggaaggcttcaaatacgatccttcccctgatggcactcttaa

SEQ ID NO: 360697 - DNA, 75 bp, Artificial Sequence
  Synthetic
ttcttcaaggaaggcttcaaatacgatccttcccctgatggcactcttaactcctgtgacaatgtatgaagtaag

SEQ ID NO: 360698 - DNA, 75 bp, Artificial Sequence
  Synthetic
gtggtcatagtgggggtgcttcaccagaactcaaaagacacgtccatgcagaaaaccattcccattgtggctctg

SEQ ID NO: 360699 - DNA, 75 bp, Artificial Sequence
  Synthetic
agaactcaaaagacacgtccatgcagaaaaccattcccattgtggctctgacactgacctcatacatgggcttaa

SEQ ID NO: 360700 - DNA, 75 bp, Artificial Sequence
  Synthetic
ctatatgtccacacaagtatttggcagaagaagcattcctgtgaatgaagctcttgcagcagctggcctggtggg

SEQ ID NO: 360701 - DNA, 75 bp, Artificial Sequence
  Synthetic
gacatggaaaatttcttagggccgattgccgtgggtggaatactcatgatgctggtcagtgtggcagggaaagtt

SEQ ID NO: 360702 - DNA, 75 bp, Artificial Sequence
  Synthetic
ttgccgtgggtggaatactcatgatgctggtcagtgtggcagggaaagttgatggattggaactcaaaaagcttg

SEQ ID NO: 360703 - DNA, 75 bp, Artificial Sequence
  Synthetic
tacgatgtggcactaagtgaacagggagaattcaagctcctctcagaggacaaagtaccctgggatcagattgtc

SEQ ID NO: 360704 - DNA, 75 bp, Artificial Sequence
  Synthetic
cagcgatacatccatttgctctactactggttttaggaggttgggtcctacacattaaaggagctaggaggagcg

SEQ ID NO: 360705 - DNA, 75 bp, Artificial Sequence
  Synthetic
actggttttaggaggttgggtcctacacattaaaggagctaggaggagcggggatgttctttgggacattcccac

SEQ ID NO: 360706 - DNA, 75 bp, Artificial Sequence
  Synthetic
catctggaggatggaatttatggcatattccaatcaaccttccttggagcctcccagagaggagtcggagtggcc

SEQ ID NO: 360707 - DNA, 75 bp, Artificial Sequence
  Synthetic
ctcccagagaggagtcggagtggcccaagggggtgtcttccacacgatgtggcatgtcaccagaggagcgtttct

SEQ ID NO: 360708 - DNA, 75 bp, Artificial Sequence
  Synthetic
ccatcttgggcctctgtgaaggaggatttggtggcctatggtggatcttggaagctagatggaaagtgggatggt

SEQ ID NO: 360709 - DNA, 75 bp, Artificial Sequence
  Synthetic
gggcagttgccttggattatcccagcgggacctctggttcacccattgtaaatcgcagtggtgaagtggtgggac

SEQ ID NO: 360710 - DNA, 75 bp, Artificial Sequence
  Synthetic
cggggaaaacccgcaggtttttgccccaaatactggccgagtgcgccaggaggcgcctacgaacacttgttctgg

SEQ ID NO: 360711 - DNA, 75 bp, Artificial Sequence
  Synthetic
ccaaatactggccgagtgcgccaggaggcgcctacgaacacttgttctggcgcctactcgggttgtcctgtcaga

SEQ ID NO: 360712 - DNA, 75 bp, Artificial Sequence
  Synthetic
gatgtgaagttccacacacaggctttctcagctcatgggagtgggaaagaagtcattgatgcaatgtgccacgca

SEQ ID NO: 360713 - DNA, 75 bp, Artificial Sequence
  Synthetic
caacaagagttgtcaactgggaagtcattatcatggatgaggctcattttttggatcctgccagtatcgcagcga

SEQ ID NO: 360714 - DNA, 75 bp, Artificial Sequence
  Synthetic
cattatcatggatgaggctcattttttggatcctgccagtatcgcagcgaggggctgggcagcccacagggcgag

SEQ ID NO: 360715 - DNA, 75 bp, Artificial Sequence
  Synthetic
gccatgagtggatcctagccgacaaacgaccaacagcatggtttcttccatcgatcagagctgcaaatgtcatgg

SEQ ID NO: 360716 - DNA, 75 bp, Artificial Sequence
  Synthetic
acgaccaacagcatggtttcttccatcgatcagagctgcaaatgtcatggccgcctccctgcgcaaagcggggaa

SEQ ID NO: 360717 - DNA, 75 bp, Artificial Sequence
  Synthetic
tcaaacaaaagaggccggatttcatcctggccacagacattgccgagatgggagcgaacctgtgcgttgagagag

SEQ ID NO: 360718 - DNA, 75 bp, Artificial Sequence
  Synthetic
acctgtcctggtggatgaagggagaaaggtagccatcaaagggccgctacggatttccgcatcatcggctgccca

SEQ ID NO: 360719 - DNA, 75 bp, Artificial Sequence
  Synthetic
aaggtagccatcaaagggccgctacggatttccgcatcatcggctgcccagagaagaggacgcattggacggaat

SEQ ID NO: 360720 - DNA, 75 bp, Artificial Sequence
  Synthetic
actactcagaacccactagtgaggataacgcccatcatgtgtgttggctagaagcttccatgcttcttgataaca

SEQ ID NO: 360721 - DNA, 75 bp, Artificial Sequence
  Synthetic
taacgcccatcatgtgtgttggctagaagcttccatgcttcttgataacatggaagttagaggaggaatggttgc

SEQ ID NO: 360722 - DNA, 75 bp, Artificial Sequence
  Synthetic
aagacccctgtctcccctggggagatgaggctaagagatgatcaaagaagagtcttcagggagttggtgcgtgga

SEQ ID NO: 360723 - DNA, 75 bp, Artificial Sequence
  Synthetic
tgaggctaagagatgatcaaagaagagtcttcagggagttggtgcgtggatgtgacttaccagtttggttatcct

SEQ ID NO: 360724 - DNA, 75 bp, Artificial Sequence
  Synthetic
gaaggacccgaagagcacgagatacttaatgacaacggtgaaactgtgaagtgcaggtcccccggtggagcaaaa

SEQ ID NO: 360725 - DNA, 75 bp, Artificial Sequence
  Synthetic
atgaaagagtgtcctcagatcaaagtgctttggctgatttcatcaaatttgccgaaggtagaagaggggctgctg

SEQ ID NO: 360726 - DNA, 75 bp, Artificial Sequence
  Synthetic
gcctgacttcttggcgaaaaaaggaggggaggccatggacaccataagtgtgtttcttcattctgaggaggggtc

SEQ ID NO: 360727 - DNA, 75 bp, Artificial Sequence
  Synthetic
atgatgcctgaagccatgaccatcgtgatgcttttcatactggctggtctcttgacctcaggaatggtgattttc

SEQ ID NO: 360728 - DNA, 75 bp, Artificial Sequence
  Synthetic
gaatgtctatggcaatggggactatggctggcagcgggtacctcatgttcctagggggagtgaaaccaacacaca

SEQ ID NO: 360729 - DNA, 75 bp, Artificial Sequence
  Synthetic
ggctggcagcgggtacctcatgttcctagggggagtgaaaccaacacacatctcatatgtcatgctgatcttttt

SEQ ID NO: 360730 - DNA, 75 bp, Artificial Sequence
  Synthetic
gagccaggacaacagaggtccatccaggacaaccaagtggcctatcttatcattggaatactcacattgctgtct

SEQ ID NO: 360731 - DNA, 75 bp, Artificial Sequence
  Synthetic
aggacaaccaagtggcctatcttatcattggaatactcacattgctgtctgtcgtggcagctaatgagctaggga

SEQ ID NO: 360732 - DNA, 75 bp, Artificial Sequence
  Synthetic
ccgctgacattgaagaagcacctgaaatgcctgccctgtacgagaagaaattggcactgtaccttctcctcgcct

SEQ ID NO: 360733 - DNA, 75 bp, Artificial Sequence
  Synthetic
ccgaacccctttttccttagcggagggaatagtattgtcatccgctgctctagggcccctgatagagggaaacac

SEQ ID NO: 360734 - DNA, 75 bp, Artificial Sequence
  Synthetic
gcggcaattactatgcttttgtgggtgtgatgtataacctctggaagatgaagacagggcgtagagggagtgcaa

SEQ ID NO: 360735 - DNA, 75 bp, Artificial Sequence
  Synthetic
gaagagggaactcaacctgctagacaaacagcaatttgagctgtataagagaacagatatcaccgaggtggatcg

SEQ ID NO: 360736 - DNA, 75 bp, Artificial Sequence
  Synthetic
gaggggaaggtggacactggagtggctgtgtcgagggggacagcgaagctgaggtggttccacgagcgtggctat

SEQ ID NO: 360737 - DNA, 75 bp, Artificial Sequence
  Synthetic
gtgctactacgcagcagctcagaaagaggtcagcggtgtgaaaggttacactttgggcagagatggccatgaaaa

SEQ ID NO: 360738 - DNA, 75 bp, Artificial Sequence
  Synthetic
tggaacattgtgaccttcaaggataagactgacatccacagactagagccagccaagtgtgaaactctcctttgt

SEQ ID NO: 360739 - DNA, 75 bp, Artificial Sequence
  Synthetic
agactgacatccacagactagagccagccaagtgtgaaactctcctttgtgacatcggggagtcctcgccttctt

SEQ ID NO: 360740 - DNA, 75 bp, Artificial Sequence
  Synthetic
gagagttcttgaaacagttgaaaagtggctggcttgtggagtggacaatttttgtgtcaaggttctggcaccata

SEQ ID NO: 360741 - DNA, 75 bp, Artificial Sequence
  Synthetic
tggctggcttgtggagtggacaatttttgtgtcaaggttctggcaccatacatgcctgatgtgatagagaaattg

SEQ ID NO: 360742 - DNA, 75 bp, Artificial Sequence
  Synthetic
gaactgtcattaggaatcccctttccagaaattcaacccatgagatgtactatgtgtcaggagcaagaagtaaca

SEQ ID NO: 360743 - DNA, 75 bp, Artificial Sequence
  Synthetic
cagaaattcaacccatgagatgtactatgtgtcaggagcaagaagtaacatcaccttcacggtcaaccaaacatc

SEQ ID NO: 360744 - DNA, 75 bp, Artificial Sequence
  Synthetic
cgaccaacaggcaaagtcaccttggagcccgatgtaatcctccccataggcacacgcagtgtggaaactgataag

SEQ ID NO: 360745 - DNA, 75 bp, Artificial Sequence
  Synthetic
aagagagggttgagaggatcaagactgagtatgccgcaacatggtttcatgacaatgacaacccgtaccggacct

SEQ ID NO: 360746 - DNA, 75 bp, Artificial Sequence
  Synthetic
gacaccacgccttttggccaacaaagagtcttcaaggaaaaggtggacacgagggccaaagaccctcctgctgga

SEQ ID NO: 360747 - DNA, 75 bp, Artificial Sequence
  Synthetic
accgatggttgtttcgacacctagctcgggaaaagaaacccaggttgtgcacaaaggaagagttcatagccaagg

SEQ ID NO: 360748 - DNA, 75 bp, Artificial Sequence
  Synthetic
tcgggaaaagaaacccaggttgtgcacaaaggaagagttcatagccaaggtgcgcagtcatgctgcgataggggc

SEQ ID NO: 360749 - DNA, 75 bp, Artificial Sequence
  Synthetic
aagacagccaatgaagcagtccaagaccccaagttttgggagatggttgacgctgagcgcaagctccatcaacag

SEQ ID NO: 360750 - DNA, 75 bp, Artificial Sequence
  Synthetic
accccaagttttgggagatggttgacgctgagcgcaagctccatcaacaggggcggtgccagtcttgtgtctata

SEQ ID NO: 360751 - DNA, 75 bp, Artificial Sequence
  Synthetic
attatctgaatttggtaaagcaaaaggaagccgtgccatctggtacatgtggctgggggcgcgtttcctcgagtt

SEQ ID NO: 360752 - DNA, 75 bp, Artificial Sequence
  Synthetic
ggaagccgtgccatctggtacatgtggctgggggcgcgtttcctcgagtttgaagctcttgggttcctgaatgaa

SEQ ID NO: 360753 - DNA, 75 bp, Artificial Sequence
  Synthetic
caggaggaggtgttgaaggcataggactccaatatctaggctatgtaatcaaggacctatccaccaaagaagggg

SEQ ID NO: 360754 - DNA, 75 bp, Artificial Sequence
  Synthetic
aaggacctatccaccaaagaagggggaggattctatgctgatgacacagcaggatgggacacacgtatcacggaa

SEQ ID NO: 360755 - DNA, 75 bp, Artificial Sequence
  Synthetic
agtaggagagatcaaaggggatcagggcaagttgtgacatatgcccttaacaccatcaccaatctgaaagttcag

SEQ ID NO: 360756 - DNA, 75 bp, Artificial Sequence
  Synthetic
ctcataaggatggctgaagctgagatggtaatcaaccaccagcacgtgaatgaatgtgacgagagcgctttggca

SEQ ID NO: 360757 - DNA, 75 bp, Artificial Sequence
  Synthetic
gcttggctctttctcatctcaatgccatgtcaaaagttaggaaggacatctcagaatggcagccctccaaagggt

SEQ ID NO: 360758 - DNA, 75 bp, Artificial Sequence
  Synthetic
gttaataggaagagggagagtgtctccaggaaatggctggatgatcaaagagacagcttgccttagcaaggctta

SEQ ID NO: 360759 - DNA, 75 bp, Artificial Sequence
  Synthetic
ttccacaagagagacatgaggctactctcattcgctgtctcatctgccgttccaacggcatgggtacccagtgga

SEQ ID NO: 360760 - DNA, 75 bp, Artificial Sequence
  Synthetic
tctcattcgctgtctcatctgccgttccaacggcatgggtacccagtggaagaacaacatggtctgttcatggaa

SEQ ID NO: 360761 - DNA, 75 bp, Artificial Sequence
  Synthetic
catgttagacgtctggaacagggtttgggtattaaataacccacacatgaaggacaagactactgtaaaggagtg

SEQ ID NO: 360762 - DNA, 75 bp, Artificial Sequence
  Synthetic
tgggtattaaataacccacacatgaaggacaagactactgtaaaggagtggagggatgttccttaccttacaaaa

SEQ ID NO: 360763 - DNA, 75 bp, Artificial Sequence
  Synthetic
cactgtgatggacaggtactctgttgatgctgacctccaaccaggagagctcatctgatacctgccattgcaaaa

SEQ ID NO: 360764 - DNA, 75 bp, Artificial Sequence
  Synthetic
gagaaccggactccccacttccaaagcatcaataagaaaccgggataaaaactacggatggagaaccggactcca

SEQ ID NO: 360765 - DNA, 75 bp, Artificial Sequence
  Synthetic
gcatcaataagaaaccgggataaaaactacggatggagaaccggactccacaattaaaaggctattgacgtcagc

SEQ ID NO: 360766 - DNA, 75 bp, Artificial Sequence
  Synthetic
ttgccaccgctaagctgtgaggcggtgcgggctgggacagccgttttccagatcacgacaaatctggtttctggg

SEQ ID NO: 360767 - DNA, 75 bp, Artificial Sequence
  Synthetic
ggaaagaccggagtggtctctgcttttcctccaagggtctgcgagcacagtttgctttaaaagaagcagaccttt

SEQ ID NO: 360768 - DNA, 75 bp, Artificial Sequence
  Synthetic
ttttcctccaagggtctgcgagcacagtttgctttaaaagaagcagaccttttggatgaaaaacacaaaaccact

SEQ ID NO: 360769 - DNA, 75 bp, Artificial Sequence
  Synthetic
atgaagtcttgactgttcagtttctgatcttgggaatgctgctgatgactggtggagtgaccctggtgcgtaaga

SEQ ID NO: 360770 - DNA, 75 bp, Artificial Sequence
  Synthetic
cggtgacagccttggctattgcttatttggtggggagcaacatgacgcaacgagttgtgattgctttgctagttt

SEQ ID NO: 360771 - DNA, 75 bp, Artificial Sequence
  Synthetic
tatcactggaaacagttgccattgatggacctgctgaagcaaggaaagtgtgttacagtgcagtcttgacccatg

SEQ ID NO: 360772 - DNA, 75 bp, Artificial Sequence
  Synthetic
caccggtgaagcccatttggccgaagaaaacgagggagatcacgcctgtaaacgaacttactctgacagaggctg

SEQ ID NO: 360773 - DNA, 75 bp, Artificial Sequence
  Synthetic
gaaaacgagggagatcacgcctgtaaacgaacttactctgacagaggctgggggaacggctgtggcctgtttgga

SEQ ID NO: 360774 - DNA, 75 bp, Artificial Sequence
  Synthetic
aattcacctgtgccaagtctatgagcctgtttgaggttgaccagaccaaaatccagtatgtcattagggcacagc

SEQ ID NO: 360775 - DNA, 75 bp, Artificial Sequence
  Synthetic
ctggaatgctgatattaagactctcaaatttgatgccctgtcaggttctcaggaggctgagttcactggatatgg

SEQ ID NO: 360776 - DNA, 75 bp, Artificial Sequence
  Synthetic
aaatttgatgccctgtcaggttctcaggaggctgagttcactggatatgggaaggccacactggagtgtcaagta

SEQ ID NO: 360777 - DNA, 75 bp, Artificial Sequence
  Synthetic
agagatgcaccatcttgtggaattcgagcctccacatgctgcaactatcaaagtgttggccctgggaaaccaaga

SEQ ID NO: 360778 - DNA, 75 bp, Artificial Sequence
  Synthetic
gagcctccacatgctgcaactatcaaagtgttggccctgggaaaccaagaaggctctctgaagacagctctcact

SEQ ID NO: 360779 - DNA, 75 bp, Artificial Sequence
  Synthetic
ccaacagacactggacatggcactgccgtgatgcaggtgaaagtgccaaagggagccccctgtaggatcccagtg

SEQ ID NO: 360780 - DNA, 75 bp, Artificial Sequence
  Synthetic
ccgtgatgcaggtgaaagtgccaaagggagccccctgtaggatcccagtgatggtagctgatgacctcacggcgt

SEQ ID NO: 360781 - DNA, 75 bp, Artificial Sequence
  Synthetic
agtcaatccaatagcctccactaatgaggatgaggtgttgattgaggtgaacccccccttcggggacagctatat

SEQ ID NO: 360782 - DNA, 75 bp, Artificial Sequence
  Synthetic
agggattgtttggtggcttgagttggataacaaaggtcatcatgggggcagtcctcatatgggttggcatcaaca

SEQ ID NO: 360783 - DNA, 75 bp, Artificial Sequence
  Synthetic
cggaccaaggatgtgcaatcaactttggcaggagagaactcaaatgtggggaaggagtcttcatcttcagggatt

SEQ ID NO: 360784 - DNA, 75 bp, Artificial Sequence
  Synthetic
cggaccaaggatgtgcaatcaactttggcaggagagaactcaaatgtggggatggagtcttcatcttcagggatt

SEQ ID NO: 360785 - DNA, 75 bp, Artificial Sequence
  Synthetic
cggaccaaggatgtgcaatcaactttggcaggagagaactcaaatgtggggacggagtcttcatcttcagggatt

SEQ ID NO: 360786 - DNA, 75 bp, Artificial Sequence
  Synthetic
cggaccaaggatgtgcaatcaactttggcaggagagaactcaaatgtggggagggagtcttcatcttcagggatt

SEQ ID NO: 360787 - DNA, 75 bp, Artificial Sequence
  Synthetic
tcaatgccatccttgaggagaatgaggtagacatctcagtggtggtccaagaccccaaaaacatctatcagagag

SEQ ID NO: 360788 - DNA, 75 bp, Artificial Sequence
  Synthetic
ctccaggaagaaagaatggaagcttcatcatagacgggaagtccaggaaagagtgcccgttttcaaacagagtgt

SEQ ID NO: 360789 - DNA, 75 bp, Artificial Sequence
  Synthetic
agttggaggcatagtgctcctaggagccatgttagttggacaggtgaccctgttggacctgctgaagcttgtagt

SEQ ID NO: 360790 - DNA, 75 bp, Artificial Sequence
  Synthetic
atgaacaatggaggggatgccatgtacatggccttgatcgctgctttctcgatcaggccgggactgctcatcggc

SEQ ID NO: 360791 - DNA, 75 bp, Artificial Sequence
  Synthetic
acatggccttgatcgctgctttctcgatcaggccgggactgctcatcggcttcgggttgaggacactgtggagcc

SEQ ID NO: 360792 - DNA, 75 bp, Artificial Sequence
  Synthetic
tggagctgccatggtggagatagccctgggcggcatgatgggagggctgtggaagtacttgaatgcagtgtccct

SEQ ID NO: 360793 - DNA, 75 bp, Artificial Sequence
  Synthetic
ctgggcggcatgatgggagggctgtggaagtacttgaatgcagtgtccctttgcatcttgacaataaatgctgtt

SEQ ID NO: 360794 - DNA, 75 bp, Artificial Sequence
  Synthetic
tcctgcccttgatggcgttgttgacacctgtgacaatggctgaggtgagacttgcaacgatgctcttttgcaccg

SEQ ID NO: 360795 - DNA, 75 bp, Artificial Sequence
  Synthetic
acctgtgacaatggctgaggtgagacttgcaacgatgctcttttgcaccgtggtcatcataggggtcctccacca

SEQ ID NO: 360796 - DNA, 75 bp, Artificial Sequence
  Synthetic
aagaccatgcccctggtggccctcacactgacttcttacctgggattgacacagccttttttgggcttgtgtgcc

SEQ ID NO: 360797 - DNA, 75 bp, Artificial Sequence
  Synthetic
cactgacttcttacctgggattgacacagccttttttgggcttgtgtgccttcatggcgacccgaatattcggac

SEQ ID NO: 360798 - DNA, 75 bp, Artificial Sequence
  Synthetic
acttgcagcggctggtctcgtgggagtgttggcgggactggctttccaggagatggagaactttctgggcccagt

SEQ ID NO: 360799 - DNA, 75 bp, Artificial Sequence
  Synthetic
gtgttggcgggactggctttccaggagatggagaactttctgggcccagttgcagttggaggaattctgatgatg

SEQ ID NO: 360800 - DNA, 75 bp, Artificial Sequence
  Synthetic
gagatcagtggaagttctgcccgttatgatgtggccctcagtgaacagggggaattcaaactactctctgaagag

SEQ ID NO: 360801 - DNA, 75 bp, Artificial Sequence
  Synthetic
tgacctcactggctttggtcggagctgctatccatccatttgcactcatgctagttcttgctggttggttgctcc

SEQ ID NO: 360802 - DNA, 75 bp, Artificial Sequence
  Synthetic
agacgtcctctgggatatccccgcacccacaattgttgaggagtgtgaacacttagaggatgggatttatggcat

SEQ ID NO: 360803 - DNA, 75 bp, Artificial Sequence
  Synthetic
cccacaattgttgaggagtgtgaacacttagaggatgggatttatggcattttccagtcgacttttctaggggcc

SEQ ID NO: 360804 - DNA, 75 bp, Artificial Sequence
  Synthetic
aagctggagggcaggtgggatggagaagaggaggttcagttgatcgctgccgcccccggaaagaacgtggtcaat

SEQ ID NO: 360805 - DNA, 75 bp, Artificial Sequence
  Synthetic
gttcagacaaagccaagcctattcaaggttaggaatggcggagaaatcggggcggtggctcttgactacccgagc

SEQ ID NO: 360806 - DNA, 75 bp, Artificial Sequence
  Synthetic
acaatgctaaagaagggaatgacaacaattcttgacttccatcctggggccggaaaaactaggcgctatctgccc

SEQ ID NO: 360807 - DNA, 75 bp, Artificial Sequence
  Synthetic
gacggctgcgcacgcttgttctggctcccactagggttgttctttccgagatgaaggaggcctttcatggcctag

SEQ ID NO: 360808 - DNA, 75 bp, Artificial Sequence
  Synthetic
tcccactagggttgttctttccgagatgaaggaggcctttcatggcctagatgtaaaatttcacacacaggcctt

SEQ ID NO: 360809 - DNA, 75 bp, Artificial Sequence
  Synthetic
gtcattgatgccatgtgtcacgccaccctgacatacaggatgctggagccaactagagtggtgaattgggaggtg

SEQ ID NO: 360810 - DNA, 75 bp, Artificial Sequence
  Synthetic
tagatccggccagtatagcagccagaggctgggcagcgcacagagctagagcaaatgaaagtgcaacaatcttga

SEQ ID NO: 360811 - DNA, 75 bp, Artificial Sequence
  Synthetic
aggcccacggcctggtttcttccatccatcagggctgcgaatgtcatggcagcctctctacgcaaagctgggaag

SEQ ID NO: 360812 - DNA, 75 bp, Artificial Sequence
  Synthetic
ccactctatggcatagaggggacaaagacaccagtctccacaggcgaaatgaggttaagagatgaccaaagaaga

SEQ ID NO: 360813 - DNA, 75 bp, Artificial Sequence
  Synthetic
aaggtccagaggaacacgagatcttgaatgacagtggtgagacagtgaagtgcagggcccctggaggagcgaaga

SEQ ID NO: 360814 - DNA, 75 bp, Artificial Sequence
  Synthetic
gctcttgccgaattcataaagtttgccgagggcaggagaggggcggcagaggtgctagttgtactgagtgagctc

SEQ ID NO: 360815 - DNA, 75 bp, Artificial Sequence
  Synthetic
gagaggcgatggacactatcagtgtgtttttgaactctgaggaaggttccagggcttaccgcaatgcattgtcaa

SEQ ID NO: 360816 - DNA, 75 bp, Artificial Sequence
  Synthetic
gtttttgaactctgaggaaggttccagggcttaccgcaatgcattgtcaatgatgcctgaggcaatgacgatagt

SEQ ID NO: 360817 - DNA, 75 bp, Artificial Sequence
  Synthetic
ttgggggtgtcaaacccacccacatctcctacattatgctgatattctttgtcctaatggtggtggtggttccag

SEQ ID NO: 360818 - DNA, 75 bp, Artificial Sequence
  Synthetic
ctcctacattatgctgatattctttgtcctaatggtggtggtggttccagagccggggcagcagagaaccattca

SEQ ID NO: 360819 - DNA, 75 bp, Artificial Sequence
  Synthetic
tgacgatgctctctccaatgctgcaccattggatcaaggttgagtatggcaacttgtccctgtctggaattgccc

SEQ ID NO: 360820 - DNA, 75 bp, Artificial Sequence
  Synthetic
atgaacatctcggtcataatcctactaattagtggctggaattcaataacagtgatgcctttgctttgtggcatt

SEQ ID NO: 360821 - DNA, 75 bp, Artificial Sequence
  Synthetic
tttggcctctgttgctatgtgcaggacccctttatcattagccgaaggcattgtactggcatcggcagctctggg

SEQ ID NO: 360822 - DNA, 75 bp, Artificial Sequence
  Synthetic
tttggcctctgttgctatgtgcaggacccctttttcattagccgaaggcattgtactggcatcggcagctctggg

SEQ ID NO: 360823 - DNA, 75 bp, Artificial Sequence
  Synthetic
tttggcctctgttgctatgtgcaggacccctttctcattagccgaaggcattgtactggcatcggcagctctggg

SEQ ID NO: 360824 - DNA, 75 bp, Artificial Sequence
  Synthetic
tttggcctctgttgctatgtgcaggacccctttgtcattagccgaaggcattgtactggcatcggcagctctggg

SEQ ID NO: 360825 - DNA, 75 bp, Artificial Sequence
  Synthetic
ctcctgtggaatggacccatggctgtgtccatgacgggagtcatgcgggggaactattatgcctttgtgggtgtc

SEQ ID NO: 360826 - DNA, 75 bp, Artificial Sequence
  Synthetic
tgtccatgacgggagtcatgcgggggaactattatgcctttgtgggtgtcatgtacaatctctggaagatgaata

SEQ ID NO: 360827 - DNA, 75 bp, Artificial Sequence
  Synthetic
agggagctgaacctgctggacaagcaacagtttgagctgtacaaaaggacagacatcgtggaggtggaccgtgaa

SEQ ID NO: 360828 - DNA, 75 bp, Artificial Sequence
  Synthetic
ggaaggtggacactggggtggctgtctcgagagggactgctaaactaagatggtttcatgaacgtggctatgtca

SEQ ID NO: 360829 - DNA, 75 bp, Artificial Sequence
  Synthetic
ctcgagagggactgctaaactaagatggtttcatgaacgtggctatgtcaggctggaaggcagggtgactgacct

SEQ ID NO: 360830 - DNA, 75 bp, Artificial Sequence
  Synthetic
gttcttgacaccgttgagaaatggcttggttgcggtgttgagagcttctgtgtgaaggtgttggctccatacatg

SEQ ID NO: 360831 - DNA, 75 bp, Artificial Sequence
  Synthetic
ggtcatcagaaaccccctttccagaaattctacccatgagatgtattatgtatctggagcccgcagtaacatcac

SEQ ID NO: 360832 - DNA, 75 bp, Artificial Sequence
  Synthetic
cactggatagggcagccattgaagagagggttgaaagaataaaatctgaatacgcagccacctggttccatgaca

SEQ ID NO: 360833 - DNA, 75 bp, Artificial Sequence
  Synthetic
ttattgcggctcctatgtcacaagaacctcagggagcgcagcaagtatgatcaatggagtgatcaagattctgac

SEQ ID NO: 360834 - DNA, 75 bp, Artificial Sequence
  Synthetic
acctcagggagcgcagcaagtatgatcaatggagtgatcaagattctgacatatccctgggataggatagaggag

SEQ ID NO: 360835 - DNA, 75 bp, Artificial Sequence
  Synthetic
caactccttttggacaacaaagagtgtttaaggaaaaagttgataccagagcaaaggatccaccagtagggacca

SEQ ID NO: 360836 - DNA, 75 bp, Artificial Sequence
  Synthetic
ggaaaattatgaaggttgttaataggtggctattccgtcacctggctagggaaaagagccccaggctgtgcacga

SEQ ID NO: 360837 - DNA, 75 bp, Artificial Sequence
  Synthetic
aaaattctgggaattggtggatgaagaacggcggttacatcagcagggtaggtgtcggacctgtgtgtacaacat

SEQ ID NO: 360838 - DNA, 75 bp, Artificial Sequence
  Synthetic
gccctgggattcttaaatgaggaccactgggcatccagggagaattcagggggaggagttgaaggtatcggtctg

SEQ ID NO: 360839 - DNA, 75 bp, Artificial Sequence
  Synthetic
gaactacatgagtccacaccataggaagctggcattggcagtaatggaaatgacatacaaaaacaaggtggtgaa

SEQ ID NO: 360840 - DNA, 75 bp, Artificial Sequence
  Synthetic
tcaggatggcagaagcagagatggtggtgcaccaccagcatgtccaggactgtgacgatgcggttctgacaaaac

SEQ ID NO: 360841 - DNA, 75 bp, Artificial Sequence
  Synthetic
ggtgcaccaccagcatgtccaggactgtgacgatgcggttctgacaaaactcgaggcatggctcgctgagcatgg

SEQ ID NO: 360842 - DNA, 75 bp, Artificial Sequence
  Synthetic
tggaatgaccaacagagccacttgggcatctcacatccacttggtcatacaccgcatccggacactgattgggaa

SEQ ID NO: 360843 - DNA, 75 bp, Artificial Sequence
  Synthetic
gtcatggacagatattctgtggatgctgacctgcagcccggcgagctcatttgagacgccattttgcagggataa

SEQ ID NO: 360844 - DNA, 75 bp, Artificial Sequence
  Synthetic
aacagacctggcccttcaagaggtgttcaaggatttattttcttctttttgtttaacattctgactgggaaaaag

SEQ ID NO: 360845 - DNA, 75 bp, Artificial Sequence
  Synthetic
ggaggatgcttgatccaaggcagggacttgctgtactgcggaaggtcaaaagagttgtagctagcttaatgagag

SEQ ID NO: 360846 - DNA, 75 bp, Artificial Sequence
  Synthetic
acttgctgtactgcggaaggtcaaaagagttgtagctagcttaatgagaggactgtcttccaggaaacgtagatc

SEQ ID NO: 360847 - DNA, 75 bp, Artificial Sequence
  Synthetic
ttgttactgggtttgttggctctatcaggaggagtgaccctcgtcagaaagaacagatggttgctcttgaatgta

SEQ ID NO: 360848 - DNA, 75 bp, Artificial Sequence
  Synthetic
caggaggagtgaccctcgtcagaaagaacagatggttgctcttgaatgtaactgctgaagatctggggaaaacgt

SEQ ID NO: 360849 - DNA, 75 bp, Artificial Sequence
  Synthetic
cacgaatattctggaagcaaaatactggtgccccgactcaatggagtacaattgtcccaatctcagtccaagaga

SEQ ID NO: 360850 - DNA, 75 bp, Artificial Sequence
  Synthetic
tggtgccccgactcaatggagtacaattgtcccaatctcagtccaagagaagagccagatgacatagattgctgg

SEQ ID NO: 360851 - DNA, 75 bp, Artificial Sequence
  Synthetic
tggcctatggaagatgtgatgcggtagggcgatcaaaacgttctaggagagcgattgatctacccacacatgaga

SEQ ID NO: 360852 - DNA, 75 bp, Artificial Sequence
  Synthetic
agggcgatcaaaacgttctaggagagcgattgatctacccacacatgagaaccatggactaaagactcggcagga

SEQ ID NO: 360853 - DNA, 75 bp, Artificial Sequence
  Synthetic
gagaggcagctccagaagattgaaagatggctggttaggaatccattttttgcggtcacagcattggcaatagcc

SEQ ID NO: 360854 - DNA, 75 bp, Artificial Sequence
  Synthetic
gatggctggttaggaatccattttttgcggtcacagcattggcaatagcctatctggtgggtaacaacacgacgc

SEQ ID NO: 360855 - DNA, 75 bp, Artificial Sequence
  Synthetic
tctagcggttggtccagcgtactctgcccattgcatagggataaccgacagagatttcattgaaggtgtccatgg

SEQ ID NO: 360856 - DNA, 75 bp, Artificial Sequence
  Synthetic
gcccattgcatagggataaccgacagagatttcattgaaggtgtccatgggggcacttgggtgtcagccactctg

SEQ ID NO: 360857 - DNA, 75 bp, Artificial Sequence
  Synthetic
tggcccctgacaaaccttctctagacatctcactacagacagtggcaatcgatggaccggctgaagcgaggaagg

SEQ ID NO: 360858 - DNA, 75 bp, Artificial Sequence
  Synthetic
catctcactacagacagtggcaatcgatggaccggctgaagcgaggaaggtttgctacagtgcagtcctaaccca

SEQ ID NO: 360859 - DNA, 75 bp, Artificial Sequence
  Synthetic
agcactggtgaggctcaccttgcagaggaaaatgatggtgacaatgcttgcaaacggacatattctgacagaggc

SEQ ID NO: 360860 - DNA, 75 bp, Artificial Sequence
  Synthetic
aggaaaatgatggtgacaatgcttgcaaacggacatattctgacagaggctggggcaatggctgtggtctatttg

SEQ ID NO: 360861 - DNA, 75 bp, Artificial Sequence
  Synthetic
taagttcacatgtgccaaatctatgagtctctttgaggtggatcagaccaagattcaatatgtcatcagggctca

SEQ ID NO: 360862 - DNA, 75 bp, Artificial Sequence
  Synthetic
agtctctttgaggtggatcagaccaagattcaatatgtcatcagggctcagctccatgtgggtgccaaacaggaa

SEQ ID NO: 360863 - DNA, 75 bp, Artificial Sequence
  Synthetic
tgaaatttgatgctctttctggctcacaggaggctgaattcactggttatggaaaagcaacactggagtgtcagg

SEQ ID NO: 360864 - DNA, 75 bp, Artificial Sequence
  Synthetic
acaggaggctgaattcactggttatggaaaagcaacactggagtgtcaggtccagactgccgtggactttgggaa

SEQ ID NO: 360865 - DNA, 75 bp, Artificial Sequence
  Synthetic
gatagctggatcgttgaccgccaatgggcacaggacttgacactgccatggcagagtgggagtggtggcatatgg

SEQ ID NO: 360866 - DNA, 75 bp, Artificial Sequence
  Synthetic
gggcacaggacttgacactgccatggcagagtgggagtggtggcatatggagagaaatgcaccaccttgttgagt

SEQ ID NO: 360867 - DNA, 75 bp, Artificial Sequence
  Synthetic
tagggtgctggccttgggcaatcaagaaggctccttgaagaccgctctcacaggcgccatgcgcgtcaccaagga

SEQ ID NO: 360868 - DNA, 75 bp, Artificial Sequence
  Synthetic
gaaggctccttgaagaccgctctcacaggcgccatgcgcgtcaccaaggatgagaatgacaacaacttgtacaaa

SEQ ID NO: 360869 - DNA, 75 bp, Artificial Sequence
  Synthetic
gagtgaaactgtcagctctcactctcaaaggaacatcctacaagatgtgtacagacaagatgtcatttgtcaaga

SEQ ID NO: 360870 - DNA, 75 bp, Artificial Sequence
  Synthetic
caaaggaacatcctacaagatgtgtacagacaagatgtcatttgtcaagaatccgacggatacagggcatggcac

SEQ ID NO: 360871 - DNA, 75 bp, Artificial Sequence
  Synthetic
aaaggggccccatgcaagattcccgtgattgtggcagatgacctaacggctgcggtgaacaaaggcatcttggtc

SEQ ID NO: 360872 - DNA, 75 bp, Artificial Sequence
  Synthetic
tgattgtggcagatgacctaacggctgcggtgaacaaaggcatcttggtcactgtcaatcctattgcatccacaa

SEQ ID NO: 360873 - DNA, 75 bp, Artificial Sequence
  Synthetic
caatcccccttttggggatagctacatcatagttgggactggagattcacgactgacctatcagtggcacaaaga

SEQ ID NO: 360874 - DNA, 75 bp, Artificial Sequence
  Synthetic
atcatagttgggactggagattcacgactgacctatcagtggcacaaagaagggagttcaataggaaaattgttt

SEQ ID NO: 360875 - DNA, 75 bp, Artificial Sequence
  Synthetic
gtcttgcagtgatgggtgatgctgcttgggattttagttctgctggggggttcttcacatctgtgggaaaaggaa

SEQ ID NO: 360876 - DNA, 75 bp, Artificial Sequence
  Synthetic
ttgggattttagttctgctggggggttcttcacatctgtgggaaaaggaatccataccgtgtttggctcggcctt

SEQ ID NO: 360877 - DNA, 75 bp, Artificial Sequence
  Synthetic
tggattacgaaagtcatcatgggagccgtactcatctgggtgggaataaacacccgcaacatgaccatgtccatg

SEQ ID NO: 360878 - DNA, 75 bp, Artificial Sequence
  Synthetic
ccgtactcatctgggtgggaataaacacccgcaacatgaccatgtccatgtccatgatcttggtaggtgtgatca

SEQ ID NO: 360879 - DNA, 75 bp, Artificial Sequence
  Synthetic
ggctgaccaaggatgtgctgtcaactttgggaaacgcgagctcaaatgcggagatggcatctttgtgtttagaga

SEQ ID NO: 360880 - DNA, 75 bp, Artificial Sequence
  Synthetic
tttgggaaacgcgagctcaaatgcggagatggcatctttgtgtttagagactctgatgattggctcacaaagtac

SEQ ID NO: 360881 - DNA, 75 bp, Artificial Sequence
  Synthetic
aattggcatccattattaaagcctcccacgaggagggcaaatgtggattgaattcagttgattccctcgaacacg

SEQ ID NO: 360882 - DNA, 75 bp, Artificial Sequence
  Synthetic
ccacgaggagggcaaatgtggattgaattcagttgattccctcgaacacgagatgtggaggagtagggcggatga

SEQ ID NO: 360883 - DNA, 75 bp, Artificial Sequence
  Synthetic
gaggtagacatctcggtcgtcgtccaagacccaaagaacatctatcaaagagggacccacccgttctcaaggatc

SEQ ID NO: 360884 - DNA, 75 bp, Artificial Sequence
  Synthetic
aagacccaaagaacatctatcaaagagggacccacccgttctcaaggatccgtgacggattgcagtatgggtgga

SEQ ID NO: 360885 - DNA, 75 bp, Artificial Sequence
  Synthetic
ctcaccagggaggaagaacggcagcttcatcattgacgggaagtcacgaaaggagtgccccttctctaacagagt

SEQ ID NO: 360886 - DNA, 75 bp, Artificial Sequence
  Synthetic
ttcatcattgacgggaagtcacgaaaggagtgccccttctctaacagagtgtggaactcattccagattgaggag

SEQ ID NO: 360887 - DNA, 75 bp, Artificial Sequence
  Synthetic
gagtttttatggacgcgacctttgactattcagtggactgtgatggagccatcctgggtgcagcggtaaatggaa

SEQ ID NO: 360888 - DNA, 75 bp, Artificial Sequence
  Synthetic
ctattcagtggactgtgatggagccatcctgggtgcagcggtaaatggaaagaagagtgcccatggatcacccac

SEQ ID NO: 360889 - DNA, 75 bp, Artificial Sequence
  Synthetic
aatggaacgtggatgatacacactctggaaactcttgattacaaggagtgtgaatggccactgacacacactatt

SEQ ID NO: 360890 - DNA, 75 bp, Artificial Sequence
  Synthetic
tggaaactcttgattacaaggagtgtgaatggccactgacacacactattggaacctcagtagaagaaagtgaca

SEQ ID NO: 360891 - DNA, 75 bp, Artificial Sequence
  Synthetic
tccggtgagctcccacaaccgcatcccgggttacaaggtgcaaactaatgggccatggatgcaagtccctctgga

SEQ ID NO: 360892 - DNA, 75 bp, Artificial Sequence
  Synthetic
ccgggttacaaggtgcaaactaatgggccatggatgcaagtccctctggaagtaaaaagggaagtctgtccaggg

SEQ ID NO: 360893 - DNA, 75 bp, Artificial Sequence
  Synthetic
gtgatggacgtggaaaatcaacaagatcaaccactgacagtgggaaaataatcccggaatggtgttgcagatcct

SEQ ID NO: 360894 - DNA, 75 bp, Artificial Sequence
  Synthetic
atcaaccactgacagtgggaaaataatcccggaatggtgttgcagatcctgtaccatgcctccagtcagcttcca

SEQ ID NO: 360895 - DNA, 75 bp, Artificial Sequence
  Synthetic
atggagatcagacccatgaaaacatccgacagccacctagtgaggtcctgggtgactgcaggagaagttcatgca

SEQ ID NO: 360896 - DNA, 75 bp, Artificial Sequence
  Synthetic
ccgacagccacctagtgaggtcctgggtgactgcaggagaagttcatgcagtaccctttgggctggtgagcatga

SEQ ID NO: 360897 - DNA, 75 bp, Artificial Sequence
  Synthetic
cagaaggcaaggaccaaaacaaatgctggtaggaggagttgtgctgcttggagcgatgttagtgggacaagtcac

SEQ ID NO: 360898 - DNA, 75 bp, Artificial Sequence
  Synthetic
ctggtaggaggagttgtgctgcttggagcgatgttagtgggacaagtcacagtcttagaccttgtgaagtttgtt

SEQ ID NO: 360899 - DNA, 75 bp, Artificial Sequence
  Synthetic
agattaacaacggaggagatgccatgtacatggcattaattgccagcttttccatccggccaggcctgctcatgg

SEQ ID NO: 360900 - DNA, 75 bp, Artificial Sequence
  Synthetic
gtacatggcattaattgccagcttttccatccggccaggcctgctcatgggctttgggctgcgcacactgtggag

SEQ ID NO: 360901 - DNA, 75 bp, Artificial Sequence
  Synthetic
tttggagcagccatggttgagattgccctaggtggaatgatgggtgggctttggcagtacttgaacgccgtttca

SEQ ID NO: 360902 - DNA, 75 bp, Artificial Sequence
  Synthetic
ccctaggtggaatgatgggtgggctttggcagtacttgaacgccgtttcactgtgtgtgctcaccataaatgcaa

SEQ ID NO: 360903 - DNA, 75 bp, Artificial Sequence
  Synthetic
gatcctccccctgatggcactcatgactcccatgacaatgcatgaggtgaggatggcgacgatgctgttctgcac

SEQ ID NO: 360904 - DNA, 75 bp, Artificial Sequence
  Synthetic
actcccatgacaatgcatgaggtgaggatggcgacgatgctgttctgcactgttgtcataataggggtgcttcat

SEQ ID NO: 360905 - DNA, 75 bp, Artificial Sequence
  Synthetic
aaaagaccattcccattgtagccctgacactgacctcatacatgggcttgacccagccctttctagggctgtgtg

SEQ ID NO: 360906 - DNA, 75 bp, Artificial Sequence
  Synthetic
gacactgacctcatacatgggcttgacccagccctttctagggctgtgtgcatacatgtccacgcaggtgtttgg

SEQ ID NO: 360907 - DNA, 75 bp, Artificial Sequence
  Synthetic
gccttggcagcggctggcttggtgggagtgctagcagggctagccttccaagacatggaaaactttttgggtcca

SEQ ID NO: 360908 - DNA, 75 bp, Artificial Sequence
  Synthetic
gagtgctagcagggctagccttccaagacatggaaaactttttgggtccaatagcggtgggggggatcctcatga

SEQ ID NO: 360909 - DNA, 75 bp, Artificial Sequence
  Synthetic
tgatggactagagctcaagaaacttggtgaaatctcctgggaagaagaagctgaaataagcggaagctctagccg

SEQ ID NO: 360910 - DNA, 75 bp, Artificial Sequence
  Synthetic
ggtgaaatctcctgggaagaagaagctgaaataagcggaagctctagccgctatgatgtggcactcagtgagcag

SEQ ID NO: 360911 - DNA, 75 bp, Artificial Sequence
  Synthetic
acaaagtgccctgggaccagatagtaatgacatccctagccctcgtgggagcagccatacatccatttgccctct

SEQ ID NO: 360912 - DNA, 75 bp, Artificial Sequence
  Synthetic
aatgacatccctagccctcgtgggagcagccatacatccatttgccctcttgctggtcctgggaggatggatcct

SEQ ID NO: 360913 - DNA, 75 bp, Artificial Sequence
  Synthetic
ggggatgttctttgggacattcccacgccaaaggtgattgaggaatgtgagcacctggaggatggaatctatggc

SEQ ID NO: 360914 - DNA, 75 bp, Artificial Sequence
  Synthetic
cgccaaaggtgattgaggaatgtgagcacctggaggatggaatctatggcatattccagtcaaccttccttggag

SEQ ID NO: 360915 - DNA, 75 bp, Artificial Sequence
  Synthetic
gcagggaggggtcttccacacaatgtggcatgtcactaggggagcattcctcttgaggaatggaaagaaactggt

SEQ ID NO: 360916 - DNA, 75 bp, Artificial Sequence
  Synthetic
tggcatgtcactaggggagcattcctcttgaggaatggaaagaaactggttccgtcttgggcttctgtgaaggaa

SEQ ID NO: 360917 - DNA, 75 bp, Artificial Sequence
  Synthetic
ggaaactagacgggagatgggatggtgaggaggaagtccaactcatcgctgctgtgcctggaaaatctgttgtca

SEQ ID NO: 360918 - DNA, 75 bp, Artificial Sequence
  Synthetic
tgaggaggaagtccaactcatcgctgctgtgcctggaaaatctgttgtcaacgttcaaacaaaaccaagcttgtt

SEQ ID NO: 360919 - DNA, 75 bp, Artificial Sequence
  Synthetic
agtaaattttgcgtgctagtcgctgagcgtcagaccgcaaagtgagtttttagtgatctaaagtgaggagttatt

SEQ ID NO: 360920 - DNA, 75 bp, Artificial Sequence
  Synthetic
cttactgtcatcaaacactacaaataaacacgttgaaattatttccggaagaacaactgtccggaatcaaagacg

SEQ ID NO: 360921 - DNA, 75 bp, Artificial Sequence
  Synthetic
atgaaaaatcgtagacaaaacacccgaatttcgggtgtcaatataaaaaagcaaaatccaaaaaacaaaaaacaa

SEQ ID NO: 360922 - DNA, 75 bp, Artificial Sequence
  Synthetic
acaaaaataaaaacatctgttgtaaaaagaggcaagcgctctgtgcaaccttttggattcctgaatccaatcatg

SEQ ID NO: 360923 - DNA, 75 bp, Artificial Sequence
  Synthetic
agagtgcgagctctgatagtctatctaatcaccatgattttgactgggcgccaatggaccaaaggaatgaaactt

SEQ ID NO: 360924 - DNA, 75 bp, Artificial Sequence
  Synthetic
ttctggaagcgggttaacccacagatggctatagcgaccttgaaacgagtccgcaacatcacaaccaatttactg

SEQ ID NO: 360925 - DNA, 75 bp, Artificial Sequence
  Synthetic
actggactcatgaaacggaaacgcagaagctctgtcagttgtgaactcttgttgacactactactgatggtaact

SEQ ID NO: 360926 - DNA, 75 bp, Artificial Sequence
  Synthetic
gtaggagctctacagattgggaggatgagatttgccggaaagatagtactgtcaatcaacgcaacaaaatatgat

SEQ ID NO: 360927 - DNA, 75 bp, Artificial Sequence
  Synthetic
ataggaaaaacatttgatatcatgaacggcacatgcacagtcatggcagtagacgtggggaattggtgtgacgat

SEQ ID NO: 360928 - DNA, 75 bp, Artificial Sequence
  Synthetic
tatgtcatctaccaatgccctactctgacagagaatgaaaatcccgaagacattgactgctggtgctatggagtg

SEQ ID NO: 360929 - DNA, 75 bp, Artificial Sequence
  Synthetic
cccaacgtgtatgtcacatacggacgttgcaaacatgatggacaaccgcgaaggaacagacgatccgtggctttg

SEQ ID NO: 360930 - DNA, 75 bp, Artificial Sequence
  Synthetic
acaaaccatgttgaagaaacattgaacacccgtggagagaggtgggccgtagacaagatagggaaacagcaattt

SEQ ID NO: 360931 - DNA, 75 bp, Artificial Sequence
  Synthetic
gaaaagattgaacgatggatcattcgcaacccgctatatgccctggcagttgttggcattagctacatgctaggg

SEQ ID NO: 360932 - DNA, 75 bp, Artificial Sequence
  Synthetic
agcaacgtaggtcagagaatcattatatgcattctgctgttacttgtcgccccagcatacagcacacactgtaca

SEQ ID NO: 360933 - DNA, 75 bp, Artificial Sequence
  Synthetic
aatgtggaaaaaagagattttctccaaagcacctcgggttcctcgtggacaacggttgtgctggaacatggtgga

SEQ ID NO: 360934 - DNA, 75 bp, Artificial Sequence
  Synthetic
tgtgtaactttgtccgctaaagacaagccaagtgttgacgtatggctgtcatcagtcaccatcaataatccaccg

SEQ ID NO: 360935 - DNA, 75 bp, Artificial Sequence
  Synthetic
ctgacccggaaagtctgctacaaggcaaccctctcagaacataagacagccaaccattgcccaacggcaggagaa

SEQ ID NO: 360936 - DNA, 75 bp, Artificial Sequence
  Synthetic
gcctttttagatgaagagagtgatgaccaacatatttgcaaacgtgggttctctgaccgaggctggggaaatgga

SEQ ID NO: 360937 - DNA, 75 bp, Artificial Sequence
  Synthetic
tgtgggttatttggaaaaggaagtattgtcgcctgctcaaaattcacatgcaatcatgacatgcacctcatggaa

SEQ ID NO: 360938 - DNA, 75 bp, Artificial Sequence
  Synthetic
attgatcaaaataagatacattttaaggtgacagctcaagtgcatacatcagagagagatgccacttcaaaggaa

SEQ ID NO: 360939 - DNA, 75 bp, Artificial Sequence
  Synthetic
tggaaaagagaaacagaattcaccatggcctctggaccacaagtgattggatttgccggatatggcaccgccacg

SEQ ID NO: 360940 - DNA, 75 bp, Artificial Sequence
  Synthetic
gtttcttgcaacctgaaaacatccatggatcttaataactattatgtctcaaaaatggcagatgagtatttcctc

SEQ ID NO: 360941 - DNA, 75 bp, Artificial Sequence
  Synthetic
ctgaacaaacagtgggttatggatttgccactcccgtggacaccagctaccgccacttcctggagggaaaaacat

SEQ ID NO: 360942 - DNA, 75 bp, Artificial Sequence
  Synthetic
tatctcacccactttgatgagccacacgctacaacagtcaccgtcacgagcatggggaaccaagaaggatccctg

SEQ ID NO: 360943 - DNA, 75 bp, Artificial Sequence
  Synthetic
aaggcatccatggttggggctacaaaaatctcttattctgaaaacaaatatcacatcaaaggaggacatgcagtt

SEQ ID NO: 360944 - DNA, 75 bp, Artificial Sequence
  Synthetic
tgccaaatacaactacagggactaaccatgaaaggaagcacatacaccatgtgcaaagggggttactcattttca

SEQ ID NO: 360945 - DNA, 75 bp, Artificial Sequence
  Synthetic
aaaacacctgttgactcgggtcatcaaacagtgataatgaaagttaaagtgtcaaaagccaccccgtgcagaatc

SEQ ID NO: 360946 - DNA, 75 bp, Artificial Sequence
  Synthetic
cctgtggcagtcattgactcaatgcagagcaacattaataggggagttgttgtcaccaccaaccccgtggccttt

SEQ ID NO: 360947 - DNA, 75 bp, Artificial Sequence
  Synthetic
gaggctgcaacggaagtgatgattgaagtcgttcctccgtttggagagagtgtgatcacgattggaaacggagag

SEQ ID NO: 360948 - DNA, 75 bp, Artificial Sequence
  Synthetic
gacaggctgacctaccaatggcatcaagaagggagcacgatagggaaagcgttctcagagaccctaaaaggactc

SEQ ID NO: 360949 - DNA, 75 bp, Artificial Sequence
  Synthetic
gaacgactcacaatcattggagatgacgcgtgggatttcggatccacggggggaattttcaacacaattgggaag

SEQ ID NO: 360950 - DNA, 75 bp, Artificial Sequence
  Synthetic
gccatccatacagttttcggaggggctttttcggccgtctttggtggcgtcagctggattgtgaaactactctta

SEQ ID NO: 360951 - DNA, 75 bp, Artificial Sequence
  Synthetic
ggagtagcatttctatggctgggagtcaatgcgaggaatggaaccctaactcttatcttgatgactttgggggga

SEQ ID NO: 360952 - DNA, 75 bp, Artificial Sequence
  Synthetic
atcctaatttttctgggaactggagttggagccgaacaagcctgcgctgtctcatgggagagaagagagttcaaa

SEQ ID NO: 360953 - DNA, 75 bp, Artificial Sequence
  Synthetic
tgcggagatggcatgttcattttccgagacacaaatgacttcttgggcaagtacaagatgtacccaacatcgccg

SEQ ID NO: 360954 - DNA, 75 bp, Artificial Sequence
  Synthetic
cgtgaaattgctgccgtcattgcacaaacattctcaaatggcgcatgtgggctcaactctgtggatgagttagaa

SEQ ID NO: 360955 - DNA, 75 bp, Artificial Sequence
  Synthetic
caccaaatgtggaaaggaattgaagatgaaattaaccacgttctaagtgagaatggtctggatctgtctgtagtc

SEQ ID NO: 360956 - DNA, 75 bp, Artificial Sequence
  Synthetic
gtgcaggacccccacaacatttatagaagaggaggaaaaagtttttcaccagcccaacgaacgttggaatatgga

SEQ ID NO: 360957 - DNA, 75 bp, Artificial Sequence
  Synthetic
tggaaaacgtggggaaagtccttctactctgcagtagagaggaaaaacaattcctttattatagatgccctagat

SEQ ID NO: 360958 - DNA, 75 bp, Artificial Sequence
  Synthetic
caaaatgaatgcaaaaatgctgaaagggtatggaattctttagaactggaggaatttggatttggggtttttaaa

SEQ ID NO: 360959 - DNA, 75 bp, Artificial Sequence
  Synthetic
acaaagctcttccttaaaccaaggtttgattactcaaagaaatgtccgacatacctgttaggaacagcggtgaaa

SEQ ID NO: 360960 - DNA, 75 bp, Artificial Sequence
  Synthetic
catgccagggcagtccatggtgaccagaacatgtggatggagtctgagcatgtcaatggaacttggcaaattacc

SEQ ID NO: 360961 - DNA, 75 bp, Artificial Sequence
  Synthetic
agattggaattacaatcatacagggaatgtctttggcctccaatgcacacagcaggaatcacttctgtgatggaa

SEQ ID NO: 360962 - DNA, 75 bp, Artificial Sequence
  Synthetic
agtgatttgttcatgccccgagagctgggaggacctgtcaccttacataaccatatcccaggttacgcgacacag

SEQ ID NO: 360963 - DNA, 75 bp, Artificial Sequence
  Synthetic
gtttatggagcctggcatttaccgaatatggaactgaaaagggaagaatgccctggcactacggtgcaggtaaaa

SEQ ID NO: 360964 - DNA, 75 bp, Artificial Sequence
  Synthetic
gacaattgtggaaaacgtggtccatcagttagatcaaccacagcaagtaacaaagtgataccccattggtgttgt

SEQ ID NO: 360965 - DNA, 75 bp, Artificial Sequence
  Synthetic
cgttcctgcaccatgccacccgtgacctatagaacagcaaatgagtgttggtatgcaatggaaattagacctgaa

SEQ ID NO: 360966 - DNA, 75 bp, Artificial Sequence
  Synthetic
aacatgcaggaagaacacctggtgaaaagctgggtctcggccggggaaggaagaatgtgcgatcatttctcagga

SEQ ID NO: 360967 - DNA, 75 bp, Artificial Sequence
  Synthetic
gggctgtttgccttaatcattttgatggacttgataatacaccatcgtctctctccacgcaagcatttgctccta

SEQ ID NO: 360968 - DNA, 75 bp, Artificial Sequence
  Synthetic
atcctgctgttagcgctcctaaccgtgttcggaggagtttccatgcgtgatcttgcacgatgtttgctcttactc

SEQ ID NO: 360969 - DNA, 75 bp, Artificial Sequence
  Synthetic
ggacacacatttaacaccatgaactctggtactgaagtcgctcatttggcaatggtggcactcaccaaattgcgg

SEQ ID NO: 360970 - DNA, 75 bp, Artificial Sequence
  Synthetic
gctggcttcataactggatactttcttgcgcgaccccttggaccgagagggaaatttctcctcgttgtggccttg

SEQ ID NO: 360971 - DNA, 75 bp, Artificial Sequence
  Synthetic
tctttactgcagacgacactccccatgaacatggaattcatggaatgggccgactcattgggacttgtgctggcg

SEQ ID NO: 360972 - DNA, 75 bp, Artificial Sequence
  Synthetic
ctggcagatgccctctacacaatgcatgccgacagctggacaatgctaggtctgatagccctaaacccacttgga

SEQ ID NO: 360973 - DNA, 75 bp, Artificial Sequence
  Synthetic
aaccacatgttagtgaagacagtcacaacgatactgttctcggtgtgtgcttttgtgctagtcacaagaaaatca

SEQ ID NO: 360974 - DNA, 75 bp, Artificial Sequence
  Synthetic
acatccataagaaaaacttatccccaactgataactgcggggttagtggaactagggatgctgcgagggtggatc

SEQ ID NO: 360975 - DNA, 75 bp, Artificial Sequence
  Synthetic
ctaggtctccttgttgggctgcacaggaaaaacaatggcaaggttcggtcgattgattggactgatggagtcact

SEQ ID NO: 360976 - DNA, 75 bp, Artificial Sequence
  Synthetic
gtcctaggtgtagtagctggcttactagggatgctttgtggagaacgtgaggagttactggctccattcgtcatt

SEQ ID NO: 360977 - DNA, 75 bp, Artificial Sequence
  Synthetic
gggtcaatcctgctactttgctacgtgttcagcatgaagagtgacggattagaacttgaacgggttgctgatgtg

SEQ ID NO: 360978 - DNA, 75 bp, Artificial Sequence
  Synthetic
acctgggatgaagaagctgagtattccggagaagcggagcggtttgatgtgacggtcaatcacaatggggaattc

SEQ ID NO: 360979 - DNA, 75 bp, Artificial Sequence
  Synthetic
aatctgatagaccagaaaccagtaccatggtcacacgtcctgatgggcacaggtctgttaatagtgtcaactgtg

SEQ ID NO: 360980 - DNA, 75 bp, Artificial Sequence
  Synthetic
cacccagctggattggttctggccgctttcgcattctggtattatcagtacaccaagcaacgcagcaatattcta

SEQ ID NO: 360981 - DNA, 75 bp, Artificial Sequence
  Synthetic
tgggaactaccagaagtcgccgagcggacaccaatgttgactgaaggagtgcctgatggagtgtaccgtatcatg

SEQ ID NO: 360982 - DNA, 75 bp, Artificial Sequence
  Synthetic
cagaagggggtgtttggaccacagcaaaaaggagtaggggtaggaaaaagcggaaccttccacacgatgtggcat

SEQ ID NO: 360983 - DNA, 75 bp, Artificial Sequence
  Synthetic
gtaacccacggttcattattaagattaaatgggaaactggtcactccaagctgggcgaatgtaaaaaaggactta

SEQ ID NO: 360984 - DNA, 75 bp, Artificial Sequence
  Synthetic
atcgcttatggcgggccatggcggttaacagatcagtgggtagaaaatgaggatgtccaagtgatagtgtgctct

SEQ ID NO: 360985 - DNA, 75 bp, Artificial Sequence
  Synthetic
cccagagctgtgatcagaaacgtccagactactccaggtatgttcaccaccattgaggggaagaaaatcggagct

SEQ ID NO: 360986 - DNA, 75 bp, Artificial Sequence
  Synthetic
gtgtcactggattacccgccaggaacatcaggttcgcccattatcaacaaaagaggtgaggttattggactatat

SEQ ID NO: 360987 - DNA, 75 bp, Artificial Sequence
  Synthetic
ggaaatggaatcctcacagaggagaagaggtttgtatcctccatagcccaagcaagcgttgaggagactgccagt

SEQ ID NO: 360988 - DNA, 75 bp, Artificial Sequence
  Synthetic
ccaacacctgacatttctctgtcaaaaggaaacctgcatgtgttagacctgcatccaggatctgggaaaacccga

SEQ ID NO: 360989 - DNA, 75 bp, Artificial Sequence
  Synthetic
caagtactgcccgctcttcttaggaaatgtgtggaaaaaaggcttagaacactcgtcctggctccaacaaaagta

SEQ ID NO: 360990 - DNA, 75 bp, Artificial Sequence
  Synthetic
gtgttgagtgaaatgcatgaagcagttaaagacttaccagttaggttccacacgagcgccgcgctggaaacaaag

SEQ ID NO: 360991 - DNA, 75 bp, Artificial Sequence
  Synthetic
aaaacaggagccctgatagacttgatgtgccatgctactctagcaaaccgcctcttggaaccaacacgttacgtt

SEQ ID NO: 360992 - DNA, 75 bp, Artificial Sequence
  Synthetic
aactgggaagtggtcgtcatggacgaggctcactttcttgacccacacagcatagctgtgagagggtggatgcaa

SEQ ID NO: 360993 - DNA, 75 bp, Artificial Sequence
  Synthetic
caattggtgactctcaagttggcagcagttgtgttaatgacagcaacacctcctggaacaagtgatccattcccg

SEQ ID NO: 360994 - DNA, 75 bp, Artificial Sequence
  Synthetic
gagtctaatgggacaatagaagacacacaggtgactattccagatgaaccttggaaaagaggcaacgaatggata

SEQ ID NO: 360995 - DNA, 75 bp, Artificial Sequence
  Synthetic
cttgatgatccccggccaactgcgtggttcctgccttccatcaaagcaagtaacattatggctgcttttctaaaa

SEQ ID NO: 360996 - DNA, 75 bp, Artificial Sequence
  Synthetic
aagaatgggaaaaaagttgtggttctgaataggaaaacatttgacaaagaatatggaacgttgaaagcggaaaag

SEQ ID NO: 360997 - DNA, 75 bp, Artificial Sequence
  Synthetic
cctgacttcatactgaccacagacattgctgaaatgggagcaaacctgcctgttgaaagagtgattgacccaagg

SEQ ID NO: 360998 - DNA, 75 bp, Artificial Sequence
  Synthetic
acatgcatgcgtccagtgttagtggatgagaaaaatagagtggagctgcagggaccccttcccatcacagcttct

SEQ ID NO: 360999 - DNA, 75 bp, Artificial Sequence
  Synthetic
tcagctgcgcagcggaggggcaggataggaagaaacccagatcgcaacacggactcttacatgtatgaaggggag

SEQ ID NO: 361000 - DNA, 75 bp, Artificial Sequence
  Synthetic
accagtgaagaaaatggagatttggtgtgctggaaagaagcgttgatgatcctggataacatggaaatccctgga

SEQ ID NO: 361001 - DNA, 75 bp, Artificial Sequence
  Synthetic
ggattcacgatgagcctctttggtagtgaggctaggaaagtcgagcacgttccaggggaataccgtttaaaacca

SEQ ID NO: 361002 - DNA, 75 bp, Artificial Sequence
  Synthetic
gaagcaaggaaacggttcaggcaactgatgaggaagtatgagtttacaccatggttggcttggaaagtcgcaaag

SEQ ID NO: 361003 - DNA, 75 bp, Artificial Sequence
  Synthetic
aataccaaagagatggaaatgtcttggatagtgcaaggacctaaagagaacagagtcttaaatgagtttggtgag

SEQ ID NO: 361004 - DNA, 75 bp, Artificial Sequence
  Synthetic
aacctgacgttcaaaagcaggtatggctcaattgagaaaatacaaccaatctggagcgatgctagaatgtttgct

SEQ ID NO: 361005 - DNA, 75 bp, Artificial Sequence
  Synthetic
gacggacagacccaaaaagcgttcatagagtacgcaacaacaacacgatcaataacagccgtgatcgaaaaggtg

SEQ ID NO: 361006 - DNA, 75 bp, Artificial Sequence
  Synthetic
gctatggtgccagaggccttaaaagacaaggtgcaggatgctttcgacacctactacactttgtacaaggcagaa

SEQ ID NO: 361007 - DNA, 75 bp, Artificial Sequence
  Synthetic
gaaaaatcacgcagttaccaaatcgctcttgaacagatacctgatgccctaataacgacattgtgcttgggagcc

SEQ ID NO: 361008 - DNA, 75 bp, Artificial Sequence
  Synthetic
ttggctgcagccacaggaggaatccttctctatttgttgctgccaaaaggaatgtctcgcatgacactggctttc

SEQ ID NO: 361009 - DNA, 75 bp, Artificial Sequence
  Synthetic
ttcactatgttggtaacgggggctggtttatggatgggaggactatcaacagtgaaggtggccagtgctatgctg

SEQ ID NO: 361010 - DNA, 75 bp, Artificial Sequence
  Synthetic
gtctttttcatactgtgtgttgtgctgattccagacactggaatgcaacgttccatccaagataactacttggct

SEQ ID NO: 361011 - DNA, 75 bp, Artificial Sequence
  Synthetic
tacttcatcatcagtctaataagctgtgtggcccttattgtcgccaacgaaaacggctacctggagaaaactaaa

SEQ ID NO: 361012 - DNA, 75 bp, Artificial Sequence
  Synthetic
gaggatctatttggaaggagagcgctgaacagctcaaatgtttatgccaacttgccagtggaaaagtggctgagc

SEQ ID NO: 361013 - DNA, 75 bp, Artificial Sequence
  Synthetic
cttgacttacagcctgccacttcctggacactctatgctgtaatagtgggggtgttgtcaccgctgtaccaccat

SEQ ID NO: 361014 - DNA, 75 bp, Artificial Sequence
  Synthetic
atcgaacacgtcaactatggagccatatcattacagggaatatcccagggagcggctgccctttttcagatggac

SEQ ID NO: 361015 - DNA, 75 bp, Artificial Sequence
  Synthetic
aaggggtatcctttcatgcggttgagaattccgctggttctgctgttggcaggggccatcaacaacctcactgcc

SEQ ID NO: 361016 - DNA, 75 bp, Artificial Sequence
  Synthetic
atcacagcaggactagggttcctatgtgctatgatacattgggctttggttttgcctggcttgaaggccaaatta

SEQ ID NO: 361017 - DNA, 75 bp, Artificial Sequence
  Synthetic
gcaaaacaggcgttgcgcagaacgtaccatggggtcacaaaaaacgctgtggtggacggcatgtgcacaaatgac

SEQ ID NO: 361018 - DNA, 75 bp, Artificial Sequence
  Synthetic
ctagatgctggggacgacatgcctgaaaagtttgagaaacaactaggaacctttgtgctcatcacccttgttttc

SEQ ID NO: 361019 - DNA, 75 bp, Artificial Sequence
  Synthetic
ttaaacgtaattctgaatcacaatgtaaaggcttttctggagggaatggttctggtatccgccagcctgcaacca

SEQ ID NO: 361020 - DNA, 75 bp, Artificial Sequence
  Synthetic
ttattgacaggggttccaaatccgtactggaatcaacaaatagctgtaggtgtggcaggtctcatgagaggaaac

SEQ ID NO: 361021 - DNA, 75 bp, Artificial Sequence
  Synthetic
tacatggctgcagtaggaatggctcatgccttatggaatgcccaggcaaatcgcagaggtggcacaggatccgga

SEQ ID NO: 361022 - DNA, 75 bp, Artificial Sequence
  Synthetic
atgaccccaggggaggcttggaagaaacagctgaataagcttgggaaaacacaatttgagcagtacaagagatca

SEQ ID NO: 361023 - DNA, 75 bp, Artificial Sequence
  Synthetic
tgcatacttgaagtggacaggacacatgccagagactctttgaaaaatggcattcagaatgggatagctgtctcc

SEQ ID NO: 361024 - DNA, 75 bp, Artificial Sequence
  Synthetic
agagggagcgcaaagttaaggtggatggaagaaagaggctacgtgaaaccaactggaatcgtggttgacctcggc

SEQ ID NO: 361025 - DNA, 75 bp, Artificial Sequence
  Synthetic
tgcggtcgaggggggtggagttactatgctgcttcgctgaaaaatgtgaaaaaagtaatggccttcaccctgggt

SEQ ID NO: 361026 - DNA, 75 bp, Artificial Sequence
  Synthetic
gtgcaagggcatgaaaagccaataatgagaacaactctagggtggaatctcataagattcaaggacaagacagat

SEQ ID NO: 361027 - DNA, 75 bp, Artificial Sequence
  Synthetic
gtgttcaacatggaagtaatccctggggacacactgttatgtgacattggagaaagttcaccgagcattgcagtg

SEQ ID NO: 361028 - DNA, 75 bp, Artificial Sequence
  Synthetic
gaagaacagcgcaccctaaaagtcttaaattgtgcaaaacaatggctacaggagggaaattacaccgagttctgc

SEQ ID NO: 361029 - DNA, 75 bp, Artificial Sequence
  Synthetic
atcaaggtgttgtgtccctacacccctctcataatggaagaactctccaggttacaactaaagcatggaggaggc

SEQ ID NO: 361030 - DNA, 75 bp, Artificial Sequence
  Synthetic
ttggttagggtgccactttcccgtaactcaactcatgagatgtattgggtgtcaggaacaagaactgatgtggtg

SEQ ID NO: 361031 - DNA, 75 bp, Artificial Sequence
  Synthetic
ggcaccgtgtcaaatgtgtcgcggttgttgaccaggaggatgttgaataagccgcaacccccaacactggaagat

SEQ ID NO: 361032 - DNA, 75 bp, Artificial Sequence
  Synthetic
gacgtgattctggatatgggcacccgaagcatggaatgtgatacaggtcctattgatgaggacaagataagacga

SEQ ID NO: 361033 - DNA, 75 bp, Artificial Sequence
  Synthetic
cgggtggaccttctaagagaagagtacaagaagacctggttccatgatttaaaccatccatacaggacgtggcat

SEQ ID NO: 361034 - DNA, 75 bp, Artificial Sequence
  Synthetic
tacattggctcttacttgacaagaggaggaggaacagcggcatccatgaccaatggcatagtcaaactcatgtca

SEQ ID NO: 361035 - DNA, 75 bp, Artificial Sequence
  Synthetic
caaccatgggacgcagtggctggggtggcatgcatggccatgactgacacaacaccatttggacagcagagagtg

SEQ ID NO: 361036 - DNA, 75 bp, Artificial Sequence
  Synthetic
tttaaagagaaagtggataccaaaccgccagaacccaacaagacagtgcgtcatgtgatggccatgactaatagc

SEQ ID NO: 361037 - DNA, 75 bp, Artificial Sequence
  Synthetic
tggatcatgaaatacttggccaggaataagcaaccacggctgtgcactaaggaagagttcatagctaaggttcga

SEQ ID NO: 361038 - DNA, 75 bp, Artificial Sequence
  Synthetic
tcccacgctgccctcggagctttcgttccagagttggaaggttggagttcagcacatgaggccgtccatgatcaa

SEQ ID NO: 361039 - DNA, 75 bp, Artificial Sequence
  Synthetic
cggttctggaaacttgttgatgaggaaagggagttgcacaaaaaaggtgaatgtagaacatgtgtgtacaacatg

SEQ ID NO: 361040 - DNA, 75 bp, Artificial Sequence
  Synthetic
atggggaaacgagagaagaaaccatctgaatttgggaaagccaaagggagccgagccatatggtatatgtggctc

SEQ ID NO: 361041 - DNA, 75 bp, Artificial Sequence
  Synthetic
ggagctcggtttcttgagtttgaggcactgggtttcttaaatgaagatcactgggtctcccggaagaactctctg

SEQ ID NO: 361042 - DNA, 75 bp, Artificial Sequence
  Synthetic
agcggagtggaaggcgttgggctgcaatacctcggccatgttctgaaaacattggaaagaaaaagtgggacgtcc

SEQ ID NO: 361043 - DNA, 75 bp, Artificial Sequence
  Synthetic
tattatgcagatgacacggctggatgggataccaggataacgatagctgatctagaagatgagcaagacatcttg

SEQ ID NO: 361044 - DNA, 75 bp, Artificial Sequence
  Synthetic
acttacatgagactagagcaccgaatcctggccgaagctgtaatgaacctggcatacaaacacaaagtggttagg

SEQ ID NO: 361045 - DNA, 75 bp, Artificial Sequence
  Synthetic
gttgaaagacctattcagggcgggaaaactgcaatggacatcatctataggcaggagcatcgaggatctgggcag

SEQ ID NO: 361046 - DNA, 75 bp, Artificial Sequence
  Synthetic
gtggtgacgtacgcgttcaacaccatcacaaacatgaaggtccaattgataagaatggccgagagtgaagaagtc

SEQ ID NO: 361047 - DNA, 75 bp, Artificial Sequence
  Synthetic
ctacctgacccgtcccaagaatggactccagaacacggaaacacactatggcaatggctgaatgaaaatggggaa

SEQ ID NO: 361048 - DNA, 75 bp, Artificial Sequence
  Synthetic
gacagacttggcagaatggctgttagtggagatgactgcgtggtgaaacctatagatgatcgcttcgcaacatcc

SEQ ID NO: 361049 - DNA, 75 bp, Artificial Sequence
  Synthetic
ttgacttacctgaaccacatggccaaaataaggaaagatatatctgagtggaagccatcaaaaccattcatggac

SEQ ID NO: 361050 - DNA, 75 bp, Artificial Sequence
  Synthetic
atcgaggaagttcctttctgctcccaccatttccacaaactcatcctccgggatggaagagagataatggcccct

SEQ ID NO: 361051 - DNA, 75 bp, Artificial Sequence
  Synthetic
tgcagagaacaggatgagctgatcgggagggctaggatttcccctggaaatggctggttggttagagagactgcc

SEQ ID NO: 361052 - DNA, 75 bp, Artificial Sequence
  Synthetic
ccattaagcaaggcctatgctaacatgtggaaactgttttactttcaccgtagagatctaaggctgatggctaat

SEQ ID NO: 361053 - DNA, 75 bp, Artificial Sequence
  Synthetic
gcaatcaactcagctgtccccattgactgggtcccaacgggacgtaccacatggtcagttcatggaaaaggagag

SEQ ID NO: 361054 - DNA, 75 bp, Artificial Sequence
  Synthetic
tggatgacgtcagaagacatgctagatgtgtggaatagagtatggatcaccgacaaccccttcatgaaccggaaa

SEQ ID NO: 361055 - DNA, 75 bp, Artificial Sequence
  Synthetic
actttgatagggaagtggcaggacatcccgtacatttccaagtcacaggatgtccgttgtggctcaatgattggc

SEQ ID NO: 361056 - DNA, 75 bp, Artificial Sequence
  Synthetic
acatcaaagagaagcagttgggctgaagctcttcctcacactgtacaaaaggtgagaggcattgtggggacacaa

SEQ ID NO: 361057 - DNA, 75 bp, Artificial Sequence
  Synthetic
gagaggtaccgtgattaccttgaaactcaaaacaggttcaggaccatagtccaacatcttgttggagatatcctg

SEQ ID NO: 361058 - DNA, 75 bp, Artificial Sequence
  Synthetic
tgagagcaataaaaaattttaaagacaaaagtgtcaggccaagattgagaaaatcttgccacagcttggcagact

SEQ ID NO: 361059 - DNA, 75 bp, Artificial Sequence
  Synthetic
gtgcagcctgcagccctagagggagactgaccaactccctttagtagaaaaggtcagggaagaacttgaggatgg

SEQ ID NO: 361060 - DNA, 75 bp, Artificial Sequence
  Synthetic
gtgtggcctcaagatctcttctcaaaaaacggactgaacaccacacctagatgaagatagtaggggagcctccgc

SEQ ID NO: 361061 - DNA, 75 bp, Artificial Sequence
  Synthetic
caatggtggctttacatattgagctactgcattggtcgatggggactagcggttagaggagaccctctcctacgc

SEQ ID NO: 361062 - DNA, 75 bp, Artificial Sequence
  Synthetic
atggattttgcaatatgttgacatcagggaaagaccgggtgtttgtcggttccggagagctccggaggccagggc

SEQ ID NO: 361063 - DNA, 75 bp, Artificial Sequence
  Synthetic
agctccggaggccagggcgccgtttgcccgtagtttataactggccttcggggatcgaaggagttgccaaacact

SEQ ID NO: 361064 - DNA, 75 bp, Artificial Sequence
  Synthetic
acgaagaccaacaaaccatttaaagcattacaagaatcaagaaaaccgtcagcaggaatcagccatgttctccaa

SEQ ID NO: 361065 - DNA, 75 bp, Artificial Sequence
  Synthetic
aattaaacatatcgcttctggcgcagatgtggaagttcgacttccagctagcgaggatccggtggagtacccgag

SEQ ID NO: 361066 - DNA, 75 bp, Artificial Sequence
  Synthetic
cgaattcttttcaaaactgcagcagaaaccaaaactatacgtggcagacgggcacaccgtggagcagttgagaca

SEQ ID NO: 361067 - DNA, 75 bp, Artificial Sequence
  Synthetic
attcgtagaacaagggctgatctccagaaatgtaaacatagtgcatatcaattcttacctgtatcatgtactcaa

SEQ ID NO: 361068 - DNA, 75 bp, Artificial Sequence
  Synthetic
ggatactgaagcgttgtgcgatagagactggacatccttcggtatcaatatagggaaggccggatcgaaagtaaa

SEQ ID NO: 361069 - DNA, 75 bp, Artificial Sequence
  Synthetic
gatatttgacatgctagatgttgagtatctcgaaaacaagcccaatgcggggcaggcatgtcccgaggcttgcaa

SEQ ID NO: 361070 - DNA, 75 bp, Artificial Sequence
  Synthetic
ggacgacgatgtttggcttcctatgtatctgctgggtctttatagagtaggcagggcaaccgtcccatcttatca

SEQ ID NO: 361071 - DNA, 75 bp, Artificial Sequence
  Synthetic
gaatgatctcatggaggctctgaacactcagtgtaagtttaggtctcccaaatttcgagagctggtgcaggctca

SEQ ID NO: 361072 - DNA, 75 bp, Artificial Sequence
  Synthetic
gagtgatttttatgaagcctggtcaaatgatctgaacttcaccagaattgtggcagcggttgacatgttctttca

SEQ ID NO: 361073 - DNA, 75 bp, Artificial Sequence
  Synthetic
ccgcttcaagaaacattctgatgcaggcctcaggttcggcaccatagtctcgagattcagagattgtgccagtct

SEQ ID NO: 361074 - DNA, 75 bp, Artificial Sequence
  Synthetic
gtcgacattccatcacctcgtcaagatcactgggctgagccttgctgatgtgggctcttggattcttaatgacca

SEQ ID NO: 361075 - DNA, 75 bp, Artificial Sequence
  Synthetic
ggtagcccgggaaattatccaaatgatgaggccaggtcaagagattgatcatgctgattcttacatgccatacct

SEQ ID NO: 361076 - DNA, 75 bp, Artificial Sequence
  Synthetic
catcgatatggggctgtctactaaatctccttactcctctgtgaagaatccttgcttccatttctggggacaaat

SEQ ID NO: 361077 - DNA, 75 bp, Artificial Sequence
  Synthetic
gaccgctcttctactgcgctcctctcgagccaagcatgcacgggtaccggatgatattccatacccatctatcac

SEQ ID NO: 361078 - DNA, 75 bp, Artificial Sequence
  Synthetic
caatgcggccttgcttttcgcttatgcagtcggccgaacctcagatattgcccagcgcttcacaacgggggatgt

SEQ ID NO: 361079 - DNA, 75 bp, Artificial Sequence
  Synthetic
gtatgagtcgtcaaagaaggggggtgccagcaagcttctcagtgtcgccagcgttgccgagcccgagactagtga

SEQ ID NO: 361080 - DNA, 75 bp, Artificial Sequence
  Synthetic
ggtcatcaagtggctagcctggtgggacgacaaaggcaagagtcccaccaaagagatggaatcatttgccagaag

SEQ ID NO: 361081 - DNA, 75 bp, Artificial Sequence
  Synthetic
agcggttcacgcgttgactgacctgagggccaactccattgggaaatatgccaagactcacttcgatcagtgatt

SEQ ID NO: 361082 - DNA, 75 bp, Artificial Sequence
  Synthetic
gctttccttttctgcaaggatatgaaaaaaatcagcaggaatcatggagaattctcgcgccgtttccgaagccct

SEQ ID NO: 361083 - DNA, 75 bp, Artificial Sequence
  Synthetic
caaggcctaccccaagttggatgcagcagtggccgaggcagacatcaatgagtccatgctgatgcccccagacga

SEQ ID NO: 361084 - DNA, 75 bp, Artificial Sequence
  Synthetic
accatctaacaatgagagtcaggagggggaaagattttacttaaccgaccaactggatgggttggactcgctcag

SEQ ID NO: 361085 - DNA, 75 bp, Artificial Sequence
  Synthetic
ctcggagtcatctgaagattcagacccagaagaagagattgtaaatcgttgctatcccaaccagctggacataca

SEQ ID NO: 361086 - DNA, 75 bp, Artificial Sequence
  Synthetic
tggtgaggagtacgatgacaatagggattctgaccccattgaggatctgtccagggatgatgatgatcagggggt

SEQ ID NO: 361087 - DNA, 75 bp, Artificial Sequence
  Synthetic
ggaggacgaatcagagtatgaagtttcgtttaattcaacaaatcctatcatagatcttagtgatgtcaggtatcc

SEQ ID NO: 361088 - DNA, 75 bp, Artificial Sequence
  Synthetic
tgttagacaaatgatcttagctcaaatgtctgaggccctagatagaatccaaagaagtccaagggtgaaatatat

SEQ ID NO: 361089 - DNA, 75 bp, Artificial Sequence
  Synthetic
tgtcgttatgtctggggatgtgattgaatttatcccaatagaagagcctgtatctgctccacctcctttcactcc

SEQ ID NO: 361090 - DNA, 75 bp, Artificial Sequence
  Synthetic
tgctgaccatacctccacaagcttggatatggttcccgaagccagttcaccggaatctgaagagataccctctgt

SEQ ID NO: 361091 - DNA, 75 bp, Artificial Sequence
  Synthetic
gccggatcccggagagctcctaagaaaggtgttctatctaccacacaagaaaggaggagacccgttaaaaacatc

SEQ ID NO: 361092 - DNA, 75 bp, Artificial Sequence
  Synthetic
ttgtgtggaattgtttggatctctgagcatggctgctgaagctttcgacaacggagcaatgagttttagggagct

SEQ ID NO: 361093 - DNA, 75 bp, Artificial Sequence
  Synthetic
ggttgagcttgggctcaagcagaggggggtgtttaatcgaattcgtatagaatacgacataatgcctgtgttcac

SEQ ID NO: 361094 - DNA, 75 bp, Artificial Sequence
  Synthetic
tgcttaagatagtatgaaaaaaaaatttaacaggaatcctgcttatactgttgagatgaaaggattccgtgagat

SEQ ID NO: 361095 - DNA, 75 bp, Artificial Sequence
  Synthetic
cttcaagagcaccaaaagagatggtccgagcagtggttccaaccccaagaaggaaaaaggcaaacgtaaagacaa

SEQ ID NO: 361096 - DNA, 75 bp, Artificial Sequence
  Synthetic
aaagaagggggcccagatggacgatgagcgcccacccgcctatttccacgtcagcccagagtggggagccccttc

SEQ ID NO: 361097 - DNA, 75 bp, Artificial Sequence
  Synthetic
tgctcctctgtttggctatgatgagtcttatgaggaaccgagttccgtgatagctactaaggttcaatacaagtt

SEQ ID NO: 361098 - DNA, 75 bp, Artificial Sequence
  Synthetic
ctctttggatgtagccgtgaattatccattcgccaacttcattgaggcgctacacgggttgaagcactggtgcga

SEQ ID NO: 361099 - DNA, 75 bp, Artificial Sequence
  Synthetic
cgactacagaggcctttttgacaagagaggcatttacaacatactcatgctttatgcagcgcgccgactcaaggc

SEQ ID NO: 361100 - DNA, 75 bp, Artificial Sequence
  Synthetic
gggacctaaaagtatttacaacggaagaagcattgaataccactccactggcagcggaaagttcactcttcacca

SEQ ID NO: 361101 - DNA, 75 bp, Artificial Sequence
  Synthetic
cactctgaaaaatctattcaatatggattttacttccgagcagtttgtgcgttcatggacagaccccctgaggag

SEQ ID NO: 361102 - DNA, 75 bp, Artificial Sequence
  Synthetic
cggtactcttaacttcttcgtatgggtgggagagacagatactcaagatgaactaccccctatgatcggacccgc

SEQ ID NO: 361103 - DNA, 75 bp, Artificial Sequence
  Synthetic
cgaatttagcgatgccactgagttcaataccggatgtgaggtactagggatcaaaatcgaagttcagtcggacaa

SEQ ID NO: 361104 - DNA, 75 bp, Artificial Sequence
  Synthetic
cacatgggtggtggtagaggcctaaggtatgaaaaaaatcagcaggcatctctgccttatatccaaagcaatcat

SEQ ID NO: 361105 - DNA, 75 bp, Artificial Sequence
  Synthetic
gatctcgtccaccctcatacttgtgataatatccgcccacgcgttctgtgatatgataattcccttccccgacgt

SEQ ID NO: 361106 - DNA, 75 bp, Artificial Sequence
  Synthetic
gacaaccaccagttggaagcctgtgttgagaggtgaacatcactgtccggcatccaatgatctggacatggccgg

SEQ ID NO: 361107 - DNA, 75 bp, Artificial Sequence
  Synthetic
aggtttgtctaccttaaaaatgaatgtaaagattccgagcggggtcgtgggatctaaaagtgatggatacctttg

SEQ ID NO: 361108 - DNA, 75 bp, Artificial Sequence
  Synthetic
tcatggtgcaaagtgggtcactacctgcgactatcgatggtacggggcaaaatacataacccattcgctacatcc

SEQ ID NO: 361109 - DNA, 75 bp, Artificial Sequence
  Synthetic
tttgcgtcccagtacctctcaatgttttgatgctatcaaagcatatagagaaggtacgttgcttagtcctggttt

SEQ ID NO: 361110 - DNA, 75 bp, Artificial Sequence
  Synthetic
tcctcctgaatcctgtggttggaactctgtgactgactctgagctcttgtccatccagatcactcctcaccacag

SEQ ID NO: 361111 - DNA, 75 bp, Artificial Sequence
  Synthetic
cggggttgatgattaccgcggtgtctggattgattccatgtttcccaagggagagtgcgatcagcgcatctgtga

SEQ ID NO: 361112 - DNA, 75 bp, Artificial Sequence
  Synthetic
cacagtccaagaacattccatttggattgctgccaacaatgtttccagtgcttgtagcatcgcattcaagcaact

SEQ ID NO: 361113 - DNA, 75 bp, Artificial Sequence
  Synthetic
ggaggggtacttttactatcgcaattcagggatccaacccaacaaagacggcacgttcttccacagttcccacca

SEQ ID NO: 361114 - DNA, 75 bp, Artificial Sequence
  Synthetic
ccccaactctccaatgtcgtcctgctgtcgaatcaagtactgcaatcaagaggggctccgtctacatacagggga

SEQ ID NO: 361115 - DNA, 75 bp, Artificial Sequence
  Synthetic
atggatcggagttgcctggaacaccaaaattcgagatgtaacgctagattcgtatactgacacatgtcccggtgg

SEQ ID NO: 361116 - DNA, 75 bp, Artificial Sequence
  Synthetic
tactgaagtcaagtcgacgatcgggagttctcctactcgtgttgtcgcatgggaaatggaacggataatggattt

SEQ ID NO: 361117 - DNA, 75 bp, Artificial Sequence
  Synthetic
tgctctatgtcagaacgtgtgggacaaagtcaatcgaggagagcagttgagtcccctagacctaagttacctttc

SEQ ID NO: 361118 - DNA, 75 bp, Artificial Sequence
  Synthetic
ttctcgagcgcctggcaaagggctggcctacacgatcataaatgagacactccatgtggcccatgtcagatatat

SEQ ID NO: 361119 - DNA, 75 bp, Artificial Sequence
  Synthetic
caggacttggatcaaaggaccggtgctgaaggaaatcaaagggcgtaggggatcttcatccgccgcagaagacac

SEQ ID NO: 361120 - DNA, 75 bp, Artificial Sequence
  Synthetic
actctggattcagtggtttccttttggtgacaatcaaattggacccaatggactcctgaagtccaatgggacgtt

SEQ ID NO: 361121 - DNA, 75 bp, Artificial Sequence
  Synthetic
taaattccccttttacctagtcggggtgggagcactggatgaagatctgatagagatggcaaatgcagacccggt

SEQ ID NO: 361122 - DNA, 75 bp, Artificial Sequence
  Synthetic
ggaccatcttcagagagttgatgcggagacgcacatgaggggagacgaggagctcttttttggtgacaccggtgt

SEQ ID NO: 361123 - DNA, 75 bp, Artificial Sequence
  Synthetic
gtcgaaaaacccaatcgagtctgtggagggatggttctcgaattggatatccggtcttttcaacatctccatcat

SEQ ID NO: 361124 - DNA, 75 bp, Artificial Sequence
  Synthetic
tgtgctgtgtgtactgtctgtgttgatcgtgttcaaatctgtcatcaccctgattcgagtggttaggcgtcggag

SEQ ID NO: 361125 - DNA, 75 bp, Artificial Sequence
  Synthetic
aagaccgagagctgaagaagatgtggaactgaacaacatgaacccaagaccgcaaaccagacaaccagtgggtgc

SEQ ID NO: 361126 - DNA, 75 bp, Artificial Sequence
  Synthetic
ccccaacatcattcccggggcttggggaatccagcctagtcatgggcgaggtgtcagacagtctcagtttgtcaa

SEQ ID NO: 361127 - DNA, 75 bp, Artificial Sequence
  Synthetic
acggagtgcactgaacatagtgacctgagaatagttgtatgaaaaaaaatcagcaggcatcatgtctcatataga

SEQ ID NO: 361128 - DNA, 75 bp, Artificial Sequence
  Synthetic
ttctgatggaaccaactgggaccccctgctactcgatgagagggagggggtcttgaaattgtccgcagaggagag

SEQ ID NO: 361129 - DNA, 75 bp, Artificial Sequence
  Synthetic
atctaatgctctcagtcaatttgattataacttgaactctccgcttatcagagatgacttggacaatctactgat

SEQ ID NO: 361130 - DNA, 75 bp, Artificial Sequence
  Synthetic
gcgttatatggggcatccagtgggggggctctggagccagaaagattgggatggggttctgaccctgctctatca

SEQ ID NO: 361131 - DNA, 75 bp, Artificial Sequence
  Synthetic
tcgcaatgctgaacctcgagctgtgtccgacatgcacaaatggtttggcgaatggataagatcccgggatcatcc

SEQ ID NO: 361132 - DNA, 75 bp, Artificial Sequence
  Synthetic
cgttgatcagggcgccgaatttctcaagagagtagatgaagagtcggaaatcacatatgatgtcgtccaagcttt

SEQ ID NO: 361133 - DNA, 75 bp, Artificial Sequence
  Synthetic
cctgcgggggtgggcgggggtcgaatcaagcatccggagaaagagcggggagccaatgtatatgtgtgaatccct

SEQ ID NO: 361134 - DNA, 75 bp, Artificial Sequence
  Synthetic
gtgccaaaaattcctggatctacacaagatggtgctctatctgaacgcctcgactgagacagaacgtgatgcttt

SEQ ID NO: 361135 - DNA, 75 bp, Artificial Sequence
  Synthetic
gagacgcactctaggactgaaacacaagaagggcttcacaagtgggaagttcatatcccttggccgagtcttctt

SEQ ID NO: 361136 - DNA, 75 bp, Artificial Sequence
  Synthetic
tgagaagggtttttgctggttagagagccaacgttttgtcatggatcgaaacttcattttgatgatgaaagatgt

SEQ ID NO: 361137 - DNA, 75 bp, Artificial Sequence
  Synthetic
tatagtagggaggctccaaactgtcctagctatgatagggcatgaaaaccctgtatggtcagacgggaatatcaa

SEQ ID NO: 361138 - DNA, 75 bp, Artificial Sequence
  Synthetic
aaagttcacccaaatctatgacataggggactctatattggctgaattggggaatgaggcgtatgatttgatcaa

SEQ ID NO: 361139 - DNA, 75 bp, Artificial Sequence
  Synthetic
gtgcatcgagcccatctgcaatttaaggctgtccgagcttgcacattcctaccgacccctgatccctctattccc

SEQ ID NO: 361140 - DNA, 75 bp, Artificial Sequence
  Synthetic
taggtttcatcagcacatctcagacagtgtagactcgcttgcagtcagaagtacgcgcatacgtgcgttgcaccg

SEQ ID NO: 361141 - DNA, 75 bp, Artificial Sequence
  Synthetic
agccatcatggatctgcaggaagttgacatagttctcgcagtctacgggtctttccgacactggggtcatccctt

SEQ ID NO: 361142 - DNA, 75 bp, Artificial Sequence
  Synthetic
catagattacactgagggactccgtaagttgcatgaacaagtgacaatgccaaaagtcatcgaccatgcgtatgc

SEQ ID NO: 361143 - DNA, 75 bp, Artificial Sequence
  Synthetic
taacgctttagcaagcgatctagcccgaatagtgttggaacaggagttcaacaaaaagaagaaatggtccgtcaa

SEQ ID NO: 361144 - DNA, 75 bp, Artificial Sequence
  Synthetic
tcctgcttcagtcagtctcaaccatcccttccgtacccacatactagaaaacacttggcctactccggctcaaat

SEQ ID NO: 361145 - DNA, 75 bp, Artificial Sequence
  Synthetic
acaagatttcggggatcactggcatgaacttcctctaatacagtgcttcgacataccagatctgatagacccatc

SEQ ID NO: 361146 - DNA, 75 bp, Artificial Sequence
  Synthetic
catcatctactccgataaaagtcactctatgaaccgagctgaggttcttaaccacgtaagaaagcatccgaacaa

SEQ ID NO: 361147 - DNA, 75 bp, Artificial Sequence
  Synthetic
gatcatacctaccaagaaagtgttgaaaactatgttggaaaaaccagcaactaactggctggagtttctagatga

SEQ ID NO: 361148 - DNA, 75 bp, Artificial Sequence
  Synthetic
gatcgacagaaatggactaggagaggacgaccttgtgattggacttaaagggaaagagagagaattaaaattgat

SEQ ID NO: 361149 - DNA, 75 bp, Artificial Sequence
  Synthetic
tgggcgtttcttttctctcatgtcttggaaattgagagaatacttcgtcataaccgagcacctaattaagactca

SEQ ID NO: 361150 - DNA, 75 bp, Artificial Sequence
  Synthetic
ctttgtccctctgttccacggacttacgatggcagatgatctcacatcagtgatcaagaagatgatggacagttc

SEQ ID NO: 361151 - DNA, 75 bp, Artificial Sequence
  Synthetic
ctcggggcaggggttgacagattactcagctgtatgcatagccaatcatatcgactacgaaaaatggaacaatca

SEQ ID NO: 361152 - DNA, 75 bp, Artificial Sequence
  Synthetic
ccagcggaaagaatccaatgggccggtattccgagtaatgggccaattcttgggcttccccaatctgatatccag

SEQ ID NO: 361153 - DNA, 75 bp, Artificial Sequence
  Synthetic
aacgcacgaattctttgagaaaagtttggtttattacaatggccggccagatttgatgagagtatcggggaattc

SEQ ID NO: 361154 - DNA, 75 bp, Artificial Sequence
  Synthetic
tttgacaaacacgaccaacctgagggtttgctgggagggccaagccggcggtctggaaggtttgcggcagaaggg

SEQ ID NO: 361155 - DNA, 75 bp, Artificial Sequence
  Synthetic
atggagcattttgaacctactggtgattcaaagagaagccaaaatccggaacacctcagtgaaagttctagcaca

SEQ ID NO: 361156 - DNA, 75 bp, Artificial Sequence
  Synthetic
gggagacaatcaggtgatctgtacccagtacaaaaccagaaaccacagggactccatcgagctccatagcgcttt

SEQ ID NO: 361157 - DNA, 75 bp, Artificial Sequence
  Synthetic
gcaggacatccaaagtaataacgacgccatcatgtctgccatagaacgtggtaccactaagttaggacttgtgat

SEQ ID NO: 361158 - DNA, 75 bp, Artificial Sequence
  Synthetic
caaccaagatgagaccatgcaatccgccgattatttgaattatgggaagattccgattttccgtggaacaattcg

SEQ ID NO: 361159 - DNA, 75 bp, Artificial Sequence
  Synthetic
tggactcgaattcaaaagatggtctagagtgacatgtgtgaccaatgatcagctgcctacgtgtgccaacctcat

SEQ ID NO: 361160 - DNA, 75 bp, Artificial Sequence
  Synthetic
gtcgtcagtgtccaccaatgctttgacagtagctcactttgacaccaacccgaccaatgcgatgacacaattcaa

SEQ ID NO: 361161 - DNA, 75 bp, Artificial Sequence
  Synthetic
ctactttgggaacttcgctcgattactcctatacatgcatgaccccgctataaaattgtcatttcacgaccaaaa

SEQ ID NO: 361162 - DNA, 75 bp, Artificial Sequence
  Synthetic
attcagcctcaaaggtgtgttctcttatgcattcaaaatcgggatgctctatctcgacccatcgatcggtggagt

SEQ ID NO: 361163 - DNA, 75 bp, Artificial Sequence
  Synthetic
atgcggtacagcattatctcgattcttgattagaagcttcccggaccctgtgactgagagcctagccttttggaa

SEQ ID NO: 361164 - DNA, 75 bp, Artificial Sequence
  Synthetic
attaatttatcacaacactgggaaaaaagaactgcgagttttagccgccagatttgggaacccgaggattgcagt

SEQ ID NO: 361165 - DNA, 75 bp, Artificial Sequence
  Synthetic
attcaggctagaacatgtagacaagttattggaggatccaacgagtttgaacatctcaatgggtatgagccctgc

SEQ ID NO: 361166 - DNA, 75 bp, Artificial Sequence
  Synthetic
caacttgctcaaaactgaaattaagaagaacctaatcgaaaacaagggccgaattaagaatcaaattgtgcggga

SEQ ID NO: 361167 - DNA, 75 bp, Artificial Sequence
  Synthetic
ctcagtgtttcgagttgttaaagatgacaagcacttgacagatttcctctggtcgattgaccccttattcccgcg

SEQ ID NO: 361168 - DNA, 75 bp, Artificial Sequence
  Synthetic
ttttctcagtgagttcaaatccggaacttttgcaggagttgcctccagcatcgtaagtttattccaaaactctcg

SEQ ID NO: 361169 - DNA, 75 bp, Artificial Sequence
  Synthetic
cactgtcagaaatttatttaaggagttcatgagcaaagaattggacattttagtgtggagaagcgaaatcagttc

SEQ ID NO: 361170 - DNA, 75 bp, Artificial Sequence
  Synthetic
attggaacacctggtgtcttacggcattagacgggacactcctgcaatctggtcatgctcagcctcacaagcaga

SEQ ID NO: 361171 - DNA, 75 bp, Artificial Sequence
  Synthetic
ctatttgcggacgttatcctggaagcgcaagtgtctaggtacaactgtacctcatccgctggaaatgcacggaag

SEQ ID NO: 361172 - DNA, 75 bp, Artificial Sequence
  Synthetic
aggagatattaagtctatactcaatgaatgctgccggacctcttctatggactacatatcagtgtattgcccgaa

SEQ ID NO: 361173 - DNA, 75 bp, Artificial Sequence
  Synthetic
aggtctgactgatgtcctgtccggtcggggcccgtttcctgcatacctaggatccaaaacatcagaaagcacatc

SEQ ID NO: 361174 - DNA, 75 bp, Artificial Sequence
  Synthetic
gatcatacaaccatgggaaaaagaaagcaaagttcccctaataaggagagcaactcgcctccgtgatgccattca

SEQ ID NO: 361175 - DNA, 75 bp, Artificial Sequence
  Synthetic
ttggtttattgaccccaagagcaatttggcctccgccatcaacgacaacttatcatccctgacaggagaggattg

SEQ ID NO: 361176 - DNA, 75 bp, Artificial Sequence
  Synthetic
gtcccaggccgctcctggatttaaacggacagggtcagcactacaccgattctccacaagcaggatgagcaacgg

SEQ ID NO: 361177 - DNA, 75 bp, Artificial Sequence
  Synthetic
gggtttcgccagtcaaagccctgcagctttgacaagaatggtagccaccacagacacaatgatagagttcaacca

SEQ ID NO: 361178 - DNA, 75 bp, Artificial Sequence
  Synthetic
ggagaattatgatttcatgttccaggcatcactattatacagtcaaatgtccacatcggtgatgcttcgagacac

SEQ ID NO: 361179 - DNA, 75 bp, Artificial Sequence
  Synthetic
tgggatatccaataccgtgcattttcacgttaaatgcagggattgcattagaaaaattgaagagccctggttgga

SEQ ID NO: 361180 - DNA, 75 bp, Artificial Sequence
  Synthetic
gacagcgtctgcgtacaaattcgacaatatgtcaaccaccttgaatgagtggagaaatggcaccgggagctgggg

SEQ ID NO: 361181 - DNA, 75 bp, Artificial Sequence
  Synthetic
agaaaggagagagcaggtgccacttcagaacggagactgggaatcgattactccggccgaaaagtcatatcatgt

SEQ ID NO: 361182 - DNA, 75 bp, Artificial Sequence
  Synthetic
ggggcgtgcggtcggcttcctgtatggagaactagcaaaccaaaattctaaacattcagacgatagttcaatttt

SEQ ID NO: 361183 - DNA, 75 bp, Artificial Sequence
  Synthetic
ccctctctctatccagaagaaactgaggggacatagcttcttcaaaggaatgctagacgggctgatgagggccag

SEQ ID NO: 361184 - DNA, 75 bp, Artificial Sequence
  Synthetic
tgcttgtcaagtcatacatcggaggagcttggctcaaatcaaacgcccagccaacgcagtgtacggaggtcttat

SEQ ID NO: 361185 - DNA, 75 bp, Artificial Sequence
  Synthetic
atacttaatagacaaattaagcttgtcccatcctttcgtcaacttctgccgagagggacaattgagagaagaact

SEQ ID NO: 361186 - DNA, 75 bp, Artificial Sequence
  Synthetic
ccgatccattcctcacaagatccctgcctcttatccgacctcaaacattgatctcggagtgaacatacgcaatta

SEQ ID NO: 361187 - DNA, 75 bp, Artificial Sequence
  Synthetic
ttttagataccattgtgctagagtcagtaggggcatatacaagattgaggtaccccagatctgggtgttttccga

SEQ ID NO: 361188 - DNA, 75 bp, Artificial Sequence
  Synthetic
tctaatgtcattggacttcgtggggccgtttgctctgtctggcaaattagtaaaagtgctgtacaagccagcact

SEQ ID NO: 361189 - DNA, 75 bp, Artificial Sequence
  Synthetic
cagcaaaaaggatcgaaactctattcgtagaatcaacaacttgtcaaaactgcttcgatccaatgagaacctccc

SEQ ID NO: 361190 - DNA, 75 bp, Artificial Sequence
  Synthetic
ggacgtgtatcagaactacatcaaagaaagagtcaagtgctgcagggaagagattcgccatgcatgcaaatttgg

SEQ ID NO: 361191 - DNA, 75 bp, Artificial Sequence
  Synthetic
gatcccccccactctctctggaacagactacaaagactggggagatgaggactacggccgatgctacccaataag

SEQ ID NO: 361192 - DNA, 75 bp, Artificial Sequence
  Synthetic
agtcgagttctcatcacaaacttccacaaagaaactaacaatgccccaacggattcaaaatcctatcgtgtcggg

SEQ ID NO: 361193 - DNA, 75 bp, Artificial Sequence
  Synthetic
acttcggaccgcccaactccccactggggcacattacaaactgcggagtatcatcaagcattttgtgattagata

SEQ ID NO: 361194 - DNA, 75 bp, Artificial Sequence
  Synthetic
cagtcacttcatttgtggtggtgatggatcggggggaatgaccgcagcccttctgagaatgaatcgacaatcatt

SEQ ID NO: 361195 - DNA, 75 bp, Artificial Sequence
  Synthetic
gggcattttcaacagcctgctggattactcagcctctactatgcggggatcagcacccgatccacctagtgctct

SEQ ID NO: 361196 - DNA, 75 bp, Artificial Sequence
  Synthetic
agagacattgggaggcgagaggcacaggtgcataaacggagacacagtgtgggaagctccttccgatctgtccga

SEQ ID NO: 361197 - DNA, 75 bp, Artificial Sequence
  Synthetic
aacctctacatggcaatatttccatgccttgaaatctgagcgtcgtttaagcattgacctgatggtttttgatat

SEQ ID NO: 361198 - DNA, 75 bp, Artificial Sequence
  Synthetic
ggaggtccaagatcctaatacaagtgcccttatagagcagaggatcagagaaaacttgcacaccctgctcgatcc

SEQ ID NO: 361199 - DNA, 75 bp, Artificial Sequence
  Synthetic
gagagggactctgatatacaagacctacgggaccatgattgcacgacaggagaaaggcgctctcgagacgtttgg

SEQ ID NO: 361200 - DNA, 75 bp, Artificial Sequence
  Synthetic
acctttatttcaggatgtccatctgacccaaacagagtatagtagcgccgaaacctcagaggtctacttggtctg

SEQ ID NO: 361201 - DNA, 75 bp, Artificial Sequence
  Synthetic
tcgaggactgaagggctttgtggacgcgaaggaggtcgactgggaagacttggcgtaccattggggcaagcttag

SEQ ID NO: 361202 - DNA, 75 bp, Artificial Sequence
  Synthetic
gtgtttcgcaggggcagattcagaatacgatcgggccaagtccatatctcgtagagacgggatggtgggagtccc

SEQ ID NO: 361203 - DNA, 75 bp, Artificial Sequence
  Synthetic
taaggaattcctaccagaccccatagcctcattgggcacattaatggaaatagcaggagtgccatcaggtgttgc

SEQ ID NO: 361204 - DNA, 75 bp, Artificial Sequence
  Synthetic
tcacaatctgtctatagatttggatatggcaccagttagtggactatccaaggctattgctctgtgcatcatgct

SEQ ID NO: 361205 - DNA, 75 bp, Artificial Sequence
  Synthetic
gtcccatcacactgtgaacactttgagagagcagcctgctctacctaaccccccatcagatggtaaagtgatcaa

SEQ ID NO: 361206 - DNA, 75 bp, Artificial Sequence
  Synthetic
tctaggaagcgctctctgcgggattggactgtgggtgagtttgttctacaatgataaaagattgtatcacacttg

SEQ ID NO: 361207 - DNA, 75 bp, Artificial Sequence
  Synthetic
tttgcagtgcataagggtgtgctttcctttcaggtgtcgcactctcaaactaaaaaatgggaaatatcgtatgga

SEQ ID NO: 361208 - DNA, 75 bp, Artificial Sequence
  Synthetic
atggggtgtgcgggaacaattgcgtattaataaagatgttcgattgtgtgacaagatggcagcgatagggcaatg

SEQ ID NO: 361209 - DNA, 75 bp, Artificial Sequence
  Synthetic
gattcgttgtctttcacgacttcggtggcaggaaggtgcactcgaggtgtcatgggtgaatgcgtttctgtctgg

SEQ ID NO: 361210 - DNA, 75 bp, Artificial Sequence
  Synthetic
agtgtctgcaggtttaactgtcatccaaacaaagaacaccacgggagtttttgactttctcaaaggaaacatatc

SEQ ID NO: 361211 - DNA, 75 bp, Artificial Sequence
  Synthetic
gaaagaagatcactctaggacccttgtcactaaagagaccattgattctagagactggagagaatgattggcttc

SEQ ID NO: 361212 - DNA, 75 bp, Artificial Sequence
  Synthetic
tctattgtgttgagtgattgtttatgaaaaaaacaagaatgcatgtaaaagtaccatcatgtgtacggtgtgtga

SEQ ID NO: 361213 - DNA, 75 bp, Artificial Sequence
  Synthetic
aaaaaacaagaatgcatgtaaaagtaccatcatgtgtacggtgtgtgaagttaaaattggtttgttggtatctgt

SEQ ID NO: 361214 - DNA, 75 bp, Artificial Sequence
  Synthetic
tacattgtcattggggttggagataagaaaattacccatcattggcacagaagtggaagcacgattgggaaggca

SEQ ID NO: 361215 - DNA, 75 bp, Artificial Sequence
  Synthetic
caaggacgggagatccattgtggtcccctgccgccaccaagatgaactgattggccgagcccgtgtctcaccagg

SEQ ID NO: 361216 - DNA, 75 bp, Artificial Sequence
  Synthetic
ggcaggatggagcatccgggagactgcttgtcttgcaaaatcatatgcacagatgtggcagcttctttatttcca

SEQ ID NO: 361217 - DNA, 75 bp, Artificial Sequence
  Synthetic
tgtgggccttggaagctggacgcagcttgggacggagttagtgaggtgcagcttctggccgtaccccctggagag

SEQ ID NO: 361218 - DNA, 75 bp, Artificial Sequence
  Synthetic
tatcctgcaggaacctcaggatctccgatcctagacaaatgcgggagagtgataggactctatggcaatggggtt

SEQ ID NO: 361219 - DNA, 75 bp, Artificial Sequence
  Synthetic
tgaggagaacgaccacatggaggacaagacccctgtaacaaaatggacagacattccctatttgggaaaaaggga

SEQ ID NO: 361220 - DNA, 75 bp, Artificial Sequence
  Synthetic
ggcgtgttcaattctctgggcaagggagttcatcaggtcttcggagcagcctttaaatccttatttggcggaatg

SEQ ID NO: 361221 - DNA, 75 bp, Artificial Sequence
  Synthetic
cttcctgaaatagtccgtgaagctataaagaagagactccgcacggtgatcttggcaccaaccagggtcgtcgct

SEQ ID NO: 361222 - DNA, 75 bp, Artificial Sequence
  Synthetic
cttgcatgtctggcgcttggaggggcgatgatctttctctccacggccgtctcggcagacgtggggtgctcagtt

SEQ ID NO: 361223 - DNA, 75 bp, Artificial Sequence
  Synthetic
gtacggaacctgccatcacaaaaaaggtgaagcacggagatctagaagagctgtgacgctcccctcccattccac

SEQ ID NO: 361224 - DNA, 75 bp, Artificial Sequence
  Synthetic
aacctctacatcatggatgaagcccatttcacagacccctcaagcatagctgcaagaggatatatatcaacaagg

SEQ ID NO: 361225 - DNA, 75 bp, Artificial Sequence
  Synthetic
tacaagtaccatccagactctccacgtagactggcggcggctgttaagcaagcttgggaagatggaatctgcggg

SEQ ID NO: 361226 - DNA, 75 bp, Artificial Sequence
  Synthetic
aaaagtcatatacttggtcatgatactgctgattgccccggcatacagcatcaggtgcataggagtcagcaatag

SEQ ID NO: 361227 - DNA, 75 bp, Artificial Sequence
  Synthetic
actccatgagtttccaccacgctggccgccaggcacagatcgccgaacagcggcggccggtgtggggaaatccat

SEQ ID NO: 361228 - DNA, 75 bp, Artificial Sequence
  Synthetic
ggcacaggacaaaccgactgtcgacatagagctggttacaacaacagtcagcaacatggcggaggtaagatccta

SEQ ID NO: 361229 - DNA, 75 bp, Artificial Sequence
  Synthetic
aacggagtgcagctcacagttgttgtaggacctgtaaaaaatcctatgtggagagcaccacaacggctaccggtg

SEQ ID NO: 361230 - DNA, 75 bp, Artificial Sequence
  Synthetic
agctttgtggtcgatggcgacaccttgaaagagtgtccactcaaacagagggcctggaacagcttccttgtggag

SEQ ID NO: 361231 - DNA, 75 bp, Artificial Sequence
  Synthetic
gccgtgattggaacagccatcaaagggaaggaagctgctcacagtgatcttggttattggattgagagcgagaag

SEQ ID NO: 361232 - DNA, 75 bp, Artificial Sequence
  Synthetic
aacgacacctggagactgaagagggctcacatgatcgagatgaagacgtgtgagtggccaagatctcacacccta

SEQ ID NO: 361233 - DNA, 75 bp, Artificial Sequence
  Synthetic
gcctcgctctatcgacctgaggccgacaaggtagccgccattgagggagagtttaagctgaggacagagcaaagg

SEQ ID NO: 361234 - DNA, 75 bp, Artificial Sequence
  Synthetic
aagcctaggacttgattgtgaaccgaggacaggccttgacttttcagatttgtattacttgactatgaataacaa

SEQ ID NO: 361235 - DNA, 75 bp, Artificial Sequence
  Synthetic
gcactggttggttcacaaggagtggttccacgacattccattaccttggcacgctggggcagacaccggaactcc

SEQ ID NO: 361236 - DNA, 75 bp, Artificial Sequence
  Synthetic
caggacaagccaacagttgacatcgagttggtcacgacaacggttagcaacatggccgaggtaagatcctactgc

SEQ ID NO: 361237 - DNA, 75 bp, Artificial Sequence
  Synthetic
gccctgaagtcgttcaaagaattcgccgctgggaaaagaggagcggctttgggagtaatggaggccctgggaaca

SEQ ID NO: 361238 - DNA, 75 bp, Artificial Sequence
  Synthetic
gacgaaaacagagcaaaggtcgaggtcacacccaattcaccaagagcagaagcaaccttgggaggttttggaagc

SEQ ID NO: 361239 - DNA, 75 bp, Artificial Sequence
  Synthetic
gatgagagtggtgacttctctttgctggaagacgacggacccccgatgaaggagatcatactcaaagtggttttg

SEQ ID NO: 361240 - DNA, 75 bp, Artificial Sequence
  Synthetic
gacagatggaccttgcaaggttccagctcagatggcggtggacatgcaaactctgaccccagttgggaggttgat

SEQ ID NO: 361241 - DNA, 75 bp, Artificial Sequence
  Synthetic
tggaacaacaaagaggcattggtggagttcaaggacgctcacgccaagaggcaaactgttgtggttctggggagc

SEQ ID NO: 361242 - DNA, 75 bp, Artificial Sequence
  Synthetic
caagagggagctgttcacacggccctcgctggagctctggaggctgagatggatggtgcaaagggaaggctattc

SEQ ID NO: 361243 - DNA, 75 bp, Artificial Sequence
  Synthetic
tctggccatttgaaatgccgcctaaaaatggacaagcttaggttgaagggtgtgtcatattccctgtgtactgca

SEQ ID NO: 361244 - DNA, 75 bp, Artificial Sequence
  Synthetic
acagtatcgctggggatcttttttgtcttgatgaggaacaagggcatcgggaagatgggctttgaaatggtaacc

SEQ ID NO: 361245 - DNA, 75 bp, Artificial Sequence
  Synthetic
tttttattactggtggtgctaataccagagccagagaagcaaagatccccccaggacaatcagatggcaatcatt

SEQ ID NO: 361246 - DNA, 75 bp, Artificial Sequence
  Synthetic
gccaaccctgtgatcactgaaagtactgagaattcaaagatgatgttggaacttgacccaccatttggggattct

SEQ ID NO: 361247 - DNA, 75 bp, Artificial Sequence
  Synthetic
atagctcatctgatgggaaagagagaagagggaacaaccgtgggattctcaatggacatcgatctgcgaccagcc

SEQ ID NO: 361248 - DNA, 75 bp, Artificial Sequence
  Synthetic
atgtggcacgtcacaaaaggggctgcgctgcggagtggagaagggagactggatccgtactggggtgatgtgaag

SEQ ID NO: 361249 - DNA, 75 bp, Artificial Sequence
  Synthetic
gctgttcctccaggagaaagagctagaaatgtccaaactctccctggaatcttcaagaccaaagatggggacatt

SEQ ID NO: 361250 - DNA, 75 bp, Artificial Sequence
  Synthetic
agagaatggagttcaactgacggtcgttgtgggatctgtaaaaaaccccatgtggagaggtccacagagattgcc

SEQ ID NO: 361251 - DNA, 75 bp, Artificial Sequence
  Synthetic
accgcttggggatggggggaggctggagctttgatcacagcagcaacttccaccctgtgggaaggctccccaaac

SEQ ID NO: 361252 - DNA, 75 bp, Artificial Sequence
  Synthetic
ctctatggcaatggagtggtgatcagaaatgggagctatgtgagcgccataacacaaggaaagagagaggaagag

SEQ ID NO: 361253 - DNA, 75 bp, Artificial Sequence
  Synthetic
ggaaagacccggagggtccttccagagatagtacgcgaggcaataaagaggaggctccgcactgtaatcttagca

SEQ ID NO: 361254 - DNA, 75 bp, Artificial Sequence
  Synthetic
aatgtggcccactctgggaccgagattgttgacctgatgtgtcatgccacattcacctcgcgtctgttgcagcct

SEQ ID NO: 361255 - DNA, 75 bp, Artificial Sequence
  Synthetic
ggctacatctcgaccagagtggaaatgggggaagcagcagccatcttcatgacagccacgccgccaggcaccagg

SEQ ID NO: 361256 - DNA, 75 bp, Artificial Sequence
  Synthetic
ttcgaatgggtgacagatcacgctggcagaacagtgtggtttgttccgagtgtgaggaatggaaacgaaatcgca

SEQ ID NO: 361257 - DNA, 75 bp, Artificial Sequence
  Synthetic
agttttgttgtcgacggagacacactgaaggagtgtccgctcaaacatagagcatggaatagcttccttgtggag

SEQ ID NO: 361258 - DNA, 75 bp, Artificial Sequence
  Synthetic
cccaggcactaaggtccacgtggaggaaacatgtggaacaagaggaccatctctgagatcaaccactgcaagcgg

SEQ ID NO: 361259 - DNA, 75 bp, Artificial Sequence
  Synthetic
ggctttggaatggtcactctaggagctagtgcgtggctcatgtggctctcagagatcgaacctgctagaatagcc

SEQ ID NO: 361260 - DNA, 75 bp, Artificial Sequence
  Synthetic
ctcagagtgctctccatggtgggggactggcttgagaagagaccaggggccttctgcataaaggtgttatgccca

SEQ ID NO: 361261 - DNA, 75 bp, Artificial Sequence
  Synthetic
aaccaaatggccatcatcatcatggtcgcggtgggactgctgggcctcattgcggccaacgaacttggctggctg

SEQ ID NO: 361262 - DNA, 75 bp, Artificial Sequence
  Synthetic
gaccacaaagatcatcataagcacatcaatggcagtgctggtagctatgatcctgggaggattttcaatgagtga

SEQ ID NO: 361263 - DNA, 75 bp, Artificial Sequence
  Synthetic
cctggctaagcttgcaattttgatgggtgccaccttcgcggaaatgaacactggaggagatgtagctcatctggc

SEQ ID NO: 361264 - DNA, 75 bp, Artificial Sequence
  Synthetic
atagatctgcggccagcatcggcatgggccatttatgccgcattgacaaccctcatcaccccggccgttcaacat

SEQ ID NO: 361265 - DNA, 75 bp, Artificial Sequence
  Synthetic
agtgaacatgcagaaacatggttctttgatgaaaaccatccatacaggacatgggcctaccacgggagctacgaa

SEQ ID NO: 361266 - DNA, 75 bp, Artificial Sequence
  Synthetic
aaggggatgcctttctacacctgggattttggtgttccactgctgatgattgggtgttattctcaattgacacct

SEQ ID NO: 361267 - DNA, 75 bp, Artificial Sequence
  Synthetic
ctggctggcgcttcccttatttacactgtgacaaggaacgctggtctagtcaagaggcgcggaggaggaacagga

SEQ ID NO: 361268 - DNA, 75 bp, Artificial Sequence
  Synthetic
ggaataactgaagtgtgcagggatgaggctcggagggccttgaaggacggagtggctactggaggacacgcagta

SEQ ID NO: 361269 - DNA, 75 bp, Artificial Sequence
  Synthetic
aaccgctgtgaggctggtcgaccccatcaacgtggtgggactgctgttgctcacaaggagtgggaagcggagctg

SEQ ID NO: 361270 - DNA, 75 bp, Artificial Sequence
  Synthetic
ggatgtggtaggggaggctggagctactatgcggcaaccatccgcaaagtccaagaggtcagaggatacaccaaa

SEQ ID NO: 361271 - DNA, 75 bp, Artificial Sequence
  Synthetic
gacgtgttccacatggcagctgagccttgcgacaccctcctatgtgacattggagagtcatcatctagtccagag

SEQ ID NO: 361272 - DNA, 75 bp, Artificial Sequence
  Synthetic
gataaggaaagagaacaccacctgagaggagagtgccatagttgtgtgtacaacatgatgggaaaaagagaaaag

SEQ ID NO: 361273 - DNA, 75 bp, Artificial Sequence
  Synthetic
ataaaagtcctgtgcccatacacgagcaccatgatggagaccatggagcgtttgcagcgtaggtatggaggtgga

SEQ ID NO: 361274 - DNA, 75 bp, Artificial Sequence
  Synthetic
ctggtgagggtgcctctctcccgcaattcgacacatgagatgtactgggtctcgggagcaaaaagcaacatcatc

SEQ ID NO: 361275 - DNA, 75 bp, Artificial Sequence
  Synthetic
gctggctgggacacccgcattagcaagtttgatttggagaatgaagccttgattactaaccaaatggatgaaggg

SEQ ID NO: 361276 - DNA, 75 bp, Artificial Sequence
  Synthetic
gctgggcccatggctgcagtaggcctgctaattgtcagttatgtggtctcgggaaagagtgtggacatgtacatc

SEQ ID NO: 361277 - DNA, 75 bp, Artificial Sequence
  Synthetic
cactatgtggcacgtcacaaaaggatccgcgctgagaagcggtgaagggagacttgatccatactggggagatgt

SEQ ID NO: 361278 - DNA, 75 bp, Artificial Sequence
  Synthetic
cacagaactctggcgttggccgtgattaagtacacataccaaaacaaagtggtgaaggtcctcagaccagctgaa

SEQ ID NO: 361279 - DNA, 75 bp, Artificial Sequence
  Synthetic
cttggccgtgccccccggagagagagcgaggaacatccagactctgcccggaatatttaagacaaaggatgggga

SEQ ID NO: 361280 - DNA, 75 bp, Artificial Sequence
  Synthetic
tggctgttgaggaagccagagaaagtaaccagatggctgcagagtagcggatgggacagactcaaacgaatggca

SEQ ID NO: 361281 - DNA, 75 bp, Artificial Sequence
  Synthetic
gggaaagttaggaaagacacacaggaatggaaaccctcaactggatggagcaactgggaagaagtcccgttctgc

SEQ ID NO: 361282 - DNA, 75 bp, Artificial Sequence
  Synthetic
ggcggagttgaaggactgggactgcaaagacttggctatatccttgaggagatgagccgggcaccaggaggaaag

SEQ ID NO: 361283 - DNA, 75 bp, Artificial Sequence
  Synthetic
aaccaaatggaagaaaggcacagagccctggctcaggcggtaatcaaatacacataccagaacaaagtggttaag

SEQ ID NO: 361284 - DNA, 75 bp, Artificial Sequence
  Synthetic
gccgtaccccccggagagagggctagaaacattcagactctgcctggaatattcaagacaaaggatggggacatc

SEQ ID NO: 361285 - DNA, 75 bp, Artificial Sequence
  Synthetic
gtggtcacttacgccctcaatacattcaccaatctggtggtgcagctcattagatgcatggaagctgaggaggtg

SEQ ID NO: 361286 - DNA, 75 bp, Artificial Sequence
  Synthetic
gccaatcagagtccccaactataatctgtatattatggatgaggcccacttcacagatccctcaagtatagcagc

SEQ ID NO: 361287 - DNA, 75 bp, Artificial Sequence
  Synthetic
aagaggatacatttcaacaagggttgagatgggcgaggcggctgccatcttcatgaccgccacgccaccaggaac

SEQ ID NO: 361288 - DNA, 75 bp, Artificial Sequence
  Synthetic
ctggagaagtcatacgcgcaaatgtggcctctcctctacttccatataagagatctcaggcttatggcgcacgca

SEQ ID NO: 361289 - DNA, 75 bp, Artificial Sequence
  Synthetic
tcccaccactttaacaagctgcacctcaaagacgggagatccattgtggtcccttgccgccaccaagatgaactg

SEQ ID NO: 361290 - DNA, 75 bp, Artificial Sequence
  Synthetic
ctggagacacatgatctgtggacactgaggaaaccagcaaaagtcacccgctggctgggtaacaatggatggcac

SEQ ID NO: 361291 - DNA, 75 bp, Artificial Sequence
  Synthetic
atctgctcatctgtgcctgtcgattgggtcccaacagggaaaacaacctgctcgattcacgggaaaggagagtgg

SEQ ID NO: 361292 - DNA, 75 bp, Artificial Sequence
  Synthetic
acctgttgatactgttgctagctttcgcttcaaactcgaactgtcgcagtctgattcacacagatcaacaggttt

SEQ ID NO: 361293 - DNA, 75 bp, Artificial Sequence
  Synthetic
tgtcacacatgccagcgctgcccagaggagggggcgcataggcaggaatcccaacaaacctggagatgagtatct

SEQ ID NO: 361294 - DNA, 75 bp, Artificial Sequence
  Synthetic
gttgttgatctgtgtgaatcagactgcgacagttcgagtttgaagcgagagctaacaacagtatcaacaggttta

SEQ ID NO: 361295 - DNA, 75 bp, Artificial Sequence
  Synthetic
ttacctccaagatggcctcatagcctcgctctatcgacctgaggccgacaaagtagcagccattgagggagagtt

SEQ ID NO: 361296 - DNA, 75 bp, Artificial Sequence
  Synthetic
caagcttaggacggagcaaaggaagacctttgtggaactcatgaaaagaggagatcttcctgtttggctggccta

SEQ ID NO: 361297 - DNA, 75 bp, Artificial Sequence
  Synthetic
tcaggttgcatctgccggaataacctacacagatagaagatggtgctttgatggcacgaccaacaacaccataat

SEQ ID NO: 361298 - DNA, 75 bp, Artificial Sequence
  Synthetic
ggaagacagtgtgccggcagaggtgtggaccagacacggagagaaaagagtgctcaaaccgaggtggatggacgc

SEQ ID NO: 361299 - DNA, 75 bp, Artificial Sequence
  Synthetic
gtagcatctgccggaataacttacacagacagaagatggtgctttgatggcactaccaacaacaccataatggaa

SEQ ID NO: 361300 - DNA, 75 bp, Artificial Sequence
  Synthetic
agtgatggaagccctgggaacactgccaggacacatgacagagagattccaggaagccattgacaacctcgctgt

SEQ ID NO: 361301 - DNA, 75 bp, Artificial Sequence
  Synthetic
ctgctgactacagccatggcagcagagattaccagacgtggaagtgcatactacatgtacttggacaggagcgat

SEQ ID NO: 361302 - DNA, 75 bp, Artificial Sequence
  Synthetic
atgcgagcagagactggaagtaggccctacaaagcagcggcagctcaactgccggagaccctagagaccatcatg

SEQ ID NO: 361303 - DNA, 75 bp, Artificial Sequence
  Synthetic
gatgggctttggaatggtgactcttggggccagcgcatggctcatgtggctctcggaaattgagccagccagaat

SEQ ID NO: 361304 - DNA, 75 bp, Artificial Sequence
  Synthetic
atcaggtgcattggagtcagcaatagagacttcgtggaaggcatgtcaggtgggacctgggttgatgtcgtcttg

SEQ ID NO: 361305 - DNA, 75 bp, Artificial Sequence
  Synthetic
ctgaggacagagcaaaggaagacctttgtggaactcatgaagagaggagaccttcccgtttggctggcctatcaa

SEQ ID NO: 361306 - DNA, 75 bp, Artificial Sequence
  Synthetic
gtctgttcagatcatgcggctctgaagtcgttcaaagaatttgccgctgggaagagaggagcggctttgggagta

SEQ ID NO: 361307 - DNA, 75 bp, Artificial Sequence
  Synthetic
gaacatggaggttgcgtcaccgtaatggcacaggacaagccaacagttgacatagagttggtcacgacaacggtc

SEQ ID NO: 361308 - DNA, 75 bp, Artificial Sequence
  Synthetic
tgcaacacgacatcaacttgggttgtgtacggaacctgtcatcacaaaaaaggtgaagcacggcgatctagaaga

SEQ ID NO: 361309 - DNA, 75 bp, Artificial Sequence
  Synthetic
aaagggaaaggtagtgtgaagaagaacctgccattcgtcgcggccttgggattgaccgctgtgagaatagtggac

SEQ ID NO: 361310 - DNA, 75 bp, Artificial Sequence
  Synthetic
gctcatgcgggcagagactggaagcaggccttacaaagccgcggcggcccaattgccggagaccctagagaccat

SEQ ID NO: 361311 - DNA, 75 bp, Artificial Sequence
  Synthetic
ggctttggaagcttaggacttgattgtgaaccaaggacaggcctggacttttcagatttgtactacttgaccatg

SEQ ID NO: 361312 - DNA, 75 bp, Artificial Sequence
  Synthetic
aacaataagcactggttagtgcacaaagagtggtttcatgacatcccattgccctggcatgctggggcagacacc

SEQ ID NO: 361313 - DNA, 75 bp, Artificial Sequence
  Synthetic
agtaacatggccgaggtaagatcctactgttatgaggcatcaatatcggacatggcttcggacagtcgctgccca

SEQ ID NO: 361314 - DNA, 75 bp, Artificial Sequence
  Synthetic
ttggcaggggcttcccttatttacacagtgacaagaaatgccggtctggttaagagacgtggaggtggaacggga

SEQ ID NO: 361315 - DNA, 75 bp, Artificial Sequence
  Synthetic
gagaccctgggagagaagtggaaagcccgcctgaaccagatgtcggccctggagttttactcttacaaaaagtca

SEQ ID NO: 361316 - DNA, 75 bp, Artificial Sequence
  Synthetic
ctagccttcttgcggttcacagcgctaaaaccctcactgggccttatcaacagatggggttccgtggggaaaaaa

SEQ ID NO: 361317 - DNA, 75 bp, Artificial Sequence
  Synthetic
ggcatcaccgaagtgtgtagggaggaggcgcgccgcgctctcaaggatggagtggccacaggagggcatgctgta

SEQ ID NO: 361318 - DNA, 75 bp, Artificial Sequence
  Synthetic
ggatgtggcagaggaggctggagttattacgctgccactatccgtaaagtgcaggaggtcagaggatacacaaag

SEQ ID NO: 361319 - DNA, 75 bp, Artificial Sequence
  Synthetic
atcggaaaagcatttgaggccactgtgagaggtgccaagagaatggcagttctgggggacacagcctgggacttt

SEQ ID NO: 361320 - DNA, 75 bp, Artificial Sequence
  Synthetic
gacgtcttccacatggcggctgagccgtgtgacactctgctgtgtgacataggcgagtcatcatctagtcctgaa

SEQ ID NO: 361321 - DNA, 75 bp, Artificial Sequence
  Synthetic
ggaggtcctggtcatgaagaacccatgctggtgcaaagctatgggtggaacatagttcgcctcaagagtggagtg

SEQ ID NO: 361322 - DNA, 75 bp, Artificial Sequence
  Synthetic
ggatcagtcgggggcgtgtttaactcattgggcaagggcatccaccagatttttggagcagccttcaaatcactg

SEQ ID NO: 361323 - DNA, 75 bp, Artificial Sequence
  Synthetic
cataaaaagtgtgtccaccacgagccagctcctcttggggcgcatggacgggcctaggaggccagtgaaatatga

SEQ ID NO: 361324 - DNA, 75 bp, Artificial Sequence
  Synthetic
gatgtgaacctcggctcaggcacacgagctgtggcaagctgcgctgaggctcccaacatgaagatcattggtagg

SEQ ID NO: 361325 - DNA, 75 bp, Artificial Sequence
  Synthetic
ggcttaccatggaagctatgaggcccccacacaagggtcagcgtcctctctaataaacggggttgtcaggctcct

SEQ ID NO: 361326 - DNA, 75 bp, Artificial Sequence
  Synthetic
tctctggtggaggaagatggtccacccatgagagagatcatacttaaggtggtcttgatggccatctgtggcatg

SEQ ID NO: 361327 - DNA, 75 bp, Artificial Sequence
  Synthetic
ttccttgtggaggatcatgggtttggggtcttccacaccagtgtttggcttaaggttagagaagattactcacta

SEQ ID NO: 361328 - DNA, 75 bp, Artificial Sequence
  Synthetic
aagccctgggatgtggtgactggagttacaggaatagctatgactgacaccacgccatacggccaacaaagagtc

SEQ ID NO: 361329 - DNA, 75 bp, Artificial Sequence
  Synthetic
tcgtagcaatgcagcattaggggcaatatttgaagaggaaaaagagtggaagactgcagtggaagctgtgaacga

SEQ ID NO: 361330 - DNA, 75 bp, Artificial Sequence
  Synthetic
gaatgtgacccagccgtcataggaacagctgttaagggaaaggaggccgcgcacagtgacctaggctactggatt

SEQ ID NO: 361331 - DNA, 75 bp, Artificial Sequence
  Synthetic
ttcaaggaaaaagtggacacaagggtgccagatccccaagaaggcactcgccaagtaatgaacatagtttcgtct

SEQ ID NO: 361332 - DNA, 75 bp, Artificial Sequence
  Synthetic
atgggtaaaagagaaaagaagcaaggagaattcgggaaagcaaaaggcagccgcgcaatctggtacatgtggttg

SEQ ID NO: 361333 - DNA, 75 bp, Artificial Sequence
  Synthetic
tccaaggttctgggctctagtggacaaggaaagagagcaccacctgagaggagagtgccagagctgtgtgtacaa

SEQ ID NO: 361334 - DNA, 75 bp, Artificial Sequence
  Synthetic
ggtggtgttgaagggctaggactgcaaaggcttggatatatcctagaagaaatgaaccgggcaccaggaggaaag

SEQ ID NO: 361335 - DNA, 75 bp, Artificial Sequence
  Synthetic
caccaaccaaatggagaaagggcacagggccttggcattggccataatcaagtacacataccaaaacaaagtggt

SEQ ID NO: 361336 - DNA, 75 bp, Artificial Sequence
  Synthetic
aagagaatgaccacgaagatcattatgagcacatcaatggcagtgctggtagccatgatcctgggaggattttca

SEQ ID NO: 361337 - DNA, 75 bp, Artificial Sequence
  Synthetic
gttgttacttatgccctcaacacattcaccaacctggtggtgcagcttatccggaacatggaggctgaggaagtg

SEQ ID NO: 361338 - DNA, 75 bp, Artificial Sequence
  Synthetic
ctagagatgcatgatctgtggttgttgaggaaaccagagaaagtgaccagatggttgcagagtaatggatgggac

SEQ ID NO: 361339 - DNA, 75 bp, Artificial Sequence
  Synthetic
cctcaggttcttgaatgatatgggaaaagttaggaaggacacacaagagtggaaaccctcaactggatgggacaa

SEQ ID NO: 361340 - DNA, 75 bp, Artificial Sequence
  Synthetic
ctgggaagaagttccgttttgctcccaccacttcaacaagctccatctcaaggacgggaggtccattgtggttcc

SEQ ID NO: 361341 - DNA, 75 bp, Artificial Sequence
  Synthetic
gtgatctatctggtgatgatcctgttgattgccccggcatacagtatcaggtgcattggagtcagcaatagagac

SEQ ID NO: 361342 - DNA, 75 bp, Artificial Sequence
  Synthetic
cgccaccaagatgaactgattggccgagcccgtgtctcaccaggggcaggatggagcatccgtgagactgcttgc

SEQ ID NO: 361343 - DNA, 75 bp, Artificial Sequence
  Synthetic
cggagctggccccctagtgaagtgcttacagctgttggcctgatatgtgcactggccggagggtttgccaaggca

SEQ ID NO: 361344 - DNA, 75 bp, Artificial Sequence
  Synthetic
atggatgaccactgaagacatgcttgtggtgtggaacagagtgtggattgaggagaacgaccacatggaagacaa

SEQ ID NO: 361345 - DNA, 75 bp, Artificial Sequence
  Synthetic
cttgcaaaatcatatgcacagatgtggcagcttctttatttccacagaagagatctccgactgatggccaatgcc

SEQ ID NO: 361346 - DNA, 75 bp, Artificial Sequence
  Synthetic
cctgttccaaaatggacagaaattccctacttggggaaaagggagtccctatggtgtggatacattatagggcac

SEQ ID NO: 361347 - DNA, 75 bp, Artificial Sequence
  Synthetic
aaggtggtcctgatggccatctgtggcatgaacccaatagccataccctttgctgcaggagcgtggtatgtgtat

SEQ ID NO: 361348 - DNA, 75 bp, Artificial Sequence
  Synthetic
gtgaagactgggaaaaggagtggtgccctctgggatgtgcccgctcccaaagaagtgaaaaaaggagagaccaca

SEQ ID NO: 361349 - DNA, 75 bp, Artificial Sequence
  Synthetic
gggaagagcattcagccggagaacttggagtaccggataatgctatcagtgcatggatcccagcacagtgggatg

SEQ ID NO: 361350 - DNA, 75 bp, Artificial Sequence
  Synthetic
agacctcgcaccacttgggctgagaacatcaaagacacagtcaacatggtgcttaggctcataggtgatgaagaa

SEQ ID NO: 361351 - DNA, 75 bp, Artificial Sequence
  Synthetic
ggacatgaaactgacgaaaacagagcaaaggtcgaggtcacacccaattcaccaagagcagaagcaaccttggga

SEQ ID NO: 361352 - DNA, 75 bp, Artificial Sequence
  Synthetic
gcacagaccgcgcaccacctgggctgagaacattaaaaacacagtcaacatggtgcgcaggatcataggtgatga

SEQ ID NO: 361353 - DNA, 75 bp, Artificial Sequence
  Synthetic
tcatcaatagatggggttcagtggggaaaaaagaggctatggaaataataaagaagtttaagaaagatctggctg

SEQ ID NO: 361354 - DNA, 75 bp, Artificial Sequence
  Synthetic
agagccagaaacattcagactctgcctggaatatttaagacaaaggatggggacatcggagcagttgctttggac

SEQ ID NO: 361355 - DNA, 75 bp, Artificial Sequence
  Synthetic
agactccatgagtttccaccacgctggccgccaggcacagatcgccgaatagcggcggccggtgtggggaaatcc

SEQ ID NO: 361356 - DNA, 75 bp, Artificial Sequence
  Synthetic
agcaccaatcttaatgttgtcaggcctgctagtcagccacagcttggggaaagctgtgcagcctgtgaccccccc

SEQ ID NO: 361357 - DNA, 75 bp, Artificial Sequence
  Synthetic
acaacagcagttaacgtcacccactctgggacagaaatcgttgatttgatgtgccatgccaccttcacttcacgc

SEQ ID NO: 361358 - DNA, 75 bp, Artificial Sequence
  Synthetic
aaagaggctatggaaataataaagaagttcaagaaagatctggctgccatgctgagaataatcaatgctaggaag

SEQ ID NO: 361359 - DNA, 75 bp, Artificial Sequence
  Synthetic
atagctgcaagaggatacatatcaacaagggttgaaatgggcgaggcggctgccatctttatgacagccacgcca

SEQ ID NO: 361360 - DNA, 75 bp, Artificial Sequence
  Synthetic
gctgaccgggtcatagactctaggagatgcctaaagccagttatacttgatggtgagagagtcatcttggctggg

SEQ ID NO: 361361 - DNA, 75 bp, Artificial Sequence
  Synthetic
aatgtcctggttctcacaaattctcattggaacgttgctgatgtggttgggtctgaacacaaagaatggatctat

SEQ ID NO: 361362 - DNA, 75 bp, Artificial Sequence
  Synthetic
tggttggtgcacaaggagtggttccacgacattccattgccatggcacgctggagcggacacagggactccccat

SEQ ID NO: 361363 - DNA, 75 bp, Artificial Sequence
  Synthetic
gaaccctcgatgctgaagaagaagcagctaactgtcctggacctgcatccaggggctgggaaaaccaggagagtt

SEQ ID NO: 361364 - DNA, 75 bp, Artificial Sequence
  Synthetic
tcctgctgaccacagctatggcagcggaggtcactagacgtgggagtgcatactatatgtacttggacagaagcg

SEQ ID NO: 361365 - DNA, 75 bp, Artificial Sequence
  Synthetic
accataatggaagatagtgtaccagcagaggtgtggacaaaatatggagagaagagagtgcttaaaccaagatgg

SEQ ID NO: 361366 - DNA, 75 bp, Artificial Sequence
  Synthetic
actgatgagaatagagcgaaggttgagataacgcccaattcaccaagagccgaagccaccctggggggttttgga

SEQ ID NO: 361367 - DNA, 75 bp, Artificial Sequence
  Synthetic
ctcgctgtgcttatgcgagcagagactggaagtaggccttacaaggcagcggcagcccaactgccggagacccta

SEQ ID NO: 361368 - DNA, 75 bp, Artificial Sequence
  Synthetic
caggagggtgccgtccacacagccctggcaggagctttggaagcggagatggatggagccaaaggaaggctgttc

SEQ ID NO: 361369 - DNA, 75 bp, Artificial Sequence
  Synthetic
ttctcaatggacatcgatttgcggccagcctccgcctgggctatttatgccgcactgacaactctcatcacccca

SEQ ID NO: 361370 - DNA, 75 bp, Artificial Sequence
  Synthetic
gcatttgaagccactgtgagaggtgccaagagaatggcagtcttgggagacacagcctgggactttggatcagtt

SEQ ID NO: 361371 - DNA, 75 bp, Artificial Sequence
  Synthetic
caattaacacccctaaccttgatagtggctatcattctgcttgtggcacactacatgtacttgatcccaggccta

SEQ ID NO: 361372 - DNA, 75 bp, Artificial Sequence
  Synthetic
gtggtaactgacattgacacaatgacaattgacccccaagtggagaagaagatgggacaagtgttactcatagca

SEQ ID NO: 361373 - DNA, 75 bp, Artificial Sequence
  Synthetic
gtagccatctccagtgctgtgctgctgcgaactgcttggggatggggggaggctggagctctgatcacagcagca

SEQ ID NO: 361374 - DNA, 75 bp, Artificial Sequence
  Synthetic
acctccaccttgtgggaaggttctccaaacaaatactggaactcctctacagccacctcactgtgcaacatcttt

SEQ ID NO: 361375 - DNA, 75 bp, Artificial Sequence
  Synthetic
agaggaagttacctggcaggcgcttctctcatttatacagtgacaagaaatgctggcctagtcaagagacgtgga

SEQ ID NO: 361376 - DNA, 75 bp, Artificial Sequence
  Synthetic
gggatctcctctgtttcaagaatggaaaacatcatgtggagatcagtagaaggggagctcaacgcaatcctggaa

SEQ ID NO: 361377 - DNA, 75 bp, Artificial Sequence
  Synthetic
gccttcacattctcaaaggttccggctgaaacgctgcatgggacagtcacagttgaggtgcagtatgcgggcaga

SEQ ID NO: 361378 - DNA, 75 bp, Artificial Sequence
  Synthetic
gtgcctgtgaacgagctgccccacggctggaaggcttgggggaaatcgtacttcgtcagagcagcaaagacaaat

SEQ ID NO: 361379 - DNA, 75 bp, Artificial Sequence
  Synthetic
acagaaatcgttgatttgatgtgccatgccaccttcacttcacgcctactacaacccattagagtccctaattac

SEQ ID NO: 361380 - DNA, 75 bp, Artificial Sequence
  Synthetic
gggagcttggtgacatgtgccaagtttacgtgttctaagaagatgaccgggaagagcattcagccggagaacttg

SEQ ID NO: 361381 - DNA, 75 bp, Artificial Sequence
  Synthetic
gttgagatgggcgaggcagcagccatctttatgactgccacaccaccaggaacccgcgatgcgtttccagattcc

SEQ ID NO: 361382 - DNA, 75 bp, Artificial Sequence
  Synthetic
tctagtcctgaagtggaagagacgcgaacactcagagtgctctctatggtgggggactggcttgagaaaagaccg

SEQ ID NO: 361383 - DNA, 75 bp, Artificial Sequence
  Synthetic
ttgaagcaagaatgcttcttgacaacatttacctccaagatggcctcatagcctcgctctatcgacctgaggccg

SEQ ID NO: 361384 - DNA, 75 bp, Artificial Sequence
  Synthetic
gcaaatcccatcataactgagagcactgaaaactcgagaatgatgttggagctggacccaccctttggagactct

SEQ ID NO: 361385 - DNA, 75 bp, Artificial Sequence
  Synthetic
agtaacatcataaaaagtgtgtccaccacaagtcagctcctcctgggacgcatggatggccccaggaggccagtg

SEQ ID NO: 361386 - DNA, 75 bp, Artificial Sequence
  Synthetic
aaatatgaggaagatgtgaacctcggctcgggcacacgagctgtggcaagctgtgctgaagctcccaacatgaag

SEQ ID NO: 361387 - DNA, 75 bp, Artificial Sequence
  Synthetic
aagaatgacacatggaggctgaagagggcccatctgatcgagatgaaaacatgtgaatggccaaagtcccacaca

SEQ ID NO: 361388 - DNA, 75 bp, Artificial Sequence
  Synthetic
tcttgatgcggaacaagggcatagggaagatgggctttggaatggtgactcttggggccagcgcatggcttatgt

SEQ ID NO: 361389 - DNA, 75 bp, Artificial Sequence
  Synthetic
gatcacatggatcacttctcccttggagtgcttgtgattctgctcatggtgcaggaagggctgaagaagagaatg

SEQ ID NO: 361390 - DNA, 75 bp, Artificial Sequence
  Synthetic
aagagtggagtggatgtcttccacatggcggccgagccgtgtgacaccttgctgtgcgacataggtgagtcatca

SEQ ID NO: 361391 - DNA, 75 bp, Artificial Sequence
  Synthetic
atggtttcttcctggctgtggaaggagctggggaaacgcaagcggccacgtgtctgcaccaaagaagagttcatc

SEQ ID NO: 361392 - DNA, 75 bp, Artificial Sequence
  Synthetic
gaggagacatgcggaacgagaggaccatctctgagatcaaccactgcaagcggaagggtcattgaggaatggtgc

SEQ ID NO: 361393 - DNA, 75 bp, Artificial Sequence
  Synthetic
gtgaatgatccaaggttttgggccctagtggacaaggagagagaacatcacctgagaggagagtgccatagctgt

SEQ ID NO: 361394 - DNA, 75 bp, Artificial Sequence
  Synthetic
ggaggatcatgggttcggggtatttcacactagtgtctggctcaaggttagagaagattattcattagagtgtga

SEQ ID NO: 361395 - DNA, 75 bp, Artificial Sequence
  Synthetic
tttgaggccactgtgagaggtgcaaaaaggatggcagtcctgggagataccgcctgggattttggttctgttgga

SEQ ID NO: 361396 - DNA, 75 bp, Artificial Sequence
  Synthetic
gggtttatgctcctctctctgaagggaaaaggcagtgtgaagaagaacttaccatttgtcatggccctgggacta

SEQ ID NO: 361397 - DNA, 75 bp, Artificial Sequence
  Synthetic
ccaggaggaaagatgtatgcagatgacaccgctggctgggatacccgtattagtaagtttgatctggagaatgaa

SEQ ID NO: 361398 - DNA, 75 bp, Artificial Sequence
  Synthetic
gccttaattaccaaccaaatggaggaagggcatagagctctagcattggctgtgattaagtacacataccaaaac

SEQ ID NO: 361399 - DNA, 75 bp, Artificial Sequence
  Synthetic
aaagtggtgaaggtcctcagaccagctgaaggagggaaaacagttatggacatcatttcaagacaagaccagaga

SEQ ID NO: 361400 - DNA, 75 bp, Artificial Sequence
  Synthetic
gggagtggacaagttgtcacttatgctctcaacacatttaccaacttggtggtgcagcttatccggaacatggag

SEQ ID NO: 361401 - DNA, 75 bp, Artificial Sequence
  Synthetic
gctgaggaagtgctagagatgcaagacttatggctgctgaggaagccagagaaagtgaccagatggttgcagtgc

SEQ ID NO: 361402 - DNA, 75 bp, Artificial Sequence
  Synthetic
aatggatgggacagactcaaacgaatggcagtcagtggagatgactgcgttgtgaagccaattgatgataggttt

SEQ ID NO: 361403 - DNA, 75 bp, Artificial Sequence
  Synthetic
ggaaagcgggttatacagcttagtaggaaaacttttgagacagagtttcagaaaacaaaaaatcaagagtgggac

SEQ ID NO: 361404 - DNA, 75 bp, Artificial Sequence
  Synthetic
tggagcaattgggaagaagtcccgttctgctcccaccatttcaacaagctgcacctcaaggatggtagatccatt

SEQ ID NO: 361405 - DNA, 75 bp, Artificial Sequence
  Synthetic
aagcaggatctggtgtcatactgtggtccatggaagctagatgccgcctgggacgggcacagcgaggtgcagctc

SEQ ID NO: 361406 - DNA, 75 bp, Artificial Sequence
  Synthetic
gagactgcctgtctagcaaaatcatatgcacagatgtggcagcttctttacttccacagaagagaccttcgactg

SEQ ID NO: 361407 - DNA, 75 bp, Artificial Sequence
  Synthetic
tcctggttttcacaaattcttattggcacacttttagtgtggttgggcttgaatacaaaaaatggatccatttcc

SEQ ID NO: 361408 - DNA, 75 bp, Artificial Sequence
  Synthetic
gagactcctgttgagtgcttcgagccttcgatgctgaagaagaagcagctaactgtcttagacttgcatcctgga

SEQ ID NO: 361409 - DNA, 75 bp, Artificial Sequence
  Synthetic
gacagttcgagtttgaagcgaaagctagcaacagtatcaacaggttttatttggatttggaaacgagagtttctg

SEQ ID NO: 361410 - DNA, 75 bp, Artificial Sequence
  Synthetic
gctccaaccagggttgtcgctgctgaaatggaggaagcccttagagggcttccagtgcgttatatgacaacagca

SEQ ID NO: 361411 - DNA, 75 bp, Artificial Sequence
  Synthetic
ggtgatgaagaaaaatacatggactacttatccacccaggtccgctacttgggtgaggaagggtccacacctgga

SEQ ID NO: 361412 - DNA, 75 bp, Artificial Sequence
  Synthetic
cagaggagaggacgtataggcaggaaccccaacaagcctggagatgagtacatgtatggaggtgggtgtgcggag

SEQ ID NO: 361413 - DNA, 75 bp, Artificial Sequence
  Synthetic
gcgttcacatttaccaaggtcccagctgaaacattgcatggaacagttacagtggaggtgcagtatgcagggaca

SEQ ID NO: 361414 - DNA, 75 bp, Artificial Sequence
  Synthetic
gacttcgctagaaaagagacaagatgtggcacaggagttttcgtctacaacgacgttgatgcctggagggacaga

SEQ ID NO: 361415 - DNA, 75 bp, Artificial Sequence
  Synthetic
attgtggacagatggaatagaagagagtgatctgatcatacccaagtctttagctgggccactcagccatcacaa

SEQ ID NO: 361416 - DNA, 75 bp, Artificial Sequence
  Synthetic
aggaagagacgtggcgcagacaccagcatcggaatcattggcctcctgctgactacagccatggcagcagagatc

SEQ ID NO: 361417 - DNA, 75 bp, Artificial Sequence
  Synthetic
gatcacatggaccacttctcccttggagtgcttgtgattctgctcatggtgcaggaagggctgaagaagagaatg

SEQ ID NO: 361418 - DNA, 75 bp, Artificial Sequence
  Synthetic
ttgggagtgaacaagtgccacgtacagatcatggacctcgggcacatgtgtgacgccaccatgagttatgagtgc

SEQ ID NO: 361419 - DNA, 75 bp, Artificial Sequence
  Synthetic
actagacgcgggagtgcatactacatgtacttggataggagcgatgccgggaaggccatttcgtttgctaccaca

SEQ ID NO: 361420 - DNA, 75 bp, Artificial Sequence
  Synthetic
atgaaaaaccccaaagaagaaatccggaggatccggattgtcaatatgctaaaacgcggagtagcccgtgtgagc

SEQ ID NO: 361421 - DNA, 75 bp, Artificial Sequence
  Synthetic
actagacgtgggagtgcatactatatgtacttggacagaagcgatgctggggaggccatatcttttccaaccaca

SEQ ID NO: 361422 - DNA, 75 bp, Artificial Sequence
  Synthetic
atttcctccgtctcaaggatggaaaacatcatgtggaagtcggtggagggagagctcaatgctatactcgaagag

SEQ ID NO: 361423 - DNA, 75 bp, Artificial Sequence
  Synthetic
caggacaagccaacagttgacatagagttggtcacgacgacggttagtaacatggccgaggtaagatcctattgc

SEQ ID NO: 361424 - DNA, 75 bp, Artificial Sequence
  Synthetic
tacattgtcataggagtcggggacaagaaaatcacccatcactggctcaagaaagggagctccatcggaaaggca

SEQ ID NO: 361425 - DNA, 75 bp, Artificial Sequence
  Synthetic
tatgaggcatcaatatcggacatggcttcggacagccgctgcccaacacaaggtgaagcctaccttgacaagcag

SEQ ID NO: 361426 - DNA, 75 bp, Artificial Sequence
  Synthetic
gagtatcggataatgctatcagtgcatggctcccagcatagcgggatgattgtcaatgatataggacatgaaact

SEQ ID NO: 361427 - DNA, 75 bp, Artificial Sequence
  Synthetic
aggatgtatgcagatgacactgctggctgggacacccgcatcagcaggtttgatctggagaatgaagctctaatc

SEQ ID NO: 361428 - DNA, 75 bp, Artificial Sequence
  Synthetic
gacgaaaacagagcgaaagtcgaggttacgcctaattcaccaagagcggaagcaaccttgggaggctttggaagc

SEQ ID NO: 361429 - DNA, 75 bp, Artificial Sequence
  Synthetic
tggttggtgcacaaagagtggtttcatgacatcccattgccttggcatgctggggcagacaccggaactccacac

SEQ ID NO: 361430 - DNA, 75 bp, Artificial Sequence
  Synthetic
atgcttttggggttgctgggaacagtctcgctgggaatctttttcgtcttgatgaggaacaagggcatagggaag

SEQ ID NO: 361431 - DNA, 75 bp, Artificial Sequence
  Synthetic
caggaaggagccgttcacacggctctcgctggagctctagaggctgagatggatggtgcaaagggaaggctgttc

SEQ ID NO: 361432 - DNA, 75 bp, Artificial Sequence
  Synthetic
cctgtgaatgagcttcctcatggatggaaagcctggggcaaatcatacttcatcaaagcagcaaagaccaacaat

SEQ ID NO: 361433 - DNA, 75 bp, Artificial Sequence
  Synthetic
gtgtggaccaagtatggagagaagagagtgctcaaaccaagatggatggacgccagggtctgctcagatcatgcg

SEQ ID NO: 361434 - DNA, 75 bp, Artificial Sequence
  Synthetic
gatggaccctgcaaggtcccagcccagatggcggtggacatgcagaccctgaccccagttggaaggctgataacc

SEQ ID NO: 361435 - DNA, 75 bp, Artificial Sequence
  Synthetic
gacattgacacaatgacaattgacccccaagtggagaaaaagatgggacaggtgctactcatagcagtagccgtc

SEQ ID NO: 361436 - DNA, 75 bp, Artificial Sequence
  Synthetic
aatgacacatggaggctgaagagggcccacctgatcgagatgaaaacatgtgaatggccaaagtcccacacattg

SEQ ID NO: 361437 - DNA, 75 bp, Artificial Sequence
  Synthetic
gccgttattggaacagctgctaagggaaaggaggctgtgcacagtgatctaggctactggattgagagtgagaag

SEQ ID NO: 361438 - DNA, 75 bp, Artificial Sequence
  Synthetic
catgcagtgaccacttcatacaacaactactccttaatggcgatggccacgcaagctggagtgttgtttggtatg

SEQ ID NO: 361439 - DNA, 75 bp, Artificial Sequence
  Synthetic
ggtgtgttcaactcactgggtaagggcattcaccagatttttggagcagccttcaaatcactgtttggaggaatg

SEQ ID NO: 361440 - DNA, 75 bp, Artificial Sequence
  Synthetic
caagtacacataccaaaacaaagtggtaaaggtccttagaccagctgaaaaagggaagacagttatggacattat

SEQ ID NO: 361441 - DNA, 75 bp, Artificial Sequence
  Synthetic
gacttctcaaaaagagaaacgagatgtggcacgggggtattcatctataatgatgttgaagcctggagggaccgg

SEQ ID NO: 361442 - DNA, 75 bp, Artificial Sequence
  Synthetic
gaccatgggtttggagttttccacactagtgtgtggctcaaagtcagggaggattactcattagagtgtgatcca

SEQ ID NO: 361443 - DNA, 75 bp, Artificial Sequence
  Synthetic
atctcatccgtttcaagaatggaaaacatcatgtggaaatcagtagaaggggagctcaatgctatcctagaggag

SEQ ID NO: 361444 - DNA, 75 bp, Artificial Sequence
  Synthetic
gaatttgaagcgaatgctaacaacagtatcaacaggttttattttggatttggaaacgagagtttctggtcatga

SEQ ID NO: 361445 - DNA, 75 bp, Artificial Sequence
  Synthetic
agttttgttgtcgacggtgacacactgaaggaatgtccgcttaagcacagagcatggaatagttttcttgtggag

SEQ ID NO: 361446 - DNA, 75 bp, Artificial Sequence
  Synthetic
gatcacgggtttggagtcttccacaccagtgtttggcttaaggtcagagaagattactcattagaatgtgaccca

SEQ ID NO: 361447 - DNA, 75 bp, Artificial Sequence
  Synthetic
agcaggccctacaaggcagcggcagcccaattgccggagaccctagagaccatcatgcttttaggcctgctggga

SEQ ID NO: 361448 - DNA, 75 bp, Artificial Sequence
  Synthetic
ggatgaataagtgttatatacagatcatggatcttggacacatgtgtgatgccaccatgagctatgaatgcccta

SEQ ID NO: 361449 - DNA, 75 bp, Artificial Sequence
  Synthetic
ggcaccaaggttcacgtggaggagacatgcggaactagaggaccatctctgagatcaactactgcaagtggaagg

SEQ ID NO: 361450 - DNA, 75 bp, Artificial Sequence
  Synthetic
acaaagatcatcatgagcacatcaatggcagtgctggtagtcatgatcttgggaggattttcaatgagtgacctg

SEQ ID NO: 361451 - DNA, 75 bp, Artificial Sequence
  Synthetic
tgcaaacgcggtcgcaaacctggttggaatcaagagaatacacaaagcacttgattagagtcgaaaattggatat

SEQ ID NO: 361452 - DNA, 75 bp, Artificial Sequence
  Synthetic
atgctgctagccctggcttcgtgtcttctgcaaactgcgatctctgctcttgaaggtgacttgatggtcctcgtt

SEQ ID NO: 361453 - DNA, 75 bp, Artificial Sequence
  Synthetic
tcctggttgtggaaagagctaggcaaacacaaacggccacgagtctgtaccaaagaagagttcatcaacaaggtt

SEQ ID NO: 361454 - DNA, 75 bp, Artificial Sequence
  Synthetic
ttggctgctctaacaccactagctcgaggcacactgctcgtggcatggagagcgggcctggctacttgtggaggg

SEQ ID NO: 361455 - DNA, 75 bp, Artificial Sequence
  Synthetic
aatggatttgctttggcctggttggcaattcgagcaatggccgtgccacgcactgacaacatcgctctagcaatc

SEQ ID NO: 361456 - DNA, 75 bp, Artificial Sequence
  Synthetic
gctgtgagggtagtagaccctattaatgtggtaggactactgttactcacaaggagtgggaagcggagctggccc

SEQ ID NO: 361457 - DNA, 75 bp, Artificial Sequence
  Synthetic
ttcatgctcctctccctgaaagggaaaggtagtgtgaagaagaacctgccatttgtcatggccctgggattgaca

SEQ ID NO: 361458 - DNA, 75 bp, Artificial Sequence
  Synthetic
cttggggccagcgcatggctcatgtggctctcagaaatcgaaccagccagaattgcatgtgtccttattgttgtg

SEQ ID NO: 361459 - DNA, 75 bp, Artificial Sequence
  Synthetic
tggacagatggagtagaaggagagtgattgatcatacccaagtccttagctggtccactcagtcaccacaacacc

SEQ ID NO: 361460 - DNA, 75 bp, Artificial Sequence
  Synthetic
gatgagagtggtgatttctccttggtagaggaagatggtccacccatgagagagatcatactcaaggtggtcctg

SEQ ID NO: 361461 - DNA, 75 bp, Artificial Sequence
  Synthetic
cctagtgaagttctcacagccgttggcctgatatgtgcactggccggagggtttgccaaggcagacattgagatg

SEQ ID NO: 361462 - DNA, 75 bp, Artificial Sequence
  Synthetic
gccgtacctcccggagagagggccagaaacattcagaccctgcctggaatattcaagacaaaggacggggacatc

SEQ ID NO: 361463 - DNA, 75 bp, Artificial Sequence
  Synthetic
attatggtggcagtgggccttttggggttgataactgcaaatgaacttggatggctggagagaacaaaaaatgac

SEQ ID NO: 361464 - DNA, 75 bp, Artificial Sequence
  Synthetic
cccgtgaatgagctgccccatggctggaaagcctgggggaaatcgtactttgtcagagcggcaaagaccaacaac

SEQ ID NO: 361465 - DNA, 75 bp, Artificial Sequence
  Synthetic
gccatttgttcatctgtgccagttgactgggttccaactgggagaactacctggtcaatccatggaaagggagaa

SEQ ID NO: 361466 - DNA, 75 bp, Artificial Sequence
  Synthetic
ggagcagttgctctggactaccctgcagggacctcaggatctccgatcctagacaaatgtggaagagtgatagga

SEQ ID NO: 361467 - DNA, 75 bp, Artificial Sequence
  Synthetic
ctctatggcaatggggttgtgatcaagaatggaagctatgttagtgctataacccagggaaagagggaggaggag

SEQ ID NO: 361468 - DNA, 75 bp, Artificial Sequence
  Synthetic
ttggatattcaggaaccctggcttcgcgttagcagcagctgccatcgcttggcttttgggaagctcaacgagcca

SEQ ID NO: 361469 - DNA, 75 bp, Artificial Sequence
  Synthetic
tccgcatgggctatttatgccgcattgacaaccctcatcaccccagccgtccagcacgcggtaactacctcgtac

SEQ ID NO: 361470 - DNA, 75 bp, Artificial Sequence
  Synthetic
agtggttagaggagaccccccggaaaacgcaaaacagcatattgacgctgggaaagaccagagactccatgagtt

SEQ ID NO: 361471 - DNA, 75 bp, Artificial Sequence
  Synthetic
gttgcatctgccggaataacttacacagacagaagatggtgctttgatggcacaaccaacaacaccataatggaa

SEQ ID NO: 361472 - DNA, 75 bp, Artificial Sequence
  Synthetic
atgcgagcagagactggaagcaggccttataaggcagcggcagcccaactgccggagaccctagagaccattatg

SEQ ID NO: 361473 - DNA, 75 bp, Artificial Sequence
  Synthetic
ctcttaggtttgctgggaacagtttcactggggatcttctttgtcttgatgcggaataagggcatcgggaagatg

SEQ ID NO: 361474 - DNA, 75 bp, Artificial Sequence
  Synthetic
gaaagagcaggtgacatcacatgggaaaaggatgcagaaataactggaaacagtcctaggcttgatgtggcattg

SEQ ID NO: 361475 - DNA, 75 bp, Artificial Sequence
  Synthetic
tgtgtcctcattgttgtgtttttattactggtggtgctcatacccgagccagagaagcaaagatctccccaagat

SEQ ID NO: 361476 - DNA, 75 bp, Artificial Sequence
  Synthetic
gcatgggacttaggagtcccgttgctaatgatgggctgctactcacaactaacacccctgaccctgatagtagcc

SEQ ID NO: 361477 - DNA, 75 bp, Artificial Sequence
  Synthetic
aaccagatggcaattatcatcatggtggcagtgggccttctaggtttgataactgcaaacgaacttggatggctg

SEQ ID NO: 361478 - DNA, 75 bp, Artificial Sequence
  Synthetic
gcggtaaccacttcatacaacaactactccttaatggcgatggccacacaagctggagtgctgtttggcatgggc

SEQ ID NO: 361479 - DNA, 75 bp, Artificial Sequence
  Synthetic
ctgactctgatagtagctatcattctgcttgtggcgcactacatgtacttgatcccaggcctacaagcggcagca

SEQ ID NO: 361480 - DNA, 75 bp, Artificial Sequence
  Synthetic
atcattttgcttgtggcacattacatgtacttgatcccaggcctacaggcagcagcagcacgcgctgcccagaag

SEQ ID NO: 361481 - DNA, 75 bp, Artificial Sequence
  Synthetic
tgctcctctctctgaagggaaaaggcagtgtgaagaagaacttaccatttgtcatggccctgggactaaccgctg

SEQ ID NO: 361482 - DNA, 75 bp, Artificial Sequence
  Synthetic
agtgctgtgctgctgcggaccgcctggggatggggggaggctggagctctgatcacagcagcgacctccaccttg

SEQ ID NO: 361483 - DNA, 75 bp, Artificial Sequence
  Synthetic
atggccgtgtgcggcgtgagtcccatagccataccctttgcagctggagcttggtatgtgtacatcaagactggc

SEQ ID NO: 361484 - DNA, 75 bp, Artificial Sequence
  Synthetic
ctggcaggagcttcccttatctatacagtgacgagaaacgctggcctggttaagagacgtggaggtgggacggga

SEQ ID NO: 361485 - DNA, 75 bp, Artificial Sequence
  Synthetic
gagactctgggagagaagtggaaagctcgtctgaatcagatgtcggccctggagttctactcttataaaaagtca

SEQ ID NO: 361486 - DNA, 75 bp, Artificial Sequence
  Synthetic
ggtatcactgaagtgtgtagagaggaggctcgccgtgccctcaaggatggagtggccacaggaggacatgccgta

SEQ ID NO: 361487 - DNA, 75 bp, Artificial Sequence
  Synthetic
aaacggagtggagccctctgggacataccggcacccaaggaagtgaagaaaggggaaacaactgatggcgtgtat

SEQ ID NO: 361488 - DNA, 75 bp, Artificial Sequence
  Synthetic
ggatgtggcagagggggctggagctattatgccgccaccatccgcaaagtgcaggaggtgagaggatacacaaag

SEQ ID NO: 361489 - DNA, 75 bp, Artificial Sequence
  Synthetic
gacccccaagtggagaagaagatgggacaagtgctacttatagcagtggctgtctccagtgctgtgttgctgcgg

SEQ ID NO: 361490 - DNA, 75 bp, Artificial Sequence
  Synthetic
gaaaaaagaggctatggaaataataaagaagttcaagaaagatctggctgccatgctgagaataatcaatgctag

SEQ ID NO: 361491 - DNA, 75 bp, Artificial Sequence
  Synthetic
catcaggatggtcttggcgattctagcctttttgagattcacggcaatcaagccatcactgggtctcatcaatag

SEQ ID NO: 361492 - DNA, 75 bp, Artificial Sequence
  Synthetic
cgtgttatgacccgcagactgttgggctcaacacaggttggagtgggagtcatgcaggagggggttttccacaca

SEQ ID NO: 361493 - DNA, 75 bp, Artificial Sequence
  Synthetic
ccacagctatggcagcggaggtcactagacgtgggagtgcatactatatgtacttggacagaaacgatgctgggg

SEQ ID NO: 361494 - DNA, 75 bp, Artificial Sequence
  Synthetic
atgaataagtgttatatacagatcatggatcttggacacatgtgtgatgccaccatgagctatgaatgccctatg

SEQ ID NO: 361495 - DNA, 75 bp, Artificial Sequence
  Synthetic
aaaagtgtgtccaccacaagtcagctcctcctgggacgcatggatggccccaggaggccagtgaaatatgaggag

SEQ ID NO: 361496 - DNA, 75 bp, Artificial Sequence
  Synthetic
atggcaatggggtcgtgatcaaaaatgggagttatgttagtgccatcacccaagggaggagggaggaagagactc

SEQ ID NO: 361497 - DNA, 75 bp, Artificial Sequence
  Synthetic
gaagcacggagatctagaagagctgtgacgctcccctcccattccactaggaagctgcaaacgcggtcgcaaacc

SEQ ID NO: 361498 - DNA, 75 bp, Artificial Sequence
  Synthetic
tgtcaggtgggacttgggttgatgttgtcttggaacatggaggttgtgtcaccgtaatggcacaggacaaaccga

SEQ ID NO: 361499 - DNA, 75 bp, Artificial Sequence
  Synthetic
ttcaaagaaaaagtggacaccagggtgccagatccccaagaaggcactcgccaggtaatgaacatggtctcttcc

SEQ ID NO: 361500 - DNA, 75 bp, Artificial Sequence
  Synthetic
ggagtaccggataatgctgtcagttcatggctcccagcacagtgggatgatcgttaatgacacaggacatgaaac

SEQ ID NO: 361501 - DNA, 75 bp, Artificial Sequence
  Synthetic
agcaatgcagcactgggagcaatatttgaagaggaaaaagaatggaagacggctgtggaagctgtgaatgatcca

SEQ ID NO: 361502 - DNA, 75 bp, Artificial Sequence
  Synthetic
gtgaagagcttgaaattcggtttgaggaatgcccaggcactaagatccacgtggaggaaacatgtggaacaagag

SEQ ID NO: 361503 - DNA, 75 bp, Artificial Sequence
  Synthetic
gtgaagagcttgaaattcggtttgaggaatgcccaggcactaagttccacgtggaggaaacatgtggaacaagag

SEQ ID NO: 361504 - DNA, 75 bp, Artificial Sequence
  Synthetic
gtgaagagcttgaaattcggtttgaggaatgcccaggcactaagctccacgtggaggaaacatgtggaacaagag

SEQ ID NO: 361505 - DNA, 75 bp, Artificial Sequence
  Synthetic
gtgaagagcttgaaattcggtttgaggaatgcccaggcactaaggtccacgtggaggaaacatgtggaacaagag

SEQ ID NO: 361506 - DNA, 75 bp, Artificial Sequence
  Synthetic
caagacctggtgtcatactgcggaccttggaagttggatgccgcttgggacggactcagcgaggtccaactgttg

SEQ ID NO: 361507 - DNA, 75 bp, Artificial Sequence
  Synthetic
atcaagagtgggactttgtcgtgacaactgacatttcagagatgggcgccaactttaaagctgaccgtgtcatag

SEQ ID NO: 361508 - DNA, 75 bp, Artificial Sequence
  Synthetic
ggcggagttgaaggactgggactgcagagactgggctatgtccttgaggagatgagccaggcaccaggagggaag

SEQ ID NO: 361509 - DNA, 75 bp, Artificial Sequence
  Synthetic
aaatactggaactcctccacagccacctcactgtgcaacatcttcagaggaagttacttggcaggagcttccctt

SEQ ID NO: 361510 - DNA, 75 bp, Artificial Sequence
  Synthetic
atgggggccactttcgcagaaatgaacactggaggagacgtagctcacttggcattagtagcggcatttaaagtc

SEQ ID NO: 361511 - DNA, 75 bp, Artificial Sequence
  Synthetic
ggctggagggttcgccaaggcagatatagagatggctgggcccatggccgcggtcggtctgctaattgtcagtta

SEQ ID NO: 361512 - DNA, 75 bp, Artificial Sequence
  Synthetic
tggaaagcccgcctgaatcagatgtcggccttggagttctactcttacaaaaagtcaggcatcactgaagtatgt

SEQ ID NO: 361513 - DNA, 75 bp, Artificial Sequence
  Synthetic
ttagagatgcaagacttatggctgttgaggaagccagagaaagtgaccagatggttgcagagcaatggatgggat

SEQ ID NO: 361514 - DNA, 75 bp, Artificial Sequence
  Synthetic
agatgtagctcatctggcgctgatagcggcattcaaagtcagaccagcgttgctggtatctttcatcttcagagc

SEQ ID NO: 361515 - DNA, 75 bp, Artificial Sequence
  Synthetic
gttccaagcgtgaggaacggcaatgagatcgcagcttgtctgacaaaggctggaaaacgggtcatacagctcagc

SEQ ID NO: 361516 - DNA, 75 bp, Artificial Sequence
  Synthetic
ggagcagtggccttagactacccagcggggacatctggatccccaatcctggataaaaacggaagagtcatagga

SEQ ID NO: 361517 - DNA, 75 bp, Artificial Sequence
  Synthetic
cgccaccaagatgaactgattggccgagctcgcgtttcaccaggggcaggatggagcatccgggagactgcctgt

SEQ ID NO: 361518 - DNA, 75 bp, Artificial Sequence
  Synthetic
cttgcaaaatcatatgcgcagatgtggcagctcctttatttccacagaagagaccttcgactgatggctaatgcc

SEQ ID NO: 361519 - DNA, 75 bp, Artificial Sequence
  Synthetic
atggaaaccctcgactggatggagcaattgggaagaggtcccgttctgttctcaccacttcaacaagctgcacct

SEQ ID NO: 361520 - DNA, 75 bp, Artificial Sequence
  Synthetic
ggctctcggaaattgagccagccagaattgcatgtgtcctcattgttgtgttcctattgctggtggtgctcatac

SEQ ID NO: 361521 - DNA, 75 bp, Artificial Sequence
  Synthetic
acccatgcctgtcacacatgccagcgctgcccagaggagggggcgcataggcaggaatcccaacaaaactggaga

SEQ ID NO: 361522 - DNA, 75 bp, Artificial Sequence
  Synthetic
acccatgcctgtcacacatgccagcgctgcccagaggagggggcgcataggcaggaatcccaacaaatctggaga

SEQ ID NO: 361523 - DNA, 75 bp, Artificial Sequence
  Synthetic
acccatgcctgtcacacatgccagcgctgcccagaggagggggcgcataggcaggaatcccaacaaacctggaga

SEQ ID NO: 361524 - DNA, 75 bp, Artificial Sequence
  Synthetic
acccatgcctgtcacacatgccagcgctgcccagaggagggggcgcataggcaggaatcccaacaaagctggaga

SEQ ID NO: 361525 - DNA, 75 bp, Artificial Sequence
  Synthetic
ctcagatggttggtggagagaggatatctgcagccctatggaaaggttgttgatctcggatgcggcagagggggc

SEQ ID NO: 361526 - DNA, 75 bp, Artificial Sequence
  Synthetic
gctaacaacagtatcaacaggttttattttggatttggaaacgagagtttctggtcatgaaaaacccaaaaaaga

SEQ ID NO: 361527 - DNA, 75 bp, Artificial Sequence
  Synthetic
caagagacgtgggggtggaacaggagagaccctgggagagaaatggaaggcccgcttgaaccagatgtcggccct

SEQ ID NO: 361528 - DNA, 75 bp, Artificial Sequence
  Synthetic
gctccgttggagtgctttgagccatcaatgttgaggaagaagcagttaacagtcctggatttgcaccctggagct

SEQ ID NO: 361529 - DNA, 75 bp, Artificial Sequence
  Synthetic
cctgcagccccatggaaaggtcattgatcttggatgtggcagagggggctggagttactacgccgccaccatccg

SEQ ID NO: 361530 - DNA, 75 bp, Artificial Sequence
  Synthetic
ctggagttctactcctacaaaaagacaggcatcaccgaggtgtgcagagaagaggcccgccgcgccctcaaggac

SEQ ID NO: 361531 - DNA, 75 bp, Artificial Sequence
  Synthetic
acaatgacaattgacccccaagtggagaaaaagatgggacaggtgctactcatagcagtagccgtctccagcgcc

SEQ ID NO: 361532 - DNA, 75 bp, Artificial Sequence
  Synthetic
acataggtgagtcatcatctagtcctgaagtggaagaagcacggacgctcagagttctctccatggtgggggata

SEQ ID NO: 361533 - DNA, 75 bp, Artificial Sequence
  Synthetic
acataggtgagtcatcatctagtcctgaagtggaagaagcacggacgctcagagttctctccatggtgggggatt

SEQ ID NO: 361534 - DNA, 75 bp, Artificial Sequence
  Synthetic
acataggtgagtcatcatctagtcctgaagtggaagaagcacggacgctcagagttctctccatggtgggggatc

SEQ ID NO: 361535 - DNA, 75 bp, Artificial Sequence
  Synthetic
acataggtgagtcatcatctagtcctgaagtggaagaagcacggacgctcagagttctctccatggtgggggatg

SEQ ID NO: 361536 - DNA, 75 bp, Artificial Sequence
  Synthetic
gtgccactctcccgcaactctacacatgagatgtactgggtctctggagcgaaaagcaacaccataaaaagtgtg

SEQ ID NO: 361537 - DNA, 75 bp, Artificial Sequence
  Synthetic
aggaatagccatgaccgacaccacaccgtatggtcagcaaagagttttcaaggaaaaagtggacactagggtgcc

SEQ ID NO: 361538 - DNA, 75 bp, Artificial Sequence
  Synthetic
agagaaaagaaacaaggggaatttggaaaggccaagggcagccgcgccatctggtatatgtggctaggggctaga

SEQ ID NO: 361539 - DNA, 75 bp, Artificial Sequence
  Synthetic
ccaacaagggtagtggcggctgagatggaagaggccttaaggggccttccagttcggtatatgacgccagccata

SEQ ID NO: 361540 - DNA, 75 bp, Artificial Sequence
  Synthetic
acacataccaaaacaaagtggtaaaggtccttagaccagctgaaaaagggaaaacagttatggacattatttcga

SEQ ID NO: 361541 - DNA, 75 bp, Artificial Sequence
  Synthetic
ctggccgctttaacaccattggccagaggcacactgctcgtggcatggagagcgggcctcgccacttgtggaggg

SEQ ID NO: 361542 - DNA, 75 bp, Artificial Sequence
  Synthetic
gctgagtcgtgtgacactttgctgtgtgacataggtgagtcatcatccagtcctgaagtggaggagacgcgaaca

SEQ ID NO: 361543 - DNA, 75 bp, Artificial Sequence
  Synthetic
aaaacagttatggacattatttcgagacaagaccaaagggggagcggacaagttgtcacttacgctcttaacaca

SEQ ID NO: 361544 - DNA, 75 bp, Artificial Sequence
  Synthetic
tgaatctcggctctggcacgcgggctgtggtaagctgcgctgaagctcccaacatgaagatcattggtaaccgca

SEQ ID NO: 361545 - DNA, 75 bp, Artificial Sequence
  Synthetic
cggcccttgctggagctctggaggctgagatggatggtgcaaagggaaggctgtcctctggccacttgaaatgtc

SEQ ID NO: 361546 - DNA, 75 bp, Artificial Sequence
  Synthetic
tacaccagcaccatgatggagaccatggagcgactgcaacgtaggtatgggggaggactagtcagagtgccactg

SEQ ID NO: 361547 - DNA, 75 bp, Artificial Sequence
  Synthetic
atcagagtcccaaactacaacttgtacatcatggatgaggcccatttcacggatccatcgagcattgcggcaaga

SEQ ID NO: 361548 - DNA, 75 bp, Artificial Sequence
  Synthetic
cagctcagatggcggtggacatgcaaactctgaccccagttgggaggttgataaccgctaaccccgtaatcactg

SEQ ID NO: 361549 - DNA, 75 bp, Artificial Sequence
  Synthetic
tcccgcaattctacacatgagatgtattgggtctctggagcaaaaagtaacatcataaaaagtgtgtccaccaca

SEQ ID NO: 361550 - DNA, 75 bp, Artificial Sequence
  Synthetic
aacacaaggtgaagcctaccttgacaagcaatcagacactcaatatgtctgcaaaagaacgttagtggacagagg

SEQ ID NO: 361551 - DNA, 75 bp, Artificial Sequence
  Synthetic
ctggggaaatggatgtggactttttggcaaagggagcctggtgacatgcgctaagtttgcatgctccaagaaaat

SEQ ID NO: 361552 - DNA, 75 bp, Artificial Sequence
  Synthetic
gatgcttttccagattccaactcccctatcatggacacagaaattgaggtcccagaaagagcctggaactcgggt

SEQ ID NO: 361553 - DNA, 75 bp, Artificial Sequence
  Synthetic
tcaaacgaatggcagtcagtggagatgattgcgttgtgaagccaattgatgataggtttgcacatgccctcaggt

SEQ ID NO: 361554 - DNA, 75 bp, Artificial Sequence
  Synthetic
acggctggaaggcttgggggaaatcgtacttcgtcagagcagcaaagacaaataacagctttgtcgtggatggtg

SEQ ID NO: 361555 - DNA, 75 bp, Artificial Sequence
  Synthetic
tgagatggatggtgcaaagggaaggctgtcctctggccacttgaaatgtcgcctgaaaatggataaacttagatt

SEQ ID NO: 361556 - DNA, 75 bp, Artificial Sequence
  Synthetic
gctggaacttgatccaccatttggggactcttacattgtcataggagtcggggagaagaagatcacccaccactg

SEQ ID NO: 361557 - DNA, 75 bp, Artificial Sequence
  Synthetic
ggaaagaaccagaaagcaacttagtaaggtcaatggtgactgcaggatcaactgatcacatggatcacttctccc

SEQ ID NO: 361558 - DNA, 75 bp, Artificial Sequence
  Synthetic
acatagagcatggaacagctttcttgtggaggatcatgggttcggggtatttcacactagtgtctggctcaaggt

SEQ ID NO: 361559 - DNA, 75 bp, Artificial Sequence
  Synthetic
ctgttggcctgatatgcgcattggctggagggttcgccaaggcagatatagagatggctgggcccatggccgcgg

SEQ ID NO: 361560 - DNA, 75 bp, Artificial Sequence
  Synthetic
ctgctgggactgctaggagcggtgtcaatgggagtgttctttgtattgatgaggaacaaaggcattgggaaaatg

SEQ ID NO: 361561 - DNA, 75 bp, Artificial Sequence
  Synthetic
accagggtgccagaccctcaagaaggtactcgccaggtaatgaacatggtcgcttcctggctgtggaaggagctg

SEQ ID NO: 361562 - DNA, 75 bp, Artificial Sequence
  Synthetic
gatccgcgctgagaagcggtgaagggagacttgatccatactggggagatgtcaagcaggatctggtgtcatact

SEQ ID NO: 361563 - DNA, 75 bp, Artificial Sequence
  Synthetic
cactggaggagatgtagctcatctggcgctgatagcggcattcaaagtcagaccagcgttgctggtatctttcat

SEQ ID NO: 361564 - DNA, 75 bp, Artificial Sequence
  Synthetic
acccagcaggaacttcaggatctccaatcctagacaagtgtgggagagtgataggactttatggcaatggggtcg

SEQ ID NO: 361565 - DNA, 75 bp, Artificial Sequence
  Synthetic
cgccttggaaggcgacctgatggttctcatcaatggttttgctttggcctggttggcaatacgagcgatggttgt

SEQ ID NO: 361566 - DNA, 75 bp, Artificial Sequence
  Synthetic
tgcgtcctcattgtggtgtttctgttgttggtcgtgctcatacccgagccggagaaacagcgatccccgcaagac

SEQ ID NO: 361567 - DNA, 75 bp, Artificial Sequence
  Synthetic
ctgaaatggaggaagcccttagagggcttccagtgcgttatatgacaacagcagtcaatgtcacccactctggaa

SEQ ID NO: 361568 - DNA, 75 bp, Artificial Sequence
  Synthetic
cagaaatcgtcgacttaatgtgccatgccaccttcacttcacgtctactacagccaatcagagtccccaactata

SEQ ID NO: 361569 - DNA, 75 bp, Artificial Sequence
  Synthetic
gaaaacgggtcatacagctcagcagaaagacttttgagacagagttccagaaaacaaaacatcaagagtgggact

SEQ ID NO: 361570 - DNA, 75 bp, Artificial Sequence
  Synthetic
gaaagaacaaagagtgacatagctcacctaatgggcaggaaggatgaggagaggatggtggggttctcaattgac

SEQ ID NO: 361571 - DNA, 75 bp, Artificial Sequence
  Synthetic
aagcaaggggaattcgggaaagcaaaaggcagtcgcgccatctggtacatgtggttgggagccagattcttggag

SEQ ID NO: 361572 - DNA, 75 bp, Artificial Sequence
  Synthetic
ttcgtggagggcatgtcaggtgggacctgggttgatgttgtcttggaacatgggggttgcgtcaccgtgatggca

SEQ ID NO: 361573 - DNA, 75 bp, Artificial Sequence
  Synthetic
gcagtcaccacctcctacaacaactactcccttatggcgatggcaacccaagcgggtgtgttgttcggcatggga

SEQ ID NO: 361574 - DNA, 75 bp, Artificial Sequence
  Synthetic
ggactgcaaagacttggatacgttctagaagaaatgagccgggcaccaggaggaaagatgtatgcagatgacacc

SEQ ID NO: 361575 - DNA, 75 bp, Artificial Sequence
  Synthetic
ggaagtcccagagagagcctggagctcaggctttgattgggtgacggatcattctggaaaaacagtttggtttgt

SEQ ID NO: 361576 - DNA, 75 bp, Artificial Sequence
  Synthetic
gatgggcgccaactttaaagctgaccgtgtcatagattccaggagatgcctaaagccggtcatacttgatggcga

SEQ ID NO: 361577 - DNA, 75 bp, Artificial Sequence
  Synthetic
ttgggacttgactgtgaaccaaggacaggccttgacttctcagatctgtattacctgaccatgaacaataagcat

SEQ ID NO: 361578 - DNA, 75 bp, Artificial Sequence
  Synthetic
tcattttgctcgtggcgcactacatgtacttgatcccagggctgcaggcagcagctgcgcgcgctgcccagaaga

SEQ ID NO: 361579 - DNA, 75 bp, Artificial Sequence
  Synthetic
ggaaaaaccaggagggttcttcctgaaatagtccgtgaagccataaaaaagagactccggacagtgatcttggca

SEQ ID NO: 361580 - DNA, 75 bp, Artificial Sequence
  Synthetic
ctcactctcatagtagccatcaccctgctagtggctcattacatgtacttgattccaggcctgcaggcagcagca

SEQ ID NO: 361581 - DNA, 75 bp, Artificial Sequence
  Synthetic
ccaactagggttgtcgctgctgagatggaggaggccttgagaggacttccggtgcgttacatgacaacagcagtc

SEQ ID NO: 361582 - DNA, 75 bp, Artificial Sequence
  Synthetic
gagaagaggcccgccgcgccctcaaggacggtgtggcaacgggaggccatgctgtgtcccgaggaagtgcaaagc

SEQ ID NO: 361583 - DNA, 75 bp, Artificial Sequence
  Synthetic
ggaggaaaaacagtcatggacatcatttcaagacaagaccagagggggagcggacaagttgtcacttatgctctc

SEQ ID NO: 361584 - DNA, 75 bp, Artificial Sequence
  Synthetic
tggaagggctctccaaacaaatactggaactcctccacggccacatctctgtgtaacatctttaggggcagttac

SEQ ID NO: 361585 - DNA, 75 bp, Artificial Sequence
  Synthetic
aacccgtgttggtgcaaagctatgggtggaacatagtccgtcttaagagtggggtggacgtctttcatatggcgg

SEQ ID NO: 361586 - DNA, 75 bp, Artificial Sequence
  Synthetic
tacaagtaccatcctgactccccccgcagattggcagcagctgttaagcaggcttgggaagaggggatttgtggg

SEQ ID NO: 361587 - DNA, 75 bp, Artificial Sequence
  Synthetic
aacacatttaccaacttggtggtgcagctcatccggaacatggaggctgaggaagtgttagagatgcaagactta

SEQ ID NO: 361588 - DNA, 75 bp, Artificial Sequence
  Synthetic
gcacgcgggctgtggtaagctgcgctgaagctcccaacatgaagatcattggtaaccgcattgaaaggatccgca

SEQ ID NO: 361589 - DNA, 75 bp, Artificial Sequence
  Synthetic
gagaccctcggagaaaagtggaaatctcgattgaatcagatgtcagccctggagttctactcatacaaaaagtca

SEQ ID NO: 361590 - DNA, 75 bp, Artificial Sequence
  Synthetic
ttcactgtgtaacatttttaggggaagttacttggctggagcttctctaatctacacagtaacaagaaacgctgg

SEQ ID NO: 361591 - DNA, 75 bp, Artificial Sequence
  Synthetic
gtcagtggtgatgactgtgttgtaaagccaattgatgacaggtttgcacacgccctcaggttcttgaatgatatg

SEQ ID NO: 361592 - DNA, 75 bp, Artificial Sequence
  Synthetic
tcccgaggaagcgcaaagctcagatggcttgtggagagagggtacctgcagccacatgggaaggttgttgaccta

SEQ ID NO: 361593 - DNA, 75 bp, Artificial Sequence
  Synthetic
ggagcgactgcagcgtaggtatgggggaggactggtcagagtgccactctcccgcaactctacacatgagatgta

SEQ ID NO: 361594 - DNA, 75 bp, Artificial Sequence
  Synthetic
ctggctgctctaacaccattagccagaggcacactgctcgtggcatggagagcgggcctcgccacttgtggaggg

SEQ ID NO: 361595 - DNA, 75 bp, Artificial Sequence
  Synthetic
tgaagctcccaacatgaagatcattggtaaccgcattgaaaggatccgcagtgagcacgcggaaacgtggttctt

SEQ ID NO: 361596 - DNA, 75 bp, Artificial Sequence
  Synthetic
cctagtgaagtgcttacagctgttggcctgatatgtgcactggccggagggtttgccaaggcagacatagagatg

SEQ ID NO: 361597 - DNA, 75 bp, Artificial Sequence
  Synthetic
ggaggacctggccatgaagagccaatgctagtgcagagctatggttggaacatagtccgcctcaagagcggagtg

SEQ ID NO: 361598 - DNA, 75 bp, Artificial Sequence
  Synthetic
gaagactgcagtggaagctgtgaacgatccaaggttctgggctctagtggacaaggaaagagagcaccacctgag

SEQ ID NO: 361599 - DNA, 75 bp, Artificial Sequence
  Synthetic
aggagagtgccagagctgtgtgtacaacatgatgggaaaaagagaaaagaaacaaggggaatttggaaaggccaa

SEQ ID NO: 361600 - DNA, 75 bp, Artificial Sequence
  Synthetic
attggccgggctcgcgtttcgccgggggcaggatggagcatccgggagactgcctgtcttgcaaaatcatatgca

SEQ ID NO: 361601 - DNA, 75 bp, Artificial Sequence
  Synthetic
ggatatatatcaacaagggttgaaatgggcgaggcggctgctatcttcatgactgctacaccaccaggaacccgc

SEQ ID NO: 361602 - DNA, 75 bp, Artificial Sequence
  Synthetic
aaaaccccacgcgcttggaggcgcaggatgggaaaagaaggtggcgaccttccccacccttcaatctggggcctg

SEQ ID NO: 361603 - DNA, 75 bp, Artificial Sequence
  Synthetic
actcattcggaatatggaggctgaggaagttctagagatgcaagacttgtggctgctgcggaggtcagagaaagt

SEQ ID NO: 361604 - DNA, 75 bp, Artificial Sequence
  Synthetic
gattccggattgtcaatatgctaaaacgcggagtagcccgtgtgagcccctttgggggcttgaagaggctgccag

SEQ ID NO: 361605 - DNA, 75 bp, Artificial Sequence
  Synthetic
gcctgtctgacaaaggctggaaagcgggtcatacagctcagcaggaagacttttgagacagagtttcagaagaca

SEQ ID NO: 361606 - DNA, 75 bp, Artificial Sequence
  Synthetic
gtggaggaaactagaacactcagagtgctttccatggtgggggattggttggagaagagaccaggagccttttgc

SEQ ID NO: 361607 - DNA, 75 bp, Artificial Sequence
  Synthetic
ctccaggatggcctcatagcctcgctctatcggcctgaggccgacaaggtagccgccattgagggagagttcaag

SEQ ID NO: 361608 - DNA, 75 bp, Artificial Sequence
  Synthetic
cagaagggacctccgactgatggccaatgccatttgttcatctgtgccagttgactgggttccaactgggagaac

SEQ ID NO: 361609 - DNA, 75 bp, Artificial Sequence
  Synthetic
atggatgccctgggaacattgccaggacacatgacagagaggtttcaggaagccattgacaatctcgctgtgctc

SEQ ID NO: 361610 - DNA, 75 bp, Artificial Sequence
  Synthetic
tgaggagaacgaccacatggaagacaagaccccagttacgaaatggacagacattccctatttgggaaaaaggga

SEQ ID NO: 361611 - DNA, 75 bp, Artificial Sequence
  Synthetic
catggtgcgcaggatcataggtgatgaagaaaagtacatggactacctatccacccaagttcgctacttgggtga

SEQ ID NO: 361612 - DNA, 75 bp, Artificial Sequence
  Synthetic
attgatctgcggccagcctccgcctgggctatttatgccgcattgacaactctcatcaccccagccgtccaacat

SEQ ID NO: 361613 - DNA, 75 bp, Artificial Sequence
  Synthetic
ctgaccctgatagtggccatcattctgcttgtggcacactacatgtacttgatcccaggtttgcaggcagcagca

SEQ ID NO: 361614 - DNA, 75 bp, Artificial Sequence
  Synthetic
tccccacccttcaatctggggcctgaactggagatcagctgtggatctccagaagagggactagtggttagagga

SEQ ID NO: 361615 - DNA, 75 bp, Artificial Sequence
  Synthetic
gcacgtgctgcccagaagaggacagcagctggcatcatgaagaatcccgttgtggatggaatagtggtgactgac

SEQ ID NO: 361616 - DNA, 75 bp, Artificial Sequence
  Synthetic
aagagtgtttctaccacgagccagcttctgctgggacgaatggatgggcctaggaggccagtgaaatatgaggag

SEQ ID NO: 361617 - DNA, 75 bp, Artificial Sequence
  Synthetic
tggcggtggacatgcaaactctgaccccagttgggaggttgataaccgctaaccccgtaatcactgaaagcactg

SEQ ID NO: 361618 - DNA, 75 bp, Artificial Sequence
  Synthetic
ggggaggctggggctctgatcacagccgcaacttccactttgtgggaaggctctccgaacaagtactggaactcc

SEQ ID NO: 361619 - DNA, 75 bp, Artificial Sequence
  Synthetic
agattttgggctctagtggacaaggaaagagaacaccacctgagaggagagtgtcatagctgtgtgtacaacatg

SEQ ID NO: 361620 - DNA, 75 bp, Artificial Sequence
  Synthetic
cgttgctgatgtggttgggtctgaacacaaagaatggatctatttcccttatgtgcttggccttagggggagtgt

SEQ ID NO: 361621 - DNA, 75 bp, Artificial Sequence
  Synthetic
aggttcttgaatgacatgggaaaggttaggaaagacacacaggaatggaaaccctcgactggatggagcaattgg

SEQ ID NO: 361622 - DNA, 75 bp, Artificial Sequence
  Synthetic
ggaaccaggtttttggagtttgaatcactggggtttctgaacgaagatcactggatgggaagagaaaactctgga

SEQ ID NO: 361623 - DNA, 75 bp, Artificial Sequence
  Synthetic
ggatccaggtttttggagtttgaatcactggggtttctgaacgaagatcactggatgggaagagaaaactctgga

SEQ ID NO: 361624 - DNA, 75 bp, Artificial Sequence
  Synthetic
ggacccaggtttttggagtttgaatcactggggtttctgaacgaagatcactggatgggaagagaaaactctgga

SEQ ID NO: 361625 - DNA, 75 bp, Artificial Sequence
  Synthetic
ggagccaggtttttggagtttgaatcactggggtttctgaacgaagatcactggatgggaagagaaaactctgga

SEQ ID NO: 361626 - DNA, 75 bp, Artificial Sequence
  Synthetic
gaagaaaagtacatggactacctatccacccaagtacgttacttgggtgaggaagggtccacacctggagtgctg

SEQ ID NO: 361627 - DNA, 75 bp, Artificial Sequence
  Synthetic
gaagaaaagttcatggactacctatccacccaagtacgttacttgggtgaggaagggtccacacctggagtgctg

SEQ ID NO: 361628 - DNA, 75 bp, Artificial Sequence
  Synthetic
gaagaaaagtccatggactacctatccacccaagtacgttacttgggtgaggaagggtccacacctggagtgctg

SEQ ID NO: 361629 - DNA, 75 bp, Artificial Sequence
  Synthetic
gaagaaaagtgcatggactacctatccacccaagtacgttacttgggtgaggaagggtccacacctggagtgctg

SEQ ID NO: 361630 - DNA, 75 bp, Artificial Sequence
  Synthetic
atgtacgcagatgacactgcgggttgggacaccagaattagcaagtttgacttggaaaatgaggccctgatcacc

SEQ ID NO: 361631 - DNA, 75 bp, Artificial Sequence
  Synthetic
tacgagcgatggttgttccacgcactgacaacatcaccttggcaatcctggctgctctgacaccactggcccggg

SEQ ID NO: 361632 - DNA, 75 bp, Artificial Sequence
  Synthetic
tagaaggggagctcaacgcaatcctggaagagaatggagttcaactgacggtcgttgtgggatctgtaaaaaacc

SEQ ID NO: 361633 - DNA, 75 bp, Artificial Sequence
  Synthetic
gttctcagaccagctgaaggaggaagaacagtaatggacatcatctcaaggcaagaccagagagggagtggacaa

SEQ ID NO: 361634 - DNA, 75 bp, Artificial Sequence
  Synthetic
taaggtcaatggtgactgcaggatcaactgatcacatggatcacttctcccttggagtgcttgtgattctgctca

SEQ ID NO: 361635 - DNA, 75 bp, Artificial Sequence
  Synthetic
tcgacttaatgtgccatgccaccttcacttcacgtctactacagccaatcagagtccccaactataatctgtata

SEQ ID NO: 361636 - DNA, 75 bp, Artificial Sequence
  Synthetic
aagctcaaacggatggcagttagtggagatgactgcgttgtgaaaccaattgatgataggtttgcacatgccctc

SEQ ID NO: 361637 - DNA, 75 bp, Artificial Sequence
  Synthetic
tttgaggccactgtgagaggcgccaagagaatggcagtcctgggggatacagcctgggacttcggatcagtcggg

SEQ ID NO: 361638 - DNA, 75 bp, Artificial Sequence
  Synthetic
ccatgagagagatcatactcaaggtggtcctgatgaccatctgtggcatgaacccaatagccataccctttgcag

SEQ ID NO: 361639 - DNA, 75 bp, Artificial Sequence
  Synthetic
gtagcggcatttaaagtcagaccagccttgctggtctccttcattttcagagccaattggacaccccgtgagagc

SEQ ID NO: 361640 - DNA, 75 bp, Artificial Sequence
  Synthetic
gtgccatcacccaagggaggagggaggaagagactcctgttgagtgcttcgagccttcgatgctgaagaagaagc

SEQ ID NO: 361641 - DNA, 75 bp, Artificial Sequence
  Synthetic
tggtggtgctcatacctgagccagaaaagcaaagatctccccaggacaaccaaatggcaatcatcatcatggtag

SEQ ID NO: 361642 - DNA, 75 bp, Artificial Sequence
  Synthetic
ggagccagattcttggagtttgaagcccttggattcttgaacgaggaccattggatgggaagagaaaactcagga

SEQ ID NO: 361643 - DNA, 75 bp, Artificial Sequence
  Synthetic
taatgggaaggagagaggagggggcaaccataggattctcaatggacattgacctgcggccagcctcagcttggg

SEQ ID NO: 361644 - DNA, 75 bp, Artificial Sequence
  Synthetic
gaagaaaagtacatggactatctatccacccaagtccgctacttgggtgaggaagggtccacacccggagtgttg

SEQ ID NO: 361645 - DNA, 75 bp, Artificial Sequence
  Synthetic
aaagaagagacttcgcacagtgatcctagcaccaaccagggtcgttgctgctgagatggaggaagccctaagagg

SEQ ID NO: 361646 - DNA, 75 bp, Artificial Sequence
  Synthetic
ggaacctgtcatcacaaaaaaggtgagacacggcgatctagaagatctgtgtcgctccgttatcactatacaagg

SEQ ID NO: 361647 - DNA, 75 bp, Artificial Sequence
  Synthetic
tctccatggtgggggattggcttgaaaaaagaccaggagccttttgtataaaagtgttgtgcccatacaccagca

SEQ ID NO: 361648 - DNA, 75 bp, Artificial Sequence
  Synthetic
aagttgcaaacgcggtcgcagacatggttagaatcaagagaatacaagaagcacttgatcatggtcgaaaactgg

SEQ ID NO: 361649 - DNA, 75 bp, Artificial Sequence
  Synthetic
gtcatatacttggtcatgatagtgttgattgtcccggcatacagtatcagctgcattggagtcagcaatagagac

SEQ ID NO: 361650 - DNA, 75 bp, Artificial Sequence
  Synthetic
atattcaggaaccccgggtttgccatagtgtccgttgccattacctggctgatgggaagcttgacgagccaaaaa

SEQ ID NO: 361651 - DNA, 75 bp, Artificial Sequence
  Synthetic
tacgaggcatcgttatccgacatggcttcggccagtcgttgcccaacacaaggcgaaccctccctcgacaagcaa

SEQ ID NO: 361652 - DNA, 75 bp, Artificial Sequence
  Synthetic
tcagacactcaatctgtatgcaaaagaacattaggagacagaggttggggaaatggttgtgggatttttggcaaa

SEQ ID NO: 361653 - DNA, 75 bp, Artificial Sequence
  Synthetic
gggagcttggtgacatgttccaagttcacgtgttgtaagaagatgcccgggaagagcattcaaccggaaaatctg

SEQ ID NO: 361654 - DNA, 75 bp, Artificial Sequence
  Synthetic
gagtatcggataatgctcccagtgcatggctcccagcatagcgggatgattgtgaatgacataggacatgaaact

SEQ ID NO: 361655 - DNA, 75 bp, Artificial Sequence
  Synthetic
atcaacagatggggttcagtggggaaaaaagaggctatggaaataataaagaagtttaagaaagatcttgctgcc

SEQ ID NO: 361656 - DNA, 75 bp, Artificial Sequence
  Synthetic
ccaactccagttgagagatcatactcaaggtggtccttgtggccatctgtggcacgtacccagacaacagcagtc

SEQ ID NO: 361657 - DNA, 75 bp, Artificial Sequence
  Synthetic
acctgcagccctatggaaaggtcattgatcttggatgtggcagagggggctggagttactacgccgccaccatcc

SEQ ID NO: 361658 - DNA, 75 bp, Artificial Sequence
  Synthetic
ggaggtgggtgtgcagagactgatgaagaccatgcacactggcttgaagcaagaatgcttcttgacaacatctac

SEQ ID NO: 361659 - DNA, 75 bp, Artificial Sequence
  Synthetic
atgaaaaacccaaagaagaaatccggaggattccggattgtcaatatgctaaaacgcggagtagcccgtgtgagc

SEQ ID NO: 361660 - DNA, 75 bp, Artificial Sequence
  Synthetic
ccaacctagtggtgcaactcattcggaatatggaggctgaggaagttctagagatgcaagacttgtggctgctgc

SEQ ID NO: 361661 - DNA, 75 bp, Artificial Sequence
  Synthetic
aagaagagacgaggcacagatactagtgtcggaattgttggcctcctgctgaccacagccatggcagtggaggtc

SEQ ID NO: 361662 - DNA, 75 bp, Artificial Sequence
  Synthetic
ctctaataaacggggttgtcaggctcctgtcaaaaccctgggatgtggtgactggagtcacaggaatagccatga

SEQ ID NO: 361663 - DNA, 75 bp, Artificial Sequence
  Synthetic
cgcgcttggaggcgcaggatgggaaaagaaggtggcgaccttccccacccttcaatctggggcctgaactggaga

SEQ ID NO: 361664 - DNA, 75 bp, Artificial Sequence
  Synthetic
tgaccaactggttgcagagcaacggatgggataggctcaaacgaatggcagtcagtggagatgattgcgttgtga

SEQ ID NO: 361665 - DNA, 75 bp, Artificial Sequence
  Synthetic
agtggaaaccctcaactggatgggacaactgggaagaagttccgttttgctcccaccacttcaacaagctccatc

SEQ ID NO: 361666 - DNA, 75 bp, Artificial Sequence
  Synthetic
tactccttgtgtaccgcagcgttcacattcaccaagatcccggctgaaacactgcacgggacagtcacagtggag

SEQ ID NO: 361667 - DNA, 75 bp, Artificial Sequence
  Synthetic
tggacagatggaatagaagaaagtgatctgatcatacccaagtctttagctgggccactcagccatcacaacacc

SEQ ID NO: 361668 - DNA, 75 bp, Artificial Sequence
  Synthetic
gtgaatcagactgcgacagttcgagtttgaagcgaaagctagcaacagtatcaacaggttttattttggatttgg

SEQ ID NO: 361669 - DNA, 75 bp, Artificial Sequence
  Synthetic
ggagcagttgcgctggactacccagcaggaacttcaggatctccaatcctagataagtgtgggagagtgatagga

SEQ ID NO: 361670 - DNA, 75 bp, Artificial Sequence
  Synthetic
atcaatgctaggaaggagaagaagagacgaggcgcagatactagtgtcggaattgttggcctcctgctgaccaca

SEQ ID NO: 361671 - DNA, 75 bp, Artificial Sequence
  Synthetic
tcaacttgggttgtgtacggaacctgccatcacaaaaaaggtgaagcacggagatctagaagagctgtgacgctc

SEQ ID NO: 361672 - DNA, 75 bp, Artificial Sequence
  Synthetic
gacgcattcccggactccaactcaccaattatggacaccgaagtggaagtcccagagagagcctggagctcaggc

SEQ ID NO: 361673 - DNA, 75 bp, Artificial Sequence
  Synthetic
ggagtcagcaatagggactttgtggaaggtatgtcaggtgggacctgggttgatgttgtcttggaacatggaggt

SEQ ID NO: 361674 - DNA, 75 bp, Artificial Sequence
  Synthetic
gaggtaagatcctactgctatgaggcatcaatatcagacatggcttcggacagccgctgcccaacacaaggtgaa

SEQ ID NO: 361675 - DNA, 75 bp, Artificial Sequence
  Synthetic
ctgccgccaccaagatgaactgattggccgggcccgcgtctctccaggggcgggatggagcatccgggagactgc

SEQ ID NO: 361676 - DNA, 75 bp, Artificial Sequence
  Synthetic
catgttgagaataatcaatgctaggaaggagaggaagagacgtggtgcagacaccagcatcggaatcattggtct

SEQ ID NO: 361677 - DNA, 75 bp, Artificial Sequence
  Synthetic
aaagggatgccattctatgcatgggactttggagtcccgctgctaatgataggttgctactcacaattaacaccc

SEQ ID NO: 361678 - DNA, 75 bp, Artificial Sequence
  Synthetic
tgctgggaaggccatctcctttgctaccaacttgggagttaacaaatgccatgtacagatcatggatctcgggca

SEQ ID NO: 361679 - DNA, 75 bp, Artificial Sequence
  Synthetic
agctgtgacgctcccttctcactctacaaggaagttgcaaacgcggtcgcagacctggttagaatcaagagaata

SEQ ID NO: 361680 - DNA, 75 bp, Artificial Sequence
  Synthetic
cacgaagcacctgatcaaggttgaaaactggatatttaggaaccccgggtttgcgctcgcagctgttgccattgc

SEQ ID NO: 361681 - DNA, 75 bp, Artificial Sequence
  Synthetic
gagaccctgggagagaaatggaaggcccgcctgaaccagatgtcggccctggagttctactcctacaaaaagtca

SEQ ID NO: 361682 - DNA, 75 bp, Artificial Sequence
  Synthetic
gcaaagggaaggctgtcctctggccacttgaaatgtcgcctgaaaatggataaacttagattgaagggcgtgtca

SEQ ID NO: 361683 - DNA, 75 bp, Artificial Sequence
  Synthetic
ggaggccctggtcatgaagaacccatgttggtgcaaagctatgggtggaacatagtccgtcttaagagtggggtg

SEQ ID NO: 361684 - DNA, 75 bp, Artificial Sequence
  Synthetic
aagaatggatctatttcccttatgtgcttggccttagggggagtgttgatcttcttatccacagccgtctctgct

SEQ ID NO: 361685 - DNA, 75 bp, Artificial Sequence
  Synthetic
gatgtggggtgctcggtggacttctcaaagaaggagacgagatgcggtacaggggtgttcgtctataacgacgtt

SEQ ID NO: 361686 - DNA, 75 bp, Artificial Sequence
  Synthetic
gaagcctggagggacaggtacaagtaccatcctgactccccccgtagattggcagcagcagtcaagcaagcctgg

SEQ ID NO: 361687 - DNA, 75 bp, Artificial Sequence
  Synthetic
agcagaagcaaccttgggaggctttggaagcttaggacttgattgtgaaccaaggacaggcctggacttttcaga

SEQ ID NO: 361688 - DNA, 75 bp, Artificial Sequence
  Synthetic
caagaggcaaaccgtcgttgttctagggagccaggaaggagccgttcacacggctcttgctggagctctggaggc

SEQ ID NO: 361689 - DNA, 75 bp, Artificial Sequence
  Synthetic
gatgattgttaatgacataggacatgaaactgacgaaaacagagcgaaagtcgaggtcacgcccaattcaccaag

SEQ ID NO: 361690 - DNA, 75 bp, Artificial Sequence
  Synthetic
gcatgctggggcagataccggaactccacactggaacaacaaggaggcattggtagagttcaaagatgcccacgc

SEQ ID NO: 361691 - DNA, 75 bp, Artificial Sequence
  Synthetic
agttacagtggaggtgcagtatgcagggacagatggaccctgcaaggtcccagcccagatggcggtggacatgca

SEQ ID NO: 361692 - DNA, 75 bp, Artificial Sequence
  Synthetic
ggggccgcattgaggagcggtgaagggagacttgatccatactggggggatgtcaagcaggacttggtgtcatat

SEQ ID NO: 361693 - DNA, 75 bp, Artificial Sequence
  Synthetic
gttggagctcgacccaccatttggggattcttacattgtcataggagttggggacaagaaaatcacccatcactg

SEQ ID NO: 361694 - DNA, 75 bp, Artificial Sequence
  Synthetic
tgagatggatggtgcaaaaggaaggctgttctccggccatttgaaatgccgcttaaaaatggacaagcttagatt

SEQ ID NO: 361695 - DNA, 75 bp, Artificial Sequence
  Synthetic
ggatacagcctgggacttcggatcagtcgggggcgtgttcaactcattgggcaagggtgttcaccagatttttgg

SEQ ID NO: 361696 - DNA, 75 bp, Artificial Sequence
  Synthetic
agcagctttcaaatcactgtttggaggaatgtcctggttctcacagatcctcataggcacgctgctggtgtggtt

SEQ ID NO: 361697 - DNA, 75 bp, Artificial Sequence
  Synthetic
gaagaaaagtacgtggactacctatccacccaagttcgctacttgggcgaagaagggtccacacctggagtgcta

SEQ ID NO: 361698 - DNA, 75 bp, Artificial Sequence
  Synthetic
atattttgtcagagcggcaaagaccaacaacagttttgttgtcgatggtgacacactgaaggaatgtccgctcaa

SEQ ID NO: 361699 - DNA, 75 bp, Artificial Sequence
  Synthetic
tgacctgggctactggattgaaagtgaaaagaatgacacatggaggctgaagagggcccatctgattgagatgaa

SEQ ID NO: 361700 - DNA, 75 bp, Artificial Sequence
  Synthetic
atggccctgggactaaccgctgtgaggctggtcgaccccatcaacgtggtgggactgctgttgctcacaaggagt

SEQ ID NO: 361701 - DNA, 75 bp, Artificial Sequence
  Synthetic
caccatgagctatgaatgccctatgctggatgagggggtggaaccagatgacgtcgattgttggtgcaacacgac

SEQ ID NO: 361702 - DNA, 75 bp, Artificial Sequence
  Synthetic
tttagctggtccactcagccaccacaacactagagagggttacagaactcaagcaaaagggccatggcatagtga

SEQ ID NO: 361703 - DNA, 75 bp, Artificial Sequence
  Synthetic
agagcttgaaatccggtttgaggaatgtccaggcaccaaggttcacgtggaggagacatgcggaactagaggacc

SEQ ID NO: 361704 - DNA, 75 bp, Artificial Sequence
  Synthetic
gatcctgggaggatttttaatgagtgacttggctaagcttgtgatcctgatgggtgccaccttcgcagaaatgaa

SEQ ID NO: 361705 - DNA, 75 bp, Artificial Sequence
  Synthetic
cactggaggagatgtggctcacttggcattggttgcggcatttaaagtcagaccagccttgctggtctcctttat

SEQ ID NO: 361706 - DNA, 75 bp, Artificial Sequence
  Synthetic
tttcagagctaattggacacctcgtgagagcatgctgctagccctggcttcgtgtcttttgcaaactgcaatctc

SEQ ID NO: 361707 - DNA, 75 bp, Artificial Sequence
  Synthetic
tgctctcgaaggtgacttgatggtcctcgtcaatggatttgctttggcctggttggcaatacgagcaatggccgt

SEQ ID NO: 361708 - DNA, 75 bp, Artificial Sequence
  Synthetic
gccacgcactgacaacattgctctggcaatcctggctgctctgacaccactagcccgaggtacactgctcgtggc

SEQ ID NO: 361709 - DNA, 75 bp, Artificial Sequence
  Synthetic
atggagagcgggcctcgctacttgtggagggtttatgctcctctccctgaaagggaaaggtagtgtgaagaagaa

SEQ ID NO: 361710 - DNA, 75 bp, Artificial Sequence
  Synthetic
cctgccatttgtcatggccttgggattgactgctgtgaggatagtagaccccattaatgtggtgggactactgtt

SEQ ID NO: 361711 - DNA, 75 bp, Artificial Sequence
  Synthetic
gagggggtctttcacactatgtggcacgtcacaaaaggatccgcgctgagaagcggtgaagggagacttgatcca

SEQ ID NO: 361712 - DNA, 75 bp, Artificial Sequence
  Synthetic
gacttgcatcctggagctgggaaaaccaggagagttcttcctgaaatagtccgtgaagccataaaaacaagactc

SEQ ID NO: 361713 - DNA, 75 bp, Artificial Sequence
  Synthetic
cgtactgtgatcttagctccaaccagggttgtcgctgctgaaatggaggaggcccttagagggcttccagtgcgt

SEQ ID NO: 361714 - DNA, 75 bp, Artificial Sequence
  Synthetic
tggaaatagtcctcggcttgacgtggcactagatgagagtggtgatttctctctggtggaggaagatggtccacc

SEQ ID NO: 361715 - DNA, 75 bp, Artificial Sequence
  Synthetic
catgagagagatcatactcaaggtggtcctgatggccatctgtggcatgaacccaatagccataccctttgctgc

SEQ ID NO: 361716 - DNA, 75 bp, Artificial Sequence
  Synthetic
gggagtcatgcaagagggagtcttccacaccatgtggcacgtcacaaaaggagctgcactgaggagcggtgaagg

SEQ ID NO: 361717 - DNA, 75 bp, Artificial Sequence
  Synthetic
gagacttgatccatactggggggatgtcaagcaggacttagtgtcatactgtgggccttggaagttggatgcagc

SEQ ID NO: 361718 - DNA, 75 bp, Artificial Sequence
  Synthetic
tggaatattcaagacaaaggatggggacatcggagcagtcgctctggactaccccgcaggaacttcaggatcccc

SEQ ID NO: 361719 - DNA, 75 bp, Artificial Sequence
  Synthetic
gatcctagacaaatgcggaagagtgataggactttatggcaatggggttgtgatcaagaatggaagctatgttag

SEQ ID NO: 361720 - DNA, 75 bp, Artificial Sequence
  Synthetic
gctaactgtcctggatctgcatccaggagccggaaagactaggagagttcttcctgaaatagtccgtgaagccat

SEQ ID NO: 361721 - DNA, 75 bp, Artificial Sequence
  Synthetic
aaaaaagagactccgcacagtgattttggctccaaccagggttgtcgctgctgagatggaggaagccttgagagg

SEQ ID NO: 361722 - DNA, 75 bp, Artificial Sequence
  Synthetic
cttcatgacagccacgccaccaggaacccgagatgcatttccagactccaactcaccaatcatggacacagaagt

SEQ ID NO: 361723 - DNA, 75 bp, Artificial Sequence
  Synthetic
gaagacttttgagacagagtttcagaaaacaaaaaatcaagagtgggactttgtcataacaactgacatctcaga

SEQ ID NO: 361724 - DNA, 75 bp, Artificial Sequence
  Synthetic
aaccactgcaagcggaagggtgatcgaggaatggtgctgcagggagtgcacaatgcccccactgtcgttccgggc

SEQ ID NO: 361725 - DNA, 75 bp, Artificial Sequence
  Synthetic
aggagaccttcccgtttggctagcctatcaggttgcatctgccggaataacttacacagacagaagatggtgctt

SEQ ID NO: 361726 - DNA, 75 bp, Artificial Sequence
  Synthetic
tgatggcacaaccaacaacaccataatggaagatagtgtaccagcagaagtgtggacaaaatatggagagaagag

SEQ ID NO: 361727 - DNA, 75 bp, Artificial Sequence
  Synthetic
agtgctcaaaccaagatggatggatgcgagggtctgttccgatcatgctgccctgaagtcgttcaaagaatttgc

SEQ ID NO: 361728 - DNA, 75 bp, Artificial Sequence
  Synthetic
tgccgggaaaagaggagtggctttaggagtaatggaggccctgggaacattgccaggacacatgacagagaggtt

SEQ ID NO: 361729 - DNA, 75 bp, Artificial Sequence
  Synthetic
ccaactgccggagaccctagagaccatcatgctcttaggcttgttgggaacagtttcgttggggatcttctttgt

SEQ ID NO: 361730 - DNA, 75 bp, Artificial Sequence
  Synthetic
cttgatgcggaacaagggcatcgggaagatgggttttggaatggtaactcttggggccagtgcatggctcatgtg

SEQ ID NO: 361731 - DNA, 75 bp, Artificial Sequence
  Synthetic
gctttcggaaattgaaccagccagaattgcatgtgtcctcattgttgtgttcttgttactggtggtactcatacc

SEQ ID NO: 361732 - DNA, 75 bp, Artificial Sequence
  Synthetic
cgagccagagaagcaaagatctccccaggacaaccagatggcaatcatcatcatggtggcagtgggccttctggg

SEQ ID NO: 361733 - DNA, 75 bp, Artificial Sequence
  Synthetic
tttgataactgcaaacgaacttggatggctggaaagaacaaaaaatgacatagctcatctaatgggaaggagaga

SEQ ID NO: 361734 - DNA, 75 bp, Artificial Sequence
  Synthetic
acaagtgttacttatagcagtagccatctccagtgctgtgctgctgcggactgcttggggatggggggaggctgg

SEQ ID NO: 361735 - DNA, 75 bp, Artificial Sequence
  Synthetic
gtggaacatcgttcgtctcaagagtggagtggacgtcttccacatggcggccgagccgtgtgataccttgctgtg

SEQ ID NO: 361736 - DNA, 75 bp, Artificial Sequence
  Synthetic
tgacataggtgagtcatcatctagtcctgaagtggaagagacgcgaacactccgagtgctctctatggtggggga

SEQ ID NO: 361737 - DNA, 75 bp, Artificial Sequence
  Synthetic
gggagagagaactcaggaggtggtgttgaagggctgggattacaaagactcggatatgtcctagaagagatgagt

SEQ ID NO: 361738 - DNA, 75 bp, Artificial Sequence
  Synthetic
tgatgaaaaccatccatacaggacatgggcctaccatgggagctacgaagcccccacacaagggtcagcatcttc

SEQ ID NO: 361739 - DNA, 75 bp, Artificial Sequence
  Synthetic
cctcgtgaatggggttgttagactcctgtcaaagccctgggatgtagtgactggagttacaggaatagctatgac

SEQ ID NO: 361740 - DNA, 75 bp, Artificial Sequence
  Synthetic
caccaaagaagagttcatcaacaaggtgcgcagcaatgcagcactgggagcaatatttgaagaggaaaaagaatg

SEQ ID NO: 361741 - DNA, 75 bp, Artificial Sequence
  Synthetic
aggcagccgcgccatctggtacatgtggttgggagccagattcttggagtttgaagcccttggattcttgaatga

SEQ ID NO: 361742 - DNA, 75 bp, Artificial Sequence
  Synthetic
agaagaaatgaatcgggcaccaggaggaaagatgtatgcagatgacaccgctggctgggacacccgcattagtaa

SEQ ID NO: 361743 - DNA, 75 bp, Artificial Sequence
  Synthetic
gtttgatctggagaatgaagccttaattaccaaccaaatggaggaagggcacagagctctggcgttggctgtgat

SEQ ID NO: 361744 - DNA, 75 bp, Artificial Sequence
  Synthetic
aagacaggaccagagagggagtggacaagttgtcacctatgctctcaacacatttaccaacttagtggtgcagct

SEQ ID NO: 361745 - DNA, 75 bp, Artificial Sequence
  Synthetic
tcgagtttgaagcgaaagctagcaacagtatcaacaggttttattttggatttggaaacgagagtttctggtcat

SEQ ID NO: 361746 - DNA, 75 bp, Artificial Sequence
  Synthetic
aagagaccttcgactgatggccaatgctatttgttcggctgtgccagttgactgggtaccaaccgggagaaccac

SEQ ID NO: 361747 - DNA, 75 bp, Artificial Sequence
  Synthetic
ctggtcaatccacggaaagggagaatggatgactactgaggacatgctcatggtgtggaatagagtgtggattga

SEQ ID NO: 361748 - DNA, 75 bp, Artificial Sequence
  Synthetic
ggagaacgaccatatggaggacaagactcctgtgacaaagtggacagacatcccctatctgggaaaaagggagga

SEQ ID NO: 361749 - DNA, 75 bp, Artificial Sequence
  Synthetic
agctgtgcagcctgtagcccccccaggagaagctgggaaaccaagctcatagtcaggccgagaacgccatggcac

SEQ ID NO: 361750 - DNA, 75 bp, Artificial Sequence
  Synthetic
caatggtgacagcgggatcaaccgatcacatggaccacttctctcttggagtgcttgtgattctactcatggtgc

SEQ ID NO: 361751 - DNA, 75 bp, Artificial Sequence
  Synthetic
atgggcccatcaggatggtcttggcgattctagccttcttgagattcacggcaatcaagccatcactgggtctca

SEQ ID NO: 361752 - DNA, 75 bp, Artificial Sequence
  Synthetic
gtatggtcagcaaagagttttcaaggaaaaagtggacactagggtgccagacccccaagaaggcactcgtcaggt

SEQ ID NO: 361753 - DNA, 75 bp, Artificial Sequence
  Synthetic
gaacaacaaagaagcactggtagagttcaaggacgcacatgccaaaaggcaaactgtcgtggttctagggagtca

SEQ ID NO: 361754 - DNA, 75 bp, Artificial Sequence
  Synthetic
cgctctcaactcattgggcaagggcatccatcaaatttttggagcagctttcaaatcattgtttggaggaatgtc

SEQ ID NO: 361755 - DNA, 75 bp, Artificial Sequence
  Synthetic
acctggagtgctgtaagcaccaatcttaatgttgtcaggcctgctagtcagccacagcttggggaaagctgtgca

SEQ ID NO: 361756 - DNA, 75 bp, Artificial Sequence
  Synthetic
cagcagctgccatcgcttggcttttgggaagctcaacgagccaaaaagtcatatacttggtcatgatactgctga

SEQ ID NO: 361757 - DNA, 75 bp, Artificial Sequence
  Synthetic
catgctccaagaaaatgaccgggaagagcatccagccagagaatctggagtaccggataatgctgtcagttcatg

SEQ ID NO: 361758 - DNA, 75 bp, Artificial Sequence
  Synthetic
tgattgggtgacggatcattctggaaaaacagtttggtttgttccaagcgtgaggaacggcaatgagatcgcagc

SEQ ID NO: 361759 - DNA, 75 bp, Artificial Sequence
  Synthetic
tggtgttgaagggctgggattacaaagactcggatatgtcctagaagagatgagtcgcataccaggaggaaggat

SEQ ID NO: 361760 - DNA, 75 bp, Artificial Sequence
  Synthetic
agcgactgcagcgtaggtatggaggaggactggtcagagtgccactctcccgcaactctacacatgagatgtact

SEQ ID NO: 361761 - DNA, 75 bp, Artificial Sequence
  Synthetic
agttacgaaatggacagacattccctatttgggaaaaagggaagacttgtggtgtggatctctcatagggcacag

SEQ ID NO: 361762 - DNA, 75 bp, Artificial Sequence
  Synthetic
atgctggggaggccatatcttttccaaccacactggggatgaataagtgttacatacaaatcatggatcttggac

SEQ ID NO: 361763 - DNA, 75 bp, Artificial Sequence
  Synthetic
acatgtgtgatgccaccatgagctatgaatgccctatgttggatgagggggtagaaccagatgacgtcgattgct

SEQ ID NO: 361764 - DNA, 75 bp, Artificial Sequence
  Synthetic
ctggaaacagtccccggctcgatgtggcactagatgagagtggtgatttctccctagtggaggatgatggtcccc

SEQ ID NO: 361765 - DNA, 75 bp, Artificial Sequence
  Synthetic
tctataacgacgttgaagcctggagggacaggtacaagtaccatcctgactcccctcgtagattggcagcagcag

SEQ ID NO: 361766 - DNA, 75 bp, Artificial Sequence
  Synthetic
gtgtgtaccgcagcgaaggtcccagctgaaacattgcatggaacagtcacagtggaggtgcagtatgcagggaca

SEQ ID NO: 361767 - DNA, 75 bp, Artificial Sequence
  Synthetic
agagagggttacagaactcaagtgaaagggccatggcatagtgaagagctcgaaatccggtttgaggagtgccca

SEQ ID NO: 361768 - DNA, 75 bp, Artificial Sequence
  Synthetic
aatggatttgctttggcctggttggcaatacgagcaatggccgtgccacgcactgacaatatcgctctagcaatt

SEQ ID NO: 361769 - DNA, 75 bp, Artificial Sequence
  Synthetic
tcttcagagctaattggacaccccgtgagagcatgctgctggccttggcctcgtgtcttctgcaaactgcgatct

SEQ ID NO: 361770 - DNA, 75 bp, Artificial Sequence
  Synthetic
agagtgatgactcgcagactgctgggttcaacacaggttggagtgggagtcatgcaagagggagtcttccacacc

SEQ ID NO: 361771 - DNA, 75 bp, Artificial Sequence
  Synthetic
cgtggagagcaggccttgctacttgcggggggttcatgctcctctctctgaaggggaaaggcagtgtgaagaaga

SEQ ID NO: 361772 - DNA, 75 bp, Artificial Sequence
  Synthetic
tgctcacaaggagtgggaagcggagctggccccctagtgaagtactcacagctgttggcctgatatgcgcattgg

SEQ ID NO: 361773 - DNA, 75 bp, Artificial Sequence
  Synthetic
tttgactgggtgacggaccattctgggaaaacaatttggtttgttccaagtgtgagatctggagaagaaagcgca

SEQ ID NO: 361774 - DNA, 75 bp, Artificial Sequence
  Synthetic
acgcatgccagtgctgctcagaggagaggacgtataggcaggaaccccaacaaacctggagatgagtacatgtat

SEQ ID NO: 361775 - DNA, 75 bp, Artificial Sequence
  Synthetic
ctggagcgtggtacgtgtatgtgaagactggaaaaaggagtggtgctctatgggatgtgcctgctcccaaggaag

SEQ ID NO: 361776 - DNA, 75 bp, Artificial Sequence
  Synthetic
agtgctgtgctgctgcggaccgcttggggatggggggaggctggggctctgatcacagcagcaacctccacctta

SEQ ID NO: 361777 - DNA, 75 bp, Artificial Sequence
  Synthetic
gtggaagagacgcgaacactcagagtgctctccatggtgggagactggcttgagaaaagaccaggggccttctgc

SEQ ID NO: 361778 - DNA, 75 bp, Artificial Sequence
  Synthetic
ggcttccagttcgttatatgacaacagcagtcaatgtcacccattctgggacagaaatcgttgacttaatgtgcc

SEQ ID NO: 361779 - DNA, 75 bp, Artificial Sequence
  Synthetic
atgctaccttcacttcacgcctactacaaccaatcagagtccccaactataatttgtatattatggatgaggccc

SEQ ID NO: 361780 - DNA, 75 bp, Artificial Sequence
  Synthetic
ggagccagatttttggagtttgaagctcttggattcttgaacgaggaccactggatgggaagagaaaactcagga

SEQ ID NO: 361781 - DNA, 75 bp, Artificial Sequence
  Synthetic
atttgttcggctgtgccagttgactgggtaccaactgggagaaccacctggtcaatccatggaaagggagaatgg

SEQ ID NO: 361782 - DNA, 75 bp, Artificial Sequence
  Synthetic
gcttgattaccgccaatgaactcggatggttggagagaacaaaaagtgacctaagccatctaatgggaaggagag

SEQ ID NO: 361783 - DNA, 75 bp, Artificial Sequence
  Synthetic
tgacaactttcatcaccccagccgtccaacatgcggtgaccacttcatacaacaactactccttaatggcgatgg

SEQ ID NO: 361784 - DNA, 75 bp, Artificial Sequence
  Synthetic
gggccctgatcacagctgcaacttccaccttgtgggaaggctctccgaacaagtactggaactcctccacagcca

SEQ ID NO: 361785 - DNA, 75 bp, Artificial Sequence
  Synthetic
aaggaggctgtacacagtgatctaggctactggattgagagtgagaagaatgacacatggaggctgaagagggcc

SEQ ID NO: 361786 - DNA, 75 bp, Artificial Sequence
  Synthetic
aagacttgtggtgtggatctctcatagggcacagaccgcgtactacctgggctgagaacatcaaaaatacagtca

SEQ ID NO: 361787 - DNA, 75 bp, Artificial Sequence
  Synthetic
acaggttttattttggatttggaaacgagagtttctggtcatgaaaaacccaaaaaagaaatccggaggattccg

SEQ ID NO: 361788 - DNA, 75 bp, Artificial Sequence
  Synthetic
aagagaatacacaaagcacttgattagagtcgaaaattggatattcaggaaccctggcttcgcgttagcagcagc

SEQ ID NO: 361789 - DNA, 75 bp, Artificial Sequence
  Synthetic
ctaattgtcagttacgtggtctcaggaaagagtgtggacatgtacattgaaagagcaggtgacatcacatgggaa

SEQ ID NO: 361790 - DNA, 75 bp, Artificial Sequence
  Synthetic
gccataccctttgcagctggagcgtggtacgtatacgtgaagactggaaaaaggagtggtgctctatgggatgtg

SEQ ID NO: 361791 - DNA, 75 bp, Artificial Sequence
  Synthetic
aatttttggagcagctttcaaatcattgtttggaggaatgtcctggttctcacaaattctcattggaacgttgct

SEQ ID NO: 361792 - DNA, 75 bp, Artificial Sequence
  Synthetic
agcagcagtcaagcaagcctgggaagatggtatctgtgggatctcctctgtttcaagaatggaaaacatcatgtg

SEQ ID NO: 361793 - DNA, 75 bp, Artificial Sequence
  Synthetic
acccaagtctttagctgggccactcagccatcacaataccagagagggctacaggacccaaatgaaagggccatg

SEQ ID NO: 361794 - DNA, 75 bp, Artificial Sequence
  Synthetic
tcatggacccatcagaatggttttggcgatactagcctttttgagatttacagcaatcaagccatcactgggcct

SEQ ID NO: 361795 - DNA, 75 bp, Artificial Sequence
  Synthetic
cctgctgactacagccatggcagcagagatcactagacgcgggagtgcatactacatgtacttggataggagcga

SEQ ID NO: 361796 - DNA, 75 bp, Artificial Sequence
  Synthetic
cacgaagcacttgatcaaggttgaaaactggatattcaggaaccccgggtttgcgctagtggccgttgccattgc

SEQ ID NO: 361797 - DNA, 75 bp, Artificial Sequence
  Synthetic
ttggggaaacggttgtggactttttggcaaagggagcttggtgacatgtgccaagtttacgtgttctaagaagat

SEQ ID NO: 361798 - DNA, 75 bp, Artificial Sequence
  Synthetic
gaccgggaagagcattcaaccggaaaatctggagtatcggataatgctatcagtgcatggctcccagcatagcgg

SEQ ID NO: 361799 - DNA, 75 bp, Artificial Sequence
  Synthetic
tgtgacacgttgctgtgtgacataggtgagtcatcatctagtcctgaagtggaagaagcacggacgctcagagtc

SEQ ID NO: 361800 - DNA, 75 bp, Artificial Sequence
  Synthetic
ttatgttagtgccatcacccaagggaggagggaggaagagactcctgttgagtgcttcgagccttcgatgctgaa

SEQ ID NO: 361801 - DNA, 75 bp, Artificial Sequence
  Synthetic
cccaccatttggggattcttacattgtcataggagttggggacaagaaaatcacccaccactggcataggagtgg

SEQ ID NO: 361802 - DNA, 75 bp, Artificial Sequence
  Synthetic
gcggaaacgtggttctttgacgagaaccacccatataggacatgggcttaccatggaagctatgaggcccccaca

SEQ ID NO: 361803 - DNA, 75 bp, Artificial Sequence
  Synthetic
acaggaatagccatgaccgacaccacaccgtatggtcagcaaagagttttcaaggaaaaagtggacactagggtg

SEQ ID NO: 361804 - DNA, 75 bp, Artificial Sequence
  Synthetic
aaagaatggatctatctccctcacatgcttggccctggggggagtgatgatcttcctctccacggctgtttctgc

SEQ ID NO: 361805 - DNA, 75 bp, Artificial Sequence
  Synthetic
aaaagacggctgctggtatggaatggagataaggcccaggaaagaaccagagagcaacttagtgaggtcaatggt

SEQ ID NO: 361806 - DNA, 75 bp, Artificial Sequence
  Synthetic
atactggggggatgtcaagcaggacttggtgtcatactgtgggccttggaagttggatgcagcttgggatggact

SEQ ID NO: 361807 - DNA, 75 bp, Artificial Sequence
  Synthetic
ggacatggcttcggacagccgctgcccaacacaaggtgaagcctaccttgacaagcaatcagacactcaatatgt

SEQ ID NO: 361808 - DNA, 75 bp, Artificial Sequence
  Synthetic
gagagcctggagctcaggctttgattgggtgacagaccattctgggaaaacagtttggttcgttccaagcgtgag

SEQ ID NO: 361809 - DNA, 75 bp, Artificial Sequence
  Synthetic
gcttcttgacaacatctacctccaggatggcctcatagcctcgctctatcggcctgaggccgataaggtagccgc

SEQ ID NO: 361810 - DNA, 75 bp, Artificial Sequence
  Synthetic
cattgagggagagtttaagctgaggacagagcaaaggaagaccttcgtggaactcatgaagagaggagaccttcc

SEQ ID NO: 361811 - DNA, 75 bp, Artificial Sequence
  Synthetic
aggagcggctttgggagtaatggaggccctgggaacactgccaggacacatgacagagaggtttcaggaagccat

SEQ ID NO: 361812 - DNA, 75 bp, Artificial Sequence
  Synthetic
catgggattctcaatggacattgatctgcggccagcctccgcctgggctatctatgccgcattgacaactctcat

SEQ ID NO: 361813 - DNA, 75 bp, Artificial Sequence
  Synthetic
agtgctgtttggcatgggcaaagggatgccatttatgcatggggaccttggagtcccgctgctaatgatgggttg

SEQ ID NO: 361814 - DNA, 75 bp, Artificial Sequence
  Synthetic
ctgcagggagtgcacaatgcccccactgtcgttccaggctaaagatggctgttggtatggaatggagataaggcc

SEQ ID NO: 361815 - DNA, 75 bp, Artificial Sequence
  Synthetic
gatctgtgtgaatcagactgcgacagttcgagtttgaagcgaaagctagcaacagtatcaacaggttttattttg

SEQ ID NO: 361816 - DNA, 75 bp, Artificial Sequence
  Synthetic
tgggaaggttgttgacctcggatgtggcagagggggctggagctattatgccgccaccatccgcaaagtgcagga

SEQ ID NO: 361817 - DNA, 75 bp, Artificial Sequence
  Synthetic
ctggttggcaatacgagcgatggttgttccacgcactgataacatcaccttggcaatcctggctgctctgacacc

SEQ ID NO: 361818 - DNA, 75 bp, Artificial Sequence
  Synthetic
tcgtctcaagagtggagtggacgtcttccacatggcggctgagccgtgtgacactctgctgtgtgacataggtga

SEQ ID NO: 361819 - DNA, 75 bp, Artificial Sequence
  Synthetic
ggttgttagactcctgtcaaagccttgggacgtggtgactggagttacaggaatagccatgactgacaccacacc

SEQ ID NO: 361820 - DNA, 75 bp, Artificial Sequence
  Synthetic
gggaagagaaaactcaggaggtggagtcgaagggttaggattgcaaagacttggatacattctagaagaaatgaa

SEQ ID NO: 361821 - DNA, 75 bp, Artificial Sequence
  Synthetic
ggttgagatgggcgaggcggctgccatcttcatgaccgccacgccaccaggaacccgtgacgcatttccggactc

SEQ ID NO: 361822 - DNA, 75 bp, Artificial Sequence
  Synthetic
tggaaaacgggtcatacagctcagcagaaagacttttgagacagagttccagaaaacaaaacatcaagagtggga

SEQ ID NO: 361823 - DNA, 75 bp, Artificial Sequence
  Synthetic
ccatggaaagggagaatggatgaccactgaggacatgctcatggtgtggaatagagtgtggattgaggagaacga

SEQ ID NO: 361824 - DNA, 75 bp, Artificial Sequence
  Synthetic
ccatatggaggacaagactcctgtaacaaaatggacagacattccctatctaggaaaaagggaggacttatggtg

SEQ ID NO: 361825 - DNA, 75 bp, Artificial Sequence
  Synthetic
aagcaggccttacaaagccgcggcggcccaattgccggagaccctagagaccattatgcttttggggttgctggg

SEQ ID NO: 361826 - DNA, 75 bp, Artificial Sequence
  Synthetic
agtggttagaggagaccccccggaaaacgcaaaacagcatattgacgtgggaaagaccagagactccatgagttt

SEQ ID NO: 361827 - DNA, 75 bp, Artificial Sequence
  Synthetic
gagatcaaccactgcaagcggaagggtgatcgaggaatggtgctgcagggagtgcacaatgcccccactgtcgtt

SEQ ID NO: 361828 - DNA, 75 bp, Artificial Sequence
  Synthetic
caacaactactccttaatggcgatggccacgcaagctggagtgttgtttggtatgggcaaagggatgccattcta

SEQ ID NO: 361829 - DNA, 75 bp, Artificial Sequence
  Synthetic
gaccgcctgggggtggggggaggctggggccctgatcacagctgcaacttccactttgtgggaaggctctccgaa

SEQ ID NO: 361830 - DNA, 75 bp, Artificial Sequence
  Synthetic
agctaattggacaccccgtgaaagcatgctgctggccttggcctcgtgtcttttgcaaactgcgatctccgcctt

SEQ ID NO: 361831 - DNA, 75 bp, Artificial Sequence
  Synthetic
cagtgagcacgcggaaacgtggttctttgacgagaaccacccatataggacatgggcttaccatggaagctatga

SEQ ID NO: 361832 - DNA, 75 bp, Artificial Sequence
  Synthetic
gaaacaaggggaatttggaaaggccaagggcagccgcgccatctggtatatgtggctaggggctagatttctaga

SEQ ID NO: 361833 - DNA, 75 bp, Artificial Sequence
  Synthetic
aaaagggaagacagttatggacattatttcgagacaagaccaaagggggagcggacaagttgtcacttacgctct

SEQ ID NO: 361834 - DNA, 75 bp, Artificial Sequence
  Synthetic
gattggccgggcccgcgtctctccaggggcgggatggagcatccgggagactgcttgcctagcaaaatcatatgc

SEQ ID NO: 361835 - DNA, 75 bp, Artificial Sequence
  Synthetic
cttgggggaaatcgtacttcgtcagagcagcaaagacaaataacagctttgtcgtggatggtgacacactgaagg

SEQ ID NO: 361836 - DNA, 75 bp, Artificial Sequence
  Synthetic
agacattccctatttgggaaaaagggaagacttgtggtgtggatctctcatagggcacagaccgcgcaccacctg

SEQ ID NO: 361837 - DNA, 75 bp, Artificial Sequence
  Synthetic
tgatcgagatgaaaacatgtgaatggccaaagtcccacacattgtggacagatggaatagaagagagtgatctga

SEQ ID NO: 361838 - DNA, 75 bp, Artificial Sequence
  Synthetic
gcattcacattcaccaaggtcccagctgaaacactgcatggaacagtcacagtggaggtgcagtatgcagggaca

SEQ ID NO: 361839 - DNA, 75 bp, Artificial Sequence
  Synthetic
tttcattaccccagccgtccaacatgcagtgaccacttcatacaacaactactccttaatggcgatggccacgca

SEQ ID NO: 361840 - DNA, 75 bp, Artificial Sequence
  Synthetic
cggaaaacgcaaaacagcatattgacgctgggaaagaccagagactccatgagtttccaccacgctggccgccag

SEQ ID NO: 361841 - DNA, 75 bp, Artificial Sequence
  Synthetic
gcccccactgtcgttccgggctaaagatggctgttggtatggaatggagataaggcccaggaaagaaccagaaag

SEQ ID NO: 361842 - DNA, 75 bp, Artificial Sequence
  Synthetic
ccgcgccatctggtatatgtggctaggggctagatttctagagttcgaagcccttggattcttgaacgaggatca

SEQ ID NO: 361843 - DNA, 75 bp, Artificial Sequence
  Synthetic
caaggaagtaaaaaagggggagaccacagatggagtgtacagagtaatgactcgtagactgctaggttcaacaca

SEQ ID NO: 361844 - DNA, 75 bp, Artificial Sequence
  Synthetic
gcataggcaggaatcccaacaaacctggagatgagtatctgtatggaggtgggtgcgcagagactgacgaagacc

SEQ ID NO: 361845 - DNA, 75 bp, Artificial Sequence
  Synthetic
ggacctccgactgatggccaatgccatttgttcatctgtgccagttgactgggttccaactgggagaactacctg

SEQ ID NO: 361846 - DNA, 75 bp, Artificial Sequence
  Synthetic
ggaggctggggccctgatcacagccgcaacttccactttgtgggaaggctctccgaacaagtactggaactcctc

SEQ ID NO: 361847 - DNA, 75 bp, Artificial Sequence
  Synthetic
tgtgcagcctgtgacccccccaggagaagctgggaaaccaagcctatagtcaggccgagaacgccatggcacgga

SEQ ID NO: 361848 - DNA, 75 bp, Artificial Sequence
  Synthetic
gggactagtggttagaggagaccccccggaaaacgcaaaacagcatattgacgctgggaaagaccagagactcca

SEQ ID NO: 361849 - DNA, 75 bp, Artificial Sequence
  Synthetic
gttgttactgttgctgactcagactgcgacagttcgagtttgaagcgaaagctagcaacagtatcaacaggtttt

SEQ ID NO: 361850 - DNA, 75 bp, Artificial Sequence
  Synthetic
atttggatttggaaacgagagtttctggtcatgaaaaacccaaaaaagaaatccggaggattccggattgtcaat

SEQ ID NO: 361851 - DNA, 75 bp, Artificial Sequence
  Synthetic
tggcttttgggaagctcaacgagccaaaaagtcatatacttggtcatgatactgctgattgccccggcatacagc

SEQ ID NO: 361852 - DNA, 75 bp, Artificial Sequence
  Synthetic
catgtggagaggtccacaaagattgccagtgcctgtgaatgagctgccccatggctggaaagcctgggggaaatc

SEQ ID NO: 361853 - DNA, 75 bp, Artificial Sequence
  Synthetic
atctctgagatcaactactgcaagtggaagggtcattgaggaatggtgctgtagggaatgcacaatgcccccact

SEQ ID NO: 361854 - DNA, 75 bp, Artificial Sequence
  Synthetic
gcgtctctccaggggcgggatggagcatccgggagactgcttgcctagcaaaatcatatgcgcaaatgtggcagc

SEQ ID NO: 361855 - DNA, 75 bp, Artificial Sequence
  Synthetic
ggtgcaggaagggctgaagaagagaatgaccacaaagatcattatgagcacatcaatggcagtgctggtggccat

SEQ ID NO: 361856 - DNA, 75 bp, Artificial Sequence
  Synthetic
aggagagtgtcatagctgtgtgtacaacatgatgggaaaaagagagaagaagcaaggagaattcggaaaagcaaa

SEQ ID NO: 361857 - DNA, 75 bp, Artificial Sequence
  Synthetic
agaccagagactccatgagtttccaccacgctggccgccaggcacagatcgccgaacagcggcggccagtgtggg

SEQ ID NO: 361858 - DNA, 75 bp, Artificial Sequence
  Synthetic
tgctataacccagggaaagagggaggaggagactccggttgaatgtttcgaaccctcgatgctgaagaagaagca

SEQ ID NO: 361859 - DNA, 75 bp, Artificial Sequence
  Synthetic
gagagtcatcttggctgggcccatgcctgtcacgcatgctagtgctgctcagaggagaggacgtataggcaggaa

SEQ ID NO: 361860 - DNA, 75 bp, Artificial Sequence
  Synthetic
ccaactgccggagaccctagagaccattatgctcttaggtttgctgggaacagtttcactggggatcttcttcgt

SEQ ID NO: 361861 - DNA, 75 bp, Artificial Sequence
  Synthetic
ggatggagtggccacaggaggacatgccgtatcccggggaagtgcaaagctcagatggttggtggagagaggata

SEQ ID NO: 361862 - DNA, 75 bp, Artificial Sequence
  Synthetic
ctctcggaaattgagccagccagaattgcatgtgtcctcattgttgtgttcctattgctggtggtgctcatacct

SEQ ID NO: 361863 - DNA, 75 bp, Artificial Sequence
  Synthetic
ttgattaccgccaatgaactcggatggttggagagaacaaagagtgacctaagccatctaatgggaaggagagag

SEQ ID NO: 361864 - DNA, 75 bp, Artificial Sequence
  Synthetic
ggagcgactgcaacgtaggcatgggggaggattagtcagagtgccattgtctcgcaactccacacatgagatgta

SEQ ID NO: 361865 - DNA, 75 bp, Artificial Sequence
  Synthetic
tgatgaaaaccacccatacaggacatgggcctaccatgggagctacgaagcccccacgcaaggatcagcgtcttc

SEQ ID NO: 361866 - DNA, 75 bp, Artificial Sequence
  Synthetic
tgacaccacaccatacggccaacaaagagtcttcaaagaaaaagtggacaccagggtgccagatccccaagaagg

SEQ ID NO: 361867 - DNA, 75 bp, Artificial Sequence
  Synthetic
ctgtggtaagctgcgctgaagctcccaacatgaagatcattggtaaccgcattgaaaggatccgcagtgagcacg

SEQ ID NO: 361868 - DNA, 75 bp, Artificial Sequence
  Synthetic
ctcacacactgtggacagatggagtggaagaaagtgatctgatcatacccaagtccttagctggtccactcagcc

SEQ ID NO: 361869 - DNA, 75 bp, Artificial Sequence
  Synthetic
gacataggtgagtcatcatctagtcctgaagtggaagaagcacggacgctcagagtcctctccatggtgggggat

SEQ ID NO: 361870 - DNA, 75 bp, Artificial Sequence
  Synthetic
ctagtggaagggtcatagaggaatggtgctgtagggaatgcacaatgcctccactatcgttccgggcgaaagacg

SEQ ID NO: 361871 - DNA, 75 bp, Artificial Sequence
  Synthetic
taaatacacataccaaaacaaagtggtgaaggttctcagaccagctgaaggaggaaaaacagttatggacatcat

SEQ ID NO: 361872 - DNA, 75 bp, Artificial Sequence
  Synthetic
gctgctggtatggaatggagataaggcccagaaaggaaccagagagcaacttagtgaggtccatgctaacaacag

SEQ ID NO: 361873 - DNA, 75 bp, Artificial Sequence
  Synthetic
tccggattgtcaatatgctaaaacgcggagtagcccgtgtaaaccccttggggggtttgaagaggctgccagccg

SEQ ID NO: 361874 - DNA, 75 bp, Artificial Sequence
  Synthetic
gacgatccagaagagccgtgacgcttccttctcactccacgaggaagctgcaaacgcgatcgcagacttggctag

SEQ ID NO: 361875 - DNA, 75 bp, Artificial Sequence
  Synthetic
agtcaagagaatacacaaagcacctgatcaaggttgaaaattggatattcaggaaccccgggtttgcgctagtgg

SEQ ID NO: 361876 - DNA, 75 bp, Artificial Sequence
  Synthetic
ggaagggtccacacccggagtgttgtaagcaccaattttagtgttgtcaggcctgctagtcagccacagtttggg

SEQ ID NO: 361877 - DNA, 75 bp, Artificial Sequence
  Synthetic
gtacgttacatgacaacagcagtcaacgtcacccattctgggacagaaatcgttgatttgatgtgccatgccact

SEQ ID NO: 361878 - DNA, 75 bp, Artificial Sequence
  Synthetic
gttcgttacatgacaacagcagtcaacgtcacccattctgggacagaaatcgttgatttgatgtgccatgccact

SEQ ID NO: 361879 - DNA, 75 bp, Artificial Sequence
  Synthetic
gtccgttacatgacaacagcagtcaacgtcacccattctgggacagaaatcgttgatttgatgtgccatgccact

SEQ ID NO: 361880 - DNA, 75 bp, Artificial Sequence
  Synthetic
gtgcgttacatgacaacagcagtcaacgtcacccattctgggacagaaatcgttgatttgatgtgccatgccact

SEQ ID NO: 361881 - DNA, 75 bp, Artificial Sequence
  Synthetic
tggtggatagaggttggggaaatgggtgtggactttttggcaaagggagcttggtgacatgtgccaagtttacgt

SEQ ID NO: 361882 - DNA, 75 bp, Artificial Sequence
  Synthetic
aagaagagacgtggcgcagacaccagtgtcggaattgttggcctcctgctgaccacagccatggcagtggaggtc

SEQ ID NO: 361883 - DNA, 75 bp, Artificial Sequence
  Synthetic
atattcaggaaccctggctttgcgttggcagcagctgccattgcttggcttttgggaagctcaacgagccaaaaa

SEQ ID NO: 361884 - DNA, 75 bp, Artificial Sequence
  Synthetic
tggcagtcttgggggacacagcctgggactttggatcagttgggggtgtgtttaattcattgggtaagggtattc

SEQ ID NO: 361885 - DNA, 75 bp, Artificial Sequence
  Synthetic
accagatctttggagcagctttcaaatcactgtttggaggaatgtcctggttctcacagatcctcataggcacac

SEQ ID NO: 361886 - DNA, 75 bp, Artificial Sequence
  Synthetic
caggacaagccaactgttgatatagagttggtcacaacaacggttagcaacatggcggaggtaagatcctactgc

SEQ ID NO: 361887 - DNA, 75 bp, Artificial Sequence
  Synthetic
tcttcctttccacggctgtttctgctgatgttgggtgctcggtggacttctcaaaaaaggaaacgagatgtggca

SEQ ID NO: 361888 - DNA, 75 bp, Artificial Sequence
  Synthetic
tggttggtgcacaaggagtggttccatgacattccactaccttggcatgctggggcagacaccggaactccacat

SEQ ID NO: 361889 - DNA, 75 bp, Artificial Sequence
  Synthetic
gcgttcacattcaccaagatcccggctgaaacgctgcatgggacagtcacagtggaggtacagtatgcagggaca

SEQ ID NO: 361890 - DNA, 75 bp, Artificial Sequence
  Synthetic
tgattgagatgaaaacatgtgagtggccaaagtctcacacactgtggacagatggagtggaagaaagtgatctga

SEQ ID NO: 361891 - DNA, 75 bp, Artificial Sequence
  Synthetic
tcatacccaagtccttagctggtccactcagccaccacaacaccagagagggttacagaactcaagtgaaagggc

SEQ ID NO: 361892 - DNA, 75 bp, Artificial Sequence
  Synthetic
tacattgtcataggagttggggataagaagatcacccaccactggaacaggagtggcagcaccatcggaaaagca

SEQ ID NO: 361893 - DNA, 75 bp, Artificial Sequence
  Synthetic
tacattgtcataggagttggggataagaagatcacccaccactggtacaggagtggcagcaccatcggaaaagca

SEQ ID NO: 361894 - DNA, 75 bp, Artificial Sequence
  Synthetic
tacattgtcataggagttggggataagaagatcacccaccactggcacaggagtggcagcaccatcggaaaagca

SEQ ID NO: 361895 - DNA, 75 bp, Artificial Sequence
  Synthetic
tacattgtcataggagttggggataagaagatcacccaccactgggacaggagtggcagcaccatcggaaaagca

SEQ ID NO: 361896 - DNA, 75 bp, Artificial Sequence
  Synthetic
cttacgtgcttggccttagggggagtgttgatcttcctatctacagccgtctctgctgatgtggggtgttcggtg

SEQ ID NO: 361897 - DNA, 75 bp, Artificial Sequence
  Synthetic
gacttctcaaagaaggaaacgagatgcggtacgggggtgttcgtctataacgacgttgaagcctggagggacagg

SEQ ID NO: 361898 - DNA, 75 bp, Artificial Sequence
  Synthetic
cctgtgaatgagctgccccacggttggaaggcctgggggaaatcgtactttgtcagggcagcaaagaccaacaac

SEQ ID NO: 361899 - DNA, 75 bp, Artificial Sequence
  Synthetic
agctttgttgtggatggtgacacactgaaggaatgcccgctcaaacacagagcatggaacagctttcttgtggag

SEQ ID NO: 361900 - DNA, 75 bp, Artificial Sequence
  Synthetic
gatcacgggttcggggtatttcacactagtgtctggcttaaagtcagagaggattactcattagagtgtgatcca

SEQ ID NO: 361901 - DNA, 75 bp, Artificial Sequence
  Synthetic
gccgtcataggaacagctgctaagggaaaggaggccgtgcacagtgatctaggctactggattgagagtgaaaag

SEQ ID NO: 361902 - DNA, 75 bp, Artificial Sequence
  Synthetic
aacgacacatggaggctgaagagggctcacctgatcgagatgaaaacatgtgaatggccaaagtcccacacactg

SEQ ID NO: 361903 - DNA, 75 bp, Artificial Sequence
  Synthetic
acgcggaagtcactggaaacagtcctcggcttgacgtggcactagatgagagtggtgatttctccttggtagagg

SEQ ID NO: 361904 - DNA, 75 bp, Artificial Sequence
  Synthetic
agagagggctacaggactcaagtgaaagggccgtggcatagtgaagagcttgaaatccggtttgaggaatgtcca

SEQ ID NO: 361905 - DNA, 75 bp, Artificial Sequence
  Synthetic
ggcaccaaggtccacgtggaggaaacatgtggaacgagaggaccgtccctgagatcaaccactgcaagcggaagg

SEQ ID NO: 361906 - DNA, 75 bp, Artificial Sequence
  Synthetic
ggaatggagataaggcccaggaaggaaccagagagtaacctagtaaggtcaatggtgactgcaggatcaactgat

SEQ ID NO: 361907 - DNA, 75 bp, Artificial Sequence
  Synthetic
cacaggttggagtgggagtcatgcaagagggagtcttccacaccatgtggcacgtcacaaaaggagccgcattga

SEQ ID NO: 361908 - DNA, 75 bp, Artificial Sequence
  Synthetic
ggagcggtgaaggaagacttgatccatattggggggacgtcaagcaggacttggtgtcatattgtgggccttgga

SEQ ID NO: 361909 - DNA, 75 bp, Artificial Sequence
  Synthetic
agttggatgcagcctgggatggactaagtgaagtgcagcttttggccgtaccccccggagagagggctagaaaca

SEQ ID NO: 361910 - DNA, 75 bp, Artificial Sequence
  Synthetic
atgctgctggccttggcctcgtgccttctgcaaactgagatctccgccctggaaggcgacctgatggttctcatc

SEQ ID NO: 361911 - DNA, 75 bp, Artificial Sequence
  Synthetic
atgctgctggccttggcctcgtgccttctgcaaactgtgatctccgccctggaaggcgacctgatggttctcatc

SEQ ID NO: 361912 - DNA, 75 bp, Artificial Sequence
  Synthetic
atgctgctggccttggcctcgtgccttctgcaaactgcgatctccgccctggaaggcgacctgatggttctcatc

SEQ ID NO: 361913 - DNA, 75 bp, Artificial Sequence
  Synthetic
atgctgctggccttggcctcgtgccttctgcaaactgggatctccgccctggaaggcgacctgatggttctcatc

SEQ ID NO: 361914 - DNA, 75 bp, Artificial Sequence
  Synthetic
atagcggcattcaaagtcagacccgcgttgctggtctctttcatcttcagagccaattggacaccccgtgagagc

SEQ ID NO: 361915 - DNA, 75 bp, Artificial Sequence
  Synthetic
ttcatgctcctctctctgaaggggaaaggtagtgtgaagaagaacctaccatttgtcatggccttgggactaacc

SEQ ID NO: 361916 - DNA, 75 bp, Artificial Sequence
  Synthetic
cctagtgaagtactcacagctgttggcctgatatgtgcactggccggagggttcgccaaagcagatatagagatg

SEQ ID NO: 361917 - DNA, 75 bp, Artificial Sequence
  Synthetic
atttgatgtgccatgccaccttcacttcacgcctactacaacccatcagagtccccaactacaacctttacatca

SEQ ID NO: 361918 - DNA, 75 bp, Artificial Sequence
  Synthetic
gctgggcccatggctgcagttggcctgctaattgttagttacgtggtctcaggaaagagtgtggacatgtacatt

SEQ ID NO: 361919 - DNA, 75 bp, Artificial Sequence
  Synthetic
gatgagagtggtgatttctccctggtggaggatgatggtccccccatgagagagatcatactcaaggtggtcctg

SEQ ID NO: 361920 - DNA, 75 bp, Artificial Sequence
  Synthetic
tacagctcagcaggaagacttttgagacagagtttcagaagacaaaaaatcaagagtgggactttgtcataacaa

SEQ ID NO: 361921 - DNA, 75 bp, Artificial Sequence
  Synthetic
tactcgatggcgagagagtcatcctggctgggcccatgcctgtcacgcatgccagtgctgctcagaggagaggac

SEQ ID NO: 361922 - DNA, 75 bp, Artificial Sequence
  Synthetic
ggagcagttgctctggactacccagcaggaacttcaggatctccgatcctagacaagtgtgggagagtgatagga

SEQ ID NO: 361923 - DNA, 75 bp, Artificial Sequence
  Synthetic
ggcctgaggccgacaaggtagccgccattgagggagagttcaagctgaggacagagcaaaggaagacctttgtgg

SEQ ID NO: 361924 - DNA, 75 bp, Artificial Sequence
  Synthetic
aatgtcacccactctgggacagaaatcgttgatttaatgtgccatgccaccttcacttcacgcctactacaaccc

SEQ ID NO: 361925 - DNA, 75 bp, Artificial Sequence
  Synthetic
attagagtccccaactacaatctttacattatggatgaggcccacttcacagatccctcaagtatagcagcaaga

SEQ ID NO: 361926 - DNA, 75 bp, Artificial Sequence
  Synthetic
acggaacctgccatcacaaaaaaggtgaagcacggagatctagaagagctgtgacgctcccctcccattccaacc

SEQ ID NO: 361927 - DNA, 75 bp, Artificial Sequence
  Synthetic
tggtgctcatacccgagccagagaagcaaagatctccccaggataatcaaatggcaatcatcatcatggtggcag

SEQ ID NO: 361928 - DNA, 75 bp, Artificial Sequence
  Synthetic
aaaaatcaagagtgggacttcgtcgtaacaactgacatctcagagatgggcgccaacttcaaagctgaccgggtc

SEQ ID NO: 361929 - DNA, 75 bp, Artificial Sequence
  Synthetic
gcatcatgaagaatcccgttgtggatggaatagtggtgactgacattgacacaatgacaattgacccccaagtgg

SEQ ID NO: 361930 - DNA, 75 bp, Artificial Sequence
  Synthetic
ggggggaggctggggctctgatcacagcagcaacctccaccttatgggaaggctctccaaacaaatactggaact

SEQ ID NO: 361931 - DNA, 75 bp, Artificial Sequence
  Synthetic
cttttgggtttgctgggaacagtctcgctgggaatcttctttgtcttgatgcggaacaagggcatagggaagatg

SEQ ID NO: 361932 - DNA, 75 bp, Artificial Sequence
  Synthetic
gccgcgccctcaaggatggagtggccacaggaggacatgctgtatcccggggaagcgcaaagcttagatggttgg

SEQ ID NO: 361933 - DNA, 75 bp, Artificial Sequence
  Synthetic
aaagggatgccattctatgcgtgggacttcggagtcccgctgctaatgatgggttgctactcacaattaacaccc

SEQ ID NO: 361934 - DNA, 75 bp, Artificial Sequence
  Synthetic
aaagctgaccgtgtcatagattccaggagatgcctaaagccggtcatacttgatggcgagagagtcattctggct

SEQ ID NO: 361935 - DNA, 75 bp, Artificial Sequence
  Synthetic
ttgaccttaatagtggccatcattctgctcgtggcgcactacatgtacttgatcccaggtctacaggcagcagcg

SEQ ID NO: 361936 - DNA, 75 bp, Artificial Sequence
  Synthetic
tgggacgcatggaagggcctaggaggccagtgaaatatgaggaggatgtgaacctcggctcaggcacacgagctg

SEQ ID NO: 361937 - DNA, 75 bp, Artificial Sequence
  Synthetic
ttggctggagcttctcttatttacacagtaacaagaaacgctggcctggtcaagagacgtggaggtggaacggga

SEQ ID NO: 361938 - DNA, 75 bp, Artificial Sequence
  Synthetic
ggtcagcgtcatccctcgtgaacggggttgttagactcttgtcaaagccctgggatgtggtgactggagttacag

SEQ ID NO: 361939 - DNA, 75 bp, Artificial Sequence
  Synthetic
ggcatcaccgaagtgtgcagagaagaagcccgccgcgccctcaaggacggagtggcaacaggaggccatgctgtg

SEQ ID NO: 361940 - DNA, 75 bp, Artificial Sequence
  Synthetic
atccccaagaaggcactcgccaagtgatgaacatggtatcgtcttggctatggaaggagctgggaaaacgcaagc

SEQ ID NO: 361941 - DNA, 75 bp, Artificial Sequence
  Synthetic
aacctcgctgtgctcatgcgggcagagactggaagcaggccttacaaagccgcggcggcccaattgccggagacc

SEQ ID NO: 361942 - DNA, 75 bp, Artificial Sequence
  Synthetic
gcggcttttggagtgatggaagccctgggaacactgccaggacacatgacagagagattccaggaagccattgac

SEQ ID NO: 361943 - DNA, 75 bp, Artificial Sequence
  Synthetic
tcccgaggaagcgcaaagcttagatggttggtggagagaggatacctgcagccctatggaaaggtcattgatctt

SEQ ID NO: 361944 - DNA, 75 bp, Artificial Sequence
  Synthetic
gacgtctttcacatggcggcggagtcgtgtgacactttgctgtgtgacataggtgagtcatcatctagtcctgaa

SEQ ID NO: 361945 - DNA, 75 bp, Artificial Sequence
  Synthetic
ttggatatatcctagaagaaatgaaccgggcaccaggaggaaagatgtatgcagatgacactgctggctgggaca

SEQ ID NO: 361946 - DNA, 75 bp, Artificial Sequence
  Synthetic
gatgtgaatctcggctccggcacgcgagctgtggcaagctgcgccgaagctcccaacctgaagatcattggtaac

SEQ ID NO: 361947 - DNA, 75 bp, Artificial Sequence
  Synthetic
cgcgttgagaggatccgcagtgagcatgcggaaacgtggttctttgatgagaaccacccatacaggacatgggct

SEQ ID NO: 361948 - DNA, 75 bp, Artificial Sequence
  Synthetic
taccatgggagctacgaggcccctacacaagggtcagcgtcttctctcataaacggggttgtcaggctcctgtca

SEQ ID NO: 361949 - DNA, 75 bp, Artificial Sequence
  Synthetic
aatggtgctgcagggagtgcacaatgcccccactgtcgttccgggctaaagatggctgttggtatggaatggaga

SEQ ID NO: 361950 - DNA, 75 bp, Artificial Sequence
  Synthetic
tatggtgctgcagggagtgcacaatgcccccactgtcgttccgggctaaagatggctgttggtatggaatggaga

SEQ ID NO: 361951 - DNA, 75 bp, Artificial Sequence
  Synthetic
catggtgctgcagggagtgcacaatgcccccactgtcgttccgggctaaagatggctgttggtatggaatggaga

SEQ ID NO: 361952 - DNA, 75 bp, Artificial Sequence
  Synthetic
gatggtgctgcagggagtgcacaatgcccccactgtcgttccgggctaaagatggctgttggtatggaatggaga

SEQ ID NO: 361953 - DNA, 75 bp, Artificial Sequence
  Synthetic
tggctatggaaggagctaggtaaacacaaacggccacgagtttgcaccaaagaagagttcatcaataaggttcgc

SEQ ID NO: 361954 - DNA, 75 bp, Artificial Sequence
  Synthetic
agcaatgcagcactgggggcaatatttgaagaggagaaagaatggaagactgcagtggaagctgtgaacgatcca

SEQ ID NO: 361955 - DNA, 75 bp, Artificial Sequence
  Synthetic
ggtggtgttgaagggctgggattacaaagacttggatatgttctagaagaaatgagccgcacaccaggaggaaag

SEQ ID NO: 361956 - DNA, 75 bp, Artificial Sequence
  Synthetic
atgtatgcagatgataccgctggctgggacacccgcatcagtaggtttgatctggagaatgaagctctgatcacc

SEQ ID NO: 361957 - DNA, 75 bp, Artificial Sequence
  Synthetic
caactgggagaaccacctggtcaatccatggaaagggagaatggatgactactgaggacatgctcatggtgtgga

SEQ ID NO: 361958 - DNA, 75 bp, Artificial Sequence
  Synthetic
gtccttagaccagctgaaagagggaagacagttatggacatcatctcaagacaagaccaaagagggagcggacaa

SEQ ID NO: 361959 - DNA, 75 bp, Artificial Sequence
  Synthetic
gttgttacttacgctcttaatacattcaccaacctggtggtgcagctcattcggaacatggaggctgaggaagtt

SEQ ID NO: 361960 - DNA, 75 bp, Artificial Sequence
  Synthetic
ctagagatgcaagacttgtggctgttgaggaggccagagaaggtgaccagctggttgcagagcaacggatgggat

SEQ ID NO: 361961 - DNA, 75 bp, Artificial Sequence
  Synthetic
ctcctgctgaccacagctatggcagcggaggtcactagacgtgggagtgcatactatatgtacttggacagaaac

SEQ ID NO: 361962 - DNA, 75 bp, Artificial Sequence
  Synthetic
aggtttttgaatgacatggggaaagttaggaaggacacacaggagtggaaaccctcaactggatggagcaactgg

SEQ ID NO: 361963 - DNA, 75 bp, Artificial Sequence
  Synthetic
gaagaagttccgttttgctcccatcacttcaacaagctttacctcaaggacgggaggtccattgtggtcccctgt

SEQ ID NO: 361964 - DNA, 75 bp, Artificial Sequence
  Synthetic
cgccaccaagatgaactgattggccgagcccgcgtctcaccaggggcgggatggagcatccgggagactgcttgc

SEQ ID NO: 361965 - DNA, 75 bp, Artificial Sequence
  Synthetic
gctgtgaatctccagcagaaggactagtggttagaggagaccccccggaaaacgcaaaacagcatattgacgctg

SEQ ID NO: 361966 - DNA, 75 bp, Artificial Sequence
  Synthetic
ccagtcacgaaatggacagacattccctatttgggaaaaagggaagacttatggtgtggatctcttatagggcac

SEQ ID NO: 361967 - DNA, 75 bp, Artificial Sequence
  Synthetic
agaccacgcactacttgggctgagaacattaaagacacagtcaacatggtgcgcaggatcataggtgatgaagaa

SEQ ID NO: 361968 - DNA, 75 bp, Artificial Sequence
  Synthetic
gtttaaaagaagaggaggaggaagaggaggaggaagaggaagaagaagaagatgaagaggaagactagttcgagt

SEQ ID NO: 361969 - DNA, 75 bp, Artificial Sequence
  Synthetic
ctgaagcgagagctaacaacagtatcaacaggtttaatttggatttggaaacgagagtttctggtcatgaaaaac

SEQ ID NO: 361970 - DNA, 75 bp, Artificial Sequence
  Synthetic
tggtatatgtggctaggggctagatttctagagttcgaagcccttggattcttgaacgaggatcactggatgggg

SEQ ID NO: 361971 - DNA, 75 bp, Artificial Sequence
  Synthetic
ccagatgacgtcgattgctggtgcaacacgacatcaacttgggttgtgtacggaacctgtcatcataaaaaaggt

SEQ ID NO: 361972 - DNA, 75 bp, Artificial Sequence
  Synthetic
gaagcacgacgatccagaagagccgtgacgcttccttctcactctacaaggaagttgcaaacgcgatcgcagact

SEQ ID NO: 361973 - DNA, 75 bp, Artificial Sequence
  Synthetic
ttgattgccccggcatacagtatcaggtgcataggagttagcaatagagacttcgtggagggcatgtcaggtggg

SEQ ID NO: 361974 - DNA, 75 bp, Artificial Sequence
  Synthetic
gaacctgccatcacaaaaaaggtgaagcacggagatctagaagagctgtgacgctcccctcccattccactagga

SEQ ID NO: 361975 - DNA, 75 bp, Artificial Sequence
  Synthetic
gatgagggagtggaaccagatgatgtcgattgctggtgcaacacgacatcaacttgggttgtgtacggaacctgt

SEQ ID NO: 361976 - DNA, 75 bp, Artificial Sequence
  Synthetic
agaacattggtggacagaggttggggaaatgggtgtggactttttggcaaggggagcttggtgacgtgtgccaag

SEQ ID NO: 361977 - DNA, 75 bp, Artificial Sequence
  Synthetic
ggcatgtcaggtgggacctgggttgatgttgtcttggaacatggaggctgcgttaccgtgatggcacaggacaag

SEQ ID NO: 361978 - DNA, 75 bp, Artificial Sequence
  Synthetic
acagtcacagtggaggtgcagtatgcagggagggatggaccctgcaaggtcccagcccagatggcggtggacatg

SEQ ID NO: 361979 - DNA, 75 bp, Artificial Sequence
  Synthetic
taccttgacaagcaatcagacactcaatatgtctgcaaaagaacgttagtggacagaggctggggaaatggatgt

SEQ ID NO: 361980 - DNA, 75 bp, Artificial Sequence
  Synthetic
ctaaaaatggacaagcttagattgaagggcgtgtcatattccttgtgcactgcggcattcacattcaccaaggtc

SEQ ID NO: 361981 - DNA, 75 bp, Artificial Sequence
  Synthetic
tcgtactttgttagggcggcaaagaccaacaacagttttgttgtcgacggtgacacactgaaggaatgtccgctc

SEQ ID NO: 361982 - DNA, 75 bp, Artificial Sequence
  Synthetic
aagggcattcaccagatttttggagcagccttcaaatcactgtttggaggaatgtcctggttctcacagatcctc

SEQ ID NO: 361983 - DNA, 75 bp, Artificial Sequence
  Synthetic
taaaaaagggggagaccacagatggagtgtacagagtgatgactcgtagactgctaggttcaacacaagttggag

SEQ ID NO: 361984 - DNA, 75 bp, Artificial Sequence
  Synthetic
gaaaacatcatgtggaaatcagtagaaggggagctcaatgctatcctagaggagaatggagttcaactgacagtt

SEQ ID NO: 361985 - DNA, 75 bp, Artificial Sequence
  Synthetic
ggaggtcccggtcatgaagaacccatgctggtgcaaagctatgggtggaacatagttcgtctcaagagtggagtg

SEQ ID NO: 361986 - DNA, 75 bp, Artificial Sequence
  Synthetic
atggtcttgggaggattctcaatgagtgacctggctaagcttgtgatcctgatgggtgccactttcgcagaaatg

SEQ ID NO: 361987 - DNA, 75 bp, Artificial Sequence
  Synthetic
agggcccacctgattgagatgaaaacatgtgaatggccaaagtctcacacattgtggacagatggagtagaagaa

SEQ ID NO: 361988 - DNA, 75 bp, Artificial Sequence
  Synthetic
aacatgtggaacaagaggaccatctctgagatcaaccactgcaagcggaagggtgatcgaggaatggtgctgcag

SEQ ID NO: 361989 - DNA, 75 bp, Artificial Sequence
  Synthetic
gcactcgtcaggttatgagcatggtctcttcctggttgtggaaagagctaggcaaacacaaacggccacgagtct

SEQ ID NO: 361990 - DNA, 75 bp, Artificial Sequence
  Synthetic
aagaagggtctacacctggagtgctgtaagcaccaatcttagtgttgtcaggcctgctagtcagccacagcttgg

SEQ ID NO: 361991 - DNA, 75 bp, Artificial Sequence
  Synthetic
gttggcctgatatgtgcactggccggagggtttgccaaggcagacattgagatggctggacccatggctgcagta

SEQ ID NO: 361992 - DNA, 75 bp, Artificial Sequence
  Synthetic
ggcttgctaattgtcagctatgtggtctcgggaaagagtgtggacatgtacattgaaagagcaggtgacatcaca

SEQ ID NO: 361993 - DNA, 75 bp, Artificial Sequence
  Synthetic
cctggaatatttaagacaaaggatggggacatcggagcagttgctctagactaccctgcaggaacctcaggatct

SEQ ID NO: 361994 - DNA, 75 bp, Artificial Sequence
  Synthetic
gaggctatggaaataataaaaaagttcaagaaagatcttgctgccatgttgagaataatcaatgctaggaaggag

SEQ ID NO: 361995 - DNA, 75 bp, Artificial Sequence
  Synthetic
ctagccttcttgagattcacagcaatcaagccatcactgggcctcatcaatagatggggttccgtggggaagaag

SEQ ID NO: 361996 - DNA, 75 bp, Artificial Sequence
  Synthetic
atgaaaaacccaaagaagaaatccggaggattccggattgtcaatatgctaaaacgcggagtagcccgtgtaaac

SEQ ID NO: 361997 - DNA, 75 bp, Artificial Sequence
  Synthetic
ctgggggtgaacaaatgccatgtgcagatcatggacctcgggcatatgtgtgacgccaccatgagttatgagtgc

SEQ ID NO: 361998 - DNA, 75 bp, Artificial Sequence
  Synthetic
ggacttccggtgcgttacatgacaacagcagtcaacgtcacccattctgggacagaaatcgttgatttgatgtgc

SEQ ID NO: 361999 - DNA, 75 bp, Artificial Sequence
  Synthetic
aggaagagacgtggagctgatgccagcatcggaatcgtcagcctcctgctgactacagtcatggcagcagagatc

SEQ ID NO: 362000 - DNA, 75 bp, Artificial Sequence
  Synthetic
gccagaaacattcagaccctgcctggaatattcaagacaaaggacggggacatcggagcagttgctctggactac

SEQ ID NO: 362001 - DNA, 75 bp, Artificial Sequence
  Synthetic
atattcaggaaccccgggtttgcgctagtggctgtagctattgcctggctcctgggaagctcgacgagccaaaaa

SEQ ID NO: 362002 - DNA, 75 bp, Artificial Sequence
  Synthetic
gtcatatacttggtcatgatattgttgattgccccggcatacagtatcaggtgcataggagttagcaatagagac

SEQ ID NO: 362003 - DNA, 75 bp, Artificial Sequence
  Synthetic
cccatgctggacgagggagtggagccagatgacgtcgattgctggtgcaacacgacatcaacttgggttgtgtac

SEQ ID NO: 362004 - DNA, 75 bp, Artificial Sequence
  Synthetic
cctgaaatagtccgtgaagccataaaaaagagactccggacagtgatcttggcaccaactagggttgtcgctgct

SEQ ID NO: 362005 - DNA, 75 bp, Artificial Sequence
  Synthetic
actagacgcgggagtgcatactacatgtacttggacaggagcgatgctggtaaggccatttctttcgttaccaca

SEQ ID NO: 362006 - DNA, 75 bp, Artificial Sequence
  Synthetic
cgcattgagagaatccgcaatgaacatgcagaaacatggtttcttgatgaaaaccacccatacaggacatgggcc

SEQ ID NO: 362007 - DNA, 75 bp, Artificial Sequence
  Synthetic
gggagcttggtgacgtgtgccaagtttacatgctccaagaaaatgacagggaagagcatccagccggagaacttg

SEQ ID NO: 362008 - DNA, 75 bp, Artificial Sequence
  Synthetic
gatgtgaacctcggctcgggtacacgagctgtggcaagctgtgctgaggctcctaacatgaaaatcatcggcagg

SEQ ID NO: 362009 - DNA, 75 bp, Artificial Sequence
  Synthetic
gagatgggtgccaacttcaaggctgaccgggtcatagattccaggagatgcctaaagccagtcatacttgatggt

SEQ ID NO: 362010 - DNA, 75 bp, Artificial Sequence
  Synthetic
ccaaggacaggccttgacttttcagatctgtattacctgaccatgaacaataagcattggttggtgcacaaagag

SEQ ID NO: 362011 - DNA, 75 bp, Artificial Sequence
  Synthetic
tggtttcatgacatcccattaccttggcattctggtgcagacactgaaactccacactggaacaacaaagaggca

SEQ ID NO: 362012 - DNA, 75 bp, Artificial Sequence
  Synthetic
gtcataacaactgacatctcagagatgggcgccaacttcaaggctgaccgggtcatagactctaggagatgccta

SEQ ID NO: 362013 - DNA, 75 bp, Artificial Sequence
  Synthetic
acggctctcgctggagctctggaggctgagatggatggtgcgaagggaaggctatcctcaggccatttgaaatgc

SEQ ID NO: 362014 - DNA, 75 bp, Artificial Sequence
  Synthetic
tctgggaaaacagtttggttcgttccaagcgtgagaaacggaaatgaaatcgcagcctgtctgacaaaggctgga

SEQ ID NO: 362015 - DNA, 75 bp, Artificial Sequence
  Synthetic
ggggacaagaaaatcacccatcactggcatcggagtggtagcatcatcggaaaggcatttgaagccactgtgaga

SEQ ID NO: 362016 - DNA, 75 bp, Artificial Sequence
  Synthetic
tggacaaagtatggagagaagagagtgctcaaaccgagatggatggatgctagggtctgttcagaccatgcggcc

SEQ ID NO: 362017 - DNA, 75 bp, Artificial Sequence
  Synthetic
ggcgccaagagaatggcagtcttgggagacacagcctgggactttggatcagttgggggtgtgtttaactcattg

SEQ ID NO: 362018 - DNA, 75 bp, Artificial Sequence
  Synthetic
ccaggacacatgacagagaggtttcaggaagccattgacaacctcgccgtgctcatgcgagcagagactggaagc

SEQ ID NO: 362019 - DNA, 75 bp, Artificial Sequence
  Synthetic
ctcataggcacactgttggtgtggttgggtctgaacacaaagaatggatctatctccctcacatgcttggccttg

SEQ ID NO: 362020 - DNA, 75 bp, Artificial Sequence
  Synthetic
acgagatgtggcacgggggtgttcatctacaatgacgttgaagcctggagggatcgatacagataccatcctgac

SEQ ID NO: 362021 - DNA, 75 bp, Artificial Sequence
  Synthetic
atggaaaacatcatgtggaaatcagtggaaggggagcttaatgcgatcctagaggagaatggagtccaactgaca

SEQ ID NO: 362022 - DNA, 75 bp, Artificial Sequence
  Synthetic
ttattactggtggtgctcatacccgagccagagaagcaaagatctccccaagataaccagatggcaattatcatc

SEQ ID NO: 362023 - DNA, 75 bp, Artificial Sequence
  Synthetic
gttgtagtggggtctgtaaaaaaccccatgtggagaggtccacgaagattgccagtgcccgtaaatgagctgccc

SEQ ID NO: 362024 - DNA, 75 bp, Artificial Sequence
  Synthetic
catggctggaaagcctgggggaaatcgtactttgttagggcggcaaagaccaacaacagttttgttgtcgacggt

SEQ ID NO: 362025 - DNA, 75 bp, Artificial Sequence
  Synthetic
ttccacaccagtgtttggctgaaggtcagagaggactattcattagagtgtgacccagccgtcataggaacagct

SEQ ID NO: 362026 - DNA, 75 bp, Artificial Sequence
  Synthetic
gtcaagggaaaggaggctgcacacagtgatctaggctattggattgagagtgaaaagaatgacacatggaggctg

SEQ ID NO: 362027 - DNA, 75 bp, Artificial Sequence
  Synthetic
tgggaccttggagtcccgctgctaatgatgggttgctattcacaattaacacccctgactctgatagtagctatc

SEQ ID NO: 362028 - DNA, 75 bp, Artificial Sequence
  Synthetic
gaggagacatgcggaactagaggaccatctttaagatcaaccactgcaagtggaagggtcatagaggaatggtgc

SEQ ID NO: 362029 - DNA, 75 bp, Artificial Sequence
  Synthetic
aggttttgggccctagtggatagggagagagaacaccacctgagaggagagtgtcacagctgtgtgtacaacatg

SEQ ID NO: 362030 - DNA, 75 bp, Artificial Sequence
  Synthetic
acatcaatggcaatgctggtagccatggtcttgggaggattctcaatgagtgacctggctaagcttgtgatcctg

SEQ ID NO: 362031 - DNA, 75 bp, Artificial Sequence
  Synthetic
atgggtgccactttcgcagaaatgaacactggaggagatgtggctcacttggcattggtagcggcatttaaagtc

SEQ ID NO: 362032 - DNA, 75 bp, Artificial Sequence
  Synthetic
agaccagccttgttggtttccttcatcttcagagccaactggacaccccgtgagagcatgctgctagccctggct

SEQ ID NO: 362033 - DNA, 75 bp, Artificial Sequence
  Synthetic
cccatgctggtgcaaagctatgggtggaacatagttcgtctcaagagtggagtggacgtcttccacatggcggct

SEQ ID NO: 362034 - DNA, 75 bp, Artificial Sequence
  Synthetic
atgggaaaaagagaaaagaagcaaggagagttcgggaaagcaaaaggtagccgcgccatctggtacatgtggttg

SEQ ID NO: 362035 - DNA, 75 bp, Artificial Sequence
  Synthetic
agagtgctctctatggtgggggactggcttgaaaaaagaccaggggccttctgtataaaggtgctgtgcccatac

SEQ ID NO: 362036 - DNA, 75 bp, Artificial Sequence
  Synthetic
gctgtcggcctgatatgtgcactggccggagggtttgccaaggcagacatagagatggctgggcccatggctgca

SEQ ID NO: 362037 - DNA, 75 bp, Artificial Sequence
  Synthetic
agaggagagtgtcacagctgtgtgtacaacatgatgggaaaaagagaaaagaagcaaggagaattcgggaaagca

SEQ ID NO: 362038 - DNA, 75 bp, Artificial Sequence
  Synthetic
acatgggaaaaagacgcggaagtcactggaaacagtcctcggcttgacgtggcactagatgagagtggtgatttc

SEQ ID NO: 362039 - DNA, 75 bp, Artificial Sequence
  Synthetic
acacgagctgtggcaagctgtgctgaggctcctaacatgaaaatcatcggcaggcgcattgagagaatccgcaat

SEQ ID NO: 362040 - DNA, 75 bp, Artificial Sequence
  Synthetic
tctttggtagaggaggatggcccacccatgagagagatcatactcaaggtggtcctgatggccatctgtggcatg

SEQ ID NO: 362041 - DNA, 75 bp, Artificial Sequence
  Synthetic
aggtttgatctggagaatgaagccctgatcactaaccagatggaagaagggcacagagctctggcgttggccgtg

SEQ ID NO: 362042 - DNA, 75 bp, Artificial Sequence
  Synthetic
tgggacgtgcctgctcccaaagaagtaaaaaagggagagactacagatggagtgtacagagttatgactcgcaga

SEQ ID NO: 362043 - DNA, 75 bp, Artificial Sequence
  Synthetic
ggagccgcattgaggagcggtgaaggaagacttgatccatactggggggacgtcaagcaggacctggtgtcatat

SEQ ID NO: 362044 - DNA, 75 bp, Artificial Sequence
  Synthetic
atatttgaagaggaaaaagaatggaagacggctgtggaagctgtgaatgatccaaggttttgggccctagtggat

SEQ ID NO: 362045 - DNA, 75 bp, Artificial Sequence
  Synthetic
gaagcccttggattcttgaacgaggaccattggatgggaagagaaaactcaggaggtggagtcgaagggttagga

SEQ ID NO: 362046 - DNA, 75 bp, Artificial Sequence
  Synthetic
atgtacgcagatgacactgctggctgggacacccgcattagtaagtttgatctggagaatgaagctttgattacc

SEQ ID NO: 362047 - DNA, 75 bp, Artificial Sequence
  Synthetic
ggctgggacacccgcattagtaagtttgatctggagaatgaagctctgattaccaaccaaatggaggaagggcac

SEQ ID NO: 362048 - DNA, 75 bp, Artificial Sequence
  Synthetic
ggggcaggatggagcatccgggagactgcctgtcttgcaaaatcatatgcccagatgtggcagcttctttatttc

SEQ ID NO: 362049 - DNA, 75 bp, Artificial Sequence
  Synthetic
gctgagatggaggaagccctaagaggacttccggtgcgttacatgacaacagcagtcaacgtcacccattctggg

SEQ ID NO: 362050 - DNA, 75 bp, Artificial Sequence
  Synthetic
aacctttatatcatggatgaggctcatttcacagatccttcaagcatagctgcaagaggatacatatcaacaagg

SEQ ID NO: 362051 - DNA, 75 bp, Artificial Sequence
  Synthetic
gaggacttatggtgtggatcccttatagggcacagacctcgcaccacttgggctgagaacatcaaagacacagtc

SEQ ID NO: 362052 - DNA, 75 bp, Artificial Sequence
  Synthetic
aactcaccaatcatggacacagaagtggaagtcccagagagagcctggagctcaggctttgactgggtgacggac

SEQ ID NO: 362053 - DNA, 75 bp, Artificial Sequence
  Synthetic
agtggagatgactgcgttgtgaagccaatcgatgataggtttgcacatgccctcaggttcttgaatgacatggga

SEQ ID NO: 362054 - DNA, 75 bp, Artificial Sequence
  Synthetic
tggagtgctgtaagcaccaatttcagtgttgtcaggcctgctagtcagccacagtttggggaaagctgtgcagcc

SEQ ID NO: 362055 - DNA, 75 bp, Artificial Sequence
  Synthetic
tttgtcataacaactgacatttcagagatgggtgccaacttcaaggctgaccgggtcatagattccaggagatgc

SEQ ID NO: 362056 - DNA, 75 bp, Artificial Sequence
  Synthetic
ctaaagccagtcatacttgatggtgagagagtcatcctggctgggcctatgcccgtcacgcacgccagtgctgct

SEQ ID NO: 362057 - DNA, 75 bp, Artificial Sequence
  Synthetic
cattctggaaaaacaatttggtttgttccaagtgtgagaaacggaaatgaaatcgcagcctgtctgacaaaggct

SEQ ID NO: 362058 - DNA, 75 bp, Artificial Sequence
  Synthetic
actgatgaagaccatgcacactggcttgaagcaagaatgcttctcgacaacatttacctccaggatggcctcata

SEQ ID NO: 362059 - DNA, 75 bp, Artificial Sequence
  Synthetic
acttacacagacagaagatggtgctttgatggcactaccaacaacaccataatggaagacagtgtaccagcagag

SEQ ID NO: 362060 - DNA, 75 bp, Artificial Sequence
  Synthetic
tagtcaggccgagaacgccatggcacggaagaagccatgctgcctgtgagcccctcagaggacactgagtcaaaa

SEQ ID NO: 362061 - DNA, 75 bp, Artificial Sequence
  Synthetic
gtgtggaccaagtatggagagaagagagtgctcaaaccgaggtggatggatgccagggtctgttcagatcatgcg

SEQ ID NO: 362062 - DNA, 75 bp, Artificial Sequence
  Synthetic
aatctggggcctgaactggagactagctgtgaatctccagcagagggactagtggttagaggagaccccccggaa

SEQ ID NO: 362063 - DNA, 75 bp, Artificial Sequence
  Synthetic
acagtttcgctagggatcttctttgtcttgatgcggaacaagggcatcgggaagatgggcttcggaatggtaacc

SEQ ID NO: 362064 - DNA, 75 bp, Artificial Sequence
  Synthetic
cttggggccagcgcatggctcatgtggctttcggaaattgaaccagccagaatcgcatgtgtcctcattgtcgtg

SEQ ID NO: 362065 - DNA, 75 bp, Artificial Sequence
  Synthetic
aacaactactccctgatggcgatggccacacaagctggagtgctgtttggcatgggcaaagggatgccattttat

SEQ ID NO: 362066 - DNA, 75 bp, Artificial Sequence
  Synthetic
gcatgggactttggagtcccgctgctaatgatgggttgttactcacaattaacacccctgaccctgatagtggcc

SEQ ID NO: 362067 - DNA, 75 bp, Artificial Sequence
  Synthetic
cagactgcgacagttcgagtttgaagcgaaagctagcaacagtatcaacaggttttattttggatttggaaacga

SEQ ID NO: 362068 - DNA, 75 bp, Artificial Sequence
  Synthetic
aaatactggaactcctctacagccacttcactgtgcaatatcttcagaggaagttatttggcaggggcttccctt

SEQ ID NO: 362069 - DNA, 75 bp, Artificial Sequence
  Synthetic
tggaaagcccgcctgaaccagatgtcggctttggagttctattcttacaaaaagtcaggcatcaccgaagtgtgt

SEQ ID NO: 362070 - DNA, 75 bp, Artificial Sequence
  Synthetic
cttagatggttggtagagagaggatacctgcagccccatggaaaggttgttgacctcggatgtggcagagggggc

SEQ ID NO: 362071 - DNA, 75 bp, Artificial Sequence
  Synthetic
gctgagccgtgtgacactttgctgtgtgacattggcgagtcatcgtccagtcctgaagtggaagagacgcgaaca

SEQ ID NO: 362072 - DNA, 75 bp, Artificial Sequence
  Synthetic
acgagccaaaaagtcatatacttggtcatgatactgctgattgccccggcatacagcatcaggtgcataggagtc

SEQ ID NO: 362073 - DNA, 75 bp, Artificial Sequence
  Synthetic
tcccgcaactccacacatgagatgtattgggtctctggagccaaaagtaacatcataaagagtgtgtccaccaca

SEQ ID NO: 362074 - DNA, 75 bp, Artificial Sequence
  Synthetic
aatgaacatgcagagacatggttctttgatgaaaaccacccatacaggacatgggcctaccatgggagctacgaa

SEQ ID NO: 362075 - DNA, 75 bp, Artificial Sequence
  Synthetic
actagggtgccagacccccaagaaggcacccgccgagtaatgaacatggtctcgtcttggctatggaaggagctg

SEQ ID NO: 362076 - DNA, 75 bp, Artificial Sequence
  Synthetic
ggaaaacgcaagcggccacgtgtctgcaccaaagaagagttcatcaataaggtgcgcagcaatgcagcactggga

SEQ ID NO: 362077 - DNA, 75 bp, Artificial Sequence
  Synthetic
gcaatatttgaagaggaaaaagaatggaagacagctgtagaagctgtgaatgatccgagattttgggctctagtg

SEQ ID NO: 362078 - DNA, 75 bp, Artificial Sequence
  Synthetic
tttgaggctcttggattcttgaatgaggaccattggatgggaagagaaaactcaggaggtggcgttgaagggcta

SEQ ID NO: 362079 - DNA, 75 bp, Artificial Sequence
  Synthetic
ggactgcaaaggcttggatacattctagaagaaatgaaccgggcgccaggaggaaagatgtatgcagatgacacc

SEQ ID NO: 362080 - DNA, 75 bp, Artificial Sequence
  Synthetic
cacagagctctggcgttggccgtgattaaatacacataccaaaacaaagtggtgaaggttctcagaccagctgaa

SEQ ID NO: 362081 - DNA, 75 bp, Artificial Sequence
  Synthetic
ggagggaaaacagtcatggacatcatctcaagacaagaccagagagggagcggacaagttgttacttatgctctc

SEQ ID NO: 362082 - DNA, 75 bp, Artificial Sequence
  Synthetic
tggctgttgaggaagccagagaaagtgaccagatggttgcagagcaatggatgggacagactcaaacgaatggca

SEQ ID NO: 362083 - DNA, 75 bp, Artificial Sequence
  Synthetic
gtcagtggagatgactgcgttgtaaagccaattgatgataggtttgcacatgccctcaggttcttgaatgacatg

SEQ ID NO: 362084 - DNA, 75 bp, Artificial Sequence
  Synthetic
tcccaccacttcaacaagctgcacctcaaggatgggagatccattgtggtcccctgccgccaccaagatgaactg

SEQ ID NO: 362085 - DNA, 75 bp, Artificial Sequence
  Synthetic
cagatgtggcagcttctttatttccacagaagagacctccgactgatggccaatgccatctgttcggccgtgcca

SEQ ID NO: 362086 - DNA, 75 bp, Artificial Sequence
  Synthetic
gagtgtgatccagccgttattggaacagctgttaagggaaaggaggctgtacacagtgatctaggctactggatt

SEQ ID NO: 362087 - DNA, 75 bp, Artificial Sequence
  Synthetic
agtggcagcaccattggaaaagcatttgaagccactgtgagaggtgccaagagaatggcagtcttgggagacaca

SEQ ID NO: 362088 - DNA, 75 bp, Artificial Sequence
  Synthetic
gaagaaaggtacatggactacctatccacccaggtacgctacttgggtgaggaggggtccacacctggagtgctg

SEQ ID NO: 362089 - DNA, 75 bp, Artificial Sequence
  Synthetic
actagacgaggaagtgcatactacatgtacttggacaggagcgatgctgggaaggccatttcctttgctaccaca

SEQ ID NO: 362090 - DNA, 75 bp, Artificial Sequence
  Synthetic
ttgggagtgaacaaatgccatgtacagatcatggatctcgggcacatgtgtgacgccaccatgagttatgagtgc

SEQ ID NO: 362091 - DNA, 75 bp, Artificial Sequence
  Synthetic
aagttgcaaacgcggtcgcagacctggttagaatcaagagaatacacgaagcacttgatcaaggttgaaaactgg

SEQ ID NO: 362092 - DNA, 75 bp, Artificial Sequence
  Synthetic
atattcaggaaccccgggtttgcgctagcggctgttgccattgcttggcttctgggaagttcgacgagccaaaaa

SEQ ID NO: 362093 - DNA, 75 bp, Artificial Sequence
  Synthetic
catctggcgctgatagcggcattcaaagtcagaccagcgttgctggtatctttcatcttcagagctaattggaca

SEQ ID NO: 362094 - DNA, 75 bp, Artificial Sequence
  Synthetic
accttggcaatcctggctgctctgacaccactggcccggggcacactgcttgtggcgtggagagcaggccttgct

SEQ ID NO: 362095 - DNA, 75 bp, Artificial Sequence
  Synthetic
tcagacactcaatatgtttgcaaaagaacattggtggacagaggttggggaaatgggtgtggactttttggcaaa

SEQ ID NO: 362096 - DNA, 75 bp, Artificial Sequence
  Synthetic
gggagcctggtgacatgtgccaagttcacgtgttccaagaagatgaccgggaagagcatccagccggagaatctg

SEQ ID NO: 362097 - DNA, 75 bp, Artificial Sequence
  Synthetic
tggaacaacaaagaggcattggtagagttcaaggatgcccacgccaagaggcaaaccgtcgtcgttctggggagc

SEQ ID NO: 362098 - DNA, 75 bp, Artificial Sequence
  Synthetic
caggaaggagctgttcacacggctcttgctggagctttggaggctgagatggatggtgcaaaaggaaggctgttc

SEQ ID NO: 362099 - DNA, 75 bp, Artificial Sequence
  Synthetic
tctggccatttgaaatgccgcctaaaaatggacaagcttagattgaagggcgtgtcatattccttgtgcaccgca

SEQ ID NO: 362100 - DNA, 75 bp, Artificial Sequence
  Synthetic
gcgttcacattcaccaaggtcccagctgaaacactgcatggaacagtcacagtggaggtgcagtatgcagggaca

SEQ ID NO: 362101 - DNA, 75 bp, Artificial Sequence
  Synthetic
gatggaccctgcaaggtcccagcccagatggcggtggacatgcagactttgaccccagtcggaaggctgataact

SEQ ID NO: 362102 - DNA, 75 bp, Artificial Sequence
  Synthetic
ggtgtgttcaactcattgggcaagggcatccaccagatctttggagcagccttcaaatcactgtttggaggaatg

SEQ ID NO: 362103 - DNA, 75 bp, Artificial Sequence
  Synthetic
ggaaagagtgtggacatgtacattgaaagagcaggtgacatcacatgggaaaaagatgcggaagtcactggaaac

SEQ ID NO: 362104 - DNA, 75 bp, Artificial Sequence
  Synthetic
ctcacatgcttggccctggggggagtgatgatcttcctctccacggctgtttctgctgatgtggggtgctcggtg

SEQ ID NO: 362105 - DNA, 75 bp, Artificial Sequence
  Synthetic
tacaagtaccatcctgactccccccgcagattggcagcagcagtcaagcaggcttgggaagaggggatttgtggg

SEQ ID NO: 362106 - DNA, 75 bp, Artificial Sequence
  Synthetic
atctcctccgtttcaagaatggaaaacatcatgtggaaatcagtggaaggggagctcaatgctatcttagaggag

SEQ ID NO: 362107 - DNA, 75 bp, Artificial Sequence
  Synthetic
tttaagacaaaggatggggacattggagcggttgcgctggattacccagcaggaacttcaggatctccaatccta

SEQ ID NO: 362108 - DNA, 75 bp, Artificial Sequence
  Synthetic
ggaatggagataaggcccaggaaagaaccagagagcaatttagtgaggtcaatggtgacagcgggatcaaccgat

SEQ ID NO: 362109 - DNA, 75 bp, Artificial Sequence
  Synthetic
cacatggaccacttctctcttggagtgcttgtgattctactcatggtgcaggaagggctgaagaagagaatgacc

SEQ ID NO: 362110 - DNA, 75 bp, Artificial Sequence
  Synthetic
atggacgccagagtttgttcagatcatgcggccctgaagtcattcaaggagtttgccgctgggaaaagaggagcg

SEQ ID NO: 362111 - DNA, 75 bp, Artificial Sequence
  Synthetic
gctaagcttgtgatcctgatgggtgctactttcgcagaaatgaatactggaggagatgtggctcacttggcattg

SEQ ID NO: 362112 - DNA, 75 bp, Artificial Sequence
  Synthetic
atgctgctagccctggcttcgtgtcttttgcaaactgcaatttcagctcttgaaggtgacttgatggtcctcgtt

SEQ ID NO: 362113 - DNA, 75 bp, Artificial Sequence
  Synthetic
aatggatttgctttggcctggttggcaatacgagcaatggccgtgccacgcactgacaacattgctctagcaatc

SEQ ID NO: 362114 - DNA, 75 bp, Artificial Sequence
  Synthetic
ttcatgctcctctccttgaaaggaaaaggtagtgtgaagaagaacctgccatttgtcatggccttgggaatgacc

SEQ ID NO: 362115 - DNA, 75 bp, Artificial Sequence
  Synthetic
gctgtgaggatagtggaccccattaacgtggtgggactactactactcacaaggagtgggaagcggagctggccc

SEQ ID NO: 362116 - DNA, 75 bp, Artificial Sequence
  Synthetic
ttctcaatggacattgacctgcggccagcctcagcttgggccatctatgctgccttgacaactttcattacccca

SEQ ID NO: 362117 - DNA, 75 bp, Artificial Sequence
  Synthetic
gctgggcccatggctgcagtaggcttgctaattgtcagttatgtggtctcaggaaagagtgtggatatgtacatt

SEQ ID NO: 362118 - DNA, 75 bp, Artificial Sequence
  Synthetic
gaaagagcaggtgacatcacatgggaaaaagacgcggaagttactggaaatagtcctcggcttgacgtggcacta

SEQ ID NO: 362119 - DNA, 75 bp, Artificial Sequence
  Synthetic
ctcggatggttggagagaacaaagagtgacctaagccatctaatgggaaggagagaggagggggcaaccatagga

SEQ ID NO: 362120 - DNA, 75 bp, Artificial Sequence
  Synthetic
caggcagcagctgcgcgtgctgcccagaagagaacggcagctggcatcatgaagaaccctgttgtggatggaata

SEQ ID NO: 362121 - DNA, 75 bp, Artificial Sequence
  Synthetic
atggccatctgtggcatgaacccaatagccataccttttgctgcaggagcgtggtatgtgtatgtgaagactggg

SEQ ID NO: 362122 - DNA, 75 bp, Artificial Sequence
  Synthetic
ccggagaccctagagaccattatgcttttggggttgctgggaacagtctcgctgggaatctttttcgtcttgatg

SEQ ID NO: 362123 - DNA, 75 bp, Artificial Sequence
  Synthetic
agagtgatgacccgcagattgctgggttcaacacaggttggagtgggagtcatgcaggagggagtcttccacacc

SEQ ID NO: 362124 - DNA, 75 bp, Artificial Sequence
  Synthetic
gcagtacctcccggagagagggccagaaacatccagactctgcctggaatattcaagacaaaggatggggacatc

SEQ ID NO: 362125 - DNA, 75 bp, Artificial Sequence
  Synthetic
ggtggaacaggagagaccctgggagagaaatggaaggcccgcttgaaccagatgtcggccctggagttctactcc

SEQ ID NO: 362126 - DNA, 75 bp, Artificial Sequence
  Synthetic
actccggttgaatgtttcgaaccctcgatgctgaagaagaagcagctaactgtcctggacctgcatccaggagcc

SEQ ID NO: 362127 - DNA, 75 bp, Artificial Sequence
  Synthetic
gtcattgatcttggatgtggcagagggggctggagttactacgccgccaccatccgcaaagttcaagaagtgaaa

SEQ ID NO: 362128 - DNA, 75 bp, Artificial Sequence
  Synthetic
aacgtcacccattctgggacagaaatcgttgatttgatgtgccatgccactttcacttcacgcttactacaaccc

SEQ ID NO: 362129 - DNA, 75 bp, Artificial Sequence
  Synthetic
atcagagtccctaattacaatctcaacatcatggatgaagcccacttcacagacccctcaagtatagctgcaaga

SEQ ID NO: 362130 - DNA, 75 bp, Artificial Sequence
  Synthetic
ggatacatatcaacaagggttgaaatgggcgaggcggctgccatttttatgactgccacaccaccaggaacccgt

SEQ ID NO: 362131 - DNA, 75 bp, Artificial Sequence
  Synthetic
gcctgcctgacaaaggctggaaagcgggtcatacagctcagcaggaagacttttgagacagagttccagaaaaca

SEQ ID NO: 362132 - DNA, 75 bp, Artificial Sequence
  Synthetic
acgcatgctagtgctgctcagaggagaggacgtataggcaggaaccctaacaaacctggagatgagtacatgtat

SEQ ID NO: 362133 - DNA, 75 bp, Artificial Sequence
  Synthetic
ctgaggacagagcaaaggaagacctttgtggaacttatgaagagaggagaccttcccgtttggctagcctatcag

SEQ ID NO: 362134 - DNA, 75 bp, Artificial Sequence
  Synthetic
gtctgttcagatcatgccgccctgaagtcgttcaaagagtttgctgccgggaaaagaggagcggctttgggagta

SEQ ID NO: 362135 - DNA, 75 bp, Artificial Sequence
  Synthetic
atgcgagcagaaactggaagcaggccttacaaggcagcggcagccccactgccggagaccctagagaccatcatg

SEQ ID NO: 362136 - DNA, 75 bp, Artificial Sequence
  Synthetic
ctcttaggtttgctgggaacagtttcgttggggatattctttgtcttgatgcggaacaagggcatcgggaagatg

SEQ ID NO: 362137 - DNA, 75 bp, Artificial Sequence
  Synthetic
gggtttggaatggtaactcttggggccagtgcatggctcatgtggctttcggaaattgaaccagccagaattgca

SEQ ID NO: 362138 - DNA, 75 bp, Artificial Sequence
  Synthetic
gaaagaacaaaaaatgacatagctcatctaatgggaaggagagaagaaggagtaactatgggattctcaatggac

SEQ ID NO: 362139 - DNA, 75 bp, Artificial Sequence
  Synthetic
atcgatttgaggccggcctccgcctgggctatctatgctgcattgacaactctcatcaccccagccgtccaacat

SEQ ID NO: 362140 - DNA, 75 bp, Artificial Sequence
  Synthetic
gcgcgtgctgcccagaagagaacagcagctggcatcatgaagaatcccgttgtggatggaatagtggtaactgac

SEQ ID NO: 362141 - DNA, 75 bp, Artificial Sequence
  Synthetic
attgacacaatgacaattgacccccaagtggagaagaagatgggacaagtgttactcatagcagtagccatctcc

SEQ ID NO: 362142 - DNA, 75 bp, Artificial Sequence
  Synthetic
ggtgatgaagaaaagtacatggactacctatccacccaagttcgctacttgggtgaagaagggtctacacctgga

SEQ ID NO: 362143 - DNA, 75 bp, Artificial Sequence
  Synthetic
gagactctaggagagaagtggaaagctcgcctgaatcagatgtcggccctggagttctactcttacaaaaagtcg

SEQ ID NO: 362144 - DNA, 75 bp, Artificial Sequence
  Synthetic
acccccccaggagaagctgggaaaccaagcctatagtcaggccgagaacgccatggcacggaagaagccatgctg

SEQ ID NO: 362145 - DNA, 75 bp, Artificial Sequence
  Synthetic
ggcatcactgaagtgtgtagagaggaggctcgccgcgccctcaaggatggagtggccacaggaggacatgctgta

SEQ ID NO: 362146 - DNA, 75 bp, Artificial Sequence
  Synthetic
ggatgtggcagagggggttggagctattatgccgctaccatccggaaagtgcaggaggtgaaaggatacacaaag

SEQ ID NO: 362147 - DNA, 75 bp, Artificial Sequence
  Synthetic
tcccggggaagcgcaaagctcagatggctggtggagagaggatacctgcagccccatggaaaggttgttgacctc

SEQ ID NO: 362148 - DNA, 75 bp, Artificial Sequence
  Synthetic
ctggcaggcgcttctcttatttacacagtgacaagaaatgctggcctggtcaagagacgtggaggtggaacggga

SEQ ID NO: 362149 - DNA, 75 bp, Artificial Sequence
  Synthetic
gtagaagagacgcgaacactcagagtgctctctatggtgggggactggcttgaaaaaagaccaggggccttctgc

SEQ ID NO: 362150 - DNA, 75 bp, Artificial Sequence
  Synthetic
ataaaggtgctgtgcccatacaccagcactatgatggagaccatggagcgactgcaacgtaggtatgggggagga

SEQ ID NO: 362151 - DNA, 75 bp, Artificial Sequence
  Synthetic
ttagtcagagtgccattgtctcgcaactccacacatgagatgtattgggtctctggagcaaaaagcaacatcata

SEQ ID NO: 362152 - DNA, 75 bp, Artificial Sequence
  Synthetic
aaaagtgtgtccaccacaagccagctcctcctgggacgcatggatgggcccaggaggccagtgaaatatgaggag

SEQ ID NO: 362153 - DNA, 75 bp, Artificial Sequence
  Synthetic
cgcattgagagaatccgcagtgaacatgcagaaacatggttctttgatgaaaaccacccatacaggacatgggct

SEQ ID NO: 362154 - DNA, 75 bp, Artificial Sequence
  Synthetic
ttcaaagaaaaagtggacaccagggtgccagatccccaagaaggcactcgccagacaatgaacatggtctcgtcc

SEQ ID NO: 362155 - DNA, 75 bp, Artificial Sequence
  Synthetic
tggctgtggaaggagctgggaaaacgcaagcggccacgcgtctgcaccaaagaagagttcatcaacaaggtgcgc

SEQ ID NO: 362156 - DNA, 75 bp, Artificial Sequence
  Synthetic
aggttttgggccctagtggataaggagagagagcatcacctaagaggagagtgtcatagctgtgtgtacaacatg

SEQ ID NO: 362157 - DNA, 75 bp, Artificial Sequence
  Synthetic
atgggaaaaagagagaagaagaaaggagaattcgggaaagcaaaaggcagccgcgccatctggtacatgtggttg

SEQ ID NO: 362158 - DNA, 75 bp, Artificial Sequence
  Synthetic
atgggaaaaagagagaagaagtaaggagaattcgggaaagcaaaaggcagccgcgccatctggtacatgtggttg

SEQ ID NO: 362159 - DNA, 75 bp, Artificial Sequence
  Synthetic
atgggaaaaagagagaagaagcaaggagaattcgggaaagcaaaaggcagccgcgccatctggtacatgtggttg

SEQ ID NO: 362160 - DNA, 75 bp, Artificial Sequence
  Synthetic
atgggaaaaagagagaagaaggaaggagaattcgggaaagcaaaaggcagccgcgccatctggtacatgtggttg

SEQ ID NO: 362161 - DNA, 75 bp, Artificial Sequence
  Synthetic
ggagccaggtttctggagtttgaatcactggggtttctgaatgaagatcactggatgggaagagagaactcagga

SEQ ID NO: 362162 - DNA, 75 bp, Artificial Sequence
  Synthetic
ggtggtgtcgaagggctaggactgcaaagacttggatatattctagaagaaatgaatcgggcaccaggaggaaag

SEQ ID NO: 362163 - DNA, 75 bp, Artificial Sequence
  Synthetic
actttcattaccccagccgtccaacatgcagtgacaacttcatacaacaactactccttaatggcgatggccacg

SEQ ID NO: 362164 - DNA, 75 bp, Artificial Sequence
  Synthetic
actttcattaccccagccgtccaacatgcagtgactacttcatacaacaactactccttaatggcgatggccacg

SEQ ID NO: 362165 - DNA, 75 bp, Artificial Sequence
  Synthetic
actttcattaccccagccgtccaacatgcagtgaccacttcatacaacaactactccttaatggcgatggccacg

SEQ ID NO: 362166 - DNA, 75 bp, Artificial Sequence
  Synthetic
actttcattaccccagccgtccaacatgcagtgacgacttcatacaacaactactccttaatggcgatggccacg

SEQ ID NO: 362167 - DNA, 75 bp, Artificial Sequence
  Synthetic
gttgtcacttatgctctcaacacgtttaccaacttagtggtgcagcttattcggaacatggaggctgaggaagtg

SEQ ID NO: 362168 - DNA, 75 bp, Artificial Sequence
  Synthetic
aggttcctaaacgacatggggaaagttaggaaagacacacaggaatggaaaccctcgactggatggagcaattgg

SEQ ID NO: 362169 - DNA, 75 bp, Artificial Sequence
  Synthetic
cgccaccaagatgaactgattggccgagcccgtgtatcaccaggggcaggatggagcatccgggagactgcctgt

SEQ ID NO: 362170 - DNA, 75 bp, Artificial Sequence
  Synthetic
atttgttcggctgtgccagtcgactgggtaccaaccgggagaaccacctggtcaatccacgggaagggagaatgg

SEQ ID NO: 362171 - DNA, 75 bp, Artificial Sequence
  Synthetic
gacagaggctggggaaatggatgtggactttttggcaaagggagcctggtgacatgcgccaagtttgcatgctcc

SEQ ID NO: 362172 - DNA, 75 bp, Artificial Sequence
  Synthetic
cctgtaacaaagtggactgacattccctacctgggaaaaagggaggacttatggtgtggatcccttatagggcac

SEQ ID NO: 362173 - DNA, 75 bp, Artificial Sequence
  Synthetic
tgacaccacgccatacggccaacaaagagtcttcaaggaaaaagtggacaccagggtgccagatccccaagaagg

SEQ ID NO: 362174 - DNA, 75 bp, Artificial Sequence
  Synthetic
gagtgccagagttgtgtgtacaacatgatgggaaaaagagaaaagaaacaaggggaatttggaaaggccaaggga

SEQ ID NO: 362175 - DNA, 75 bp, Artificial Sequence
  Synthetic
gagtgccagagttgtgtgtacaacatgatgggaaaaagagaaaagaaacaaggggaatttggaaaggccaagggt

SEQ ID NO: 362176 - DNA, 75 bp, Artificial Sequence
  Synthetic
gagtgccagagttgtgtgtacaacatgatgggaaaaagagaaaagaaacaaggggaatttggaaaggccaagggc

SEQ ID NO: 362177 - DNA, 75 bp, Artificial Sequence
  Synthetic
gagtgccagagttgtgtgtacaacatgatgggaaaaagagaaaagaaacaaggggaatttggaaaggccaagggg

SEQ ID NO: 362178 - DNA, 75 bp, Artificial Sequence
  Synthetic
cagccggagaatctggagtatcgaataatgctatcggtgcatggctcccagcacagcgggatgattgttaatgac

SEQ ID NO: 362179 - DNA, 75 bp, Artificial Sequence
  Synthetic
aacagagcggaagtcgaggtcacgcctaattcaccaagagcagaagcaaccttgggaggctttggaagtttagga

SEQ ID NO: 362180 - DNA, 75 bp, Artificial Sequence
  Synthetic
agaccccgcaccacttgggctgagaacatcaaagacacagtcaacatggtgcgcaggatcataggtgatgaagaa

SEQ ID NO: 362181 - DNA, 75 bp, Artificial Sequence
  Synthetic
ctggagatcagctgtggatctccagaagagggactagtggttagaggagaccccccggaaaacgcaaaacagcat

SEQ ID NO: 362182 - DNA, 75 bp, Artificial Sequence
  Synthetic
agttgttgatctgtgtgaatcagactgcgacagttcgagtttgaagcgagagctaacaacagtatcaacaggttt

SEQ ID NO: 362183 - DNA, 75 bp, Artificial Sequence
  Synthetic
cgcagatactagtgtcggaattgttggcctcctgctgaccacagctatggcagcggaggtcactagacgtgggag

SEQ ID NO: 362184 - DNA, 75 bp, Artificial Sequence
  Synthetic
gatggcggtggacatgcaaactctgaccccagttgggaggttgataaccgctaaccccgtaatcactgaaagcac

SEQ ID NO: 362185 - DNA, 75 bp, Artificial Sequence
  Synthetic
ccatggacccatcagaatggttttggcgatactagccttcttgagattcacagcaatcaaaccatcactgggcct

SEQ ID NO: 362186 - DNA, 75 bp, Artificial Sequence
  Synthetic
tcacaaattctcattggaacgttgctgatgtggttgggtctgaacacaaagaatggatctatttcccttatgtgc

SEQ ID NO: 362187 - DNA, 75 bp, Artificial Sequence
  Synthetic
catgttgagaattatcaatgctaggaaggagaggaagagacgtggcgctgacaccagcatcggaatcgtcggcct

SEQ ID NO: 362188 - DNA, 75 bp, Artificial Sequence
  Synthetic
cctgctgaccacagccatggcagccgagatcactagacgtgggagtgcatactacatgtacttggacaggagcga

SEQ ID NO: 362189 - DNA, 75 bp, Artificial Sequence
  Synthetic
atggtgctgcagggagtgcacaatgcccccactgtcgttccgggctaaagatggctgttggtatggaatggagaa

SEQ ID NO: 362190 - DNA, 75 bp, Artificial Sequence
  Synthetic
atggtgctgcagggagtgcacaatgcccccactgtcgttccgggctaaagatggctgttggtatggaatggagat

SEQ ID NO: 362191 - DNA, 75 bp, Artificial Sequence
  Synthetic
atggtgctgcagggagtgcacaatgcccccactgtcgttccgggctaaagatggctgttggtatggaatggagac

SEQ ID NO: 362192 - DNA, 75 bp, Artificial Sequence
  Synthetic
atggtgctgcagggagtgcacaatgcccccactgtcgttccgggctaaagatggctgttggtatggaatggagag

SEQ ID NO: 362193 - DNA, 75 bp, Artificial Sequence
  Synthetic
tgctggtaaggccatttcttttgccaccacattgggggtgaacaaatgccatgtacagatcatggacctcgggca

SEQ ID NO: 362194 - DNA, 75 bp, Artificial Sequence
  Synthetic
ttatccacagccgtctctgctgatgtggggtgctcggtggacttctcaaaaaaagaaacgagatgcggcacaggg

SEQ ID NO: 362195 - DNA, 75 bp, Artificial Sequence
  Synthetic
acatggaggctgaagagggcccatctgatcgagatgaaaacatgtgaatggccaaagtcccacacattgtggaca

SEQ ID NO: 362196 - DNA, 75 bp, Artificial Sequence
  Synthetic
ggcctggttggcaatacgagcgatggttgttccacgcactgataacatcaccttggcaatcttggctgctctgac

SEQ ID NO: 362197 - DNA, 75 bp, Artificial Sequence
  Synthetic
ctggctcctgggaagctcgacgagccaaaaagttatatacttggtcatgatattgttgattgccccggcatacag

SEQ ID NO: 362198 - DNA, 75 bp, Artificial Sequence
  Synthetic
gcgcattggctggagggttcgccaaggcagatatagagatggctgggcccatggccgcggtcggtctgctaattg

SEQ ID NO: 362199 - DNA, 75 bp, Artificial Sequence
  Synthetic
gcgcattggctggagggttcgccaaggcagatatagtgatggctgggcccatggccgcggtcggtctgctaattg

SEQ ID NO: 362200 - DNA, 75 bp, Artificial Sequence
  Synthetic
gcgcattggctggagggttcgccaaggcagatatagcgatggctgggcccatggccgcggtcggtctgctaattg

SEQ ID NO: 362201 - DNA, 75 bp, Artificial Sequence
  Synthetic
gcgcattggctggagggttcgccaaggcagatatagggatggctgggcccatggccgcggtcggtctgctaattg

SEQ ID NO: 362202 - DNA, 75 bp, Artificial Sequence
  Synthetic
tgggaaaaagatgcggaagtcactggaaacagtccccggctcgatgtggcgctagatgagagtggtgatttctcc

SEQ ID NO: 362203 - DNA, 75 bp, Artificial Sequence
  Synthetic
ccccatgagagagatcatactcaaggtggtcctgatgaccatctgtggcatgaacccaatagccataccctttgc

SEQ ID NO: 362204 - DNA, 75 bp, Artificial Sequence
  Synthetic
tgactcgtagactgctaggttcaacacaagttggagtgggagttatgcaagagggggtctttcacactatgtggc

SEQ ID NO: 362205 - DNA, 75 bp, Artificial Sequence
  Synthetic
aacacaaggtgaagcctaccttgacaagcagtcagacactcaatatgtctgcaagagaacattggtggatagagg

SEQ ID NO: 362206 - DNA, 75 bp, Artificial Sequence
  Synthetic
aaatcgtcgacttaatgtgccatgccaccttcacttcacgtctactacagccaatcagagtccccaattataatc

SEQ ID NO: 362207 - DNA, 75 bp, Artificial Sequence
  Synthetic
agactgacgaagaccatgcacactggcttgaagcaagaatgctccttgacaatatttacctccaagatggcctca

SEQ ID NO: 362208 - DNA, 75 bp, Artificial Sequence
  Synthetic
tctgtattacctgaccatgaacaataagcattggttggtgcacaaggagtggtttcatgacatcccattaccttg

SEQ ID NO: 362209 - DNA, 75 bp, Artificial Sequence
  Synthetic
gatagaagatggtgctttgatggcacgaccaacaacaccataatggaagacagtgtgccggcagaggtgtggacc

SEQ ID NO: 362210 - DNA, 75 bp, Artificial Sequence
  Synthetic
caatatttacctccaagatggcctcatagcctcgctctatcgacctgaggccgacaaagtagcagccattgaggg

SEQ ID NO: 362211 - DNA, 75 bp, Artificial Sequence
  Synthetic
gcagaggtgtggaccagacacggagagaaaagagtgctcaaaccgaggtggatggatgccagagtttgttcagat

SEQ ID NO: 362212 - DNA, 75 bp, Artificial Sequence
  Synthetic
gaagggtgtgtcatattccctgtgtaccgcagcgttcacatttaccaaggtcccagctgaaacattgcatggaac

SEQ ID NO: 362213 - DNA, 75 bp, Artificial Sequence
  Synthetic
tctacgcatgggactttggagtcccgctgctaatgataggttgctactcacaattaacacccctgaccctaatag

SEQ ID NO: 362214 - DNA, 75 bp, Artificial Sequence
  Synthetic
gactcttggggccagcgcatggctcatgtggctctcggaaattgagccagccagaattgcatgtgtcctcattgt

SEQ ID NO: 362215 - DNA, 75 bp, Artificial Sequence
  Synthetic
gaccctgaccccagttggaaggctgataaccgccaatcctgtgatcactgaaagtactgagaattcaaagatgat

SEQ ID NO: 362216 - DNA, 75 bp, Artificial Sequence
  Synthetic
aagctgagatggttggtggagcggggatacctgcagccccatggaaaggtcattgatcttggatgtggcagaggg

SEQ ID NO: 362217 - DNA, 75 bp, Artificial Sequence
  Synthetic
gcactatgatggaaaccctggagcgactgcagcgtaggtatgggggaggactggtcagagtgccactctcccgca

SEQ ID NO: 362218 - DNA, 75 bp, Artificial Sequence
  Synthetic
ggctcttggagtgatggaagccctgggaacactgccaggacacatgacagagagattccaggaagccattgacaa

SEQ ID NO: 362219 - DNA, 75 bp, Artificial Sequence
  Synthetic
tggtaaccgcattgaaaggatccgcagtgagcacgcggaaacgtggttctttgacgagaaccacccatataggac

SEQ ID NO: 362220 - DNA, 75 bp, Artificial Sequence
  Synthetic
gaagctatgaggcccccacacaagggtcagcgtcctctctagtaaacggggttgtcaggctcctgtcaaaaccct

SEQ ID NO: 362221 - DNA, 75 bp, Artificial Sequence
  Synthetic
agcagctttcaaatcactgtttggaggaatgtcctggttctcacagatcctcataggcacactgttggtgtggtt

SEQ ID NO: 362222 - DNA, 75 bp, Artificial Sequence
  Synthetic
ctcctttatttccacagaagggacctccgactgatggccaatgccatttgctcatctgtgccagttgactgggtt

SEQ ID NO: 362223 - DNA, 75 bp, Artificial Sequence
  Synthetic
ggaaggggagcttaatgcaatcctagaggagaatggagttcaactgacagttgtagtggggtctgtaaaaaaccc

SEQ ID NO: 362224 - DNA, 75 bp, Artificial Sequence
  Synthetic
gtggattgaggagaacgaccacatggaagacaagaccccagttacgaaatggacagacattccctatttgggaaa

SEQ ID NO: 362225 - DNA, 75 bp, Artificial Sequence
  Synthetic
gatgccgcctgggacggacacagcgaggtgcagctcttggccgtgccccccggagagagagcgaggaacatccag

SEQ ID NO: 362226 - DNA, 75 bp, Artificial Sequence
  Synthetic
acatggactacctatccacccaagttcgctacttgggtgaagaagggtctacacctggagtgctgtaagcaccag

SEQ ID NO: 362227 - DNA, 75 bp, Artificial Sequence
  Synthetic
atcgttccgggcgaaagacggctgctggtatggaatggagataaggcccagaaaggaaccagagagcaacttagt

SEQ ID NO: 362228 - DNA, 75 bp, Artificial Sequence
  Synthetic
gaggtccatggtgacagcaggatcaaccgatcatatggatcacttctctcttggagtgcttgtgattctactcat

SEQ ID NO: 362229 - DNA, 75 bp, Artificial Sequence
  Synthetic
cactggaggagatgtagctcacttggcattggttgcggcatttaaagtcagaccagccttgttggtttccttcat

SEQ ID NO: 362230 - DNA, 75 bp, Artificial Sequence
  Synthetic
cttcagagccaactggacaccccgtgagagcatgctgctagccctggcttcgtgcctcctgcagactgcgatctc

SEQ ID NO: 362231 - DNA, 75 bp, Artificial Sequence
  Synthetic
tgctcttgaaggcgagctgatggtcctcgttaatggatttgctttggcctggttggcaatacgagcaatggccgt

SEQ ID NO: 362232 - DNA, 75 bp, Artificial Sequence
  Synthetic
atggagagcgggcctcgccacttgtggagggttcatgctcctttccctgaaagggaaaggtagtgtgaagaagaa

SEQ ID NO: 362233 - DNA, 75 bp, Artificial Sequence
  Synthetic
cctgccttttgtcatggccttggggttgaccgctgtgaggatagtggaccccatcaatgtggtaggactactgtt

SEQ ID NO: 362234 - DNA, 75 bp, Artificial Sequence
  Synthetic
aggagcgtggtatgtgtatgtaaagactggaaaaaggagtggtgccctctgggacgtgcctgctcccaaagaagt

SEQ ID NO: 362235 - DNA, 75 bp, Artificial Sequence
  Synthetic
gggagtcatgcaagagggagtcttccacaccatgtggcacgtcacaaaaggagccgcattgaggagcggtgaagg

SEQ ID NO: 362236 - DNA, 75 bp, Artificial Sequence
  Synthetic
tggaatattcaagacaaaggatggggacatcggagcagtcgctctagactaccccgcaggaacctcaggatctcc

SEQ ID NO: 362237 - DNA, 75 bp, Artificial Sequence
  Synthetic
tgccataacccagggaaaaagggaggaggaggctccagttgagtgctttgaaccctcgatgctgaggaagaagca

SEQ ID NO: 362238 - DNA, 75 bp, Artificial Sequence
  Synthetic
gctaacagtcttggatctgcatccaggagccgggaaaaccaggagggttcttcctgaaatagtccgtgaagccat

SEQ ID NO: 362239 - DNA, 75 bp, Artificial Sequence
  Synthetic
cccttgggaggtttgaagaggctgccagccggacttctgctgggtcatggacccatcagaatggttttggcgata

SEQ ID NO: 362240 - DNA, 75 bp, Artificial Sequence
  Synthetic
ttagcctttttgagattcacagcaatcaagccatcactgggcctcatcaacagatggggtaccgtggggaaaaaa

SEQ ID NO: 362241 - DNA, 75 bp, Artificial Sequence
  Synthetic
tttcacagatccctcaagcatagctgcacgaggatatatatcaacaagggttgaaatgggcgaggcggctgctat

SEQ ID NO: 362242 - DNA, 75 bp, Artificial Sequence
  Synthetic
actagacgtgggagtgcatactacatgtacttggataggagcgatgcagggaaggccatttctttcgctaccaca

SEQ ID NO: 362243 - DNA, 75 bp, Artificial Sequence
  Synthetic
tccaagtgtgagaaacggaaatgaaatcgcagcctgtctgacaaaggctggaaagcgggtcatacagctcagcag

SEQ ID NO: 362244 - DNA, 75 bp, Artificial Sequence
  Synthetic
ttgggggtgaacaaatgccatgtgcagatcatggacctcgggcacatgtgtgacgccaccatgagctatgaatgc

SEQ ID NO: 362245 - DNA, 75 bp, Artificial Sequence
  Synthetic
ggaacctgtcatcataaaaaaggtgaagcacggcgatctagaagagccgtcacgctcccatctcactccacaagg

SEQ ID NO: 362246 - DNA, 75 bp, Artificial Sequence
  Synthetic
accatccgcaaagttcaagaggtgaaaggatacacaaaaggaggccctggtcatgaagaacccatgttggtgcaa

SEQ ID NO: 362247 - DNA, 75 bp, Artificial Sequence
  Synthetic
aaattgcaaacgcggtcgcagacttggctagaatcaagagaatacacaaagcacctgatcaaggttgaaaattgg

SEQ ID NO: 362248 - DNA, 75 bp, Artificial Sequence
  Synthetic
atattcaggaaccctggttttacgctagtggctgtcgccatcgcctggcttttgggaagctcgacgagccaaaaa

SEQ ID NO: 362249 - DNA, 75 bp, Artificial Sequence
  Synthetic
ttcgtggagggcatgtcaggtgggacctgggttgacgttgtcctggaacatggaggctgcgtcaccgtgatggca

SEQ ID NO: 362250 - DNA, 75 bp, Artificial Sequence
  Synthetic
caggacaagccaacagttgacatagagctggtcacaacaacggttagtaacatggccgaggtgagatcctattgt

SEQ ID NO: 362251 - DNA, 75 bp, Artificial Sequence
  Synthetic
tgatggcactaccaacaacaccataatggaagacagtgtaccagcagaggtgtggaccaagtatggagagaagag

SEQ ID NO: 362252 - DNA, 75 bp, Artificial Sequence
  Synthetic
agtgcttaaaccgaggtggatggatgctagggtctgttcagatcatgcggctctgaagtcgttcaaagaatttgc

SEQ ID NO: 362253 - DNA, 75 bp, Artificial Sequence
  Synthetic
gggagtttggtgacatgtgctaagttcacgtgctccaagaagatgactgggaagagcattcagccggagaacctg

SEQ ID NO: 362254 - DNA, 75 bp, Artificial Sequence
  Synthetic
gagtatcggataatgctatcagtgcatggctcccagcacagtgggatgattgttaatgatgaaaacagagcgaag

SEQ ID NO: 362255 - DNA, 75 bp, Artificial Sequence
  Synthetic
gtcgaggttacgcccaattcaccaagagcagaagcaaccctgggaggctttggaagcttaggacttgattgtgaa

SEQ ID NO: 362256 - DNA, 75 bp, Artificial Sequence
  Synthetic
ccaaggacaggccttgacttttcagatctgtattacctaaccatgaataacaagcattggttggtgcacaaagag

SEQ ID NO: 362257 - DNA, 75 bp, Artificial Sequence
  Synthetic
tggtttcatgacatcccattgccctggcatgctggggcagacactggaactccacattggaacaacaaggaggca

SEQ ID NO: 362258 - DNA, 75 bp, Artificial Sequence
  Synthetic
ttagtggaattcaaggacgcccacgccaagaggcaaaccgtcgtggttttggggagccaggaaggagccgtccac

SEQ ID NO: 362259 - DNA, 75 bp, Artificial Sequence
  Synthetic
tttgataactgcaaatgaactcggatggctggaaaggacaaaaagtgatatagctcatctaatgggaaggaaaga

SEQ ID NO: 362260 - DNA, 75 bp, Artificial Sequence
  Synthetic
acggctcttgctggagctctagaggctgagatggatggtgcaaagggaaggctattctctggccacttgaaatgt

SEQ ID NO: 362261 - DNA, 75 bp, Artificial Sequence
  Synthetic
agaggggacaaccatgggattctcaatggatattgatctgcggccagcctccgcctgggctatttatgccgcatt

SEQ ID NO: 362262 - DNA, 75 bp, Artificial Sequence
  Synthetic
cacacaagctggagtgctgtttggcatgggcaaagggatgccattttatgcatgggactttggagtcccgctgct

SEQ ID NO: 362263 - DNA, 75 bp, Artificial Sequence
  Synthetic
gaaagcactgagaattcaaagatgatgttggagctcgacccaccatttggggattcttacattgtcataggagtt

SEQ ID NO: 362264 - DNA, 75 bp, Artificial Sequence
  Synthetic
ggggataagaaaatcacccatcactggcataggagtggcagcaccattggaaaagcatttgaagccactgtgaga

SEQ ID NO: 362265 - DNA, 75 bp, Artificial Sequence
  Synthetic
ggcgctaagagaatggcagtcctgggggacacagcttgggactttggatcagtcggaggtgtgtttaactcattg

SEQ ID NO: 362266 - DNA, 75 bp, Artificial Sequence
  Synthetic
ctcactgtgcaacatctttagaggaagttatttggcaggggcttcccttatttacacagtgacaagaaatgccgg

SEQ ID NO: 362267 - DNA, 75 bp, Artificial Sequence
  Synthetic
acgagatgtggcacgggggtgttcgtctacaatgacgttgaagcctggagggaccggtacaagtaccatcctgac

SEQ ID NO: 362268 - DNA, 75 bp, Artificial Sequence
  Synthetic
tcccctcgtagactggcagcagccgttaagcaagcttgggaagaggggatttgtgggatctcctctgtttctaga

SEQ ID NO: 362269 - DNA, 75 bp, Artificial Sequence
  Synthetic
atggaaaacataatgtggaaatcagtggaaggagagctcaatgcaatcctagaggagaatggagtccaactgaca

SEQ ID NO: 362270 - DNA, 75 bp, Artificial Sequence
  Synthetic
gttgttgtgggatctgtaaaaaaccccatgtggagaggcccacaaagattgccagtgcctgtgaatgagctgccc

SEQ ID NO: 362271 - DNA, 75 bp, Artificial Sequence
  Synthetic
gacacattgaaggaatgtccgctcaagcacagagcatggaacagcttcctcgtggaggatcacgggtttggggtc

SEQ ID NO: 362272 - DNA, 75 bp, Artificial Sequence
  Synthetic
ttccacaccagtgtttggcttaaggttagagaagattactcactggagtgtgacccagccgtcataggaacagct

SEQ ID NO: 362273 - DNA, 75 bp, Artificial Sequence
  Synthetic
gttaagggaaaggaggccgcgcacagtgatctaggctattggattgaaagtgaaaagaatgacacatggaggctg

SEQ ID NO: 362274 - DNA, 75 bp, Artificial Sequence
  Synthetic
ctggcttgaaaaaagaccaggggccttctgcataaaggtgctgtgcccatacaccagcacaatgatggagaccat

SEQ ID NO: 362275 - DNA, 75 bp, Artificial Sequence
  Synthetic
acagtcaacatggtgcgcaggatcataggtgatgaagaaaagtacatggactacctatccacccaagttcgctac

SEQ ID NO: 362276 - DNA, 75 bp, Artificial Sequence
  Synthetic
ttgggtctctggagccaaaagtaacatcataaagagtgtgtccaccacaagtcagctcctcttgggacgcatgga

SEQ ID NO: 362277 - DNA, 75 bp, Artificial Sequence
  Synthetic
gcaggatcataggtgatgaagaaaagtacatggactacctatccacccaagttcgctacttgggcgaagaagggt

SEQ ID NO: 362278 - DNA, 75 bp, Artificial Sequence
  Synthetic
caagtgaaagggccatggcatagtgaggagcttgaaatccgatttgaggaatgtccaggtaccaaggttcatgtg

SEQ ID NO: 362279 - DNA, 75 bp, Artificial Sequence
  Synthetic
ggaacctgtcatcacaaaaaaggtgaggcacggccctcaagaagagctgtcacgcttccttcccattccacaaga

SEQ ID NO: 362280 - DNA, 75 bp, Artificial Sequence
  Synthetic
cttggagtgcttgtgattctactcatggtgcaggaagggttgaagaagagaatgaccacaaagatcatcatgagc

SEQ ID NO: 362281 - DNA, 75 bp, Artificial Sequence
  Synthetic
aagttacagacacggtcacaaacctggcttgaatcacgggagtacacgaagcacctgatcaaagttgagaactgg

SEQ ID NO: 362282 - DNA, 75 bp, Artificial Sequence
  Synthetic
atactccggaatccagggttcacagttgctgctctagcaatggcctggctcttgggaaattccacgagccagcga

SEQ ID NO: 362283 - DNA, 75 bp, Artificial Sequence
  Synthetic
agaccagccttgctggtctcatttatcttcagagccaactggacacctcgtgagagcatgctgctagccttggct

SEQ ID NO: 362284 - DNA, 75 bp, Artificial Sequence
  Synthetic
tcgtgtcttctgcaaactgcgatctccgctcttgaaggcgacttgatggtcctcgttaatggatttgctttggcc

SEQ ID NO: 362285 - DNA, 75 bp, Artificial Sequence
  Synthetic
gagtacagaattatgctgtcagtgcacggctcccaacacagcgggatgattgtgaatgacataggacatgagacc

SEQ ID NO: 362286 - DNA, 75 bp, Artificial Sequence
  Synthetic
ctagcccgaggcacactgctcgtggcatggagagcgggcctcgccacttgtggagggttcatgctcctctccctg

SEQ ID NO: 362287 - DNA, 75 bp, Artificial Sequence
  Synthetic
ttgggactcgattgtgagccaaggaccggtttagatttctccgacctgtactatttaaccatgaacaacaagcat

SEQ ID NO: 362288 - DNA, 75 bp, Artificial Sequence
  Synthetic
cccattaatgtggtgggactactgttactcacaaggagtgggaagcggagctggccccctagtgaagtgctcact

SEQ ID NO: 362289 - DNA, 75 bp, Artificial Sequence
  Synthetic
tggaacaacaaagaggcattggttgagttcaaggatgcccacgccaaaagacagactgttgtcgtgttgggaagt

SEQ ID NO: 362290 - DNA, 75 bp, Artificial Sequence
  Synthetic
gtgggcctgctaattgtcagttatgtggtctcgggaaagagtgtagatatgtacattgaaagagcaggtgacatc

SEQ ID NO: 362291 - DNA, 75 bp, Artificial Sequence
  Synthetic
tcaggtcatttgaagtgccggataaagatggacaagcttaggttgaagggtgtctcatactcattgtgcactgcc

SEQ ID NO: 362292 - DNA, 75 bp, Artificial Sequence
  Synthetic
gatgaaaacagagcaaaagtggaggtcacaccaaactcaccaagagctgaagcgaccctagggggcttcgggagt

SEQ ID NO: 362293 - DNA, 75 bp, Artificial Sequence
  Synthetic
gatggaccttgcaaggtgccagcccaaatggcagtggatatgcagactcttaccccagtgggaaggttgataacg

SEQ ID NO: 362294 - DNA, 75 bp, Artificial Sequence
  Synthetic
tgggacgtgcctgctccgaaagaagtgaaaaaaggagagaccacagatggagtgtacagagtgatgactcgcaga

SEQ ID NO: 362295 - DNA, 75 bp, Artificial Sequence
  Synthetic
gtaaaagaacaagcgtttgttcattttatctttttaagtttttagtatggaaaaagatggaaagtcgtcaacgtg

SEQ ID NO: 362296 - DNA, 75 bp, Artificial Sequence
  Synthetic
gtcctccttctcaaccgccctctctgaaatccagaaagaacgggtaccgggcctggaggagaaaacatccattga

SEQ ID NO: 362297 - DNA, 75 bp, Artificial Sequence
  Synthetic
ctttgaggttgatggaaagagatactctcttgtatcctcgcgtaagccaacagaccgagaagtcgagctcaagtc

SEQ ID NO: 362298 - DNA, 75 bp, Artificial Sequence
  Synthetic
actgattccttcagcaatactaactgaacagttattgtccaacgaacatatcggtaagtatttcgaaagaattag

SEQ ID NO: 362299 - DNA, 75 bp, Artificial Sequence
  Synthetic
aaaagctttaattgttaaaaacacccaagcagacttagttgaactcttgaactcattcactacagtgctgactaa

SEQ ID NO: 362300 - DNA, 75 bp, Artificial Sequence
  Synthetic
tattcaccaggtttcattgtacattgaacaccatccggacacaactgcggtagctaaaagttttgaaaactataa

SEQ ID NO: 362301 - DNA, 75 bp, Artificial Sequence
  Synthetic
actaaagaaagatttatcaaagtggaagctagatatgttaaactctttaagtactgtagatggtagggtccaaat

SEQ ID NO: 362302 - DNA, 75 bp, Artificial Sequence
  Synthetic
tcatgtcaatgaaatcttagccatgtttcatggtgtgaaaaatgccgctcaaaaggatgcacagatgaaagaaga

SEQ ID NO: 362303 - DNA, 75 bp, Artificial Sequence
  Synthetic
aaaagcacgtaagttaatgaaacagcaggttgagcttgctcgacaagagtttgaagaaagaattaaacatgttag

SEQ ID NO: 362304 - DNA, 75 bp, Artificial Sequence
  Synthetic
accttttcaaggacttatgttattaactggttctttcaaagaacagtctgatcgtgttcatgaaatggctaggca

SEQ ID NO: 362305 - DNA, 75 bp, Artificial Sequence
  Synthetic
agaatggatgagccttcctgacactgagaaatcttcagattacgatgcttgggcacaagcatggtgggcaacacg

SEQ ID NO: 362306 - DNA, 75 bp, Artificial Sequence
  Synthetic
taaggacggggagatatttgcagttctcgaatcaacagtgatgacagaggaattcttggagttcttttctcagca

SEQ ID NO: 362307 - DNA, 75 bp, Artificial Sequence
  Synthetic
ctggctttttcgaggctgaccgccttacatggtcacgacgctttaagcaatcagtgtctagatatggttatggtt

SEQ ID NO: 362308 - DNA, 75 bp, Artificial Sequence
  Synthetic
ttaataaagaaaaaaaaatagatacaaaattcaaaaacttaaaaaaaataaataatatacaaaaacatcctcctc

SEQ ID NO: 362309 - DNA, 75 bp, Artificial Sequence
  Synthetic
tagttggtagaggtccgtgccaacgcaatcttttctttgaaatactctaagatccatgggtggtagtgaagttcg

SEQ ID NO: 362310 - DNA, 75 bp, Artificial Sequence
  Synthetic
tgccatagatttgtacaaaaattatggcagatttggcggttcacgagtggattccattttatacatgaagaattt

SEQ ID NO: 362311 - DNA, 75 bp, Artificial Sequence
  Synthetic
tgataaaaagtatcctactcttgatttagactggaagtcaaataaagagtggtgcttcgaaatttttggaaaagt

SEQ ID NO: 362312 - DNA, 75 bp, Artificial Sequence
  Synthetic
caatcatatcaagttgtttgacatggagtactgcttggatgttccagatgtcccttctgacacttcgccaggtat

SEQ ID NO: 362313 - DNA, 75 bp, Artificial Sequence
  Synthetic
tacgtacaaaagacttggtttcataaagaaagctgatgctttacctgtttgcttatcacatctaagagatgtgct

SEQ ID NO: 362314 - DNA, 75 bp, Artificial Sequence
  Synthetic
taagaaaattgaaaaacatgagttacaaacactaccggaaattgcgtggtgtattgcaggtaggccaaagtttac

SEQ ID NO: 362315 - DNA, 75 bp, Artificial Sequence
  Synthetic
tgaattaaacaaagcatttcagaaagtttatgatcgacagtccgtaggacggagtatttgggtgtctgacatgga

SEQ ID NO: 362316 - DNA, 75 bp, Artificial Sequence
  Synthetic
ggaggctatattatctagacattttactagatatattgataaaaatattactgggactcccacattccacaagat

SEQ ID NO: 362317 - DNA, 75 bp, Artificial Sequence
  Synthetic
aatgattaatttcgataaagtcaaagatgctaaacacttacaaaactgggtagaacaatatgattatataattga

SEQ ID NO: 362318 - DNA, 75 bp, Artificial Sequence
  Synthetic
agctgactatagtaagtttgacagtagtgttcctgcttgtgttgttagaaaagctttccaaatttttaaggagtt

SEQ ID NO: 362319 - DNA, 75 bp, Artificial Sequence
  Synthetic
atttatttgtttttcgatcatactaccgctactgtttatgattttgatcgaaaatttcttaaatagtaaggtaga

SEQ ID NO: 362320 - DNA, 75 bp, Artificial Sequence
  Synthetic
tctaagtgatgggagactgcttcaaaaattcggaggagtaccatcgggttcaggattcacatccatcattggatc

SEQ ID NO: 362321 - DNA, 75 bp, Artificial Sequence
  Synthetic
gatttgtaactatattatgttggacacctgtttcatgaagatgggactcgataagaatcggtggtcagcaatagt

SEQ ID NO: 362322 - DNA, 75 bp, Artificial Sequence
  Synthetic
atacggtgatgactgtctgataggcattaagaaacctttacacaaacatgaagattcagcttttaaaatccgtaa

SEQ ID NO: 362323 - DNA, 75 bp, Artificial Sequence
  Synthetic
gttaatgttaaagtttatgcagcttctttttgatatcactctcgatcccaaagataccaagttagtgtgtgaaaa

SEQ ID NO: 362324 - DNA, 75 bp, Artificial Sequence
  Synthetic
gtatgttagtgtgataataccggagtatgacgaagacaccactaatggaacttcattattaaaaccgtcaaagat

SEQ ID NO: 362325 - DNA, 75 bp, Artificial Sequence
  Synthetic
cactagaatagaaaaagaacccgacacatttcttttatcaaactctagctcacatcgatggtggtatagctttga

SEQ ID NO: 362326 - DNA, 75 bp, Artificial Sequence
  Synthetic
gaaaacgaagtttcttgggtactctttaacatgcgatggtaggctgatcagaccaactcgcgatgtactagctag

SEQ ID NO: 362327 - DNA, 75 bp, Artificial Sequence
  Synthetic
aatctacaatccagaaaagccggttaagagttgggatgaacatgttacactacttaagatggcttacctagaaaa

SEQ ID NO: 362328 - DNA, 75 bp, Artificial Sequence
  Synthetic
ttatgaaaatgcacatacacgtaatagaatttatcattatcttatggatgcatggtgggtaatccatcacggttg

SEQ ID NO: 362329 - DNA, 75 bp, Artificial Sequence
  Synthetic
tccgcaacgagcactacctgatgtagactacactgtatcgaaaggaaggtgtttccatagatatacaaatcatta

SEQ ID NO: 362330 - DNA, 75 bp, Artificial Sequence
  Synthetic
tccgcaacgagcactacctgatgtagactacactgtatcgaaaggaaggtgtttccatagatatacaattcatta

SEQ ID NO: 362331 - DNA, 75 bp, Artificial Sequence
  Synthetic
tccgcaacgagcactacctgatgtagactacactgtatcgaaaggaaggtgtttccatagatatacaactcatta

SEQ ID NO: 362332 - DNA, 75 bp, Artificial Sequence
  Synthetic
tccgcaacgagcactacctgatgtagactacactgtatcgaaaggaaggtgtttccatagatatacaagtcatta

SEQ ID NO: 362333 - DNA, 75 bp, Artificial Sequence
  Synthetic
tgttcatttaagatgggaaccttcacttcaaggctttcataacttttttgataattttgactttaatatgttgaa

SEQ ID NO: 362334 - DNA, 75 bp, Artificial Sequence
  Synthetic
acttcatatccaggtaagtttgaacgaattttattactcacgtgtgaaacgaggaagattaagctcttcactgtt

SEQ ID NO: 362335 - DNA, 75 bp, Artificial Sequence
  Synthetic
tgacatgagtatgagaccagctcattaccacagtgtagcatacttgtgcaagaaacttggtatggttactcctca

SEQ ID NO: 362336 - DNA, 75 bp, Artificial Sequence
  Synthetic
agtaaccacagcgtacacatatagtaaagaatggtttcattcccacccagggatgcttaagaacataaagaaagt

SEQ ID NO: 362337 - DNA, 75 bp, Artificial Sequence
  Synthetic
tttaaggaaaagaatgcaattctatcatcaagatggtggacgaaaaaaatttaaaaaaatgttacaaaacttcaa

SEQ ID NO: 362338 - DNA, 75 bp, Artificial Sequence
  Synthetic
aaaaataagacagggagttttcctttttatatcctaacaaaccatttaccatacataatccagatatcattgcgg

SEQ ID NO: 362339 - DNA, 75 bp, Artificial Sequence
  Synthetic
cgttgtaattacgaccctatgaaagttaattaatctgaaacgaaaacacctccgcttaaaaggtgggcattatat

SEQ ID NO: 362340 - DNA, 75 bp, Artificial Sequence
  Synthetic
attacgaccctatgaaagttaattaatctgaaacgaaaacacctccgcttaaaaggtgggcattatatgccttgg

SEQ ID NO: 362341 - DNA, 140 bp, Artificial Sequence
  Synthetic
aggccctggctgctgatatgacacacgtagcctaccagtttcttactgctctactctgcaaagcaagagattaataacccatcatggatcctgtgtacgtggacatagacgctgacagcggaccttttgggacagcggtg

SEQ ID NO: 362342 - DNA, 140 bp, Artificial Sequence
  Synthetic
caccgctgtcccaaaaggtccgctgtcagcgtctatgtccacgtacacaggatccatgatgggttattaatctcttgctttgcagagtagagcagtaagaaactggtaggctacgtgtgtcatatcagcagccagggcct

SEQ ID NO: 362343 - DNA, 140 bp, Artificial Sequence
  Synthetic
atacgccatgctgggtctccaccagtggaaagaaagaaaactgccaagaaatctccaccgacgtgatgcgacagaggaacctggagatatctgcacgcacggtcgactcactgctcttgacgtacttgggagtcggccat

SEQ ID NO: 362344 - DNA, 140 bp, Artificial Sequence
  Synthetic
atggccgactcccaagtacgtcaagagcagtgagtcgaccgtgcgtgcagatatctccaggttcctctgtcgcatcacgtcggtggagatttcttggcagttttctttctttccactggtggagacccagcatggcgtat

SEQ ID NO: 362345 - DNA, 140 bp, Artificial Sequence
  Synthetic
aggccctggctgctgatatgcagcagcttggcaggcagaaaaggatacagcaccacggaaggcgcactgtactcatatctagaagggacccgttttcaccagacggcagtggatatggcggaccttttgggacagcggtg

SEQ ID NO: 362346 - DNA, 140 bp, Artificial Sequence
  Synthetic
caccgctgtcccaaaaggtccgccatatccactgccgtctggtgaaaacgggtcccttctagatatgagtacagtgcgccttccgtggtgctgtatccttttctgcctgccaagctgctgcatatcagcagccagggcct

SEQ ID NO: 362347 - DNA, 140 bp, Artificial Sequence
  Synthetic
aggccctggctgctgatatgcctatatgccctgggggaaagtattgaatcgatcaggcagaaatgcccggtggatgatgcagatgcatcatctcccccaaaaactgtcccgtgcctttgcgaccttttgggacagcggtg

SEQ ID NO: 362348 - DNA, 140 bp, Artificial Sequence
  Synthetic
caccgctgtcccaaaaggtcgcaaaggcacgggacagtttttgggggagatgatgcatctgcatcatccaccgggcatttctgcctgatcgattcaatactttcccccagggcatataggcatatcagcagccagggcct

SEQ ID NO: 362349 - DNA, 140 bp, Artificial Sequence
  Synthetic
aggccctggctgctgatatgtgcgagaaagctagcatctgccgcaggaaaagtcctggacagaaacatctctggaaagatcggggacttacaagcagtaatggccgtgccagacaaggaggaccttttgggacagcggtg

SEQ ID NO: 362350 - DNA, 140 bp, Artificial Sequence
  Synthetic
caccgctgtcccaaaaggtcctccttgtctggcacggccattactgcttgtaagtccccgatctttccagagatgtttctgtccaggacttttcctgcggcagatgctagctttctcgcacatatcagcagccagggcct

SEQ ID NO: 362351 - DNA, 140 bp, Artificial Sequence; identical to SEQ ID NO: 7709
  Synthetic

SEQ ID NO: 362352 - DNA, 140 bp, Artificial Sequence; identical to SEQ ID NO: 7710
  Synthetic

SEQ ID NO: 362353 - DNA, 140 bp, Artificial Sequence; identical to SEQ ID NO: 10507
  Synthetic

SEQ ID NO: 362354 - DNA, 140 bp, Artificial Sequence; identical to SEQ ID NO: 10508
  Synthetic

SEQ ID NO: 362355 - DNA, 140 bp, Artificial Sequence
  Synthetic
atacgccatgctgggtctccgcgttgacggcgagatactgcccgtcccgtcagacctggatgctgacgccccagccctagaaccagccctagacgacggggcgacacacacgttgccatccgtacttgggagtcggccat

SEQ ID NO: 362356 - DNA, 140 bp, Artificial Sequence
  Synthetic
atggccgactcccaagtacggatggcaacgtgtgtgtcgccccgtcgtctagggctggttctagggctggggcgtcagcatccaggtctgacgggacgggcagtatctcgccgtcaacgcggagacccagcatggcgtat

SEQ ID NO: 362357 - DNA, 140 bp, Artificial Sequence; identical to SEQ ID NO: 5705
  Synthetic

SEQ ID NO: 362358 - DNA, 140 bp, Artificial Sequence; identical to SEQ ID NO: 5706
  Synthetic

SEQ ID NO: 362359 - DNA, 140 bp, Artificial Sequence
  Synthetic
atacgccatgctgggtctccacaaccccgttcatgtacaatgccatggcgggtgcctacccctcatactcgacaaactgggcagatgagcaggtactgaaggctaagaacataggattatcgtacttgggagtcggccat

SEQ ID NO: 362360 - DNA, 140 bp, Artificial Sequence
  Synthetic
atggccgactcccaagtacgataatcctatgttcttagccttcagtacctgctcatctgcccagtttgtcgagtatgaggggtaggcacccgccatggcattgtacatgaacggggttgtggagacccagcatggcgtat

SEQ ID NO: 362361 - DNA, 140 bp, Artificial Sequence; identical to SEQ ID NO: 10509
  Synthetic

SEQ ID NO: 362362 - DNA, 140 bp, Artificial Sequence; identical to SEQ ID NO: 10510
  Synthetic

SEQ ID NO: 362363 - DNA, 140 bp, Artificial Sequence
  Synthetic
aggccctggctgctgatatggacgagagagaagggaatataacacccatggctagcgtccgattctttagggcagagctgtgtccggtcgtacaagaaacagcggagacgcgtgacacaggaccttttgggacagcggtg

SEQ ID NO: 362364 - DNA, 140 bp, Artificial Sequence
  Synthetic
caccgctgtcccaaaaggtcctgtgtcacgcgtctccgctgtttcttgtacgaccggacacagctctgccctaaagaatcggacgctagccatgggtgttatattcccttctctctcgtccatatcagcagccagggcct

SEQ ID NO: 362365 - DNA, 140 bp, Artificial Sequence
  Synthetic
aggccctggctgctgatatgcgtagcacaccgaactcttccataattctccgaacccacagggacgtaggagatgttcaaagtgactataaaaccctgaacagtaataaaacataaaattgaccttttgggacagcggtg

SEQ ID NO: 362366 - DNA, 140 bp, Artificial Sequence
  Synthetic
caccgctgtcccaaaaggtcaattttatgttttattactgttcagggttttatagtcactttgaacatctcctacgtccctgtgggttcggagaattatggaagagttcggtgtgctacgcatatcagcagccagggcct

SEQ ID NO: 362367 - DNA, 140 bp, Artificial Sequence
  Synthetic
atacgccatgctgggtctccgagtgggaggtggagcatgcatcaataatggcgggcatctgcagtcaccaaatgaccttcgatacattccaaaataaagccaacgtttgttgggctaagacgtacttgggagtcggccat

SEQ ID NO: 362368 - DNA, 140 bp, Artificial Sequence
  Synthetic
atggccgactcccaagtacgtcttagcccaacaaacgttggctttattttggaatgtatcgaaggtcatttggtgactgcagatgcccgccattattgatgcatgctccacctcccactcggagacccagcatggcgtat

SEQ ID NO: 362369 - DNA, 140 bp, Artificial Sequence
  Synthetic
atacgccatgctgggtctcctgatgtgcaagactaccgacacggttgacggcgaaagagtgtcattctcggtgtgcacatacgtgccggcgaccatttgtgatcaaatgaccggcatcctcgtacttgggagtcggccat

SEQ ID NO: 362370 - DNA, 140 bp, Artificial Sequence
  Synthetic
atggccgactcccaagtacgaggatgccggtcatttgatcacaaatggtcgccggcacgtatgtgcacaccgagaatgacactctttcgccgtcaaccgtgtcggtagtcttgcacatcaggagacccagcatggcgtat

SEQ ID NO: 362371 - DNA, 140 bp, Artificial Sequence
  Synthetic
aggccctggctgctgatatggagacgtaggtactaagcttcttaaaagcagccgaactcactttgagatgtaggcatagcataccgaactcttccacaattctccgtacccatagggacggaccttttgggacagcggtg

SEQ ID NO: 362372 - DNA, 140 bp, Artificial Sequence
  Synthetic
caccgctgtcccaaaaggtccgtccctatgggtacggagaattgtggaagagttcggtatgctatgcctacatctcaaagtgagttcggctgcttttaagaagcttagtacctacgtctccatatcagcagccagggcct

SEQ ID NO: 362373 - DNA, 140 bp, Artificial Sequence; identical to SEQ ID NO: 6477
  Synthetic

SEQ ID NO: 362374 - DNA, 140 bp, Artificial Sequence; identical to SEQ ID NO: 6478
  Synthetic

SEQ ID NO: 362375 - DNA, 140 bp, Artificial Sequence
  Synthetic
aggccctggctgctgatatggaacactgacctgctgctgtctatgggcattcaagaagcagaaaacacacacggtctacaagaggcctgatacccagtcaattcagaaggttcaggccgagaccttttgggacagcggtg

SEQ ID NO: 362376 - DNA, 140 bp, Artificial Sequence
  Synthetic
caccgctgtcccaaaaggtctcggcctgaaccttctgaattgactgggtatcaggcctcttgtagaccgtgtgtgttttctgcttcttgaatgcccatagacagcagcaggtcagtgttccatatcagcagccagggcct

SEQ ID NO: 362377 - DNA, 140 bp, Artificial Sequence
  Synthetic
aggccctggctgctgatatggtttgacagctttgtggtaccgagtctgtggtcgtccgggttgtcaatccctttgaggactagaatcaaatggttgttaagcaaggtgccaaaaaccgacgaccttttgggacagcggtg

SEQ ID NO: 362378 - DNA, 140 bp, Artificial Sequence
  Synthetic
caccgctgtcccaaaaggtcgtcggtttttggcaccttgcttaacaaccatttgattctagtcctcaaagggattgacaacccggacgaccacagactcggtaccacaaagctgtcaaaccatatcagcagccagggcct

SEQ ID NO: 362379 - DNA, 140 bp, Artificial Sequence
  Synthetic
aggccctggctgctgatatgacgtaatgaacaaccagctgaatgctgcttttgttggtcaggccacccgagcagggtgtgcaccgtcgtaccgggttaaacgcatggacatcgcaagaacgaccttttgggacagcggtg

SEQ ID NO: 362380 - DNA, 140 bp, Artificial Sequence
  Synthetic
caccgctgtcccaaaaggtcgttcttgcgatgtccatgcgtttaacccggtacgacggtgcacaccctgctcgggtggcctgaccaacaaaagcagcattcagctggttgttcattacgtcatatcagcagccagggcct

SEQ ID NO: 362381 - DNA, 140 bp, Artificial Sequence
  Synthetic
aggccctggctgctgatatgaggttcacagtagacatgaaaagggacgtgaaggtgactcctggtacaaagcacacagaggaaagacctaaggtgcaggttatacaggcggctgaaccctgaccttttgggacagcggtg

SEQ ID NO: 362382 - DNA, 140 bp, Artificial Sequence
  Synthetic
caccgctgtcccaaaaggtcagggttcagccgcctgtataacctgcaccttaggtctttcctctgtgtgctttgtaccaggagtcaccttcacgtcccttttcatgtctactgtgaacctcatatcagcagccagggcct

SEQ ID NO: 362383 - DNA, 140 bp, Artificial Sequence
  Synthetic
atacgccatgctgggtctccgaaccgaatcatccgccgatctccttcggagcatcaagcgagacgttccccattacatttggggacttcaacgaaggagaaatcgaaagcttgtcttctgcgtacttgggagtcggccat

SEQ ID NO: 362384 - DNA, 140 bp, Artificial Sequence
  Synthetic
atggccgactcccaagtacgcagaagacaagctttcgatttctccttcgttgaagtccccaaatgtaatggggaacgtctcgcttgatgctccgaaggagatcggcggatgattcggttcggagacccagcatggcgtat

SEQ ID NO: 362385 - DNA, 140 bp, Artificial Sequence
  Synthetic
aggccctggctgctgatatgagagagggcggggctatttgtaagaacatcagcaccgtgcacgattactggaacaatgggacacttcatcctggcccgatgcccgaaaggggaaactctggaccttttgggacagcggtg

SEQ ID NO: 362386 - DNA, 140 bp, Artificial Sequence
  Synthetic
caccgctgtcccaaaaggtccagagtttcccctttcgggcatcgggccaggatgaagtgtcccattgttccagtaatcgtgcacggtgctgatgttcttacaaatagccccgccctctctcatatcagcagccagggcct

SEQ ID NO: 362387 - DNA, 140 bp, Artificial Sequence
  Synthetic
aggccctggctgctgatatgtagaaacggacatagcctcctttgataagagccaagatgattcacttgcgcttactgctttgatgctgttagaagatttaggggtggatcactccctgctgaccttttgggacagcggtg

SEQ ID NO: 362388 - DNA, 140 bp, Artificial Sequence
  Synthetic
caccgctgtcccaaaaggtcagcagggagtgatccacccctaaatcttctaacagcatcaaagcagtaagcgcaagtgaatcatcttggctcttatcaaaggaggctatgtccgtttctacatatcagcagccagggcct

SEQ ID NO: 362389 - DNA, 140 bp, Artificial Sequence
  Synthetic
aggccctggctgctgatatgagccctgaacaccgacgaagagtcgtatgagctggtgagggcagagaggacagaacacgagtacgtctacgacgtggatcagagaagatgctgtaagaaggaccttttgggacagcggtg

SEQ ID NO: 362390 - DNA, 140 bp, Artificial Sequence
  Synthetic
caccgctgtcccaaaaggtccttcttacagcatcttctctgatccacgtcgtagacgtactcgtgttctgtcctctctgccctcaccagctcatacgactcttcgtcggtgttcagggctcatatcagcagccagggcct

SEQ ID NO: 362391 - DNA, 140 bp, Artificial Sequence
  Synthetic
atacgccatgctgggtctcccagcttgcagagtggcagacccgctaaaaaggctatttaaactgggcaaaccgctagcggcaggtgacgaacaagatgaagatagaagacgagcgctggccgtacttgggagtcggccat

SEQ ID NO: 362392 - DNA, 140 bp, Artificial Sequence
  Synthetic
atggccgactcccaagtacggccagcgctcgtcttctatcttcatcttgttcgtcacctgccgctagcggtttgcccagtttaaatagcctttttagcgggtctgccactctgcaagctgggagacccagcatggcgtat

SEQ ID NO: 362393 - DNA, 140 bp, Artificial Sequence
  Synthetic
aggccctggctgctgatatgccagtcgacgtgttgtacgtagacgaggcgtttgcgtgccactctggaacgctacttgctttgatcgccttggtgagaccaaggcagaaagttgtactttgaccttttgggacagcggtg

SEQ ID NO: 362394 - DNA, 140 bp, Artificial Sequence
  Synthetic
caccgctgtcccaaaaggtcaaagtacaactttctgccttggtctcaccaaggcgatcaaagcaagtagcgttccagagtggcacgcaaacgcctcgtctacgtacaacacgtcgactggcatatcagcagccagggcct

SEQ ID NO: 362395 - DNA, 140 bp, Artificial Sequence; identical to SEQ ID NO: 5939
  Synthetic

SEQ ID NO: 362396 - DNA, 140 bp, Artificial Sequence; identical to SEQ ID NO: 5940
  Synthetic

SEQ ID NO: 362397 - DNA, 140 bp, Artificial Sequence; identical to SEQ ID NO: 10519
  Synthetic

SEQ ID NO: 362398 - DNA, 140 bp, Artificial Sequence; identical to SEQ ID NO: 10520
  Synthetic

SEQ ID NO: 362399 - DNA, 140 bp, Artificial Sequence
  Synthetic
aggccctggctgctgatatgtgacaatgcgcgcggtaccccaacagaagccacgcaggaatcggaagaataagaagcaaaagcaaaagcaacaggcgccacaaaacaacacaaaccaaaagaccttttgggacagcggtg

SEQ ID NO: 362400 - DNA, 140 bp, Artificial Sequence
  Synthetic
caccgctgtcccaaaaggtcttttggtttgtgttgttttgtggcgcctgttgcttttgcttttgcttcttattcttccgattcctgcgtggcttctgttggggtaccgcgcgcattgtcacatatcagcagccagggcct

SEQ ID NO: 362401 - DNA, 140 bp, Artificial Sequence
  Synthetic
aggccctggctgctgatatggcaaaatgcgcactacgaatgagtacaacaagccgattgtagtggacactacaggctcaacaaaacctgaccctggagacctcgtgttaacgtgcttcaggaccttttgggacagcggtg

SEQ ID NO: 362402 - DNA, 140 bp, Artificial Sequence
  Synthetic
caccgctgtcccaaaaggtcctgaagcacgttaacacgaggtctccagggtcaggttttgttgagcctgtagtgtccactacaatcggcttgttgtactcattcgtagtgcgcattttgccatatcagcagccagggcct

SEQ ID NO: 362403 - DNA, 140 bp, Artificial Sequence
  Synthetic
aggccctggctgctgatatgtagtaacaaaatataaaaatcaacaaaaatcataaaatagaaaaccagaaatagaagtaggtaagaaggtatatgtgtcccctaagagacacaccatatagaccttttgggacagcggtg

SEQ ID NO: 362404 - DNA, 140 bp, Artificial Sequence
  Synthetic
caccgctgtcccaaaaggtctatatggtgtgtctcttaggggacacatataccttcttacctacttctatttctggttttctattttatgatttttgttgatttttatattttgttactacatatcagcagccagggcct

SEQ ID NO: 362405 - DNA, 140 bp, Artificial Sequence
  Synthetic
aggccctggctgctgatatgcaaaaagttaatgaaaacccgctctatgcatcaacgtcagagcacgtcaacgtactcctaacgcgtacggaaggtaaactggtatggaagacactttccggaccttttgggacagcggtg

SEQ ID NO: 362406 - DNA, 140 bp, Artificial Sequence
  Synthetic
caccgctgtcccaaaaggtccggaaagtgtcttccataccagtttaccttccgtacgcgttaggagtacgttgacgtgctctgacgttgatgcatagagcgggttttcattaactttttgcatatcagcagccagggcct

SEQ ID NO: 362407 - DNA, 140 bp, Artificial Sequence; identical to SEQ ID NO: 8707
  Synthetic

SEQ ID NO: 362408 - DNA, 140 bp, Artificial Sequence; identical to SEQ ID NO: 8708
  Synthetic

SEQ ID NO: 362409 - DNA, 140 bp, Artificial Sequence
  Synthetic
aggccctggctgctgatatgatgtgcctgttggcaaacaccacgttcccctgctcccagcccccttgcacaccctgctgctacgaaaaggaaccggaggaaaccctacgcatgcttgagggaccttttgggacagcggtg

SEQ ID NO: 362410 - DNA, 140 bp, Artificial Sequence
  Synthetic
caccgctgtcccaaaaggtccctcaagcatgcgtagggtttcctccggttccttttcgtagcagcagggtgtgcaagggggctgggagcaggggaacgtggtgtttgccaacaggcacatcatatcagcagccagggcct

SEQ ID NO: 362411 - DNA, 140 bp, Artificial Sequence
  Synthetic
atacgccatgctgggtctccaccctgctgctacgaaaaggaaccggaggaaaccctacgcatgcttgaggacaacgtcatgagacctgggtactatcagctgctacaagcatccttaacacgtacttgggagtcggccat

SEQ ID NO: 362412 - DNA, 140 bp, Artificial Sequence
  Synthetic
atggccgactcccaagtacgtgttaaggatgcttgtagcagctgatagtacccaggtctcatgacgttgtcctcaagcatgcgtagggtttcctccggttccttttcgtagcagcagggtggagacccagcatggcgtat

SEQ ID NO: 362413 - DNA, 140 bp, Artificial Sequence
  Synthetic
aggccctggctgctgatatgatactcacctgaagtagccctgaatgaaatatgtacgcgcatgtatggggtggatctagacagcgggctattttctaaaccgttggtgtctgtgtattacgaccttttgggacagcggtg

SEQ ID NO: 362414 - DNA, 140 bp, Artificial Sequence
  Synthetic
caccgctgtcccaaaaggtcgtaatacacagacaccaacggtttagaaaatagcccgctgtctagatccaccccatacatgcgcgtacatatttcattcagggctacttcaggtgagtatcatatcagcagccagggcct

SEQ ID NO: 362415 - DNA, 140 bp, Artificial Sequence
  Synthetic
aggccctggctgctgatatgccgaatcatgcaaaacagaatttgcatcagcatacagggctcataccgcatccgcatcagctaagctccgcgtcctttaccaaggaaataacatcactgtgaccttttgggacagcggtg

SEQ ID NO: 362416 - DNA, 140 bp, Artificial Sequence
  Synthetic
caccgctgtcccaaaaggtcacagtgatgttatttccttggtaaaggacgcggagcttagctgatgcggatgcggtatgagccctgtatgctgatgcaaattctgttttgcatgattcggcatatcagcagccagggcct

SEQ ID NO: 362417 - DNA, 140 bp, Artificial Sequence
  Synthetic
atacgccatgctgggtctccccccgaggcagcatccattctagaaagaaagtatccattcacaaaagggaagtggaacatcaacaagcagatctgcgtgactaccaggaggatagaagaccgtacttgggagtcggccat

SEQ ID NO: 362418 - DNA, 140 bp, Artificial Sequence
  Synthetic
atggccgactcccaagtacggtcttctatcctcctggtagtcacgcagatctgcttgttgatgttccacttcccttttgtgaatggatactttctttctagaatggatgctgcctcggggggagacccagcatggcgtat

SEQ ID NO: 362419 - DNA, 140 bp, Artificial Sequence
  Synthetic
atacgccatgctgggtctccccgtagggagagaatgtgcatgaaaattgaaaatgattgcatcttcgaagtcaagcatgaaggcaaagtgatgggctacgcatgcctggtgggggataaacgtacttgggagtcggccat

SEQ ID NO: 362420 - DNA, 140 bp, Artificial Sequence
  Synthetic
atggccgactcccaagtacgtttatcccccaccaggcatgcgtagcccatcactttgccttcatgcttgacttcgaagatgcaatcattttcaattttcatgcacattctctccctacggggagacccagcatggcgtat

SEQ ID NO: 362421 - DNA, 140 bp, Artificial Sequence
  Synthetic
aggccctggctgctgatatgaccaataaaaatcataaaatagaaaaccctaaacagaagtagttcaaagggctataaaacccctgaatagtaacaaaatataaaactaacaaaaatcaaagaccttttgggacagcggtg

SEQ ID NO: 362422 - DNA, 140 bp, Artificial Sequence
  Synthetic
caccgctgtcccaaaaggtctttgatttttgttagttttatattttgttactattcaggggttttatagccctttgaactacttctgtttagggttttctattttatgatttttattggtcatatcagcagccagggcct

SEQ ID NO: 362423 - DNA, 140 bp, Artificial Sequence
  Synthetic
aggccctggctgctgatatgggtggacgggtcggaaagttgccttgaccgggcgacgttcaatccatcaaagcttagaagttatccaaaacagcactcctaccatgcacccacaatcagagaccttttgggacagcggtg

SEQ ID NO: 362424 - DNA, 140 bp, Artificial Sequence
  Synthetic
caccgctgtcccaaaaggtctctgattgtgggtgcatggtaggagtgctgttttggataacttctaagctttgatggattgaacgtcgcccggtcaaggcaactttccgacccgtccacccatatcagcagccagggcct

SEQ ID NO: 362425 - DNA, 140 bp, Artificial Sequence
  Synthetic
aggccctggctgctgatatgtaccaacagtgcgtcgaccacgcaatgaaactgcaaatgctcgggggtgactcattgagactgctcaaaccgggcggctctctattgatcagagcatatggaccttttgggacagcggtg

SEQ ID NO: 362426 - DNA, 140 bp, Artificial Sequence
  Synthetic
caccgctgtcccaaaaggtccatatgctctgatcaatagagagccgcccggtttgagcagtctcaatgagtcacccccgagcatttgcagtttcattgcgtggtcgacgcactgttggtacatatcagcagccagggcct

SEQ ID NO: 362427 - DNA, 140 bp, Artificial Sequence
  Synthetic
atacgccatgctgggtctcctccgctggcaaatgtaacatgcagggtgcctaaagcaaggaaccccaccgtgacgtacgggaaaaaccaagtcatcatgctactgtatcctgaccacccacgtacttgggagtcggccat

SEQ ID NO: 362428 - DNA, 140 bp, Artificial Sequence
  Synthetic
atggccgactcccaagtacgtgggtggtcaggatacagtagcatgatgacttggtttttcccgtacgtcacggtggggttccttgctttaggcaccctgcatgttacatttgccagcggaggagacccagcatggcgtat

SEQ ID NO: 362429 - DNA, 140 bp, Artificial Sequence
  Synthetic
aggccctggctgctgatatgcagagaagatgctgtaagaaggaagaagccgcaggactggtactggtgggcgacttgactaatccgccctaccacgaattcgcatatgaagggctaaaaagaccttttgggacagcggtg

SEQ ID NO: 362430 - DNA, 140 bp, Artificial Sequence
  Synthetic
caccgctgtcccaaaaggtctttttagcccttcatatgcgaattcgtggtagggcggattagtcaagtcgcccaccagtaccagtcctgcggcttcttccttcttacagcatcttctctgcatatcagcagccagggcct

SEQ ID NO: 362431 - DNA, 140 bp, Artificial Sequence
  Synthetic
aggccctggctgctgatatggtaatgaaaccagcacatgtgaagggaactatcgacaatgccgatctggctaaactggccttcaagcggtcatctaaatacgatcttgaatgtgcacagagaccttttgggacagcggtg

SEQ ID NO: 362432 - DNA, 140 bp, Artificial Sequence
  Synthetic
caccgctgtcccaaaaggtctctgtgcacattcaagatcgtatttagatgaccgcttgaaggccagtttagccagatcggcattgtcgatagttcccttcacatgtgctggtttcattaccatatcagcagccagggcct

SEQ ID NO: 362433 - DNA, 140 bp, Artificial Sequence
  Synthetic
aggccctggctgctgatatggtgacggtgtttgcaaggcagtatacaaaaaatggccggagtcctttaagaacagtgcaacaccagtgggaaccgcaaaaacagttatgtgcggtacgtagaccttttgggacagcggtg

SEQ ID NO: 362434 - DNA, 140 bp, Artificial Sequence
  Synthetic
caccgctgtcccaaaaggtctacgtaccgcacataactgtttttgcggttcccactggtgttgcactgttcttaaaggactccggccattttttgtatactgccttgcaaacaccgtcaccatatcagcagccagggcct

SEQ ID NO: 362435 - DNA, 140 bp, Artificial Sequence
  Synthetic
aggccctggctgctgatatgatctatagatcaaagggctacacaacccctgaatagtaacaaaatacaaaatcactaaaaattataaaaacagaaaaatacataaataggtatacgtgtcgaccttttgggacagcggtg

SEQ ID NO: 362436 - DNA, 140 bp, Artificial Sequence
  Synthetic
caccgctgtcccaaaaggtcgacacgtatacctatttatgtatttttctgtttttataatttttagtgattttgtattttgttactattcaggggttgtgtagccctttgatctatagatcatatcagcagccagggcct

SEQ ID NO: 362437 - DNA, 140 bp, Artificial Sequence
  Synthetic
aggccctggctgctgatatgatcctaatcgtggtgctatgcgtgtcgtttagcaggcactaacttgacaactaggtatgaaggcatacgcgtccctaaagagacacaccacatatagctagaccttttgggacagcggtg

SEQ ID NO: 362438 - DNA, 140 bp, Artificial Sequence
  Synthetic
caccgctgtcccaaaaggtctagctatatgtggtgtgtctctttagggacgcgtatgccttcatacctagttgtcaagttagtgcctgctaaacgacacgcatagcaccacgattaggatcatatcagcagccagggcct

SEQ ID NO: 362439 - DNA, 140 bp, Artificial Sequence
  Synthetic
aggccctggctgctgatatgatgtaggtacttaagcttcctaaaagcagccgaactcactttgagaagtaggcatagcataccgaactcttccacgattctccgaacccacagggacgtagaccttttgggacagcggtg

SEQ ID NO: 362440 - DNA, 140 bp, Artificial Sequence
  Synthetic
caccgctgtcccaaaaggtctacgtccctgtgggttcggagaatcgtggaagagttcggtatgctatgcctacttctcaaagtgagttcggctgcttttaggaagcttaagtacctacatcatatcagcagccagggcct

SEQ ID NO: 362441 - DNA, 140 bp, Artificial Sequence
  Synthetic
aggccctggctgctgatatgccacctaaaaagaaaccggctcaaaagaaaaagaagccgggccgcagagagaggatgtgcatgaaaatcgaaaatgattgtattttcgaagtcaagcatggaccttttgggacagcggtg

SEQ ID NO: 362442 - DNA, 140 bp, Artificial Sequence
  Synthetic
caccgctgtcccaaaaggtccatgcttgacttcgaaaatacaatcattttcgattttcatgcacatcctctctctgcggcccggcttctttttcttttgagccggtttctttttaggtggcatatcagcagccagggcct

SEQ ID NO: 362443 - DNA, 140 bp, Artificial Sequence; identical to SEQ ID NO: 6065
  Synthetic

SEQ ID NO: 362444 - DNA, 140 bp, Artificial Sequence; identical to SEQ ID NO: 6066
  Synthetic

SEQ ID NO: 362445 - DNA, 140 bp, Artificial Sequence; identical to SEQ ID NO: 11529
  Synthetic

SEQ ID NO: 362446 - DNA, 140 bp, Artificial Sequence; identical to SEQ ID NO: 11530
  Synthetic

SEQ ID NO: 362447 - DNA, 140 bp, Artificial Sequence
  Synthetic
atacgccatgctgggtctcctcctcagacttcgggggcgtcgccattattaaatatgcagccagcaagaaaggcaagtgtgcggtgcattcgatgaccaacgccgtcactattcgggaagcgtacttgggagtcggccat

SEQ ID NO: 362448 - DNA, 140 bp, Artificial Sequence
  Synthetic
atggccgactcccaagtacgcttcccgaatagtgacggcgttggtcatcgaatgcaccgcacacttgcctttcttgctggctgcatatttaataatggcgacgcccccgaagtctgaggaggagacccagcatggcgtat

SEQ ID NO: 362449 - DNA, 140 bp, Artificial Sequence
  Synthetic
aggccctggctgctgatatgcaacgtgccatcgcgcgtaagtccaagggaatatagatcttcccaggagtctgcacaggaggcgagtacaatcacgtcactgacgcatagtcaattcgacgaccttttgggacagcggtg

SEQ ID NO: 362450 - DNA, 140 bp, Artificial Sequence
  Synthetic
caccgctgtcccaaaaggtcgtcgaattgactatgcgtcagtgacgtgattgtactcgcctcctgtgcagactcctgggaagatctatattcccttggacttacgcgcgatggcacgttgcatatcagcagccagggcct

SEQ ID NO: 362451 - DNA, 140 bp, Artificial Sequence
  Synthetic
aggccctggctgctgatatggtaagtgggcaaaggagtgccggaaggacatggaagatgagaagcttctgggggtcagagaaagaacactaacctgctgctgtctatgggcatttaagaagaccttttgggacagcggtg

SEQ ID NO: 362452 - DNA, 140 bp, Artificial Sequence
  Synthetic
caccgctgtcccaaaaggtcttcttaaatgcccatagacagcagcaggttagtgttctttctctgacccccagaagcttctcatcttccatgtccttccggcactcctttgcccacttaccatatcagcagccagggcct

SEQ ID NO: 362453 - DNA, 140 bp, Artificial Sequence; identical to SEQ ID NO: 7503
  Synthetic

SEQ ID NO: 362454 - DNA, 140 bp, Artificial Sequence; identical to SEQ ID NO: 7504
  Synthetic

SEQ ID NO: 362455 - DNA, 140 bp, Artificial Sequence
  Synthetic
atacgccatgctgggtctccacaactaagtatgaaggtatatgtgtcccctaagagacacactgtacatagctaataatctatagatcaaagggctacacaacccctgaatagtaacaaacgtacttgggagtcggccat

SEQ ID NO: 362456 - DNA, 140 bp, Artificial Sequence
  Synthetic
atggccgactcccaagtacgtttgttactattcaggggttgtgtagccctttgatctatagattattagctatgtacagtgtgtctcttaggggacacatataccttcatacttagttgtggagacccagcatggcgtat

SEQ ID NO: 362457 - DNA, 140 bp, Artificial Sequence; identical to SEQ ID NO: 6011
  Synthetic

SEQ ID NO: 362458 - DNA, 140 bp, Artificial Sequence; identical to SEQ ID NO: 6012
  Synthetic

SEQ ID NO: 362459 - DNA, 140 bp, Artificial Sequence
  Synthetic
aggccctggctgctgatatgttggcaaacggaagagatgtaggtacttaagcttcctaaaagcagccgaactcactttgagatgtaggcatagcataccgaactcttccacgattctccggaccttttgggacagcggtg

SEQ ID NO: 362460 - DNA, 140 bp, Artificial Sequence
  Synthetic
caccgctgtcccaaaaggtccggagaatcgtggaagagttcggtatgctatgcctacatctcaaagtgagttcggctgcttttaggaagcttaagtacctacatctcttccgtttgccaacatatcagcagccagggcct

SEQ ID NO: 362461 - DNA, 140 bp, Artificial Sequence
  Synthetic
atacgccatgctgggtctccgtacgccagtcagtgctgccggtgaacaccctggaggaagtccacgaggagaagtgttacccacctaagctggatgaagcaaaggagcaactattacttacgtacttgggagtcggccat

SEQ ID NO: 362462 - DNA, 140 bp, Artificial Sequence
  Synthetic
atggccgactcccaagtacgtaagtaatagttgctcctttgcttcatccagcttaggtgggtaacacttctcctcgtggacttcctccagggtgttcaccggcagcactgactggcgtacggagacccagcatggcgtat

SEQ ID NO: 362463 - DNA, 140 bp, Artificial Sequence
  Synthetic
aggccctggctgctgatatgcctattttgcagaagccgacagcaagtacctaaacactaatcagctacaatggagttcatcccaacccaaactttttacaacaggaggtaccagcctcgagaccttttgggacagcggtg

SEQ ID NO: 362464 - DNA, 140 bp, Artificial Sequence
  Synthetic
caccgctgtcccaaaaggtctcgaggctggtacctcctgttgtaaaaagtttgggttgggatgaactccattgtagctgattagtgtttaggtacttgctgtcggcttctgcaaaataggcatatcagcagccagggcct

SEQ ID NO: 362465 - DNA, 140 bp, Artificial Sequence
  Synthetic
atacgccatgctgggtctcccccttggcgacagcatacctatgtgggattcacagagagctggttaggaggctgaacgccgtcctcctacccaatgtacatacactatttgacatgtctgcgtacttgggagtcggccat

SEQ ID NO: 362466 - DNA, 140 bp, Artificial Sequence
  Synthetic
atggccgactcccaagtacgcagacatgtcaaatagtgtatgtacattgggtaggaggacggcgttcagcctcctaaccagctctctgtgaatcccacataggtatgctgtcgccaagggggagacccagcatggcgtat

SEQ ID NO: 362467 - DNA, 140 bp, Artificial Sequence
  Synthetic
atacgccatgctgggtctccccgaggatttcgatgccatcatagccgcacactttaagccaggagacactgttttggaaacggacatagcctcctttgataagagccaagatgattcactcgtacttgggagtcggccat

SEQ ID NO: 362468 - DNA, 140 bp, Artificial Sequence
  Synthetic
atggccgactcccaagtacgagtgaatcatcttggctcttatcaaaggaggctatgtccgtttccaaaacagtgtctcctggcttaaagtgtgcggctatgatggcatcgaaatcctcggggagacccagcatggcgtat

SEQ ID NO: 362469 - DNA, 140 bp, Artificial Sequence
  Synthetic
atacgccatgctgggtctcctgcgcttactgctttgatgctgttagaggatttaggggtggatcactccctgctggacttgatagaggctgctttcggagagatttccagctgtcacctacgtacttgggagtcggccat

SEQ ID NO: 362470 - DNA, 140 bp, Artificial Sequence
  Synthetic
atggccgactcccaagtacgtaggtgacagctggaaatctctccgaaagcagcctctatcaagtccagcagggagtgatccacccctaaatcctctaacagcatcaaagcagtaagcgcaggagacccagcatggcgtat

SEQ ID NO: 362471 - DNA, 140 bp, Artificial Sequence; identical to SEQ ID NO: 11255
  Synthetic

SEQ ID NO: 362472 - DNA, 140 bp, Artificial Sequence; identical to SEQ ID NO: 11256
  Synthetic

SEQ ID NO: 362473 - DNA, 140 bp, Artificial Sequence; identical to SEQ ID NO: 7837
  Synthetic

SEQ ID NO: 362474 - DNA, 140 bp, Artificial Sequence; identical to SEQ ID NO: 7838
  Synthetic

SEQ ID NO: 362475 - DNA, 140 bp, Artificial Sequence; identical to SEQ ID NO: 9477
  Synthetic

SEQ ID NO: 362476 - DNA, 140 bp, Artificial Sequence; identical to SEQ ID NO: 9478
  Synthetic

SEQ ID NO: 362477 - DNA, 140 bp, Artificial Sequence
  Synthetic
atacgccatgctgggtctcctgaagacttccagagcctaagcgaaagcgcaacgatggtgtacaacgaaagagagttcgtaaacagaaagctacaccatattgcgatgcatggaccagcccgtacttgggagtcggccat

SEQ ID NO: 362478 - DNA, 140 bp, Artificial Sequence
  Synthetic
atggccgactcccaagtacgggctggtccatgcatcgcaatatggtgtagctttctgtttacgaactctctttcgttgtacaccatcgttgcgctttcgcttaggctctggaagtcttcaggagacccagcatggcgtat

SEQ ID NO: 362479 - DNA, 140 bp, Artificial Sequence; identical to SEQ ID NO: 5957
  Synthetic

SEQ ID NO: 362480 - DNA, 140 bp, Artificial Sequence; identical to SEQ ID NO: 5958
  Synthetic

SEQ ID NO: 362481 - DNA, 140 bp, Artificial Sequence
  Synthetic
aggccctggctgctgatatgaatgtccatggccacctttgcaagctccagatccaacttcgagaagctcagaggacccgtcataactttgtacggcggtcctaaataggtacgcactacagaccttttgggacagcggtg

SEQ ID NO: 362482 - DNA, 140 bp, Artificial Sequence
  Synthetic
caccgctgtcccaaaaggtctgtagtgcgtacctatttaggaccgccgtacaaagttatgacgggtcctctgagcttctcgaagttggatctggagcttgcaaaggtggccatggacattcatatcagcagccagggcct

SEQ ID NO: 362483 - DNA, 140 bp, Artificial Sequence
  Synthetic
aggccctggctgctgatatgtgcagtcataggagtcttcggagtaccaggatctggcaagtcagctattatcaagaacctagttaccaggcaagacctggtgactagcggaaagaaagaagaccttttgggacagcggtg

SEQ ID NO: 362484 - DNA, 140 bp, Artificial Sequence
  Synthetic
caccgctgtcccaaaaggtcttctttctttccgctagtcaccaggtcttgcctggtaactaggttcttgataatagctgacttgccagatcctggtactccgaagactcctatgactgcacatatcagcagccagggcct

SEQ ID NO: 362485 - DNA, 140 bp, Artificial Sequence
  Synthetic
aggccctggctgctgatatgacgtgtcccctaagagacacattgtatgtaggtgataagtatagatcaaaggggcgaacaacccctgaatagtaacaaaatatgaaaaattaaaaaaaaagaccttttgggacagcggtg

SEQ ID NO: 362486 - DNA, 140 bp, Artificial Sequence
  Synthetic
caccgctgtcccaaaaggtctttttttttaatttttcatattttgttactattcaggggttgttcgcccctttgatctatacttatcacctacatacaatgtgtctcttaggggacacgtcatatcagcagccagggcct

SEQ ID NO: 362487 - DNA, 140 bp, Artificial Sequence
  Synthetic
atacgccatgctgggtctccaaaaaaaaaaaaaaaaaaaaaaaaaaaaaaaaaaaaaaaaaaaaaaaaaaaaaaaaaaaaaaaaaatcataaaatagaaaaaccataaacagaagtagttcgtacttgggagtcggccat

SEQ ID NO: 362488 - DNA, 140 bp, Artificial Sequence
  Synthetic
atggccgactcccaagtacgaactacttctgtttatggtttttctattttatgattttttttttttttttttttttttttttttttttttttttttttttttttttttttttttttttttggagacccagcatggcgtat

SEQ ID NO: 362489 - DNA, 140 bp, Artificial Sequence
  Synthetic
aggccctggctgctgatatgaaatcaataaaaatcataaaatagaaaaaccataaacagaagtagtttaaagggctataaaacccctgaatagtaacaaaacataaagttaataaaaatcgaccttttgggacagcggtg

SEQ ID NO: 362490 - DNA, 140 bp, Artificial Sequence
  Synthetic
caccgctgtcccaaaaggtcgatttttattaactttatgttttgttactattcaggggttttatagccctttaaactacttctgtttatggtttttctattttatgatttttattgatttcatatcagcagccagggcct

SEQ ID NO: 362491 - DNA, 140 bp, Artificial Sequence
  Synthetic
atacgccatgctgggtctccaaaagaagcagccacctaaaaagaaaccggctcaaaagaaaaagaagccgggccgcagagagaggatgtgcatgaaaatcgaaaatgattgtattttcgacgtacttgggagtcggccat

SEQ ID NO: 362492 - DNA, 140 bp, Artificial Sequence
  Synthetic
atggccgactcccaagtacgtcgaaaatacaatcattttcgattttcatgcacatcctctctctgcggcccggcttctttttcttttgagccggtttctttttaggtggctgcttcttttggagacccagcatggcgtat

SEQ ID NO: 362493 - DNA, 140 bp, Artificial Sequence
  Synthetic
aggccctggctgctgatatgtgtaggtacttaagcttcctaaaagcagccgaactcactttgagatgtaggcatagcataccgaactcttccacgattctccgaacccacagggacgtaggaccttttgggacagcggtg

SEQ ID NO: 362494 - DNA, 140 bp, Artificial Sequence
  Synthetic
caccgctgtcccaaaaggtcctacgtccctgtgggttcggagaatcgtggaagagttcggtatgctatgcctacatctcaaagtgagttcggctgcttttaggaagcttaagtacctacacatatcagcagccagggcct

SEQ ID NO: 362495 - DNA, 140 bp, Artificial Sequence
  Synthetic
aggccctggctgctgatatgacggaagagatgtaggtacttaagcttcctaaaagcagccgaactcactttgagaagtaggcatagcataccgaactctcctacgattctccgaacccccgaccttttgggacagcggtg

SEQ ID NO: 362496 - DNA, 140 bp, Artificial Sequence
  Synthetic
caccgctgtcccaaaaggtcgggggttcggagaatcgtaggagagttcggtatgctatgcctacttctcaaagtgagttcggctgcttttaggaagcttaagtacctacatctcttccgtcatatcagcagccagggcct

SEQ ID NO: 362497 - DNA, 140 bp, Artificial Sequence; identical to SEQ ID NO: 7483
  Synthetic

SEQ ID NO: 362498 - DNA, 140 bp, Artificial Sequence; identical to SEQ ID NO: 7484
  Synthetic

SEQ ID NO: 362499 - DNA, 140 bp, Artificial Sequence; identical to SEQ ID NO: 10551
  Synthetic

SEQ ID NO: 362500 - DNA, 140 bp, Artificial Sequence; identical to SEQ ID NO: 10552
  Synthetic

SEQ ID NO: 362501 - DNA, 140 bp, Artificial Sequence
  Synthetic
atacgccatgctgggtctccgatacccgtgcacatgaagtccgacgcttcgaagttcacccatgagaaaccggaggggtactacaactggcaccacggagcagtacagtactcaggaggccgtacttgggagtcggccat

SEQ ID NO: 362502 - DNA, 140 bp, Artificial Sequence
  Synthetic
atggccgactcccaagtacggcctcctgagtactgtactgctccgtggtgccagttgtagtacccctccggtttctcatgggtgaacttcgaagcgtcggacttcatgtgcacgggtatcggagacccagcatggcgtat

SEQ ID NO: 362503 - DNA, 140 bp, Artificial Sequence
  Synthetic
aggccctggctgctgatatgggctaagagtttggtccctatcctcgaaacagcggggataaaactaaacgacaggcagtggtcccagataattcaagccttcaaagaagacaaagcatatgaccttttgggacagcggtg

SEQ ID NO: 362504 - DNA, 140 bp, Artificial Sequence
  Synthetic
caccgctgtcccaaaaggtcatatgctttgtcttctttgaaggcttgaattatctgggaccactgcctgtcgtttagttttatccccgctgtttcgaggatagggaccaaactcttagcccatatcagcagccagggcct

SEQ ID NO: 362505 - DNA, 140 bp, Artificial Sequence
  Synthetic
aggccctggctgctgatatgatgaaggagcccgtacagccctctcggtggtgacctggaataaagacattgtcactaaaatcacccccgagggggccgaagagtggagtcttgccatcccgaccttttgggacagcggtg

SEQ ID NO: 362506 - DNA, 140 bp, Artificial Sequence
  Synthetic
caccgctgtcccaaaaggtcgggatggcaagactccactcttcggccccctcgggggtgattttagtgacaatgtctttattccaggtcaccaccgagagggctgtacgggctccttcatcatatcagcagccagggcct

SEQ ID NO: 362507 - DNA, 140 bp, Artificial Sequence
  Synthetic
atacgccatgctgggtctccctttctcctcaccccctctccaaacttcaattcctaacccctttctaacattctaccttccctctacttcctcttctctatacccctactaaccattccccgtacttgggagtcggccat

SEQ ID NO: 362508 - DNA, 140 bp, Artificial Sequence
  Synthetic
atggccgactcccaagtacggggaatggttagtaggggtatagagaagaggaagtagagggaaggtagaatgttagaaaggggttaggaattgaagtttggagagggggtgaggagaaagggagacccagcatggcgtat

SEQ ID NO: 362509 - DNA, 140 bp, Artificial Sequence
  Synthetic
aggccctggctgctgatatgaatcaatagataagtatagatcaaagggctgaacaacccctgaatagtaacaaaatataaaaatcaacaaaaatcataaaatagaaaactagaaatagaagaccttttgggacagcggtg

SEQ ID NO: 362510 - DNA, 140 bp, Artificial Sequence
  Synthetic
caccgctgtcccaaaaggtcttctatttctagttttctattttatgatttttgttgatttttatattttgttactattcaggggttgttcagccctttgatctatacttatctattgattcatatcagcagccagggcct

SEQ ID NO: 362511 - DNA, 140 bp, Artificial Sequence
  Synthetic
atacgccatgctgggtctccctgaatagtaacaaaacataaaaataataaaaactacaaaatagaaaatctataaacaaaaagtagttcaaagggctacaaaacccctgaatagtaacaacgtacttgggagtcggccat

SEQ ID NO: 362512 - DNA, 140 bp, Artificial Sequence
  Synthetic
atggccgactcccaagtacgttgttactattcaggggttttgtagccctttgaactactttttgtttatagattttctattttgtagtttttattatttttatgttttgttactattcagggagacccagcatggcgtat

SEQ ID NO: 362513 - DNA, 140 bp, Artificial Sequence
  Synthetic
atacgccatgctgggtctcctacccggcgtcacacaccaccctcggggtccaagacatttccgctacggcgatgtcatgggtgcagaagatcacgggaggtgtgggactggttgtcgctgcgtacttgggagtcggccat

SEQ ID NO: 362514 - DNA, 140 bp, Artificial Sequence
  Synthetic
atggccgactcccaagtacgcagcgacaaccagtcccacacctcccgtgatcttctgcacccatgacatcgccgtagcggaaatgtcttggaccccgagggtggtgtgtgacgccgggtaggagacccagcatggcgtat

SEQ ID NO: 362515 - DNA, 140 bp, Artificial Sequence
  Synthetic
aggccctggctgctgatatgccattcccgaccgcagcacggtaaagagctaccttgcagcacgtacgtgcagagcaccgccgcaactaccgaggagatagaggtacacatgcccccagacgaccttttgggacagcggtg

SEQ ID NO: 362516 - DNA, 140 bp, Artificial Sequence
  Synthetic
caccgctgtcccaaaaggtcgtctgggggcatgtgtacctctatctcctcggtagttgcggcggtgctctgcacgtacgtgctgcaaggtagctctttaccgtgctgcggtcgggaatggcatatcagcagccagggcct

SEQ ID NO: 362517 - DNA, 140 bp, Artificial Sequence
  Synthetic
aggccctggctgctgatatgacttaagcttcctaaaagcagccgaactcactttgagatgtaggcatagcataccgaactcttccacaattctccgtacccatagggacgtaggagatgtgaccttttgggacagcggtg

SEQ ID NO: 362518 - DNA, 140 bp, Artificial Sequence
  Synthetic
caccgctgtcccaaaaggtcacatctcctacgtccctatgggtacggagaattgtggaagagttcggtatgctatgcctacatctcaaagtgagttcggctgcttttaggaagcttaagtcatatcagcagccagggcct

SEQ ID NO: 362519 - DNA, 140 bp, Artificial Sequence
  Synthetic
atacgccatgctgggtctcctaacttgacaactaggtatgaaagtatatgtgtcccctaagagacacaccacatatagctaagaatcaatagataagtatagatcaaagggctgaacaaccgtacttgggagtcggccat

SEQ ID NO: 362520 - DNA, 140 bp, Artificial Sequence
  Synthetic
atggccgactcccaagtacggttgttcagccctttgatctatacttatctattgattcttagctatatgtggtgtgtctcttaggggacacatatactttcatacctagttgtcaagttaggagacccagcatggcgtat

SEQ ID NO: 362521 - DNA, 140 bp, Artificial Sequence
  Synthetic
atacgccatgctgggtctccccctgaatagtaacaaaatataaaaatcaataaaaaatcataaaatagaaaaccagaaacagaagtaggtaagaaggtatatgtgtcccctaagagacaccgtacttgggagtcggccat

SEQ ID NO: 362522 - DNA, 140 bp, Artificial Sequence
  Synthetic
atggccgactcccaagtacggtgtctcttaggggacacatataccttcttacctacttctgtttctggttttctattttatgattttttattgatttttatattttgttactattcagggggagacccagcatggcgtat

SEQ ID NO: 362523 - DNA, 140 bp, Artificial Sequence
  Synthetic
atacgccatgctgggtctccgtaggtaagaaggtatatgtgtcccctaagagacacaccatatatagctaagaatcaatagataagcatagatcaaagggctgaataacccctgaataatcgtacttgggagtcggccat

SEQ ID NO: 362524 - DNA, 140 bp, Artificial Sequence
  Synthetic
atggccgactcccaagtacgattattcaggggttattcagccctttgatctatgcttatctattgattcttagctatatatggtgtgtctcttaggggacacatataccttcttacctacggagacccagcatggcgtat

SEQ ID NO: 362525 - DNA, 140 bp, Artificial Sequence
  Synthetic
aggccctggctgctgatatgaccgtgacgtacgggaaaaaccaagtcatcatgctactgtatcctgaccacccaacactcctgtcctaccggaatatgggagaagaaccaaactatcaaggaccttttgggacagcggtg

SEQ ID NO: 362526 - DNA, 140 bp, Artificial Sequence
  Synthetic
caccgctgtcccaaaaggtccttgatagtttggttcttctcccatattccggtaggacaggagtgttgggtggtcaggatacagtagcatgatgacttggtttttcccgtacgtcacggtcatatcagcagccagggcct

SEQ ID NO: 362527 - DNA, 140 bp, Artificial Sequence
  Synthetic
aggccctggctgctgatatgttccacgattctccgaacccacacggacgtaggagatgttattttgatacttgataccataattggcaaacggaagagatgtaggtacttaagcttcctagaccttttgggacagcggtg

SEQ ID NO: 362528 - DNA, 140 bp, Artificial Sequence
  Synthetic
caccgctgtcccaaaaggtctaggaagcttaagtacctacatctcttccgtttgccaattatggtatcaagtatcaaaataacatctcctacgtccgtgtgggttcggagaatcgtggaacatatcagcagccagggcct

SEQ ID NO: 362529 - DNA, 140 bp, Artificial Sequence
  Synthetic
aggccctggctgctgatatggggagaagaaaatatctgaggccatacagatgcggacccaagtggagctgctggatgagcacatctccatagactgcgatgttgttcgcgtgcaccctgagaccttttgggacagcggtg

SEQ ID NO: 362530 - DNA, 140 bp, Artificial Sequence
  Synthetic
caccgctgtcccaaaaggtctcagggtgcacgcgaacaacatcgcagtctatggagatgtgctcatccagcagctccacttgggtccgcatctgtatggcctcagatattttcttctccccatatcagcagccagggcct

SEQ ID NO: 362531 - DNA, 140 bp, Artificial Sequence
  Synthetic
atacgccatgctgggtctccgttatctacaaacggtacagcccatggccacccgcatgagataattctgtattattatgagctgtaccctactatgactgtagtagttgtgtcagtggcccgtacttgggagtcggccat

SEQ ID NO: 362532 - DNA, 140 bp, Artificial Sequence
  Synthetic
atggccgactcccaagtacgggccactgacacaactactacagtcatagtagggtacagctcataataatacagaattatctcatgcgggtggccatgggctgtaccgtttgtagataacggagacccagcatggcgtat

SEQ ID NO: 362533 - DNA, 140 bp, Artificial Sequence; identical to SEQ ID NO: 7145
  Synthetic

SEQ ID NO: 362534 - DNA, 140 bp, Artificial Sequence; identical to SEQ ID NO: 7146
  Synthetic

SEQ ID NO: 362535 - DNA, 140 bp, Artificial Sequence
  Synthetic
atacgccatgctgggtctccacgttcatactcctgtcgatggtgggtatggcagcggggatgtgcatgtgtgcacgacgcagatgcatcacaccgtatgaactgacaccaggagctaccgcgtacttgggagtcggccat

SEQ ID NO: 362536 - DNA, 140 bp, Artificial Sequence
  Synthetic
atggccgactcccaagtacgcggtagctcctggtgtcagttcatacggtgtgatgcatctgcgtcgtgcacacatgcacatccccgctgccatacccaccatcgacaggagtatgaacgtggagacccagcatggcgtat

SEQ ID NO: 362537 - DNA, 140 bp, Artificial Sequence
  Synthetic
atacgccatgctgggtctcctggagttcatcccaacccaaactttttacaataggaggtaccagcctcgaccctggactccgcgctctactatccaagtcatcaggcccagaccgcgccccgtacttgggagtcggccat

SEQ ID NO: 362538 - DNA, 140 bp, Artificial Sequence
  Synthetic
atggccgactcccaagtacggggcgcggtctgggcctgatgacttggatagtagagcgcggagtccagggtcgaggctggtacctcctattgtaaaaagtttgggttgggatgaactccaggagacccagcatggcgtat

SEQ ID NO: 362539 - DNA, 140 bp, Artificial Sequence
  Synthetic
aggccctggctgctgatatgttatgagctgtaccctactatgactgtagtagttgtgtcagtggccacgttcatactcctgtcgatggtgggtatggcagcggggatgtgcatgtgtgcagaccttttgggacagcggtg

SEQ ID NO: 362540 - DNA, 140 bp, Artificial Sequence
  Synthetic
caccgctgtcccaaaaggtctgcacacatgcacatccccgctgccatacccaccatcgacaggagtatgaacgtggccactgacacaactactacagtcatagtagggtacagctcataacatatcagcagccagggcct

SEQ ID NO: 362541 - DNA, 140 bp, Artificial Sequence
  Synthetic
aggccctggctgctgatatggagagtaaagacgtctatgctaatacacaactggtactgcagagaccggctgtgggtacggtacacgtgccatactctcaggcaccatctggctttaagtgaccttttgggacagcggtg

SEQ ID NO: 362542 - DNA, 140 bp, Artificial Sequence
  Synthetic
caccgctgtcccaaaaggtcacttaaagccagatggtgcctgagagtatggcacgtgtaccgtacccacagccggtctctgcagtaccagttgtgtattagcatagacgtctttactctccatatcagcagccagggcct

SEQ ID NO: 362543 - DNA, 140 bp, Artificial Sequence; identical to SEQ ID NO: 12235
  Synthetic

SEQ ID NO: 362544 - DNA, 140 bp, Artificial Sequence; identical to SEQ ID NO: 12236
  Synthetic

SEQ ID NO: 362545 - DNA, 140 bp, Artificial Sequence; identical to SEQ ID NO: 11651
  Synthetic

SEQ ID NO: 362546 - DNA, 140 bp, Artificial Sequence; identical to SEQ ID NO: 11652
  Synthetic

SEQ ID NO: 362547 - DNA, 140 bp, Artificial Sequence
  Synthetic
atacgccatgctgggtctccacaattaaggaatgggaagtggaacatgcttcaataatggcgggtatctgtaaccaccaagtgacctttgacacgttccagaataaagccaatgtctgctcgtacttgggagtcggccat

SEQ ID NO: 362548 - DNA, 140 bp, Artificial Sequence
  Synthetic
atggccgactcccaagtacgagcagacattggctttattctggaacgtgtcaaaggtcacttggtggttacagatacccgccattattgaagcatgttccacttcccattccttaattgtggagacccagcatggcgtat

SEQ ID NO: 362549 - DNA, 140 bp, Artificial Sequence
  Synthetic
atacgccatgctgggtctccacactaatcagctacagcgatcgcgccgccaccatggtgagcaagggcgaggagctgttcaccggggtggtgcccatcctggtcgagctggacggcgacgcgtacttgggagtcggccat

SEQ ID NO: 362550 - DNA, 140 bp, Artificial Sequence
  Synthetic
atggccgactcccaagtacgcgtcgccgtccagctcgaccaggatgggcaccaccccggtgaacagctcctcgcccttgctcaccatggtggcggcgcgatcgctgtagctgattagtgtggagacccagcatggcgtat

SEQ ID NO: 362551 - DNA, 140 bp, Artificial Sequence
  Synthetic
atacgccatgctgggtctccagttactgcccaaccaacagaccacgtcgtgggagagtacctggtactctccccgcagaccgtactacgtagccagaagctcagtctgattcacgctttgcgtacttgggagtcggccat

SEQ ID NO: 362552 - DNA, 140 bp, Artificial Sequence
  Synthetic
atggccgactcccaagtacgcaaagcgtgaatcagactgagcttctggctacgtagtacggtctgcggggagagtaccaggtactctcccacgacgtggtctgttggttgggcagtaactggagacccagcatggcgtat

SEQ ID NO: 362553 - DNA, 140 bp, Artificial Sequence
  Synthetic
atacgccatgctgggtctcctaaacggccacaagttcagcgtgtccggcgagggcgagggcgatgccacctacggcaagctgaccctgaagttcatctgcaccaccggcaagctgcccgtcgtacttgggagtcggccat

SEQ ID NO: 362554 - DNA, 140 bp, Artificial Sequence
  Synthetic
atggccgactcccaagtacgacgggcagcttgccggtggtgcagatgaacttcagggtcagcttgccgtaggtggcatcgccctcgccctcgccggacacgctgaacttgtggccgtttaggagacccagcatggcgtat

SEQ ID NO: 362555 - DNA, 140 bp, Artificial Sequence; identical to SEQ ID NO: 7171
  Synthetic

SEQ ID NO: 362556 - DNA, 140 bp, Artificial Sequence; identical to SEQ ID NO: 7172
  Synthetic

SEQ ID NO: 362557 - DNA, 140 bp, Artificial Sequence
  Synthetic
atacgccatgctgggtctcctttggctgcgtgagacacacgtagcctaccagtttcttactgctctactctgcaaagcaagagattaataacccatcatggatcctgtgtacgtggacatcgtacttgggagtcggccat

SEQ ID NO: 362558 - DNA, 140 bp, Artificial Sequence
  Synthetic
atggccgactcccaagtacgatgtccacgtacacaggatccatgatgggttattaatctcttgctttgcagagtagagcagtaagaaactggtaggctacgtgtgtctcacgcagccaaaggagacccagcatggcgtat

SEQ ID NO: 362559 - DNA, 140 bp, Artificial Sequence
  Synthetic
atacgccatgctgggtctcccccgaaggctacgtccaggagcgcaccatcttcttcaaggacgacggcaactacaagacccgcgccgaggtgaagttcgagggcgacaccctggtgaacccgtacttgggagtcggccat

SEQ ID NO: 362560 - DNA, 140 bp, Artificial Sequence
  Synthetic
atggccgactcccaagtacgggttcaccagggtgtcgccctcgaacttcacctcggcgcgggtcttgtagttgccgtcgtccttgaagaagatggtgcgctcctggacgtagccttcgggggagacccagcatggcgtat

SEQ ID NO: 362561 - DNA, 140 bp, Artificial Sequence
  Synthetic
atacgccatgctgggtctccgcatcgagctgaagggcatcgacttcaaggaggacggcaacatcctggggcacaagctggagtacaactacaacagccacaacgtctatatcatggccgacgtacttgggagtcggccat

SEQ ID NO: 362562 - DNA, 140 bp, Artificial Sequence
  Synthetic
atggccgactcccaagtacgtcggccatgatatagacgttgtggctgttgtagttgtactccagcttgtgccccaggatgttgccgtcctccttgaagtcgatgcccttcagctcgatgcggagacccagcatggcgtat

SEQ ID NO: 362563 - DNA, 140 bp, Artificial Sequence; identical to SEQ ID NO: 7183
  Synthetic

SEQ ID NO: 362564 - DNA, 140 bp, Artificial Sequence; identical to SEQ ID NO: 7184
  Synthetic

SEQ ID NO: 362565 - DNA, 140 bp, Artificial Sequence
  Synthetic
atacgccatgctgggtctccaataaaacataaaattaataaggagtaccataattggcaaacggaagagacgtaggtacttaagcttcctaaaagcagccgaactcactttgagatgtagcgtacttgggagtcggccat

SEQ ID NO: 362566 - DNA, 140 bp, Artificial Sequence
  Synthetic
atggccgactcccaagtacgctacatctcaaagtgagttcggctgcttttaggaagcttaagtacctacgtctcttccgtttgccaattatggtactccttattaattttatgttttattggagacccagcatggcgtat

SEQ ID NO: 362567 - DNA, 140 bp, Artificial Sequence
  Synthetic
aggccctggctgctgatatgtgccaaaaaccgacctgatcccatacagcggggacgcccaagaagcccgggacgcagaaaaagaagcagaggaagaacgagaagcagaactgactcgtgagaccttttgggacagcggtg

SEQ ID NO: 362568 - DNA, 140 bp, Artificial Sequence
  Synthetic
caccgctgtcccaaaaggtctcacgagtcagttctgcttctcgttcttcctctgcttctttttctgcgtcccgggcttcttgggcgtccccgctgtatgggatcaggtcggtttttggcacatatcagcagccagggcct

SEQ ID NO: 362569 - DNA, 140 bp, Artificial Sequence
  Synthetic
aggccctggctgctgatatgccgagtccgcagtggcagcatgcaatgagttcttggctagaaactatccaactgtttcatcataccaaatcaccgacgagtatgatgcatatctagacatgaccttttgggacagcggtg

SEQ ID NO: 362570 - DNA, 140 bp, Artificial Sequence
  Synthetic
caccgctgtcccaaaaggtcatgtctagatatgcatcatactcgtcggtgatttggtatgatgaaacagttggatagtttctagccaagaactcattgcatgctgccactgcggactcggcatatcagcagccagggcct

SEQ ID NO: 362571 - DNA, 140 bp, Artificial Sequence
  Synthetic
aggccctggctgctgatatgggtggacgggtcggagagttgtctggaccgagcgacattcaatccgtcaaaacttaggagctacccaaaacagcacgcttaccacgcgccctccatcagagaccttttgggacagcggtg

SEQ ID NO: 362572 - DNA, 140 bp, Artificial Sequence
  Synthetic
caccgctgtcccaaaaggtctctgatggagggcgcgtggtaagcgtgctgttttgggtagctcctaagttttgacggattgaatgtcgctcggtccagacaactctccgacccgtccacccatatcagcagccagggcct

SEQ ID NO: 362573 - DNA, 140 bp, Artificial Sequence
  Synthetic
aggccctggctgctgatatggacggccttagccagcgccgaattccgcgtacaagtctgttctacacaagtacactgtgcagctgagtgccaccccccgaaggaccacatagtcaactacgaccttttgggacagcggtg

SEQ ID NO: 362574 - DNA, 140 bp, Artificial Sequence
  Synthetic
caccgctgtcccaaaaggtcgtagttgactatgtggtccttcggggggtggcactcagctgcacagtgtacttgtgtagaacagacttgtacgcggaattcggcgctggctaaggccgtccatatcagcagccagggcct

SEQ ID NO: 362575 - DNA, 140 bp, Artificial Sequence
  Synthetic
atacgccatgctgggtctccttatcaagaacctagttaccaggcaagacctggtgactagcggaaagaaagaaaactgccaagaaatcaccaccgacgtgatgagacagagaggtctagacgtacttgggagtcggccat

SEQ ID NO: 362576 - DNA, 140 bp, Artificial Sequence
  Synthetic
atggccgactcccaagtacgtctagacctctctgtctcatcacgtcggtggtgatttcttggcagttttctttctttccgctagtcaccaggtcttgcctggtaactaggttcttgataaggagacccagcatggcgtat

SEQ ID NO: 362577 - DNA, 140 bp, Artificial Sequence
  Synthetic
aggccctggctgctgatatggaactcttccataactctccgaacccacagggacgtaggagatgttcaaagtgactataaaaccctgaacagtaataaaacataaaattaataaggagtagaccttttgggacagcggtg

SEQ ID NO: 362578 - DNA, 140 bp, Artificial Sequence
  Synthetic
caccgctgtcccaaaaggtctactccttattaattttatgttttattactgttcagggttttatagtcactttgaacatctcctacgtccctgtgggttcggagagttatggaagagttccatatcagcagccagggcct

SEQ ID NO: 362579 - DNA, 140 bp, Artificial Sequence
  Synthetic
aggccctggctgctgatatgcaaaatataaaatcactaaaaattataaaaacagaaaaatacataaataggtatacgtgtcccctaagagacacattgtatgtaggtgataagtatagatgaccttttgggacagcggtg

SEQ ID NO: 362580 - DNA, 140 bp, Artificial Sequence
  Synthetic
caccgctgtcccaaaaggtcatctatacttatcacctacatacaatgtgtctcttaggggacacgtatacctatttatgtatttttctgtttttataatttttagtgattttatattttgcatatcagcagccagggcct

SEQ ID NO: 362581 - DNA, 140 bp, Artificial Sequence
  Synthetic
aggccctggctgctgatatgcggtgtacactgcctgtgactgccattgtgtcatcgttgcattacgaaggcaaaatgcgcactacgaatgagtacaacaagccgattgtagtggacactagaccttttgggacagcggtg

SEQ ID NO: 362582 - DNA, 140 bp, Artificial Sequence
  Synthetic
caccgctgtcccaaaaggtctagtgtccactacaatcggcttgttgtactcattcgtagtgcgcattttgccttcgtaatgcaacgatgacacaatggcagtcacaggcagtgtacaccgcatatcagcagccagggcct

SEQ ID NO: 362583 - DNA, 140 bp, Artificial Sequence
  Synthetic
aggccctggctgctgatatgacccctgaatagtaacaaaacataaaattaataaaaatcaaatgaataccataattggcaaacggaagagatgtaggcacttaagcttcctaaaagcagcgaccttttgggacagcggtg

SEQ ID NO: 362584 - DNA, 140 bp, Artificial Sequence
  Synthetic
caccgctgtcccaaaaggtcgctgcttttaggaagcttaagtgcctacatctcttccgtttgccaattatggtattcatttgatttttattaattttatgttttgttactattcaggggtcatatcagcagccagggcct

SEQ ID NO: 362585 - DNA, 140 bp, Artificial Sequence
  Synthetic
aggccctggctgctgatatgataattggcaaacggaagagatgtaggcacttaagcttcctaaaagcagccgaactcactttgagaagtaggcatagcataccgaactcttccacgattcgaccttttgggacagcggtg

SEQ ID NO: 362586 - DNA, 140 bp, Artificial Sequence
  Synthetic
caccgctgtcccaaaaggtcgaatcgtggaagagttcggtatgctatgcctacttctcaaagtgagttcggctgcttttaggaagcttaagtgcctacatctcttccgtttgccaattatcatatcagcagccagggcct

SEQ ID NO: 362587 - DNA, 140 bp, Artificial Sequence
  Synthetic
aggccctggctgctgatatgtaccgaactcttccacgattctccgaacccacagggacgtaggagatgttattttgtttttaatatttcaaaaaaaaaaaaaaaaaaaaaaaaaaaaaaagaccttttgggacagcggtg

SEQ ID NO: 362588 - DNA, 140 bp, Artificial Sequence
  Synthetic
caccgctgtcccaaaaggtctttttttttttttttttttttttttttttttgaaatattaaaaacaaaataacatctcctacgtccctgtgggttcggagaatcgtggaagagttcggtacatatcagcagccagggcct

SEQ ID NO: 362589 - DNA, 140 bp, Artificial Sequence; identical to SEQ ID NO: 7393
  Synthetic

SEQ ID NO: 362590 - DNA, 140 bp, Artificial Sequence; identical to SEQ ID NO: 7394
  Synthetic

SEQ ID NO: 362591 - DNA, 140 bp, Artificial Sequence; identical to SEQ ID NO: 8025
  Synthetic

SEQ ID NO: 362592 - DNA, 140 bp, Artificial Sequence; identical to SEQ ID NO: 8026
  Synthetic

SEQ ID NO: 362593 - DNA, 140 bp, Artificial Sequence
  Synthetic
aggccctggctgctgatatgggaggatagaagactttaaccctaccaccaacattataccggccaacaggagactaccacactcattagtggccgaacaccgcccagtaaaaggggaaaggaccttttgggacagcggtg

SEQ ID NO: 362594 - DNA, 140 bp, Artificial Sequence
  Synthetic
caccgctgtcccaaaaggtcctttccccttttactgggcggtgttcggccactaatgagtgtggtagtctcctgttggccggtataatgttggtggtagggttaaagtcttctatcctcccatatcagcagccagggcct

SEQ ID NO: 362595 - DNA, 140 bp, Artificial Sequence
  Synthetic
aggccctggctgctgatatggtggaacatcaacaagcagatctgcgtgactaccaggaggatagaagacttcaaccctaccaccaacattataccggccaacaggagactaccacactcagaccttttgggacagcggtg

SEQ ID NO: 362596 - DNA, 140 bp, Artificial Sequence
  Synthetic
caccgctgtcccaaaaggtctgagtgtggtagtctcctgttggccggtataatgttggtggtagggttgaagtcttctatcctcctggtagtcacgcagatctgcttgttgatgttccaccatatcagcagccagggcct

SEQ ID NO: 362597 - DNA, 140 bp, Artificial Sequence; identical to SEQ ID NO: 6119
  Synthetic

SEQ ID NO: 362598 - DNA, 140 bp, Artificial Sequence; identical to SEQ ID NO: 6120
  Synthetic

SEQ ID NO: 362599 - DNA, 140 bp, Artificial Sequence
  Synthetic
atacgccatgctgggtctccgtaccacaaaagtatctccaggcggtgcacactgcctgtgaccgccattgtgtcatcgttgcattacgaaggcaaaatgcgcactacgaatgagtacaaccgtacttgggagtcggccat

SEQ ID NO: 362600 - DNA, 140 bp, Artificial Sequence
  Synthetic
atggccgactcccaagtacggttgtactcattcgtagtgcgcattttgccttcgtaatgcaacgatgacacaatggcggtcacaggcagtgtgcaccgcctggagatacttttgtggtacggagacccagcatggcgtat

SEQ ID NO: 362601 - DNA, 140 bp, Artificial Sequence
  Synthetic
atacgccatgctgggtctccacggtaaagagctaccttgcagcacgtacgtgcagagcaccgccgcaactaccgaggagatagaggtacacatgcccccagacacccctgatcgcacattcgtacttgggagtcggccat

SEQ ID NO: 362602 - DNA, 140 bp, Artificial Sequence
  Synthetic
atggccgactcccaagtacgaatgtgcgatcaggggtgtctgggggcatgtgtacctctatctcctcggtagttgcggcggtgctctgcacgtacgtgctgcaaggtagctctttaccgtggagacccagcatggcgtat

SEQ ID NO: 362603 - DNA, 140 bp, Artificial Sequence
  Synthetic
atacgccatgctgggtctccgagacttcctacccggtgaagtggatgatttgacagatagcgactggtccacgtgcccagacacggacgacgagttagacagggcaggtgggtatatattcgtacttgggagtcggccat

SEQ ID NO: 362604 - DNA, 140 bp, Artificial Sequence
  Synthetic
atggccgactcccaagtacgaatatatacccacctgccctgtctaactcgtcgtccgtgtctgggcacgtggaccagtcgctatctgtcaaatcatccacttcaccgggtaggaagtctcggagacccagcatggcgtat

SEQ ID NO: 362605 - DNA, 140 bp, Artificial Sequence
  Synthetic
atacgccatgctgggtctcctcaccatccctacaggtgcgggcaaaccaggggacagcggtagaccgatcttcgacaacaagggacgcgtggtggccatagtcttaggaggagctaatgacgtacttgggagtcggccat

SEQ ID NO: 362606 - DNA, 140 bp, Artificial Sequence
  Synthetic
atggccgactcccaagtacgtcattagctcctcctaagactatggccaccacgcgtcccttgttgtcgaagatcggtctaccgctgtcccctggtttgcccgcacctgtagggatggtgaggagacccagcatggcgtat

SEQ ID NO: 362607 - DNA, 140 bp, Artificial Sequence; identical to SEQ ID NO: 11911
  Synthetic

SEQ ID NO: 362608 - DNA, 140 bp, Artificial Sequence; identical to SEQ ID NO: 11912
  Synthetic

SEQ ID NO: 362609 - DNA, 140 bp, Artificial Sequence
  Synthetic
aggccctggctgctgatatgtgaccggcatccttgctacagaagtcacgccggaggatgcacagaagctgttggtggggctgaaccagagaatagtggttaacggcagaacgcaacggaagaccttttgggacagcggtg

SEQ ID NO: 362610 - DNA, 140 bp, Artificial Sequence
  Synthetic
caccgctgtcccaaaaggtcttccgttgcgttctgccgttaaccactattctctggttcagccccaccaacagcttctgtgcatcctccggcgtgacttctgtagcaaggatgccggtcacatatcagcagccagggcct

SEQ ID NO: 362611 - DNA, 140 bp, Artificial Sequence
  Synthetic
atacgccatgctgggtctccatgtgcggtacgtatccagtaatccacgccgttggaccaaacttctctaattattcggagtctgaaggggaccgggaattggcagctgcctatcgagaagcgtacttgggagtcggccat

SEQ ID NO: 362612 - DNA, 140 bp, Artificial Sequence
  Synthetic
atggccgactcccaagtacgcttctcgataggcagctgccaattcccggtccccttcagactccgaataattagagaagtttggtccaacggcgtggattactggatacgtaccgcacatggagacccagcatggcgtat

SEQ ID NO: 362613 - DNA, 140 bp, Artificial Sequence
  Synthetic
aggccctggctgctgatatgttattcggagtctgaaggggaccgggaattggcagctgcctatcgagaagtcgcaaaggaagtaactagactgggagtaaatagtgtagctatacctctcgaccttttgggacagcggtg

SEQ ID NO: 362614 - DNA, 140 bp, Artificial Sequence
  Synthetic
caccgctgtcccaaaaggtcgagaggtatagctacactatttactcccagtctagttacttcctttgcgacttctcgataggcagctgccaattcccggtccccttcagactccgaataacatatcagcagccagggcct

SEQ ID NO: 362615 - DNA, 140 bp, Artificial Sequence
  Synthetic
atacgccatgctgggtctcctcgcaaaggaagtaactagactgggagtaaatagtgtagctatacctctcctctccacaggtgtatactcaggagggaaagacaggctgacccagtcactcgtacttgggagtcggccat

SEQ ID NO: 362616 - DNA, 140 bp, Artificial Sequence
  Synthetic
atggccgactcccaagtacgagtgactgggtcagcctgtctttccctcctgagtatacacctgtggagaggagaggtatagctacactatttactcccagtctagttacttcctttgcgaggagacccagcatggcgtat

SEQ ID NO: 362617 - DNA, 140 bp, Artificial Sequence
  Synthetic
atacgccatgctgggtctcctgagctactaactttcggagacttcctacccggtgaagtggatgatttgacagatagcgactggtccacgtgctcagacacggacgacgagttatgactacgtacttgggagtcggccat

SEQ ID NO: 362618 - DNA, 140 bp, Artificial Sequence
  Synthetic
atggccgactcccaagtacgtagtcataactcgtcgtccgtgtctgagcacgtggaccagtcgctatctgtcaaatcatccacttcaccgggtaggaagtctccgaaagttagtagctcaggagacccagcatggcgtat

SEQ ID NO: 362619 - DNA, 140 bp, Artificial Sequence
  Synthetic
atacgccatgctgggtctcccaacgagaagagacgtaggtatttaagcttcctaaaagcagccgaactcactttgagacgtaggcatagcataccgaactcttccactattctccgaacccgtacttgggagtcggccat

SEQ ID NO: 362620 - DNA, 140 bp, Artificial Sequence
  Synthetic
atggccgactcccaagtacgggttcggagaatagtggaagagttcggtatgctatgcctacgtctcaaagtgagttcggctgcttttaggaagcttaaatacctacgtctcttctcgttgggagacccagcatggcgtat

SEQ ID NO: 362621 - DNA, 140 bp, Artificial Sequence
  Synthetic
aggccctggctgctgatatgagaaaaaccataaacagaagtagttcaaagggctataaaacccctgaatagtaacaaaacataaaattaataaaaatcaaatgaataccataattggcaagaccttttgggacagcggtg

SEQ ID NO: 362622 - DNA, 140 bp, Artificial Sequence
  Synthetic
caccgctgtcccaaaaggtcttgccaattatggtattcatttgatttttattaattttatgttttgttactattcaggggttttatagccctttgaactacttctgtttatggtttttctcatatcagcagccagggcct

SEQ ID NO: 362623 - DNA, 140 bp, Artificial Sequence
  Synthetic
atacgccatgctgggtctccgccaaaaaccgacctgatcccatacagcggagacgcccgagaagcccgggacgcagaaaaagaagcagaggaagaacgagaagcagaactgactcgcgaacgtacttgggagtcggccat

SEQ ID NO: 362624 - DNA, 140 bp, Artificial Sequence
  Synthetic
atggccgactcccaagtacgttcgcgagtcagttctgcttctcgttcttcctctgcttctttttctgcgtcccgggcttctcgggcgtctccgctgtatgggatcaggtcggtttttggcggagacccagcatggcgtat

SEQ ID NO: 362625 - DNA, 140 bp, Artificial Sequence
  Synthetic
aggccctggctgctgatatgctcgacggatgcagacgtggtcatctactgccgcgacaaagaatgggagaagaaaatatctgaggccatacagatgcggacccaagtggagctgctggatgaccttttgggacagcggtg

SEQ ID NO: 362626 - DNA, 140 bp, Artificial Sequence
  Synthetic
caccgctgtcccaaaaggtcatccagcagctccacttgggtccgcatctgtatggcctcagatattttcttctcccattctttgtcgcggcagtagatgaccacgtctgcatccgtcgagcatatcagcagccagggcct

SEQ ID NO: 362627 - DNA, 140 bp, Artificial Sequence
  Synthetic
aggccctggctgctgatatgcaacgccgcaactgccgaggagatagaggtacacatgcccccagacacccctgatcgcacattgctgtcacaacagtccggcaacgtaaagatcacagtcgaccttttgggacagcggtg

SEQ ID NO: 362628 - DNA, 140 bp, Artificial Sequence
  Synthetic
caccgctgtcccaaaaggtcgactgtgatctttacgttgccggactgttgtgacagcaatgtgcgatcaggggtgtctgggggcatgtgtacctctatctcctcggcagttgcggcgttgcatatcagcagccagggcct

SEQ ID NO: 362629 - DNA, 140 bp, Artificial Sequence
  Synthetic
aggccctggctgctgatatgctgatcgcacattgctgtcacaacagtccggcaacgtaaagatcacagtcaacggccggacggtgcggtataagtgtaattgcggtggctcaaatgaagggaccttttgggacagcggtg

SEQ ID NO: 362630 - DNA, 140 bp, Artificial Sequence
  Synthetic
caccgctgtcccaaaaggtcccttcatttgagccaccgcaattacacttataccgcaccgtccggccgttgactgtgatctttacgttgccggactgttgtgacagcaatgtgcgatcagcatatcagcagccagggcct

SEQ ID NO: 362631 - DNA, 140 bp, Artificial Sequence
  Synthetic
aggccctggctgctgatatgatggaatggctggttaacaagataaacggccaccacgtgctcctggtcagtggctgtagccttgcactgcctactaagagagtcacttgggtagcgccacgaccttttgggacagcggtg

SEQ ID NO: 362632 - DNA, 140 bp, Artificial Sequence
  Synthetic
caccgctgtcccaaaaggtcgtggcgctacccaagtgactctcttagtaggcagtgcaaggctacagccactgaccaggagcacgtggtggccgtttatcttgttaaccagccattccatcatatcagcagccagggcct

SEQ ID NO: 362633 - DNA, 140 bp, Artificial Sequence
  Synthetic
aggccctggctgctgatatgagaggaaagacctaaggtgcaggttatacaggcggctgaacccttggcaacagcgtacctatgtggaattcacagagaattggttaggagattgaacgccgaccttttgggacagcggtg

SEQ ID NO: 362634 - DNA, 140 bp, Artificial Sequence
  Synthetic
caccgctgtcccaaaaggtcggcgttcaatctcctaaccaattctctgtgaattccacataggtacgctgttgccaagggttcagccgcctgtataacctgcaccttaggtctttcctctcatatcagcagccagggcct

SEQ ID NO: 362635 - DNA, 140 bp, Artificial Sequence; identical to SEQ ID NO: 5891
  Synthetic

SEQ ID NO: 362636 - DNA, 140 bp, Artificial Sequence; identical to SEQ ID NO: 5892
  Synthetic

SEQ ID NO: 362637 - DNA, 140 bp, Artificial Sequence
  Synthetic
aggccctggctgctgatatggacacacacgttgccatccacaactggaaaccttgcggccgtgtctgactgggtaatgagcaccgtacctgtcgcgccgcccagaagaaggcgagggagagaccttttgggacagcggtg

SEQ ID NO: 362638 - DNA, 140 bp, Artificial Sequence
  Synthetic
caccgctgtcccaaaaggtctctccctcgccttcttctgggcggcgcgacaggtacggtgctcattacccagtcagacacggccgcaaggtttccagttgtggatggcaacgtgtgtgtccatatcagcagccagggcct

SEQ ID NO: 362639 - DNA, 140 bp, Artificial Sequence
  Synthetic
atacgccatgctgggtctccgccttaatgctgttagaagatttgggagtggatcactccctgttggacttgatagaggctgcttttggagagatttccagctgtcacctgccgacaggtacgtacttgggagtcggccat

SEQ ID NO: 362640 - DNA, 140 bp, Artificial Sequence
  Synthetic
atggccgactcccaagtacgtacctgtcggcaggtgacagctggaaatctctccaaaagcagcctctatcaagtccaacagggagtgatccactcccaaatcttctaacagcattaaggcggagacccagcatggcgtat

SEQ ID NO: 362641 - DNA, 140 bp, Artificial Sequence
  Synthetic
atacgccatgctgggtctccgcccagaagaaggcgagggagaaacctgactgtgacatgcgacgagagggcagagctgtgtccagtcgtacaagaaacagcggagacgcgtgacacagctcgtacttgggagtcggccat

SEQ ID NO: 362642 - DNA, 140 bp, Artificial Sequence
  Synthetic
atggccgactcccaagtacgagctgtgtcacgcgtctccgctgtttcttgtacgactggacacagctctgccctctcgtcgcatgtcacagtcaggtttctccctcgccttcttctgggcggagacccagcatggcgtat

SEQ ID NO: 362643 - DNA, 140 bp, Artificial Sequence; identical to SEQ ID NO: 11313
  Synthetic

SEQ ID NO: 362644 - DNA, 140 bp, Artificial Sequence; identical to SEQ ID NO: 11314
  Synthetic

SEQ ID NO: 362645 - DNA, 140 bp, Artificial Sequence
  Synthetic
aggccctggctgctgatatggcaactattacttaagaaactccaggagagtgcatccatggccaacagaagcaggtatcagtcgcgcaaagtagaaaacatgaaagcaacaatcatccaggaccttttgggacagcggtg

SEQ ID NO: 362646 - DNA, 140 bp, Artificial Sequence
  Synthetic
caccgctgtcccaaaaggtcctggatgattgttgctttcatgttttctactttgcgcgactgatacctgcttctgttggccatggatgcactctcctggagtttcttaagtaatagttgccatatcagcagccagggcct

SEQ ID NO: 362647 - DNA, 140 bp, Artificial Sequence; identical to SEQ ID NO: 11771
  Synthetic

SEQ ID NO: 362648 - DNA, 140 bp, Artificial Sequence; identical to SEQ ID NO: 11772
  Synthetic

SEQ ID NO: 362649 - DNA, 140 bp, Artificial Sequence; identical to SEQ ID NO: 5653
  Synthetic

SEQ ID NO: 362650 - DNA, 140 bp, Artificial Sequence; identical to SEQ ID NO: 5654
  Synthetic

SEQ ID NO: 362651 - DNA, 140 bp, Artificial Sequence
  Synthetic
atacgccatgctgggtctccctctttctcgacggccttagccagcgccgaattccgcgtacaagtctgttctacacaagtacactgtgcagccgagtgccaccccccgaaggaccacatacgtacttgggagtcggccat

SEQ ID NO: 362652 - DNA, 140 bp, Artificial Sequence
  Synthetic
atggccgactcccaagtacgtatgtggtccttcggggggtggcactcggctgcacagtgtacttgtgtagaacagacttgtacgcggaattcggcgctggctaaggccgtcgagaaagagggagacccagcatggcgtat

SEQ ID NO: 362653 - DNA, 140 bp, Artificial Sequence; identical to SEQ ID NO: 11321
  Synthetic

SEQ ID NO: 362654 - DNA, 140 bp, Artificial Sequence; identical to SEQ ID NO: 11322
  Synthetic

SEQ ID NO: 362655 - DNA, 140 bp, Artificial Sequence; identical to SEQ ID NO: 8087
  Synthetic

SEQ ID NO: 362656 - DNA, 140 bp, Artificial Sequence; identical to SEQ ID NO: 8088
  Synthetic

SEQ ID NO: 362657 - DNA, 140 bp, Artificial Sequence
  Synthetic
aggccctggctgctgatatgatttaacaacctatgttactaaactaaaggggccaaaagcagcagcgctatttgcaaaaacccataatctgctgccactgcaggaagtgccaatggataggaccttttgggacagcggtg

SEQ ID NO: 362658 - DNA, 140 bp, Artificial Sequence
  Synthetic
caccgctgtcccaaaaggtcctatccattggcacttcctgcagtggcagcagattatgggtttttgcaaatagcgctgctgcttttggcccctttagtttagtaacataggttgttaaatcatatcagcagccagggcct

SEQ ID NO: 362659 - DNA, 140 bp, Artificial Sequence
  Synthetic
aggccctggctgctgatatggtaggcatagcataccgaactcttccacgattctccgaacccacagggacgtaggagatgttattttgtttttaatatttcaaaaaaaaaaaaaaaaaaagaccttttgggacagcggtg

SEQ ID NO: 362660 - DNA, 140 bp, Artificial Sequence
  Synthetic
caccgctgtcccaaaaggtctttttttttttttttttttgaaatattaaaaacaaaataacatctcctacgtccctgtgggttcggagaatcgtggaagagttcggtatgctatgcctaccatatcagcagccagggcct

SEQ ID NO: 362661 - DNA, 140 bp, Artificial Sequence; identical to SEQ ID NO: 8445
  Synthetic

SEQ ID NO: 362662 - DNA, 140 bp, Artificial Sequence; identical to SEQ ID NO: 8446
  Synthetic

SEQ ID NO: 362663 - DNA, 140 bp, Artificial Sequence
  Synthetic
aggccctggctgctgatatgtaataaaaatcaaatgaataccataattggcaaacggaagagatgtaggtacttaagcttcctaaaagcagccgaactcactttgagaagtaggcatagcgaccttttgggacagcggtg

SEQ ID NO: 362664 - DNA, 140 bp, Artificial Sequence
  Synthetic
caccgctgtcccaaaaggtcgctatgcctacttctcaaagtgagttcggctgcttttaggaagcttaagtacctacatctcttccgtttgccaattatggtattcatttgatttttattacatatcagcagccagggcct

SEQ ID NO: 362665 - DNA, 140 bp, Artificial Sequence
  Synthetic
aggccctggctgctgatatgggccaacgagcaagtctgcctatatgccctgggggaaagtattgaatcgatcaggcagaaatgcccggtggatgatgcagatgcatcatctccccccaaagaccttttgggacagcggtg

SEQ ID NO: 362666 - DNA, 140 bp, Artificial Sequence
  Synthetic
caccgctgtcccaaaaggtctttggggggagatgatgcatctgcatcatccaccgggcatttctgcctgatcgattcaatactttcccccagggcatataggcagacttgctcgttggcccatatcagcagccagggcct

SEQ ID NO: 362667 - DNA, 140 bp, Artificial Sequence
  Synthetic
aggccctggctgctgatatgtcatgagccccgggtactatcagctgctacaagcatccttaacatgttctccccgacgccagcgacgcagtattaaggacaacttcaatgtctataaagcgaccttttgggacagcggtg

SEQ ID NO: 362668 - DNA, 140 bp, Artificial Sequence
  Synthetic
caccgctgtcccaaaaggtcgctttatagacattgaagttgtccttaatactgcgtcgctggcgtcggggagaacatgttaaggatgcttgtagcagctgatagtacccggggctcatgacatatcagcagccagggcct

SEQ ID NO: 362669 - DNA, 140 bp, Artificial Sequence
  Synthetic
atacgccatgctgggtctccacaagaagtaagttcgaccacgtcactgacgcacagccaattcgaccttagcgttgacggtgaggtactgcccgctccgtctgacctggaagctgatgctcgtacttgggagtcggccat

SEQ ID NO: 362670 - DNA, 140 bp, Artificial Sequence
  Synthetic
atggccgactcccaagtacgagcatcagcttccaggtcagacggagcgggcagtacctcaccgtcaacgctaaggtcgaattggctgtgcgtcagtgacgtggtcgaacttacttcttgtggagacccagcatggcgtat

SEQ ID NO: 362671 - DNA, 140 bp, Artificial Sequence
  Synthetic
aggccctggctgctgatatgacgtagcctaccagtttcttactgctctactctgcttagcaagagacttgagaacccatcatggatcccgtgtacgtggacatagacgccgacagcgcctgaccttttgggacagcggtg

SEQ ID NO: 362672 - DNA, 140 bp, Artificial Sequence
  Synthetic
caccgctgtcccaaaaggtcaggcgctgtcggcgtctatgtccacgtacacgggatccatgatgggttctcaagtctcttgctaagcagagtagagcagtaagaaactggtaggctacgtcatatcagcagccagggcct

SEQ ID NO: 362673 - DNA, 140 bp, Artificial Sequence; identical to SEQ ID NO: 7665
  Synthetic

SEQ ID NO: 362674 - DNA, 140 bp, Artificial Sequence; identical to SEQ ID NO: 7666
  Synthetic

SEQ ID NO: 362675 - DNA, 140 bp, Artificial Sequence
  Synthetic
aggccctggctgctgatatgtaggcagcgcgccagcaaggaggatgatgtcggataggaagtaccactgcgtttgcccaatgcgcagcgcagaagaccctgagagactcgccaactacgcgaccttttgggacagcggtg

SEQ ID NO: 362676 - DNA, 140 bp, Artificial Sequence
  Synthetic
caccgctgtcccaaaaggtcgcgtagttggcgagtctctcagggtcttctgcgctgcgcattgggcaaacgcagtggtacttcctatccgacatcatcctccttgctggcgcgctgcctacatatcagcagccagggcct

SEQ ID NO: 362677 - DNA, 140 bp, Artificial Sequence
  Synthetic
aggccctggctgctgatatggcttgcagagtggcagacccgctaaaaaggctatttaaactgggcaaaccgctagcggcaggtgacgaacaagatgaggatagaagacgagcgctggctggaccttttgggacagcggtg

SEQ ID NO: 362678 - DNA, 140 bp, Artificial Sequence
  Synthetic
caccgctgtcccaaaaggtccagccagcgctcgtcttctatcctcatcttgttcgtcacctgccgctagcggtttgcccagtttaaatagcctttttagcgggtctgccactctgcaagccatatcagcagccagggcct

SEQ ID NO: 362679 - DNA, 140 bp, Artificial Sequence
  Synthetic
aggccctggctgctgatatggagaaaactagcatctgccgcaggaaaagtcttggacagaaacatctccggaaaaatcggagatctacaagcagtaatggctgtaccagacgcagaaacggaccttttgggacagcggtg

SEQ ID NO: 362680 - DNA, 140 bp, Artificial Sequence
  Synthetic
caccgctgtcccaaaaggtccgtttctgcgtctggtacagccattactgcttgtagatctccgatttttccggagatgtttctgtccaagacttttcctgcggcagatgctagttttctccatatcagcagccagggcct

SEQ ID NO: 362681 - DNA, 140 bp, Artificial Sequence
  Synthetic
aggccctggctgctgatatgactccaggagagtgcgtccacggccaatagaagcaggtatcaatcacgcaaggtggaaaatatgaaagcaacaatcatccaaagactgaagagaggctgtgaccttttgggacagcggtg

SEQ ID NO: 362682 - DNA, 140 bp, Artificial Sequence
  Synthetic
caccgctgtcccaaaaggtcacagcctctcttcagtctttggatgattgttgctttcatattttccaccttgcgtgattgatacctgcttctattggccgtggacgcactctcctggagtcatatcagcagccagggcct

SEQ ID NO: 362683 - DNA, 140 bp, Artificial Sequence
  Synthetic
aggccctggctgctgatatgtctccacaggtgtatactcaggagggaaagacaggctgacccagtcactgaaccacctctttacagccatggactcgacggatgcagacgtggtcatctagaccttttgggacagcggtg

SEQ ID NO: 362684 - DNA, 140 bp, Artificial Sequence
  Synthetic
caccgctgtcccaaaaggtctagatgaccacgtctgcatccgtcgagtccatggctgtaaagaggtggttcagtgactgggtcagcctgtctttccctcctgagtatacacctgtggagacatatcagcagccagggcct

SEQ ID NO: 362685 - DNA, 140 bp, Artificial Sequence
  Synthetic
aggccctggctgctgatatgccgatggcgagacactgcctgtcccgtcagacctggatgctgacgccccagccctagaaccggccctagacgacggggcgatacatacgttaccaaccacgaccttttgggacagcggtg

SEQ ID NO: 362686 - DNA, 140 bp, Artificial Sequence
  Synthetic
caccgctgtcccaaaaggtcgtggttggtaacgtatgtatcgccccgtcgtctagggccggttctagggctggggcgtcagcatccaggtctgacgggacaggcagtgtctcgccatcggcatatcagcagccagggcct

SEQ ID NO: 362687 - DNA, 140 bp, Artificial Sequence
  Synthetic
aggccctggctgctgatatgaccaggcgattaaaggagtccgtgtagcatactggatagggtttgatacaaccccgttcatgtataatgccatggcaggtgcatacccctcgtactcgacgaccttttgggacagcggtg

SEQ ID NO: 362688 - DNA, 140 bp, Artificial Sequence
  Synthetic
caccgctgtcccaaaaggtcgtcgagtacgaggggtatgcacctgccatggcattatacatgaacggggttgtatcaaaccctatccagtatgctacacggactcctttaatcgcctggtcatatcagcagccagggcct

SEQ ID NO: 362689 - DNA, 140 bp, Artificial Sequence
  Synthetic
aggccctggctgctgatatgaaactgggcagatgagcaggtgctgaaggcaaagaacataggattatgttcaacagacctgacggaaggtagacgaggtaaactgtctatcatgagaggagaccttttgggacagcggtg

SEQ ID NO: 362690 - DNA, 140 bp, Artificial Sequence
  Synthetic
caccgctgtcccaaaaggtctcctctcatgatagacagtttacctcgtctaccttccgtcaggtctgttgaacataatcctatgttctttgccttcagcacctgctcatctgcccagtttcatatcagcagccagggcct

SEQ ID NO: 362691 - DNA, 140 bp, Artificial Sequence
  Synthetic
aggccctggctgctgatatgttacccggagagccgtaagcttcttaagagttggcacttaccttcagtgttccacctaaaagggaagctcagcttcacgtgccgctgtgatacagtggttgaccttttgggacagcggtg

SEQ ID NO: 362692 - DNA, 140 bp, Artificial Sequence
  Synthetic
caccgctgtcccaaaaggtcaaccactgtatcacagcggcacgtgaagctgagcttcccttttaggtggaacactgaaggtaagtgccaactcttaagaagcttacggctctccgggtaacatatcagcagccagggcct

SEQ ID NO: 362693 - DNA, 140 bp, Artificial Sequence
  Synthetic
aggccctggctgctgatatgacatcagcaccgtgcacgattactggaacaatgggacacttcatcctggcccgatgtccgaaaggggaaactctgacggtgggattcactgacagtaggagaccttttgggacagcggtg

SEQ ID NO: 362694 - DNA, 140 bp, Artificial Sequence
  Synthetic
caccgctgtcccaaaaggtctcctactgtcagtgaatcccaccgtcagagtttcccctttcggacatcgggccaggatgaagtgtcccattgttccagtaatcgtgcacggtgctgatgtcatatcagcagccagggcct

SEQ ID NO: 362695 - DNA, 140 bp, Artificial Sequence
  Synthetic
aggccctggctgctgatatgaattacttgcttcctgtggttgcccaagccttcagtaagtgggcaaaggaatgccggaaagatatggaagatgaaaaacttttgggcatcagagaaaggagaccttttgggacagcggtg

SEQ ID NO: 362696 - DNA, 140 bp, Artificial Sequence
  Synthetic
caccgctgtcccaaaaggtctcctttctctgatgcccaaaagtttttcatcttccatatctttccggcattcctttgcccacttactgaaggcttgggcaaccacaggaagcaagtaattcatatcagcagccagggcct

SEQ ID NO: 362697 - DNA, 140 bp, Artificial Sequence
  Synthetic
aggccctggctgctgatatgcactgacatgctgctgcctttgggcgttcaagaagcagaagacacacacggtctacaagaggcctgacactcagtcaattcagaaagtcccagccgaattgaccttttgggacagcggtg

SEQ ID NO: 362698 - DNA, 140 bp, Artificial Sequence
  Synthetic
caccgctgtcccaaaaggtcaattcggctgggactttctgaattgactgagtgtcaggcctcttgtagaccgtgtgtgtcttctgcttcttgaacgcccaaaggcagcagcatgtcagtgcatatcagcagccagggcct

SEQ ID NO: 362699 - DNA, 140 bp, Artificial Sequence; identical to SEQ ID NO: 5587
  Synthetic

SEQ ID NO: 362700 - DNA, 140 bp, Artificial Sequence; identical to SEQ ID NO: 5588
  Synthetic

SEQ ID NO: 362701 - DNA, 140 bp, Artificial Sequence
  Synthetic
aggccctggctgctgatatgtacggaccagaatcaagtggctgctaagcaaagtgccaaagactgatttgatcccttacagcggtgacgccaaagaagcccgcgacgctgaaaaagaagcgaccttttgggacagcggtg

SEQ ID NO: 362702 - DNA, 140 bp, Artificial Sequence
  Synthetic
caccgctgtcccaaaaggtcgcttctttttcagcgtcgcgggcttctttggcgtcaccgctgtaagggatcaaatcagtctttggcactttgcttagcagccacttgattctggtccgtacatatcagcagccagggcct

SEQ ID NO: 362703 - DNA, 140 bp, Artificial Sequence; identical to SEQ ID NO: 11601
  Synthetic

SEQ ID NO: 362704 - DNA, 140 bp, Artificial Sequence; identical to SEQ ID NO: 11602
  Synthetic

SEQ ID NO: 362705 - DNA, 140 bp, Artificial Sequence
  Synthetic
aggccctggctgctgatatgagaagaagaacgagaagcggagctaactcgcgaggcactaccaccactacaggcggcacaggatgacgtccaggtcgaaattgacgtggaacagctcgaagaccttttgggacagcggtg

SEQ ID NO: 362706 - DNA, 140 bp, Artificial Sequence
  Synthetic
caccgctgtcccaaaaggtcttcgagctgttccacgtcaatttcgacctggacgtcatcctgtgccgcctgtagtggtggtagtgcctcgcgagttagctccgcttctcgttcttcttctcatatcagcagccagggcct

SEQ ID NO: 362707 - DNA, 140 bp, Artificial Sequence
  Synthetic
aggccctggctgctgatatggacagagctggggcaggaataattgaaactccaagaggagccatcaaagtcactgcccaaccaacagaccacgtcgtgggagagtacttggtactttcccgaccttttgggacagcggtg

SEQ ID NO: 362708 - DNA, 140 bp, Artificial Sequence
  Synthetic
caccgctgtcccaaaaggtcgggaaagtaccaagtactctcccacgacgtggtctgttggttgggcagtgactttgatggctcctcttggagtttcaattattcctgccccagctctgtccatatcagcagccagggcct

SEQ ID NO: 362709 - DNA, 140 bp, Artificial Sequence
  Synthetic
aggccctggctgctgatatgcgcagaccgtgttacgaagccagaagctcagcctgatccacgcattggcggaacaagtgaagacatgcacacacagcggacgagcaggaaggtacgcggtgaccttttgggacagcggtg

SEQ ID NO: 362710 - DNA, 140 bp, Artificial Sequence
  Synthetic
caccgctgtcccaaaaggtcaccgcgtaccttcctgctcgtccgctgtgtgtgcatgtcttcacttgttccgccaatgcgtggatcaggctgagcttctggcttcgtaacacggtctgcgcatatcagcagccagggcct

SEQ ID NO: 362711 - DNA, 140 bp, Artificial Sequence
  Synthetic
atacgccatgctgggtctcctatctgcttatgcaaacggcgaccatgccgtcacagttaaggacgctaaattcatagtggggccaatgtcttcagcctggacacctttcgacaataaaatcgtacttgggagtcggccat

SEQ ID NO: 362712 - DNA, 140 bp, Artificial Sequence
  Synthetic
atggccgactcccaagtacgattttattgtcgaaaggtgtccaggctgaagacattggccccactatgaatttagcgtccttaactgtgacggcatggtcgccgtttgcataagcagataggagacccagcatggcgtat

SEQ ID NO: 362713 - DNA, 140 bp, Artificial Sequence; identical to SEQ ID NO: 6107
  Synthetic

SEQ ID NO: 362714 - DNA, 140 bp, Artificial Sequence; identical to SEQ ID NO: 6108
  Synthetic

SEQ ID NO: 362715 - DNA, 140 bp, Artificial Sequence
  Synthetic
atacgccatgctgggtctccctctgacggtgggattcactgacagtaggaagattagtcactcatgtacgcacccatttcaccacgaccctcctgtgataggccgggaaaaattccattccgtacttgggagtcggccat

SEQ ID NO: 362716 - DNA, 140 bp, Artificial Sequence
  Synthetic
atggccgactcccaagtacggaatggaatttttcccggcctatcacaggagggtcgtggtgaaatgggtgcgtacatgagtgactaatcttcctactgtcagtgaatcccaccgtcagagggagacccagcatggcgtat

SEQ ID NO: 362717 - DNA, 140 bp, Artificial Sequence
  Synthetic
aggccctggctgctgatatgcctgaacactgacgaggagtcgtacgagctggtaagggcagaaaggacagagcatgagtacgtctatgatgtggaccaaagaaggtgctgcaagaaagaggaccttttgggacagcggtg

SEQ ID NO: 362718 - DNA, 140 bp, Artificial Sequence
  Synthetic
caccgctgtcccaaaaggtcctctttcttgcagcaccttctttggtccacatcatagacgtactcatgctctgtcctttctgcccttaccagctcgtacgactcctcgtcagtgttcaggcatatcagcagccagggcct

SEQ ID NO: 362719 - DNA, 140 bp, Artificial Sequence
  Synthetic
atacgccatgctgggtctccccgaccgcagcacggtaaagagctaccttgcagcacatacgtgcagagcaccgccgcaactgccgatgagatagaggtacacgtgcccccagacacccctcgtacttgggagtcggccat

SEQ ID NO: 362720 - DNA, 140 bp, Artificial Sequence
  Synthetic
atggccgactcccaagtacgaggggtgtctgggggcacgtgtacctctatctcatcggcagttgcggcggtgctctgcacgtatgtgctgcaaggtagctctttaccgtgctgcggtcggggagacccagcatggcgtat

SEQ ID NO: 362721 - DNA, 140 bp, Artificial Sequence
  Synthetic
aggccctggctgctgatatggaggcagccgggctggtactggtcggcgacttgaccaacccgccctaccatgagttcgcatatgaagggctgagaatccgccccgcctgcccatacaagagaccttttgggacagcggtg

SEQ ID NO: 362722 - DNA, 140 bp, Artificial Sequence
  Synthetic
caccgctgtcccaaaaggtctcttgtatgggcaggcggggcggattctcagcccttcatatgcgaactcatggtagggcgggttggtcaagtcgccgaccagtaccagcccggctgcctccatatcagcagccagggcct

SEQ ID NO: 362723 - DNA, 140 bp, Artificial Sequence; identical to SEQ ID NO: 8301
  Synthetic

SEQ ID NO: 362724 - DNA, 140 bp, Artificial Sequence; identical to SEQ ID NO: 8302
  Synthetic

SEQ ID NO: 362725 - DNA, 140 bp, Artificial Sequence
  Synthetic
aggccctggctgctgatatgtatctgcacgcacggtcgactcactgctcttgaacggatgcaatagaccagtcgacgtgttgtacgtcgacgaagcgtttgcgtgccattctggcacgctgaccttttgggacagcggtg

SEQ ID NO: 362726 - DNA, 140 bp, Artificial Sequence
  Synthetic
caccgctgtcccaaaaggtcagcgtgccagaatggcacgcaaacgcttcgtcgacgtacaacacgtcgactggtctattgcatccgttcaagagcagtgagtcgaccgtgcgtgcagatacatatcagcagccagggcct

SEQ ID NO: 362727 - DNA, 140 bp, Artificial Sequence
  Synthetic
aggccctggctgctgatatgacttgccctgatagccttggtgagaccgaggcagaaagtcgtgctatgcggtgatccgaaacagtgcggcttcttcaatatgatgcagatgaaagttaacgaccttttgggacagcggtg

SEQ ID NO: 362728 - DNA, 140 bp, Artificial Sequence
  Synthetic
caccgctgtcccaaaaggtcgttaactttcatctgcatcatattgaagaagccgcactgtttcggatcaccgcatagcacgactttctgcctcggtctcaccaaggctatcagggcaagtcatatcagcagccagggcct

SEQ ID NO: 362729 - DNA, 140 bp, Artificial Sequence
  Synthetic
aggccctggctgctgatatgtacaaccataacatctgcacccaagtgtaccataaaagtatttccaggcggtgtacactgcctgtgactgccattgtgtcctcgttgcattacgaaggcagaccttttgggacagcggtg

SEQ ID NO: 362730 - DNA, 140 bp, Artificial Sequence
  Synthetic
caccgctgtcccaaaaggtctgccttcgtaatgcaacgaggacacaatggcagtcacaggcagtgtacaccgcctggaaatacttttatggtacacttgggtgcagatgttatggttgtacatatcagcagccagggcct

SEQ ID NO: 362731 - DNA, 140 bp, Artificial Sequence
  Synthetic
atacgccatgctgggtctccatccaaagtcgcacacctgagagtaaagacgtctatgctaatacacaactggtactgcagagaccggctgcgggtacggtacatgtgccatactctcaggcgtacttgggagtcggccat

SEQ ID NO: 362732 - DNA, 140 bp, Artificial Sequence
  Synthetic
atggccgactcccaagtacgcctgagagtatggcacatgtaccgtacccgcagccggtctctgcagtaccagttgtgtattagcatagacgtctttactctcaggtgtgcgactttggatggagacccagcatggcgtat

SEQ ID NO: 362733 - DNA, 140 bp, Artificial Sequence; identical to SEQ ID NO: 8309
  Synthetic

SEQ ID NO: 362734 - DNA, 140 bp, Artificial Sequence; identical to SEQ ID NO: 8310
  Synthetic

SEQ ID NO: 362735 - DNA, 140 bp, Artificial Sequence
  Synthetic
aggccctggctgctgatatgatgagctgtaccctactatgactgtagtagttgtgtcagtggcctcgttcatactcctgtcgatggtgggtatggcagtggggatgtgcatgtgtgcacggaccttttgggacagcggtg

SEQ ID NO: 362736 - DNA, 140 bp, Artificial Sequence
  Synthetic
caccgctgtcccaaaaggtccgtgcacacatgcacatccccactgccatacccaccatcgacaggagtatgaacgaggccactgacacaactactacagtcatagtagggtacagctcatcatatcagcagccagggcct

SEQ ID NO: 362737 - DNA, 140 bp, Artificial Sequence
  Synthetic
aggccctggctgctgatatggtgggttaagcaactgcaaattgactatcgtggacacgaggtcatgacagcagctgcatctcaggggctaaccagaaaaggggtctatgccgtcaggcaagaccttttgggacagcggtg

SEQ ID NO: 362738 - DNA, 140 bp, Artificial Sequence
  Synthetic
caccgctgtcccaaaaggtcttgcctgacggcatagaccccttttctggttagcccctgagatgcagctgctgtcatgacctcgtgtccacgatagtcaatttgcagttgcttaacccaccatatcagcagccagggcct

SEQ ID NO: 362739 - DNA, 140 bp, Artificial Sequence
  Synthetic
aggccctggctgctgatatgaaagtcaatgaaaaccccctttacgcatcaacatcagagcacgtgaacgtgctactgacgcgtacggaaggcaaactagtatggaagacactttctggaggaccttttgggacagcggtg

SEQ ID NO: 362740 - DNA, 140 bp, Artificial Sequence
  Synthetic
caccgctgtcccaaaaggtcctccagaaagtgtcttccatactagtttgccttccgtacgcgtcagtagcacgttcacgtgctctgatgttgatgcgtaaagggggttttcattgactttcatatcagcagccagggcct

SEQ ID NO: 362741 - DNA, 140 bp, Artificial Sequence; identical to SEQ ID NO: 6131
  Synthetic

SEQ ID NO: 362742 - DNA, 140 bp, Artificial Sequence; identical to SEQ ID NO: 6132
  Synthetic

SEQ ID NO: 362743 - DNA, 140 bp, Artificial Sequence
  Synthetic
atacgccatgctgggtctccaatcaggtatgttcctaactctgttcgtcaacacattgttaaacatcaccatcgccagccgagtgctggaagatcgtctgacaaaatccgcgtgcgcggccgtacttgggagtcggccat

SEQ ID NO: 362744 - DNA, 140 bp, Artificial Sequence
  Synthetic
atggccgactcccaagtacggccgcgcacgcggattttgtcagacgatcttccagcactcggctggcgatggtgatgtttaacaatgtgttgacgaacagagttaggaacatacctgattggagacccagcatggcgtat

SEQ ID NO: 362745 - DNA, 140 bp, Artificial Sequence
  Synthetic
aggccctggctgctgatatggggcgaagagcttagtccccatcctagaaacagcagggataaaactaaacgacaggcagtggtcccagataatccaggcttttaaagaagacagagcatagaccttttgggacagcggtg

SEQ ID NO: 362746 - DNA, 140 bp, Artificial Sequence
  Synthetic
caccgctgtcccaaaaggtctatgctctgtcttctttaaaagcctggattatctgggaccactgcctgtcgtttagttttatccctgctgtttctaggatggggactaagctcttcgccccatatcagcagccagggcct

SEQ ID NO: 362747 - DNA, 140 bp, Artificial Sequence; identical to SEQ ID NO: 7737
  Synthetic

SEQ ID NO: 362748 - DNA, 140 bp, Artificial Sequence; identical to SEQ ID NO: 7738
  Synthetic

SEQ ID NO: 362749 - DNA, 140 bp, Artificial Sequence
  Synthetic
aggccctggctgctgatatgcaggtgctggcaaaccaggggacagcggcagaccgatcttcgacaacaagggacgcgtggtggccatagtcttaggaggagctaatgaaggagcccgtacgaccttttgggacagcggtg

SEQ ID NO: 362750 - DNA, 140 bp, Artificial Sequence
  Synthetic
caccgctgtcccaaaaggtcgtacgggctccttcattagctcctcctaagactatggccaccacgcgtcccttgttgtcgaagatcggtctgccgctgtcccctggtttgccagcacctgcatatcagcagccagggcct

SEQ ID NO: 362751 - DNA, 140 bp, Artificial Sequence
  Synthetic
aggccctggctgctgatatgacctggacagcggactgttctctaaaccactggtgtccgtgcattatgcggataatcactgggacaacaggccgggagggaagatgttcggattcaacccgaccttttgggacagcggtg

SEQ ID NO: 362752 - DNA, 140 bp, Artificial Sequence
  Synthetic
caccgctgtcccaaaaggtcgggttgaatccgaacatcttccctcccggcctgttgtcccagtgattatccgcataatgcacggacaccagtggtttagagaacagtccgctgtccaggtcatatcagcagccagggcct

SEQ ID NO: 362753 - DNA, 140 bp, Artificial Sequence; identical to SEQ ID NO: 7745
  Synthetic

SEQ ID NO: 362754 - DNA, 140 bp, Artificial Sequence; identical to SEQ ID NO: 7746
  Synthetic

SEQ ID NO: 362755 - DNA, 140 bp, Artificial Sequence; identical to SEQ ID NO: 7747
  Synthetic

SEQ ID NO: 362756 - DNA, 140 bp, Artificial Sequence; identical to SEQ ID NO: 7748
  Synthetic

SEQ ID NO: 362757 - DNA, 140 bp, Artificial Sequence
  Synthetic
atacgccatgctgggtctccaaatcgtggtgtacaaaggtgacgtttacaacatggactacccgccctttggcgcaggaagaccaggacaatttggcgatatccaaagtcgcacgcctgacgtacttgggagtcggccat

SEQ ID NO: 362758 - DNA, 140 bp, Artificial Sequence
  Synthetic
atggccgactcccaagtacgtcaggcgtgcgactttggatatcgccaaattgtcctggtcttcctgcgccaaagggcgggtagtccatgttgtaaacgtcacctttgtacaccacgatttggagacccagcatggcgtat

SEQ ID NO: 362759 - DNA, 140 bp, Artificial Sequence; identical to SEQ ID NO: 6155
  Synthetic

SEQ ID NO: 362760 - DNA, 140 bp, Artificial Sequence; identical to SEQ ID NO: 6156
  Synthetic

SEQ ID NO: 362761 - DNA, 140 bp, Artificial Sequence; identical to SEQ ID NO: 8333
  Synthetic

SEQ ID NO: 362762 - DNA, 140 bp, Artificial Sequence; identical to SEQ ID NO: 8334
  Synthetic

SEQ ID NO: 362763 - DNA, 140 bp, Artificial Sequence
  Synthetic
aggccctggctgctgatatgcgatcatccagagcgttgaaaccgccgtgcgtcactagcaacaccgagatgtttttcttgttcagcaactttgataacggcagaaggaactttacaacgcgaccttttgggacagcggtg

SEQ ID NO: 362764 - DNA, 140 bp, Artificial Sequence
  Synthetic
caccgctgtcccaaaaggtcgcgttgtaaagttccttctgccgttatcaaagttgctgaacaagaaaaacatctcggtgttgctagtgacgcacggcggtttcaacgctctggatgatcgcatatcagcagccagggcct

SEQ ID NO: 362765 - DNA, 140 bp, Artificial Sequence
  Synthetic
aggccctggctgctgatatgcgatgaagagtgcgtagtcaacgccgccaaccctcgtgggctaccaggcgatggcgtctgtaaagcagtatacaaaaaatggccggagtccttcaagaacgaccttttgggacagcggtg

SEQ ID NO: 362766 - DNA, 140 bp, Artificial Sequence
  Synthetic
caccgctgtcccaaaaggtcgttcttgaaggactccggccattttttgtatactgctttacagacgccatcgcctggtagcccacgagggttggcggcgttgactacgcactcttcatcgcatatcagcagccagggcct

SEQ ID NO: 362767 - DNA, 140 bp, Artificial Sequence
  Synthetic
aggccctggctgctgatatgagtgcaacaccagtgggaaccgcaaagacagtcatgtgcggtacatacccggtaatccatgcagtaggacctaatttctcaaattactctgagtccgaaggaccttttgggacagcggtg

SEQ ID NO: 362768 - DNA, 140 bp, Artificial Sequence
  Synthetic
caccgctgtcccaaaaggtccttcggactcagagtaatttgagaaattaggtcctactgcatggattaccgggtatgtaccgcacatgactgtctttgcggttcccactggtgttgcactcatatcagcagccagggcct

SEQ ID NO: 362769 - DNA, 140 bp, Artificial Sequence
  Synthetic
aggccctggctgctgatatgggtgcagaagatcacgggaggtgtgggactggttgtcgctgttgcagcactgattctaatcgtggtgctatgcgtgtcgttcagcaggcactaacttgacgaccttttgggacagcggtg

SEQ ID NO: 362770 - DNA, 140 bp, Artificial Sequence
  Synthetic
caccgctgtcccaaaaggtcgtcaagttagtgcctgctgaacgacacgcatagcaccacgattagaatcagtgctgcaacagcgacaaccagtcccacacctcccgtgatcttctgcacccatatcagcagccagggcct

SEQ ID NO: 362771 - DNA, 140 bp, Artificial Sequence
  Synthetic
aggccctggctgctgatatgagactaggagtaaacagcgtagctataccgctcctttccaccggtgtgtactctggagggaaagacaggctgactcagtcattaaaccacctttttacaggaccttttgggacagcggtg

SEQ ID NO: 362772 - DNA, 140 bp, Artificial Sequence
  Synthetic
caccgctgtcccaaaaggtcctgtaaaaaggtggtttaatgactgagtcagcctgtctttccctccagagtacacaccggtggaaaggagcggtatagctacgctgtttactcctagtctcatatcagcagccagggcct

SEQ ID NO: 362773 - DNA, 140 bp, Artificial Sequence
  Synthetic
atacgccatgctgggtctccctctggagggaaagacaggctgactcagtcattaaaccacctttttacagcattagattcaactgatgcagatgtggttatctactgccgcgacaaggagcgtacttgggagtcggccat

SEQ ID NO: 362774 - DNA, 140 bp, Artificial Sequence
  Synthetic
atggccgactcccaagtacgctccttgtcgcggcagtagataaccacatctgcatcagttgaatctaatgctgtaaaaaggtggtttaatgactgagtcagcctgtctttccctccagagggagacccagcatggcgtat

SEQ ID NO: 362775 - DNA, 140 bp, Artificial Sequence
  Synthetic
aggccctggctgctgatatgcattagattcaactgatgcagatgtggttatctactgccgcgacaaggagtgggagaagaaaatagccgaggccatacaaatgaggacccaagtggaactgaccttttgggacagcggtg

SEQ ID NO: 362776 - DNA, 140 bp, Artificial Sequence
  Synthetic
caccgctgtcccaaaaggtcagttccacttgggtcctcatttgtatggcctcggctattttcttctcccactccttgtcgcggcagtagataaccacatctgcatcagttgaatctaatgcatatcagcagccagggcct

SEQ ID NO: 362777 - DNA, 140 bp, Artificial Sequence
  Synthetic
atacgccatgctgggtctcctgggagaagaaaatagccgaggccatacaaatgaggacccaagtggaactactagacgaacacatctctgtagactgcgatatcatccgagtgcaccctgcgtacttgggagtcggccat

SEQ ID NO: 362778 - DNA, 140 bp, Artificial Sequence
  Synthetic
atggccgactcccaagtacgcagggtgcactcggatgatatcgcagtctacagagatgtgttcgtctagtagttccacttgggtcctcatttgtatggcctcggctattttcttctcccaggagacccagcatggcgtat

SEQ ID NO: 362779 - DNA, 140 bp, Artificial Sequence
  Synthetic
atacgccatgctgggtctcctactcctacttggaagggacacggttccatcagacggcagtggacatggcagaagtatacaccatgtggccaaagcagacggaggctaatgaacaagtttcgtacttgggagtcggccat

SEQ ID NO: 362780 - DNA, 140 bp, Artificial Sequence
  Synthetic
atggccgactcccaagtacgaaacttgttcattagcctccgtctgctttggccacatggtgtatacttctgccatgtccactgccgtctgatggaaccgtgtcccttccaagtaggagtaggagacccagcatggcgtat

SEQ ID NO: 362781 - DNA, 140 bp, Artificial Sequence
  Synthetic
aggccctggctgctgatatgtcagaaatgaagcgacagacgggacgctgaaaatccaggtctccttgcaaatcggaataaagacggatgacagccacgattggaccaagctgcgttatatgaccttttgggacagcggtg

SEQ ID NO: 362782 - DNA, 140 bp, Artificial Sequence
  Synthetic
caccgctgtcccaaaaggtcatataacgcagcttggtccaatcgtggctgtcatccgtctttattccgatttgcaaggagacctggattttcagcgtcccgtctgtcgcttcatttctgacatatcagcagccagggcct

SEQ ID NO: 362783 - DNA, 140 bp, Artificial Sequence
  Synthetic
aggccctggctgctgatatggtggatgacgcagatgcatcgtcgcccccaaaaaccgtcccgtgcctctgccgttatgccatgacacccgaacgagtcaccaggcttcgtatgaaccatggaccttttgggacagcggtg

SEQ ID NO: 362784 - DNA, 140 bp, Artificial Sequence
  Synthetic
caccgctgtcccaaaaggtccatggttcatacgaagcctggtgactcgttcgggtgtcatggcataacggcagaggcacgggacggtttttgggggcgacgatgcatctgcgtcatccaccatatcagcagccagggcct

SEQ ID NO: 362785 - DNA, 140 bp, Artificial Sequence
  Synthetic
aggccctggctgctgatatgttgataccataattggcaaacggaagagatgtaggtacttaagcttcctaaaagcagccgaactcactttgagatgtaggcatagcataccgaactcttcgaccttttgggacagcggtg

SEQ ID NO: 362786 - DNA, 140 bp, Artificial Sequence
  Synthetic
caccgctgtcccaaaaggtcgaagagttcggtatgctatgcctacatctcaaagtgagttcggctgcttttaggaagcttaagtacctacatctcttccgtttgccaattatggtatcaacatatcagcagccagggcct

SEQ ID NO: 362787 - DNA, 140 bp, Artificial Sequence
  Synthetic
aggccctggctgctgatatgtcacaagcataatagtatgctcatcattcccccttccaaagtataaaatagaaggagtgcagaaagtcaagtgttctaaagtgatgctgttcgaccataagaccttttgggacagcggtg

SEQ ID NO: 362788 - DNA, 140 bp, Artificial Sequence
  Synthetic
caccgctgtcccaaaaggtcttatggtcgaacagcatcactttagaacacttgactttctgcactccttctattttatactttggaagggggaatgatgagcatactattatgcttgtgacatatcagcagccagggcct

SEQ ID NO: 362789 - DNA, 140 bp, Artificial Sequence
  Synthetic
aggccctggctgctgatatgtgagcccaggcctttatggaaaaaccacggggtatgcggtaacccaccacgcagacggattcttgatgtgcaagactaccgacacggttgacggcgaaaggaccttttgggacagcggtg

SEQ ID NO: 362790 - DNA, 140 bp, Artificial Sequence
  Synthetic
caccgctgtcccaaaaggtcctttcgccgtcaaccgtgtcggtagtcttgcacatcaagaatccgtctgcgtggtgggttaccgcataccccgtggtttttccataaaggcctgggctcacatatcagcagccagggcct

SEQ ID NO: 362791 - DNA, 140 bp, Artificial Sequence; identical to SEQ ID NO: 8371
  Synthetic

SEQ ID NO: 362792 - DNA, 140 bp, Artificial Sequence; identical to SEQ ID NO: 8372
  Synthetic

SEQ ID NO: 362793 - DNA, 140 bp, Artificial Sequence
  Synthetic
aggccctggctgctgatatgaaaagctaaaaccgtgcgaccgtgtgctgttctcagtagggtcaacgctctacccggaaagccgcaagctacttaagagctggcacctaccatcggtgttgaccttttgggacagcggtg

SEQ ID NO: 362794 - DNA, 140 bp, Artificial Sequence
  Synthetic
caccgctgtcccaaaaggtcaacaccgatggtaggtgccagctcttaagtagcttgcggctttccgggtagagcgttgaccctactgagaacagcacacggtcgcacggttttagcttttcatatcagcagccagggcct

SEQ ID NO: 362795 - DNA, 140 bp, Artificial Sequence; identical to SEQ ID NO: 9205
  Synthetic

SEQ ID NO: 362796 - DNA, 140 bp, Artificial Sequence; identical to SEQ ID NO: 9206
  Synthetic

SEQ ID NO: 362797 - DNA, 140 bp, Artificial Sequence
  Synthetic
atacgccatgctgggtctccaaaagtccctacttaccggactacatatccggcgcctgtgtactcgcctccgatcaacgtccgattgtccaatcccgagtccgcagtggcagcatgcaatcgtacttgggagtcggccat

SEQ ID NO: 362798 - DNA, 140 bp, Artificial Sequence
  Synthetic
atggccgactcccaagtacgattgcatgctgccactgcggactcgggattggacaatcggacgttgatcggaggcgagtacacaggcgccggatatgtagtccggtaagtagggacttttggagacccagcatggcgtat

SEQ ID NO: 362799 - DNA, 140 bp, Artificial Sequence
  Synthetic
aggccctggctgctgatatgcgtgccgactgaagggctcgaggtcacgtggggcaacaacgagccgtataagtattggccgcagttatctacaaacggtacagcccatggccacccgcatgaccttttgggacagcggtg

SEQ ID NO: 362800 - DNA, 140 bp, Artificial Sequence
  Synthetic
caccgctgtcccaaaaggtcatgcgggtggccatgggctgtaccgtttgtagataactgcggccaatacttatacggctcgttgttgccccacgtgacctcgagcccttcagtcggcacgcatatcagcagccagggcct

SEQ ID NO: 362801 - DNA, 140 bp, Artificial Sequence; identical to SEQ ID NO: 8381
  Synthetic

SEQ ID NO: 362802 - DNA, 140 bp, Artificial Sequence; identical to SEQ ID NO: 8382
  Synthetic

SEQ ID NO: 362803 - DNA, 140 bp, Artificial Sequence
  Synthetic
aggccctggctgctgatatgaactccaggaaagcgcgtccatggctaacagaagcaggtaccaatcccgcaaagtagagaacatgaaagcaacaatagtccaaaggctgaagggtggttggaccttttgggacagcggtg

SEQ ID NO: 362804 - DNA, 140 bp, Artificial Sequence
  Synthetic
caccgctgtcccaaaaggtccaaccacccttcagcctttggactattgttgctttcatgttctctactttgcgggattggtacctgcttctgttagccatggacgcgctttcctggagttcatatcagcagccagggcct

SEQ ID NO: 362805 - DNA, 140 bp, Artificial Sequence
  Synthetic
aggccctggctgctgatatgcaaactttatttaatgtcggagaccccgaaagttcctacctaccgaactacatatccggcaccagtgtactcacccccaatcaatatccgactgtccaacgaccttttgggacagcggtg

SEQ ID NO: 362806 - DNA, 140 bp, Artificial Sequence
  Synthetic
caccgctgtcccaaaaggtcgttggacagtcggatattgattgggggtgagtacactggtgccggatatgtagttcggtaggtaggaactttcggggtctccgacattaaataaagtttgcatatcagcagccagggcct

SEQ ID NO: 362807 - DNA, 140 bp, Artificial Sequence
  Synthetic
aggccctggctgctgatatgcccgagtctgctgtggcagcgtgcaatgagttcctagcaaggaactatccgacagttgcgtcgtaccaaatcaccgatgagtacgatgcatacctggatagaccttttgggacagcggtg

SEQ ID NO: 362808 - DNA, 140 bp, Artificial Sequence
  Synthetic
caccgctgtcccaaaaggtctatccaggtatgcatcgtactcatcggtgatttggtacgacgcaactgtcggatagttccttgctaggaactcattgcacgctgccacagcagactcgggcatatcagcagccagggcct

SEQ ID NO: 362809 - DNA, 140 bp, Artificial Sequence
  Synthetic
aggccctggctgctgatatgctgccacgaaaagaaattgcaacgtcacacagatgagagaactgcctactttggattcagcggtatttaatgttgagtgctttaaaaaatttgcgtgcaagaccttttgggacagcggtg

SEQ ID NO: 362810 - DNA, 140 bp, Artificial Sequence
  Synthetic
caccgctgtcccaaaaggtcttgcacgcaaattttttaaagcactcaacattaaataccgctgaatccaaagtaggcagttctctcatctgtgtgacgttgcaatttcttttcgtggcagcatatcagcagccagggcct

SEQ ID NO: 362811 - DNA, 140 bp, Artificial Sequence
  Synthetic
aggccctggctgctgatatgtcaagaatactggaaggaatttgccgccagtcctattaggataacgactgagaacttgacaacttatgtcacaaaactaaaaggaccaaaagcagcagcagaccttttgggacagcggtg

SEQ ID NO: 362812 - DNA, 140 bp, Artificial Sequence
  Synthetic
caccgctgtcccaaaaggtctgctgctgcttttggtccttttagttttgtgacataagttgtcaagttctcagtcgttatcctaataggactggcggcaaattccttccagtattcttgacatatcagcagccagggcct

SEQ ID NO: 362813 - DNA, 140 bp, Artificial Sequence
  Synthetic
aggccctggctgctgatatgcccatgagaaaccggaggggtactacaactggcaccacggagcagtacagtactcaggaggccggttcaccatccctacaggtgctggcaaaccaggggagaccttttgggacagcggtg

SEQ ID NO: 362814 - DNA, 140 bp, Artificial Sequence
  Synthetic
caccgctgtcccaaaaggtctcccctggtttgccagcacctgtagggatggtgaaccggcctcctgagtactgtactgctccgtggtgccagttgtagtacccctccggtttctcatgggcatatcagcagccagggcct

SEQ ID NO: 362815 - DNA, 140 bp, Artificial Sequence
  Synthetic
aggccctggctgctgatatgttgtttgccaagacacataacctgctaccactgcaggaggtgccgatggacaggtttactgtagacatgaaaagggacgtgaaggtgactccggggacgagaccttttgggacagcggtg

SEQ ID NO: 362816 - DNA, 140 bp, Artificial Sequence
  Synthetic
caccgctgtcccaaaaggtctcgtccccggagtcaccttcacgtcccttttcatgtctacagtaaacctgtccatcggcacctcctgcagtggtagcaggttatgtgtcttggcaaacaacatatcagcagccagggcct

SEQ ID NO: 362817 - DNA, 140 bp, Artificial Sequence; identical to SEQ ID NO: 6243
  Synthetic

SEQ ID NO: 362818 - DNA, 140 bp, Artificial Sequence; identical to SEQ ID NO: 6244
  Synthetic

SEQ ID NO: 362819 - DNA, 140 bp, Artificial Sequence
  Synthetic
aggccctggctgctgatatgagcacactgaggaaagacctaaagtgcaggtcatacaggcagccgaacctttggcaacagcatatctgtgtgggatccacagagagttggtcagaaggctgaccttttgggacagcggtg

SEQ ID NO: 362820 - DNA, 140 bp, Artificial Sequence
  Synthetic
caccgctgtcccaaaaggtcagccttctgaccaactctctgtggatcccacacagatatgctgttgccaaaggttcggctgcctgtatgacctgcactttaggtctttcctcagtgtgctcatatcagcagccagggcct

SEQ ID NO: 362821 - DNA, 140 bp, Artificial Sequence
  Synthetic
atacgccatgctgggtctccttggcaacagcatatctgtgtgggatccacagagagttggtcagaaggctgaatgcagtccttctacctaatgtacacacgctgtttgatatgtctgccgcgtacttgggagtcggccat

SEQ ID NO: 362822 - DNA, 140 bp, Artificial Sequence
  Synthetic
atggccgactcccaagtacgcggcagacatatcaaacagcgtgtgtacattaggtagaaggactgcattcagccttctgaccaactctctgtggatcccacacagatatgctgttgccaaggagacccagcatggcgtat

SEQ ID NO: 362823 - DNA, 140 bp, Artificial Sequence
  Synthetic
aggccctggctgctgatatggaatgcagtccttctacctaatgtacacacgctgtttgatatgtctgccgaggactttgacgccattattgccgcgcacttcaagcccggggacgctgtagaccttttgggacagcggtg

SEQ ID NO: 362824 - DNA, 140 bp, Artificial Sequence
  Synthetic
caccgctgtcccaaaaggtctacagcgtccccgggcttgaagtgcgcggcaataatggcgtcaaagtcctcggcagacatatcaaacagcgtgtgtacattaggtagaaggactgcattccatatcagcagccagggcct

SEQ ID NO: 362825 - DNA, 140 bp, Artificial Sequence
  Synthetic
aggccctggctgctgatatgttggaaaccgatatagcctcctttgacaagagccaagacgactcattggcgctcactgctctaatgttgctagaggatttgggggtggatcatcccctgtgaccttttgggacagcggtg

SEQ ID NO: 362826 - DNA, 140 bp, Artificial Sequence
  Synthetic
caccgctgtcccaaaaggtcacaggggatgatccacccccaaatcctctagcaacattagagcagtgagcgccaatgagtcgtcttggctcttgtcaaaggaggctatatcggtttccaacatatcagcagccagggcct

SEQ ID NO: 362827 - DNA, 140 bp, Artificial Sequence
  Synthetic
aggccctggctgctgatatgaaccctgttcgtcaacacactgctaaacatcaccatagccagccgagtgctggaggaccgcttgacaaagtctgcgtgcgcggccttcatcggcgacgacgaccttttgggacagcggtg

SEQ ID NO: 362828 - DNA, 140 bp, Artificial Sequence
  Synthetic
caccgctgtcccaaaaggtcgtcgtcgccgatgaaggccgcgcacgcagactttgtcaagcggtcctccagcactcggctggctatggtgatgtttagcagtgtgttgacgaacagggttcatatcagcagccagggcct

SEQ ID NO: 362829 - DNA, 140 bp, Artificial Sequence
  Synthetic
aggccctggctgctgatatgcgtcactattcgggaagctgagatagaagttgaagggaattctcagctgcaaatctctttctcgacggccttagccagcgccgaattccgcgtacaagtcgaccttttgggacagcggtg

SEQ ID NO: 362830 - DNA, 140 bp, Artificial Sequence
  Synthetic
caccgctgtcccaaaaggtcgacttgtacgcggaattcggcgctggctaaggccgtcgagaaagagatttgcagctgagaattcccttcaacttctatctcagcttcccgaatagtgacgcatatcagcagccagggcct

SEQ ID NO: 362831 - DNA, 140 bp, Artificial Sequence
  Synthetic
aggccctggctgctgatatgtacatggatgaacatggaagtgaagatcatagatgcggtcgtgtctcagaaagccccgtacttctgcggagggtttatactgtatgacacagtagcaggcgaccttttgggacagcggtg

SEQ ID NO: 362832 - DNA, 140 bp, Artificial Sequence
  Synthetic
caccgctgtcccaaaaggtcgcctgctactgtgtcatacagtataaaccctccgcagaagtacggggctttctgagacacgaccgcatctatgatcttcacttccatgttcatccatgtacatatcagcagccagggcct

SEQ ID NO: 362833 - DNA, 140 bp, Artificial Sequence
  Synthetic
aggccctggctgctgatatgtgttctacacaagtacactgtgcagccgagtgccaccccccgaaggaccacatagtcaactacccggcgtcacataccaccctcggggtccaggacatctgaccttttgggacagcggtg

SEQ ID NO: 362834 - DNA, 140 bp, Artificial Sequence
  Synthetic
caccgctgtcccaaaaggtcagatgtcctggaccccgagggtggtatgtgacgccgggtagttgactatgtggtccttcggggggtggcactcggctgcacagtgtacttgtgtagaacacatatcagcagccagggcct

SEQ ID NO: 362835 - DNA, 140 bp, Artificial Sequence
  Synthetic
aggccctggctgctgatatgacggcctgcagagtggcagacccgctaaagcggctgttcaagctgggcaaaccgctggcggcgggagatgaacaagacgacgacagaagacgtgcactgggaccttttgggacagcggtg

SEQ ID NO: 362836 - DNA, 140 bp, Artificial Sequence
  Synthetic
caccgctgtcccaaaaggtcccagtgcacgtcttctgtcgtcgtcttgttcatctcccgccgccagcggtttgcccagcttgaacagccgctttagcgggtctgccactctgcaggccgtcatatcagcagccagggcct

SEQ ID NO: 362837 - DNA, 140 bp, Artificial Sequence
  Synthetic
atacgccatgctgggtctccaccgctggcggcgggagatgaacaagacgacgacagaagacgtgcactggctgacgaagtggttagatggcaacgaacagggctaactgatgagctagaacgtacttgggagtcggccat

SEQ ID NO: 362838 - DNA, 140 bp, Artificial Sequence
  Synthetic
atggccgactcccaagtacgttctagctcatcagttagccctgttcgttgccatctaaccacttcgtcagccagtgcacgtcttctgtcgtcgtcttgttcatctcccgccgccagcggtggagacccagcatggcgtat

SEQ ID NO: 362839 - DNA, 140 bp, Artificial Sequence
  Synthetic
aggccctggctgctgatatgagaaagctacaccatattgcgatgcacggaccagccctgaacaccgacgaagagtcgtatgagctggtgagggcagagaggacagaacacgagtacgtctgaccttttgggacagcggtg

SEQ ID NO: 362840 - DNA, 140 bp, Artificial Sequence
  Synthetic
caccgctgtcccaaaaggtcagacgtactcgtgttctgtcctctctgccctcaccagctcatacgactcttcgtcggtgttcagggctggtccgtgcatcgcaatatggtgtagctttctcatatcagcagccagggcct

SEQ ID NO: 362841 - DNA, 140 bp, Artificial Sequence
  Synthetic
aggccctggctgctgatatgaaagcggtacactccaggtatgaagtgcagggcatatctgtcgtggtaatgtctatggccacctttgcaagctctagatctaactttgagaagctcagaggaccttttgggacagcggtg

SEQ ID NO: 362842 - DNA, 140 bp, Artificial Sequence
  Synthetic
caccgctgtcccaaaaggtcctctgagcttctcaaagttagatctagagcttgcaaaggtggccatagacattaccacgacagatatgccctgcacttcatacctggagtgtaccgctttcatatcagcagccagggcct

SEQ ID NO: 362843 - DNA, 140 bp, Artificial Sequence
  Synthetic
aggccctggctgctgatatggagacacactgtacatagcaaataatctatagatcaaagggctacgcaacccctgaatagtaacaaaatacaaaatcactaaaaattataaaaacagaaagaccttttgggacagcggtg

SEQ ID NO: 362844 - DNA, 140 bp, Artificial Sequence
  Synthetic
caccgctgtcccaaaaggtctttctgtttttataatttttagtgattttgtattttgttactattcaggggttgcgtagccctttgatctatagattatttgctatgtacagtgtgtctccatatcagcagccagggcct

SEQ ID NO: 362845 - DNA, 140 bp, Artificial Sequence
  Synthetic
aggccctggctgctgatatgaatacataaataggtatacgtgtcccctaagagacacattgtatgtaggtgataagtatagatcaaagggccgaataacccctgaatagtaacaaaatatgaccttttgggacagcggtg

SEQ ID NO: 362846 - DNA, 140 bp, Artificial Sequence
  Synthetic
caccgctgtcccaaaaggtcatattttgttactattcaggggttattcggccctttgatctatacttatcacctacatacaatgtgtctcttaggggacacgtatacctatttatgtattcatatcagcagccagggcct

SEQ ID NO: 362847 - DNA, 140 bp, Artificial Sequence; identical to SEQ ID NO: 7883
  Synthetic

SEQ ID NO: 362848 - DNA, 140 bp, Artificial Sequence; identical to SEQ ID NO: 7884
  Synthetic

SEQ ID NO: 362849 - DNA, 140 bp, Artificial Sequence; identical to SEQ ID NO: 5115
  Synthetic

SEQ ID NO: 362850 - DNA, 140 bp, Artificial Sequence; identical to SEQ ID NO: 5116
  Synthetic

SEQ ID NO: 362851 - DNA, 140 bp, Artificial Sequence
  Synthetic
aggccctggctgctgatatgccacagaggcaggcagggcaactcgcccagctgatctctgcagtcaacaaattgaccatgcgcgcggtacctcaacagaagcctcgcagaaatcggaaaagaccttttgggacagcggtg

SEQ ID NO: 362852 - DNA, 140 bp, Artificial Sequence
  Synthetic
caccgctgtcccaaaaggtcttttccgatttctgcgaggcttctgttgaggtaccgcgcgcatggtcaatttgttgactgcagagatcagctgggcgagttgccctgcctgcctctgtggcatatcagcagccagggcct

SEQ ID NO: 362853 - DNA, 140 bp, Artificial Sequence
  Synthetic
atacgccatgctgggtctccaaccacctctttacagccatggactcgacggatgcagacgtggtcatctactgccgagacaaggaatgggagaagaaaatatctgaggccatacagatgccgtacttgggagtcggccat

SEQ ID NO: 362854 - DNA, 140 bp, Artificial Sequence
  Synthetic
atggccgactcccaagtacggcatctgtatggcctcagatattttcttctcccattccttgtctcggcagtagatgaccacgtctgcatccgtcgagtccatggctgtaaagaggtggttggagacccagcatggcgtat

SEQ ID NO: 362855 - DNA, 140 bp, Artificial Sequence; identical to SEQ ID NO: 7891
  Synthetic

SEQ ID NO: 362856 - DNA, 140 bp, Artificial Sequence; identical to SEQ ID NO: 7892
  Synthetic

SEQ ID NO: 362857 - DNA, 140 bp, Artificial Sequence
  Synthetic
atacgccatgctgggtctccgtaggtacttaagcttcctaaaagcagccgaactcgctttgatgtaggcatagcacaccgaactcttccataattctccgaacccacagggacgtaggagcgtacttgggagtcggccat

SEQ ID NO: 362858 - DNA, 140 bp, Artificial Sequence
  Synthetic
atggccgactcccaagtacgctcctacgtccctgtgggttcggagaattatggaagagttcggtgtgctatgcctacatcaaagcgagttcggctgcttttaggaagcttaagtacctacggagacccagcatggcgtat

SEQ ID NO: 362859 - DNA, 140 bp, Artificial Sequence
  Synthetic
aggccctggctgctgatatgtgaggtggaacctaggcaggtcacatcaaatgaccatgctaatgctagagcgttctcgcatctagccataaaactaatagagcaggaaattgatcccgacgaccttttgggacagcggtg

SEQ ID NO: 362860 - DNA, 140 bp, Artificial Sequence
  Synthetic
caccgctgtcccaaaaggtcgtcgggatcaatttcctgctctattagttttatggctagatgcgagaacgctctagcattagcatggtcatttgatgtgacctgcctaggttccacctcacatatcagcagccagggcct

SEQ ID NO: 362861 - DNA, 140 bp, Artificial Sequence
  Synthetic
aggccctggctgctgatatgtaccagtgcacatgaagtctgatgcctcgaagttcacccacgagaaacccgaggggtactataactggcatcacggagcagtgcagtattcaggaggccggaccttttgggacagcggtg

SEQ ID NO: 362862 - DNA, 140 bp, Artificial Sequence
  Synthetic
caccgctgtcccaaaaggtccggcctcctgaatactgcactgctccgtgatgccagttatagtacccctcgggtttctcgtgggtgaacttcgaggcatcagacttcatgtgcactggtacatatcagcagccagggcct

SEQ ID NO: 362863 - DNA, 140 bp, Artificial Sequence
  Synthetic
aggccctggctgctgatatgtcaaccatcctggatataggtagtgcgccagcaaggaggatgatgtcggacaggaagtaccactgcgtttgcccgatgcgcagcgcagaagatcccgagagaccttttgggacagcggtg

SEQ ID NO: 362864 - DNA, 140 bp, Artificial Sequence
  Synthetic
caccgctgtcccaaaaggtctctcgggatcttctgcgctgcgcatcgggcaaacgcagtggtacttcctgtccgacatcatcctccttgctggcgcactacctatatccaggatggttgacatatcagcagccagggcct

SEQ ID NO: 362865 - DNA, 140 bp, Artificial Sequence
  Synthetic
aggccctggctgctgatatggttcactatcccgacgggtgcaggcaagccgggagacagcggcagaccgatcttcgacaacaaaggacgggtggtggccatcgtcctaggaggggccaacgaccttttgggacagcggtg

SEQ ID NO: 362866 - DNA, 140 bp, Artificial Sequence
  Synthetic
caccgctgtcccaaaaggtcgttggcccctcctaggacgatggccaccacccgtcctttgttgtcgaagatcggtctgccgctgtctcccggcttgcctgcacccgtcgggatagtgaaccatatcagcagccagggcct

SEQ ID NO: 362867 - DNA, 140 bp, Artificial Sequence
  Synthetic
atacgccatgctgggtctccgactcgctaattatgcgagaaagctcgcatctgccgcaggaaaagtcctggacagaaacatttctggaaagatcggggacttacaagcggtgatggccgtcgtacttgggagtcggccat

SEQ ID NO: 362868 - DNA, 140 bp, Artificial Sequence
  Synthetic
atggccgactcccaagtacgacggccatcaccgcttgtaagtccccgatctttccagaaatgtttctgtccaggacttttcctgcggcagatgcgagctttctcgcataattagcgagtcggagacccagcatggcgtat

SEQ ID NO: 362869 - DNA, 140 bp, Artificial Sequence
  Synthetic
aggccctggctgctgatatggaaggtgcccgcacggccctctccgtggtgacgtggaacaaagacatcgtcacaaaaattacccctgagggagccgaagagtggagcctcgccctcccgggaccttttgggacagcggtg

SEQ ID NO: 362870 - DNA, 140 bp, Artificial Sequence
  Synthetic
caccgctgtcccaaaaggtcccgggagggcgaggctccactcttcggctccctcaggggtaatttttgtgacgatgtctttgttccacgtcaccacggagagggccgtgcgggcaccttccatatcagcagccagggcct

SEQ ID NO: 362871 - DNA, 140 bp, Artificial Sequence
  Synthetic
atacgccatgctgggtctccccctacctaccggaccacatatccggcgcctgtgtactcgcctccgattaacgtccgactgtccaaccccgagtccgcagtggcagcatgcaatgagttccgtacttgggagtcggccat

SEQ ID NO: 362872 - DNA, 140 bp, Artificial Sequence
  Synthetic
atggccgactcccaagtacggaactcattgcatgctgccactgcggactcggggttggacagtcggacgttaatcggaggcgagtacacaggcgccggatatgtggtccggtaggtagggggagacccagcatggcgtat

SEQ ID NO: 362873 - DNA, 140 bp, Artificial Sequence
  Synthetic
aggccctggctgctgatatgtcttgtgcctgttggcaaacactacattcccctgctctcagccgccttgcacaccatgctgctacgaaaaggaaccggaaagcaccttgcgcatgcttgagaccttttgggacagcggtg

SEQ ID NO: 362874 - DNA, 140 bp, Artificial Sequence
  Synthetic
caccgctgtcccaaaaggtctcaagcatgcgcaaggtgctttccggttccttttcgtagcagcatggtgtgcaaggcggctgagagcaggggaatgtagtgtttgccaacaggcacaagacatatcagcagccagggcct

SEQ ID NO: 362875 - DNA, 140 bp, Artificial Sequence
  Synthetic
aggccctggctgctgatatgggacaacgtgatgagacccggatactaccagctgctaaaagcatcgctgacttgctctccccaccgccaaagacgcagtactaaggacaattttaatgtcgaccttttgggacagcggtg

SEQ ID NO: 362876 - DNA, 140 bp, Artificial Sequence
  Synthetic
caccgctgtcccaaaaggtcgacattaaaattgtccttagtactgcgtctttggcggtggggagagcaagtcagcgatgcttttagcagctggtagtatccgggtctcatcacgttgtcccatatcagcagccagggcct

SEQ ID NO: 362877 - DNA, 140 bp, Artificial Sequence; identical to SEQ ID NO: 11043
  Synthetic

SEQ ID NO: 362878 - DNA, 140 bp, Artificial Sequence; identical to SEQ ID NO: 11044
  Synthetic

SEQ ID NO: 362879 - DNA, 140 bp, Artificial Sequence
  Synthetic
aggccctggctgctgatatggcattcgtgccacagccctatcgcattggagcgcatcagaaatgaagcaacggacggaacgctgaaaatccaggtctctttgcagatcgggataaagacagaccttttgggacagcggtg

SEQ ID NO: 362880 - DNA, 140 bp, Artificial Sequence
  Synthetic
caccgctgtcccaaaaggtctgtctttatcccgatctgcaaagagacctggattttcagcgttccgtccgttgcttcatttctgatgcgctccaatgcgatagggctgtggcacgaatgccatatcagcagccagggcct

SEQ ID NO: 362881 - DNA, 140 bp, Artificial Sequence
  Synthetic
atacgccatgctgggtctcccggacggaacgctgaaaatccaggtctctttgcagatcgggataaagacagatgacagccacgattggaccaagctgcgctatatggatagccatacgcccgtacttgggagtcggccat

SEQ ID NO: 362882 - DNA, 140 bp, Artificial Sequence
  Synthetic
atggccgactcccaagtacgggcgtatggctatccatatagcgcagcttggtccaatcgtggctgtcatctgtctttatcccgatctgcaaagagacctggattttcagcgttccgtccgggagacccagcatggcgtat

SEQ ID NO: 362883 - DNA, 140 bp, Artificial Sequence
  Synthetic
aggccctggctgctgatatgagcggacgcggagcgagccggattgcttgtaaggacttcagcaccgtgcacgatcaccgggaccatgggacactttattctcgcccgatgcccgaaaggagaccttttgggacagcggtg

SEQ ID NO: 362884 - DNA, 140 bp, Artificial Sequence
  Synthetic
caccgctgtcccaaaaggtctcctttcgggcatcgggcgagaataaagtgtcccatggtcccggtgatcgtgcacggtgctgaagtccttacaagcaatccggctcgctccgcgtccgctcatatcagcagccagggcct

SEQ ID NO: 362885 - DNA, 140 bp, Artificial Sequence
  Synthetic
aggccctggctgctgatatgaggaggtaccagcctcgaccctggactccgcgctctactatccaagtcatcaggcccagaccgcgccctcagaggcaagctgggcaacttgcccagctgagaccttttgggacagcggtg

SEQ ID NO: 362886 - DNA, 140 bp, Artificial Sequence
  Synthetic
caccgctgtcccaaaaggtctcagctgggcaagttgcccagcttgcctctgagggcgcggtctgggcctgatgacttggatagtagagcgcggagtccagggtcgaggctggtacctcctcatatcagcagccagggcct

SEQ ID NO: 362887 - DNA, 140 bp, Artificial Sequence
  Synthetic
aggccctggctgctgatatgactctcgaccacaacatggtaaagagttaccttgcagcacgtacgtgcagagcaccgctgccactgccgaggagatagaggtgcatatgcccccggatacgaccttttgggacagcggtg

SEQ ID NO: 362888 - DNA, 140 bp, Artificial Sequence
  Synthetic
caccgctgtcccaaaaggtcgtatccgggggcatatgcacctctatctcctcggcagtggcagcggtgctctgcacgtacgtgctgcaaggtaactctttaccatgttgtggtcgagagtcatatcagcagccagggcct

SEQ ID NO: 362889 - DNA, 140 bp, Artificial Sequence
  Synthetic
atacgccatgctgggtctcccacgaacaccatgaagaactatctacttcccgtggtcgcccaggccttcagtaagtgggcgaaggagtgccggaaggacatggaagatgagaagcttctgcgtacttgggagtcggccat

SEQ ID NO: 362890 - DNA, 140 bp, Artificial Sequence
  Synthetic
atggccgactcccaagtacgcagaagcttctcatcttccatgtccttccggcactccttcgcccacttactgaaggcctgggcgaccacgggaagtagatagttcttcatggtgttcgtgggagacccagcatggcgtat

SEQ ID NO: 362891 - DNA, 140 bp, Artificial Sequence
  Synthetic
aggccctggctgctgatatgggagacgcgtgacacagctatttcccttcaggcaccgccaagtaccaccatggaactgagccatccaccgatctccttcggagcaccaagcgagacgttcgaccttttgggacagcggtg

SEQ ID NO: 362892 - DNA, 140 bp, Artificial Sequence
  Synthetic
caccgctgtcccaaaaggtcgaacgtctcgcttggtgctccgaaggagatcggtggatggctcagttccatggtggtacttggcggtgcctgaagggaaatagctgtgtcacgcgtctcccatatcagcagccagggcct

SEQ ID NO: 362893 - DNA, 140 bp, Artificial Sequence; identical to SEQ ID NO: 6319
  Synthetic

SEQ ID NO: 362894 - DNA, 140 bp, Artificial Sequence; identical to SEQ ID NO: 6320
  Synthetic

SEQ ID NO: 362895 - DNA, 140 bp, Artificial Sequence; identical to SEQ ID NO: 7923
  Synthetic

SEQ ID NO: 362896 - DNA, 140 bp, Artificial Sequence; identical to SEQ ID NO: 7924
  Synthetic

SEQ ID NO: 362897 - DNA, 140 bp, Artificial Sequence
  Synthetic
atacgccatgctgggtctccagcaagtgaagacgtgcacgcacagcggacgagcagggaggtatgcggtcgaagcgtacgacggccgagtcctagtgccctcaggctatgcaatctcgcccgtacttgggagtcggccat

SEQ ID NO: 362898 - DNA, 140 bp, Artificial Sequence
  Synthetic
atggccgactcccaagtacgggcgagattgcatagcctgagggcactaggactcggccgtcgtacgcttcgaccgcatacctccctgctcgtccgctgtgcgtgcacgtcttcacttgctggagacccagcatggcgtat

SEQ ID NO: 362899 - DNA, 140 bp, Artificial Sequence; identical to SEQ ID NO: 10391
  Synthetic

SEQ ID NO: 362900 - DNA, 140 bp, Artificial Sequence; identical to SEQ ID NO: 10392
  Synthetic

SEQ ID NO: 362901 - DNA, 140 bp, Artificial Sequence
  Synthetic
aggccctggctgctgatatgatgcagaaaaagaagcagaggaagaacgagaagcagaactgactcatgaggctctaccacccctacaggcagcacaggaagatgtccaggtcgaaatcgagaccttttgggacagcggtg

SEQ ID NO: 362902 - DNA, 140 bp, Artificial Sequence
  Synthetic
caccgctgtcccaaaaggtctcgatttcgacctggacatcttcctgtgctgcctgtaggggtggtagagcctcatgagtcagttctgcttctcgttcttcctctgcttctttttctgcatcatatcagcagccagggcct

SEQ ID NO: 362903 - DNA, 140 bp, Artificial Sequence
  Synthetic
aggccctggctgctgatatggagtgggtgacacacaagaaggaggtcaccttgaccgtgcctactgagggtctggaggtcacttggggcaacaacgaaccatacaagtactggccgcagagaccttttgggacagcggtg

SEQ ID NO: 362904 - DNA, 140 bp, Artificial Sequence
  Synthetic
caccgctgtcccaaaaggtctctgcggccagtacttgtatggttcgttgttgccccaagtgacctccagaccctcagtaggcacggtcaaggtgacctccttcttgtgtgtcacccactccatatcagcagccagggcct

SEQ ID NO: 362905 - DNA, 140 bp, Artificial Sequence
  Synthetic
aggccctggctgctgatatgtgtctacgaacggtactgctcatggccacccacatgagataatcttgtactattatgagctgtaccccactatgactgtagtcattgtgtcggtggcctcgaccttttgggacagcggtg

SEQ ID NO: 362906 - DNA, 140 bp, Artificial Sequence
  Synthetic
caccgctgtcccaaaaggtcgaggccaccgacacaatgactacagtcatagtggggtacagctcataatagtacaagattatctcatgtgggtggccatgagcagtaccgttcgtagacacatatcagcagccagggcct

SEQ ID NO: 362907 - DNA, 140 bp, Artificial Sequence
  Synthetic
aggccctggctgctgatatgtacctggtactttccccgcagaccgtattacgcagccagaagctcagcctgatccacgctttagcggagcaagtgaagacgtgtacgcatagcggacgaggaccttttgggacagcggtg

SEQ ID NO: 362908 - DNA, 140 bp, Artificial Sequence
  Synthetic
caccgctgtcccaaaaggtcctcgtccgctatgcgtacacgtcttcacttgctccgctaaagcgtggatcaggctgagcttctggctgcgtaatacggtctgcggggaaagtaccaggtacatatcagcagccagggcct

SEQ ID NO: 362909 - DNA, 140 bp, Artificial Sequence; identical to SEQ ID NO: 8465
  Synthetic

SEQ ID NO: 362910 - DNA, 140 bp, Artificial Sequence; identical to SEQ ID NO: 8466
  Synthetic

SEQ ID NO: 362911 - DNA, 140 bp, Artificial Sequence; identical to SEQ ID NO: 7937
  Synthetic

SEQ ID NO: 362912 - DNA, 140 bp, Artificial Sequence; identical to SEQ ID NO: 7938
  Synthetic

SEQ ID NO: 362913 - DNA, 140 bp, Artificial Sequence
  Synthetic
atacgccatgctgggtctccgatggtgtacaacgaaagagagttcgtaaacagaaagttacaccacattgcgatgcacggaccagccctgaacactgacgaagagtcgtatgagcttgtgcgtacttgggagtcggccat

SEQ ID NO: 362914 - DNA, 140 bp, Artificial Sequence
  Synthetic
atggccgactcccaagtacgcacaagctcatacgactcttcgtcagtgttcagggctggtccgtgcatcgcaatgtggtgtaactttctgtttacgaactctctttcgttgtacaccatcggagacccagcatggcgtat

SEQ ID NO: 362915 - DNA, 140 bp, Artificial Sequence
  Synthetic
atacgccatgctgggtctccggttgcaggctcttatcccgctggccgccttgatcgtcctgtgcaactgtctgaagctcttgccatgctgctgtaagaccctggtttttttagccgtaatcgtacttgggagtcggccat

SEQ ID NO: 362916 - DNA, 140 bp, Artificial Sequence
  Synthetic
atggccgactcccaagtacgattacggctaaaaaaaccagggtcttacagcagcatggcaagagcttcagacagttgcacaggacgatcaaggcggccagcgggataagagcctgcaaccggagacccagcatggcgtat

SEQ ID NO: 362917 - DNA, 140 bp, Artificial Sequence; identical to SEQ ID NO: 4857
  Synthetic

SEQ ID NO: 362918 - DNA, 140 bp, Artificial Sequence; identical to SEQ ID NO: 4858
  Synthetic

SEQ ID NO: 362919 - DNA, 140 bp, Artificial Sequence; identical to SEQ ID NO: 12001
  Synthetic

SEQ ID NO: 362920 - DNA, 140 bp, Artificial Sequence; identical to SEQ ID NO: 12002
  Synthetic

SEQ ID NO: 362921 - DNA, 140 bp, Artificial Sequence
  Synthetic
atacgccatgctgggtctcctggtaagtcagccattatcaagaacctagttaccaggcaagacctggtgactagcggaaagaaagaaaactgccaagaaatcagcaccgacgtgatgagacgtacttgggagtcggccat

SEQ ID NO: 362922 - DNA, 140 bp, Artificial Sequence
  Synthetic
atggccgactcccaagtacgtctcatcacgtcggtgctgatttcttggcagttttctttctttccgctagtcaccaggtcttgcctggtaactaggttcttgataatggctgacttaccaggagacccagcatggcgtat

SEQ ID NO: 362923 - DNA, 140 bp, Artificial Sequence
  Synthetic
atacgccatgctgggtctccgcatcatctccccccaaaactgtcccgtgcctttgccgttacgctatgactccagaacgcgtcacccggcttcgcatgaaccacgtcacaagcataattgcgtacttgggagtcggccat

SEQ ID NO: 362924 - DNA, 140 bp, Artificial Sequence
  Synthetic
atggccgactcccaagtacgcaattatgcttgtgacgtggttcatgcgaagccgggtgacgcgttctggagtcatagcgtaacggcaaaggcacgggacagttttggggggagatgatgcggagacccagcatggcgtat

SEQ ID NO: 362925 - DNA, 140 bp, Artificial Sequence
  Synthetic
aggccctggctgctgatatgcgcctactgcttttgcgacgccgaaaatacgcaattgagcgaggcacatgtagagaaatctgaatcttgcaaaacagagtttgcatcggcctacagagccgaccttttgggacagcggtg

SEQ ID NO: 362926 - DNA, 140 bp, Artificial Sequence
  Synthetic
caccgctgtcccaaaaggtcggctctgtaggccgatgcaaactctgttttgcaagattcagatttctctacatgtgcctcgctcaattgcgtattttcggcgtcgcaaaagcagtaggcgcatatcagcagccagggcct

SEQ ID NO: 362927 - DNA, 140 bp, Artificial Sequence
  Synthetic
atacgccatgctgggtctccgccactctggaacgttacttgccttgatcgccttggtgagaccaagactgaaagttgtactttgtggtgacccgaagcagtgcggcttcttcaatatgatcgtacttgggagtcggccat

SEQ ID NO: 362928 - DNA, 140 bp, Artificial Sequence
  Synthetic
atggccgactcccaagtacgatcatattgaagaagccgcactgcttcgggtcaccacaaagtacaactttcagtcttggtctcaccaaggcgatcaaggcaagtaacgttccagagtggcggagacccagcatggcgtat

SEQ ID NO: 362929 - DNA, 140 bp, Artificial Sequence
  Synthetic
atacgccatgctgggtctccaacaaaatcgtggtgtacaaagacgacgtctacaacatggactacccaccttttggcgcaggaagaccaggacaatttggtgacattcaaagtcgtacaccgtacttgggagtcggccat

SEQ ID NO: 362930 - DNA, 140 bp, Artificial Sequence
  Synthetic
atggccgactcccaagtacggtgtacgactttgaatgtcaccaaattgtcctggtcttcctgcgccaaaaggtgggtagtccatgttgtagacgtcgtctttgtacaccacgattttgttggagacccagcatggcgtat

SEQ ID NO: 362931 - DNA, 140 bp, Artificial Sequence
  Synthetic
aggccctggctgctgatatgcggtaccccaacagaagccacgcaggaatcggaagaataagaagcaaaagcaaaaacaacaggcgccacaaaacaacacaaatcaaaagaagcagccaccgaccttttgggacagcggtg

SEQ ID NO: 362932 - DNA, 140 bp, Artificial Sequence
  Synthetic
caccgctgtcccaaaaggtcggtggctgcttcttttgatttgtgttgttttgtggcgcctgttgtttttgcttttgcttcttattcttccgattcctgcgtggcttctgttggggtaccgcatatcagcagccagggcct

SEQ ID NO: 362933 - DNA, 140 bp, Artificial Sequence
  Synthetic
aggccctggctgctgatatgcggaaagtaaagacgtttatgccaacactcagttggtactacagaggccagcagcaggcacggtacatgtaccatactctcaggcaccatctggcttcaagaccttttgggacagcggtg

SEQ ID NO: 362934 - DNA, 140 bp, Artificial Sequence
  Synthetic
caccgctgtcccaaaaggtcttgaagccagatggtgcctgagagtatggtacatgtaccgtgcctgctgctggcctctgtagtaccaactgagtgttggcataaacgtctttactttccgcatatcagcagccagggcct

SEQ ID NO: 362935 - DNA, 140 bp, Artificial Sequence
  Synthetic
aggccctggctgctgatatggtattggctgaaggaacgaggagcatcgctacagcacacggcaccgttcggttgccagattgcgacaaacccggtaagagctgtaaattgcgctgtgggggaccttttgggacagcggtg

SEQ ID NO: 362936 - DNA, 140 bp, Artificial Sequence
  Synthetic
caccgctgtcccaaaaggtcccccacagcgcaatttacagctcttaccgggtttgtcgcaatctggcaaccgaacggtgccgtgtgctgtagcgatgctcctcgttccttcagccaataccatatcagcagccagggcct

SEQ ID NO: 362937 - DNA, 140 bp, Artificial Sequence
  Synthetic
aggccctggctgctgatatgaacataccaatttccatcgacataccggatgcggcctttactagggttgtcgatgcaccctctgtaacggacatgtcatgcgaagtaccagcctgcactcgaccttttgggacagcggtg

SEQ ID NO: 362938 - DNA, 140 bp, Artificial Sequence
  Synthetic
caccgctgtcccaaaaggtcgagtgcaggctggtacttcgcatgacatgtccgttacagagggtgcatcgacaaccctagtaaaggccgcatccggtatgtcgatggaaattggtatgttcatatcagcagccagggcct

SEQ ID NO: 362939 - DNA, 140 bp, Artificial Sequence; identical to SEQ ID NO: 7965
  Synthetic

SEQ ID NO: 362940 - DNA, 140 bp, Artificial Sequence; identical to SEQ ID NO: 7966
  Synthetic

SEQ ID NO: 362941 - DNA, 140 bp, Artificial Sequence; identical to SEQ ID NO: 4873
  Synthetic

SEQ ID NO: 362942 - DNA, 140 bp, Artificial Sequence; identical to SEQ ID NO: 4874
  Synthetic

SEQ ID NO: 362943 - DNA, 140 bp, Artificial Sequence
  Synthetic
aggccctggctgctgatatgcactgcgcagccgcatgccatcctccaaaggaccacatagtcaattacccagcatcacacaccacccttggggtccaggatatatccacaacggcaatgtgaccttttgggacagcggtg

SEQ ID NO: 362944 - DNA, 140 bp, Artificial Sequence
  Synthetic
caccgctgtcccaaaaggtcacattgccgttgtggatatatcctggaccccaagggtggtgtgtgatgctgggtaattgactatgtggtcctttggaggatggcatgcggctgcgcagtgcatatcagcagccagggcct

SEQ ID NO: 362945 - DNA, 140 bp, Artificial Sequence; identical to SEQ ID NO: 5141
  Synthetic

SEQ ID NO: 362946 - DNA, 140 bp, Artificial Sequence; identical to SEQ ID NO: 5142
  Synthetic

SEQ ID NO: 362947 - DNA, 140 bp, Artificial Sequence; identical to SEQ ID NO: 8479
  Synthetic

SEQ ID NO: 362948 - DNA, 140 bp, Artificial Sequence; identical to SEQ ID NO: 8480
  Synthetic

SEQ ID NO: 362949 - DNA, 140 bp, Artificial Sequence; identical to SEQ ID NO: 7975
  Synthetic

SEQ ID NO: 362950 - DNA, 140 bp, Artificial Sequence; identical to SEQ ID NO: 7976
  Synthetic

SEQ ID NO: 362951 - DNA, 140 bp, Artificial Sequence; identical to SEQ ID NO: 7977
  Synthetic

SEQ ID NO: 362952 - DNA, 140 bp, Artificial Sequence; identical to SEQ ID NO: 7978
  Synthetic

SEQ ID NO: 362953 - DNA, 140 bp, Artificial Sequence
  Synthetic
aggccctggctgctgatatgcggctataaccttgcactgcctactaagagagtcacctgggtagcgccactaggtgtccgcggagcggactatacatacaacctagagctgggtctaccggaccttttgggacagcggtg

SEQ ID NO: 362954 - DNA, 140 bp, Artificial Sequence
  Synthetic
caccgctgtcccaaaaggtccggtagacccagctctaggttgtatgtatagtccgctccgcggacacctagtggcgctacccaggtgactctcttagtaggcagtgcaaggttatagccgcatatcagcagccagggcct

SEQ ID NO: 362955 - DNA, 140 bp, Artificial Sequence
  Synthetic
atacgccatgctgggtctccagacacattgtatgtaggtagtaagtatagatcaaagggctatattaacccctgaatagtaacaaaacacaaaaacaataaaaactacaaaatagaaaatcgtacttgggagtcggccat

SEQ ID NO: 362956 - DNA, 140 bp, Artificial Sequence
  Synthetic
atggccgactcccaagtacgattttctattttgtagtttttattgtttttgtgttttgttactattcaggggttaatatagccctttgatctatacttactacctacatacaatgtgtctggagacccagcatggcgtat

SEQ ID NO: 362957 - DNA, 140 bp, Artificial Sequence
  Synthetic
aggccctggctgctgatatgcctgaatagtaacaaaacacaaaaacaataaaaactacaaaatagaaaatctataaacaaaagtagttcaaagggctacaaaacccctgaatagtaacaagaccttttgggacagcggtg

SEQ ID NO: 362958 - DNA, 140 bp, Artificial Sequence
  Synthetic
caccgctgtcccaaaaggtcttgttactattcaggggttttgtagccctttgaactacttttgtttatagattttctattttgtagtttttattgtttttgtgttttgttactattcaggcatatcagcagccagggcct

SEQ ID NO: 362959 - DNA, 140 bp, Artificial Sequence
  Synthetic
atacgccatgctgggtctcctgctagggggtgactcactgagactgctcaaaccgggtggctctctattgatcagagcatacggttacgcagatagaaccagtgaacgagtaatctgcgtcgtacttgggagtcggccat

SEQ ID NO: 362960 - DNA, 140 bp, Artificial Sequence
  Synthetic
atggccgactcccaagtacgacgcagattactcgttcactggttctatctgcgtaaccgtatgctctgatcaatagagagccacccggtttgagcagtctcagtgagtcaccccctagcaggagacccagcatggcgtat

SEQ ID NO: 362961 - DNA, 140 bp, Artificial Sequence
  Synthetic
aggccctggctgctgatatgatcagagcatacggttacgcagatagaaccagtgaacgagtaatctgcgtactgggacgtaagtttagatcatccagagcattgaaaccaccatgtatcagaccttttgggacagcggtg

SEQ ID NO: 362962 - DNA, 140 bp, Artificial Sequence
  Synthetic
caccgctgtcccaaaaggtctgatacatggtggtttcaatgctctggatgatctaaacttacgtcccagtacgcagattactcgttcactggttctatctgcgtaaccgtatgctctgatcatatcagcagccagggcct

SEQ ID NO: 362963 - DNA, 140 bp, Artificial Sequence
  Synthetic
atacgccatgctgggtctccacagaagcaggtatcagtcgcgcaaagtagaaaacatgaaagcagcaatcatccagagactaaagagaggctgtagactatacttaatgtcagagacccccgtacttgggagtcggccat

SEQ ID NO: 362964 - DNA, 140 bp, Artificial Sequence
  Synthetic
atggccgactcccaagtacgggggtctctgacattaagtatagtctacagcctctctttagtctctggatgattgctgctttcatgttttctactttgcgcgactgatacctgcttctgtggagacccagcatggcgtat

SEQ ID NO: 362965 - DNA, 140 bp, Artificial Sequence
  Synthetic
aggccctggctgctgatatgagcaacctttgttttggctacaagcccttattccgctggcagccctgattgttctatgcaactgtctgagactcttaccatgctgctgtaaaacgttggcgaccttttgggacagcggtg

SEQ ID NO: 362966 - DNA, 140 bp, Artificial Sequence
  Synthetic
caccgctgtcccaaaaggtcgccaacgttttacagcagcatggtaagagtctcagacagttgcatagaacaatcagggctgccagcggaataagggcttgtagccaaaacaaaggttgctcatatcagcagccagggcct

SEQ ID NO: 362967 - DNA, 140 bp, Artificial Sequence
  Synthetic
aggccctggctgctgatatgaggaattttacaacgcatgtcatgaacaatcaactgaacgcagcctttgtaggacaggccacccgagcaggatgtgcaccatcgtaccgggtaaaacgcagaccttttgggacagcggtg

SEQ ID NO: 362968 - DNA, 140 bp, Artificial Sequence
  Synthetic
caccgctgtcccaaaaggtctgcgttttacccggtacgatggtgcacatcctgctcgggtggcctgtcctacaaaggctgcgttcagttgattgttcatgacatgcgttgtaaaattcctcatatcagcagccagggcct

SEQ ID NO: 362969 - DNA, 140 bp, Artificial Sequence
  Synthetic
atacgccatgctgggtctccaagcttagaagttatccaaaacagcactcctaccatgcacccacaatcagaagtgccgtaccttccccgttccagaacacgttgcagaacgtactggctgcgtacttgggagtcggccat

SEQ ID NO: 362970 - DNA, 140 bp, Artificial Sequence
  Synthetic
atggccgactcccaagtacgcagccagtacgttctgcaacgtgttctggaacggggaaggtacggcacttctgattgtgggtgcatggtaggagtgctgttttggataacttctaagcttggagacccagcatggcgtat

SEQ ID NO: 362971 - DNA, 140 bp, Artificial Sequence
  Synthetic
aggccctggctgctgatatgggagtcctttaaaaatagtgcaacaccagtaggaactgcaaaaacagttatgtgcggtacatatccagtaatccacgccgtaggaccaaacttctcaaatgaccttttgggacagcggtg

SEQ ID NO: 362972 - DNA, 140 bp, Artificial Sequence
  Synthetic
caccgctgtcccaaaaggtcatttgagaagtttggtcctacggcgtggattactggatatgtaccgcacataactgtttttgcagttcctactggtgttgcactatttttaaaggactcccatatcagcagccagggcct

SEQ ID NO: 362973 - DNA, 140 bp, Artificial Sequence
  Synthetic
aggccctggctgctgatatggcctcctttgataagagccaagatgattcacttgcgcttactgctttgatgctgttagaggatttaggggtggatcactccctgctggacttgatagagggaccttttgggacagcggtg

SEQ ID NO: 362974 - DNA, 140 bp, Artificial Sequence
  Synthetic
caccgctgtcccaaaaggtccctctatcaagtccagcagggagtgatccacccctaaatcctctaacagcatcaaagcagtaagcgcaagtgaatcatcttggctcttatcaaaggaggccatatcagcagccagggcct

SEQ ID NO: 362975 - DNA, 140 bp, Artificial Sequence
  Synthetic
atacgccatgctgggtctcccacgaggtcatgacagcagccgcatcccaagggttaaccagaaaaggagtttacgcagttaggcaaaaagttaacgaaaacccgctttatgcatcaacgtcgtacttgggagtcggccat

SEQ ID NO: 362976 - DNA, 140 bp, Artificial Sequence
  Synthetic
atggccgactcccaagtacgacgttgatgcataaagcgggttttcgttaactttttgcctaactgcgtaaactccttttctggttaacccttgggatgcggctgctgtcatgacctcgtgggagacccagcatggcgtat

SEQ ID NO: 362977 - DNA, 140 bp, Artificial Sequence; identical to SEQ ID NO: 7807
  Synthetic

SEQ ID NO: 362978 - DNA, 140 bp, Artificial Sequence; identical to SEQ ID NO: 7808
  Synthetic

SEQ ID NO: 362979 - DNA, 140 bp, Artificial Sequence
  Synthetic
aggccctggctgctgatatgttttttagccgtaatgagcgtcggtgcccacactgtgagcgcgtacgaacacgtaacagtgatcccgaacacggtgggagtaccgtataagactctagtcgaccttttgggacagcggtg

SEQ ID NO: 362980 - DNA, 140 bp, Artificial Sequence
  Synthetic
caccgctgtcccaaaaggtcgactagagtcttatacggtactcccaccgtgttcgggatcactgttacgtgttcgtacgcgctcacagtgtgggcaccgacgctcattacggctaaaaaacatatcagcagccagggcct

SEQ ID NO: 362981 - DNA, 140 bp, Artificial Sequence
  Synthetic
aggccctggctgctgatatgaaatagcaacaaacccggtaagagcgatgaactgcgccgtagggaacatgcccatctccatcgacataccggatgcggccttcactagggtcgtcgacgcgaccttttgggacagcggtg

SEQ ID NO: 362982 - DNA, 140 bp, Artificial Sequence
  Synthetic
caccgctgtcccaaaaggtcgcgtcgacgaccctagtgaaggccgcatccggtatgtcgatggagatgggcatgttccctacggcgcagttcatcgctcttaccgggtttgttgctatttcatatcagcagccagggcct

SEQ ID NO: 362983 - DNA, 140 bp, Artificial Sequence
  Synthetic
aggccctggctgctgatatgcacggaggttacaccggaggatgcacagaagctgctggtgggactgaaccagaggatagtggtcaatggcagaacgcagaggaacacgaacacaatgaaggaccttttgggacagcggtg

SEQ ID NO: 362984 - DNA, 140 bp, Artificial Sequence
  Synthetic
caccgctgtcccaaaaggtccttcattgtgttcgtgttcctctgcgttctgccattgaccactatcctctggttcagtcccaccagcagcttctgtgcatcctccggtgtaacctccgtgcatatcagcagccagggcct

SEQ ID NO: 362985 - DNA, 140 bp, Artificial Sequence
  Synthetic
atacgccatgctgggtctccctgtcccgtgcctttgccgttatgccatgactcctgaacgcgtcacccgacttcgcatgaaccatgtcacaaatataattgtgtgttcttcatttcccctcgtacttgggagtcggccat

SEQ ID NO: 362986 - DNA, 140 bp, Artificial Sequence
  Synthetic
atggccgactcccaagtacgaggggaaatgaagaacacacaattatatttgtgacatggttcatgcgaagtcgggtgacgcgttcaggagtcatggcataacggcaaaggcacgggacagggagacccagcatggcgtat

SEQ ID NO: 362987 - DNA, 140 bp, Artificial Sequence
  Synthetic
aggccctggctgctgatatgagtaacgtacggaaaaaaccaagtcaccatgctgctgtatcctgaccatccgacactcttgtcttaccgtaacatgggacaggaaccaaattaccacgaggaccttttgggacagcggtg

SEQ ID NO: 362988 - DNA, 140 bp, Artificial Sequence
  Synthetic
caccgctgtcccaaaaggtcctcgtggtaatttggttcctgtcccatgttacggtaagacaagagtgtcggatggtcaggatacagcagcatggtgacttggttttttccgtacgttactcatatcagcagccagggcct

SEQ ID NO: 362989 - DNA, 140 bp, Artificial Sequence
  Synthetic
atacgccatgctgggtctccattggctgaaagaacgaggggcgtcgctgcagcacacagcaccatttggctgccaaatagcaacaaacccggtaagagcggtgaactgcgccgtagggaacgtacttgggagtcggccat

SEQ ID NO: 362990 - DNA, 140 bp, Artificial Sequence
  Synthetic
atggccgactcccaagtacgttccctacggcgcagttcaccgctcttaccgggtttgttgctatttggcagccaaatggtgctgtgtgctgcagcgacgcccctcgttctttcagccaatggagacccagcatggcgtat

SEQ ID NO: 362991 - DNA, 140 bp, Artificial Sequence
  Synthetic
aggccctggctgctgatatgtcttcccaggagtctgtacgggaagtgagtatgacaacgtcattgacgcatagccagtttgatctaagcgccgatggcgagacactgcctgtcccgtcaggaccttttgggacagcggtg

SEQ ID NO: 362992 - DNA, 140 bp, Artificial Sequence
  Synthetic
caccgctgtcccaaaaggtcctgacgggacaggcagtgtctcgccatcggcgcttagatcaaactggctatgcgtcaatgacgttgtcatactcacttcccgtacagactcctgggaagacatatcagcagccagggcct

SEQ ID NO: 362993 - DNA, 140 bp, Artificial Sequence
  Synthetic
aggccctggctgctgatatgtagccagtttgatctaagcgccgatggcgagacactgcctgtcccgtcagacctggatgctgacgccccagccctagaaccggccctagacgacggggcggaccttttgggacagcggtg

SEQ ID NO: 362994 - DNA, 140 bp, Artificial Sequence
  Synthetic
caccgctgtcccaaaaggtccgccccgtcgtctagggccggttctagggctggggcgtcagcatccaggtctgacgggacaggcagtgtctcgccatcggcgcttagatcaaactggctacatatcagcagccagggcct

SEQ ID NO: 362995 - DNA, 140 bp, Artificial Sequence
  Synthetic
aggccctggctgctgatatgacctggatgctgacgccccagccctagaaccggccctagacgacggggcgatcggaaaccttgcggccgtgtctgactgggtaatgagcaccgtacctgtgaccttttgggacagcggtg

SEQ ID NO: 362996 - DNA, 140 bp, Artificial Sequence
  Synthetic
caccgctgtcccaaaaggtcacaggtacggtgctcattacccagtcagacacggccgcaaggtttccgatcgccccgtcgtctagggccggttctagggctggggcgtcagcatccaggtcatatcagcagccagggcct

SEQ ID NO: 362997 - DNA, 140 bp, Artificial Sequence; identical to SEQ ID NO: 4907
  Synthetic

SEQ ID NO: 362998 - DNA, 140 bp, Artificial Sequence; identical to SEQ ID NO: 4908
  Synthetic

SEQ ID NO: 362999 - DNA, 140 bp, Artificial Sequence; identical to SEQ ID NO: 10911
  Synthetic

SEQ ID NO: 363000 - DNA, 140 bp, Artificial Sequence; identical to SEQ ID NO: 10912
  Synthetic

SEQ ID NO: 363001 - DNA, 140 bp, Artificial Sequence
  Synthetic
aggccctggctgctgatatgtctccttcggagcaccaagcgagacgttccccatcacatttggggacttcgacgatggagaaatcgaaagcttgtcttctgagctactaactttcggagagaccttttgggacagcggtg

SEQ ID NO: 363002 - DNA, 140 bp, Artificial Sequence
  Synthetic
caccgctgtcccaaaaggtctctccgaaagttagtagctcagaagacaagctttcgatttctccatcgtcgaagtccccaaatgtgatggggaacgtctcgcttggtgctccgaaggagacatatcagcagccagggcct

SEQ ID NO: 363003 - DNA, 140 bp, Artificial Sequence
  Synthetic
aggccctggctgctgatatgttgccgttacgctatgactccagaacgcgtcacccggcttcgcatgaaccacgtcacaagcataattgtgtgttcttcgtttcccctcccaaagtacaaagaccttttgggacagcggtg

SEQ ID NO: 363004 - DNA, 140 bp, Artificial Sequence
  Synthetic
caccgctgtcccaaaaggtctttgtactttgggaggggaaacgaagaacacacaattatgcttgtgacgtggttcatgcgaagccgggtgacgcgttctggagtcatagcgtaacggcaacatatcagcagccagggcct

SEQ ID NO: 363005 - DNA, 140 bp, Artificial Sequence; identical to SEQ ID NO: 6401
  Synthetic

SEQ ID NO: 363006 - DNA, 140 bp, Artificial Sequence; identical to SEQ ID NO: 6402
  Synthetic

SEQ ID NO: 363007 - DNA, 140 bp, Artificial Sequence
  Synthetic
aggccctggctgctgatatggtcagtgctgccggtaaacaccctggaggaagttcacgaggagaagtgttacccacctaagctggatgaattaaaggagcaactactacttaagaaactcgaccttttgggacagcggtg

SEQ ID NO: 363008 - DNA, 140 bp, Artificial Sequence
  Synthetic
caccgctgtcccaaaaggtcgagtttcttaagtagtagttgctcctttaattcatccagcttaggtgggtaacacttctcctcgtgaacttcctccagggtgtttaccggcagcactgaccatatcagcagccagggcct

SEQ ID NO: 363009 - DNA, 140 bp, Artificial Sequence
  Synthetic
atacgccatgctgggtctccacccacctaagctggatgaattaaaggagcaactactacttaagaaactccaggagagtgcgtccacggccaatagaagcaggtatcaatcacgcaaagtcgtacttgggagtcggccat

SEQ ID NO: 363010 - DNA, 140 bp, Artificial Sequence
  Synthetic
atggccgactcccaagtacgactttgcgtgattgatacctgcttctattggccgtggacgcactctcctggagtttcttaagtagtagttgctcctttaattcatccagcttaggtgggtggagacccagcatggcgtat

SEQ ID NO: 363011 - DNA, 140 bp, Artificial Sequence
  Synthetic
aggccctggctgctgatatgacagcagtctggcaggtagaaaagggtacagcactacagaaggttcactgtactcctacttggaagggacacggttccatcagacggcagtggacatggcgaccttttgggacagcggtg

SEQ ID NO: 363012 - DNA, 140 bp, Artificial Sequence
  Synthetic
caccgctgtcccaaaaggtcgccatgtccactgccgtctgatggaaccgtgtcccttccaagtaggagtacagtgaaccttctgtagtgctgtacccttttctacctgccagactgctgtcatatcagcagccagggcct

SEQ ID NO: 363013 - DNA, 140 bp, Artificial Sequence
  Synthetic
aggccctggctgctgatatgatttcacaactcatgtcatgaacaatcaactgaatgcagccttcgtaggacaggtcacccgagcaggatgtgcaccgtcgtaccgggtaaaacgcatggagaccttttgggacagcggtg

SEQ ID NO: 363014 - DNA, 140 bp, Artificial Sequence
  Synthetic
caccgctgtcccaaaaggtctccatgcgttttacccggtacgacggtgcacatcctgctcgggtgacctgtcctacgaaggctgcattcagttgattgttcatgacatgagttgtgaaatcatatcagcagccagggcct

SEQ ID NO: 363015 - DNA, 140 bp, Artificial Sequence; identical to SEQ ID NO: 12213
  Synthetic

SEQ ID NO: 363016 - DNA, 140 bp, Artificial Sequence; identical to SEQ ID NO: 12214
  Synthetic

SEQ ID NO: 363017 - DNA, 140 bp, Artificial Sequence; identical to SEQ ID NO: 8367
  Synthetic

SEQ ID NO: 363018 - DNA, 140 bp, Artificial Sequence; identical to SEQ ID NO: 8368
  Synthetic

SEQ ID NO: 363019 - DNA, 140 bp, Artificial Sequence; identical to SEQ ID NO: 6233
  Synthetic

SEQ ID NO: 363020 - DNA, 140 bp, Artificial Sequence; identical to SEQ ID NO: 6234
  Synthetic

SEQ ID NO: 363021 - DNA, 140 bp, Artificial Sequence
  Synthetic
aggccctggctgctgatatggccgatctcattcggagcaccaaacgagactttccccataacgttcggggattttgatgaaggggagattgaaagcttgtcctctgagttactgacctttgaccttttgggacagcggtg

SEQ ID NO: 363022 - DNA, 140 bp, Artificial Sequence
  Synthetic
caccgctgtcccaaaaggtcaaaggtcagtaactcagaggacaagctttcaatctccccttcatcaaaatccccgaacgttatggggaaagtctcgtttggtgctccgaatgagatcggccatatcagcagccagggcct

SEQ ID NO: 363023 - DNA, 140 bp, Artificial Sequence
  Synthetic
aggccctggctgctgatatgctcagcagttaataaactgacaatgcgcgcggtacctcaacagaagccgcgcaagaatcggaagaataagaagcaaaagcaaaagcagcaggcgccacgagaccttttgggacagcggtg

SEQ ID NO: 363024 - DNA, 140 bp, Artificial Sequence
  Synthetic
caccgctgtcccaaaaggtctcgtggcgcctgctgcttttgcttttgcttcttattcttccgattcttgcgcggcttctgttgaggtaccgcgcgcattgtcagtttattaactgctgagcatatcagcagccagggcct

SEQ ID NO: 363025 - DNA, 140 bp, Artificial Sequence
  Synthetic
aggccctggctgctgatatgcgccagacagtactgccggtaaataccttggaggaagttcaggaggagaaatgttacccacctaagttggatgaagtgaaagagcagttgttacttaagagaccttttgggacagcggtg

SEQ ID NO: 363026 - DNA, 140 bp, Artificial Sequence
  Synthetic
caccgctgtcccaaaaggtctcttaagtaacaactgctctttcacttcatccaacttaggtgggtaacatttctcctcctgaacttcctccaaggtatttaccggcagtactgtctggcgcatatcagcagccagggcct

SEQ ID NO: 363027 - DNA, 140 bp, Artificial Sequence
  Synthetic
aggccctggctgctgatatgaacggacatagcctcctttgataagagccaggatgattcacttgcgctcaccgccttaatgctgttagaagatttgggagtggatcactccttgttggacgaccttttgggacagcggtg

SEQ ID NO: 363028 - DNA, 140 bp, Artificial Sequence
  Synthetic
caccgctgtcccaaaaggtcgtccaacaaggagtgatccactcccaaatcttctaacagcattaaggcggtgagcgcaagtgaatcatcctggctcttatcaaaggaggctatgtccgttcatatcagcagccagggcct

SEQ ID NO: 363029 - DNA, 140 bp, Artificial Sequence
  Synthetic
aggccctggctgctgatatgtacccggaaagccgcatgctacttaagagctggcacctaccatcggtgttccatctaaagggcaagcttagcttcacatgccgctgtgacacagtggtttgaccttttgggacagcggtg

SEQ ID NO: 363030 - DNA, 140 bp, Artificial Sequence
  Synthetic
caccgctgtcccaaaaggtcaaaccactgtgtcacagcggcatgtgaagctaagcttgccctttagatggaacaccgatggtaggtgccagctcttaagtagcatgcggctttccgggtacatatcagcagccagggcct

SEQ ID NO: 363031 - DNA, 140 bp, Artificial Sequence
  Synthetic
aggccctggctgctgatatggatcgtctgacaaaatctgcatgcgcggccttcatcggcgacgacaacataatacatggtgtcgtctccgatgaattgatggcagccagatgcgctacttgaccttttgggacagcggtg

SEQ ID NO: 363032 - DNA, 140 bp, Artificial Sequence
  Synthetic
caccgctgtcccaaaaggtcaagtagcgcatctggctgccatcaattcatcggagacgacaccatgtattatgttgtcgtcgccgatgaaggccgcgcatgcagattttgtcagacgatccatatcagcagccagggcct

SEQ ID NO: 363033 - DNA, 140 bp, Artificial Sequence; identical to SEQ ID NO: 8819
  Synthetic

SEQ ID NO: 363034 - DNA, 140 bp, Artificial Sequence; identical to SEQ ID NO: 8820
  Synthetic

SEQ ID NO: 363035 - DNA, 140 bp, Artificial Sequence
  Synthetic
atacgccatgctgggtctccccttacttttgtggagggtttatactgcatgatactgtgacaggaacagcttgcagggtggcggacccgctaaaaaggttatttaaactgggcaaaccgtcgtacttgggagtcggccat

SEQ ID NO: 363036 - DNA, 140 bp, Artificial Sequence
  Synthetic
atggccgactcccaagtacgacggtttgcccagtttaaataacctttttagcgggtccgccaccctgcaagctgttcctgtcacagtatcatgcagtataaaccctccacaaaagtaaggggagacccagcatggcgtat

SEQ ID NO: 363037 - DNA, 140 bp, Artificial Sequence
  Synthetic
aggccctggctgctgatatggaatgcagtccttctacctaatgtacacacgctgtttgacatgtctgccgaggactttgacgccattattgccgcgcacttcaagccgggggacgccgtagaccttttgggacagcggtg

SEQ ID NO: 363038 - DNA, 140 bp, Artificial Sequence
  Synthetic
caccgctgtcccaaaaggtctacggcgtcccccggcttgaagtgcgcggcaataatggcgtcaaagtcctcggcagacatgtcaaacagcgtgtgtacattaggtagaaggactgcattccatatcagcagccagggcct

SEQ ID NO: 363039 - DNA, 140 bp, Artificial Sequence
  Synthetic
aggccctggctgctgatatgtggacttgatagaggctgccttcggggagatctccagctgccacctaccgacgggcacccgttttaagttcggcgccatgatgaagtctggtatgttcctgaccttttgggacagcggtg

SEQ ID NO: 363040 - DNA, 140 bp, Artificial Sequence
  Synthetic
caccgctgtcccaaaaggtcaggaacataccagacttcatcatggcgccgaacttaaaacgggtgcccgtcggtaggtggcagctggagatctccccgaaggcagcctctatcaagtccacatatcagcagccagggcct

SEQ ID NO: 363041 - DNA, 140 bp, Artificial Sequence
  Synthetic
atacgccatgctgggtctcctggccacctttgcaagctccagatccaacttcgagaagctcagaggacccgtcataactttgtacggcggtcctaaataggtacgcactacagctacctacgtacttgggagtcggccat

SEQ ID NO: 363042 - DNA, 140 bp, Artificial Sequence
  Synthetic
atggccgactcccaagtacgtaggtagctgtagtgcgtacctatttaggaccgccgtacaaagttatgacgggtcctctgagcttctcgaagttggatctggagcttgcaaaggtggccaggagacccagcatggcgtat

SEQ ID NO: 363043 - DNA, 140 bp, Artificial Sequence
  Synthetic
atacgccatgctgggtctccttttgcagaagccgacagcaggtacctaaataccaatcagccataatggagtttatcccaacccaaactttctacaataggaggtaccagcctcgaccttcgtacttgggagtcggccat

SEQ ID NO: 363044 - DNA, 140 bp, Artificial Sequence
  Synthetic
atggccgactcccaagtacgaaggtcgaggctggtacctcctattgtagaaagtttgggttgggataaactccattatggctgattggtatttaggtacctgctgtcggcttctgcaaaaggagacccagcatggcgtat

SEQ ID NO: 363045 - DNA, 140 bp, Artificial Sequence; identical to SEQ ID NO: 5195
  Synthetic

SEQ ID NO: 363046 - DNA, 140 bp, Artificial Sequence; identical to SEQ ID NO: 5196
  Synthetic

SEQ ID NO: 363047 - DNA, 140 bp, Artificial Sequence
  Synthetic
atacgccatgctgggtctccggactccgcgccctactatccaagttatcagacccagaccgcgtccgcaaaggaaggccgggcaacttgcccagctgatctcagcagttaataaactgaccgtacttgggagtcggccat

SEQ ID NO: 363048 - DNA, 140 bp, Artificial Sequence
  Synthetic
atggccgactcccaagtacggtcagtttattaactgctgagatcagctgggcaagttgcccggccttcctttgcggacgcggtctgggtctgataacttggatagtagggcgcggagtccggagacccagcatggcgtat

SEQ ID NO: 363049 - DNA, 140 bp, Artificial Sequence
  Synthetic
atacgccatgctgggtctccaatgcgcgtggtacctcaacagaagccgcgcaagaatcggaagaataagaagcaaaagcaaaagcagcaggcgccacgaaacaatatgaatcaaaagaagcgtacttgggagtcggccat

SEQ ID NO: 363050 - DNA, 140 bp, Artificial Sequence
  Synthetic
atggccgactcccaagtacgcttcttttgattcatattgtttcgtggcgcctgctgcttttgcttttgcttcttattcttccgattcttgcgcggcttctgttgaggtaccacgcgcattggagacccagcatggcgtat

SEQ ID NO: 363051 - DNA, 140 bp, Artificial Sequence
  Synthetic
aggccctggctgctgatatgaactccaagaaagtgcgtccatggccaacagaagcaggtaccaatcccgcaaagtagagaacacgaaagcaacaatagtccaaaggctgaagggtggctggaccttttgggacagcggtg

SEQ ID NO: 363052 - DNA, 140 bp, Artificial Sequence
  Synthetic
caccgctgtcccaaaaggtccagccacccttcagcctttggactattgttgctttcgtgttctctactttgcgggattggtacctgcttctgttggccatggacgcactttcttggagttcatatcagcagccagggcct

SEQ ID NO: 363053 - DNA, 140 bp, Artificial Sequence; identical to SEQ ID NO: 12185
  Synthetic

SEQ ID NO: 363054 - DNA, 140 bp, Artificial Sequence; identical to SEQ ID NO: 12186
  Synthetic

SEQ ID NO: 363055 - DNA, 140 bp, Artificial Sequence
  Synthetic
atacgccatgctgggtctccagagagaatgtgcatgaaaatcgaaaatgattgcatcttcgaagtcaagcatgaaggtaaggtaacaggttacgcgtgcttggtaggggacaaagtaatgcgtacttgggagtcggccat

SEQ ID NO: 363056 - DNA, 140 bp, Artificial Sequence
  Synthetic
atggccgactcccaagtacgcattactttgtcccctaccaagcacgcgtaacctgttaccttaccttcatgcttgacttcgaagatgcaatcattttcgattttcatgcacattctctctggagacccagcatggcgtat

SEQ ID NO: 363057 - DNA, 140 bp, Artificial Sequence
  Synthetic
atacgccatgctgggtctccaagccagcacacgtaaaggggaccatcgataacgcggacctggccaaattggccttcaagcgatcatctaagtacgaccttgaatgcgcgcagatacccgcgtacttgggagtcggccat

SEQ ID NO: 363058 - DNA, 140 bp, Artificial Sequence
  Synthetic
atggccgactcccaagtacgcgggtatctgcgcgcattcaaggtcgtacttagatgatcgcttgaaggccaatttggccaggtccgcgttatcgatggtcccctttacgtgtgctggcttggagacccagcatggcgtat

SEQ ID NO: 363059 - DNA, 140 bp, Artificial Sequence
  Synthetic
aggccctggctgctgatatgaagctaaaaccgtgcgaccgtgtgctgttctcagtagggtcaacgctctacccggaaagccgcaagctacttaagagctggcacttaccatcggtgttccgaccttttgggacagcggtg

SEQ ID NO: 363060 - DNA, 140 bp, Artificial Sequence
  Synthetic
caccgctgtcccaaaaggtcggaacaccgatggtaagtgccagctcttaagtagcttgcggctttccgggtagagcgttgaccctactgagaacagcacacggtcgcacggttttagcttcatatcagcagccagggcct

SEQ ID NO: 363061 - DNA, 140 bp, Artificial Sequence
  Synthetic
aggccctggctgctgatatgtgcacatgaagtccgacgcttcgaagttcacccatgagaaaccggaggggtactacaactggcaccacggagcagtacagtactcaggaggccgattcacgaccttttgggacagcggtg

SEQ ID NO: 363062 - DNA, 140 bp, Artificial Sequence
  Synthetic
caccgctgtcccaaaaggtcgtgaatcggcctcctgagtactgtactgctccgtggtgccagttgtagtacccctccggtttctcatgggtgaacttcgaagcgtcggacttcatgtgcacatatcagcagccagggcct

SEQ ID NO: 363063 - DNA, 140 bp, Artificial Sequence
  Synthetic
atacgccatgctgggtctccccatctaaagggcaaactcagcttcacatgccgctgtgatacagtggtttcgtgcgagggctacgtcgttaagagaataacgatgagcccaggcctttatcgtacttgggagtcggccat

SEQ ID NO: 363064 - DNA, 140 bp, Artificial Sequence
  Synthetic
atggccgactcccaagtacgataaaggcctgggctcatcgttattctcttaacgacgtagccctcgcacgaaaccactgtatcacagcggcatgtgaagctgagtttgccctttagatggggagacccagcatggcgtat

SEQ ID NO: 363065 - DNA, 140 bp, Artificial Sequence
  Synthetic
atacgccatgctgggtctcccatccctacaggtgcgggcaaaccaggggatagtggtagaccgatcttcgacaacaaggggcgcgtggtggccatagttttaggaggagctaatgaaggacgtacttgggagtcggccat

SEQ ID NO: 363066 - DNA, 140 bp, Artificial Sequence
  Synthetic
atggccgactcccaagtacgtccttcattagctcctcctaaaactatggccaccacgcgccccttgttgtcgaagatcggtctaccactatcccctggtttgcccgcacctgtagggatgggagacccagcatggcgtat

SEQ ID NO: 363067 - DNA, 140 bp, Artificial Sequence
  Synthetic
atacgccatgctgggtctccgcccgtacagccctctcggtggtgacctggaacaaagacatcgtcacgaaaatcacccctgagggggccgaagagtggagtctggccattccagttatgtcgtacttgggagtcggccat

SEQ ID NO: 363068 - DNA, 140 bp, Artificial Sequence
  Synthetic
atggccgactcccaagtacgacataactggaatggccagactccactcttcggccccctcaggggtgattttcgtgacgatgtctttgttccaggtcaccaccgagagggctgtacgggcggagacccagcatggcgtat

SEQ ID NO: 363069 - DNA, 140 bp, Artificial Sequence
  Synthetic
aggccctggctgctgatatgtgtcatgagccccgggtactatcagctgctacaagcatccttaacatgttctccccgacgccagcggcgcagtattaaggaccacttcaatgtctataaagaccttttgggacagcggtg

SEQ ID NO: 363070 - DNA, 140 bp, Artificial Sequence
  Synthetic
caccgctgtcccaaaaggtctttatagacattgaagtggtccttaatactgcgccgctggcgtcggggagaacatgttaaggatgcttgtagcagctgatagtacccggggctcatgacacatatcagcagccagggcct

SEQ ID NO: 363071 - DNA, 140 bp, Artificial Sequence
  Synthetic
aggccctggctgctgatatggtgccatagtcccgtagcgctagaacgcatcagaaatgaagcgacagacgggacgttgaaaatccaggtttccttgcaaatcggaataaagacggatgatgaccttttgggacagcggtg

SEQ ID NO: 363072 - DNA, 140 bp, Artificial Sequence
  Synthetic
caccgctgtcccaaaaggtcatcatccgtctttattccgatttgcaaggaaacctggattttcaacgtcccgtctgtcgcttcatttctgatgcgttctagcgctacgggactatggcaccatatcagcagccagggcct

SEQ ID NO: 363073 - DNA, 140 bp, Artificial Sequence
  Synthetic
aggccctggctgctgatatgaggcatagcataccgaactcttccacgattctccgaacccacagggacgtaggagatgttattttgtttttaatatttcaaaaaaaaaaaaaaaaaaaaagaccttttgggacagcggtg

SEQ ID NO: 363074 - DNA, 140 bp, Artificial Sequence
  Synthetic
caccgctgtcccaaaaggtctttttttttttttttttttttgaaatattaaaaacaaaataacatctcctacgtccctgtgggttcggagaatcgtggaagagttcggtatgctatgcctcatatcagcagccagggcct

SEQ ID NO: 363075 - DNA, 140 bp, Artificial Sequence
  Synthetic
aggccctggctgctgatatgagagcgggtgcaggaataatagagactccgagaggagctatcaaagttactgcccaaccaacagaccacgtcgtgggagagtacctggtactttccccgcgaccttttgggacagcggtg

SEQ ID NO: 363076 - DNA, 140 bp, Artificial Sequence
  Synthetic
caccgctgtcccaaaaggtcgcggggaaagtaccaggtactctcccacgacgtggtctgttggttgggcagtaactttgatagctcctctcggagtctctattattcctgcacccgctctcatatcagcagccagggcct

SEQ ID NO: 363077 - DNA, 140 bp, Artificial Sequence; identical to SEQ ID NO: 12079
  Synthetic

SEQ ID NO: 363078 - DNA, 140 bp, Artificial Sequence; identical to SEQ ID NO: 12080
  Synthetic

SEQ ID NO: 363079 - DNA, 140 bp, Artificial Sequence
  Synthetic
aggccctggctgctgatatgctgacggtggggttcactgacggtagaaagatcagtcactcatgtacgcacccatttcaccacgaccctcctgtgataggccgggaaaaattccattcccgaccttttgggacagcggtg

SEQ ID NO: 363080 - DNA, 140 bp, Artificial Sequence
  Synthetic
caccgctgtcccaaaaggtcgggaatggaatttttcccggcctatcacaggagggtcgtggtgaaatgggtgcgtacatgagtgactgatctttctaccgtcagtgaaccccaccgtcagcatatcagcagccagggcct

SEQ ID NO: 363081 - DNA, 140 bp, Artificial Sequence
  Synthetic
atacgccatgctgggtctccgccgattgtagtggacactacaggctcaacaaaacctgaccctggagacctcgtgttaacgtgcttcagagggtgggttaaacaactgcaaattgactatcgtacttgggagtcggccat

SEQ ID NO: 363082 - DNA, 140 bp, Artificial Sequence
  Synthetic
atggccgactcccaagtacgatagtcaatttgcagttgtttaacccaccctctgaagcacgttaacacgaggtctccagggtcaggttttgttgagcctgtagtgtccactacaatcggcggagacccagcatggcgtat

SEQ ID NO: 363083 - DNA, 140 bp, Artificial Sequence; identical to SEQ ID NO: 7959
  Synthetic

SEQ ID NO: 363084 - DNA, 140 bp, Artificial Sequence; identical to SEQ ID NO: 7960
  Synthetic

SEQ ID NO: 363085 - DNA, 140 bp, Artificial Sequence
  Synthetic
aggccctggctgctgatatgagccgacgtagaagtagaggggaactcccagctgcaaatatccttctcaacagccctggcaagcgccgagtttcgcgtgcaagtgtgctccacacaagtagaccttttgggacagcggtg

SEQ ID NO: 363086 - DNA, 140 bp, Artificial Sequence
  Synthetic
caccgctgtcccaaaaggtctacttgtgtggagcacacttgcacgcgaaactcggcgcttgccagggctgttgagaaggatatttgcagctgggagttcccctctacttctacgtcggctcatatcagcagccagggcct

SEQ ID NO: 363087 - DNA, 140 bp, Artificial Sequence; identical to SEQ ID NO: 7971
  Synthetic

SEQ ID NO: 363088 - DNA, 140 bp, Artificial Sequence; identical to SEQ ID NO: 7972
  Synthetic

SEQ ID NO: 363089 - DNA, 140 bp, Artificial Sequence
  Synthetic
aggccctggctgctgatatgcttgggtgcagaagattacgggaggagtaggattaattgttgctgttgctgccttaatcttaattgtggtgctatgcgtgtcgtttagcaggcactaaacgaccttttgggacagcggtg

SEQ ID NO: 363090 - DNA, 140 bp, Artificial Sequence
  Synthetic
caccgctgtcccaaaaggtcgtttagtgcctgctaaacgacacgcatagcaccacaattaagattaaggcagcaacagcaacaattaatcctactcctcccgtaatcttctgcacccaagcatatcagcagccagggcct

SEQ ID NO: 363091 - DNA, 140 bp, Artificial Sequence
  Synthetic
atacgccatgctgggtctccccgcatcccaagggttaaccagaaaaggagtttacgcagttaggcaaaaagttaatgaaaacccgctctatgcatcaacgtcagagcacgtcaacgtactcgtacttgggagtcggccat

SEQ ID NO: 363092 - DNA, 140 bp, Artificial Sequence
  Synthetic
atggccgactcccaagtacgagtacgttgacgtgctctgacgttgatgcatagagcgggttttcattaactttttgcctaactgcgtaaactccttttctggttaacccttgggatgcggggagacccagcatggcgtat

SEQ ID NO: 363093 - DNA, 140 bp, Artificial Sequence
  Synthetic
aggccctggctgctgatatgcaaacggtacagcccacggccacccgcatgagataattctgtattattatgagctgtacccaactatgactgtggtagttgtgtcagtggcctcgttcatgaccttttgggacagcggtg

SEQ ID NO: 363094 - DNA, 140 bp, Artificial Sequence
  Synthetic
caccgctgtcccaaaaggtcatgaacgaggccactgacacaactaccacagtcatagttgggtacagctcataataatacagaattatctcatgcgggtggccgtgggctgtaccgtttgcatatcagcagccagggcct

SEQ ID NO: 363095 - DNA, 140 bp, Artificial Sequence; identical to SEQ ID NO: 8485
  Synthetic

SEQ ID NO: 363096 - DNA, 140 bp, Artificial Sequence; identical to SEQ ID NO: 8486
  Synthetic

SEQ ID NO: 363097 - DNA, 140 bp, Artificial Sequence
  Synthetic
atacgccatgctgggtctcccataccgaactcttccacgattctccgaacccacagggacgtaggagatgttattttgtttttaatatttcaaaaaaaaaaaaaaaaaaaaaaaaaaaaacgtacttgggagtcggccat
